United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 48

SEQ ID NO: 1715861 - RNA, 16 nt, Salmonella enterica enterica serovar Typhi
cccggagagagcaacu

SEQ ID NO: 1715862 - RNA, 19 nt, Salmonella enterica enterica serovar Typhi
cccggagcggugaaacugu

SEQ ID NO: 1715863 - RNA, 19 nt, Salmonella enterica enterica serovar Typhi
cccggaucggucuggcgca

SEQ ID NO: 1715864 - RNA, 20 nt, Salmonella enterica enterica serovar Typhi
cccggaucgcuaauuuuuaa

SEQ ID NO: 1715865 - RNA, 21 nt, Salmonella enterica enterica serovar Typhi
cccggagagagcaacuggcaa

SEQ ID NO: 1715866 - RNA, 12 nt, Salmonella enterica enterica serovar Typhi
cccggccacagc

SEQ ID NO: 1715867 - RNA, 15 nt, Salmonella enterica enterica serovar Typhi
cccggcauacgccgg

SEQ ID NO: 1715868 - RNA, 14 nt, Salmonella enterica enterica serovar Typhi
cccggcaacugcgc

SEQ ID NO: 1715869 - RNA, 15 nt, Salmonella enterica enterica serovar Typhi
cccggcaacugcgcc

SEQ ID NO: 1715870 - RNA, 18 nt, Salmonella enterica enterica serovar Typhi
cccggcaucaagcugcug

SEQ ID NO: 1715871 - RNA, 13 nt, Salmonella enterica enterica serovar Typhi
cccggcaggcugg

SEQ ID NO: 1715872 - RNA, 17 nt, Salmonella enterica enterica serovar Typhi
cccgcauuuaacaggac

SEQ ID NO: 1715873 - RNA, 16 nt, Salmonella enterica enterica serovar Typhi
cccgcauuuuaaacga

SEQ ID NO: 1715874 - RNA, 18 nt, Salmonella enterica enterica serovar Typhi
cccgcauucgcggcaagc

SEQ ID NO: 1715875 - RNA, 17 nt, Salmonella enterica enterica serovar Typhi
cccgcaggccuggcugg

SEQ ID NO: 1715876 - RNA, 17 nt, Salmonella enterica enterica serovar Typhi
cccgcaucgccgcggcg

SEQ ID NO: 1715877 - RNA, 12 nt, Salmonella enterica enterica serovar Typhi
cccgccagcaca

SEQ ID NO: 1715878 - RNA, 15 nt, Salmonella enterica enterica serovar Typhi
cccgccagcacagca

SEQ ID NO: 1715879 - RNA, 12 nt, Salmonella enterica enterica serovar Typhi
cccgcccugccc

SEQ ID NO: 1715880 - RNA, 15 nt, Salmonella enterica enterica serovar Typhi
cccgcccugcccgcc

SEQ ID NO: 1715881 - RNA, 22 nt, Salmonella enterica enterica serovar Typhi
cccgccgaaggcaacgccgcca

SEQ ID NO: 1715882 - RNA, 18 nt, Salmonella enterica enterica serovar Typhi
cccgccgaaggcaacgcc

SEQ ID NO: 1715883 - RNA, 21 nt, Salmonella enterica enterica serovar Typhi
cccgccuugcggcgccaggac

SEQ ID NO: 1715884 - RNA, 15 nt, Salmonella enterica enterica serovar Typhi
cccgccuugcggcgc

SEQ ID NO: 1715885 - RNA, 14 nt, Salmonella enterica enterica serovar Typhi
cccgccugcugcaa

SEQ ID NO: 1715886 - RNA, 18 nt, Salmonella enterica enterica serovar Typhi
cccgcgauaaaaauccug

SEQ ID NO: 1715887 - RNA, 17 nt, Salmonella enterica enterica serovar Typhi
cccgcgcagaaucacuu

SEQ ID NO: 1715888 - RNA, 13 nt, Salmonella enterica enterica serovar Typhi
cccgcgcauccca

SEQ ID NO: 1715889 - RNA, 13 nt, Salmonella enterica enterica serovar Typhi
cccgcgcaggcgg

SEQ ID NO: 1715890 - RNA, 19 nt, Salmonella enterica enterica serovar Typhi
cccgccgcacacgccgugc

SEQ ID NO: 1715891 - RNA, 23 nt, Salmonella enterica enterica serovar Typhi
cccgccgcggcgguuauccuccg

SEQ ID NO: 1715892 - RNA, 20 nt, Salmonella enterica enterica serovar Typhi
cccgccgggcgucacccgcc

SEQ ID NO: 1715893 - RNA, 23 nt, Salmonella enterica enterica serovar Typhi
cccgccgggcgucacccgccggc

SEQ ID NO: 1715894 - RNA, 19 nt, Salmonella enterica enterica serovar Typhi
cccgccgggcgucacccgc

SEQ ID NO: 1715895 - RNA, 15 nt, Salmonella enterica enterica serovar Typhi
cgguuggcuccagua

SEQ ID NO: 1715896 - RNA, 19 nt, Salmonella enterica enterica serovar Typhi
cgguuaugcauugcugauc

SEQ ID NO: 1715897 - RNA, 13 nt, Salmonella enterica enterica serovar Typhi
cgguuaugccugc

SEQ ID NO: 1715898 - RNA, 18 nt, Salmonella enterica enterica serovar Typhi
cgguugccuuucgccagc

SEQ ID NO: 1715899 - RNA, 20 nt, Salmonella enterica enterica serovar Typhi
cgguuuccggcauccagcgc

SEQ ID NO: 1715900 - RNA, 20 nt, Salmonella enterica enterica serovar Typhi
cgguuucuaccacccagcca

SEQ ID NO: 1715901 - RNA, 17 nt, Salmonella enterica enterica serovar Typhi
cgguuucuccagccucg

SEQ ID NO: 1715902 - RNA, 20 nt, Salmonella enterica enterica serovar Typhi
cgguuucaacuuccaccacc

SEQ ID NO: 1715903 - RNA, 11 nt, Salmonella enterica enterica serovar Typhi
cgguuuauccc

SEQ ID NO: 1715904 - RNA, 21 nt, Salmonella enterica enterica serovar Typhi
cgguuuuauccccuucaggaa

SEQ ID NO: 1715905 - RNA, 22 nt, Salmonella enterica enterica serovar Typhi
cgguuuuauccccuucaggaau

SEQ ID NO: 1715906 - RNA, 17 nt, Salmonella enterica enterica serovar Typhi
cgguuuugcgccauccu

SEQ ID NO: 1715907 - RNA, 17 nt, Salmonella enterica enterica serovar Typhi
cguaaccgcaaaugcca

SEQ ID NO: 1715908 - RNA, 13 nt, Salmonella enterica enterica serovar Typhi
cguaaccgcagcg

SEQ ID NO: 1715909 - RNA, 16 nt, Salmonella enterica enterica serovar Typhi
cguaaccgcagcgccu

SEQ ID NO: 1715910 - RNA, 12 nt, Salmonella enterica enterica serovar Typhi
cguaacccagug

SEQ ID NO: 1715911 - RNA, 20 nt, Salmonella enterica enterica serovar Typhi
cguaaaccccuucaccgcuu

SEQ ID NO: 1715912 - RNA, 21 nt, Salmonella enterica enterica serovar Typhi
cguaaaccccuucaccgcuuu

SEQ ID NO: 1715913 - RNA, 15 nt, Salmonella enterica enterica serovar Typhi
cguaaaccauuucuc

SEQ ID NO: 1715914 - RNA, 19 nt, Salmonella enterica enterica serovar Typhi
cguaaaccccuucaccgcu

SEQ ID NO: 1715915 - RNA, 14 nt, Salmonella enterica enterica serovar Typhi
cguaaagcauggcu

SEQ ID NO: 1715916 - RNA, 16 nt, Salmonella enterica enterica serovar Typhi
cggugugauuaaucca

SEQ ID NO: 1715917 - RNA, 19 nt, Salmonella enterica enterica serovar Typhi
cgguuaaaaacagccagca

SEQ ID NO: 1715918 - RNA, 18 nt, Salmonella enterica enterica serovar Typhi
cgguggguagcggcaauu

SEQ ID NO: 1715919 - RNA, 14 nt, Salmonella enterica enterica serovar Typhi
cggugucagacacc

SEQ ID NO: 1715920 - RNA, 14 nt, Salmonella enterica enterica serovar Typhi
cgguguccggcgca

SEQ ID NO: 1715921 - RNA, 18 nt, Salmonella enterica enterica serovar Typhi
cggugccaaauguauacu

SEQ ID NO: 1715922 - RNA, 17 nt, Salmonella enterica enterica serovar Typhi
cggugcagaccucugca

SEQ ID NO: 1715923 - RNA, 22 nt, Salmonella enterica enterica serovar Typhi
cgggucggacgagcgcgucagc

SEQ ID NO: 1715924 - RNA, 20 nt, Salmonella enterica enterica serovar Typhi
cggucaacugaauuucaucc

SEQ ID NO: 1715925 - RNA, 15 nt, Salmonella enterica enterica serovar Typhi
cggucauccagcggu

SEQ ID NO: 1715926 - RNA, 22 nt, Salmonella enterica enterica serovar Typhi
cggucaguguuuccauacauuu

SEQ ID NO: 1715927 - RNA, 14 nt, Salmonella enterica enterica serovar Typhi
cggucaguuugccc

SEQ ID NO: 1715928 - RNA, 18 nt, Salmonella enterica enterica serovar Typhi
cggucauacugaacaagc

SEQ ID NO: 1715929 - RNA, 23 nt, Salmonella enterica enterica serovar Typhi
cggucagggcuuacucccuggug

SEQ ID NO: 1715930 - RNA, 14 nt, Salmonella enterica enterica serovar Typhi
cggucagguagcag

SEQ ID NO: 1715931 - RNA, 15 nt, Salmonella enterica enterica serovar Typhi
cggucagguagcaga

SEQ ID NO: 1715932 - RNA, 17 nt, Salmonella enterica enterica serovar Typhi
cggucauguuccaacaa

SEQ ID NO: 1715933 - RNA, 17 nt, Salmonella enterica enterica serovar Typhi
cggucauuaauccccgg

SEQ ID NO: 1715934 - RNA, 18 nt, Salmonella enterica enterica serovar Typhi
cggucauuaauccccggc

SEQ ID NO: 1715935 - RNA, 15 nt, Salmonella enterica enterica serovar Typhi
cggucccuggcuggu

SEQ ID NO: 1715936 - RNA, 13 nt, Salmonella enterica enterica serovar Typhi
cggucgcgcgcag

SEQ ID NO: 1715937 - RNA, 21 nt, Salmonella enterica enterica serovar Typhi
cggucgggauauaugcaaaac

SEQ ID NO: 1715938 - RNA, 17 nt, Salmonella enterica enterica serovar Typhi
cggucgagcguaauucc

SEQ ID NO: 1715939 - RNA, 14 nt, Salmonella enterica enterica serovar Typhi
cggugaccugccuu

SEQ ID NO: 1715940 - RNA, 17 nt, Salmonella enterica enterica serovar Typhi
cggugacggaaaccagc

SEQ ID NO: 1715941 - RNA, 23 nt, Salmonella enterica enterica serovar Typhi
cggugaugaucaauaacgccggu

SEQ ID NO: 1715942 - RNA, 21 nt, Salmonella enterica enterica serovar Typhi
cguagcuggucgccagcgccg

SEQ ID NO: 1715943 - RNA, 18 nt, Salmonella enterica enterica serovar Typhi
cguagcgagucaaaccuc

SEQ ID NO: 1715944 - RNA, 20 nt, Salmonella enterica enterica serovar Typhi
cguagcgcgcggauauggcg

SEQ ID NO: 1715945 - RNA, 22 nt, Salmonella enterica enterica serovar Typhi
cguagccgcuuacucagccaga

SEQ ID NO: 1715946 - RNA, 21 nt, Salmonella enterica enterica serovar Typhi
cguagccgcuuacucagccag

SEQ ID NO: 1715947 - RNA, 24 nt, Salmonella enterica enterica serovar Typhi
cguaggguagaucacgccagcgcu

SEQ ID NO: 1715948 - RNA, 13 nt, Salmonella enterica enterica serovar Typhi
cguaggcggcgga

SEQ ID NO: 1715949 - RNA, 17 nt, Salmonella enterica enterica serovar Typhi
cguagccgccgagcgcc

SEQ ID NO: 1715950 - RNA, 12 nt, Salmonella enterica enterica serovar Typhi
cguagccgcgcg

SEQ ID NO: 1715951 - RNA, 13 nt, Salmonella enterica enterica serovar Typhi
cguagccagagcg

SEQ ID NO: 1715952 - RNA, 24 nt, Salmonella enterica enterica serovar Typhi
cguagcaucucuucgacaucuuca

SEQ ID NO: 1715953 - RNA, 18 nt, Salmonella enterica enterica serovar Typhi
cguagauuuucaucauau

SEQ ID NO: 1715954 - RNA, 16 nt, Salmonella enterica enterica serovar Typhi
cguagaccgcccagga

SEQ ID NO: 1715955 - RNA, 14 nt, Salmonella enterica enterica serovar Typhi
cguaacguaaccug

SEQ ID NO: 1715956 - RNA, 18 nt, Salmonella enterica enterica serovar Typhi
cguaguucccccaucugu

SEQ ID NO: 1715957 - RNA, 17 nt, Salmonella enterica enterica serovar Typhi
cguagugcuucucuuca

SEQ ID NO: 1715958 - RNA, 22 nt, Salmonella enterica enterica serovar Typhi
cguaguagucaggaucgcuggc

SEQ ID NO: 1715959 - RNA, 14 nt, Salmonella enterica enterica serovar Typhi
cguauaauuaagcu

SEQ ID NO: 1715960 - RNA, 18 nt, Salmonella enterica enterica serovar Typhi
cguauaucgcgauaaacu

SEQ ID NO: 1715961 - RNA, 19 nt, Salmonella enterica enterica serovar Typhi
cguauccccagucuuccug

SEQ ID NO: 1715962 - RNA, 13 nt, Salmonella enterica enterica serovar Typhi
cguauccagcgcg

SEQ ID NO: 1715963 - RNA, 18 nt, Salmonella enterica enterica serovar Typhi
cguaugcagccaggccau

SEQ ID NO: 1715964 - RNA, 12 nt, Salmonella enterica enterica serovar Typhi
cguauuacaagu

SEQ ID NO: 1715965 - RNA, 20 nt, Salmonella enterica enterica serovar Typhi
cguauuaucaaaucuucauu

SEQ ID NO: 1715966 - RNA, 15 nt, Salmonella enterica enterica serovar Typhi
cguauuauccacccc

SEQ ID NO: 1715967 - RNA, 15 nt, Salmonella enterica enterica serovar Typhi
cguaucgcucugcuu

SEQ ID NO: 1715968 - RNA, 21 nt, Salmonella enterica enterica serovar Typhi
cguaugauuuucuuauuacaa

SEQ ID NO: 1715969 - RNA, 14 nt, Salmonella enterica enterica serovar Typhi
cguaugaaugaaac

SEQ ID NO: 1715970 - RNA, 10 nt, Salmonella enterica enterica serovar Typhi
cguaucuucc

SEQ ID NO: 1715971 - RNA, 19 nt, Salmonella enterica enterica serovar Typhi
cguauucucaaccagccga

SEQ ID NO: 1715972 - RNA, 19 nt, Salmonella enterica enterica serovar Typhi
cguauuccacggaauacga

SEQ ID NO: 1715973 - RNA, 12 nt, Salmonella enterica enterica serovar Typhi
cguauucccccu

SEQ ID NO: 1715974 - RNA, 12 nt, Salmonella enterica enterica serovar Typhi
cguauugccauc

SEQ ID NO: 1715975 - RNA, 14 nt, Salmonella enterica enterica serovar Typhi
cguauugagcugga

SEQ ID NO: 1715976 - RNA, 15 nt, Salmonella enterica enterica serovar Typhi
cgucaaacaguucag

SEQ ID NO: 1715977 - RNA, 17 nt, Salmonella enterica enterica serovar Typhi
cgucaaacaguucagac

SEQ ID NO: 1715978 - RNA, 12 nt, Salmonella enterica enterica serovar Typhi
cgucaaaacagg

SEQ ID NO: 1715979 - RNA, 17 nt, Salmonella enterica enterica serovar Typhi
cguauuuuauuuuucaa

SEQ ID NO: 1715980 - RNA, 15 nt, Salmonella enterica enterica serovar Typhi
cgucagcgccuccgc

SEQ ID NO: 1715981 - RNA, 22 nt, Salmonella enterica enterica serovar Typhi
cgucaggcuguuguucuuuucu

SEQ ID NO: 1715982 - RNA, 20 nt, Salmonella enterica enterica serovar Typhi
cgucaggcgaaguuccgggc

SEQ ID NO: 1715983 - RNA, 22 nt, Salmonella enterica enterica serovar Typhi
cgucaggcgaaguuccgggcuc

SEQ ID NO: 1715984 - RNA, 18 nt, Salmonella enterica enterica serovar Typhi
cgucaggccgccgcacag

SEQ ID NO: 1715985 - RNA, 20 nt, Salmonella enterica enterica serovar Typhi
cgucaggccgccgcaaaagc

SEQ ID NO: 1715986 - RNA, 13 nt, Salmonella enterica enterica serovar Typhi
cgucagcauggua

SEQ ID NO: 1715987 - RNA, 15 nt, Salmonella enterica enterica serovar Typhi
cgucagccagaacga

SEQ ID NO: 1715988 - RNA, 11 nt, Salmonella enterica enterica serovar Typhi
cgucagccaga

SEQ ID NO: 1715989 - RNA, 21 nt, Salmonella enterica enterica serovar Typhi
cgucagccccguacaaggucg

SEQ ID NO: 1715990 - RNA, 11 nt, Salmonella enterica enterica serovar Typhi
cgucagauucu

SEQ ID NO: 1715991 - RNA, 17 nt, Salmonella enterica enterica serovar Typhi
cgucagcacgccgcccg

SEQ ID NO: 1715992 - RNA, 15 nt, Salmonella enterica enterica serovar Typhi
cgucagcaacaccac

SEQ ID NO: 1715993 - RNA, 18 nt, Salmonella enterica enterica serovar Typhi
cgucagaccggcaaucaa

SEQ ID NO: 1715994 - RNA, 17 nt, Salmonella enterica enterica serovar Typhi
cgucagacggcuccagc

SEQ ID NO: 1715995 - RNA, 19 nt, Salmonella enterica enterica serovar Typhi
cgucagacaggccugguua

SEQ ID NO: 1715996 - RNA, 16 nt, Salmonella enterica enterica serovar Typhi
cgucauagccgcgcgu

SEQ ID NO: 1715997 - RNA, 22 nt, Salmonella enterica enterica serovar Typhi
cgucauacccgcgcucuccggc

SEQ ID NO: 1715998 - RNA, 23 nt, Salmonella enterica enterica serovar Typhi
cgucaucaggccauuaacgccgc

SEQ ID NO: 1715999 - RNA, 18 nt, Salmonella enterica enterica serovar Typhi
cgucauauagccgcgcag

SEQ ID NO: 1716000 - RNA, 20 nt, Salmonella enterica enterica serovar Typhi
cgucaguaaacuuucagacc

SEQ ID NO: 1716001 - RNA, 21 nt, Salmonella enterica enterica serovar Typhi
cgucagugagcccuccuccag

SEQ ID NO: 1716002 - RNA, 13 nt, Salmonella enterica enterica serovar Typhi
cgucagucgcucu

SEQ ID NO: 1716003 - RNA, 22 nt, Salmonella enterica enterica serovar Typhi
cgucaguaccagcgagauaacc

SEQ ID NO: 1716004 - RNA, 12 nt, Salmonella enterica enterica serovar Typhi
cgucaucaugcu

SEQ ID NO: 1716005 - RNA, 18 nt, Salmonella enterica enterica serovar Typhi
cgucauccggcaaucaga

SEQ ID NO: 1716006 - RNA, 12 nt, Salmonella enterica enterica serovar Typhi
cgucaucauugc

SEQ ID NO: 1716007 - RNA, 13 nt, Salmonella enterica enterica serovar Typhi
cgucauccugcaa

SEQ ID NO: 1716008 - RNA, 15 nt, Salmonella enterica enterica serovar Typhi
cgucaucgcuucuau

SEQ ID NO: 1716009 - RNA, 20 nt, Salmonella enterica enterica serovar Typhi
cgucaucgcuccagacggcg

SEQ ID NO: 1716010 - RNA, 21 nt, Salmonella enterica enterica serovar Typhi
cgucaucgcuccagacggcgc

SEQ ID NO: 1716011 - RNA, 21 nt, Salmonella enterica enterica serovar Typhi
cgucaucgcucaucucaagcc

SEQ ID NO: 1716012 - RNA, 23 nt, Salmonella enterica enterica serovar Typhi
cgucaugauguuugucuuuucca

SEQ ID NO: 1716013 - RNA, 19 nt, Salmonella enterica enterica serovar Typhi
cgucaauaaagccgcccau

SEQ ID NO: 1716014 - RNA, 13 nt, Salmonella enterica enterica serovar Typhi
cgucaauaacagg

SEQ ID NO: 1716015 - RNA, 15 nt, Salmonella enterica enterica serovar Typhi
cgucaaugugaaucc

SEQ ID NO: 1716016 - RNA, 15 nt, Salmonella enterica enterica serovar Typhi
cgucaaugcugcuuu

SEQ ID NO: 1716017 - RNA, 22 nt, Salmonella enterica enterica serovar Typhi
cgucaaugugaauccaggccag

SEQ ID NO: 1716018 - RNA, 23 nt, Salmonella enterica enterica serovar Typhi
cgucacaaaaacacccgcagccg

SEQ ID NO: 1716019 - RNA, 20 nt, Salmonella enterica enterica serovar Typhi
cgucaccaccgcaggcagcg

SEQ ID NO: 1716020 - RNA, 21 nt, Salmonella enterica enterica serovar Typhi
cgucacaauaucgagaugacc

SEQ ID NO: 1716021 - RNA, 19 nt, Salmonella enterica enterica serovar Typhi
cgucacaagcucacaacga

SEQ ID NO: 1716022 - RNA, 19 nt, Salmonella enterica enterica serovar Typhi
cgucaaguagccaguuuuc

SEQ ID NO: 1716023 - RNA, 16 nt, Salmonella enterica enterica serovar Typhi
cgucaacguuuuucag

SEQ ID NO: 1716024 - RNA, 23 nt, Salmonella enterica enterica serovar Typhi
cgucaaauagagaaaauaacaau

SEQ ID NO: 1716025 - RNA, 13 nt, Salmonella enterica enterica serovar Typhi
cgucaaagaaaac

SEQ ID NO: 1716026 - RNA, 18 nt, Salmonella enterica enterica serovar Typhi
cgucaaacucuuccgggc

SEQ ID NO: 1716027 - RNA, 18 nt, Salmonella enterica enterica serovar Typhi
cgucacugaaccugccuu

SEQ ID NO: 1716028 - RNA, 12 nt, Salmonella enterica enterica serovar Typhi
cgucacgaccgg

SEQ ID NO: 1716029 - RNA, 17 nt, Salmonella enterica enterica serovar Typhi
cgucacgcaacaggccg

SEQ ID NO: 1716030 - RNA, 15 nt, Salmonella enterica enterica serovar Typhi
cgucaccgccgcgcu

SEQ ID NO: 1716031 - RNA, 13 nt, Salmonella enterica enterica serovar Typhi
cgucaccgcgcac

SEQ ID NO: 1716032 - RNA, 18 nt, Salmonella enterica enterica serovar Typhi
cgucaccgggcugcagcc

SEQ ID NO: 1716033 - RNA, 20 nt, Salmonella enterica enterica serovar Typhi
cgucacccuauuuugcgccu

SEQ ID NO: 1716034 - RNA, 11 nt, Salmonella enterica enterica serovar Typhi
cgucacccggc

SEQ ID NO: 1716035 - RNA, 19 nt, Salmonella enterica enterica serovar Typhi
cgucacccgccggcagcag

SEQ ID NO: 1716036 - RNA, 21 nt, Salmonella enterica enterica serovar Typhi
cgucacccgccggcagcagcu

SEQ ID NO: 1716037 - RNA, 14 nt, Salmonella enterica enterica serovar Typhi
cggcgcucgccagc

SEQ ID NO: 1716038 - RNA, 14 nt, Salmonella enterica enterica serovar Typhi
cggcgcuaaccagc

SEQ ID NO: 1716039 - RNA, 23 nt, Salmonella enterica enterica serovar Typhi
cggccuugaaguuauccagcgcc

SEQ ID NO: 1716040 - RNA, 16 nt, Salmonella enterica enterica serovar Typhi
cggccuugccgccagc

SEQ ID NO: 1716041 - RNA, 17 nt, Salmonella enterica enterica serovar Typhi
cggcgcgcucuuuuucu

SEQ ID NO: 1716042 - RNA, 15 nt, Salmonella enterica enterica serovar Typhi
cggccugucgcgacc

SEQ ID NO: 1716043 - RNA, 15 nt, Salmonella enterica enterica serovar Typhi
cggccuguuuuucug

SEQ ID NO: 1716044 - RNA, 16 nt, Salmonella enterica enterica serovar Typhi
cggccuuauuuuucag

SEQ ID NO: 1716045 - RNA, 21 nt, Salmonella enterica enterica serovar Typhi
cggcggaagcgaauggcggca

SEQ ID NO: 1716046 - RNA, 16 nt, Salmonella enterica enterica serovar Typhi
cggcggaaugcugguu

SEQ ID NO: 1716047 - RNA, 13 nt, Salmonella enterica enterica serovar Typhi
cggcguaauguug

SEQ ID NO: 1716048 - RNA, 19 nt, Salmonella enterica enterica serovar Typhi
cggcguaagaucgcggggc

SEQ ID NO: 1716049 - RNA, 13 nt, Salmonella enterica enterica serovar Typhi
cggcggucgccgc

SEQ ID NO: 1716050 - RNA, 13 nt, Salmonella enterica enterica serovar Typhi
cggcggucugcgc

SEQ ID NO: 1716051 - RNA, 16 nt, Salmonella enterica enterica serovar Typhi
cggcgggagcucuacc

SEQ ID NO: 1716052 - RNA, 18 nt, Salmonella enterica enterica serovar Typhi
cggcgggaucuccagaag

SEQ ID NO: 1716053 - RNA, 20 nt, Salmonella enterica enterica serovar Typhi
cggcguuacccgucuggcgc

SEQ ID NO: 1716054 - RNA, 20 nt, Salmonella enterica enterica serovar Typhi
cggcuaccccggcgcggcgc

SEQ ID NO: 1716055 - RNA, 15 nt, Salmonella enterica enterica serovar Typhi
cggcguuccgcccag

SEQ ID NO: 1716056 - RNA, 18 nt, Salmonella enterica enterica serovar Typhi
cggcguuuuuuccugcug

SEQ ID NO: 1716057 - RNA, 21 nt, Salmonella enterica enterica serovar Typhi
cggcguguagccaaucagccc

SEQ ID NO: 1716058 - RNA, 15 nt, Salmonella enterica enterica serovar Typhi
cggcguagcucgccc

SEQ ID NO: 1716059 - RNA, 15 nt, Salmonella enterica enterica serovar Typhi
cggcguaccgcgcgc

SEQ ID NO: 1716060 - RNA, 17 nt, Salmonella enterica enterica serovar Typhi
cggcguggagcauucca

SEQ ID NO: 1716061 - RNA, 19 nt, Salmonella enterica enterica serovar Typhi
cggcucaaacggccugcgc

SEQ ID NO: 1716062 - RNA, 22 nt, Salmonella enterica enterica serovar Typhi
cggcucaccagcugacgcagca

SEQ ID NO: 1716063 - RNA, 13 nt, Salmonella enterica enterica serovar Typhi
cggcuaccgccug

SEQ ID NO: 1716064 - RNA, 16 nt, Salmonella enterica enterica serovar Typhi
cggcuaccgaaggcgc

SEQ ID NO: 1716065 - RNA, 22 nt, Salmonella enterica enterica serovar Typhi
cggcuacugccagcgucgcuga

SEQ ID NO: 1716066 - RNA, 16 nt, Salmonella enterica enterica serovar Typhi
cggcuagcgcaguuug

SEQ ID NO: 1716067 - RNA, 20 nt, Salmonella enterica enterica serovar Typhi
cggcuacgccuuauccggcc

SEQ ID NO: 1716068 - RNA, 17 nt, Salmonella enterica enterica serovar Typhi
cggcucgaacuguucug

SEQ ID NO: 1716069 - RNA, 13 nt, Salmonella enterica enterica serovar Typhi
cggcucauccagc

SEQ ID NO: 1716070 - RNA, 16 nt, Salmonella enterica enterica serovar Typhi
cggcucauccagcaac

SEQ ID NO: 1716071 - RNA, 17 nt, Salmonella enterica enterica serovar Typhi
cggcucauccagcaaca

SEQ ID NO: 1716072 - RNA, 22 nt, Salmonella enterica enterica serovar Typhi
cggcuccggcaaauucuuccgc

SEQ ID NO: 1716073 - RNA, 19 nt, Salmonella enterica enterica serovar Typhi
cggcugcgccuuauccggc

SEQ ID NO: 1716074 - RNA, 16 nt, Salmonella enterica enterica serovar Typhi
cggcugcgccugcggg

SEQ ID NO: 1716075 - RNA, 23 nt, Salmonella enterica enterica serovar Typhi
cggcuguaccuuaaccgggcgcu

SEQ ID NO: 1716076 - RNA, 19 nt, Salmonella enterica enterica serovar Typhi
cggcuguagccagccugaa

SEQ ID NO: 1716077 - RNA, 12 nt, Salmonella enterica enterica serovar Typhi
cggcuguauaca

SEQ ID NO: 1716078 - RNA, 13 nt, Salmonella enterica enterica serovar Typhi
cggcuguagccag

SEQ ID NO: 1716079 - RNA, 16 nt, Salmonella enterica enterica serovar Typhi
cggcuuuccgcaccgc

SEQ ID NO: 1716080 - RNA, 21 nt, Salmonella enterica enterica serovar Typhi
cggcuuucuguuccgaaauaa

SEQ ID NO: 1716081 - RNA, 22 nt, Salmonella enterica enterica serovar Typhi
cggcuuugaacagcgucaucca

SEQ ID NO: 1716082 - RNA, 14 nt, Salmonella enterica enterica serovar Typhi
cggcuuccggcagc

SEQ ID NO: 1716083 - RNA, 16 nt, Salmonella enterica enterica serovar Typhi
cggcuucagcggcgca

SEQ ID NO: 1716084 - RNA, 18 nt, Salmonella enterica enterica serovar Typhi
cggcuucacgccauccag

SEQ ID NO: 1716085 - RNA, 22 nt, Salmonella enterica enterica serovar Typhi
cggcuguguccgccaugugcug

SEQ ID NO: 1716086 - RNA, 21 nt, Salmonella enterica enterica serovar Typhi
cggcuuauccggccugcacga

SEQ ID NO: 1716087 - RNA, 15 nt, Salmonella enterica enterica serovar Typhi
cgggcgaagccugac

SEQ ID NO: 1716088 - RNA, 17 nt, Salmonella enterica enterica serovar Typhi
cgggcgacacgcgcgcu

SEQ ID NO: 1716089 - RNA, 15 nt, Salmonella enterica enterica serovar Typhi
cgggcgaccacccgc

SEQ ID NO: 1716090 - RNA, 15 nt, Salmonella enterica enterica serovar Typhi
cgggccugagcgcgc

SEQ ID NO: 1716091 - RNA, 13 nt, Salmonella enterica enterica serovar Typhi
cgggccugccagg

SEQ ID NO: 1716092 - RNA, 18 nt, Salmonella enterica enterica serovar Typhi
cgggcgauacaccuucac

SEQ ID NO: 1716093 - RNA, 15 nt, Salmonella enterica enterica serovar Typhi
cgggcgauaaaccag

SEQ ID NO: 1716094 - RNA, 16 nt, Salmonella enterica enterica serovar Typhi
cgggcgauaaaccagc

SEQ ID NO: 1716095 - RNA, 16 nt, Salmonella enterica enterica serovar Typhi
cgggcgaccgucgggc

SEQ ID NO: 1716096 - RNA, 21 nt, Salmonella enterica enterica serovar Typhi
cgggccgccgcagcagaugug

SEQ ID NO: 1716097 - RNA, 16 nt, Salmonella enterica enterica serovar Typhi
cgggccgccgcagcag

SEQ ID NO: 1716098 - RNA, 20 nt, Salmonella enterica enterica serovar Typhi
cgggccguagugcuucucuu

SEQ ID NO: 1716099 - RNA, 19 nt, Salmonella enterica enterica serovar Typhi
cgggccguggccaggaaua

SEQ ID NO: 1716100 - RNA, 15 nt, Salmonella enterica enterica serovar Typhi
cgggcacgcugacca

SEQ ID NO: 1716101 - RNA, 15 nt, Salmonella enterica enterica serovar Typhi
cgggaaguccuucuc

SEQ ID NO: 1716102 - RNA, 23 nt, Salmonella enterica enterica serovar Typhi
cgggaauaacgcgagaagaagaa

SEQ ID NO: 1716103 - RNA, 23 nt, Salmonella enterica enterica serovar Typhi
cgggcaggcuuccacgcacgccg

SEQ ID NO: 1716104 - RNA, 19 nt, Salmonella enterica enterica serovar Typhi
cgggcaggucgucuucuug

SEQ ID NO: 1716105 - RNA, 23 nt, Salmonella enterica enterica serovar Typhi
cggggaaaauauuagcggcggca

SEQ ID NO: 1716106 - RNA, 23 nt, Salmonella enterica enterica serovar Typhi
cgggcuuuguugucuauaaagcg

SEQ ID NO: 1716107 - RNA, 13 nt, Salmonella enterica enterica serovar Typhi
cgggcuucaggau

SEQ ID NO: 1716108 - RNA, 20 nt, Salmonella enterica enterica serovar Typhi
cggguauggcaaugcccccu

SEQ ID NO: 1716109 - RNA, 23 nt, Salmonella enterica enterica serovar Typhi
cgggcguuucacauuccggcgcg

SEQ ID NO: 1716110 - RNA, 13 nt, Salmonella enterica enterica serovar Typhi
cgggcucggcgcu

SEQ ID NO: 1716111 - RNA, 19 nt, Salmonella enterica enterica serovar Typhi
cgggcguauagccaggcag

SEQ ID NO: 1716112 - RNA, 22 nt, Salmonella enterica enterica serovar Typhi
cgggcgucacccgccggcagca

SEQ ID NO: 1716113 - RNA, 14 nt, Salmonella enterica enterica serovar Typhi
cgggcggcgcagcg

SEQ ID NO: 1716114 - RNA, 13 nt, Salmonella enterica enterica serovar Typhi
cgcucugccuuuu

SEQ ID NO: 1716115 - RNA, 15 nt, Salmonella enterica enterica serovar Typhi
cgcucucgccgcgcu

SEQ ID NO: 1716116 - RNA, 22 nt, Salmonella enterica enterica serovar Typhi
cgcucucgccgcgcuccaucau

SEQ ID NO: 1716117 - RNA, 18 nt, Salmonella enterica enterica serovar Typhi
cgcucuaucgccgcccgc

SEQ ID NO: 1716118 - RNA, 14 nt, Salmonella enterica enterica serovar Typhi
cgcucuaucgccug

SEQ ID NO: 1716119 - RNA, 19 nt, Salmonella enterica enterica serovar Typhi
cgcucuauauccugcccuu

SEQ ID NO: 1716120 - RNA, 16 nt, Salmonella enterica enterica serovar Typhi
cgcucuaucgccgccc

SEQ ID NO: 1716121 - RNA, 16 nt, Salmonella enterica enterica serovar Typhi
cgcucguacaaaucac

SEQ ID NO: 1716122 - RNA, 21 nt, Salmonella enterica enterica serovar Typhi
cgcucgucgcgacguccgcca

SEQ ID NO: 1716123 - RNA, 16 nt, Salmonella enterica enterica serovar Typhi
cgcucaggcgcgcgcu

SEQ ID NO: 1716124 - RNA, 14 nt, Salmonella enterica enterica serovar Typhi
cgcugccagcugcg

SEQ ID NO: 1716125 - RNA, 16 nt, Salmonella enterica enterica serovar Typhi
cgcugaugaaaaccca

SEQ ID NO: 1716126 - RNA, 14 nt, Salmonella enterica enterica serovar Typhi
cgcugaugacgcgc

SEQ ID NO: 1716127 - RNA, 22 nt, Salmonella enterica enterica serovar Typhi
cgcugaccacgccgccgcgucc

SEQ ID NO: 1716128 - RNA, 16 nt, Salmonella enterica enterica serovar Typhi
cgcugaaguccgcgau

SEQ ID NO: 1716129 - RNA, 21 nt, Salmonella enterica enterica serovar Typhi
cgcugaguggucuggacaugu

SEQ ID NO: 1716130 - RNA, 14 nt, Salmonella enterica enterica serovar Typhi
cgcugccgcccuuu

SEQ ID NO: 1716131 - RNA, 22 nt, Salmonella enterica enterica serovar Typhi
cgcugcgcuuacacacccggcc

SEQ ID NO: 1716132 - RNA, 18 nt, Salmonella enterica enterica serovar Typhi
cgcugcgcuuaccgggcc

SEQ ID NO: 1716133 - RNA, 19 nt, Salmonella enterica enterica serovar Typhi
cgcugcgcuuaccgggccu

SEQ ID NO: 1716134 - RNA, 18 nt, Salmonella enterica enterica serovar Typhi
cgcugcgccugcugccag

SEQ ID NO: 1716135 - RNA, 22 nt, Salmonella enterica enterica serovar Typhi
cgcugcggcguggagcauucca

SEQ ID NO: 1716136 - RNA, 15 nt, Salmonella enterica enterica serovar Typhi
cgcugcguggcgggc

SEQ ID NO: 1716137 - RNA, 14 nt, Salmonella enterica enterica serovar Typhi
cgcugcuccggcuu

SEQ ID NO: 1716138 - RNA, 23 nt, Salmonella enterica enterica serovar Typhi
cgcuggacgucgucaccacggug

SEQ ID NO: 1716139 - RNA, 21 nt, Salmonella enterica enterica serovar Typhi
cgcuggaacugaucgugccca

SEQ ID NO: 1716140 - RNA, 13 nt, Salmonella enterica enterica serovar Typhi
cgcuggaagagaa

SEQ ID NO: 1716141 - RNA, 22 nt, Salmonella enterica enterica serovar Typhi
cgcugcuguaacagacgcaggc

SEQ ID NO: 1716142 - RNA, 14 nt, Salmonella enterica enterica serovar Typhi
cgcugcuucacgga

SEQ ID NO: 1716143 - RNA, 23 nt, Salmonella enterica enterica serovar Typhi
cgcuggagccuguuccagcugcg

SEQ ID NO: 1716144 - RNA, 15 nt, Salmonella enterica enterica serovar Typhi
cgcuggcacuggcag

SEQ ID NO: 1716145 - RNA, 16 nt, Salmonella enterica enterica serovar Typhi
cgcuggcaauaaagca

SEQ ID NO: 1716146 - RNA, 16 nt, Salmonella enterica enterica serovar Typhi
cgcuggcacaggauau

SEQ ID NO: 1716147 - RNA, 13 nt, Salmonella enterica enterica serovar Typhi
cgcuggcgcugca

SEQ ID NO: 1716148 - RNA, 20 nt, Salmonella enterica enterica serovar Typhi
cgcuggcgcggggaacaccc

SEQ ID NO: 1716149 - RNA, 17 nt, Salmonella enterica enterica serovar Typhi
cgcuuuugguuuuucaa

SEQ ID NO: 1716150 - RNA, 18 nt, Salmonella enterica enterica serovar Typhi
cgcuuuuugcgccagcgc

SEQ ID NO: 1716151 - RNA, 19 nt, Salmonella enterica enterica serovar Typhi
cgcuuuuuuauuguuucua

SEQ ID NO: 1716152 - RNA, 23 nt, Salmonella enterica enterica serovar Typhi
cgcuuuuuuaacgauuuccccug

SEQ ID NO: 1716153 - RNA, 20 nt, Salmonella enterica enterica serovar Typhi
cgcuuuugccgcgacuuccg

SEQ ID NO: 1716154 - RNA, 13 nt, Salmonella enterica enterica serovar Typhi
cgcuuuucuggcu

SEQ ID NO: 1716155 - RNA, 23 nt, Salmonella enterica enterica serovar Typhi
cgcuuuccggggugaauuuuuug

SEQ ID NO: 1716156 - RNA, 13 nt, Salmonella enterica enterica serovar Typhi
cgcuuucauacga

SEQ ID NO: 1716157 - RNA, 16 nt, Salmonella enterica enterica serovar Typhi
cgcuuucaguaauaau

SEQ ID NO: 1716158 - RNA, 14 nt, Salmonella enterica enterica serovar Typhi
cggaaaccccaggu

SEQ ID NO: 1716159 - RNA, 23 nt, Salmonella enterica enterica serovar Typhi
cggaaaaaugucgcuuaucgccu

SEQ ID NO: 1716160 - RNA, 16 nt, Salmonella enterica enterica serovar Typhi
cgcuuuuuucucugcu

SEQ ID NO: 1716161 - RNA, 14 nt, Salmonella enterica enterica serovar Typhi
cgcuugauacgcca

SEQ ID NO: 1716162 - RNA, 17 nt, Salmonella enterica enterica serovar Typhi
cgcuugauccagcucgc

SEQ ID NO: 1716163 - RNA, 17 nt, Salmonella enterica enterica serovar Typhi
cgcuugauacgccaucu

SEQ ID NO: 1716164 - RNA, 17 nt, Salmonella enterica enterica serovar Typhi
cgcuuagcuucccgcau

SEQ ID NO: 1716165 - RNA, 16 nt, Salmonella enterica enterica serovar Typhi
cgcuuacgcuccugcg

SEQ ID NO: 1716166 - RNA, 14 nt, Salmonella enterica enterica serovar Typhi
cgcuuacgcggcgc

SEQ ID NO: 1716167 - RNA, 18 nt, Salmonella enterica enterica serovar Typhi
cgcuuacgcggcgcgcuc

SEQ ID NO: 1716168 - RNA, 18 nt, Salmonella enterica enterica serovar Typhi
cgcuuacucagccagaua

SEQ ID NO: 1716169 - RNA, 18 nt, Salmonella enterica enterica serovar Typhi
cgcuuacaauuuaucugc

SEQ ID NO: 1716170 - RNA, 14 nt, Salmonella enterica enterica serovar Typhi
cgcuugcgccgcca

SEQ ID NO: 1716171 - RNA, 21 nt, Salmonella enterica enterica serovar Typhi
cgcuuuacccgggccaucuuu

SEQ ID NO: 1716172 - RNA, 15 nt, Salmonella enterica enterica serovar Typhi
cgcuuuaccgccuuc

SEQ ID NO: 1716173 - RNA, 12 nt, Salmonella enterica enterica serovar Typhi
cgcuugccacua

SEQ ID NO: 1716174 - RNA, 13 nt, Salmonella enterica enterica serovar Typhi
cgcuuucaccauc

SEQ ID NO: 1716175 - RNA, 18 nt, Salmonella enterica enterica serovar Typhi
cgcuggguuuuuccgcuu

SEQ ID NO: 1716176 - RNA, 14 nt, Salmonella enterica enterica serovar Typhi
cgcuguaacccgcc

SEQ ID NO: 1716177 - RNA, 18 nt, Salmonella enterica enterica serovar Typhi
cgcuguaacccgccgcca

SEQ ID NO: 1716178 - RNA, 19 nt, Salmonella enterica enterica serovar Typhi
cgcuguaacccgccgccau

SEQ ID NO: 1716179 - RNA, 16 nt, Salmonella enterica enterica serovar Typhi
cgcuggugccaaucuc

SEQ ID NO: 1716180 - RNA, 12 nt, Salmonella enterica enterica serovar Typhi
cgcugggaugac

SEQ ID NO: 1716181 - RNA, 16 nt, Salmonella enterica enterica serovar Typhi
cgcuggcgcgucugug

SEQ ID NO: 1716182 - RNA, 20 nt, Salmonella enterica enterica serovar Typhi
cgcuguuaugcacgcgcggc

SEQ ID NO: 1716183 - RNA, 15 nt, Salmonella enterica enterica serovar Typhi
cgcuguuuuccgcuu

SEQ ID NO: 1716184 - RNA, 15 nt, Salmonella enterica enterica serovar Typhi
cgcuguuuauccaca

SEQ ID NO: 1716185 - RNA, 22 nt, Salmonella enterica enterica serovar Typhi
cgcuuaaucuugaguuuggccu

SEQ ID NO: 1716186 - RNA, 17 nt, Salmonella enterica enterica serovar Typhi
cgcuuaacggcccaggc

SEQ ID NO: 1716187 - RNA, 22 nt, Salmonella enterica enterica serovar Typhi
cgcugucaccagcagcauuuca

SEQ ID NO: 1716188 - RNA, 20 nt, Salmonella enterica enterica serovar Typhi
cgcugucggucagauucaga

SEQ ID NO: 1716189 - RNA, 15 nt, Salmonella enterica enterica serovar Typhi
cgcugucggcgccca

SEQ ID NO: 1716190 - RNA, 19 nt, Salmonella enterica enterica serovar Typhi
cgcugugauccauguugcc

SEQ ID NO: 1716191 - RNA, 16 nt, Salmonella enterica enterica serovar Typhi
cgcggccaaaacccac

SEQ ID NO: 1716192 - RNA, 20 nt, Salmonella enterica enterica serovar Typhi
cgcggccaaaacccaccagc

SEQ ID NO: 1716193 - RNA, 22 nt, Salmonella enterica enterica serovar Typhi
cgcggccaaaacccaccagcag

SEQ ID NO: 1716194 - RNA, 19 nt, Salmonella enterica enterica serovar Typhi
cgcggcaaccagcccauga

SEQ ID NO: 1716195 - RNA, 17 nt, Salmonella enterica enterica serovar Typhi
cgcggauuaagcgaauc

SEQ ID NO: 1716196 - RNA, 18 nt, Salmonella enterica enterica serovar Typhi
cgcggaucggcacacagc

SEQ ID NO: 1716197 - RNA, 14 nt, Salmonella enterica enterica serovar Typhi
cgcggcaucaagca

SEQ ID NO: 1716198 - RNA, 21 nt, Salmonella enterica enterica serovar Typhi
cgcgccgcuggcgaccagccu

SEQ ID NO: 1716199 - RNA, 23 nt, Salmonella enterica enterica serovar Typhi
cgcggcgccgaagcaggcggaga

SEQ ID NO: 1716200 - RNA, 14 nt, Salmonella enterica enterica serovar Typhi
cgcggcgcucgcca

SEQ ID NO: 1716201 - RNA, 13 nt, Salmonella enterica enterica serovar Typhi
cgcggcggaccgc

SEQ ID NO: 1716202 - RNA, 21 nt, Salmonella enterica enterica serovar Typhi
cgcggcggacaacgcuccagc

SEQ ID NO: 1716203 - RNA, 23 nt, Salmonella enterica enterica serovar Typhi
cgcggcucaccagcugacgcagc

SEQ ID NO: 1716204 - RNA, 13 nt, Salmonella enterica enterica serovar Typhi
cgcggcuccggcu

SEQ ID NO: 1716205 - RNA, 17 nt, Salmonella enterica enterica serovar Typhi
cgcggcuuauccggcuu

SEQ ID NO: 1716206 - RNA, 18 nt, Salmonella enterica enterica serovar Typhi
cgcggcugguaagagagc

SEQ ID NO: 1716207 - RNA, 17 nt, Salmonella enterica enterica serovar Typhi
cgcgguaaauuccgcag

SEQ ID NO: 1716208 - RNA, 14 nt, Salmonella enterica enterica serovar Typhi
cgcgggccugccug

SEQ ID NO: 1716209 - RNA, 18 nt, Salmonella enterica enterica serovar Typhi
cgcgugacgcaguaauac

SEQ ID NO: 1716210 - RNA, 17 nt, Salmonella enterica enterica serovar Typhi
cgcgugcucgcggcgga

SEQ ID NO: 1716211 - RNA, 15 nt, Salmonella enterica enterica serovar Typhi
cgcguuuaucaccaa

SEQ ID NO: 1716212 - RNA, 16 nt, Salmonella enterica enterica serovar Typhi
cgcguuuuuucaugaa

SEQ ID NO: 1716213 - RNA, 13 nt, Salmonella enterica enterica serovar Typhi
cgcguuuuccauu

SEQ ID NO: 1716214 - RNA, 20 nt, Salmonella enterica enterica serovar Typhi
cgcuaaacagcgccgcgaau

SEQ ID NO: 1716215 - RNA, 15 nt, Salmonella enterica enterica serovar Typhi
cgcuaaaauccacgu

SEQ ID NO: 1716216 - RNA, 14 nt, Salmonella enterica enterica serovar Typhi
cgcuaaccaucagc

SEQ ID NO: 1716217 - RNA, 12 nt, Salmonella enterica enterica serovar Typhi
cgcuaccuuuuu

SEQ ID NO: 1716218 - RNA, 14 nt, Salmonella enterica enterica serovar Typhi
cgcuacguuuaucu

SEQ ID NO: 1716219 - RNA, 16 nt, Salmonella enterica enterica serovar Typhi
cgcuacguuuaucugg

SEQ ID NO: 1716220 - RNA, 15 nt, Salmonella enterica enterica serovar Typhi
cgcuacugccgccau

SEQ ID NO: 1716221 - RNA, 17 nt, Salmonella enterica enterica serovar Typhi
cgcuaucugcuccgcca

SEQ ID NO: 1716222 - RNA, 20 nt, Salmonella enterica enterica serovar Typhi
cgcuaucuguugcgccaggg

SEQ ID NO: 1716223 - RNA, 19 nt, Salmonella enterica enterica serovar Typhi
cgcuaucugcuccgccagc

SEQ ID NO: 1716224 - RNA, 21 nt, Salmonella enterica enterica serovar Typhi
cgcucacgguuucaacuucca

SEQ ID NO: 1716225 - RNA, 11 nt, Salmonella enterica enterica serovar Typhi
cgcucacgcca

SEQ ID NO: 1716226 - RNA, 16 nt, Salmonella enterica enterica serovar Typhi
cgcucagccagaaacg

SEQ ID NO: 1716227 - RNA, 16 nt, Salmonella enterica enterica serovar Typhi
cgcucaaccgguuugu

SEQ ID NO: 1716228 - RNA, 22 nt, Salmonella enterica enterica serovar Typhi
cgcuauguaagguucccugcgc

SEQ ID NO: 1716229 - RNA, 19 nt, Salmonella enterica enterica serovar Typhi
cgcuauugagcgacgccgc

SEQ ID NO: 1716230 - RNA, 13 nt, Salmonella enterica enterica serovar Typhi
cgcuauuuaaccc

SEQ ID NO: 1716231 - RNA, 23 nt, Salmonella enterica enterica serovar Typhi
cgcgguauuucgcaacgccgccg

SEQ ID NO: 1716232 - RNA, 18 nt, Salmonella enterica enterica serovar Typhi
cgcgguauuucgccgccg

SEQ ID NO: 1716233 - RNA, 18 nt, Salmonella enterica enterica serovar Typhi
cgcgguauucauaccuuu

SEQ ID NO: 1716234 - RNA, 19 nt, Salmonella enterica enterica serovar Typhi
cgcgguauuucgccgccgc

SEQ ID NO: 1716235 - RNA, 17 nt, Salmonella enterica enterica serovar Typhi
cgcggucauugagccgc

SEQ ID NO: 1716236 - RNA, 19 nt, Salmonella enterica enterica serovar Typhi
cgcggucagcggcgcgccg

SEQ ID NO: 1716237 - RNA, 22 nt, Salmonella enterica enterica serovar Typhi
cgcggucgggauauaugcaaaa

SEQ ID NO: 1716238 - RNA, 12 nt, Salmonella enterica enterica serovar Typhi
cgcggucggcag

SEQ ID NO: 1716239 - RNA, 23 nt, Salmonella enterica enterica serovar Typhi
cgcggugacuuuggccggcuucu

SEQ ID NO: 1716240 - RNA, 22 nt, Salmonella enterica enterica serovar Typhi
cgcgucauaaugcccagcgccg

SEQ ID NO: 1716241 - RNA, 11 nt, Salmonella enterica enterica serovar Typhi
cgcgucagggc

SEQ ID NO: 1716242 - RNA, 17 nt, Salmonella enterica enterica serovar Typhi
cgcgguuucguggcgcu

SEQ ID NO: 1716243 - RNA, 21 nt, Salmonella enterica enterica serovar Typhi
cgcgguucuguuccgcuaucu

SEQ ID NO: 1716244 - RNA, 12 nt, Salmonella enterica enterica serovar Typhi
cgcgguuuaucc

SEQ ID NO: 1716245 - RNA, 15 nt, Salmonella enterica enterica serovar Typhi
cgcgguugucggcgc

SEQ ID NO: 1716246 - RNA, 13 nt, Salmonella enterica enterica serovar Typhi
cgcgucccucucc

SEQ ID NO: 1716247 - RNA, 15 nt, Salmonella enterica enterica serovar Typhi
cgcguccauuacucu

SEQ ID NO: 1716248 - RNA, 16 nt, Salmonella enterica enterica serovar Typhi
cggccauuaacacaca

SEQ ID NO: 1716249 - RNA, 19 nt, Salmonella enterica enterica serovar Typhi
cggccaguguacauagcuu

SEQ ID NO: 1716250 - RNA, 19 nt, Salmonella enterica enterica serovar Typhi
cggccauuaacacacaauc

SEQ ID NO: 1716251 - RNA, 20 nt, Salmonella enterica enterica serovar Typhi
cggccagucgcucuaacuga

SEQ ID NO: 1716252 - RNA, 17 nt, Salmonella enterica enterica serovar Typhi
cggccaguagcgggggc

SEQ ID NO: 1716253 - RNA, 22 nt, Salmonella enterica enterica serovar Typhi
cggcaucaucuaccuucacgca

SEQ ID NO: 1716254 - RNA, 14 nt, Salmonella enterica enterica serovar Typhi
cggccagcgcaggc

SEQ ID NO: 1716255 - RNA, 16 nt, Salmonella enterica enterica serovar Typhi
cggccagcgcaggcug

SEQ ID NO: 1716256 - RNA, 12 nt, Salmonella enterica enterica serovar Typhi
cggccagccaua

SEQ ID NO: 1716257 - RNA, 14 nt, Salmonella enterica enterica serovar Typhi
cggccccgggcgac

SEQ ID NO: 1716258 - RNA, 13 nt, Salmonella enterica enterica serovar Typhi
cggcccccggcca

SEQ ID NO: 1716259 - RNA, 18 nt, Salmonella enterica enterica serovar Typhi
cggcccccggccauagcg

SEQ ID NO: 1716260 - RNA, 13 nt, Salmonella enterica enterica serovar Typhi
cggcccgcgcuga

SEQ ID NO: 1716261 - RNA, 23 nt, Salmonella enterica enterica serovar Typhi
cggcccgcuucauuggcgucugc

SEQ ID NO: 1716262 - RNA, 18 nt, Salmonella enterica enterica serovar Typhi
cggcccgugccagcuauc

SEQ ID NO: 1716263 - RNA, 22 nt, Salmonella enterica enterica serovar Typhi
cggccugcggugguggggccua

SEQ ID NO: 1716264 - RNA, 16 nt, Salmonella enterica enterica serovar Typhi
cggccugcgguguaga

SEQ ID NO: 1716265 - RNA, 12 nt, Salmonella enterica enterica serovar Typhi
cggccuggcccg

SEQ ID NO: 1716266 - RNA, 14 nt, Salmonella enterica enterica serovar Typhi
cggccuggcgcagc

SEQ ID NO: 1716267 - RNA, 16 nt, Salmonella enterica enterica serovar Typhi
cggccuggcucuuccg

SEQ ID NO: 1716268 - RNA, 19 nt, Salmonella enterica enterica serovar Typhi
cggccugaaucagcaucuu

SEQ ID NO: 1716269 - RNA, 16 nt, Salmonella enterica enterica serovar Typhi
cggccugcaggcaacg

SEQ ID NO: 1716270 - RNA, 15 nt, Salmonella enterica enterica serovar Typhi
cggccuacaacucag

SEQ ID NO: 1716271 - RNA, 16 nt, Salmonella enterica enterica serovar Typhi
cggccuacaacucagc

SEQ ID NO: 1716272 - RNA, 13 nt, Salmonella enterica enterica serovar Typhi
cggccuccgguga

SEQ ID NO: 1716273 - RNA, 14 nt, Salmonella enterica enterica serovar Typhi
cggccuccgcuucc

SEQ ID NO: 1716274 - RNA, 21 nt, Salmonella enterica enterica serovar Typhi
cggcagccugccgcaucugac

SEQ ID NO: 1716275 - RNA, 17 nt, Salmonella enterica enterica serovar Typhi
cggcagcgcgccgcccu

SEQ ID NO: 1716276 - RNA, 13 nt, Salmonella enterica enterica serovar Typhi
cggcagcgcgccg

SEQ ID NO: 1716277 - RNA, 20 nt, Salmonella enterica enterica serovar Typhi
cggcagccgccaccacaaag

SEQ ID NO: 1716278 - RNA, 17 nt, Salmonella enterica enterica serovar Typhi
cggcagccgggccgcaa

SEQ ID NO: 1716279 - RNA, 17 nt, Salmonella enterica enterica serovar Typhi
cggcagccgccaccaca

SEQ ID NO: 1716280 - RNA, 19 nt, Salmonella enterica enterica serovar Typhi
cggcaggccuuucggcagc

SEQ ID NO: 1716281 - RNA, 23 nt, Salmonella enterica enterica serovar Typhi
cggcauacaggccgccgggucag

SEQ ID NO: 1716282 - RNA, 15 nt, Salmonella enterica enterica serovar Typhi
cggcauacgccgggc

SEQ ID NO: 1716283 - RNA, 19 nt, Salmonella enterica enterica serovar Typhi
cggcauaagccaguccugc

SEQ ID NO: 1716284 - RNA, 23 nt, Salmonella enterica enterica serovar Typhi
cggcaguucaggcucgcaaauaa

SEQ ID NO: 1716285 - RNA, 14 nt, Salmonella enterica enterica serovar Typhi
cggcaucagauggc

SEQ ID NO: 1716286 - RNA, 16 nt, Salmonella enterica enterica serovar Typhi
cggcaucacaggcuua

SEQ ID NO: 1716287 - RNA, 18 nt, Salmonella enterica enterica serovar Typhi
cggcauauucccugacug

SEQ ID NO: 1716288 - RNA, 19 nt, Salmonella enterica enterica serovar Typhi
cggcauaugcaggucgcgc

SEQ ID NO: 1716289 - RNA, 16 nt, Salmonella enterica enterica serovar Typhi
cggcauacugucgcgc

SEQ ID NO: 1716290 - RNA, 19 nt, Salmonella enterica enterica serovar Typhi
cggcauacuuucgcgcggc

SEQ ID NO: 1716291 - RNA, 20 nt, Salmonella enterica enterica serovar Typhi
cggcagucacuuucagauuu

SEQ ID NO: 1716292 - RNA, 12 nt, Salmonella enterica enterica serovar Typhi
cggcagucgcua

SEQ ID NO: 1716293 - RNA, 20 nt, Salmonella enterica enterica serovar Typhi
cggcaguccuugcagccaga

SEQ ID NO: 1716294 - RNA, 22 nt, Salmonella enterica enterica serovar Typhi
cggcaguggcauguucccaugu

SEQ ID NO: 1716295 - RNA, 13 nt, Salmonella enterica enterica serovar Typhi
cggcaccagccag

SEQ ID NO: 1716296 - RNA, 16 nt, Salmonella enterica enterica serovar Typhi
cggcaccagcgaugcg

SEQ ID NO: 1716297 - RNA, 17 nt, Salmonella enterica enterica serovar Typhi
cggcacaucgcgcguga

SEQ ID NO: 1716298 - RNA, 16 nt, Salmonella enterica enterica serovar Typhi
cggcaaccaaagucca

SEQ ID NO: 1716299 - RNA, 15 nt, Salmonella enterica enterica serovar Typhi
cggcaaauccuccau

SEQ ID NO: 1716300 - RNA, 13 nt, Salmonella enterica enterica serovar Typhi
cggcaaagaaaaa

SEQ ID NO: 1716301 - RNA, 15 nt, Salmonella enterica enterica serovar Typhi
cggcaaacgcuggug

SEQ ID NO: 1716302 - RNA, 13 nt, Salmonella enterica enterica serovar Typhi
cggcaaacucagc

SEQ ID NO: 1716303 - RNA, 16 nt, Salmonella enterica enterica serovar Typhi
cggcaaaguuccaggu

SEQ ID NO: 1716304 - RNA, 15 nt, Salmonella enterica enterica serovar Typhi
cggcacgccagcgcc

SEQ ID NO: 1716305 - RNA, 21 nt, Salmonella enterica enterica serovar Typhi
cggcacugacucuuccgggcg

SEQ ID NO: 1716306 - RNA, 22 nt, Salmonella enterica enterica serovar Typhi
cggauugucaucugacugcgug

SEQ ID NO: 1716307 - RNA, 21 nt, Salmonella enterica enterica serovar Typhi
cggauuguuguucauggucag

SEQ ID NO: 1716308 - RNA, 24 nt, Salmonella enterica enterica serovar Typhi
cggauugccuucucugucgagcau

SEQ ID NO: 1716309 - RNA, 16 nt, Salmonella enterica enterica serovar Typhi
cggcaaaccaaacggc

SEQ ID NO: 1716310 - RNA, 20 nt, Salmonella enterica enterica serovar Typhi
cggcaaaaaauauagccauu

SEQ ID NO: 1716311 - RNA, 18 nt, Salmonella enterica enterica serovar Typhi
cggcaaaaagaaucgcca

SEQ ID NO: 1716312 - RNA, 19 nt, Salmonella enterica enterica serovar Typhi
cggcaaaaaucagcccgga

SEQ ID NO: 1716313 - RNA, 14 nt, Salmonella enterica enterica serovar Typhi
cggaugugcauuga

SEQ ID NO: 1716314 - RNA, 20 nt, Salmonella enterica enterica serovar Typhi
cggauguuagcuucacuucg

SEQ ID NO: 1716315 - RNA, 19 nt, Salmonella enterica enterica serovar Typhi
cggauuaucguccggcauc

SEQ ID NO: 1716316 - RNA, 14 nt, Salmonella enterica enterica serovar Typhi
cggauucuuccucu

SEQ ID NO: 1716317 - RNA, 18 nt, Salmonella enterica enterica serovar Typhi
cggauugccgcgcucaau

SEQ ID NO: 1716318 - RNA, 17 nt, Salmonella enterica enterica serovar Typhi
cggaugcgccaucccau

SEQ ID NO: 1716319 - RNA, 22 nt, Salmonella enterica enterica serovar Typhi
cggauggaauuuugcaccauca

SEQ ID NO: 1716320 - RNA, 17 nt, Salmonella enterica enterica serovar Typhi
cggauggccugcucaau

SEQ ID NO: 1716321 - RNA, 12 nt, Salmonella enterica enterica serovar Typhi
cggaugggcaga

SEQ ID NO: 1716322 - RNA, 18 nt, Salmonella enterica enterica serovar Typhi
cggaugguggcguaaaua

SEQ ID NO: 1716323 - RNA, 15 nt, Salmonella enterica enterica serovar Typhi
cggaugaucuucaua

SEQ ID NO: 1716324 - RNA, 20 nt, Salmonella enterica enterica serovar Typhi
cggaaaucaaaccaucccag

SEQ ID NO: 1716325 - RNA, 23 nt, Salmonella enterica enterica serovar Typhi
cggaaaucacaaacaccaccagu

SEQ ID NO: 1716326 - RNA, 18 nt, Salmonella enterica enterica serovar Typhi
cggaaagggugcccgccu

SEQ ID NO: 1716327 - RNA, 12 nt, Salmonella enterica enterica serovar Typhi
cggaaauggucg

SEQ ID NO: 1716328 - RNA, 18 nt, Salmonella enterica enterica serovar Typhi
cggagauuucauccucuu

SEQ ID NO: 1716329 - RNA, 14 nt, Salmonella enterica enterica serovar Typhi
cggagcaaaaaaug

SEQ ID NO: 1716330 - RNA, 21 nt, Salmonella enterica enterica serovar Typhi
cggagauuaacagcgcgacca

SEQ ID NO: 1716331 - RNA, 15 nt, Salmonella enterica enterica serovar Typhi
cggagaucuccagau

SEQ ID NO: 1716332 - RNA, 23 nt, Salmonella enterica enterica serovar Typhi
cggagaugaucguuuccagcauc

SEQ ID NO: 1716333 - RNA, 16 nt, Salmonella enterica enterica serovar Typhi
cggaacuggugaaaca

SEQ ID NO: 1716334 - RNA, 18 nt, Salmonella enterica enterica serovar Typhi
cggaacuaacccgcagcc

SEQ ID NO: 1716335 - RNA, 15 nt, Salmonella enterica enterica serovar Typhi
cggagcuggcacgcg

SEQ ID NO: 1716336 - RNA, 23 nt, Salmonella enterica enterica serovar Typhi
cggagcgcuuuuuuuaugcguua

SEQ ID NO: 1716337 - RNA, 22 nt, Salmonella enterica enterica serovar Typhi
cggagcuaaaccgucauuuacc

SEQ ID NO: 1716338 - RNA, 15 nt, Salmonella enterica enterica serovar Typhi
cggagcuaauaugaa

SEQ ID NO: 1716339 - RNA, 22 nt, Salmonella enterica enterica serovar Typhi
cggaggauauuuauuauuucca

SEQ ID NO: 1716340 - RNA, 15 nt, Salmonella enterica enterica serovar Typhi
cggaggagugcgcca

SEQ ID NO: 1716341 - RNA, 18 nt, Salmonella enterica enterica serovar Typhi
cggaucgaucccggcaaa

SEQ ID NO: 1716342 - RNA, 16 nt, Salmonella enterica enterica serovar Typhi
cggaucgacagcaaug

SEQ ID NO: 1716343 - RNA, 18 nt, Salmonella enterica enterica serovar Typhi
cggauaaggcgcagccgc

SEQ ID NO: 1716344 - RNA, 22 nt, Salmonella enterica enterica serovar Typhi
cggauaaggcgcagccgccauc

SEQ ID NO: 1716345 - RNA, 14 nt, Salmonella enterica enterica serovar Typhi
cggauaaguaaguu

SEQ ID NO: 1716346 - RNA, 15 nt, Salmonella enterica enterica serovar Typhi
cggauaagcaacgcg

SEQ ID NO: 1716347 - RNA, 22 nt, Salmonella enterica enterica serovar Typhi
cggauaaggccacgccgccauc

SEQ ID NO: 1716348 - RNA, 20 nt, Salmonella enterica enterica serovar Typhi
cggauaaacgcugcgcaaca

SEQ ID NO: 1716349 - RNA, 15 nt, Salmonella enterica enterica serovar Typhi
cggauaaaauuauuu

SEQ ID NO: 1716350 - RNA, 13 nt, Salmonella enterica enterica serovar Typhi
cggauaaccgacg

SEQ ID NO: 1716351 - RNA, 16 nt, Salmonella enterica enterica serovar Typhi
cgcagucaagcuugcc

SEQ ID NO: 1716352 - RNA, 14 nt, Salmonella enterica enterica serovar Typhi
cgcagguuuuacuu

SEQ ID NO: 1716353 - RNA, 15 nt, Salmonella enterica enterica serovar Typhi
cgcaguaaucaccgu

SEQ ID NO: 1716354 - RNA, 18 nt, Salmonella enterica enterica serovar Typhi
cgcagucagcacuggcga

SEQ ID NO: 1716355 - RNA, 17 nt, Salmonella enterica enterica serovar Typhi
cgcaguugggcgcgcga

SEQ ID NO: 1716356 - RNA, 22 nt, Salmonella enterica enterica serovar Typhi
cgcaguuugucuucgaugcgcu

SEQ ID NO: 1716357 - RNA, 17 nt, Salmonella enterica enterica serovar Typhi
cgcaguuuguggcgugu

SEQ ID NO: 1716358 - RNA, 14 nt, Salmonella enterica enterica serovar Typhi
cgcauaaaaaauga

SEQ ID NO: 1716359 - RNA, 16 nt, Salmonella enterica enterica serovar Typhi
cgcaggaggcuuccgc

SEQ ID NO: 1716360 - RNA, 19 nt, Salmonella enterica enterica serovar Typhi
cgcaggacuuucgcuucac

SEQ ID NO: 1716361 - RNA, 14 nt, Salmonella enterica enterica serovar Typhi
cgcaggagagccag

SEQ ID NO: 1716362 - RNA, 13 nt, Salmonella enterica enterica serovar Typhi
cgcagcggcugcg

SEQ ID NO: 1716363 - RNA, 21 nt, Salmonella enterica enterica serovar Typhi
cgcagcgcauccaccagaccc

SEQ ID NO: 1716364 - RNA, 14 nt, Salmonella enterica enterica serovar Typhi
cgcagcgccuucgc

SEQ ID NO: 1716365 - RNA, 12 nt, Salmonella enterica enterica serovar Typhi
cgcagcgcggcc

SEQ ID NO: 1716366 - RNA, 13 nt, Salmonella enterica enterica serovar Typhi
cgcagcgcggcgc

SEQ ID NO: 1716367 - RNA, 22 nt, Salmonella enterica enterica serovar Typhi
cgcagcgaaaauccaguaauuu

SEQ ID NO: 1716368 - RNA, 22 nt, Salmonella enterica enterica serovar Typhi
cgcagccccagcgccagccgcg

SEQ ID NO: 1716369 - RNA, 12 nt, Salmonella enterica enterica serovar Typhi
cgcagccccagc

SEQ ID NO: 1716370 - RNA, 13 nt, Salmonella enterica enterica serovar Typhi
cgcagccccagcg

SEQ ID NO: 1716371 - RNA, 15 nt, Salmonella enterica enterica serovar Typhi
cgcagccccagcgcc

SEQ ID NO: 1716372 - RNA, 14 nt, Salmonella enterica enterica serovar Typhi
cgcagccaacaaca

SEQ ID NO: 1716373 - RNA, 20 nt, Salmonella enterica enterica serovar Typhi
cgcagccaacaacaggccgc

SEQ ID NO: 1716374 - RNA, 14 nt, Salmonella enterica enterica serovar Typhi
cgcagaaaaagccc

SEQ ID NO: 1716375 - RNA, 21 nt, Salmonella enterica enterica serovar Typhi
cgcagcaguuggcggagguga

SEQ ID NO: 1716376 - RNA, 12 nt, Salmonella enterica enterica serovar Typhi
cgcacugccuga

SEQ ID NO: 1716377 - RNA, 19 nt, Salmonella enterica enterica serovar Typhi
cgcacugauagccgccagu

SEQ ID NO: 1716378 - RNA, 15 nt, Salmonella enterica enterica serovar Typhi
cgcacuggcgccugc

SEQ ID NO: 1716379 - RNA, 22 nt, Salmonella enterica enterica serovar Typhi
cgcacuggucgggcaggcuucc

SEQ ID NO: 1716380 - RNA, 23 nt, Salmonella enterica enterica serovar Typhi
cgcacagaaucgcuguggcauua

SEQ ID NO: 1716381 - RNA, 12 nt, Salmonella enterica enterica serovar Typhi
cgcacagcgcca

SEQ ID NO: 1716382 - RNA, 15 nt, Salmonella enterica enterica serovar Typhi
cgcacacgccgugca

SEQ ID NO: 1716383 - RNA, 23 nt, Salmonella enterica enterica serovar Typhi
cgcacagcagacaaccgacgcau

SEQ ID NO: 1716384 - RNA, 15 nt, Salmonella enterica enterica serovar Typhi
cgcaccacgccgaag

SEQ ID NO: 1716385 - RNA, 18 nt, Salmonella enterica enterica serovar Typhi
cgcacagggugaaaucac

SEQ ID NO: 1716386 - RNA, 12 nt, Salmonella enterica enterica serovar Typhi
cgcaccagccag

SEQ ID NO: 1716387 - RNA, 21 nt, Salmonella enterica enterica serovar Typhi
cgcacgcgucaucggcgcgcu

SEQ ID NO: 1716388 - RNA, 12 nt, Salmonella enterica enterica serovar Typhi
cgcacgcgcgcc

SEQ ID NO: 1716389 - RNA, 16 nt, Salmonella enterica enterica serovar Typhi
cgcacgccugcggccc

SEQ ID NO: 1716390 - RNA, 14 nt, Salmonella enterica enterica serovar Typhi
cgcacuccagaugc

SEQ ID NO: 1716391 - RNA, 14 nt, Salmonella enterica enterica serovar Typhi
cgcaaucacauaca

SEQ ID NO: 1716392 - RNA, 21 nt, Salmonella enterica enterica serovar Typhi
cgcaauaaguucaaacucauu

SEQ ID NO: 1716393 - RNA, 13 nt, Salmonella enterica enterica serovar Typhi
cgcaacgcgcacg

SEQ ID NO: 1716394 - RNA, 17 nt, Salmonella enterica enterica serovar Typhi
cgcaacgcgcaucaacg

SEQ ID NO: 1716395 - RNA, 23 nt, Salmonella enterica enterica serovar Typhi
cgcaacgcuuaucaguccccaca

SEQ ID NO: 1716396 - RNA, 16 nt, Salmonella enterica enterica serovar Typhi
cgcaacgucagcgauc

SEQ ID NO: 1716397 - RNA, 14 nt, Salmonella enterica enterica serovar Typhi
cgcaacugaaacca

SEQ ID NO: 1716398 - RNA, 23 nt, Salmonella enterica enterica serovar Typhi
cgcaacguguaggcccgguaagc

SEQ ID NO: 1716399 - RNA, 16 nt, Salmonella enterica enterica serovar Typhi
cgauucaaucugguga

SEQ ID NO: 1716400 - RNA, 17 nt, Salmonella enterica enterica serovar Typhi
cgcaaacagcacgcccu

SEQ ID NO: 1716401 - RNA, 16 nt, Salmonella enterica enterica serovar Typhi
cgcaaaauucacacca

SEQ ID NO: 1716402 - RNA, 16 nt, Salmonella enterica enterica serovar Typhi
cgcaaaggaccaacac

SEQ ID NO: 1716403 - RNA, 16 nt, Salmonella enterica enterica serovar Typhi
cgcaaacugcgcgccc

SEQ ID NO: 1716404 - RNA, 22 nt, Salmonella enterica enterica serovar Typhi
cgcaaaguuuucuuccgugccg

SEQ ID NO: 1716405 - RNA, 17 nt, Salmonella enterica enterica serovar Typhi
cgcaaacuggccacagc

SEQ ID NO: 1716406 - RNA, 21 nt, Salmonella enterica enterica serovar Typhi
cgcaaacgccgugaacgccaa

SEQ ID NO: 1716407 - RNA, 12 nt, Salmonella enterica enterica serovar Typhi
cgcaaaccgcuu

SEQ ID NO: 1716408 - RNA, 15 nt, Salmonella enterica enterica serovar Typhi
cgcaaacaguacgcc

SEQ ID NO: 1716409 - RNA, 20 nt, Salmonella enterica enterica serovar Typhi
cgauggcgauuuucaccggc

SEQ ID NO: 1716410 - RNA, 15 nt, Salmonella enterica enterica serovar Typhi
cgauggcgcuccuga

SEQ ID NO: 1716411 - RNA, 13 nt, Salmonella enterica enterica serovar Typhi
cgauggugccgac

SEQ ID NO: 1716412 - RNA, 20 nt, Salmonella enterica enterica serovar Typhi
cgauggugcggcgcacugcc

SEQ ID NO: 1716413 - RNA, 14 nt, Salmonella enterica enterica serovar Typhi
cgaugcggauccgg

SEQ ID NO: 1716414 - RNA, 23 nt, Salmonella enterica enterica serovar Typhi
cgaugcgguucaacgcgcugcag

SEQ ID NO: 1716415 - RNA, 23 nt, Salmonella enterica enterica serovar Typhi
cgaugcucaaccaguaccgggcc

SEQ ID NO: 1716416 - RNA, 20 nt, Salmonella enterica enterica serovar Typhi
cgauggccuguuuaagcuuu

SEQ ID NO: 1716417 - RNA, 16 nt, Salmonella enterica enterica serovar Typhi
cgaugaguucaguaug

SEQ ID NO: 1716418 - RNA, 20 nt, Salmonella enterica enterica serovar Typhi
cgaugacucguauuuaaacc

SEQ ID NO: 1716419 - RNA, 19 nt, Salmonella enterica enterica serovar Typhi
cgaugagcgccagcaacag

SEQ ID NO: 1716420 - RNA, 22 nt, Salmonella enterica enterica serovar Typhi
cgaugagcucguuauaagcuuu

SEQ ID NO: 1716421 - RNA, 18 nt, Salmonella enterica enterica serovar Typhi
cgaugaucgaggcgugcg

SEQ ID NO: 1716422 - RNA, 14 nt, Salmonella enterica enterica serovar Typhi
cgaugcaaccccug

SEQ ID NO: 1716423 - RNA, 20 nt, Salmonella enterica enterica serovar Typhi
cgaugauuuucaagccaaaa

SEQ ID NO: 1716424 - RNA, 21 nt, Salmonella enterica enterica serovar Typhi
cgaugauuauuguuaaaaaga

SEQ ID NO: 1716425 - RNA, 15 nt, Salmonella enterica enterica serovar Typhi
cgaugcgcuuuucca

SEQ ID NO: 1716426 - RNA, 19 nt, Salmonella enterica enterica serovar Typhi
cgaugcgcguuuuccacca

SEQ ID NO: 1716427 - RNA, 22 nt, Salmonella enterica enterica serovar Typhi
cgaucgcgccaucgauagucau

SEQ ID NO: 1716428 - RNA, 18 nt, Salmonella enterica enterica serovar Typhi
cgaucguagcaucucuuc

SEQ ID NO: 1716429 - RNA, 19 nt, Salmonella enterica enterica serovar Typhi
cgaucucauaaacgccugg

SEQ ID NO: 1716430 - RNA, 14 nt, Salmonella enterica enterica serovar Typhi
cgaugacgacuuuu

SEQ ID NO: 1716431 - RNA, 15 nt, Salmonella enterica enterica serovar Typhi
cgaugacgacuuuuu

SEQ ID NO: 1716432 - RNA, 17 nt, Salmonella enterica enterica serovar Typhi
cgaugagauaauaaaug

SEQ ID NO: 1716433 - RNA, 14 nt, Salmonella enterica enterica serovar Typhi
cgaugacucccagu

SEQ ID NO: 1716434 - RNA, 14 nt, Salmonella enterica enterica serovar Typhi
cgaugaaaaagagg

SEQ ID NO: 1716435 - RNA, 12 nt, Salmonella enterica enterica serovar Typhi
cgaucugagcgc

SEQ ID NO: 1716436 - RNA, 12 nt, Salmonella enterica enterica serovar Typhi
cgaucugugucg

SEQ ID NO: 1716437 - RNA, 20 nt, Salmonella enterica enterica serovar Typhi
cgaucuguacggcauauucc

SEQ ID NO: 1716438 - RNA, 19 nt, Salmonella enterica enterica serovar Typhi
cgaucugguuauccaccag

SEQ ID NO: 1716439 - RNA, 19 nt, Salmonella enterica enterica serovar Typhi
cgaucugugucguccaggc

SEQ ID NO: 1716440 - RNA, 14 nt, Salmonella enterica enterica serovar Typhi
cgauauauuuuccg

SEQ ID NO: 1716441 - RNA, 22 nt, Salmonella enterica enterica serovar Typhi
cgauauauuuuccguccaccug

SEQ ID NO: 1716442 - RNA, 19 nt, Salmonella enterica enterica serovar Typhi
cgaucagcgccaccacaaa

SEQ ID NO: 1716443 - RNA, 15 nt, Salmonella enterica enterica serovar Typhi
cgaucaugccgccca

SEQ ID NO: 1716444 - RNA, 19 nt, Salmonella enterica enterica serovar Typhi
cgaucaucccgcccagcaa

SEQ ID NO: 1716445 - RNA, 23 nt, Salmonella enterica enterica serovar Typhi
cgaucgagucaggcgccagaguc

SEQ ID NO: 1716446 - RNA, 15 nt, Salmonella enterica enterica serovar Typhi
cgauccagccccagc

SEQ ID NO: 1716447 - RNA, 23 nt, Salmonella enterica enterica serovar Typhi
cgauccccucuuccaucagccag

SEQ ID NO: 1716448 - RNA, 22 nt, Salmonella enterica enterica serovar Typhi
cgaucccggcaaaaaucagccc

SEQ ID NO: 1716449 - RNA, 22 nt, Salmonella enterica enterica serovar Typhi
cgaucccaguugaucggccagc

SEQ ID NO: 1716450 - RNA, 16 nt, Salmonella enterica enterica serovar Typhi
cgauccgaagaacaga

SEQ ID NO: 1716451 - RNA, 14 nt, Salmonella enterica enterica serovar Typhi
cgaucccuaauaaa

SEQ ID NO: 1716452 - RNA, 23 nt, Salmonella enterica enterica serovar Typhi
ccuucauaaugaauacgcuccag

SEQ ID NO: 1716453 - RNA, 12 nt, Salmonella enterica enterica serovar Typhi
ccuucauaaaua

SEQ ID NO: 1716454 - RNA, 22 nt, Salmonella enterica enterica serovar Typhi
ccuucagugauaaagcacagcc

SEQ ID NO: 1716455 - RNA, 21 nt, Salmonella enterica enterica serovar Typhi
ccuucauuguccucggcaaca

SEQ ID NO: 1716456 - RNA, 23 nt, Salmonella enterica enterica serovar Typhi
ccuucauucagaucaaaaaucug

SEQ ID NO: 1716457 - RNA, 14 nt, Salmonella enterica enterica serovar Typhi
cgauaaacagauau

SEQ ID NO: 1716458 - RNA, 15 nt, Salmonella enterica enterica serovar Typhi
cgauaaaccaggcag

SEQ ID NO: 1716459 - RNA, 17 nt, Salmonella enterica enterica serovar Typhi
cgauaaaccuucguaau

SEQ ID NO: 1716460 - RNA, 23 nt, Salmonella enterica enterica serovar Typhi
cgauaaagaacgcgccgaccauu

SEQ ID NO: 1716461 - RNA, 17 nt, Salmonella enterica enterica serovar Typhi
cgauaaaguggcauccg

SEQ ID NO: 1716462 - RNA, 14 nt, Salmonella enterica enterica serovar Typhi
cgauaaauaagaag

SEQ ID NO: 1716463 - RNA, 14 nt, Salmonella enterica enterica serovar Typhi
cgauaacgcagcgc

SEQ ID NO: 1716464 - RNA, 13 nt, Salmonella enterica enterica serovar Typhi
cgauaaagacagg

SEQ ID NO: 1716465 - RNA, 17 nt, Salmonella enterica enterica serovar Typhi
cgauaacgaccagauac

SEQ ID NO: 1716466 - RNA, 22 nt, Salmonella enterica enterica serovar Typhi
cgauaaccggacgauuuaagcu

SEQ ID NO: 1716467 - RNA, 14 nt, Salmonella enterica enterica serovar Typhi
cgauaaccaccagc

SEQ ID NO: 1716468 - RNA, 21 nt, Salmonella enterica enterica serovar Typhi
cgauaaccaugcucagcggcg

SEQ ID NO: 1716469 - RNA, 18 nt, Salmonella enterica enterica serovar Typhi
cgauaaccucucaccgcc

SEQ ID NO: 1716470 - RNA, 19 nt, Salmonella enterica enterica serovar Typhi
cgauaaccuguaaauaaua

SEQ ID NO: 1716471 - RNA, 22 nt, Salmonella enterica enterica serovar Typhi
cgauauaagcgccgucauccgc

SEQ ID NO: 1716472 - RNA, 17 nt, Salmonella enterica enterica serovar Typhi
cgauauagcgcugaagu

SEQ ID NO: 1716473 - RNA, 19 nt, Salmonella enterica enterica serovar Typhi
cgauauaucgcgucaucaa

SEQ ID NO: 1716474 - RNA, 20 nt, Salmonella enterica enterica serovar Typhi
cgauauaccacccgcuauga

SEQ ID NO: 1716475 - RNA, 19 nt, Salmonella enterica enterica serovar Typhi
cgauagagaccgcuuuagc

SEQ ID NO: 1716476 - RNA, 13 nt, Salmonella enterica enterica serovar Typhi
cgauagaccacgc

SEQ ID NO: 1716477 - RNA, 22 nt, Salmonella enterica enterica serovar Typhi
cgauacuccauugucggcagcg

SEQ ID NO: 1716478 - RNA, 21 nt, Salmonella enterica enterica serovar Typhi
cgauacuaaaacuuuaacacu

SEQ ID NO: 1716479 - RNA, 22 nt, Salmonella enterica enterica serovar Typhi
cgauacucacgacuuucaccag

SEQ ID NO: 1716480 - RNA, 12 nt, Salmonella enterica enterica serovar Typhi
cgccccacuggc

SEQ ID NO: 1716481 - RNA, 21 nt, Salmonella enterica enterica serovar Typhi
cgccccagcaugagccagccc

SEQ ID NO: 1716482 - RNA, 23 nt, Salmonella enterica enterica serovar Typhi
cgccccagcaugagccagcccuc

SEQ ID NO: 1716483 - RNA, 21 nt, Salmonella enterica enterica serovar Typhi
cgccccacuuucaccuccgcu

SEQ ID NO: 1716484 - RNA, 22 nt, Salmonella enterica enterica serovar Typhi
cgccccagaagagcgagucuuu

SEQ ID NO: 1716485 - RNA, 20 nt, Salmonella enterica enterica serovar Typhi
cgcccauuaauaucagcccc

SEQ ID NO: 1716486 - RNA, 21 nt, Salmonella enterica enterica serovar Typhi
cgcccauuaauaucagcccca

SEQ ID NO: 1716487 - RNA, 21 nt, Salmonella enterica enterica serovar Typhi
cgcccauuccgccugccgcgc

SEQ ID NO: 1716488 - RNA, 12 nt, Salmonella enterica enterica serovar Typhi
cgccccaaagcg

SEQ ID NO: 1716489 - RNA, 13 nt, Salmonella enterica enterica serovar Typhi
cgcccccuccagu

SEQ ID NO: 1716490 - RNA, 13 nt, Salmonella enterica enterica serovar Typhi
cgcccccugccag

SEQ ID NO: 1716491 - RNA, 18 nt, Salmonella enterica enterica serovar Typhi
cgccccgccgcgcggccc

SEQ ID NO: 1716492 - RNA, 14 nt, Salmonella enterica enterica serovar Typhi
cgccccgcuucccg

SEQ ID NO: 1716493 - RNA, 20 nt, Salmonella enterica enterica serovar Typhi
cgcccgguaaacgcgccauc

SEQ ID NO: 1716494 - RNA, 17 nt, Salmonella enterica enterica serovar Typhi
cgcccggaucacggccu

SEQ ID NO: 1716495 - RNA, 14 nt, Salmonella enterica enterica serovar Typhi
cgcccgccgccagc

SEQ ID NO: 1716496 - RNA, 13 nt, Salmonella enterica enterica serovar Typhi
cgcccgccgcgaa

SEQ ID NO: 1716497 - RNA, 14 nt, Salmonella enterica enterica serovar Typhi
cgcccgccaccagc

SEQ ID NO: 1716498 - RNA, 11 nt, Salmonella enterica enterica serovar Typhi
cgcccgccaga

SEQ ID NO: 1716499 - RNA, 14 nt, Salmonella enterica enterica serovar Typhi
cgccauccggcaac

SEQ ID NO: 1716500 - RNA, 23 nt, Salmonella enterica enterica serovar Typhi
cgccauccuuaauugccgcacgc

SEQ ID NO: 1716501 - RNA, 15 nt, Salmonella enterica enterica serovar Typhi
cgccauccugcaccg

SEQ ID NO: 1716502 - RNA, 13 nt, Salmonella enterica enterica serovar Typhi
cgccauccggccu

SEQ ID NO: 1716503 - RNA, 14 nt, Salmonella enterica enterica serovar Typhi
cgccauccggccug

SEQ ID NO: 1716504 - RNA, 23 nt, Salmonella enterica enterica serovar Typhi
cgccauccggccuguaaggucuc

SEQ ID NO: 1716505 - RNA, 22 nt, Salmonella enterica enterica serovar Typhi
cgccauccgguaaacgugcugg

SEQ ID NO: 1716506 - RNA, 17 nt, Salmonella enterica enterica serovar Typhi
cgccaucagcaaaauac

SEQ ID NO: 1716507 - RNA, 20 nt, Salmonella enterica enterica serovar Typhi
cgccaucaauuuugcgccua

SEQ ID NO: 1716508 - RNA, 17 nt, Salmonella enterica enterica serovar Typhi
cgccaucaggcauaaac

SEQ ID NO: 1716509 - RNA, 15 nt, Salmonella enterica enterica serovar Typhi
cgccaucaggcaugc

SEQ ID NO: 1716510 - RNA, 21 nt, Salmonella enterica enterica serovar Typhi
cgccaucaugcccacaggcag

SEQ ID NO: 1716511 - RNA, 12 nt, Salmonella enterica enterica serovar Typhi
cgccauccacgg

SEQ ID NO: 1716512 - RNA, 17 nt, Salmonella enterica enterica serovar Typhi
cgccaucaggcaaucuu

SEQ ID NO: 1716513 - RNA, 21 nt, Salmonella enterica enterica serovar Typhi
cgccaucaggcaugccaaacc

SEQ ID NO: 1716514 - RNA, 19 nt, Salmonella enterica enterica serovar Typhi
cgccaucaggcuggguaac

SEQ ID NO: 1716515 - RNA, 23 nt, Salmonella enterica enterica serovar Typhi
cgccaucaguucggcgcgccagc

SEQ ID NO: 1716516 - RNA, 14 nt, Salmonella enterica enterica serovar Typhi
cgccaucgccgccu

SEQ ID NO: 1716517 - RNA, 17 nt, Salmonella enterica enterica serovar Typhi
cgccaucggcgagcggc

SEQ ID NO: 1716518 - RNA, 21 nt, Salmonella enterica enterica serovar Typhi
cgccaugaccugggcgccaga

SEQ ID NO: 1716519 - RNA, 18 nt, Salmonella enterica enterica serovar Typhi
cgccaugauucaucccgc

SEQ ID NO: 1716520 - RNA, 15 nt, Salmonella enterica enterica serovar Typhi
cgccaucuccuccuc

SEQ ID NO: 1716521 - RNA, 16 nt, Salmonella enterica enterica serovar Typhi
cgccaucuucacgcag

SEQ ID NO: 1716522 - RNA, 15 nt, Salmonella enterica enterica serovar Typhi
cgccaucuucacgca

SEQ ID NO: 1716523 - RNA, 13 nt, Salmonella enterica enterica serovar Typhi
cgccaucuuucuu

SEQ ID NO: 1716524 - RNA, 16 nt, Salmonella enterica enterica serovar Typhi
cgccauuugcgcggcu

SEQ ID NO: 1716525 - RNA, 22 nt, Salmonella enterica enterica serovar Typhi
cgcccacaggcugcggcacgcu

SEQ ID NO: 1716526 - RNA, 17 nt, Salmonella enterica enterica serovar Typhi
cgccauucccgcgacgu

SEQ ID NO: 1716527 - RNA, 18 nt, Salmonella enterica enterica serovar Typhi
cgccauucucuucuacca

SEQ ID NO: 1716528 - RNA, 18 nt, Salmonella enterica enterica serovar Typhi
cgccauuccugccgccgc

SEQ ID NO: 1716529 - RNA, 22 nt, Salmonella enterica enterica serovar Typhi
cgccaugccaucggccagcagg

SEQ ID NO: 1716530 - RNA, 19 nt, Salmonella enterica enterica serovar Typhi
cgccaugcggaaucacgca

SEQ ID NO: 1716531 - RNA, 17 nt, Salmonella enterica enterica serovar Typhi
cgcccagcacuaacagc

SEQ ID NO: 1716532 - RNA, 16 nt, Salmonella enterica enterica serovar Typhi
cgcccagaucaggccc

SEQ ID NO: 1716533 - RNA, 16 nt, Salmonella enterica enterica serovar Typhi
cgcccacgcggcgugc

SEQ ID NO: 1716534 - RNA, 21 nt, Salmonella enterica enterica serovar Typhi
cgcccagcguacguaacuucu

SEQ ID NO: 1716535 - RNA, 14 nt, Salmonella enterica enterica serovar Typhi
cgcccaggcgggua

SEQ ID NO: 1716536 - RNA, 13 nt, Salmonella enterica enterica serovar Typhi
cgcccaggccuga

SEQ ID NO: 1716537 - RNA, 19 nt, Salmonella enterica enterica serovar Typhi
cgcccagucaucauaauuc

SEQ ID NO: 1716538 - RNA, 13 nt, Salmonella enterica enterica serovar Typhi
cgcccauccagag

SEQ ID NO: 1716539 - RNA, 15 nt, Salmonella enterica enterica serovar Typhi
cgcccaucacaugua

SEQ ID NO: 1716540 - RNA, 15 nt, Salmonella enterica enterica serovar Typhi
cgcccaucccgaugg

SEQ ID NO: 1716541 - RNA, 19 nt, Salmonella enterica enterica serovar Typhi
cgccagccagcucaccagc

SEQ ID NO: 1716542 - RNA, 15 nt, Salmonella enterica enterica serovar Typhi
cgccagccagcgcca

SEQ ID NO: 1716543 - RNA, 15 nt, Salmonella enterica enterica serovar Typhi
cgccagccacugacu

SEQ ID NO: 1716544 - RNA, 20 nt, Salmonella enterica enterica serovar Typhi
cgccagcaucggcagcgcca

SEQ ID NO: 1716545 - RNA, 13 nt, Salmonella enterica enterica serovar Typhi
cgccagcauggcg

SEQ ID NO: 1716546 - RNA, 14 nt, Salmonella enterica enterica serovar Typhi
cgccagcauuucaa

SEQ ID NO: 1716547 - RNA, 11 nt, Salmonella enterica enterica serovar Typhi
cgccagcagcg

SEQ ID NO: 1716548 - RNA, 16 nt, Salmonella enterica enterica serovar Typhi
cgccagcaccagcagc

SEQ ID NO: 1716549 - RNA, 23 nt, Salmonella enterica enterica serovar Typhi
cgccagccgcgccaucuccuccu

SEQ ID NO: 1716550 - RNA, 14 nt, Salmonella enterica enterica serovar Typhi
cgccagccgcgcca

SEQ ID NO: 1716551 - RNA, 14 nt, Salmonella enterica enterica serovar Typhi
cgccacgucggcga

SEQ ID NO: 1716552 - RNA, 21 nt, Salmonella enterica enterica serovar Typhi
cgccacgauagacagcaccau

SEQ ID NO: 1716553 - RNA, 21 nt, Salmonella enterica enterica serovar Typhi
cgccagcaccacuacuacacc

SEQ ID NO: 1716554 - RNA, 14 nt, Salmonella enterica enterica serovar Typhi
cgccagcaccaggc

SEQ ID NO: 1716555 - RNA, 20 nt, Salmonella enterica enterica serovar Typhi
cgccacaauauccgccccgc

SEQ ID NO: 1716556 - RNA, 15 nt, Salmonella enterica enterica serovar Typhi
cgccaauugaugaac

SEQ ID NO: 1716557 - RNA, 16 nt, Salmonella enterica enterica serovar Typhi
cgccaauuaaauaucc

SEQ ID NO: 1716558 - RNA, 13 nt, Salmonella enterica enterica serovar Typhi
cgcauaaccgauu

SEQ ID NO: 1716559 - RNA, 16 nt, Salmonella enterica enterica serovar Typhi
cgcauaauccagcagg

SEQ ID NO: 1716560 - RNA, 22 nt, Salmonella enterica enterica serovar Typhi
cgcauacaucgcagacauggca

SEQ ID NO: 1716561 - RNA, 18 nt, Salmonella enterica enterica serovar Typhi
cgccacaauauccgcccc

SEQ ID NO: 1716562 - RNA, 17 nt, Salmonella enterica enterica serovar Typhi
cgccacaccgagacaga

SEQ ID NO: 1716563 - RNA, 23 nt, Salmonella enterica enterica serovar Typhi
cgccacaccgagacagagaaccu

SEQ ID NO: 1716564 - RNA, 16 nt, Salmonella enterica enterica serovar Typhi
cgccaccaaagccagg

SEQ ID NO: 1716565 - RNA, 14 nt, Salmonella enterica enterica serovar Typhi
cgccacauucaauu

SEQ ID NO: 1716566 - RNA, 12 nt, Salmonella enterica enterica serovar Typhi
cgccaccaaaaa

SEQ ID NO: 1716567 - RNA, 20 nt, Salmonella enterica enterica serovar Typhi
cgccaccggguuaaagcccu

SEQ ID NO: 1716568 - RNA, 22 nt, Salmonella enterica enterica serovar Typhi
cgccaccgggccgucagggucu

SEQ ID NO: 1716569 - RNA, 19 nt, Salmonella enterica enterica serovar Typhi
cgccaccguaacuacaaua

SEQ ID NO: 1716570 - RNA, 22 nt, Salmonella enterica enterica serovar Typhi
cgccaccugaauaacccgcagc

SEQ ID NO: 1716571 - RNA, 22 nt, Salmonella enterica enterica serovar Typhi
cgccaccuguuucgccaggccg

SEQ ID NO: 1716572 - RNA, 14 nt, Salmonella enterica enterica serovar Typhi
cgccaccgcgcgcu

SEQ ID NO: 1716573 - RNA, 15 nt, Salmonella enterica enterica serovar Typhi
cgccaccgcgcgcuu

SEQ ID NO: 1716574 - RNA, 22 nt, Salmonella enterica enterica serovar Typhi
cgccaccgggcaacacacgcuu

SEQ ID NO: 1716575 - RNA, 13 nt, Salmonella enterica enterica serovar Typhi
cgccaccacgccg

SEQ ID NO: 1716576 - RNA, 19 nt, Salmonella enterica enterica serovar Typhi
cgccaguaggaauauacca

SEQ ID NO: 1716577 - RNA, 16 nt, Salmonella enterica enterica serovar Typhi
cgccaguaaucggcgc

SEQ ID NO: 1716578 - RNA, 23 nt, Salmonella enterica enterica serovar Typhi
cgccaguaauuuuucucccagca

SEQ ID NO: 1716579 - RNA, 13 nt, Salmonella enterica enterica serovar Typhi
cgccagucacccu

SEQ ID NO: 1716580 - RNA, 23 nt, Salmonella enterica enterica serovar Typhi
cgccagucauuaauucccgcagc

SEQ ID NO: 1716581 - RNA, 15 nt, Salmonella enterica enterica serovar Typhi
cgccagucccagcac

SEQ ID NO: 1716582 - RNA, 18 nt, Salmonella enterica enterica serovar Typhi
cgccagugaauccaccac

SEQ ID NO: 1716583 - RNA, 16 nt, Salmonella enterica enterica serovar Typhi
cgccagugaauccacc

SEQ ID NO: 1716584 - RNA, 22 nt, Salmonella enterica enterica serovar Typhi
cgccaggucucauagcgcccca

SEQ ID NO: 1716585 - RNA, 16 nt, Salmonella enterica enterica serovar Typhi
cgccauacuuacugcu

SEQ ID NO: 1716586 - RNA, 18 nt, Salmonella enterica enterica serovar Typhi
cgccauaauuguucagcu

SEQ ID NO: 1716587 - RNA, 19 nt, Salmonella enterica enterica serovar Typhi
cgccauaauacuuaauuca

SEQ ID NO: 1716588 - RNA, 23 nt, Salmonella enterica enterica serovar Typhi
cgccauaauacuuaauucauaac

SEQ ID NO: 1716589 - RNA, 22 nt, Salmonella enterica enterica serovar Typhi
cgccauaagaauguccccauau

SEQ ID NO: 1716590 - RNA, 21 nt, Salmonella enterica enterica serovar Typhi
cgccauaaaucagauccacgc

SEQ ID NO: 1716591 - RNA, 23 nt, Salmonella enterica enterica serovar Typhi
cgccauauauuuacugaauaaau

SEQ ID NO: 1716592 - RNA, 17 nt, Salmonella enterica enterica serovar Typhi
cgccauauccccgccau

SEQ ID NO: 1716593 - RNA, 15 nt, Salmonella enterica enterica serovar Typhi
cgccauauccgcaga

SEQ ID NO: 1716594 - RNA, 12 nt, Salmonella enterica enterica serovar Typhi
cgccaucaccag

SEQ ID NO: 1716595 - RNA, 20 nt, Salmonella enterica enterica serovar Typhi
cgccaguucccacagcuuca

SEQ ID NO: 1716596 - RNA, 23 nt, Salmonella enterica enterica serovar Typhi
cgccaguuuuugcgccauugccg

SEQ ID NO: 1716597 - RNA, 22 nt, Salmonella enterica enterica serovar Typhi
cgccauaaaaaacaccugucug

SEQ ID NO: 1716598 - RNA, 17 nt, Salmonella enterica enterica serovar Typhi
cgccaguuucuuuuucc

SEQ ID NO: 1716599 - RNA, 22 nt, Salmonella enterica enterica serovar Typhi
cgccaguucauucgccaccagg

SEQ ID NO: 1716600 - RNA, 17 nt, Salmonella enterica enterica serovar Typhi
cgccaguuccaucauug

SEQ ID NO: 1716601 - RNA, 16 nt, Salmonella enterica enterica serovar Typhi
cgccaguuauucgacu

SEQ ID NO: 1716602 - RNA, 15 nt, Salmonella enterica enterica serovar Typhi
cgccaggccauugcu

SEQ ID NO: 1716603 - RNA, 18 nt, Salmonella enterica enterica serovar Typhi
cgccaggcccagccgcuc

SEQ ID NO: 1716604 - RNA, 19 nt, Salmonella enterica enterica serovar Typhi
cgccaggcggguggugagc

SEQ ID NO: 1716605 - RNA, 15 nt, Salmonella enterica enterica serovar Typhi
cgccaggcgcugcgu

SEQ ID NO: 1716606 - RNA, 17 nt, Salmonella enterica enterica serovar Typhi
cgccaggauaauaauga

SEQ ID NO: 1716607 - RNA, 20 nt, Salmonella enterica enterica serovar Typhi
cgccaggaaccgcggucggc

SEQ ID NO: 1716608 - RNA, 21 nt, Salmonella enterica enterica serovar Typhi
cgccaggaaccgcggucggca

SEQ ID NO: 1716609 - RNA, 14 nt, Salmonella enterica enterica serovar Typhi
cgccagcggcugcu

SEQ ID NO: 1716610 - RNA, 17 nt, Salmonella enterica enterica serovar Typhi
cgccagcgggccgguaa

SEQ ID NO: 1716611 - RNA, 20 nt, Salmonella enterica enterica serovar Typhi
cgccagcgcuacccgcugac

SEQ ID NO: 1716612 - RNA, 13 nt, Salmonella enterica enterica serovar Typhi
cgccagcggcgcc

SEQ ID NO: 1716613 - RNA, 21 nt, Salmonella enterica enterica serovar Typhi
cgccagcggcgccaucaccau

SEQ ID NO: 1716614 - RNA, 15 nt, Salmonella enterica enterica serovar Typhi
cgccagcgccucuuc

SEQ ID NO: 1716615 - RNA, 14 nt, Salmonella enterica enterica serovar Typhi
cgccagcgccaccu

SEQ ID NO: 1716616 - RNA, 19 nt, Salmonella enterica enterica serovar Typhi
cgccagcgagaugaaaagu

SEQ ID NO: 1716617 - RNA, 13 nt, Salmonella enterica enterica serovar Typhi
cgccagcgccgga

SEQ ID NO: 1716618 - RNA, 14 nt, Salmonella enterica enterica serovar Typhi
cgccgauacugccc

SEQ ID NO: 1716619 - RNA, 18 nt, Salmonella enterica enterica serovar Typhi
cgccgauaaauccuccgg

SEQ ID NO: 1716620 - RNA, 21 nt, Salmonella enterica enterica serovar Typhi
cgccgauaaccagcgcgccgc

SEQ ID NO: 1716621 - RNA, 16 nt, Salmonella enterica enterica serovar Typhi
cgccgaguagcugagc

SEQ ID NO: 1716622 - RNA, 19 nt, Salmonella enterica enterica serovar Typhi
cgccgaggcuaagccagaa

SEQ ID NO: 1716623 - RNA, 18 nt, Salmonella enterica enterica serovar Typhi
cgccgaggcuaagccaga

SEQ ID NO: 1716624 - RNA, 22 nt, Salmonella enterica enterica serovar Typhi
cgccgccaaacugcgcgccgcc

SEQ ID NO: 1716625 - RNA, 15 nt, Salmonella enterica enterica serovar Typhi
cgccgcaggguauau

SEQ ID NO: 1716626 - RNA, 19 nt, Salmonella enterica enterica serovar Typhi
cgccgcaaacgccgagccg

SEQ ID NO: 1716627 - RNA, 21 nt, Salmonella enterica enterica serovar Typhi
cgccgauuaaugcuccaauaa

SEQ ID NO: 1716628 - RNA, 22 nt, Salmonella enterica enterica serovar Typhi
cgccgcaauuccugacugcgcg

SEQ ID NO: 1716629 - RNA, 18 nt, Salmonella enterica enterica serovar Typhi
cgccgcaaugccgccugc

SEQ ID NO: 1716630 - RNA, 18 nt, Salmonella enterica enterica serovar Typhi
cgccgcaggccaucauac

SEQ ID NO: 1716631 - RNA, 16 nt, Salmonella enterica enterica serovar Typhi
cgccgcagcuccaugu

SEQ ID NO: 1716632 - RNA, 13 nt, Salmonella enterica enterica serovar Typhi
cgccgccggcgag

SEQ ID NO: 1716633 - RNA, 13 nt, Salmonella enterica enterica serovar Typhi
cgccgccgggccg

SEQ ID NO: 1716634 - RNA, 23 nt, Salmonella enterica enterica serovar Typhi
cgccgcccaucgggccgcucagc

SEQ ID NO: 1716635 - RNA, 13 nt, Salmonella enterica enterica serovar Typhi
cgccgccaggucu

SEQ ID NO: 1716636 - RNA, 14 nt, Salmonella enterica enterica serovar Typhi
cgccgccaucaacg

SEQ ID NO: 1716637 - RNA, 14 nt, Salmonella enterica enterica serovar Typhi
cgccgccaucggcg

SEQ ID NO: 1716638 - RNA, 21 nt, Salmonella enterica enterica serovar Typhi
cgccgccaccauguugcgcag

SEQ ID NO: 1716639 - RNA, 22 nt, Salmonella enterica enterica serovar Typhi
cgccgccagaaucaccucuuuc

SEQ ID NO: 1716640 - RNA, 14 nt, Salmonella enterica enterica serovar Typhi
cgccgccagcaccg

SEQ ID NO: 1716641 - RNA, 13 nt, Salmonella enterica enterica serovar Typhi
cgccgccagccga

SEQ ID NO: 1716642 - RNA, 17 nt, Salmonella enterica enterica serovar Typhi
cgccgacucacgcagcg

SEQ ID NO: 1716643 - RNA, 16 nt, Salmonella enterica enterica serovar Typhi
cgccgacucacgcagc

SEQ ID NO: 1716644 - RNA, 15 nt, Salmonella enterica enterica serovar Typhi
cgccgagccgcccuu

SEQ ID NO: 1716645 - RNA, 13 nt, Salmonella enterica enterica serovar Typhi
cgccgagccgccc

SEQ ID NO: 1716646 - RNA, 13 nt, Salmonella enterica enterica serovar Typhi
cgccgaacacgca

SEQ ID NO: 1716647 - RNA, 16 nt, Salmonella enterica enterica serovar Typhi
cgccgaaauuuucccg

SEQ ID NO: 1716648 - RNA, 19 nt, Salmonella enterica enterica serovar Typhi
cgccgaacaacacggcggc

SEQ ID NO: 1716649 - RNA, 23 nt, Salmonella enterica enterica serovar Typhi
cgcccuuuuaguucaaccugcgc

SEQ ID NO: 1716650 - RNA, 15 nt, Salmonella enterica enterica serovar Typhi
cgccgaagcggcagu

SEQ ID NO: 1716651 - RNA, 12 nt, Salmonella enterica enterica serovar Typhi
cgccgaagugug

SEQ ID NO: 1716652 - RNA, 15 nt, Salmonella enterica enterica serovar Typhi
cgccgaagccagcgc

SEQ ID NO: 1716653 - RNA, 23 nt, Salmonella enterica enterica serovar Typhi
cgccgaccauuggcaccaccagg

SEQ ID NO: 1716654 - RNA, 19 nt, Salmonella enterica enterica serovar Typhi
cgccgacccccuccuugua

SEQ ID NO: 1716655 - RNA, 20 nt, Salmonella enterica enterica serovar Typhi
cgccgacauucccugcgcau

SEQ ID NO: 1716656 - RNA, 16 nt, Salmonella enterica enterica serovar Typhi
cgccgacaugguuaac

SEQ ID NO: 1716657 - RNA, 17 nt, Salmonella enterica enterica serovar Typhi
cgccgacauucccugcg

SEQ ID NO: 1716658 - RNA, 21 nt, Salmonella enterica enterica serovar Typhi
cgccgaccacuucaacgccgc

SEQ ID NO: 1716659 - RNA, 15 nt, Salmonella enterica enterica serovar Typhi
cgccgacaccggccu

SEQ ID NO: 1716660 - RNA, 21 nt, Salmonella enterica enterica serovar Typhi
cgccgacauaagugcaggcug

SEQ ID NO: 1716661 - RNA, 22 nt, Salmonella enterica enterica serovar Typhi
cgcccucaagacgguuauuuuu

SEQ ID NO: 1716662 - RNA, 16 nt, Salmonella enterica enterica serovar Typhi
cgcccugaagggcggc

SEQ ID NO: 1716663 - RNA, 15 nt, Salmonella enterica enterica serovar Typhi
cgcccucgccacggu

SEQ ID NO: 1716664 - RNA, 19 nt, Salmonella enterica enterica serovar Typhi
cgcccuguauacaggcaug

SEQ ID NO: 1716665 - RNA, 21 nt, Salmonella enterica enterica serovar Typhi
cgcccuguauacaggcauggc

SEQ ID NO: 1716666 - RNA, 15 nt, Salmonella enterica enterica serovar Typhi
cgcccuguccuccau

SEQ ID NO: 1716667 - RNA, 15 nt, Salmonella enterica enterica serovar Typhi
cgcccuuccgucagc

SEQ ID NO: 1716668 - RNA, 15 nt, Salmonella enterica enterica serovar Typhi
cgcccugcgcgccuu

SEQ ID NO: 1716669 - RNA, 12 nt, Salmonella enterica enterica serovar Typhi
cgcccugcggaa

SEQ ID NO: 1716670 - RNA, 14 nt, Salmonella enterica enterica serovar Typhi
cgcccugcgccagc

SEQ ID NO: 1716671 - RNA, 14 nt, Salmonella enterica enterica serovar Typhi
cgcccugcgcgccu

SEQ ID NO: 1716672 - RNA, 14 nt, Salmonella enterica enterica serovar Typhi
cgcccugcgguagc

SEQ ID NO: 1716673 - RNA, 19 nt, Salmonella enterica enterica serovar Typhi
cgcccugcgguagcgccga

SEQ ID NO: 1716674 - RNA, 16 nt, Salmonella enterica enterica serovar Typhi
cgcccugcgucgcgcu

SEQ ID NO: 1716675 - RNA, 21 nt, Salmonella enterica enterica serovar Typhi
cgcccugcgucgcgcuuucaa

SEQ ID NO: 1716676 - RNA, 13 nt, Salmonella enterica enterica serovar Typhi
cgcccugcuccca

SEQ ID NO: 1716677 - RNA, 15 nt, Salmonella enterica enterica serovar Typhi
cgccgccucccccuc

SEQ ID NO: 1716678 - RNA, 17 nt, Salmonella enterica enterica serovar Typhi
cgccgccuaucgccagc

SEQ ID NO: 1716679 - RNA, 13 nt, Salmonella enterica enterica serovar Typhi
cgccgccucuuca

SEQ ID NO: 1716680 - RNA, 12 nt, Salmonella enterica enterica serovar Typhi
cgccgccugaug

SEQ ID NO: 1716681 - RNA, 16 nt, Salmonella enterica enterica serovar Typhi
cgccgccugcgccagc

SEQ ID NO: 1716682 - RNA, 20 nt, Salmonella enterica enterica serovar Typhi
cgccgcgaagcguuccgcca

SEQ ID NO: 1716683 - RNA, 17 nt, Salmonella enterica enterica serovar Typhi
cgccgcgaugcaucuug

SEQ ID NO: 1716684 - RNA, 16 nt, Salmonella enterica enterica serovar Typhi
cgccgcgcggccccau

SEQ ID NO: 1716685 - RNA, 22 nt, Salmonella enterica enterica serovar Typhi
cgccgcggcgguuauccuccgg

SEQ ID NO: 1716686 - RNA, 20 nt, Salmonella enterica enterica serovar Typhi
cgccggaaaaccggucauau

SEQ ID NO: 1716687 - RNA, 15 nt, Salmonella enterica enterica serovar Typhi
cgccggaaauuugca

SEQ ID NO: 1716688 - RNA, 21 nt, Salmonella enterica enterica serovar Typhi
cgccggaauggcgacgacgcu

SEQ ID NO: 1716689 - RNA, 23 nt, Salmonella enterica enterica serovar Typhi
cgccgcuggcgcuuugccguucu

SEQ ID NO: 1716690 - RNA, 19 nt, Salmonella enterica enterica serovar Typhi
cgccgcuguuuucacucuu

SEQ ID NO: 1716691 - RNA, 17 nt, Salmonella enterica enterica serovar Typhi
cgccgcuuuaccgccuu

SEQ ID NO: 1716692 - RNA, 14 nt, Salmonella enterica enterica serovar Typhi
cgccgcuccacagc

SEQ ID NO: 1716693 - RNA, 19 nt, Salmonella enterica enterica serovar Typhi
cgccgcuaucgaccagcac

SEQ ID NO: 1716694 - RNA, 16 nt, Salmonella enterica enterica serovar Typhi
cgccgcuacugccgcc

SEQ ID NO: 1716695 - RNA, 20 nt, Salmonella enterica enterica serovar Typhi
cgccggauuuaccagcgcuu

SEQ ID NO: 1716696 - RNA, 20 nt, Salmonella enterica enterica serovar Typhi
cgccggaugaggacauaaac

SEQ ID NO: 1716697 - RNA, 19 nt, Salmonella enterica enterica serovar Typhi
cgccggaucgggcuuccag

SEQ ID NO: 1716698 - RNA, 20 nt, Salmonella enterica enterica serovar Typhi
cgccggagaggggacucacc

SEQ ID NO: 1716699 - RNA, 20 nt, Salmonella enterica enterica serovar Typhi
cgccggagagcauuuguagc

SEQ ID NO: 1716700 - RNA, 14 nt, Salmonella enterica enterica serovar Typhi
cgccggggcagcaa

SEQ ID NO: 1716701 - RNA, 16 nt, Salmonella enterica enterica serovar Typhi
cgccgguauagcgccu

SEQ ID NO: 1716702 - RNA, 15 nt, Salmonella enterica enterica serovar Typhi
cgccggucaugccau

SEQ ID NO: 1716703 - RNA, 15 nt, Salmonella enterica enterica serovar Typhi
cgccggucgccagca

SEQ ID NO: 1716704 - RNA, 14 nt, Salmonella enterica enterica serovar Typhi
cgccguaaggcgcc

SEQ ID NO: 1716705 - RNA, 23 nt, Salmonella enterica enterica serovar Typhi
cgccguacacguauaaacgccgc

SEQ ID NO: 1716706 - RNA, 21 nt, Salmonella enterica enterica serovar Typhi
cgccgguguuuagccugauac

SEQ ID NO: 1716707 - RNA, 13 nt, Salmonella enterica enterica serovar Typhi
cgccgguuuaucc

SEQ ID NO: 1716708 - RNA, 19 nt, Salmonella enterica enterica serovar Typhi
cgccggugccugccgccuc

SEQ ID NO: 1716709 - RNA, 22 nt, Salmonella enterica enterica serovar Typhi
cgccguacuugacacaggcgug

SEQ ID NO: 1716710 - RNA, 14 nt, Salmonella enterica enterica serovar Typhi
cgccguauucuuac

SEQ ID NO: 1716711 - RNA, 18 nt, Salmonella enterica enterica serovar Typhi
cgccgucacguucgguac

SEQ ID NO: 1716712 - RNA, 18 nt, Salmonella enterica enterica serovar Typhi
cgccguccagcaccaccu

SEQ ID NO: 1716713 - RNA, 15 nt, Salmonella enterica enterica serovar Typhi
cgccgucaggcuugc

SEQ ID NO: 1716714 - RNA, 20 nt, Salmonella enterica enterica serovar Typhi
cgccgucaggcuugccgcgc

SEQ ID NO: 1716715 - RNA, 12 nt, Salmonella enterica enterica serovar Typhi
cgccgucauccg

SEQ ID NO: 1716716 - RNA, 15 nt, Salmonella enterica enterica serovar Typhi
cgccgggaauuauua

SEQ ID NO: 1716717 - RNA, 20 nt, Salmonella enterica enterica serovar Typhi
cgccgggagcguuaaucacc

SEQ ID NO: 1716718 - RNA, 14 nt, Salmonella enterica enterica serovar Typhi
cgccgggcggcgca

SEQ ID NO: 1716719 - RNA, 23 nt, Salmonella enterica enterica serovar Typhi
cgccgggcgucacccgccggcag

SEQ ID NO: 1716720 - RNA, 18 nt, Salmonella enterica enterica serovar Typhi
cgcgcaaccgcaucacgc

SEQ ID NO: 1716721 - RNA, 23 nt, Salmonella enterica enterica serovar Typhi
cgcgcaaccgcaucacgcgaagc

SEQ ID NO: 1716722 - RNA, 21 nt, Salmonella enterica enterica serovar Typhi
cgcgcacaacgugcaaaacag

SEQ ID NO: 1716723 - RNA, 22 nt, Salmonella enterica enterica serovar Typhi
cgcgcaccauaauauaaggauc

SEQ ID NO: 1716724 - RNA, 20 nt, Salmonella enterica enterica serovar Typhi
cgcgauaaaaacccaccagc

SEQ ID NO: 1716725 - RNA, 21 nt, Salmonella enterica enterica serovar Typhi
cgcgauacacuccggcgcgcg

SEQ ID NO: 1716726 - RNA, 21 nt, Salmonella enterica enterica serovar Typhi
cgcgauaccgccguagaaaau

SEQ ID NO: 1716727 - RNA, 15 nt, Salmonella enterica enterica serovar Typhi
cgcgauauccaccac

SEQ ID NO: 1716728 - RNA, 19 nt, Salmonella enterica enterica serovar Typhi
cgcgaucacagacagaugc

SEQ ID NO: 1716729 - RNA, 14 nt, Salmonella enterica enterica serovar Typhi
cgcgaugacggcgc

SEQ ID NO: 1716730 - RNA, 13 nt, Salmonella enterica enterica serovar Typhi
cgcgaucgcgcca

SEQ ID NO: 1716731 - RNA, 17 nt, Salmonella enterica enterica serovar Typhi
cgcgaucgccccgacca

SEQ ID NO: 1716732 - RNA, 19 nt, Salmonella enterica enterica serovar Typhi
cgcgaucgaugugauaaau

SEQ ID NO: 1716733 - RNA, 23 nt, Salmonella enterica enterica serovar Typhi
cgcgaggcuuauaacccugucug

SEQ ID NO: 1716734 - RNA, 17 nt, Salmonella enterica enterica serovar Typhi
cgcgagcgugaucucau

SEQ ID NO: 1716735 - RNA, 22 nt, Salmonella enterica enterica serovar Typhi
cgcgagaagcccggccacagcg

SEQ ID NO: 1716736 - RNA, 21 nt, Salmonella enterica enterica serovar Typhi
cgcgagaagcccggccacagc

SEQ ID NO: 1716737 - RNA, 14 nt, Salmonella enterica enterica serovar Typhi
cgcgagaacugcug

SEQ ID NO: 1716738 - RNA, 21 nt, Salmonella enterica enterica serovar Typhi
cgcgagccuuuuaucaaugca

SEQ ID NO: 1716739 - RNA, 21 nt, Salmonella enterica enterica serovar Typhi
cgcgacgggcggcgacagaga

SEQ ID NO: 1716740 - RNA, 21 nt, Salmonella enterica enterica serovar Typhi
cgcgacggcagccucuuucag

SEQ ID NO: 1716741 - RNA, 19 nt, Salmonella enterica enterica serovar Typhi
cgcgacuuuggcuuuaucc

SEQ ID NO: 1716742 - RNA, 21 nt, Salmonella enterica enterica serovar Typhi
cgcgacucccaggcgcgcagc

SEQ ID NO: 1716743 - RNA, 18 nt, Salmonella enterica enterica serovar Typhi
cgcgacuuuuuucaccca

SEQ ID NO: 1716744 - RNA, 20 nt, Salmonella enterica enterica serovar Typhi
cgcgacucccaggcgcgcag

SEQ ID NO: 1716745 - RNA, 19 nt, Salmonella enterica enterica serovar Typhi
cgcgacucccaggcgcgca

SEQ ID NO: 1716746 - RNA, 14 nt, Salmonella enterica enterica serovar Typhi
cgcgaccagcgcgc

SEQ ID NO: 1716747 - RNA, 16 nt, Salmonella enterica enterica serovar Typhi
cgcgaccagcgcgcca

SEQ ID NO: 1716748 - RNA, 15 nt, Salmonella enterica enterica serovar Typhi
cgcgacagcgcgcca

SEQ ID NO: 1716749 - RNA, 19 nt, Salmonella enterica enterica serovar Typhi
cgcgacaaaaagcgcgccg

SEQ ID NO: 1716750 - RNA, 21 nt, Salmonella enterica enterica serovar Typhi
cgcgacaacgccggaccagac

SEQ ID NO: 1716751 - RNA, 17 nt, Salmonella enterica enterica serovar Typhi
cgcgacaaaaagcgcgc

SEQ ID NO: 1716752 - RNA, 14 nt, Salmonella enterica enterica serovar Typhi
cgcgaccaguucac

SEQ ID NO: 1716753 - RNA, 21 nt, Salmonella enterica enterica serovar Typhi
cgcgaccggaucaauaaacag

SEQ ID NO: 1716754 - RNA, 20 nt, Salmonella enterica enterica serovar Typhi
cgcgacgcccaugcaaccag

SEQ ID NO: 1716755 - RNA, 16 nt, Salmonella enterica enterica serovar Typhi
cgcgacgaugcgcauu

SEQ ID NO: 1716756 - RNA, 16 nt, Salmonella enterica enterica serovar Typhi
cgcgcauugaccagga

SEQ ID NO: 1716757 - RNA, 11 nt, Salmonella enterica enterica serovar Typhi
cgcgcauggca

SEQ ID NO: 1716758 - RNA, 14 nt, Salmonella enterica enterica serovar Typhi
cgcgcaguuccagc

SEQ ID NO: 1716759 - RNA, 18 nt, Salmonella enterica enterica serovar Typhi
cgcgcaguucauccacgc

SEQ ID NO: 1716760 - RNA, 13 nt, Salmonella enterica enterica serovar Typhi
cgcgcagugcagc

SEQ ID NO: 1716761 - RNA, 23 nt, Salmonella enterica enterica serovar Typhi
cgcgcaggucuucgucagcgcau

SEQ ID NO: 1716762 - RNA, 23 nt, Salmonella enterica enterica serovar Typhi
cgcgccagaugcuuaaacugcgc

SEQ ID NO: 1716763 - RNA, 12 nt, Salmonella enterica enterica serovar Typhi
cgcgccagcagg

SEQ ID NO: 1716764 - RNA, 21 nt, Salmonella enterica enterica serovar Typhi
cgcgccacggccaacgcgccc

SEQ ID NO: 1716765 - RNA, 13 nt, Salmonella enterica enterica serovar Typhi
cgcgccacuucca

SEQ ID NO: 1716766 - RNA, 22 nt, Salmonella enterica enterica serovar Typhi
cgcgccaaaguuaaucagcgcc

SEQ ID NO: 1716767 - RNA, 17 nt, Salmonella enterica enterica serovar Typhi
cgcgccaaugcgaaaau

SEQ ID NO: 1716768 - RNA, 18 nt, Salmonella enterica enterica serovar Typhi
cgcgccaauggccgcccc

SEQ ID NO: 1716769 - RNA, 19 nt, Salmonella enterica enterica serovar Typhi
cgcgccaauggccgccccc

SEQ ID NO: 1716770 - RNA, 17 nt, Salmonella enterica enterica serovar Typhi
cgcgcaccuucucuccu

SEQ ID NO: 1716771 - RNA, 21 nt, Salmonella enterica enterica serovar Typhi
cgcgcagagauagccagcgau

SEQ ID NO: 1716772 - RNA, 16 nt, Salmonella enterica enterica serovar Typhi
cgcgcagaaucacuuc

SEQ ID NO: 1716773 - RNA, 13 nt, Salmonella enterica enterica serovar Typhi
cgcgcagcaggcc

SEQ ID NO: 1716774 - RNA, 22 nt, Salmonella enterica enterica serovar Typhi
cgcgcagcaacaguugcuggag

SEQ ID NO: 1716775 - RNA, 15 nt, Salmonella enterica enterica serovar Typhi
cgcgcagcugggccu

SEQ ID NO: 1716776 - RNA, 12 nt, Salmonella enterica enterica serovar Typhi
cgcgccgccucu

SEQ ID NO: 1716777 - RNA, 13 nt, Salmonella enterica enterica serovar Typhi
cgcgccgccgccu

SEQ ID NO: 1716778 - RNA, 14 nt, Salmonella enterica enterica serovar Typhi
cgcgccgcaucuuc

SEQ ID NO: 1716779 - RNA, 16 nt, Salmonella enterica enterica serovar Typhi
cgcgcccuccuccagc

SEQ ID NO: 1716780 - RNA, 14 nt, Salmonella enterica enterica serovar Typhi
cgcgcccagcgccg

SEQ ID NO: 1716781 - RNA, 14 nt, Salmonella enterica enterica serovar Typhi
cgcgcccgacgcgc

SEQ ID NO: 1716782 - RNA, 21 nt, Salmonella enterica enterica serovar Typhi
cgcgcccgccaucaugcccac

SEQ ID NO: 1716783 - RNA, 20 nt, Salmonella enterica enterica serovar Typhi
cgcgcccgaucguccgccuc

SEQ ID NO: 1716784 - RNA, 20 nt, Salmonella enterica enterica serovar Typhi
cgcgcccgccaccagcacag

SEQ ID NO: 1716785 - RNA, 17 nt, Salmonella enterica enterica serovar Typhi
cgcgccaucuccuccuc

SEQ ID NO: 1716786 - RNA, 17 nt, Salmonella enterica enterica serovar Typhi
cgcgccaucgucaccgg

SEQ ID NO: 1716787 - RNA, 19 nt, Salmonella enterica enterica serovar Typhi
cgcgccaggucucauagcg

SEQ ID NO: 1716788 - RNA, 18 nt, Salmonella enterica enterica serovar Typhi
cgccuccccugccggcgg

SEQ ID NO: 1716789 - RNA, 12 nt, Salmonella enterica enterica serovar Typhi
cgccuccugccg

SEQ ID NO: 1716790 - RNA, 20 nt, Salmonella enterica enterica serovar Typhi
cgccuccguaugaccgccgc

SEQ ID NO: 1716791 - RNA, 14 nt, Salmonella enterica enterica serovar Typhi
cgccucccugccua

SEQ ID NO: 1716792 - RNA, 24 nt, Salmonella enterica enterica serovar Typhi
cgccugcaauguugaaucccacgc

SEQ ID NO: 1716793 - RNA, 16 nt, Salmonella enterica enterica serovar Typhi
cgccugauuuaaugaa

SEQ ID NO: 1716794 - RNA, 21 nt, Salmonella enterica enterica serovar Typhi
cgccugaaaggcacgcuccug

SEQ ID NO: 1716795 - RNA, 14 nt, Salmonella enterica enterica serovar Typhi
cgccucgcucucuu

SEQ ID NO: 1716796 - RNA, 21 nt, Salmonella enterica enterica serovar Typhi
cgccguggcggugacuuccug

SEQ ID NO: 1716797 - RNA, 20 nt, Salmonella enterica enterica serovar Typhi
cgccguggcggugacuuccu

SEQ ID NO: 1716798 - RNA, 16 nt, Salmonella enterica enterica serovar Typhi
cgccguuaccagcauc

SEQ ID NO: 1716799 - RNA, 15 nt, Salmonella enterica enterica serovar Typhi
cgccguuaucggccu

SEQ ID NO: 1716800 - RNA, 13 nt, Salmonella enterica enterica serovar Typhi
cgccgucgcgcuu

SEQ ID NO: 1716801 - RNA, 18 nt, Salmonella enterica enterica serovar Typhi
cgccgucgccaucaccag

SEQ ID NO: 1716802 - RNA, 22 nt, Salmonella enterica enterica serovar Typhi
cgccgucuucuucuucgcgcau

SEQ ID NO: 1716803 - RNA, 19 nt, Salmonella enterica enterica serovar Typhi
cgccucaauugccgccagc

SEQ ID NO: 1716804 - RNA, 14 nt, Salmonella enterica enterica serovar Typhi
cgccuauuguucca

SEQ ID NO: 1716805 - RNA, 22 nt, Salmonella enterica enterica serovar Typhi
cgccguuuguuuauugccgcuu

SEQ ID NO: 1716806 - RNA, 22 nt, Salmonella enterica enterica serovar Typhi
cgccguuugccauaucuggaua

SEQ ID NO: 1716807 - RNA, 21 nt, Salmonella enterica enterica serovar Typhi
cgccugcggaaucuccggcga

SEQ ID NO: 1716808 - RNA, 12 nt, Salmonella enterica enterica serovar Typhi
cgccugcuccgu

SEQ ID NO: 1716809 - RNA, 11 nt, Salmonella enterica enterica serovar Typhi
cgccugcugca

SEQ ID NO: 1716810 - RNA, 15 nt, Salmonella enterica enterica serovar Typhi
cgccugcugccagcc

SEQ ID NO: 1716811 - RNA, 20 nt, Salmonella enterica enterica serovar Typhi
cgccugcugccagccgccgc

SEQ ID NO: 1716812 - RNA, 14 nt, Salmonella enterica enterica serovar Typhi
cgccugccgcaugu

SEQ ID NO: 1716813 - RNA, 20 nt, Salmonella enterica enterica serovar Typhi
cgccugccaacauggggagc

SEQ ID NO: 1716814 - RNA, 20 nt, Salmonella enterica enterica serovar Typhi
cgccugccauagcaucacca

SEQ ID NO: 1716815 - RNA, 15 nt, Salmonella enterica enterica serovar Typhi
cgccugugcuggcga

SEQ ID NO: 1716816 - RNA, 21 nt, Salmonella enterica enterica serovar Typhi
cgccugugguuuaaaacggug

SEQ ID NO: 1716817 - RNA, 14 nt, Salmonella enterica enterica serovar Typhi
cgccuguuaauggu

SEQ ID NO: 1716818 - RNA, 19 nt, Salmonella enterica enterica serovar Typhi
cgccuguuagggcgcggcu

SEQ ID NO: 1716819 - RNA, 16 nt, Salmonella enterica enterica serovar Typhi
cgccuucagcgcgccc

SEQ ID NO: 1716820 - RNA, 23 nt, Salmonella enterica enterica serovar Typhi
cgccuucacacugcgccgccagc

SEQ ID NO: 1716821 - RNA, 14 nt, Salmonella enterica enterica serovar Typhi
cgccuuauucaggc

SEQ ID NO: 1716822 - RNA, 22 nt, Salmonella enterica enterica serovar Typhi
cgccuguaaggcucucuuacca

SEQ ID NO: 1716823 - RNA, 23 nt, Salmonella enterica enterica serovar Typhi
cgccuguaaugucuggugcagca

SEQ ID NO: 1716824 - RNA, 14 nt, Salmonella enterica enterica serovar Typhi
cgccuguccggccu

SEQ ID NO: 1716825 - RNA, 15 nt, Salmonella enterica enterica serovar Typhi
cgccuugccgggggc

SEQ ID NO: 1716826 - RNA, 15 nt, Salmonella enterica enterica serovar Typhi
cgccuugcggcggcg

SEQ ID NO: 1716827 - RNA, 23 nt, Salmonella enterica enterica serovar Typhi
cgccuuugcgaauggccuccagc

SEQ ID NO: 1716828 - RNA, 15 nt, Salmonella enterica enterica serovar Typhi
cgccuuuucccccag

SEQ ID NO: 1716829 - RNA, 20 nt, Salmonella enterica enterica serovar Typhi
cgccuucgcggugaucccag

SEQ ID NO: 1716830 - RNA, 21 nt, Salmonella enterica enterica serovar Typhi
cgccuucgauuaguccgucgg

SEQ ID NO: 1716831 - RNA, 12 nt, Salmonella enterica enterica serovar Typhi
cgccuuccaguu

SEQ ID NO: 1716832 - RNA, 15 nt, Salmonella enterica enterica serovar Typhi
cgccuuccacuuuca

SEQ ID NO: 1716833 - RNA, 14 nt, Salmonella enterica enterica serovar Typhi
cgccuuccuccagc

SEQ ID NO: 1716834 - RNA, 16 nt, Salmonella enterica enterica serovar Typhi
cgccuucuucaucuuc

SEQ ID NO: 1716835 - RNA, 15 nt, Salmonella enterica enterica serovar Typhi
cgccuucuucaccca

SEQ ID NO: 1716836 - RNA, 22 nt, Salmonella enterica enterica serovar Typhi
cgcgaaaucaaagaccuccgcc

SEQ ID NO: 1716837 - RNA, 19 nt, Salmonella enterica enterica serovar Typhi
cgcgaacauuacauccuca

SEQ ID NO: 1716838 - RNA, 14 nt, Salmonella enterica enterica serovar Typhi
cgcgaagcggcgcu

SEQ ID NO: 1716839 - RNA, 15 nt, Salmonella enterica enterica serovar Typhi
cgcgaauaauuauuu

SEQ ID NO: 1716840 - RNA, 18 nt, Salmonella enterica enterica serovar Typhi
cgcgaauuucaaucgcca

SEQ ID NO: 1716841 - RNA, 17 nt, Salmonella enterica enterica serovar Typhi
cgcgaauuucaacgcga

SEQ ID NO: 1716842 - RNA, 15 nt, Salmonella enterica enterica serovar Typhi
cgcgaauuucaaucg

SEQ ID NO: 1716843 - RNA, 22 nt, Salmonella enterica enterica serovar Typhi
cuugaagccuuucuguucuuug

SEQ ID NO: 1716844 - RNA, 20 nt, Salmonella enterica enterica serovar Typhi
cuugaaguuauccagcgccc

SEQ ID NO: 1716845 - RNA, 15 nt, Salmonella enterica enterica serovar Typhi
cuugaccagcacuuc

SEQ ID NO: 1716846 - RNA, 15 nt, Salmonella enterica enterica serovar Typhi
cuugaccgccugauc

SEQ ID NO: 1716847 - RNA, 19 nt, Salmonella enterica enterica serovar Typhi
cuucucaaaaucgccgccg

SEQ ID NO: 1716848 - RNA, 23 nt, Salmonella enterica enterica serovar Typhi
cuucuuugaccagcgacgaugaa

SEQ ID NO: 1716849 - RNA, 19 nt, Salmonella enterica enterica serovar Typhi
cuucuuuggugcgacgcca

SEQ ID NO: 1716850 - RNA, 19 nt, Salmonella enterica enterica serovar Typhi
cuugaucggguuuuccuga

SEQ ID NO: 1716851 - RNA, 15 nt, Salmonella enterica enterica serovar Typhi
cuugaucucucccug

SEQ ID NO: 1716852 - RNA, 19 nt, Salmonella enterica enterica serovar Typhi
cuugagacuguuugucuca

SEQ ID NO: 1716853 - RNA, 17 nt, Salmonella enterica enterica serovar Typhi
cuugagcaaaacaccgc

SEQ ID NO: 1716854 - RNA, 18 nt, Salmonella enterica enterica serovar Typhi
cuugacucugaagcggga

SEQ ID NO: 1716855 - RNA, 21 nt, Salmonella enterica enterica serovar Typhi
cuugcccuguuucgcaggccg

SEQ ID NO: 1716856 - RNA, 21 nt, Salmonella enterica enterica serovar Typhi
cuugcccagcauauuaacagu

SEQ ID NO: 1716857 - RNA, 14 nt, Salmonella enterica enterica serovar Typhi
cuugcccagcgccu

SEQ ID NO: 1716858 - RNA, 18 nt, Salmonella enterica enterica serovar Typhi
cuugccaugugccgcgaa

SEQ ID NO: 1716859 - RNA, 19 nt, Salmonella enterica enterica serovar Typhi
cuugcaaugaaaaaucccc

SEQ ID NO: 1716860 - RNA, 18 nt, Salmonella enterica enterica serovar Typhi
cuugcaacccauacagcc

SEQ ID NO: 1716861 - RNA, 17 nt, Salmonella enterica enterica serovar Typhi
cuugcauggcagccccg

SEQ ID NO: 1716862 - RNA, 22 nt, Salmonella enterica enterica serovar Typhi
cuugguauggcgcuaacaccgc

SEQ ID NO: 1716863 - RNA, 19 nt, Salmonella enterica enterica serovar Typhi
cuuggcguuaaagacgcca

SEQ ID NO: 1716864 - RNA, 17 nt, Salmonella enterica enterica serovar Typhi
cuuggcguauagccgcc

SEQ ID NO: 1716865 - RNA, 19 nt, Salmonella enterica enterica serovar Typhi
cuuggcguauagccgcccc

SEQ ID NO: 1716866 - RNA, 17 nt, Salmonella enterica enterica serovar Typhi
cuuguagaaaagaaggg

SEQ ID NO: 1716867 - RNA, 20 nt, Salmonella enterica enterica serovar Typhi
cuuguaggccugauagcaca

SEQ ID NO: 1716868 - RNA, 22 nt, Salmonella enterica enterica serovar Typhi
cuuggcagccccugaaauaaca

SEQ ID NO: 1716869 - RNA, 11 nt, Salmonella enterica enterica serovar Typhi
cuugcuuuauu

SEQ ID NO: 1716870 - RNA, 23 nt, Salmonella enterica enterica serovar Typhi
cuugcuuaacagaauugcgccac

SEQ ID NO: 1716871 - RNA, 13 nt, Salmonella enterica enterica serovar Typhi
cuugccgcgccag

SEQ ID NO: 1716872 - RNA, 18 nt, Salmonella enterica enterica serovar Typhi
cuugccgcuuccagucca

SEQ ID NO: 1716873 - RNA, 17 nt, Salmonella enterica enterica serovar Typhi
cuuucaggaauuuauca

SEQ ID NO: 1716874 - RNA, 12 nt, Salmonella enterica enterica serovar Typhi
cuuucagcucuu

SEQ ID NO: 1716875 - RNA, 13 nt, Salmonella enterica enterica serovar Typhi
cuuucagauuuuu

SEQ ID NO: 1716876 - RNA, 22 nt, Salmonella enterica enterica serovar Typhi
cuuucacugucaugguuauuuu

SEQ ID NO: 1716877 - RNA, 18 nt, Salmonella enterica enterica serovar Typhi
cuuucaauccuucuucug

SEQ ID NO: 1716878 - RNA, 19 nt, Salmonella enterica enterica serovar Typhi
cuuuauuuuacaacuacuc

SEQ ID NO: 1716879 - RNA, 14 nt, Salmonella enterica enterica serovar Typhi
cuuuauacaguaag

SEQ ID NO: 1716880 - RNA, 20 nt, Salmonella enterica enterica serovar Typhi
cuuuauaaaucaggaaaaag

SEQ ID NO: 1716881 - RNA, 15 nt, Salmonella enterica enterica serovar Typhi
cuuuauccggucugc

SEQ ID NO: 1716882 - RNA, 11 nt, Salmonella enterica enterica serovar Typhi
cuuuauugaug

SEQ ID NO: 1716883 - RNA, 22 nt, Salmonella enterica enterica serovar Typhi
cuuuaucuucugcugcucccuc

SEQ ID NO: 1716884 - RNA, 24 nt, Salmonella enterica enterica serovar Typhi
cuuuaugcccuucgacaaucagca

SEQ ID NO: 1716885 - RNA, 23 nt, Salmonella enterica enterica serovar Typhi
cuuuaucgcgcagcagauuaaca

SEQ ID NO: 1716886 - RNA, 19 nt, Salmonella enterica enterica serovar Typhi
cuuuacuaauaccuggaau

SEQ ID NO: 1716887 - RNA, 16 nt, Salmonella enterica enterica serovar Typhi
cuuuacugaaucucag

SEQ ID NO: 1716888 - RNA, 20 nt, Salmonella enterica enterica serovar Typhi
cuuuacugcgccagccugcu

SEQ ID NO: 1716889 - RNA, 21 nt, Salmonella enterica enterica serovar Typhi
cuuuagauaauuucgcauaau

SEQ ID NO: 1716890 - RNA, 23 nt, Salmonella enterica enterica serovar Typhi
cuuuaacgccuucauauuaaauu

SEQ ID NO: 1716891 - RNA, 13 nt, Salmonella enterica enterica serovar Typhi
cuuuaacgcuggc

SEQ ID NO: 1716892 - RNA, 20 nt, Salmonella enterica enterica serovar Typhi
cuuuaacuaauggcaauaau

SEQ ID NO: 1716893 - RNA, 18 nt, Salmonella enterica enterica serovar Typhi
cuugucgccaaccuccca

SEQ ID NO: 1716894 - RNA, 20 nt, Salmonella enterica enterica serovar Typhi
cuuuaaugcccgguauuuuu

SEQ ID NO: 1716895 - RNA, 14 nt, Salmonella enterica enterica serovar Typhi
cuuuaauuaaucca

SEQ ID NO: 1716896 - RNA, 22 nt, Salmonella enterica enterica serovar Typhi
cuuuaaugcccgguauuuuuuc

SEQ ID NO: 1716897 - RNA, 20 nt, Salmonella enterica enterica serovar Typhi
cuuugcacagucugcagacc

SEQ ID NO: 1716898 - RNA, 18 nt, Salmonella enterica enterica serovar Typhi
cuuugcacguucugcugg

SEQ ID NO: 1716899 - RNA, 20 nt, Salmonella enterica enterica serovar Typhi
cuuugcccgagcgcuggcau

SEQ ID NO: 1716900 - RNA, 23 nt, Salmonella enterica enterica serovar Typhi
cuuugccgcaaacgccgaagcca

SEQ ID NO: 1716901 - RNA, 15 nt, Salmonella enterica enterica serovar Typhi
cuuugcccucaaaga

SEQ ID NO: 1716902 - RNA, 20 nt, Salmonella enterica enterica serovar Typhi
cuuugcgccauuucaauaau

SEQ ID NO: 1716903 - RNA, 18 nt, Salmonella enterica enterica serovar Typhi
cuuugcgauagcccggca

SEQ ID NO: 1716904 - RNA, 14 nt, Salmonella enterica enterica serovar Typhi
cuuugcuuuguagc

SEQ ID NO: 1716905 - RNA, 16 nt, Salmonella enterica enterica serovar Typhi
cuuugcgcuccugcuc

SEQ ID NO: 1716906 - RNA, 19 nt, Salmonella enterica enterica serovar Typhi
cuuugcguuuacuuacaaa

SEQ ID NO: 1716907 - RNA, 22 nt, Salmonella enterica enterica serovar Typhi
cuuuggcaggccucuaucuucu

SEQ ID NO: 1716908 - RNA, 23 nt, Salmonella enterica enterica serovar Typhi
cuuuggccuggagaucagcaugg

SEQ ID NO: 1716909 - RNA, 20 nt, Salmonella enterica enterica serovar Typhi
cuuuggcgcgcgguuuaucc

SEQ ID NO: 1716910 - RNA, 18 nt, Salmonella enterica enterica serovar Typhi
cuuuggcuguccagccgc

SEQ ID NO: 1716911 - RNA, 15 nt, Salmonella enterica enterica serovar Typhi
cuuucuucccggcag

SEQ ID NO: 1716912 - RNA, 11 nt, Salmonella enterica enterica serovar Typhi
cuuugaacagc

SEQ ID NO: 1716913 - RNA, 14 nt, Salmonella enterica enterica serovar Typhi
cuuugaacagccag

SEQ ID NO: 1716914 - RNA, 20 nt, Salmonella enterica enterica serovar Typhi
cuuugaacagccagaagccu

SEQ ID NO: 1716915 - RNA, 22 nt, Salmonella enterica enterica serovar Typhi
cuuugagggcgauaauccgcuc

SEQ ID NO: 1716916 - RNA, 22 nt, Salmonella enterica enterica serovar Typhi
cuuugagcaucaaacuuuuaaa

SEQ ID NO: 1716917 - RNA, 15 nt, Salmonella enterica enterica serovar Typhi
cuuugaccagcgacg

SEQ ID NO: 1716918 - RNA, 18 nt, Salmonella enterica enterica serovar Typhi
cuuugacgacccgcuucc

SEQ ID NO: 1716919 - RNA, 21 nt, Salmonella enterica enterica serovar Typhi
cuuugaccauuaccauuccuc

SEQ ID NO: 1716920 - RNA, 21 nt, Salmonella enterica enterica serovar Typhi
cuuugacccacgccagcagcu

SEQ ID NO: 1716921 - RNA, 21 nt, Salmonella enterica enterica serovar Typhi
cuuucgucguccacucuuccg

SEQ ID NO: 1716922 - RNA, 18 nt, Salmonella enterica enterica serovar Typhi
cuuucgguagccacagau

SEQ ID NO: 1716923 - RNA, 15 nt, Salmonella enterica enterica serovar Typhi
cuuuccaaagcgaag

SEQ ID NO: 1716924 - RNA, 13 nt, Salmonella enterica enterica serovar Typhi
cuuucauuucacu

SEQ ID NO: 1716925 - RNA, 13 nt, Salmonella enterica enterica serovar Typhi
cuuuccagaccaa

SEQ ID NO: 1716926 - RNA, 15 nt, Salmonella enterica enterica serovar Typhi
cuuucugcugccgca

SEQ ID NO: 1716927 - RNA, 17 nt, Salmonella enterica enterica serovar Typhi
cuuagcgccagcagaaa

SEQ ID NO: 1716928 - RNA, 23 nt, Salmonella enterica enterica serovar Typhi
cuuaggcagccaggcaaagcccc

SEQ ID NO: 1716929 - RNA, 20 nt, Salmonella enterica enterica serovar Typhi
cuuaggcaggggauuagacu

SEQ ID NO: 1716930 - RNA, 15 nt, Salmonella enterica enterica serovar Typhi
cuuaguccucagcga

SEQ ID NO: 1716931 - RNA, 20 nt, Salmonella enterica enterica serovar Typhi
cuuacuuucuugccacuggc

SEQ ID NO: 1716932 - RNA, 18 nt, Salmonella enterica enterica serovar Typhi
cuuacuuguaggccuggu

SEQ ID NO: 1716933 - RNA, 13 nt, Salmonella enterica enterica serovar Typhi
cuuacugcugucc

SEQ ID NO: 1716934 - RNA, 16 nt, Salmonella enterica enterica serovar Typhi
cuuaccgcuaaaauac

SEQ ID NO: 1716935 - RNA, 14 nt, Salmonella enterica enterica serovar Typhi
cuuaccgggcagga

SEQ ID NO: 1716936 - RNA, 19 nt, Salmonella enterica enterica serovar Typhi
cuuaccagguauuaaauac

SEQ ID NO: 1716937 - RNA, 18 nt, Salmonella enterica enterica serovar Typhi
cuuaccaggucuuaccua

SEQ ID NO: 1716938 - RNA, 21 nt, Salmonella enterica enterica serovar Typhi
cuuaaugaguacggguauucc

SEQ ID NO: 1716939 - RNA, 22 nt, Salmonella enterica enterica serovar Typhi
cuuaaugcauggcagauaaacc

SEQ ID NO: 1716940 - RNA, 14 nt, Salmonella enterica enterica serovar Typhi
cuuaacccacaaga

SEQ ID NO: 1716941 - RNA, 20 nt, Salmonella enterica enterica serovar Typhi
cuuaacggcccaggcaucga

SEQ ID NO: 1716942 - RNA, 18 nt, Salmonella enterica enterica serovar Typhi
cuuaauacucgccccguu

SEQ ID NO: 1716943 - RNA, 21 nt, Salmonella enterica enterica serovar Typhi
cuuaauacccauuucuucuuc

SEQ ID NO: 1716944 - RNA, 16 nt, Salmonella enterica enterica serovar Typhi
cuuaagggccauguuu

SEQ ID NO: 1716945 - RNA, 11 nt, Salmonella enterica enterica serovar Typhi
cuguuccagcg

SEQ ID NO: 1716946 - RNA, 12 nt, Salmonella enterica enterica serovar Typhi
cuguuccucuuu

SEQ ID NO: 1716947 - RNA, 21 nt, Salmonella enterica enterica serovar Typhi
cuguuccugcgggaacagaua

SEQ ID NO: 1716948 - RNA, 14 nt, Salmonella enterica enterica serovar Typhi
cuguuccuucagaa

SEQ ID NO: 1716949 - RNA, 14 nt, Salmonella enterica enterica serovar Typhi
cuguucgccggaug

SEQ ID NO: 1716950 - RNA, 16 nt, Salmonella enterica enterica serovar Typhi
cuuaacgauaacguca

SEQ ID NO: 1716951 - RNA, 21 nt, Salmonella enterica enterica serovar Typhi
cuuaaauggcgcuguaaggca

SEQ ID NO: 1716952 - RNA, 18 nt, Salmonella enterica enterica serovar Typhi
cuuaaauuaaugauuaaa

SEQ ID NO: 1716953 - RNA, 22 nt, Salmonella enterica enterica serovar Typhi
cuuaaauuaaugauuaaaauaa

SEQ ID NO: 1716954 - RNA, 13 nt, Salmonella enterica enterica serovar Typhi
cuuaaauuuuuaa

SEQ ID NO: 1716955 - RNA, 23 nt, Salmonella enterica enterica serovar Typhi
cuuaugaccgagucuacaucaag

SEQ ID NO: 1716956 - RNA, 15 nt, Salmonella enterica enterica serovar Typhi
cuuaugaucgcccag

SEQ ID NO: 1716957 - RNA, 23 nt, Salmonella enterica enterica serovar Typhi
cuuauaaaggucaaacaccugaa

SEQ ID NO: 1716958 - RNA, 23 nt, Salmonella enterica enterica serovar Typhi
cuuauaaaucagcuuugcggcca

SEQ ID NO: 1716959 - RNA, 13 nt, Salmonella enterica enterica serovar Typhi
cuuauucaaucaa

SEQ ID NO: 1716960 - RNA, 12 nt, Salmonella enterica enterica serovar Typhi
cuuaugcccggc

SEQ ID NO: 1716961 - RNA, 12 nt, Salmonella enterica enterica serovar Typhi
cuuauuccaguc

SEQ ID NO: 1716962 - RNA, 12 nt, Salmonella enterica enterica serovar Typhi
cuuauucaggcg

SEQ ID NO: 1716963 - RNA, 18 nt, Salmonella enterica enterica serovar Typhi
cuucaaagccacacugca

SEQ ID NO: 1716964 - RNA, 16 nt, Salmonella enterica enterica serovar Typhi
cuuauugauuuucaac

SEQ ID NO: 1716965 - RNA, 21 nt, Salmonella enterica enterica serovar Typhi
cuuauuuuucagcgccaguga

SEQ ID NO: 1716966 - RNA, 14 nt, Salmonella enterica enterica serovar Typhi
cuucaauauugaug

SEQ ID NO: 1716967 - RNA, 23 nt, Salmonella enterica enterica serovar Typhi
cuucaaugcgccccgucuguguu

SEQ ID NO: 1716968 - RNA, 12 nt, Salmonella enterica enterica serovar Typhi
cuucaaugaaca

SEQ ID NO: 1716969 - RNA, 18 nt, Salmonella enterica enterica serovar Typhi
cuucaaugcgccccgucu

SEQ ID NO: 1716970 - RNA, 22 nt, Salmonella enterica enterica serovar Typhi
cuucaauguuagcauuauuuuu

SEQ ID NO: 1716971 - RNA, 16 nt, Salmonella enterica enterica serovar Typhi
cuucaauucagaaagu

SEQ ID NO: 1716972 - RNA, 19 nt, Salmonella enterica enterica serovar Typhi
cuucaauucagaaaguuac

SEQ ID NO: 1716973 - RNA, 20 nt, Salmonella enterica enterica serovar Typhi
cuucaauuccuggaacugac

SEQ ID NO: 1716974 - RNA, 19 nt, Salmonella enterica enterica serovar Typhi
cuucaccucagccaaccca

SEQ ID NO: 1716975 - RNA, 21 nt, Salmonella enterica enterica serovar Typhi
cuucacgagcggucaggccag

SEQ ID NO: 1716976 - RNA, 15 nt, Salmonella enterica enterica serovar Typhi
cuucaagaaguucca

SEQ ID NO: 1716977 - RNA, 14 nt, Salmonella enterica enterica serovar Typhi
cuucaagaaucaau

SEQ ID NO: 1716978 - RNA, 17 nt, Salmonella enterica enterica serovar Typhi
cuucaagcguuuccaga

SEQ ID NO: 1716979 - RNA, 23 nt, Salmonella enterica enterica serovar Typhi
cuucaagcuggugcuuuauguag

SEQ ID NO: 1716980 - RNA, 19 nt, Salmonella enterica enterica serovar Typhi
cuucaaccguuucuuuuuc

SEQ ID NO: 1716981 - RNA, 18 nt, Salmonella enterica enterica serovar Typhi
cuucaaccuuugggcaga

SEQ ID NO: 1716982 - RNA, 22 nt, Salmonella enterica enterica serovar Typhi
cuucaacgcgccgcucacaacc

SEQ ID NO: 1716983 - RNA, 19 nt, Salmonella enterica enterica serovar Typhi
cuucaacgcucaguacgcu

SEQ ID NO: 1716984 - RNA, 23 nt, Salmonella enterica enterica serovar Typhi
cuucggcgggaucuccagaagca

SEQ ID NO: 1716985 - RNA, 21 nt, Salmonella enterica enterica serovar Typhi
cuucggcgggaucuccagaag

SEQ ID NO: 1716986 - RNA, 18 nt, Salmonella enterica enterica serovar Typhi
cuucggccugaaucagca

SEQ ID NO: 1716987 - RNA, 22 nt, Salmonella enterica enterica serovar Typhi
cuucggcaaaauauucagcgaa

SEQ ID NO: 1716988 - RNA, 14 nt, Salmonella enterica enterica serovar Typhi
cuucgcuuaucugg

SEQ ID NO: 1716989 - RNA, 21 nt, Salmonella enterica enterica serovar Typhi
cuucgcugaguggucuggaca

SEQ ID NO: 1716990 - RNA, 19 nt, Salmonella enterica enterica serovar Typhi
cuucgcuuaucaggccuac

SEQ ID NO: 1716991 - RNA, 15 nt, Salmonella enterica enterica serovar Typhi
cuucgcuuagcuucc

SEQ ID NO: 1716992 - RNA, 18 nt, Salmonella enterica enterica serovar Typhi
cuucgcguuuaucaccaa

SEQ ID NO: 1716993 - RNA, 16 nt, Salmonella enterica enterica serovar Typhi
cuuccuuuucaucugg

SEQ ID NO: 1716994 - RNA, 15 nt, Salmonella enterica enterica serovar Typhi
cuucgaacagcucau

SEQ ID NO: 1716995 - RNA, 12 nt, Salmonella enterica enterica serovar Typhi
cuucuauccacu

SEQ ID NO: 1716996 - RNA, 15 nt, Salmonella enterica enterica serovar Typhi
cuucuaccugcacau

SEQ ID NO: 1716997 - RNA, 13 nt, Salmonella enterica enterica serovar Typhi
cuucuaccuggaa

SEQ ID NO: 1716998 - RNA, 15 nt, Salmonella enterica enterica serovar Typhi
cuucuaccuggaacc

SEQ ID NO: 1716999 - RNA, 21 nt, Salmonella enterica enterica serovar Typhi
cuucuacacgacgcauugcca

SEQ ID NO: 1717000 - RNA, 23 nt, Salmonella enterica enterica serovar Typhi
cuucguggaacugcagcgcgucg

SEQ ID NO: 1717001 - RNA, 16 nt, Salmonella enterica enterica serovar Typhi
cuucguucaguuccag

SEQ ID NO: 1717002 - RNA, 16 nt, Salmonella enterica enterica serovar Typhi
cuucguaccaaacgaa

SEQ ID NO: 1717003 - RNA, 14 nt, Salmonella enterica enterica serovar Typhi
cuucguauuucuuc

SEQ ID NO: 1717004 - RNA, 14 nt, Salmonella enterica enterica serovar Typhi
cuucgucaaaaugg

SEQ ID NO: 1717005 - RNA, 20 nt, Salmonella enterica enterica serovar Typhi
cuucgucaggcggcugcgca

SEQ ID NO: 1717006 - RNA, 16 nt, Salmonella enterica enterica serovar Typhi
cuucccggcaggcauu

SEQ ID NO: 1717007 - RNA, 16 nt, Salmonella enterica enterica serovar Typhi
cuucccgcgcagugca

SEQ ID NO: 1717008 - RNA, 17 nt, Salmonella enterica enterica serovar Typhi
cuucccggggaacagaa

SEQ ID NO: 1717009 - RNA, 19 nt, Salmonella enterica enterica serovar Typhi
cuucccggggaacagaagc

SEQ ID NO: 1717010 - RNA, 14 nt, Salmonella enterica enterica serovar Typhi
cuucccgcucauua

SEQ ID NO: 1717011 - RNA, 23 nt, Salmonella enterica enterica serovar Typhi
cuucccgcaaacuggccacagca

SEQ ID NO: 1717012 - RNA, 23 nt, Salmonella enterica enterica serovar Typhi
cuucccccuggcuaucaauguuu

SEQ ID NO: 1717013 - RNA, 20 nt, Salmonella enterica enterica serovar Typhi
cuuccccuguaacugcaccu

SEQ ID NO: 1717014 - RNA, 22 nt, Salmonella enterica enterica serovar Typhi
cuuccccggucagucccagcgu

SEQ ID NO: 1717015 - RNA, 15 nt, Salmonella enterica enterica serovar Typhi
cuucccgacgcuggc

SEQ ID NO: 1717016 - RNA, 20 nt, Salmonella enterica enterica serovar Typhi
cuuccccuucacucuucgac

SEQ ID NO: 1717017 - RNA, 23 nt, Salmonella enterica enterica serovar Typhi
cuucccccagaaugccgcccauc

SEQ ID NO: 1717018 - RNA, 15 nt, Salmonella enterica enterica serovar Typhi
cuuccagcgucucca

SEQ ID NO: 1717019 - RNA, 15 nt, Salmonella enterica enterica serovar Typhi
cuuccagcuccaucc

SEQ ID NO: 1717020 - RNA, 15 nt, Salmonella enterica enterica serovar Typhi
cuuccgucagcgaau

SEQ ID NO: 1717021 - RNA, 20 nt, Salmonella enterica enterica serovar Typhi
cuuccggugugaccagcgcg

SEQ ID NO: 1717022 - RNA, 18 nt, Salmonella enterica enterica serovar Typhi
cuucccugaccagcgacg

SEQ ID NO: 1717023 - RNA, 22 nt, Salmonella enterica enterica serovar Typhi
cuuccucaauauugucuucguc

SEQ ID NO: 1717024 - RNA, 21 nt, Salmonella enterica enterica serovar Typhi
cuuccuccccaggcgcuauuc

SEQ ID NO: 1717025 - RNA, 18 nt, Salmonella enterica enterica serovar Typhi
cuuccguccccagcccau

SEQ ID NO: 1717026 - RNA, 18 nt, Salmonella enterica enterica serovar Typhi
cuuccucacagccuugcc

SEQ ID NO: 1717027 - RNA, 15 nt, Salmonella enterica enterica serovar Typhi
cuuccugcugcgcuu

SEQ ID NO: 1717028 - RNA, 15 nt, Salmonella enterica enterica serovar Typhi
cuuccugcgucaggc

SEQ ID NO: 1717029 - RNA, 21 nt, Salmonella enterica enterica serovar Typhi
cuuccugcgcgccaaaccguu

SEQ ID NO: 1717030 - RNA, 15 nt, Salmonella enterica enterica serovar Typhi
cuuccugccaggccg

SEQ ID NO: 1717031 - RNA, 21 nt, Salmonella enterica enterica serovar Typhi
cuuccuguacaaaaucaucau

SEQ ID NO: 1717032 - RNA, 23 nt, Salmonella enterica enterica serovar Typhi
cuuccuguacaaaaucaucauca

SEQ ID NO: 1717033 - RNA, 17 nt, Salmonella enterica enterica serovar Typhi
cuuccuguaucccaaac

SEQ ID NO: 1717034 - RNA, 21 nt, Salmonella enterica enterica serovar Typhi
cuuccacccgcgcgcuuucca

SEQ ID NO: 1717035 - RNA, 18 nt, Salmonella enterica enterica serovar Typhi
cuuccacacggcauucac

SEQ ID NO: 1717036 - RNA, 23 nt, Salmonella enterica enterica serovar Typhi
cuuccaccauccgcgcauacucu

SEQ ID NO: 1717037 - RNA, 16 nt, Salmonella enterica enterica serovar Typhi
cuuccaccucuucugc

SEQ ID NO: 1717038 - RNA, 15 nt, Salmonella enterica enterica serovar Typhi
cuuccacgcacgccg

SEQ ID NO: 1717039 - RNA, 14 nt, Salmonella enterica enterica serovar Typhi
cuuccacucguaac

SEQ ID NO: 1717040 - RNA, 12 nt, Salmonella enterica enterica serovar Typhi
cuuccacugcgg

SEQ ID NO: 1717041 - RNA, 14 nt, Salmonella enterica enterica serovar Typhi
cuuccagcagaucc

SEQ ID NO: 1717042 - RNA, 13 nt, Salmonella enterica enterica serovar Typhi
cuuccagcagcca

SEQ ID NO: 1717043 - RNA, 22 nt, Salmonella enterica enterica serovar Typhi
cuuccagcacgauauccagcac

SEQ ID NO: 1717044 - RNA, 21 nt, Salmonella enterica enterica serovar Typhi
cuuccagauacauggcuauuc

SEQ ID NO: 1717045 - RNA, 17 nt, Salmonella enterica enterica serovar Typhi
cuuccagcgacuccgga

SEQ ID NO: 1717046 - RNA, 20 nt, Salmonella enterica enterica serovar Typhi
cuuccagcgcguccagcccg

SEQ ID NO: 1717047 - RNA, 12 nt, Salmonella enterica enterica serovar Typhi
cuuccagcgcca

SEQ ID NO: 1717048 - RNA, 14 nt, Salmonella enterica enterica serovar Typhi
cuuccagcgcgccg

SEQ ID NO: 1717049 - RNA, 22 nt, Salmonella enterica enterica serovar Typhi
cuuccagcgcgccgucaucgcu

SEQ ID NO: 1717050 - RNA, 14 nt, Salmonella enterica enterica serovar Typhi
cuucaucuucaccu

SEQ ID NO: 1717051 - RNA, 12 nt, Salmonella enterica enterica serovar Typhi
cuucaucuucca

SEQ ID NO: 1717052 - RNA, 16 nt, Salmonella enterica enterica serovar Typhi
cuucaucuuccaguac

SEQ ID NO: 1717053 - RNA, 19 nt, Salmonella enterica enterica serovar Typhi
cuucaugaguaaaugaacg

SEQ ID NO: 1717054 - RNA, 18 nt, Salmonella enterica enterica serovar Typhi
cuucaucggauagaugaa

SEQ ID NO: 1717055 - RNA, 22 nt, Salmonella enterica enterica serovar Typhi
cuucaucggauagaugaagaca

SEQ ID NO: 1717056 - RNA, 16 nt, Salmonella enterica enterica serovar Typhi
cuucagacaacgccgc

SEQ ID NO: 1717057 - RNA, 14 nt, Salmonella enterica enterica serovar Typhi
cuucaucgcgccuc

SEQ ID NO: 1717058 - RNA, 17 nt, Salmonella enterica enterica serovar Typhi
cugccauuaucaccauu

SEQ ID NO: 1717059 - RNA, 23 nt, Salmonella enterica enterica serovar Typhi
cugccauuaucaccauucccagc

SEQ ID NO: 1717060 - RNA, 14 nt, Salmonella enterica enterica serovar Typhi
cugccauuucugcu

SEQ ID NO: 1717061 - RNA, 16 nt, Salmonella enterica enterica serovar Typhi
cugcccacccgggccg

SEQ ID NO: 1717062 - RNA, 13 nt, Salmonella enterica enterica serovar Typhi
cugcccacccggg

SEQ ID NO: 1717063 - RNA, 20 nt, Salmonella enterica enterica serovar Typhi
cugccagcaaggcaagaaag

SEQ ID NO: 1717064 - RNA, 14 nt, Salmonella enterica enterica serovar Typhi
cugccacaucgcca

SEQ ID NO: 1717065 - RNA, 13 nt, Salmonella enterica enterica serovar Typhi
cugccagccgcuc

SEQ ID NO: 1717066 - RNA, 15 nt, Salmonella enterica enterica serovar Typhi
cugccagccgcucug

SEQ ID NO: 1717067 - RNA, 17 nt, Salmonella enterica enterica serovar Typhi
cugcccugacucgcacc

SEQ ID NO: 1717068 - RNA, 19 nt, Salmonella enterica enterica serovar Typhi
cugcccugcggcaggcaaa

SEQ ID NO: 1717069 - RNA, 17 nt, Salmonella enterica enterica serovar Typhi
cugcccuggugagcucc

SEQ ID NO: 1717070 - RNA, 21 nt, Salmonella enterica enterica serovar Typhi
cugccgcagcacccgcucgcu

SEQ ID NO: 1717071 - RNA, 13 nt, Salmonella enterica enterica serovar Typhi
cugccgcaccagu

SEQ ID NO: 1717072 - RNA, 18 nt, Salmonella enterica enterica serovar Typhi
cugcccuuucagagcguc

SEQ ID NO: 1717073 - RNA, 23 nt, Salmonella enterica enterica serovar Typhi
cugccgauuuugaacaugcgcag

SEQ ID NO: 1717074 - RNA, 19 nt, Salmonella enterica enterica serovar Typhi
cugccgcaaacgccugcuc

SEQ ID NO: 1717075 - RNA, 15 nt, Salmonella enterica enterica serovar Typhi
cugcccuacgcuucu

SEQ ID NO: 1717076 - RNA, 20 nt, Salmonella enterica enterica serovar Typhi
cugcccuacgcuucucucca

SEQ ID NO: 1717077 - RNA, 21 nt, Salmonella enterica enterica serovar Typhi
cugcccuacgcuucucuccau

SEQ ID NO: 1717078 - RNA, 14 nt, Salmonella enterica enterica serovar Typhi
cugccccggcgccu

SEQ ID NO: 1717079 - RNA, 16 nt, Salmonella enterica enterica serovar Typhi
cugcaucaccucagaa

SEQ ID NO: 1717080 - RNA, 17 nt, Salmonella enterica enterica serovar Typhi
cugcauauuuuucauuc

SEQ ID NO: 1717081 - RNA, 21 nt, Salmonella enterica enterica serovar Typhi
cugcauaauggcgacggccac

SEQ ID NO: 1717082 - RNA, 16 nt, Salmonella enterica enterica serovar Typhi
cugcagccauacauug

SEQ ID NO: 1717083 - RNA, 21 nt, Salmonella enterica enterica serovar Typhi
cugcaucugcggucuccugaa

SEQ ID NO: 1717084 - RNA, 19 nt, Salmonella enterica enterica serovar Typhi
cugcauccuguaccaccac

SEQ ID NO: 1717085 - RNA, 19 nt, Salmonella enterica enterica serovar Typhi
cugcaucguuugcaguucc

SEQ ID NO: 1717086 - RNA, 20 nt, Salmonella enterica enterica serovar Typhi
cugcaucguuugcaguuccg

SEQ ID NO: 1717087 - RNA, 11 nt, Salmonella enterica enterica serovar Typhi
cugcauucagg

SEQ ID NO: 1717088 - RNA, 17 nt, Salmonella enterica enterica serovar Typhi
cugcauuacauucauaa

SEQ ID NO: 1717089 - RNA, 22 nt, Salmonella enterica enterica serovar Typhi
cugccaaccggccccaucgccg

SEQ ID NO: 1717090 - RNA, 16 nt, Salmonella enterica enterica serovar Typhi
cugccaacauggggag

SEQ ID NO: 1717091 - RNA, 21 nt, Salmonella enterica enterica serovar Typhi
cugccaaccauuaacuccgga

SEQ ID NO: 1717092 - RNA, 18 nt, Salmonella enterica enterica serovar Typhi
cugcauuugcugccgugg

SEQ ID NO: 1717093 - RNA, 22 nt, Salmonella enterica enterica serovar Typhi
cugcauuguuccugcuggcaaa

SEQ ID NO: 1717094 - RNA, 23 nt, Salmonella enterica enterica serovar Typhi
cugcaccaggagcaaaccgaccc

SEQ ID NO: 1717095 - RNA, 15 nt, Salmonella enterica enterica serovar Typhi
cugcacccaucuuua

SEQ ID NO: 1717096 - RNA, 22 nt, Salmonella enterica enterica serovar Typhi
cugcaccagaacucccuguucc

SEQ ID NO: 1717097 - RNA, 12 nt, Salmonella enterica enterica serovar Typhi
cugcacaucccg

SEQ ID NO: 1717098 - RNA, 17 nt, Salmonella enterica enterica serovar Typhi
cugcacaaucgccagcc

SEQ ID NO: 1717099 - RNA, 18 nt, Salmonella enterica enterica serovar Typhi
cugcaacagcaccagcag

SEQ ID NO: 1717100 - RNA, 16 nt, Salmonella enterica enterica serovar Typhi
cugcaacagcacggga

SEQ ID NO: 1717101 - RNA, 19 nt, Salmonella enterica enterica serovar Typhi
cugcaacauuacugaccga

SEQ ID NO: 1717102 - RNA, 20 nt, Salmonella enterica enterica serovar Typhi
cugcaacagaagaguuaacu

SEQ ID NO: 1717103 - RNA, 14 nt, Salmonella enterica enterica serovar Typhi
cugcaacagcacca

SEQ ID NO: 1717104 - RNA, 14 nt, Salmonella enterica enterica serovar Typhi
cugcacaaucgcca

SEQ ID NO: 1717105 - RNA, 14 nt, Salmonella enterica enterica serovar Typhi
cugcaaaucugccg

SEQ ID NO: 1717106 - RNA, 16 nt, Salmonella enterica enterica serovar Typhi
cugcaaaauauauaau

SEQ ID NO: 1717107 - RNA, 17 nt, Salmonella enterica enterica serovar Typhi
cugcacgaaauguagag

SEQ ID NO: 1717108 - RNA, 24 nt, Salmonella enterica enterica serovar Typhi
cugcaccuuuuuuuccagcgucug

SEQ ID NO: 1717109 - RNA, 14 nt, Salmonella enterica enterica serovar Typhi
cugcaccuggucga

SEQ ID NO: 1717110 - RNA, 14 nt, Salmonella enterica enterica serovar Typhi
cugcaccucagacc

SEQ ID NO: 1717111 - RNA, 12 nt, Salmonella enterica enterica serovar Typhi
cugcaccgccug

SEQ ID NO: 1717112 - RNA, 19 nt, Salmonella enterica enterica serovar Typhi
cugauguaccugcguuaaa

SEQ ID NO: 1717113 - RNA, 16 nt, Salmonella enterica enterica serovar Typhi
cugauguagcucuuca

SEQ ID NO: 1717114 - RNA, 16 nt, Salmonella enterica enterica serovar Typhi
cugauguccgcagccg

SEQ ID NO: 1717115 - RNA, 22 nt, Salmonella enterica enterica serovar Typhi
cugauuauucaguaccgccuuc

SEQ ID NO: 1717116 - RNA, 15 nt, Salmonella enterica enterica serovar Typhi
cugauuauucaguac

SEQ ID NO: 1717117 - RNA, 16 nt, Salmonella enterica enterica serovar Typhi
cugcaaaaagccuugc

SEQ ID NO: 1717118 - RNA, 20 nt, Salmonella enterica enterica serovar Typhi
cugcaaaaagccuugcugaa

SEQ ID NO: 1717119 - RNA, 19 nt, Salmonella enterica enterica serovar Typhi
cugauugacuaucagccgc

SEQ ID NO: 1717120 - RNA, 22 nt, Salmonella enterica enterica serovar Typhi
cugaugcccagguuagcagcca

SEQ ID NO: 1717121 - RNA, 14 nt, Salmonella enterica enterica serovar Typhi
cugaugccugaagg

SEQ ID NO: 1717122 - RNA, 19 nt, Salmonella enterica enterica serovar Typhi
cugaugcguuguaccguuu

SEQ ID NO: 1717123 - RNA, 22 nt, Salmonella enterica enterica serovar Typhi
cugaugaccgccgucauagcag

SEQ ID NO: 1717124 - RNA, 16 nt, Salmonella enterica enterica serovar Typhi
cugaugacgcgccgga

SEQ ID NO: 1717125 - RNA, 22 nt, Salmonella enterica enterica serovar Typhi
cugcgucaugucguuagaacca

SEQ ID NO: 1717126 - RNA, 13 nt, Salmonella enterica enterica serovar Typhi
cugcgucacagac

SEQ ID NO: 1717127 - RNA, 15 nt, Salmonella enterica enterica serovar Typhi
cugcggcguggagca

SEQ ID NO: 1717128 - RNA, 18 nt, Salmonella enterica enterica serovar Typhi
cugcggcuauauaaaauc

SEQ ID NO: 1717129 - RNA, 21 nt, Salmonella enterica enterica serovar Typhi
cugcggcauuacgcgccucuu

SEQ ID NO: 1717130 - RNA, 13 nt, Salmonella enterica enterica serovar Typhi
cugcggccaugau

SEQ ID NO: 1717131 - RNA, 22 nt, Salmonella enterica enterica serovar Typhi
cugcggcauacuuucgcgcggc

SEQ ID NO: 1717132 - RNA, 17 nt, Salmonella enterica enterica serovar Typhi
cugcggcaguucuaaca

SEQ ID NO: 1717133 - RNA, 17 nt, Salmonella enterica enterica serovar Typhi
cugcgcucacgcggcgc

SEQ ID NO: 1717134 - RNA, 23 nt, Salmonella enterica enterica serovar Typhi
cugcgcucaucaggccugggcga

SEQ ID NO: 1717135 - RNA, 12 nt, Salmonella enterica enterica serovar Typhi
cugcgccugcau

SEQ ID NO: 1717136 - RNA, 15 nt, Salmonella enterica enterica serovar Typhi
cugcgccugcauauc

SEQ ID NO: 1717137 - RNA, 23 nt, Salmonella enterica enterica serovar Typhi
cugcgccugaaaggcacgcuccu

SEQ ID NO: 1717138 - RNA, 16 nt, Salmonella enterica enterica serovar Typhi
cugcgcguucugcucc

SEQ ID NO: 1717139 - RNA, 20 nt, Salmonella enterica enterica serovar Typhi
cugcgcguucugcuccagac

SEQ ID NO: 1717140 - RNA, 13 nt, Salmonella enterica enterica serovar Typhi
cugcgcugggccg

SEQ ID NO: 1717141 - RNA, 14 nt, Salmonella enterica enterica serovar Typhi
cugcgcugacggcg

SEQ ID NO: 1717142 - RNA, 15 nt, Salmonella enterica enterica serovar Typhi
cugcgcuuacggcca

SEQ ID NO: 1717143 - RNA, 14 nt, Salmonella enterica enterica serovar Typhi
cugcgccagcgccg

SEQ ID NO: 1717144 - RNA, 17 nt, Salmonella enterica enterica serovar Typhi
cugcgccagcggcacug

SEQ ID NO: 1717145 - RNA, 15 nt, Salmonella enterica enterica serovar Typhi
cugcgccauauccuc

SEQ ID NO: 1717146 - RNA, 14 nt, Salmonella enterica enterica serovar Typhi
cugcgccaucuucc

SEQ ID NO: 1717147 - RNA, 13 nt, Salmonella enterica enterica serovar Typhi
cugcgccgcuugu

SEQ ID NO: 1717148 - RNA, 15 nt, Salmonella enterica enterica serovar Typhi
cugcgccggcugcgc

SEQ ID NO: 1717149 - RNA, 16 nt, Salmonella enterica enterica serovar Typhi
cugcgccagcauggcg

SEQ ID NO: 1717150 - RNA, 12 nt, Salmonella enterica enterica serovar Typhi
cugcgccagccg

SEQ ID NO: 1717151 - RNA, 13 nt, Salmonella enterica enterica serovar Typhi
cugcgcaccugca

SEQ ID NO: 1717152 - RNA, 21 nt, Salmonella enterica enterica serovar Typhi
cugcgcaacauucugcuucca

SEQ ID NO: 1717153 - RNA, 15 nt, Salmonella enterica enterica serovar Typhi
cugcgcaacuggaag

SEQ ID NO: 1717154 - RNA, 19 nt, Salmonella enterica enterica serovar Typhi
cugcgcaacauucugcuuc

SEQ ID NO: 1717155 - RNA, 17 nt, Salmonella enterica enterica serovar Typhi
cugcgaacagcgcucca

SEQ ID NO: 1717156 - RNA, 23 nt, Salmonella enterica enterica serovar Typhi
cugcgaggucaccgggcgaaagc

SEQ ID NO: 1717157 - RNA, 16 nt, Salmonella enterica enterica serovar Typhi
cugccgccacgccgcu

SEQ ID NO: 1717158 - RNA, 13 nt, Salmonella enterica enterica serovar Typhi
cugccgccaucgc

SEQ ID NO: 1717159 - RNA, 20 nt, Salmonella enterica enterica serovar Typhi
cugccgccauuugcgcggcu

SEQ ID NO: 1717160 - RNA, 18 nt, Salmonella enterica enterica serovar Typhi
cugccgccagcaguugca

SEQ ID NO: 1717161 - RNA, 17 nt, Salmonella enterica enterica serovar Typhi
cugccgcccaucgccac

SEQ ID NO: 1717162 - RNA, 17 nt, Salmonella enterica enterica serovar Typhi
cugccgcgcccgcgccg

SEQ ID NO: 1717163 - RNA, 22 nt, Salmonella enterica enterica serovar Typhi
cugccuuuaacaaauuaaaucc

SEQ ID NO: 1717164 - RNA, 19 nt, Salmonella enterica enterica serovar Typhi
cugccuuuacugaaucuca

SEQ ID NO: 1717165 - RNA, 17 nt, Salmonella enterica enterica serovar Typhi
cugccgcgccugauuca

SEQ ID NO: 1717166 - RNA, 21 nt, Salmonella enterica enterica serovar Typhi
cugccuuaauccccggcccgc

SEQ ID NO: 1717167 - RNA, 23 nt, Salmonella enterica enterica serovar Typhi
cugcugcuugcuuuucaucacca

SEQ ID NO: 1717168 - RNA, 16 nt, Salmonella enterica enterica serovar Typhi
cugcuggcaaaacgca

SEQ ID NO: 1717169 - RNA, 14 nt, Salmonella enterica enterica serovar Typhi
cugcuggcgcguca

SEQ ID NO: 1717170 - RNA, 16 nt, Salmonella enterica enterica serovar Typhi
cugcuggcgagcagga

SEQ ID NO: 1717171 - RNA, 17 nt, Salmonella enterica enterica serovar Typhi
cugcuggcgagcaggaa

SEQ ID NO: 1717172 - RNA, 18 nt, Salmonella enterica enterica serovar Typhi
cugcugugacaucgcccc

SEQ ID NO: 1717173 - RNA, 16 nt, Salmonella enterica enterica serovar Typhi
cugcuguccgccagca

SEQ ID NO: 1717174 - RNA, 20 nt, Salmonella enterica enterica serovar Typhi
cugcuguagcgucucaucaa

SEQ ID NO: 1717175 - RNA, 22 nt, Salmonella enterica enterica serovar Typhi
cugcuguguccaggucaucacc

SEQ ID NO: 1717176 - RNA, 17 nt, Salmonella enterica enterica serovar Typhi
cugcuguguccagguca

SEQ ID NO: 1717177 - RNA, 16 nt, Salmonella enterica enterica serovar Typhi
cugcuguaccucuugc

SEQ ID NO: 1717178 - RNA, 15 nt, Salmonella enterica enterica serovar Typhi
cugcugguagagcau

SEQ ID NO: 1717179 - RNA, 17 nt, Salmonella enterica enterica serovar Typhi
cugcuggucauaacgcu

SEQ ID NO: 1717180 - RNA, 16 nt, Salmonella enterica enterica serovar Typhi
cugcugcauccgcgcu

SEQ ID NO: 1717181 - RNA, 15 nt, Salmonella enterica enterica serovar Typhi
cugcugaugcugguu

SEQ ID NO: 1717182 - RNA, 17 nt, Salmonella enterica enterica serovar Typhi
cugcugccagcgccgcc

SEQ ID NO: 1717183 - RNA, 15 nt, Salmonella enterica enterica serovar Typhi
cugcugccagcgccg

SEQ ID NO: 1717184 - RNA, 12 nt, Salmonella enterica enterica serovar Typhi
cugcugcucccu

SEQ ID NO: 1717185 - RNA, 21 nt, Salmonella enterica enterica serovar Typhi
cugcugcguggucguaaaacu

SEQ ID NO: 1717186 - RNA, 20 nt, Salmonella enterica enterica serovar Typhi
cugcugcugauggccuuugu

SEQ ID NO: 1717187 - RNA, 20 nt, Salmonella enterica enterica serovar Typhi
cugcucuaccaacugagcua

SEQ ID NO: 1717188 - RNA, 15 nt, Salmonella enterica enterica serovar Typhi
cugcucucgggcagg

SEQ ID NO: 1717189 - RNA, 14 nt, Salmonella enterica enterica serovar Typhi
cugcucuccacgcc

SEQ ID NO: 1717190 - RNA, 16 nt, Salmonella enterica enterica serovar Typhi
cugcugacacccucug

SEQ ID NO: 1717191 - RNA, 17 nt, Salmonella enterica enterica serovar Typhi
cugcugaaaugccuggu

SEQ ID NO: 1717192 - RNA, 22 nt, Salmonella enterica enterica serovar Typhi
cugcucguaaguuuccugcgcg

SEQ ID NO: 1717193 - RNA, 22 nt, Salmonella enterica enterica serovar Typhi
cugcucggguaaggcaucguug

SEQ ID NO: 1717194 - RNA, 24 nt, Salmonella enterica enterica serovar Typhi
cugcucguaaagcaucagacuacu

SEQ ID NO: 1717195 - RNA, 19 nt, Salmonella enterica enterica serovar Typhi
cugcucgcgacgcagaccc

SEQ ID NO: 1717196 - RNA, 18 nt, Salmonella enterica enterica serovar Typhi
cugcuccggcuuaaugcc

SEQ ID NO: 1717197 - RNA, 17 nt, Salmonella enterica enterica serovar Typhi
cugcucccccaguugcu

SEQ ID NO: 1717198 - RNA, 14 nt, Salmonella enterica enterica serovar Typhi
cugcguccugcuua

SEQ ID NO: 1717199 - RNA, 14 nt, Salmonella enterica enterica serovar Typhi
cugcgucgcgcgcg

SEQ ID NO: 1717200 - RNA, 13 nt, Salmonella enterica enterica serovar Typhi
cugcgugaaaagg

SEQ ID NO: 1717201 - RNA, 15 nt, Salmonella enterica enterica serovar Typhi
cugcuccugcggcgu

SEQ ID NO: 1717202 - RNA, 19 nt, Salmonella enterica enterica serovar Typhi
cugcuccguccacgcgagc

SEQ ID NO: 1717203 - RNA, 16 nt, Salmonella enterica enterica serovar Typhi
cuggaugacugaauua

SEQ ID NO: 1717204 - RNA, 12 nt, Salmonella enterica enterica serovar Typhi
cuggaugauaaa

SEQ ID NO: 1717205 - RNA, 22 nt, Salmonella enterica enterica serovar Typhi
cuggaucgugcggcgaagcauc

SEQ ID NO: 1717206 - RNA, 12 nt, Salmonella enterica enterica serovar Typhi
cuggauggcaga

SEQ ID NO: 1717207 - RNA, 17 nt, Salmonella enterica enterica serovar Typhi
cuggauggacuguuucg

SEQ ID NO: 1717208 - RNA, 14 nt, Salmonella enterica enterica serovar Typhi
cuggcaacauuaau

SEQ ID NO: 1717209 - RNA, 13 nt, Salmonella enterica enterica serovar Typhi
cuggcaaaacgca

SEQ ID NO: 1717210 - RNA, 23 nt, Salmonella enterica enterica serovar Typhi
cuggauucucucccaggcauccu

SEQ ID NO: 1717211 - RNA, 15 nt, Salmonella enterica enterica serovar Typhi
cugcuguuucugguc

SEQ ID NO: 1717212 - RNA, 13 nt, Salmonella enterica enterica serovar Typhi
cugcuuccagaau

SEQ ID NO: 1717213 - RNA, 16 nt, Salmonella enterica enterica serovar Typhi
cugcuucagccacugg

SEQ ID NO: 1717214 - RNA, 12 nt, Salmonella enterica enterica serovar Typhi
cugcuucagcca

SEQ ID NO: 1717215 - RNA, 20 nt, Salmonella enterica enterica serovar Typhi
cugcuuaugaucgcccagcc

SEQ ID NO: 1717216 - RNA, 14 nt, Salmonella enterica enterica serovar Typhi
cugcuuccugccgc

SEQ ID NO: 1717217 - RNA, 16 nt, Salmonella enterica enterica serovar Typhi
cuggauagucuucaag

SEQ ID NO: 1717218 - RNA, 23 nt, Salmonella enterica enterica serovar Typhi
cuggaucaccugaaugcaaagaa

SEQ ID NO: 1717219 - RNA, 16 nt, Salmonella enterica enterica serovar Typhi
cuggaucagauucccc

SEQ ID NO: 1717220 - RNA, 21 nt, Salmonella enterica enterica serovar Typhi
cuggaucacuuuugccgucag

SEQ ID NO: 1717221 - RNA, 19 nt, Salmonella enterica enterica serovar Typhi
cuggcgcacauugcugccu

SEQ ID NO: 1717222 - RNA, 15 nt, Salmonella enterica enterica serovar Typhi
cuggcgaauccggga

SEQ ID NO: 1717223 - RNA, 20 nt, Salmonella enterica enterica serovar Typhi
cuggcgaauccgggaaaugg

SEQ ID NO: 1717224 - RNA, 19 nt, Salmonella enterica enterica serovar Typhi
cuggcgaccagccugccgu

SEQ ID NO: 1717225 - RNA, 22 nt, Salmonella enterica enterica serovar Typhi
cuggcgaccgccaccauccggc

SEQ ID NO: 1717226 - RNA, 22 nt, Salmonella enterica enterica serovar Typhi
cuggcgaauaaaauucagcgca

SEQ ID NO: 1717227 - RNA, 17 nt, Salmonella enterica enterica serovar Typhi
cuggcgaaccaccagcc

SEQ ID NO: 1717228 - RNA, 14 nt, Salmonella enterica enterica serovar Typhi
cuggcacuggcagc

SEQ ID NO: 1717229 - RNA, 22 nt, Salmonella enterica enterica serovar Typhi
cuggcagccucguccugcaauu

SEQ ID NO: 1717230 - RNA, 18 nt, Salmonella enterica enterica serovar Typhi
cuggcagcgccugacggc

SEQ ID NO: 1717231 - RNA, 17 nt, Salmonella enterica enterica serovar Typhi
cuggccauuucaucauu

SEQ ID NO: 1717232 - RNA, 17 nt, Salmonella enterica enterica serovar Typhi
cuggccaguucgucuuc

SEQ ID NO: 1717233 - RNA, 23 nt, Salmonella enterica enterica serovar Typhi
cuggccaguucgucuuccggaua

SEQ ID NO: 1717234 - RNA, 14 nt, Salmonella enterica enterica serovar Typhi
cuggccaggcuuuc

SEQ ID NO: 1717235 - RNA, 14 nt, Salmonella enterica enterica serovar Typhi
cuggccagggcauc

SEQ ID NO: 1717236 - RNA, 17 nt, Salmonella enterica enterica serovar Typhi
cuggcuggcgcugacga

SEQ ID NO: 1717237 - RNA, 17 nt, Salmonella enterica enterica serovar Typhi
cuggcuuuauauaaaaa

SEQ ID NO: 1717238 - RNA, 11 nt, Salmonella enterica enterica serovar Typhi
cuggcuuuaua

SEQ ID NO: 1717239 - RNA, 14 nt, Salmonella enterica enterica serovar Typhi
cuggcuuuauauaa

SEQ ID NO: 1717240 - RNA, 21 nt, Salmonella enterica enterica serovar Typhi
cuggcuugcgcuauccgcgcu

SEQ ID NO: 1717241 - RNA, 13 nt, Salmonella enterica enterica serovar Typhi
cuggcuugccaga

SEQ ID NO: 1717242 - RNA, 15 nt, Salmonella enterica enterica serovar Typhi
cuggcuuaccugcuc

SEQ ID NO: 1717243 - RNA, 22 nt, Salmonella enterica enterica serovar Typhi
cuggcuucaaccuccugcaauc

SEQ ID NO: 1717244 - RNA, 14 nt, Salmonella enterica enterica serovar Typhi
cuggcuucagccug

SEQ ID NO: 1717245 - RNA, 16 nt, Salmonella enterica enterica serovar Typhi
cuggcuaccacauucu

SEQ ID NO: 1717246 - RNA, 11 nt, Salmonella enterica enterica serovar Typhi
cuggcucagac

SEQ ID NO: 1717247 - RNA, 15 nt, Salmonella enterica enterica serovar Typhi
cuggcucaauccagg

SEQ ID NO: 1717248 - RNA, 12 nt, Salmonella enterica enterica serovar Typhi
cuggcucauucu

SEQ ID NO: 1717249 - RNA, 17 nt, Salmonella enterica enterica serovar Typhi
cuggcucccgcagccac

SEQ ID NO: 1717250 - RNA, 15 nt, Salmonella enterica enterica serovar Typhi
cuggcucggccuguc

SEQ ID NO: 1717251 - RNA, 19 nt, Salmonella enterica enterica serovar Typhi
cuggcgcagcgcuuuugcc

SEQ ID NO: 1717252 - RNA, 18 nt, Salmonella enterica enterica serovar Typhi
cuggcgcauuuuaaugau

SEQ ID NO: 1717253 - RNA, 22 nt, Salmonella enterica enterica serovar Typhi
cuggcgcacgcgucaucggcgc

SEQ ID NO: 1717254 - RNA, 13 nt, Salmonella enterica enterica serovar Typhi
cuggcgccgcaaa

SEQ ID NO: 1717255 - RNA, 13 nt, Salmonella enterica enterica serovar Typhi
cuggcguuaaaua

SEQ ID NO: 1717256 - RNA, 16 nt, Salmonella enterica enterica serovar Typhi
cuggcuuugcgccggc

SEQ ID NO: 1717257 - RNA, 19 nt, Salmonella enterica enterica serovar Typhi
cugggagccgcugcucauu

SEQ ID NO: 1717258 - RNA, 15 nt, Salmonella enterica enterica serovar Typhi
cugggauuugugcga

SEQ ID NO: 1717259 - RNA, 18 nt, Salmonella enterica enterica serovar Typhi
cuggguaagcgcagcgcc

SEQ ID NO: 1717260 - RNA, 13 nt, Salmonella enterica enterica serovar Typhi
cuggguaauagau

SEQ ID NO: 1717261 - RNA, 17 nt, Salmonella enterica enterica serovar Typhi
cugggcugagaaaaauu

SEQ ID NO: 1717262 - RNA, 23 nt, Salmonella enterica enterica serovar Typhi
cugggcggcaacccgcuccagaa

SEQ ID NO: 1717263 - RNA, 21 nt, Salmonella enterica enterica serovar Typhi
cugguuucggcaucccaggcg

SEQ ID NO: 1717264 - RNA, 14 nt, Salmonella enterica enterica serovar Typhi
cugguuucaauacu

SEQ ID NO: 1717265 - RNA, 16 nt, Salmonella enterica enterica serovar Typhi
cugguuucccugccuc

SEQ ID NO: 1717266 - RNA, 14 nt, Salmonella enterica enterica serovar Typhi
cugguuggcgcgcu

SEQ ID NO: 1717267 - RNA, 16 nt, Salmonella enterica enterica serovar Typhi
cugguuaacgccgcca

SEQ ID NO: 1717268 - RNA, 15 nt, Salmonella enterica enterica serovar Typhi
cugguuaauaauuuu

SEQ ID NO: 1717269 - RNA, 24 nt, Salmonella enterica enterica serovar Typhi
cugguuaaugccuucgccgccgcu

SEQ ID NO: 1717270 - RNA, 20 nt, Salmonella enterica enterica serovar Typhi
cuggguaugcagugggccgg

SEQ ID NO: 1717271 - RNA, 23 nt, Salmonella enterica enterica serovar Typhi
cuggguucauccagcaauaacac

SEQ ID NO: 1717272 - RNA, 14 nt, Salmonella enterica enterica serovar Typhi
cuggguugcccaaa

SEQ ID NO: 1717273 - RNA, 17 nt, Salmonella enterica enterica serovar Typhi
cuggguuuauuugguac

SEQ ID NO: 1717274 - RNA, 18 nt, Salmonella enterica enterica serovar Typhi
cuggguuucccauugggc

SEQ ID NO: 1717275 - RNA, 16 nt, Salmonella enterica enterica serovar Typhi
cuggguuugcugaauc

SEQ ID NO: 1717276 - RNA, 21 nt, Salmonella enterica enterica serovar Typhi
cuggguuuuuccgcuuuuccu

SEQ ID NO: 1717277 - RNA, 22 nt, Salmonella enterica enterica serovar Typhi
cugguaacggcacugcuuuucg

SEQ ID NO: 1717278 - RNA, 19 nt, Salmonella enterica enterica serovar Typhi
cugguaaccguaacgcucc

SEQ ID NO: 1717279 - RNA, 17 nt, Salmonella enterica enterica serovar Typhi
cuggugcugugccugcc

SEQ ID NO: 1717280 - RNA, 16 nt, Salmonella enterica enterica serovar Typhi
cugguggugggcggca

SEQ ID NO: 1717281 - RNA, 17 nt, Salmonella enterica enterica serovar Typhi
cuguaucugcugacacc

SEQ ID NO: 1717282 - RNA, 20 nt, Salmonella enterica enterica serovar Typhi
cuguagcgucucaucaaaaa

SEQ ID NO: 1717283 - RNA, 23 nt, Salmonella enterica enterica serovar Typhi
cuguagcgucucaucaaaaaggc

SEQ ID NO: 1717284 - RNA, 21 nt, Salmonella enterica enterica serovar Typhi
cuguagcguuucacgcgcgcc

SEQ ID NO: 1717285 - RNA, 17 nt, Salmonella enterica enterica serovar Typhi
cuguaucgacauaguac

SEQ ID NO: 1717286 - RNA, 13 nt, Salmonella enterica enterica serovar Typhi
cuguaaugaggca

SEQ ID NO: 1717287 - RNA, 14 nt, Salmonella enterica enterica serovar Typhi
cuguaagaggcaua

SEQ ID NO: 1717288 - RNA, 13 nt, Salmonella enterica enterica serovar Typhi
cuguagccagccu

SEQ ID NO: 1717289 - RNA, 14 nt, Salmonella enterica enterica serovar Typhi
cuguagccagccug

SEQ ID NO: 1717290 - RNA, 16 nt, Salmonella enterica enterica serovar Typhi
cuguagcagcgccagc

SEQ ID NO: 1717291 - RNA, 22 nt, Salmonella enterica enterica serovar Typhi
cuguagccagccugaacgggug

SEQ ID NO: 1717292 - RNA, 16 nt, Salmonella enterica enterica serovar Typhi
cugucuuguuuuucug

SEQ ID NO: 1717293 - RNA, 20 nt, Salmonella enterica enterica serovar Typhi
cugugacaucgccccggccu

SEQ ID NO: 1717294 - RNA, 22 nt, Salmonella enterica enterica serovar Typhi
cugugacggcaacugaaaacag

SEQ ID NO: 1717295 - RNA, 22 nt, Salmonella enterica enterica serovar Typhi
cugugauaaaaacgccuugccc

SEQ ID NO: 1717296 - RNA, 14 nt, Salmonella enterica enterica serovar Typhi
cugucgaugauauc

SEQ ID NO: 1717297 - RNA, 21 nt, Salmonella enterica enterica serovar Typhi
cugucgaugauauccagcacg

SEQ ID NO: 1717298 - RNA, 22 nt, Salmonella enterica enterica serovar Typhi
cugucgaaaccagcauaaugag

SEQ ID NO: 1717299 - RNA, 19 nt, Salmonella enterica enterica serovar Typhi
cuguccugaguaaagccug

SEQ ID NO: 1717300 - RNA, 17 nt, Salmonella enterica enterica serovar Typhi
cugugcaaaauuacuuc

SEQ ID NO: 1717301 - RNA, 20 nt, Salmonella enterica enterica serovar Typhi
cugugccagcucguuauuuc

SEQ ID NO: 1717302 - RNA, 17 nt, Salmonella enterica enterica serovar Typhi
cugugcaacaucuuacc

SEQ ID NO: 1717303 - RNA, 14 nt, Salmonella enterica enterica serovar Typhi
cugugcgugaccca

SEQ ID NO: 1717304 - RNA, 19 nt, Salmonella enterica enterica serovar Typhi
cugugcucgauauauuuuc

SEQ ID NO: 1717305 - RNA, 16 nt, Salmonella enterica enterica serovar Typhi
cugugcgugacccaca

SEQ ID NO: 1717306 - RNA, 12 nt, Salmonella enterica enterica serovar Typhi
cuguuaaaaaau

SEQ ID NO: 1717307 - RNA, 14 nt, Salmonella enterica enterica serovar Typhi
cuguuaauuucccg

SEQ ID NO: 1717308 - RNA, 17 nt, Salmonella enterica enterica serovar Typhi
cuguuacgcugguuugu

SEQ ID NO: 1717309 - RNA, 18 nt, Salmonella enterica enterica serovar Typhi
cuguuaucgccauuauuc

SEQ ID NO: 1717310 - RNA, 15 nt, Salmonella enterica enterica serovar Typhi
cuguuaugccuuuuu

SEQ ID NO: 1717311 - RNA, 19 nt, Salmonella enterica enterica serovar Typhi
cuguuauugacgauauaaa

SEQ ID NO: 1717312 - RNA, 17 nt, Salmonella enterica enterica serovar Typhi
cuguucaucaaagaaaa

SEQ ID NO: 1717313 - RNA, 13 nt, Salmonella enterica enterica serovar Typhi
cuguggugugccu

SEQ ID NO: 1717314 - RNA, 14 nt, Salmonella enterica enterica serovar Typhi
cugugguucugcca

SEQ ID NO: 1717315 - RNA, 14 nt, Salmonella enterica enterica serovar Typhi
cuguggugugccug

SEQ ID NO: 1717316 - RNA, 18 nt, Salmonella enterica enterica serovar Typhi
cuguggugugccugcguu

SEQ ID NO: 1717317 - RNA, 16 nt, Salmonella enterica enterica serovar Typhi
cugugguucugccaga

SEQ ID NO: 1717318 - RNA, 15 nt, Salmonella enterica enterica serovar Typhi
cugugucguccaggc

SEQ ID NO: 1717319 - RNA, 24 nt, Salmonella enterica enterica serovar Typhi
cuguguauucugcgccagccagcu

SEQ ID NO: 1717320 - RNA, 13 nt, Salmonella enterica enterica serovar Typhi
cuguguacuuuua

SEQ ID NO: 1717321 - RNA, 20 nt, Salmonella enterica enterica serovar Typhi
cugugugaccagcaguuccg

SEQ ID NO: 1717322 - RNA, 12 nt, Salmonella enterica enterica serovar Typhi
cugugugagcgc

SEQ ID NO: 1717323 - RNA, 18 nt, Salmonella enterica enterica serovar Typhi
cugugucguccaggccug

SEQ ID NO: 1717324 - RNA, 19 nt, Salmonella enterica enterica serovar Typhi
cugugugagcgcccgccgc

SEQ ID NO: 1717325 - RNA, 18 nt, Salmonella enterica enterica serovar Typhi
cuguguaccucuacauaa

SEQ ID NO: 1717326 - RNA, 16 nt, Salmonella enterica enterica serovar Typhi
cugugugggcacucga

SEQ ID NO: 1717327 - RNA, 19 nt, Salmonella enterica enterica serovar Typhi
cugugggcgugucgccggg

SEQ ID NO: 1717328 - RNA, 16 nt, Salmonella enterica enterica serovar Typhi
cugugcuuaccgggcc

SEQ ID NO: 1717329 - RNA, 18 nt, Salmonella enterica enterica serovar Typhi
cuguggcaauuuucaguu

SEQ ID NO: 1717330 - RNA, 19 nt, Salmonella enterica enterica serovar Typhi
cuccccguuccaccgccaa

SEQ ID NO: 1717331 - RNA, 21 nt, Salmonella enterica enterica serovar Typhi
cucccggaugcaccaucucuu

SEQ ID NO: 1717332 - RNA, 15 nt, Salmonella enterica enterica serovar Typhi
cuccccuuuuuuacu

SEQ ID NO: 1717333 - RNA, 15 nt, Salmonella enterica enterica serovar Typhi
cuccccuuuuuucug

SEQ ID NO: 1717334 - RNA, 22 nt, Salmonella enterica enterica serovar Typhi
cuccccgccccagcagcagccg

SEQ ID NO: 1717335 - RNA, 18 nt, Salmonella enterica enterica serovar Typhi
cuccccguuccaccgcca

SEQ ID NO: 1717336 - RNA, 16 nt, Salmonella enterica enterica serovar Typhi
cuccaccauaucgcag

SEQ ID NO: 1717337 - RNA, 19 nt, Salmonella enterica enterica serovar Typhi
cuccaccaaaucccccaac

SEQ ID NO: 1717338 - RNA, 13 nt, Salmonella enterica enterica serovar Typhi
cuccaccaaccag

SEQ ID NO: 1717339 - RNA, 14 nt, Salmonella enterica enterica serovar Typhi
cuccacaguucaau

SEQ ID NO: 1717340 - RNA, 14 nt, Salmonella enterica enterica serovar Typhi
cuccgccugcgguu

SEQ ID NO: 1717341 - RNA, 14 nt, Salmonella enterica enterica serovar Typhi
cuccgcgcauguaa

SEQ ID NO: 1717342 - RNA, 13 nt, Salmonella enterica enterica serovar Typhi
cuccgcgcuggca

SEQ ID NO: 1717343 - RNA, 18 nt, Salmonella enterica enterica serovar Typhi
cuccgagacucaaagaaa

SEQ ID NO: 1717344 - RNA, 15 nt, Salmonella enterica enterica serovar Typhi
cuccgaccaucgccg

SEQ ID NO: 1717345 - RNA, 16 nt, Salmonella enterica enterica serovar Typhi
cucccgguucgccgcu

SEQ ID NO: 1717346 - RNA, 20 nt, Salmonella enterica enterica serovar Typhi
cucccguuucgacgggaggu

SEQ ID NO: 1717347 - RNA, 18 nt, Salmonella enterica enterica serovar Typhi
cuccgacaaacuucaucg

SEQ ID NO: 1717348 - RNA, 17 nt, Salmonella enterica enterica serovar Typhi
cuccgguugcugauaac

SEQ ID NO: 1717349 - RNA, 22 nt, Salmonella enterica enterica serovar Typhi
cuccgucucuuuauugaaaagc

SEQ ID NO: 1717350 - RNA, 14 nt, Salmonella enterica enterica serovar Typhi
cuccggacguaccc

SEQ ID NO: 1717351 - RNA, 18 nt, Salmonella enterica enterica serovar Typhi
cuccggcacauucaccac

SEQ ID NO: 1717352 - RNA, 18 nt, Salmonella enterica enterica serovar Typhi
cuccgcguagcccagcgc

SEQ ID NO: 1717353 - RNA, 18 nt, Salmonella enterica enterica serovar Typhi
cuccugcgauagcugcug

SEQ ID NO: 1717354 - RNA, 15 nt, Salmonella enterica enterica serovar Typhi
cuccugcggccuugc

SEQ ID NO: 1717355 - RNA, 22 nt, Salmonella enterica enterica serovar Typhi
cuccugaaucgccgucagugag

SEQ ID NO: 1717356 - RNA, 11 nt, Salmonella enterica enterica serovar Typhi
cuccugcuccu

SEQ ID NO: 1717357 - RNA, 22 nt, Salmonella enterica enterica serovar Typhi
cuccugcggccuugccgccagc

SEQ ID NO: 1717358 - RNA, 13 nt, Salmonella enterica enterica serovar Typhi
cuccugcucccag

SEQ ID NO: 1717359 - RNA, 15 nt, Salmonella enterica enterica serovar Typhi
cuccuggauuuuacc

SEQ ID NO: 1717360 - RNA, 16 nt, Salmonella enterica enterica serovar Typhi
cuccuggauuuuaccu

SEQ ID NO: 1717361 - RNA, 22 nt, Salmonella enterica enterica serovar Typhi
cuccuccgguuucaacugucga

SEQ ID NO: 1717362 - RNA, 13 nt, Salmonella enterica enterica serovar Typhi
cuccuccggcuuc

SEQ ID NO: 1717363 - RNA, 18 nt, Salmonella enterica enterica serovar Typhi
cuccuggcuuaccugcuc

SEQ ID NO: 1717364 - RNA, 14 nt, Salmonella enterica enterica serovar Typhi
cuccugucaggcga

SEQ ID NO: 1717365 - RNA, 16 nt, Salmonella enterica enterica serovar Typhi
cuccuucuucgccguc

SEQ ID NO: 1717366 - RNA, 18 nt, Salmonella enterica enterica serovar Typhi
cucgccgauuggcaaaau

SEQ ID NO: 1717367 - RNA, 17 nt, Salmonella enterica enterica serovar Typhi
cucgccgaccggcgcgc

SEQ ID NO: 1717368 - RNA, 14 nt, Salmonella enterica enterica serovar Typhi
cucgccgcgcucca

SEQ ID NO: 1717369 - RNA, 13 nt, Salmonella enterica enterica serovar Typhi
cucgccgccuccc

SEQ ID NO: 1717370 - RNA, 11 nt, Salmonella enterica enterica serovar Typhi
cucgccgccgg

SEQ ID NO: 1717371 - RNA, 15 nt, Salmonella enterica enterica serovar Typhi
cucgccgccuccccc

SEQ ID NO: 1717372 - RNA, 22 nt, Salmonella enterica enterica serovar Typhi
cucgcccuucgggccgccgcaa

SEQ ID NO: 1717373 - RNA, 17 nt, Salmonella enterica enterica serovar Typhi
cucgcagguacgacacc

SEQ ID NO: 1717374 - RNA, 14 nt, Salmonella enterica enterica serovar Typhi
cucgcaauauucau

SEQ ID NO: 1717375 - RNA, 20 nt, Salmonella enterica enterica serovar Typhi
cucgaggaacuguucagcca

SEQ ID NO: 1717376 - RNA, 21 nt, Salmonella enterica enterica serovar Typhi
cucgaggaacuguucagccag

SEQ ID NO: 1717377 - RNA, 20 nt, Salmonella enterica enterica serovar Typhi
cucggcgagcaguacgccug

SEQ ID NO: 1717378 - RNA, 21 nt, Salmonella enterica enterica serovar Typhi
cucggcauacaccgccagcgu

SEQ ID NO: 1717379 - RNA, 16 nt, Salmonella enterica enterica serovar Typhi
cucggcaccauuggcg

SEQ ID NO: 1717380 - RNA, 16 nt, Salmonella enterica enterica serovar Typhi
cucgcgauaggccucg

SEQ ID NO: 1717381 - RNA, 15 nt, Salmonella enterica enterica serovar Typhi
cucgccuuucuccau

SEQ ID NO: 1717382 - RNA, 21 nt, Salmonella enterica enterica serovar Typhi
cucgccuuucuccauggucag

SEQ ID NO: 1717383 - RNA, 15 nt, Salmonella enterica enterica serovar Typhi
cucgccuucggccug

SEQ ID NO: 1717384 - RNA, 20 nt, Salmonella enterica enterica serovar Typhi
cucguauaucgcgauaaacu

SEQ ID NO: 1717385 - RNA, 13 nt, Salmonella enterica enterica serovar Typhi
cucgucgcgcgcc

SEQ ID NO: 1717386 - RNA, 23 nt, Salmonella enterica enterica serovar Typhi
cucguugauguuuuuaaaagaag

SEQ ID NO: 1717387 - RNA, 18 nt, Salmonella enterica enterica serovar Typhi
cucguugccauugguuca

SEQ ID NO: 1717388 - RNA, 15 nt, Salmonella enterica enterica serovar Typhi
cucguguaaggcuuc

SEQ ID NO: 1717389 - RNA, 18 nt, Salmonella enterica enterica serovar Typhi
cucuaauugaauauggug

SEQ ID NO: 1717390 - RNA, 17 nt, Salmonella enterica enterica serovar Typhi
cucugcgccuuuuaccu

SEQ ID NO: 1717391 - RNA, 20 nt, Salmonella enterica enterica serovar Typhi
cucugccgguugaccggccc

SEQ ID NO: 1717392 - RNA, 20 nt, Salmonella enterica enterica serovar Typhi
cucugccucagcaagaaguu

SEQ ID NO: 1717393 - RNA, 21 nt, Salmonella enterica enterica serovar Typhi
cucugccuguagcagcgccag

SEQ ID NO: 1717394 - RNA, 14 nt, Salmonella enterica enterica serovar Typhi
cucugcgacgccag

SEQ ID NO: 1717395 - RNA, 22 nt, Salmonella enterica enterica serovar Typhi
cucugcgcguaaacgcaacacc

SEQ ID NO: 1717396 - RNA, 21 nt, Salmonella enterica enterica serovar Typhi
cucuggccgcgcuuuuuuaac

SEQ ID NO: 1717397 - RNA, 22 nt, Salmonella enterica enterica serovar Typhi
cucugguaguuguaauaaacag

SEQ ID NO: 1717398 - RNA, 16 nt, Salmonella enterica enterica serovar Typhi
cucucuucgugacccg

SEQ ID NO: 1717399 - RNA, 21 nt, Salmonella enterica enterica serovar Typhi
cucucuuucgguagccacaga

SEQ ID NO: 1717400 - RNA, 18 nt, Salmonella enterica enterica serovar Typhi
cucugccaguugcucaua

SEQ ID NO: 1717401 - RNA, 22 nt, Salmonella enterica enterica serovar Typhi
cucuccugaauugcaaggcgac

SEQ ID NO: 1717402 - RNA, 21 nt, Salmonella enterica enterica serovar Typhi
cucucguucccgccugcugca

SEQ ID NO: 1717403 - RNA, 15 nt, Salmonella enterica enterica serovar Typhi
cucucguucccgccu

SEQ ID NO: 1717404 - RNA, 18 nt, Salmonella enterica enterica serovar Typhi
cucuccgcaauuaauuua

SEQ ID NO: 1717405 - RNA, 14 nt, Salmonella enterica enterica serovar Typhi
cucucccuggcagg

SEQ ID NO: 1717406 - RNA, 20 nt, Salmonella enterica enterica serovar Typhi
cucucccccaccgacacaaa

SEQ ID NO: 1717407 - RNA, 22 nt, Salmonella enterica enterica serovar Typhi
cucucagcgucggugaagaaaa

SEQ ID NO: 1717408 - RNA, 13 nt, Salmonella enterica enterica serovar Typhi
cucucauauucca

SEQ ID NO: 1717409 - RNA, 18 nt, Salmonella enterica enterica serovar Typhi
cucucauagccgacccgc

SEQ ID NO: 1717410 - RNA, 17 nt, Salmonella enterica enterica serovar Typhi
cucuccagcaggguauu

SEQ ID NO: 1717411 - RNA, 14 nt, Salmonella enterica enterica serovar Typhi
cucucauuuucuuu

SEQ ID NO: 1717412 - RNA, 23 nt, Salmonella enterica enterica serovar Typhi
cucucaccgccuaggccagugcc

SEQ ID NO: 1717413 - RNA, 16 nt, Salmonella enterica enterica serovar Typhi
cucuaggcgcugcugg

SEQ ID NO: 1717414 - RNA, 21 nt, Salmonella enterica enterica serovar Typhi
cucuauaccauaaaugaaacc

SEQ ID NO: 1717415 - RNA, 12 nt, Salmonella enterica enterica serovar Typhi
cucuauuuuuua

SEQ ID NO: 1717416 - RNA, 16 nt, Salmonella enterica enterica serovar Typhi
cucuauacggcgcgca

SEQ ID NO: 1717417 - RNA, 23 nt, Salmonella enterica enterica serovar Typhi
cucuauagauuucgcgucagggc

SEQ ID NO: 1717418 - RNA, 18 nt, Salmonella enterica enterica serovar Typhi
cugacaaaaacggcuuua

SEQ ID NO: 1717419 - RNA, 12 nt, Salmonella enterica enterica serovar Typhi
cugacacccucu

SEQ ID NO: 1717420 - RNA, 20 nt, Salmonella enterica enterica serovar Typhi
cugacagagcucgucaaaaa

SEQ ID NO: 1717421 - RNA, 20 nt, Salmonella enterica enterica serovar Typhi
cugacauaaucaugaacguu

SEQ ID NO: 1717422 - RNA, 16 nt, Salmonella enterica enterica serovar Typhi
cugacagccaaacugc

SEQ ID NO: 1717423 - RNA, 15 nt, Salmonella enterica enterica serovar Typhi
cugacacccucugcg

SEQ ID NO: 1717424 - RNA, 17 nt, Salmonella enterica enterica serovar Typhi
cugacaucucuuuuaau

SEQ ID NO: 1717425 - RNA, 15 nt, Salmonella enterica enterica serovar Typhi
cugacauuuauauua

SEQ ID NO: 1717426 - RNA, 20 nt, Salmonella enterica enterica serovar Typhi
cugaccgcgaucgcuggacg

SEQ ID NO: 1717427 - RNA, 14 nt, Salmonella enterica enterica serovar Typhi
cugaccgagaucag

SEQ ID NO: 1717428 - RNA, 22 nt, Salmonella enterica enterica serovar Typhi
cugaccaugcauauaagagacg

SEQ ID NO: 1717429 - RNA, 21 nt, Salmonella enterica enterica serovar Typhi
cugaccauugauuuccgcgca

SEQ ID NO: 1717430 - RNA, 14 nt, Salmonella enterica enterica serovar Typhi
cugaccagggcaaa

SEQ ID NO: 1717431 - RNA, 14 nt, Salmonella enterica enterica serovar Typhi
cugaccagacagau

SEQ ID NO: 1717432 - RNA, 20 nt, Salmonella enterica enterica serovar Typhi
cugaccaacgucagcaucuc

SEQ ID NO: 1717433 - RNA, 16 nt, Salmonella enterica enterica serovar Typhi
cugaccacauuuucuc

SEQ ID NO: 1717434 - RNA, 12 nt, Salmonella enterica enterica serovar Typhi
cugaaugguucc

SEQ ID NO: 1717435 - RNA, 22 nt, Salmonella enterica enterica serovar Typhi
cugaaugcugacgcguuuuuuc

SEQ ID NO: 1717436 - RNA, 21 nt, Salmonella enterica enterica serovar Typhi
cugaauuuaauggucuuaaau

SEQ ID NO: 1717437 - RNA, 14 nt, Salmonella enterica enterica serovar Typhi
cugaaucugcuccg

SEQ ID NO: 1717438 - RNA, 19 nt, Salmonella enterica enterica serovar Typhi
cugaaucugcggcugcgug

SEQ ID NO: 1717439 - RNA, 20 nt, Salmonella enterica enterica serovar Typhi
cugaaucuugcgcagcauau

SEQ ID NO: 1717440 - RNA, 16 nt, Salmonella enterica enterica serovar Typhi
cugaaucucuucccag

SEQ ID NO: 1717441 - RNA, 16 nt, Salmonella enterica enterica serovar Typhi
cugaaucagcaucuua

SEQ ID NO: 1717442 - RNA, 13 nt, Salmonella enterica enterica serovar Typhi
cugaauaucuucg

SEQ ID NO: 1717443 - RNA, 22 nt, Salmonella enterica enterica serovar Typhi
cugaauaaucggcgucauuuuc

SEQ ID NO: 1717444 - RNA, 21 nt, Salmonella enterica enterica serovar Typhi
cugaauaaauaguauaacgau

SEQ ID NO: 1717445 - RNA, 15 nt, Salmonella enterica enterica serovar Typhi
cugaauaaauugaau

SEQ ID NO: 1717446 - RNA, 18 nt, Salmonella enterica enterica serovar Typhi
cugaauaacccgcagccc

SEQ ID NO: 1717447 - RNA, 17 nt, Salmonella enterica enterica serovar Typhi
cugaauaucgucaguau

SEQ ID NO: 1717448 - RNA, 15 nt, Salmonella enterica enterica serovar Typhi
cugaauagccagccc

SEQ ID NO: 1717449 - RNA, 15 nt, Salmonella enterica enterica serovar Typhi
cugaaggacaagcug

SEQ ID NO: 1717450 - RNA, 21 nt, Salmonella enterica enterica serovar Typhi
cugaaguaucgacgcagacaa

SEQ ID NO: 1717451 - RNA, 14 nt, Salmonella enterica enterica serovar Typhi
cugacuccagcugg

SEQ ID NO: 1717452 - RNA, 16 nt, Salmonella enterica enterica serovar Typhi
cugacuauacccaaaa

SEQ ID NO: 1717453 - RNA, 15 nt, Salmonella enterica enterica serovar Typhi
cugacuauccacagc

SEQ ID NO: 1717454 - RNA, 18 nt, Salmonella enterica enterica serovar Typhi
cugacuauccacagcgaa

SEQ ID NO: 1717455 - RNA, 23 nt, Salmonella enterica enterica serovar Typhi
cugacggccugucuccucagcag

SEQ ID NO: 1717456 - RNA, 18 nt, Salmonella enterica enterica serovar Typhi
cugacggugguaaaucag

SEQ ID NO: 1717457 - RNA, 17 nt, Salmonella enterica enterica serovar Typhi
cugaccuuaauccagca

SEQ ID NO: 1717458 - RNA, 13 nt, Salmonella enterica enterica serovar Typhi
cugaccuacaggc

SEQ ID NO: 1717459 - RNA, 16 nt, Salmonella enterica enterica serovar Typhi
cugacgaaaaccgucc

SEQ ID NO: 1717460 - RNA, 23 nt, Salmonella enterica enterica serovar Typhi
cugacgccgguauucauaugcuc

SEQ ID NO: 1717461 - RNA, 16 nt, Salmonella enterica enterica serovar Typhi
cugacgagguuaucag

SEQ ID NO: 1717462 - RNA, 20 nt, Salmonella enterica enterica serovar Typhi
cugacgcaauuguugcgcca

SEQ ID NO: 1717463 - RNA, 13 nt, Salmonella enterica enterica serovar Typhi
cugacugcauaau

SEQ ID NO: 1717464 - RNA, 12 nt, Salmonella enterica enterica serovar Typhi
cugacuuuccug

SEQ ID NO: 1717465 - RNA, 20 nt, Salmonella enterica enterica serovar Typhi
cugagacaggccagaauuca

SEQ ID NO: 1717466 - RNA, 19 nt, Salmonella enterica enterica serovar Typhi
cugagauaauacauaucau

SEQ ID NO: 1717467 - RNA, 12 nt, Salmonella enterica enterica serovar Typhi
cugacuuuucca

SEQ ID NO: 1717468 - RNA, 16 nt, Salmonella enterica enterica serovar Typhi
cugagcacgcccgguc

SEQ ID NO: 1717469 - RNA, 18 nt, Salmonella enterica enterica serovar Typhi
cugagaucaaacaagaga

SEQ ID NO: 1717470 - RNA, 14 nt, Salmonella enterica enterica serovar Typhi
cugagccgcccggc

SEQ ID NO: 1717471 - RNA, 16 nt, Salmonella enterica enterica serovar Typhi
cugagcggcucaucca

SEQ ID NO: 1717472 - RNA, 21 nt, Salmonella enterica enterica serovar Typhi
cugagcggucgugccaaggca

SEQ ID NO: 1717473 - RNA, 16 nt, Salmonella enterica enterica serovar Typhi
cucuguccacacaggc

SEQ ID NO: 1717474 - RNA, 15 nt, Salmonella enterica enterica serovar Typhi
cucuuacguugcauu

SEQ ID NO: 1717475 - RNA, 19 nt, Salmonella enterica enterica serovar Typhi
cucuucaaacuccccuguc

SEQ ID NO: 1717476 - RNA, 23 nt, Salmonella enterica enterica serovar Typhi
cucuucaauuuccaucuguaaca

SEQ ID NO: 1717477 - RNA, 16 nt, Salmonella enterica enterica serovar Typhi
cucuucaucgcgccuc

SEQ ID NO: 1717478 - RNA, 22 nt, Salmonella enterica enterica serovar Typhi
cucuucaguaagcguaccauuc

SEQ ID NO: 1717479 - RNA, 16 nt, Salmonella enterica enterica serovar Typhi
cucuucaucuguggca

SEQ ID NO: 1717480 - RNA, 15 nt, Salmonella enterica enterica serovar Typhi
cucuucaucuuuuuc

SEQ ID NO: 1717481 - RNA, 12 nt, Salmonella enterica enterica serovar Typhi
cucuuccgccag

SEQ ID NO: 1717482 - RNA, 16 nt, Salmonella enterica enterica serovar Typhi
cucuuccccgacaaaa

SEQ ID NO: 1717483 - RNA, 17 nt, Salmonella enterica enterica serovar Typhi
cucuucccgucgcagca

SEQ ID NO: 1717484 - RNA, 13 nt, Salmonella enterica enterica serovar Typhi
cucuuccgccagc

SEQ ID NO: 1717485 - RNA, 15 nt, Salmonella enterica enterica serovar Typhi
cucuuccagcgccaa

SEQ ID NO: 1717486 - RNA, 16 nt, Salmonella enterica enterica serovar Typhi
cucuucgacaucuuca

SEQ ID NO: 1717487 - RNA, 14 nt, Salmonella enterica enterica serovar Typhi
cucuucgacacauu

SEQ ID NO: 1717488 - RNA, 12 nt, Salmonella enterica enterica serovar Typhi
cucuucgccaau

SEQ ID NO: 1717489 - RNA, 14 nt, Salmonella enterica enterica serovar Typhi
cucuuccugcugcg

SEQ ID NO: 1717490 - RNA, 17 nt, Salmonella enterica enterica serovar Typhi
cucuuccuccccaggcg

SEQ ID NO: 1717491 - RNA, 15 nt, Salmonella enterica enterica serovar Typhi
cucuuggucauaaua

SEQ ID NO: 1717492 - RNA, 20 nt, Salmonella enterica enterica serovar Typhi
cucuugugcuuccagcucca

SEQ ID NO: 1717493 - RNA, 13 nt, Salmonella enterica enterica serovar Typhi
cucuuuaacaauu

SEQ ID NO: 1717494 - RNA, 12 nt, Salmonella enterica enterica serovar Typhi
cucuuguuucuc

SEQ ID NO: 1717495 - RNA, 16 nt, Salmonella enterica enterica serovar Typhi
cucuuuauugcuggug

SEQ ID NO: 1717496 - RNA, 23 nt, Salmonella enterica enterica serovar Typhi
cucuuucagccgacuaucuucuu

SEQ ID NO: 1717497 - RNA, 21 nt, Salmonella enterica enterica serovar Typhi
cucuuucaccagcgccagaau

SEQ ID NO: 1717498 - RNA, 17 nt, Salmonella enterica enterica serovar Typhi
cucuuucauuucugccu

SEQ ID NO: 1717499 - RNA, 20 nt, Salmonella enterica enterica serovar Typhi
cucuucgugacccgccagca

SEQ ID NO: 1717500 - RNA, 18 nt, Salmonella enterica enterica serovar Typhi
cucuucucugaaaagagu

SEQ ID NO: 1717501 - RNA, 16 nt, Salmonella enterica enterica serovar Typhi
cucuucugaccaucuu

SEQ ID NO: 1717502 - RNA, 16 nt, Salmonella enterica enterica serovar Typhi
cucuucguuauuuucc

SEQ ID NO: 1717503 - RNA, 22 nt, Salmonella enterica enterica serovar Typhi
cucuucuuuuaauugccaggcg

SEQ ID NO: 1717504 - RNA, 17 nt, Salmonella enterica enterica serovar Typhi
cucuucuggcucccgca

SEQ ID NO: 1717505 - RNA, 20 nt, Salmonella enterica enterica serovar Typhi
cucuucuuugagcucccggu

SEQ ID NO: 1717506 - RNA, 23 nt, Salmonella enterica enterica serovar Typhi
cucuugccccacauguuggcauu

SEQ ID NO: 1717507 - RNA, 15 nt, Salmonella enterica enterica serovar Typhi
cugaaaucagccugc

SEQ ID NO: 1717508 - RNA, 15 nt, Salmonella enterica enterica serovar Typhi
cugaacauagccauc

SEQ ID NO: 1717509 - RNA, 13 nt, Salmonella enterica enterica serovar Typhi
cugaaccaacagc

SEQ ID NO: 1717510 - RNA, 13 nt, Salmonella enterica enterica serovar Typhi
cugaaccugccuu

SEQ ID NO: 1717511 - RNA, 19 nt, Salmonella enterica enterica serovar Typhi
cugaaccaacagcuggguc

SEQ ID NO: 1717512 - RNA, 18 nt, Salmonella enterica enterica serovar Typhi
cugaacgcccggcgcgac

SEQ ID NO: 1717513 - RNA, 21 nt, Salmonella enterica enterica serovar Typhi
cugaacucaucaugauauaau

SEQ ID NO: 1717514 - RNA, 13 nt, Salmonella enterica enterica serovar Typhi
cugaacucccggc

SEQ ID NO: 1717515 - RNA, 13 nt, Salmonella enterica enterica serovar Typhi
cugaagccugcuu

SEQ ID NO: 1717516 - RNA, 17 nt, Salmonella enterica enterica serovar Typhi
cugaagauaaacagcag

SEQ ID NO: 1717517 - RNA, 16 nt, Salmonella enterica enterica serovar Typhi
cugaagauaaaauugu

SEQ ID NO: 1717518 - RNA, 21 nt, Salmonella enterica enterica serovar Typhi
cugaacuuuuugcaggagcuc

SEQ ID NO: 1717519 - RNA, 14 nt, Salmonella enterica enterica serovar Typhi
cugaagauaaaauu

SEQ ID NO: 1717520 - RNA, 13 nt, Salmonella enterica enterica serovar Typhi
cugaaauaacucu

SEQ ID NO: 1717521 - RNA, 21 nt, Salmonella enterica enterica serovar Typhi
cugaaagagcgugcggcugac

SEQ ID NO: 1717522 - RNA, 17 nt, Salmonella enterica enterica serovar Typhi
cugaaacggaucaaaaa

SEQ ID NO: 1717523 - RNA, 23 nt, Salmonella enterica enterica serovar Typhi
cugaaaaucaaaucggcgccggc

SEQ ID NO: 1717524 - RNA, 14 nt, Salmonella enterica enterica serovar Typhi
cugaaaaucaaaaa

SEQ ID NO: 1717525 - RNA, 13 nt, Salmonella enterica enterica serovar Typhi
cucuuucuccaca

SEQ ID NO: 1717526 - RNA, 16 nt, Salmonella enterica enterica serovar Typhi
cucuuuuaauuuucug

SEQ ID NO: 1717527 - RNA, 14 nt, Salmonella enterica enterica serovar Typhi
cucuuuugcuucaa

SEQ ID NO: 1717528 - RNA, 12 nt, Salmonella enterica enterica serovar Typhi
cugaaaaauccc

SEQ ID NO: 1717529 - RNA, 19 nt, Salmonella enterica enterica serovar Typhi
cugaaaaauccccccuccu

SEQ ID NO: 1717530 - RNA, 20 nt, Salmonella enterica enterica serovar Typhi
cucuuuuuccgccugaucuu

SEQ ID NO: 1717531 - RNA, 12 nt, Salmonella enterica enterica serovar Typhi
cucuuuuucuuu

SEQ ID NO: 1717532 - RNA, 13 nt, Salmonella enterica enterica serovar Typhi
cuacucaggagau

SEQ ID NO: 1717533 - RNA, 16 nt, Salmonella enterica enterica serovar Typhi
cuacccgcaauaccaa

SEQ ID NO: 1717534 - RNA, 19 nt, Salmonella enterica enterica serovar Typhi
cuacccgguguaaaaaaug

SEQ ID NO: 1717535 - RNA, 20 nt, Salmonella enterica enterica serovar Typhi
cuacccaauugaauuuaaau

SEQ ID NO: 1717536 - RNA, 21 nt, Salmonella enterica enterica serovar Typhi
cuacuccgcgguguccugcuu

SEQ ID NO: 1717537 - RNA, 22 nt, Salmonella enterica enterica serovar Typhi
cuacucgggccagcucuuuucu

SEQ ID NO: 1717538 - RNA, 16 nt, Salmonella enterica enterica serovar Typhi
cuacuuaccggcgcca

SEQ ID NO: 1717539 - RNA, 17 nt, Salmonella enterica enterica serovar Typhi
cuacuguggugugccug

SEQ ID NO: 1717540 - RNA, 14 nt, Salmonella enterica enterica serovar Typhi
cuacuucagcacgg

SEQ ID NO: 1717541 - RNA, 15 nt, Salmonella enterica enterica serovar Typhi
cuacuuuauuuuucg

SEQ ID NO: 1717542 - RNA, 16 nt, Salmonella enterica enterica serovar Typhi
cuaggggcucuuuuuu

SEQ ID NO: 1717543 - RNA, 15 nt, Salmonella enterica enterica serovar Typhi
cuagucaauaaagac

SEQ ID NO: 1717544 - RNA, 21 nt, Salmonella enterica enterica serovar Typhi
cuagcuuaucgccaaagauau

SEQ ID NO: 1717545 - RNA, 23 nt, Salmonella enterica enterica serovar Typhi
cuagaugaugauuuaugaauagc

SEQ ID NO: 1717546 - RNA, 20 nt, Salmonella enterica enterica serovar Typhi
cuagaugaugauuuaugaau

SEQ ID NO: 1717547 - RNA, 15 nt, Salmonella enterica enterica serovar Typhi
cuaucgcugcgcugc

SEQ ID NO: 1717548 - RNA, 13 nt, Salmonella enterica enterica serovar Typhi
cuaucgcuuuaac

SEQ ID NO: 1717549 - RNA, 20 nt, Salmonella enterica enterica serovar Typhi
cuauccgccagguauucuaa

SEQ ID NO: 1717550 - RNA, 15 nt, Salmonella enterica enterica serovar Typhi
cuauccgccgccagc

SEQ ID NO: 1717551 - RNA, 14 nt, Salmonella enterica enterica serovar Typhi
cuauccgcgccggg

SEQ ID NO: 1717552 - RNA, 20 nt, Salmonella enterica enterica serovar Typhi
cuaucgcgacggaccggcag

SEQ ID NO: 1717553 - RNA, 20 nt, Salmonella enterica enterica serovar Typhi
cuaucgcuccucccugacug

SEQ ID NO: 1717554 - RNA, 23 nt, Salmonella enterica enterica serovar Typhi
cuaucguuauauauacuucacca

SEQ ID NO: 1717555 - RNA, 13 nt, Salmonella enterica enterica serovar Typhi
cuaugccagaaua

SEQ ID NO: 1717556 - RNA, 13 nt, Salmonella enterica enterica serovar Typhi
cuaugcaaaacgu

SEQ ID NO: 1717557 - RNA, 14 nt, Salmonella enterica enterica serovar Typhi
cuaugcaaaagaaa

SEQ ID NO: 1717558 - RNA, 15 nt, Salmonella enterica enterica serovar Typhi
cuaugcaaaagaaaa

SEQ ID NO: 1717559 - RNA, 20 nt, Salmonella enterica enterica serovar Typhi
cuauucauuauuuuuaaaua

SEQ ID NO: 1717560 - RNA, 12 nt, Salmonella enterica enterica serovar Typhi
cuauucccaggc

SEQ ID NO: 1717561 - RNA, 20 nt, Salmonella enterica enterica serovar Typhi
cuauucccaggcaaaugauu

SEQ ID NO: 1717562 - RNA, 15 nt, Salmonella enterica enterica serovar Typhi
cuauucagcaguuca

SEQ ID NO: 1717563 - RNA, 18 nt, Salmonella enterica enterica serovar Typhi
cuauuccaaaauaauaaa

SEQ ID NO: 1717564 - RNA, 15 nt, Salmonella enterica enterica serovar Typhi
cuauucguucucuga

SEQ ID NO: 1717565 - RNA, 17 nt, Salmonella enterica enterica serovar Typhi
cuauuaaagcacaagaa

SEQ ID NO: 1717566 - RNA, 19 nt, Salmonella enterica enterica serovar Typhi
cuauuaggcacuaccaccu

SEQ ID NO: 1717567 - RNA, 21 nt, Salmonella enterica enterica serovar Typhi
cuauucaccagacuaaaacgu

SEQ ID NO: 1717568 - RNA, 23 nt, Salmonella enterica enterica serovar Typhi
cuauccauaccggacuccaggca

SEQ ID NO: 1717569 - RNA, 12 nt, Salmonella enterica enterica serovar Typhi
cuauccagcagu

SEQ ID NO: 1717570 - RNA, 18 nt, Salmonella enterica enterica serovar Typhi
cuauccacgcagacgccg

SEQ ID NO: 1717571 - RNA, 15 nt, Salmonella enterica enterica serovar Typhi
cuauccacagcgaau

SEQ ID NO: 1717572 - RNA, 16 nt, Salmonella enterica enterica serovar Typhi
cuaucaugcugcgguu

SEQ ID NO: 1717573 - RNA, 13 nt, Salmonella enterica enterica serovar Typhi
cuaucaccgccuc

SEQ ID NO: 1717574 - RNA, 20 nt, Salmonella enterica enterica serovar Typhi
cuaucaccgccucgaccccu

SEQ ID NO: 1717575 - RNA, 23 nt, Salmonella enterica enterica serovar Typhi
cuaucagaauauccgguacacca

SEQ ID NO: 1717576 - RNA, 14 nt, Salmonella enterica enterica serovar Typhi
cuaucagccgcgac

SEQ ID NO: 1717577 - RNA, 16 nt, Salmonella enterica enterica serovar Typhi
cuaucaagauaaaaag

SEQ ID NO: 1717578 - RNA, 17 nt, Salmonella enterica enterica serovar Typhi
cuaucaagauaaaaaga

SEQ ID NO: 1717579 - RNA, 17 nt, Salmonella enterica enterica serovar Typhi
cuauaguggcauuuacc

SEQ ID NO: 1717580 - RNA, 16 nt, Salmonella enterica enterica serovar Typhi
cuauauuccagccagg

SEQ ID NO: 1717581 - RNA, 16 nt, Salmonella enterica enterica serovar Typhi
cuauagcuuuucauau

SEQ ID NO: 1717582 - RNA, 19 nt, Salmonella enterica enterica serovar Typhi
cuauagauuucgcgucagg

SEQ ID NO: 1717583 - RNA, 16 nt, Salmonella enterica enterica serovar Typhi
cuauaaaaaugaggua

SEQ ID NO: 1717584 - RNA, 23 nt, Salmonella enterica enterica serovar Typhi
cuauagagagauggaacaucuuu

SEQ ID NO: 1717585 - RNA, 24 nt, Salmonella enterica enterica serovar Typhi
cucacgaauaagaaucagaugcuc

SEQ ID NO: 1717586 - RNA, 16 nt, Salmonella enterica enterica serovar Typhi
cucaccgaccugccuu

SEQ ID NO: 1717587 - RNA, 18 nt, Salmonella enterica enterica serovar Typhi
cucacgaauaagaaucag

SEQ ID NO: 1717588 - RNA, 20 nt, Salmonella enterica enterica serovar Typhi
cucaccgagacugcccggca

SEQ ID NO: 1717589 - RNA, 16 nt, Salmonella enterica enterica serovar Typhi
cucacggauauuaccc

SEQ ID NO: 1717590 - RNA, 14 nt, Salmonella enterica enterica serovar Typhi
cucacgcuggugcu

SEQ ID NO: 1717591 - RNA, 19 nt, Salmonella enterica enterica serovar Typhi
cucacggcacgcccuucgu

SEQ ID NO: 1717592 - RNA, 21 nt, Salmonella enterica enterica serovar Typhi
cucacuacccggaggcaauau

SEQ ID NO: 1717593 - RNA, 14 nt, Salmonella enterica enterica serovar Typhi
cucacguuccccag

SEQ ID NO: 1717594 - RNA, 15 nt, Salmonella enterica enterica serovar Typhi
cucacguuccccagc

SEQ ID NO: 1717595 - RNA, 22 nt, Salmonella enterica enterica serovar Typhi
cucaacugggcgagggaggcaa

SEQ ID NO: 1717596 - RNA, 20 nt, Salmonella enterica enterica serovar Typhi
cucaaguuauguuaucccca

SEQ ID NO: 1717597 - RNA, 21 nt, Salmonella enterica enterica serovar Typhi
cucaauacgagugacauuauu

SEQ ID NO: 1717598 - RNA, 22 nt, Salmonella enterica enterica serovar Typhi
cucaaucacuuaucaaaccagc

SEQ ID NO: 1717599 - RNA, 18 nt, Salmonella enterica enterica serovar Typhi
cucaauauacuuaucggc

SEQ ID NO: 1717600 - RNA, 21 nt, Salmonella enterica enterica serovar Typhi
cucaaucacuuuugcgaccca

SEQ ID NO: 1717601 - RNA, 18 nt, Salmonella enterica enterica serovar Typhi
cucacaauaauuuuacca

SEQ ID NO: 1717602 - RNA, 20 nt, Salmonella enterica enterica serovar Typhi
cucacagaaucaucaggcua

SEQ ID NO: 1717603 - RNA, 19 nt, Salmonella enterica enterica serovar Typhi
cucacagaaucaucaggcu

SEQ ID NO: 1717604 - RNA, 13 nt, Salmonella enterica enterica serovar Typhi
cucacccaggcga

SEQ ID NO: 1717605 - RNA, 14 nt, Salmonella enterica enterica serovar Typhi
cucacccaggcgau

SEQ ID NO: 1717606 - RNA, 19 nt, Salmonella enterica enterica serovar Typhi
cucacccaguuuuuuucug

SEQ ID NO: 1717607 - RNA, 20 nt, Salmonella enterica enterica serovar Typhi
cuauugagguaguccugcuc

SEQ ID NO: 1717608 - RNA, 15 nt, Salmonella enterica enterica serovar Typhi
cuauugccuaaauaa

SEQ ID NO: 1717609 - RNA, 14 nt, Salmonella enterica enterica serovar Typhi
cucaagcgcagcac

SEQ ID NO: 1717610 - RNA, 19 nt, Salmonella enterica enterica serovar Typhi
cucaagacgguuauuuuuc

SEQ ID NO: 1717611 - RNA, 13 nt, Salmonella enterica enterica serovar Typhi
cucaacuauuaaa

SEQ ID NO: 1717612 - RNA, 13 nt, Salmonella enterica enterica serovar Typhi
cucaacugagcgg

SEQ ID NO: 1717613 - RNA, 17 nt, Salmonella enterica enterica serovar Typhi
cucaacauacgccgcca

SEQ ID NO: 1717614 - RNA, 18 nt, Salmonella enterica enterica serovar Typhi
cucaacacauaacgcccg

SEQ ID NO: 1717615 - RNA, 21 nt, Salmonella enterica enterica serovar Typhi
cucaacacauaacgcccgaca

SEQ ID NO: 1717616 - RNA, 21 nt, Salmonella enterica enterica serovar Typhi
cucaacgcccucaaguaaaau

SEQ ID NO: 1717617 - RNA, 21 nt, Salmonella enterica enterica serovar Typhi
cucauucgggcacuccggcuc

SEQ ID NO: 1717618 - RNA, 19 nt, Salmonella enterica enterica serovar Typhi
cucauucugauuuuacuaa

SEQ ID NO: 1717619 - RNA, 23 nt, Salmonella enterica enterica serovar Typhi
cucaucagguaauacaggguuug

SEQ ID NO: 1717620 - RNA, 14 nt, Salmonella enterica enterica serovar Typhi
cucauauacccugc

SEQ ID NO: 1717621 - RNA, 16 nt, Salmonella enterica enterica serovar Typhi
cucauauuccagccac

SEQ ID NO: 1717622 - RNA, 15 nt, Salmonella enterica enterica serovar Typhi
cucauauacccugcg

SEQ ID NO: 1717623 - RNA, 14 nt, Salmonella enterica enterica serovar Typhi
cucauccaccuuau

SEQ ID NO: 1717624 - RNA, 17 nt, Salmonella enterica enterica serovar Typhi
cucauccagcaaaauaa

SEQ ID NO: 1717625 - RNA, 18 nt, Salmonella enterica enterica serovar Typhi
cucaugauagggcagcag

SEQ ID NO: 1717626 - RNA, 22 nt, Salmonella enterica enterica serovar Typhi
cucaugcaagacaucuaacucu

SEQ ID NO: 1717627 - RNA, 13 nt, Salmonella enterica enterica serovar Typhi
cucaucuuuuaca

SEQ ID NO: 1717628 - RNA, 18 nt, Salmonella enterica enterica serovar Typhi
cucacugccgacgcccuc

SEQ ID NO: 1717629 - RNA, 13 nt, Salmonella enterica enterica serovar Typhi
cucagcggcggcg

SEQ ID NO: 1717630 - RNA, 17 nt, Salmonella enterica enterica serovar Typhi
cucagggagaacucauc

SEQ ID NO: 1717631 - RNA, 17 nt, Salmonella enterica enterica serovar Typhi
cucagggucagaauaca

SEQ ID NO: 1717632 - RNA, 21 nt, Salmonella enterica enterica serovar Typhi
cucagcgucggugaagaaaau

SEQ ID NO: 1717633 - RNA, 23 nt, Salmonella enterica enterica serovar Typhi
cucaggcgcgaauaaugcguccg

SEQ ID NO: 1717634 - RNA, 19 nt, Salmonella enterica enterica serovar Typhi
cucagcuaaaaacagcgca

SEQ ID NO: 1717635 - RNA, 14 nt, Salmonella enterica enterica serovar Typhi
cucauagccgcuuu

SEQ ID NO: 1717636 - RNA, 13 nt, Salmonella enterica enterica serovar Typhi
cucauacccuucc

SEQ ID NO: 1717637 - RNA, 15 nt, Salmonella enterica enterica serovar Typhi
cucauacccuuccag

SEQ ID NO: 1717638 - RNA, 20 nt, Salmonella enterica enterica serovar Typhi
cucauacagcccgcgcagaa

SEQ ID NO: 1717639 - RNA, 22 nt, Salmonella enterica enterica serovar Typhi
cuacagaaagccauaaaacugg

SEQ ID NO: 1717640 - RNA, 13 nt, Salmonella enterica enterica serovar Typhi
cuacacucaauac

SEQ ID NO: 1717641 - RNA, 21 nt, Salmonella enterica enterica serovar Typhi
cuacacucuuaacauggcgga

SEQ ID NO: 1717642 - RNA, 20 nt, Salmonella enterica enterica serovar Typhi
cuacaguguaaaaauuuuug

SEQ ID NO: 1717643 - RNA, 15 nt, Salmonella enterica enterica serovar Typhi
cuacaucaagagaaa

SEQ ID NO: 1717644 - RNA, 13 nt, Salmonella enterica enterica serovar Typhi
cuacauaucuaua

SEQ ID NO: 1717645 - RNA, 13 nt, Salmonella enterica enterica serovar Typhi
cuaccauaaugau

SEQ ID NO: 1717646 - RNA, 15 nt, Salmonella enterica enterica serovar Typhi
cuaccaucgcgcgca

SEQ ID NO: 1717647 - RNA, 11 nt, Salmonella enterica enterica serovar Typhi
cuaccaucggc

SEQ ID NO: 1717648 - RNA, 16 nt, Salmonella enterica enterica serovar Typhi
cuaccauuacccgaac

SEQ ID NO: 1717649 - RNA, 16 nt, Salmonella enterica enterica serovar Typhi
cuaccagaucgcggua

SEQ ID NO: 1717650 - RNA, 16 nt, Salmonella enterica enterica serovar Typhi
cuaccacgcugccgcc

SEQ ID NO: 1717651 - RNA, 19 nt, Salmonella enterica enterica serovar Typhi
cuaccagcgcuauccaggc

SEQ ID NO: 1717652 - RNA, 21 nt, Salmonella enterica enterica serovar Typhi
cuaccagcgcuauccaggccg

SEQ ID NO: 1717653 - RNA, 16 nt, Salmonella enterica enterica serovar Typhi
cuaccaacaaaucauu

SEQ ID NO: 1717654 - RNA, 17 nt, Salmonella enterica enterica serovar Typhi
cuaauuugaugccuggc

SEQ ID NO: 1717655 - RNA, 20 nt, Salmonella enterica enterica serovar Typhi
cuaauuuauugccacgccau

SEQ ID NO: 1717656 - RNA, 14 nt, Salmonella enterica enterica serovar Typhi
cuaauuuuuaaaga

SEQ ID NO: 1717657 - RNA, 12 nt, Salmonella enterica enterica serovar Typhi
cuacaaagcugg

SEQ ID NO: 1717658 - RNA, 14 nt, Salmonella enterica enterica serovar Typhi
cuacaccugggcuu

SEQ ID NO: 1717659 - RNA, 22 nt, Salmonella enterica enterica serovar Typhi
cuacaccguauccggccugcag

SEQ ID NO: 1717660 - RNA, 19 nt, Salmonella enterica enterica serovar Typhi
cuacaccccuucuggagaa

SEQ ID NO: 1717661 - RNA, 16 nt, Salmonella enterica enterica serovar Typhi
cuacacgaauaccucu

SEQ ID NO: 1717662 - RNA, 18 nt, Salmonella enterica enterica serovar Typhi
cuacaccuucuucgccaa

SEQ ID NO: 1717663 - RNA, 22 nt, Salmonella enterica enterica serovar Typhi
cuacacacucggugcauuuguc

SEQ ID NO: 1717664 - RNA, 14 nt, Salmonella enterica enterica serovar Typhi
cuaauggcaauaau

SEQ ID NO: 1717665 - RNA, 16 nt, Salmonella enterica enterica serovar Typhi
cuaauguacgccuaaa

SEQ ID NO: 1717666 - RNA, 15 nt, Salmonella enterica enterica serovar Typhi
cuaauguacgccuaa

SEQ ID NO: 1717667 - RNA, 21 nt, Salmonella enterica enterica serovar Typhi
cuaaugauuaucuuuuuuagu

SEQ ID NO: 1717668 - RNA, 15 nt, Salmonella enterica enterica serovar Typhi
cuaauuauuuuucaa

SEQ ID NO: 1717669 - RNA, 19 nt, Salmonella enterica enterica serovar Typhi
cuaauuauuuuucaaauga

SEQ ID NO: 1717670 - RNA, 16 nt, Salmonella enterica enterica serovar Typhi
cuaauccccagcgcuc

SEQ ID NO: 1717671 - RNA, 16 nt, Salmonella enterica enterica serovar Typhi
cuaauccccauuuuuu

SEQ ID NO: 1717672 - RNA, 20 nt, Salmonella enterica enterica serovar Typhi
cuaauccccauuuuuuucag

SEQ ID NO: 1717673 - RNA, 21 nt, Salmonella enterica enterica serovar Typhi
cuaaucccuggcgaauaaaau

SEQ ID NO: 1717674 - RNA, 22 nt, Salmonella enterica enterica serovar Typhi
cuaauccucuucucugaaaaga

SEQ ID NO: 1717675 - RNA, 15 nt, Salmonella enterica enterica serovar Typhi
cuaaugaauuuaaua

SEQ ID NO: 1717676 - RNA, 19 nt, Salmonella enterica enterica serovar Typhi
cuaaucaauaaguuuuuuc

SEQ ID NO: 1717677 - RNA, 21 nt, Salmonella enterica enterica serovar Typhi
cuaaucaauaaguuuuuucuu

SEQ ID NO: 1717678 - RNA, 18 nt, Salmonella enterica enterica serovar Typhi
cuaaucacccacuucuca

SEQ ID NO: 1717679 - RNA, 15 nt, Salmonella enterica enterica serovar Typhi
cuaacgucagcgcca

SEQ ID NO: 1717680 - RNA, 24 nt, Salmonella enterica enterica serovar Typhi
cuaaaucagugauggauuucacga

SEQ ID NO: 1717681 - RNA, 20 nt, Salmonella enterica enterica serovar Typhi
cuaacugcggcuuacccuga

SEQ ID NO: 1717682 - RNA, 19 nt, Salmonella enterica enterica serovar Typhi
cuaaggucacuacgcggcu

SEQ ID NO: 1717683 - RNA, 21 nt, Salmonella enterica enterica serovar Typhi
cuaagcagaacggcgauacuc

SEQ ID NO: 1717684 - RNA, 16 nt, Salmonella enterica enterica serovar Typhi
cuaauaaaauucacuu

SEQ ID NO: 1717685 - RNA, 20 nt, Salmonella enterica enterica serovar Typhi
cuaagguugaaaggccuaaa

SEQ ID NO: 1717686 - RNA, 13 nt, Salmonella enterica enterica serovar Typhi
cguuuauuauuug

SEQ ID NO: 1717687 - RNA, 20 nt, Salmonella enterica enterica serovar Typhi
cguuucaacaaacucagcca

SEQ ID NO: 1717688 - RNA, 15 nt, Salmonella enterica enterica serovar Typhi
cguuuauuauaaaca

SEQ ID NO: 1717689 - RNA, 14 nt, Salmonella enterica enterica serovar Typhi
cguuuaugcaggaa

SEQ ID NO: 1717690 - RNA, 19 nt, Salmonella enterica enterica serovar Typhi
cguuucguuuagcgccugc

SEQ ID NO: 1717691 - RNA, 16 nt, Salmonella enterica enterica serovar Typhi
cguuucagucaccagc

SEQ ID NO: 1717692 - RNA, 19 nt, Salmonella enterica enterica serovar Typhi
cguuucacaaccuccacgc

SEQ ID NO: 1717693 - RNA, 19 nt, Salmonella enterica enterica serovar Typhi
cguugcguguuguacagca

SEQ ID NO: 1717694 - RNA, 22 nt, Salmonella enterica enterica serovar Typhi
cguugcuggacauauuccagaa

SEQ ID NO: 1717695 - RNA, 18 nt, Salmonella enterica enterica serovar Typhi
cguugucuucaucuaucc

SEQ ID NO: 1717696 - RNA, 18 nt, Salmonella enterica enterica serovar Typhi
cguuguggcgaccagcag

SEQ ID NO: 1717697 - RNA, 15 nt, Salmonella enterica enterica serovar Typhi
cguugugcugcggca

SEQ ID NO: 1717698 - RNA, 17 nt, Salmonella enterica enterica serovar Typhi
cguugugcagaaucauu

SEQ ID NO: 1717699 - RNA, 19 nt, Salmonella enterica enterica serovar Typhi
cguuuucauuagccgccag

SEQ ID NO: 1717700 - RNA, 20 nt, Salmonella enterica enterica serovar Typhi
cguuuucauuagccgccagc

SEQ ID NO: 1717701 - RNA, 21 nt, Salmonella enterica enterica serovar Typhi
cguuuuccagcaccaguugcg

SEQ ID NO: 1717702 - RNA, 14 nt, Salmonella enterica enterica serovar Typhi
cguuuuccagcauc

SEQ ID NO: 1717703 - RNA, 18 nt, Salmonella enterica enterica serovar Typhi
cguuuucauuagccgcca

SEQ ID NO: 1717704 - RNA, 14 nt, Salmonella enterica enterica serovar Typhi
cguuugaacagcag

SEQ ID NO: 1717705 - RNA, 18 nt, Salmonella enterica enterica serovar Typhi
cguuugacggauuuuuuu

SEQ ID NO: 1717706 - RNA, 19 nt, Salmonella enterica enterica serovar Typhi
cguuucucgcgaccagaga

SEQ ID NO: 1717707 - RNA, 13 nt, Salmonella enterica enterica serovar Typhi
cguuuucugagcg

SEQ ID NO: 1717708 - RNA, 13 nt, Salmonella enterica enterica serovar Typhi
cguuuugcagcgc

SEQ ID NO: 1717709 - RNA, 23 nt, Salmonella enterica enterica serovar Typhi
cguuuuccaggugcugccacauc

SEQ ID NO: 1717710 - RNA, 17 nt, Salmonella enterica enterica serovar Typhi
cguuuugcugccacguc

SEQ ID NO: 1717711 - RNA, 19 nt, Salmonella enterica enterica serovar Typhi
cguuuuggguaaauaccag

SEQ ID NO: 1717712 - RNA, 12 nt, Salmonella enterica enterica serovar Typhi
cguuuugcuguc

SEQ ID NO: 1717713 - RNA, 17 nt, Salmonella enterica enterica serovar Typhi
cguuuuggcagcgcccg

SEQ ID NO: 1717714 - RNA, 15 nt, Salmonella enterica enterica serovar Typhi
cuaaacucaacuggg

SEQ ID NO: 1717715 - RNA, 15 nt, Salmonella enterica enterica serovar Typhi
cuaaacucaucuuua

SEQ ID NO: 1717716 - RNA, 13 nt, Salmonella enterica enterica serovar Typhi
cuaaauaaaaaua

SEQ ID NO: 1717717 - RNA, 17 nt, Salmonella enterica enterica serovar Typhi
cguuuuucagccgcgca

SEQ ID NO: 1717718 - RNA, 14 nt, Salmonella enterica enterica serovar Typhi
cguugacgggcgac

SEQ ID NO: 1717719 - RNA, 18 nt, Salmonella enterica enterica serovar Typhi
cguugauuaucacccaca

SEQ ID NO: 1717720 - RNA, 12 nt, Salmonella enterica enterica serovar Typhi
cguugaccagcg

SEQ ID NO: 1717721 - RNA, 22 nt, Salmonella enterica enterica serovar Typhi
cguugaccagccuaccugccgc

SEQ ID NO: 1717722 - RNA, 15 nt, Salmonella enterica enterica serovar Typhi
cguucucauugcugu

SEQ ID NO: 1717723 - RNA, 22 nt, Salmonella enterica enterica serovar Typhi
cguucuauugucaccgggcgcu

SEQ ID NO: 1717724 - RNA, 15 nt, Salmonella enterica enterica serovar Typhi
cguugccaaaagguu

SEQ ID NO: 1717725 - RNA, 18 nt, Salmonella enterica enterica serovar Typhi
cguugcgaaucagguaca

SEQ ID NO: 1717726 - RNA, 17 nt, Salmonella enterica enterica serovar Typhi
cguugcgccuuuccggc

SEQ ID NO: 1717727 - RNA, 17 nt, Salmonella enterica enterica serovar Typhi
cguugccguaggcaacg

SEQ ID NO: 1717728 - RNA, 21 nt, Salmonella enterica enterica serovar Typhi
cguugccguaggcaacgaccc

SEQ ID NO: 1717729 - RNA, 15 nt, Salmonella enterica enterica serovar Typhi
cguugccugauaaau

SEQ ID NO: 1717730 - RNA, 18 nt, Salmonella enterica enterica serovar Typhi
cguugccuggccuccggc

SEQ ID NO: 1717731 - RNA, 17 nt, Salmonella enterica enterica serovar Typhi
cguugccgcaggcaacg

SEQ ID NO: 1717732 - RNA, 12 nt, Salmonella enterica enterica serovar Typhi
cguugccgccgu

SEQ ID NO: 1717733 - RNA, 20 nt, Salmonella enterica enterica serovar Typhi
cguuccgcgauuuccugugu

SEQ ID NO: 1717734 - RNA, 15 nt, Salmonella enterica enterica serovar Typhi
cguucauucccgcca

SEQ ID NO: 1717735 - RNA, 19 nt, Salmonella enterica enterica serovar Typhi
cguucauucgccccagcau

SEQ ID NO: 1717736 - RNA, 16 nt, Salmonella enterica enterica serovar Typhi
cguucauugcuuucuu

SEQ ID NO: 1717737 - RNA, 16 nt, Salmonella enterica enterica serovar Typhi
cguucaucggcauaca

SEQ ID NO: 1717738 - RNA, 14 nt, Salmonella enterica enterica serovar Typhi
cguucauccgacca

SEQ ID NO: 1717739 - RNA, 12 nt, Salmonella enterica enterica serovar Typhi
cguucauccucc

SEQ ID NO: 1717740 - RNA, 14 nt, Salmonella enterica enterica serovar Typhi
cguucaucaggcaa

SEQ ID NO: 1717741 - RNA, 19 nt, Salmonella enterica enterica serovar Typhi
cguucauaguuugcauaac

SEQ ID NO: 1717742 - RNA, 14 nt, Salmonella enterica enterica serovar Typhi
cguuccguuaauug

SEQ ID NO: 1717743 - RNA, 20 nt, Salmonella enterica enterica serovar Typhi
cguuccguucgcgucacaau

SEQ ID NO: 1717744 - RNA, 13 nt, Salmonella enterica enterica serovar Typhi
cguucggguuuuc

SEQ ID NO: 1717745 - RNA, 16 nt, Salmonella enterica enterica serovar Typhi
cguucggguuuuccug

SEQ ID NO: 1717746 - RNA, 18 nt, Salmonella enterica enterica serovar Typhi
cguucgggguugaugguu

SEQ ID NO: 1717747 - RNA, 22 nt, Salmonella enterica enterica serovar Typhi
cguccaacuggcuuucauccaa

SEQ ID NO: 1717748 - RNA, 15 nt, Salmonella enterica enterica serovar Typhi
cguccacauccccgc

SEQ ID NO: 1717749 - RNA, 21 nt, Salmonella enterica enterica serovar Typhi
cgucauuaccaguugaccaaa

SEQ ID NO: 1717750 - RNA, 13 nt, Salmonella enterica enterica serovar Typhi
cgucauuuacugc

SEQ ID NO: 1717751 - RNA, 18 nt, Salmonella enterica enterica serovar Typhi
cguuauccagcagccaca

SEQ ID NO: 1717752 - RNA, 12 nt, Salmonella enterica enterica serovar Typhi
cguuauggaagu

SEQ ID NO: 1717753 - RNA, 14 nt, Salmonella enterica enterica serovar Typhi
cguuaucggccugc

SEQ ID NO: 1717754 - RNA, 21 nt, Salmonella enterica enterica serovar Typhi
cguuauaaggccugccguccu

SEQ ID NO: 1717755 - RNA, 20 nt, Salmonella enterica enterica serovar Typhi
cguuaucaaaaaaaaccaga

SEQ ID NO: 1717756 - RNA, 13 nt, Salmonella enterica enterica serovar Typhi
aaaaaaacgcauu

SEQ ID NO: 1717757 - RNA, 10 nt, Salmonella enterica enterica serovar Typhi
aaaaaacagg

SEQ ID NO: 1717758 - RNA, 21 nt, Salmonella enterica enterica serovar Typhi
aaaaaagucacuuacuuucuu

SEQ ID NO: 1717759 - RNA, 12 nt, Salmonella enterica enterica serovar Typhi
aaaaaacaucau

SEQ ID NO: 1717760 - RNA, 13 nt, Salmonella enterica enterica serovar Typhi
aaaaaacaucaug

SEQ ID NO: 1717761 - RNA, 13 nt, Salmonella enterica enterica serovar Typhi
aaaaaacaccugu

SEQ ID NO: 1717762 - RNA, 11 nt, Salmonella enterica enterica serovar Typhi
aaaaaaccaga

SEQ ID NO: 1717763 - RNA, 19 nt, Salmonella enterica enterica serovar Typhi
aaaaaaccggcaacucgcc

SEQ ID NO: 1717764 - RNA, 18 nt, Salmonella enterica enterica serovar Typhi
aaaaaaguuauuuuuucu

SEQ ID NO: 1717765 - RNA, 17 nt, Salmonella enterica enterica serovar Typhi
aaaaaagugauccccca

SEQ ID NO: 1717766 - RNA, 13 nt, Salmonella enterica enterica serovar Typhi
aaaaaauaucucu

SEQ ID NO: 1717767 - RNA, 21 nt, Salmonella enterica enterica serovar Typhi
aaaaacaggcgcaggcauuaa

SEQ ID NO: 1717768 - RNA, 12 nt, Salmonella enterica enterica serovar Typhi
aaaaaaucagca

SEQ ID NO: 1717769 - RNA, 16 nt, Salmonella enterica enterica serovar Typhi
aaaaaaugagaacacc

SEQ ID NO: 1717770 - RNA, 12 nt, Salmonella enterica enterica serovar Typhi
aaaaaauccuca

SEQ ID NO: 1717771 - RNA, 16 nt, Salmonella enterica enterica serovar Typhi
aaaaaccaaaaaauau

SEQ ID NO: 1717772 - RNA, 11 nt, Salmonella enterica enterica serovar Typhi
aaaaaauuccc

SEQ ID NO: 1717773 - RNA, 11 nt, Salmonella enterica enterica serovar Typhi
aaaaacaaggg

SEQ ID NO: 1717774 - RNA, 16 nt, Salmonella enterica enterica serovar Typhi
aaaaacagccagcagc

SEQ ID NO: 1717775 - RNA, 14 nt, Salmonella enterica enterica serovar Typhi
aaaaugccccacga

SEQ ID NO: 1717776 - RNA, 13 nt, Salmonella enterica enterica serovar Typhi
aaaaugcacauua

SEQ ID NO: 1717777 - RNA, 15 nt, Salmonella enterica enterica serovar Typhi
aaaaugcgcaaagca

SEQ ID NO: 1717778 - RNA, 16 nt, Salmonella enterica enterica serovar Typhi
aaaauggaaaauaaua

SEQ ID NO: 1717779 - RNA, 23 nt, Salmonella enterica enterica serovar Typhi
aaaauuagacaagcaguucugaa

SEQ ID NO: 1717780 - RNA, 15 nt, Salmonella enterica enterica serovar Typhi
aaaauuauauucuaa

SEQ ID NO: 1717781 - RNA, 19 nt, Salmonella enterica enterica serovar Typhi
aaaauuaugaauaaccauc

SEQ ID NO: 1717782 - RNA, 15 nt, Salmonella enterica enterica serovar Typhi
aaaauuauuuuaaau

SEQ ID NO: 1717783 - RNA, 15 nt, Salmonella enterica enterica serovar Typhi
aaaauuauuuuuacu

SEQ ID NO: 1717784 - RNA, 19 nt, Salmonella enterica enterica serovar Typhi
aaaauuauuuuuacuuaaa

SEQ ID NO: 1717785 - RNA, 16 nt, Salmonella enterica enterica serovar Typhi
aaaauucaaaaaagca

SEQ ID NO: 1717786 - RNA, 23 nt, Salmonella enterica enterica serovar Typhi
aaaaucggcgggcaucauaucca

SEQ ID NO: 1717787 - RNA, 22 nt, Salmonella enterica enterica serovar Typhi
aaaaucggggucuuccagcaga

SEQ ID NO: 1717788 - RNA, 22 nt, Salmonella enterica enterica serovar Typhi
aaaauccuuuuucaugcaauaa

SEQ ID NO: 1717789 - RNA, 20 nt, Salmonella enterica enterica serovar Typhi
aaaaugaugccccagaacaa

SEQ ID NO: 1717790 - RNA, 16 nt, Salmonella enterica enterica serovar Typhi
aaaaugaugcaacaug

SEQ ID NO: 1717791 - RNA, 19 nt, Salmonella enterica enterica serovar Typhi
aaaaucguuaaccagcggc

SEQ ID NO: 1717792 - RNA, 16 nt, Salmonella enterica enterica serovar Typhi
aaaaucgucaucagau

SEQ ID NO: 1717793 - RNA, 19 nt, Salmonella enterica enterica serovar Typhi
aaacaacaaaguauaaagc

SEQ ID NO: 1717794 - RNA, 13 nt, Salmonella enterica enterica serovar Typhi
aaacaacauaucg

SEQ ID NO: 1717795 - RNA, 15 nt, Salmonella enterica enterica serovar Typhi
aaacaaaccaaacug

SEQ ID NO: 1717796 - RNA, 16 nt, Salmonella enterica enterica serovar Typhi
aaacaaauaaauccau

SEQ ID NO: 1717797 - RNA, 19 nt, Salmonella enterica enterica serovar Typhi
aaaauaguuggugggugau

SEQ ID NO: 1717798 - RNA, 23 nt, Salmonella enterica enterica serovar Typhi
aaaauauacaccugacggcagcc

SEQ ID NO: 1717799 - RNA, 19 nt, Salmonella enterica enterica serovar Typhi
aaaauccggaucaucuuuu

SEQ ID NO: 1717800 - RNA, 21 nt, Salmonella enterica enterica serovar Typhi
aaaauccucuaccggaaaaca

SEQ ID NO: 1717801 - RNA, 23 nt, Salmonella enterica enterica serovar Typhi
aaaauccucuaccggaaaacagc

SEQ ID NO: 1717802 - RNA, 18 nt, Salmonella enterica enterica serovar Typhi
aaaaucccggcuggguuc

SEQ ID NO: 1717803 - RNA, 17 nt, Salmonella enterica enterica serovar Typhi
aaaauacuuccauuccc

SEQ ID NO: 1717804 - RNA, 14 nt, Salmonella enterica enterica serovar Typhi
aaaauaauugauaa

SEQ ID NO: 1717805 - RNA, 15 nt, Salmonella enterica enterica serovar Typhi
aaaauaccccagcgc

SEQ ID NO: 1717806 - RNA, 16 nt, Salmonella enterica enterica serovar Typhi
aaaauaccgcacauca

SEQ ID NO: 1717807 - RNA, 20 nt, Salmonella enterica enterica serovar Typhi
aaaauaccccaggggcauau

SEQ ID NO: 1717808 - RNA, 22 nt, Salmonella enterica enterica serovar Typhi
aaaauagccagaaugccagcgc

SEQ ID NO: 1717809 - RNA, 21 nt, Salmonella enterica enterica serovar Typhi
aaaauagcccggcuucccauc

SEQ ID NO: 1717810 - RNA, 23 nt, Salmonella enterica enterica serovar Typhi
aaaauagccgaaacuuauacuga

SEQ ID NO: 1717811 - RNA, 17 nt, Salmonella enterica enterica serovar Typhi
aaaauaguucagcgcag

SEQ ID NO: 1717812 - RNA, 10 nt, Salmonella enterica enterica serovar Typhi
aaaauagcgg

SEQ ID NO: 1717813 - RNA, 12 nt, Salmonella enterica enterica serovar Typhi
aaaauaaacacu

SEQ ID NO: 1717814 - RNA, 13 nt, Salmonella enterica enterica serovar Typhi
aaaauaauaggua

SEQ ID NO: 1717815 - RNA, 13 nt, Salmonella enterica enterica serovar Typhi
aaaauaauaaaaa

SEQ ID NO: 1717816 - RNA, 20 nt, Salmonella enterica enterica serovar Typhi
aaaaguguguaccagcagcg

SEQ ID NO: 1717817 - RNA, 13 nt, Salmonella enterica enterica serovar Typhi
aaaauaaaaaagg

SEQ ID NO: 1717818 - RNA, 23 nt, Salmonella enterica enterica serovar Typhi
aaaaguaucucgccaguaaagac

SEQ ID NO: 1717819 - RNA, 16 nt, Salmonella enterica enterica serovar Typhi
aaaaguauauaucccg

SEQ ID NO: 1717820 - RNA, 23 nt, Salmonella enterica enterica serovar Typhi
aaaagucacuuacuuucuugcca

SEQ ID NO: 1717821 - RNA, 22 nt, Salmonella enterica enterica serovar Typhi
aaaagccagcacggcuucacgu

SEQ ID NO: 1717822 - RNA, 18 nt, Salmonella enterica enterica serovar Typhi
aaaagccugcacauugca

SEQ ID NO: 1717823 - RNA, 19 nt, Salmonella enterica enterica serovar Typhi
aaaagcgauuuauucuuug

SEQ ID NO: 1717824 - RNA, 22 nt, Salmonella enterica enterica serovar Typhi
aaaagccggcggaaaaaagcag

SEQ ID NO: 1717825 - RNA, 16 nt, Salmonella enterica enterica serovar Typhi
aaaagccgugaauaaa

SEQ ID NO: 1717826 - RNA, 13 nt, Salmonella enterica enterica serovar Typhi
aaaacucaggaaa

SEQ ID NO: 1717827 - RNA, 11 nt, Salmonella enterica enterica serovar Typhi
aaaagaaaaaa

SEQ ID NO: 1717828 - RNA, 19 nt, Salmonella enterica enterica serovar Typhi
aaaacuuuaacacuaacua

SEQ ID NO: 1717829 - RNA, 15 nt, Salmonella enterica enterica serovar Typhi
aaaacuaauccucuu

SEQ ID NO: 1717830 - RNA, 13 nt, Salmonella enterica enterica serovar Typhi
aaaacuauuucaa

SEQ ID NO: 1717831 - RNA, 17 nt, Salmonella enterica enterica serovar Typhi
aaaacuaccguaccagc

SEQ ID NO: 1717832 - RNA, 14 nt, Salmonella enterica enterica serovar Typhi
aaaacguugcugga

SEQ ID NO: 1717833 - RNA, 17 nt, Salmonella enterica enterica serovar Typhi
aaaacggcuaccgucau

SEQ ID NO: 1717834 - RNA, 13 nt, Salmonella enterica enterica serovar Typhi
aaaagcaaagagg

SEQ ID NO: 1717835 - RNA, 23 nt, Salmonella enterica enterica serovar Typhi
aaaagaguaaaguuauucacgua

SEQ ID NO: 1717836 - RNA, 15 nt, Salmonella enterica enterica serovar Typhi
aaaagaguaaaguua

SEQ ID NO: 1717837 - RNA, 17 nt, Salmonella enterica enterica serovar Typhi
aaaagagcuuauuuuga

SEQ ID NO: 1717838 - RNA, 17 nt, Salmonella enterica enterica serovar Typhi
aaaagauauuauaaaau

SEQ ID NO: 1717839 - RNA, 13 nt, Salmonella enterica enterica serovar Typhi
aaaagaaaaaacu

SEQ ID NO: 1717840 - RNA, 20 nt, Salmonella enterica enterica serovar Typhi
aaaagaaaaaacuuauuucu

SEQ ID NO: 1717841 - RNA, 15 nt, Salmonella enterica enterica serovar Typhi
aaaagaaaaaaguga

SEQ ID NO: 1717842 - RNA, 11 nt, Salmonella enterica enterica serovar Typhi
aaaagaaaaca

SEQ ID NO: 1717843 - RNA, 15 nt, Salmonella enterica enterica serovar Typhi
aaaagaacaauaauc

SEQ ID NO: 1717844 - RNA, 20 nt, Salmonella enterica enterica serovar Typhi
aaaagaccauccgguuuuaa

SEQ ID NO: 1717845 - RNA, 18 nt, Salmonella enterica enterica serovar Typhi
aaaacagcauaauaaagc

SEQ ID NO: 1717846 - RNA, 19 nt, Salmonella enterica enterica serovar Typhi
aaaacagcaugguguuagu

SEQ ID NO: 1717847 - RNA, 12 nt, Salmonella enterica enterica serovar Typhi
aaaaauuucgaa

SEQ ID NO: 1717848 - RNA, 17 nt, Salmonella enterica enterica serovar Typhi
aaaaauuucgcuaagau

SEQ ID NO: 1717849 - RNA, 16 nt, Salmonella enterica enterica serovar Typhi
aaaaauuaaaaauacc

SEQ ID NO: 1717850 - RNA, 12 nt, Salmonella enterica enterica serovar Typhi
aaaaaucauuau

SEQ ID NO: 1717851 - RNA, 13 nt, Salmonella enterica enterica serovar Typhi
aaaaauauagcca

SEQ ID NO: 1717852 - RNA, 18 nt, Salmonella enterica enterica serovar Typhi
aaaaauaucauuaaauca

SEQ ID NO: 1717853 - RNA, 17 nt, Salmonella enterica enterica serovar Typhi
aaaaauacugauaaaaa

SEQ ID NO: 1717854 - RNA, 20 nt, Salmonella enterica enterica serovar Typhi
aaaaauacugauaaaaaaca

SEQ ID NO: 1717855 - RNA, 15 nt, Salmonella enterica enterica serovar Typhi
aaaaacccaccaacu

SEQ ID NO: 1717856 - RNA, 15 nt, Salmonella enterica enterica serovar Typhi
aaaaaccaaaaaaua

SEQ ID NO: 1717857 - RNA, 15 nt, Salmonella enterica enterica serovar Typhi
aaaaaccagaauuuc

SEQ ID NO: 1717858 - RNA, 16 nt, Salmonella enterica enterica serovar Typhi
aaaaacaucgcugaua

SEQ ID NO: 1717859 - RNA, 11 nt, Salmonella enterica enterica serovar Typhi
aaaaacaucau

SEQ ID NO: 1717860 - RNA, 19 nt, Salmonella enterica enterica serovar Typhi
aaaaacagcgcaauaugca

SEQ ID NO: 1717861 - RNA, 16 nt, Salmonella enterica enterica serovar Typhi
aaaaaccgccucaauu

SEQ ID NO: 1717862 - RNA, 13 nt, Salmonella enterica enterica serovar Typhi
aaaaauaaaaacc

SEQ ID NO: 1717863 - RNA, 22 nt, Salmonella enterica enterica serovar Typhi
aaacgcauaggggcgcaaagca

SEQ ID NO: 1717864 - RNA, 21 nt, Salmonella enterica enterica serovar Typhi
aaacgcaucugggcugagaaa

SEQ ID NO: 1717865 - RNA, 19 nt, Salmonella enterica enterica serovar Typhi
aaacgcccccagauagaac

SEQ ID NO: 1717866 - RNA, 22 nt, Salmonella enterica enterica serovar Typhi
aaacgcccgccgcgaccagcag

SEQ ID NO: 1717867 - RNA, 22 nt, Salmonella enterica enterica serovar Typhi
aaacgccgauggcgccagauac

SEQ ID NO: 1717868 - RNA, 17 nt, Salmonella enterica enterica serovar Typhi
aaacgccugaauaaucg

SEQ ID NO: 1717869 - RNA, 14 nt, Salmonella enterica enterica serovar Typhi
aaacgacauaaccg

SEQ ID NO: 1717870 - RNA, 15 nt, Salmonella enterica enterica serovar Typhi
aaacgacgcguuuca

SEQ ID NO: 1717871 - RNA, 21 nt, Salmonella enterica enterica serovar Typhi
aaacgagucagcguuacuggc

SEQ ID NO: 1717872 - RNA, 15 nt, Salmonella enterica enterica serovar Typhi
aaaccuuucuucucu

SEQ ID NO: 1717873 - RNA, 17 nt, Salmonella enterica enterica serovar Typhi
aaaccuuccgccaggcg

SEQ ID NO: 1717874 - RNA, 23 nt, Salmonella enterica enterica serovar Typhi
aaaccuucgcuuuuaaaacuucc

SEQ ID NO: 1717875 - RNA, 14 nt, Salmonella enterica enterica serovar Typhi
aaacaagccgccaa

SEQ ID NO: 1717876 - RNA, 24 nt, Salmonella enterica enterica serovar Typhi
aaacaagccgccaacgccagcagc

SEQ ID NO: 1717877 - RNA, 16 nt, Salmonella enterica enterica serovar Typhi
aaaccugagcauauaa

SEQ ID NO: 1717878 - RNA, 17 nt, Salmonella enterica enterica serovar Typhi
aaaccugguauuacaac

SEQ ID NO: 1717879 - RNA, 19 nt, Salmonella enterica enterica serovar Typhi
aaaccugguauuacaacgu

SEQ ID NO: 1717880 - RNA, 14 nt, Salmonella enterica enterica serovar Typhi
aaacgucgaacaua

SEQ ID NO: 1717881 - RNA, 17 nt, Salmonella enterica enterica serovar Typhi
aaacgucguaaaaccug

SEQ ID NO: 1717882 - RNA, 19 nt, Salmonella enterica enterica serovar Typhi
aaacguagcguucauuccc

SEQ ID NO: 1717883 - RNA, 14 nt, Salmonella enterica enterica serovar Typhi
aaacgguauuucca

SEQ ID NO: 1717884 - RNA, 22 nt, Salmonella enterica enterica serovar Typhi
aaacguucggugaagaaaaaga

SEQ ID NO: 1717885 - RNA, 21 nt, Salmonella enterica enterica serovar Typhi
aaacgugcggcggccucuuug

SEQ ID NO: 1717886 - RNA, 14 nt, Salmonella enterica enterica serovar Typhi
aaacggcuuuaauc

SEQ ID NO: 1717887 - RNA, 18 nt, Salmonella enterica enterica serovar Typhi
aaacgggugagacauguu

SEQ ID NO: 1717888 - RNA, 17 nt, Salmonella enterica enterica serovar Typhi
aaacggccugcgcugga

SEQ ID NO: 1717889 - RNA, 22 nt, Salmonella enterica enterica serovar Typhi
aaacggaaccaaaugcccagcu

SEQ ID NO: 1717890 - RNA, 23 nt, Salmonella enterica enterica serovar Typhi
aaacgcgucuucaucagccagca

SEQ ID NO: 1717891 - RNA, 15 nt, Salmonella enterica enterica serovar Typhi
aaacgcgcuaucaac

SEQ ID NO: 1717892 - RNA, 17 nt, Salmonella enterica enterica serovar Typhi
aaacgcggacauauuuu

SEQ ID NO: 1717893 - RNA, 23 nt, Salmonella enterica enterica serovar Typhi
aaacgccugcccgguuaaggggc

SEQ ID NO: 1717894 - RNA, 18 nt, Salmonella enterica enterica serovar Typhi
aaacuaaguaaggaggaa

SEQ ID NO: 1717895 - RNA, 17 nt, Salmonella enterica enterica serovar Typhi
aaacuaauccucuucuc

SEQ ID NO: 1717896 - RNA, 13 nt, Salmonella enterica enterica serovar Typhi
aaacuauuuuuag

SEQ ID NO: 1717897 - RNA, 23 nt, Salmonella enterica enterica serovar Typhi
aaacuauuucaacccggcauuuc

SEQ ID NO: 1717898 - RNA, 21 nt, Salmonella enterica enterica serovar Typhi
aaacucuuuuucaauaaacgg

SEQ ID NO: 1717899 - RNA, 19 nt, Salmonella enterica enterica serovar Typhi
aaacuccuccgggaaaaca

SEQ ID NO: 1717900 - RNA, 12 nt, Salmonella enterica enterica serovar Typhi
aaacuccagcag

SEQ ID NO: 1717901 - RNA, 22 nt, Salmonella enterica enterica serovar Typhi
aaacucccgcacgcuggcauca

SEQ ID NO: 1717902 - RNA, 15 nt, Salmonella enterica enterica serovar Typhi
aaacucacccaggcg

SEQ ID NO: 1717903 - RNA, 23 nt, Salmonella enterica enterica serovar Typhi
aaacucacguuccccagcaccga

SEQ ID NO: 1717904 - RNA, 13 nt, Salmonella enterica enterica serovar Typhi
aaacucaucuuua

SEQ ID NO: 1717905 - RNA, 16 nt, Salmonella enterica enterica serovar Typhi
aaacuggcgcuggcag

SEQ ID NO: 1717906 - RNA, 11 nt, Salmonella enterica enterica serovar Typhi
aaacugccuuc

SEQ ID NO: 1717907 - RNA, 22 nt, Salmonella enterica enterica serovar Typhi
aaacuggagcacgcggugccga

SEQ ID NO: 1717908 - RNA, 23 nt, Salmonella enterica enterica serovar Typhi
aaacuggcacgccguuugccaua

SEQ ID NO: 1717909 - RNA, 21 nt, Salmonella enterica enterica serovar Typhi
aaacugauaguuuaaauccag

SEQ ID NO: 1717910 - RNA, 14 nt, Salmonella enterica enterica serovar Typhi
aaacugauacugga

SEQ ID NO: 1717911 - RNA, 23 nt, Salmonella enterica enterica serovar Typhi
aaacuuucauuucacuuguucuu

SEQ ID NO: 1717912 - RNA, 21 nt, Salmonella enterica enterica serovar Typhi
aaacuuaucaguaacagaaca

SEQ ID NO: 1717913 - RNA, 20 nt, Salmonella enterica enterica serovar Typhi
aaagagacagaaucaggcca

SEQ ID NO: 1717914 - RNA, 17 nt, Salmonella enterica enterica serovar Typhi
aaagagagcgccaaaaa

SEQ ID NO: 1717915 - RNA, 23 nt, Salmonella enterica enterica serovar Typhi
aaagacuuugaugcggaagagaa

SEQ ID NO: 1717916 - RNA, 19 nt, Salmonella enterica enterica serovar Typhi
aaagaaguggacuuccauu

SEQ ID NO: 1717917 - RNA, 19 nt, Salmonella enterica enterica serovar Typhi
aaagaaguuagauauuaau

SEQ ID NO: 1717918 - RNA, 12 nt, Salmonella enterica enterica serovar Typhi
aaacuuuuaaau

SEQ ID NO: 1717919 - RNA, 14 nt, Salmonella enterica enterica serovar Typhi
aaagaccuucuugc

SEQ ID NO: 1717920 - RNA, 16 nt, Salmonella enterica enterica serovar Typhi
aaagaccuccgcccgg

SEQ ID NO: 1717921 - RNA, 20 nt, Salmonella enterica enterica serovar Typhi
aaagacuacuuuaucgaaug

SEQ ID NO: 1717922 - RNA, 13 nt, Salmonella enterica enterica serovar Typhi
aaagacgccaugg

SEQ ID NO: 1717923 - RNA, 19 nt, Salmonella enterica enterica serovar Typhi
aaagccaguuucucuucuu

SEQ ID NO: 1717924 - RNA, 20 nt, Salmonella enterica enterica serovar Typhi
aaagccaguuucucuucuuu

SEQ ID NO: 1717925 - RNA, 15 nt, Salmonella enterica enterica serovar Typhi
aaagccaggccgcca

SEQ ID NO: 1717926 - RNA, 17 nt, Salmonella enterica enterica serovar Typhi
aaagccagauaaagcag

SEQ ID NO: 1717927 - RNA, 18 nt, Salmonella enterica enterica serovar Typhi
aaagcauucgcagcagac

SEQ ID NO: 1717928 - RNA, 16 nt, Salmonella enterica enterica serovar Typhi
aaagcagaggucugca

SEQ ID NO: 1717929 - RNA, 23 nt, Salmonella enterica enterica serovar Typhi
aaagcauggcuggcgguuuuugu

SEQ ID NO: 1717930 - RNA, 15 nt, Salmonella enterica enterica serovar Typhi
aaagcauuaaaucau

SEQ ID NO: 1717931 - RNA, 17 nt, Salmonella enterica enterica serovar Typhi
aaagcacggguagcuag

SEQ ID NO: 1717932 - RNA, 11 nt, Salmonella enterica enterica serovar Typhi
aaagcacugcu

SEQ ID NO: 1717933 - RNA, 17 nt, Salmonella enterica enterica serovar Typhi
aaagcacugcugcugaa

SEQ ID NO: 1717934 - RNA, 13 nt, Salmonella enterica enterica serovar Typhi
aaagauaaucuga

SEQ ID NO: 1717935 - RNA, 22 nt, Salmonella enterica enterica serovar Typhi
aaagcuggccuucagguuuuua

SEQ ID NO: 1717936 - RNA, 13 nt, Salmonella enterica enterica serovar Typhi
aaagcuguagcau

SEQ ID NO: 1717937 - RNA, 20 nt, Salmonella enterica enterica serovar Typhi
aaagcugguauugaauauuu

SEQ ID NO: 1717938 - RNA, 18 nt, Salmonella enterica enterica serovar Typhi
aaaggaaugccugcgcuu

SEQ ID NO: 1717939 - RNA, 19 nt, Salmonella enterica enterica serovar Typhi
aaaggacguucuucuccca

SEQ ID NO: 1717940 - RNA, 21 nt, Salmonella enterica enterica serovar Typhi
aaagccggcggaaaaaagcag

SEQ ID NO: 1717941 - RNA, 18 nt, Salmonella enterica enterica serovar Typhi
aaagccgguuuucguuaa

SEQ ID NO: 1717942 - RNA, 24 nt, Salmonella enterica enterica serovar Typhi
aaagccgcgucgcaccugcucuuu

SEQ ID NO: 1717943 - RNA, 20 nt, Salmonella enterica enterica serovar Typhi
aaagccgccauccggcauuu

SEQ ID NO: 1717944 - RNA, 13 nt, Salmonella enterica enterica serovar Typhi
aaagccgaccugg

SEQ ID NO: 1717945 - RNA, 14 nt, Salmonella enterica enterica serovar Typhi
aaagccccggcuca

SEQ ID NO: 1717946 - RNA, 14 nt, Salmonella enterica enterica serovar Typhi
aaagcccgcccagc

SEQ ID NO: 1717947 - RNA, 18 nt, Salmonella enterica enterica serovar Typhi
aaaggggagcccaguagc

SEQ ID NO: 1717948 - RNA, 16 nt, Salmonella enterica enterica serovar Typhi
aaaggcauuaagucau

SEQ ID NO: 1717949 - RNA, 17 nt, Salmonella enterica enterica serovar Typhi
aaaggcagacagagaaa

SEQ ID NO: 1717950 - RNA, 16 nt, Salmonella enterica enterica serovar Typhi
aaaggccagcagcagc

SEQ ID NO: 1717951 - RNA, 18 nt, Salmonella enterica enterica serovar Typhi
aaaggccuggcugagaaa

SEQ ID NO: 1717952 - RNA, 20 nt, Salmonella enterica enterica serovar Typhi
aaaggccuggcugagaaaaa

SEQ ID NO: 1717953 - RNA, 16 nt, Salmonella enterica enterica serovar Typhi
aaagggaaaagccauu

SEQ ID NO: 1717954 - RNA, 19 nt, Salmonella enterica enterica serovar Typhi
aaaguaccaaaacagaaaa

SEQ ID NO: 1717955 - RNA, 22 nt, Salmonella enterica enterica serovar Typhi
aaaguacaucauuggcccggcg

SEQ ID NO: 1717956 - RNA, 17 nt, Salmonella enterica enterica serovar Typhi
aaaguaccaaaacagaa

SEQ ID NO: 1717957 - RNA, 19 nt, Salmonella enterica enterica serovar Typhi
aaagucaacugcucuacca

SEQ ID NO: 1717958 - RNA, 20 nt, Salmonella enterica enterica serovar Typhi
aaagucaacugcucuaccaa

SEQ ID NO: 1717959 - RNA, 20 nt, Salmonella enterica enterica serovar Typhi
aaagucacuuacuuucuugc

SEQ ID NO: 1717960 - RNA, 17 nt, Salmonella enterica enterica serovar Typhi
aaaguauguuuugaaug

SEQ ID NO: 1717961 - RNA, 14 nt, Salmonella enterica enterica serovar Typhi
aaaucaggaaaaag

SEQ ID NO: 1717962 - RNA, 15 nt, Salmonella enterica enterica serovar Typhi
aaaucaggaaaaagg

SEQ ID NO: 1717963 - RNA, 20 nt, Salmonella enterica enterica serovar Typhi
aaaucaggccaagcaacauu

SEQ ID NO: 1717964 - RNA, 13 nt, Salmonella enterica enterica serovar Typhi
aaaucauaccagc

SEQ ID NO: 1717965 - RNA, 15 nt, Salmonella enterica enterica serovar Typhi
aaaucacgcuggaua

SEQ ID NO: 1717966 - RNA, 22 nt, Salmonella enterica enterica serovar Typhi
aaaucacuggagcgcauuuuac

SEQ ID NO: 1717967 - RNA, 21 nt, Salmonella enterica enterica serovar Typhi
aaaucacuggagcgcauuuua

SEQ ID NO: 1717968 - RNA, 21 nt, Salmonella enterica enterica serovar Typhi
aaaucagcaaucguuggcgua

SEQ ID NO: 1717969 - RNA, 20 nt, Salmonella enterica enterica serovar Typhi
aaaucagcaaaaacauuacc

SEQ ID NO: 1717970 - RNA, 18 nt, Salmonella enterica enterica serovar Typhi
aaaucacguuuacuaaaa

SEQ ID NO: 1717971 - RNA, 18 nt, Salmonella enterica enterica serovar Typhi
aaaucacuaagaccagca

SEQ ID NO: 1717972 - RNA, 16 nt, Salmonella enterica enterica serovar Typhi
aaaucaacauacugau

SEQ ID NO: 1717973 - RNA, 18 nt, Salmonella enterica enterica serovar Typhi
aaaucaacauuauuaaaa

SEQ ID NO: 1717974 - RNA, 13 nt, Salmonella enterica enterica serovar Typhi
aaaucaaauaaga

SEQ ID NO: 1717975 - RNA, 19 nt, Salmonella enterica enterica serovar Typhi
aaaucaacauuauuaaaau

SEQ ID NO: 1717976 - RNA, 18 nt, Salmonella enterica enterica serovar Typhi
aaaucacccaacguucau

SEQ ID NO: 1717977 - RNA, 21 nt, Salmonella enterica enterica serovar Typhi
aaaucacagggggaacauuua

SEQ ID NO: 1717978 - RNA, 22 nt, Salmonella enterica enterica serovar Typhi
aaaucacagggggaacauuuaa

SEQ ID NO: 1717979 - RNA, 17 nt, Salmonella enterica enterica serovar Typhi
aaauagugacuucugcu

SEQ ID NO: 1717980 - RNA, 19 nt, Salmonella enterica enterica serovar Typhi
aaauaguaaauagaaaaua

SEQ ID NO: 1717981 - RNA, 20 nt, Salmonella enterica enterica serovar Typhi
aaauaguccagcauccaugc

SEQ ID NO: 1717982 - RNA, 18 nt, Salmonella enterica enterica serovar Typhi
aaauauuggcggcaaaga

SEQ ID NO: 1717983 - RNA, 20 nt, Salmonella enterica enterica serovar Typhi
aaauauugauuaaucgucau

SEQ ID NO: 1717984 - RNA, 22 nt, Salmonella enterica enterica serovar Typhi
aaauauugagguauaggaaaau

SEQ ID NO: 1717985 - RNA, 12 nt, Salmonella enterica enterica serovar Typhi
aaaucaaaaagu

SEQ ID NO: 1717986 - RNA, 15 nt, Salmonella enterica enterica serovar Typhi
aaaucaaacagaaua

SEQ ID NO: 1717987 - RNA, 16 nt, Salmonella enterica enterica serovar Typhi
aaaucaaacagaauau

SEQ ID NO: 1717988 - RNA, 14 nt, Salmonella enterica enterica serovar Typhi
aaauauuucuuugu

SEQ ID NO: 1717989 - RNA, 20 nt, Salmonella enterica enterica serovar Typhi
aaauacgcgauaaaaaccca

SEQ ID NO: 1717990 - RNA, 20 nt, Salmonella enterica enterica serovar Typhi
aaauacgcucaauauacuua

SEQ ID NO: 1717991 - RNA, 15 nt, Salmonella enterica enterica serovar Typhi
aaauacgcugcggcc

SEQ ID NO: 1717992 - RNA, 19 nt, Salmonella enterica enterica serovar Typhi
aaauacgccgccagcaaua

SEQ ID NO: 1717993 - RNA, 17 nt, Salmonella enterica enterica serovar Typhi
aaauacggaccuggcgu

SEQ ID NO: 1717994 - RNA, 19 nt, Salmonella enterica enterica serovar Typhi
aaauagcgccagacagaua

SEQ ID NO: 1717995 - RNA, 17 nt, Salmonella enterica enterica serovar Typhi
aaauagcgguucaauca

SEQ ID NO: 1717996 - RNA, 14 nt, Salmonella enterica enterica serovar Typhi
aaauaggagaugca

SEQ ID NO: 1717997 - RNA, 22 nt, Salmonella enterica enterica serovar Typhi
aaauacuggccgguuuuaaaaa

SEQ ID NO: 1717998 - RNA, 18 nt, Salmonella enterica enterica serovar Typhi
aaauagcccuaauaggau

SEQ ID NO: 1717999 - RNA, 17 nt, Salmonella enterica enterica serovar Typhi
aaagucggccauuuuuu

SEQ ID NO: 1718000 - RNA, 13 nt, Salmonella enterica enterica serovar Typhi
aaauaaaauuaua

SEQ ID NO: 1718001 - RNA, 12 nt, Salmonella enterica enterica serovar Typhi
aaauaaaauuau

SEQ ID NO: 1718002 - RNA, 22 nt, Salmonella enterica enterica serovar Typhi
aaauaaaauacgcucaauauac

SEQ ID NO: 1718003 - RNA, 19 nt, Salmonella enterica enterica serovar Typhi
aaauaaaugauauuuaaaa

SEQ ID NO: 1718004 - RNA, 16 nt, Salmonella enterica enterica serovar Typhi
aaauaaauccaugaga

SEQ ID NO: 1718005 - RNA, 22 nt, Salmonella enterica enterica serovar Typhi
aaauaaacacuaaaucauaauu

SEQ ID NO: 1718006 - RNA, 17 nt, Salmonella enterica enterica serovar Typhi
aaauaacccgccuggcg

SEQ ID NO: 1718007 - RNA, 13 nt, Salmonella enterica enterica serovar Typhi
aaauaacagacga

SEQ ID NO: 1718008 - RNA, 14 nt, Salmonella enterica enterica serovar Typhi
aaauaacagacgaa

SEQ ID NO: 1718009 - RNA, 21 nt, Salmonella enterica enterica serovar Typhi
aaauaacaggaaucauucuau

SEQ ID NO: 1718010 - RNA, 19 nt, Salmonella enterica enterica serovar Typhi
aaauaacgcgauaaucccc

SEQ ID NO: 1718011 - RNA, 17 nt, Salmonella enterica enterica serovar Typhi
aaauaacgguagagaau

SEQ ID NO: 1718012 - RNA, 21 nt, Salmonella enterica enterica serovar Typhi
aaauaacgccuuucaccauuc

SEQ ID NO: 1718013 - RNA, 21 nt, Salmonella enterica enterica serovar Typhi
aaauaacucuggaucaguucc

SEQ ID NO: 1718014 - RNA, 16 nt, Salmonella enterica enterica serovar Typhi
aaauaacuuuuaauuu

SEQ ID NO: 1718015 - RNA, 18 nt, Salmonella enterica enterica serovar Typhi
aaauaacuuuuaauuuuu

SEQ ID NO: 1718016 - RNA, 19 nt, Salmonella enterica enterica serovar Typhi
aaauaauaaucguuuuaug

SEQ ID NO: 1718017 - RNA, 19 nt, Salmonella enterica enterica serovar Typhi
aaauaagccguacagccua

SEQ ID NO: 1718018 - RNA, 21 nt, Salmonella enterica enterica serovar Typhi
aaauaaggcugcgcguuuuca

SEQ ID NO: 1718019 - RNA, 12 nt, Salmonella enterica enterica serovar Typhi
aaauucgaaaua

SEQ ID NO: 1718020 - RNA, 16 nt, Salmonella enterica enterica serovar Typhi
aaauucgaaauaaaga

SEQ ID NO: 1718021 - RNA, 19 nt, Salmonella enterica enterica serovar Typhi
aaauucgcuaauccccccu

SEQ ID NO: 1718022 - RNA, 19 nt, Salmonella enterica enterica serovar Typhi
aaauucggcguuacccguc

SEQ ID NO: 1718023 - RNA, 16 nt, Salmonella enterica enterica serovar Typhi
aaauuccuggauuaaa

SEQ ID NO: 1718024 - RNA, 17 nt, Salmonella enterica enterica serovar Typhi
aaauuccuuguuuuaac

SEQ ID NO: 1718025 - RNA, 17 nt, Salmonella enterica enterica serovar Typhi
aaauucuaugccaggcg

SEQ ID NO: 1718026 - RNA, 20 nt, Salmonella enterica enterica serovar Typhi
aaauucacccguuauucauu

SEQ ID NO: 1718027 - RNA, 23 nt, Salmonella enterica enterica serovar Typhi
aaauuauugugagaaaagcagag

SEQ ID NO: 1718028 - RNA, 14 nt, Salmonella enterica enterica serovar Typhi
aaauucaggguugu

SEQ ID NO: 1718029 - RNA, 19 nt, Salmonella enterica enterica serovar Typhi
aaauuccccauaaucgacc

SEQ ID NO: 1718030 - RNA, 21 nt, Salmonella enterica enterica serovar Typhi
aaauucacuuccgucauguag

SEQ ID NO: 1718031 - RNA, 23 nt, Salmonella enterica enterica serovar Typhi
aaauuauuccuugaucaggaaau

SEQ ID NO: 1718032 - RNA, 18 nt, Salmonella enterica enterica serovar Typhi
aaauuacgccauaaaaag

SEQ ID NO: 1718033 - RNA, 14 nt, Salmonella enterica enterica serovar Typhi
aaauuaagaaagua

SEQ ID NO: 1718034 - RNA, 21 nt, Salmonella enterica enterica serovar Typhi
aaauguuguuugaaaagugaa

SEQ ID NO: 1718035 - RNA, 19 nt, Salmonella enterica enterica serovar Typhi
aaauguuguuugaaaagug

SEQ ID NO: 1718036 - RNA, 20 nt, Salmonella enterica enterica serovar Typhi
aaaaaggcgaacuccagcgc

SEQ ID NO: 1718037 - RNA, 10 nt, Salmonella enterica enterica serovar Typhi
aaaaaggaca

SEQ ID NO: 1718038 - RNA, 17 nt, Salmonella enterica enterica serovar Typhi
aaaaagcguacaaaaaa

SEQ ID NO: 1718039 - RNA, 24 nt, Salmonella enterica enterica serovar Typhi
aaaaagccugcacauugcaggcuu

SEQ ID NO: 1718040 - RNA, 11 nt, Salmonella enterica enterica serovar Typhi
aaaaagcugcg

SEQ ID NO: 1718041 - RNA, 23 nt, Salmonella enterica enterica serovar Typhi
aaaaagcuccggacgcaccagcc

SEQ ID NO: 1718042 - RNA, 19 nt, Salmonella enterica enterica serovar Typhi
aaaaagccacgcaagcagc

SEQ ID NO: 1718043 - RNA, 20 nt, Salmonella enterica enterica serovar Typhi
aaaaagccacgcaagcagca

SEQ ID NO: 1718044 - RNA, 19 nt, Salmonella enterica enterica serovar Typhi
aaaaagccaagcacaaaaa

SEQ ID NO: 1718045 - RNA, 18 nt, Salmonella enterica enterica serovar Typhi
aaaaagccaaaaggcgcc

SEQ ID NO: 1718046 - RNA, 22 nt, Salmonella enterica enterica serovar Typhi
aaaaagcccgacccgcugcgug

SEQ ID NO: 1718047 - RNA, 19 nt, Salmonella enterica enterica serovar Typhi
aaaaagccggcggaaaaaa

SEQ ID NO: 1718048 - RNA, 21 nt, Salmonella enterica enterica serovar Typhi
aaaaagccggcggaaaaaagc

SEQ ID NO: 1718049 - RNA, 19 nt, Salmonella enterica enterica serovar Typhi
aaaaagccucugauuucga

SEQ ID NO: 1718050 - RNA, 16 nt, Salmonella enterica enterica serovar Typhi
aaaucaucgccacgau

SEQ ID NO: 1718051 - RNA, 21 nt, Salmonella enterica enterica serovar Typhi
aaaucaucgcgcugauauuuu

SEQ ID NO: 1718052 - RNA, 16 nt, Salmonella enterica enterica serovar Typhi
aaaucauccugcggca

SEQ ID NO: 1718053 - RNA, 13 nt, Salmonella enterica enterica serovar Typhi
aaaucaucaucag

SEQ ID NO: 1718054 - RNA, 19 nt, Salmonella enterica enterica serovar Typhi
aaaucaucaauggcgauuu

SEQ ID NO: 1718055 - RNA, 20 nt, Salmonella enterica enterica serovar Typhi
aaaucauuuguacaaaaaau

SEQ ID NO: 1718056 - RNA, 13 nt, Salmonella enterica enterica serovar Typhi
aaaucgcgagccu

SEQ ID NO: 1718057 - RNA, 22 nt, Salmonella enterica enterica serovar Typhi
aaaucuguuaucuggauguaaa

SEQ ID NO: 1718058 - RNA, 14 nt, Salmonella enterica enterica serovar Typhi
aaaucguucgcgga

SEQ ID NO: 1718059 - RNA, 17 nt, Salmonella enterica enterica serovar Typhi
aaaucgcgagccuucaa

SEQ ID NO: 1718060 - RNA, 21 nt, Salmonella enterica enterica serovar Typhi
aaaucgcuauauugcugcgca

SEQ ID NO: 1718061 - RNA, 23 nt, Salmonella enterica enterica serovar Typhi
aaaugaugacucauuaaaaaaac

SEQ ID NO: 1718062 - RNA, 18 nt, Salmonella enterica enterica serovar Typhi
aaaugaaaugcccauaaa

SEQ ID NO: 1718063 - RNA, 13 nt, Salmonella enterica enterica serovar Typhi
aaaugauguguuu

SEQ ID NO: 1718064 - RNA, 13 nt, Salmonella enterica enterica serovar Typhi
aaaucuucauuuc

SEQ ID NO: 1718065 - RNA, 13 nt, Salmonella enterica enterica serovar Typhi
aaaucuuccaguu

SEQ ID NO: 1718066 - RNA, 16 nt, Salmonella enterica enterica serovar Typhi
aaaugcgaugaacauc

SEQ ID NO: 1718067 - RNA, 18 nt, Salmonella enterica enterica serovar Typhi
aaaugcccgucucauuuc

SEQ ID NO: 1718068 - RNA, 16 nt, Salmonella enterica enterica serovar Typhi
aaaugcccgucucauu

SEQ ID NO: 1718069 - RNA, 22 nt, Salmonella enterica enterica serovar Typhi
aaaugccugccguuuuuaacgc

SEQ ID NO: 1718070 - RNA, 13 nt, Salmonella enterica enterica serovar Typhi
aaaugcugggcuu

SEQ ID NO: 1718071 - RNA, 18 nt, Salmonella enterica enterica serovar Typhi
aaaugcuugcuuuagcuu

SEQ ID NO: 1718072 - RNA, 22 nt, Salmonella enterica enterica serovar Typhi
aaaugcuuccgaccgcagcaga

SEQ ID NO: 1718073 - RNA, 15 nt, Salmonella enterica enterica serovar Typhi
aaaugcuuaucugau

SEQ ID NO: 1718074 - RNA, 22 nt, Salmonella enterica enterica serovar Typhi
aaaugcucaauuauacgcuggu

SEQ ID NO: 1718075 - RNA, 17 nt, Salmonella enterica enterica serovar Typhi
aaaugcggguccugauc

SEQ ID NO: 1718076 - RNA, 16 nt, Salmonella enterica enterica serovar Typhi
aaaugcgcuuugauag

SEQ ID NO: 1718077 - RNA, 14 nt, Salmonella enterica enterica serovar Typhi
aaguuuuuuuaaaa

SEQ ID NO: 1718078 - RNA, 18 nt, Salmonella enterica enterica serovar Typhi
aaguuuuuuuaaaaaacc

SEQ ID NO: 1718079 - RNA, 14 nt, Salmonella enterica enterica serovar Typhi
aauaaaaaaaccuc

SEQ ID NO: 1718080 - RNA, 13 nt, Salmonella enterica enterica serovar Typhi
aauaaaaauaauc

SEQ ID NO: 1718081 - RNA, 22 nt, Salmonella enterica enterica serovar Typhi
aauaaacaccauacgacgaucc

SEQ ID NO: 1718082 - RNA, 22 nt, Salmonella enterica enterica serovar Typhi
aauaaacacgauggcaaauaau

SEQ ID NO: 1718083 - RNA, 23 nt, Salmonella enterica enterica serovar Typhi
aauaaacacgauggcaaauaaua

SEQ ID NO: 1718084 - RNA, 15 nt, Salmonella enterica enterica serovar Typhi
aauaaaauucagcgc

SEQ ID NO: 1718085 - RNA, 12 nt, Salmonella enterica enterica serovar Typhi
aauaaaaggaau

SEQ ID NO: 1718086 - RNA, 13 nt, Salmonella enterica enterica serovar Typhi
aauaaaauaacua

SEQ ID NO: 1718087 - RNA, 21 nt, Salmonella enterica enterica serovar Typhi
aauaaaacugccgucaauuuu

SEQ ID NO: 1718088 - RNA, 13 nt, Salmonella enterica enterica serovar Typhi
aauaaaaauuccc

SEQ ID NO: 1718089 - RNA, 23 nt, Salmonella enterica enterica serovar Typhi
aauaaacuguccaguuuuugcau

SEQ ID NO: 1718090 - RNA, 11 nt, Salmonella enterica enterica serovar Typhi
aauaaagaaag

SEQ ID NO: 1718091 - RNA, 21 nt, Salmonella enterica enterica serovar Typhi
aauaaagaaagcauuaaauca

SEQ ID NO: 1718092 - RNA, 21 nt, Salmonella enterica enterica serovar Typhi
aauaaagcggucuuucaacau

SEQ ID NO: 1718093 - RNA, 13 nt, Salmonella enterica enterica serovar Typhi
aauaaacauuuuu

SEQ ID NO: 1718094 - RNA, 15 nt, Salmonella enterica enterica serovar Typhi
aauaaacaucagcca

SEQ ID NO: 1718095 - RNA, 11 nt, Salmonella enterica enterica serovar Typhi
aauaaacuccc

SEQ ID NO: 1718096 - RNA, 20 nt, Salmonella enterica enterica serovar Typhi
aauaaagcccuguuauucag

SEQ ID NO: 1718097 - RNA, 15 nt, Salmonella enterica enterica serovar Typhi
aauaaagccgcccau

SEQ ID NO: 1718098 - RNA, 14 nt, Salmonella enterica enterica serovar Typhi
aauaaagugcugaa

SEQ ID NO: 1718099 - RNA, 19 nt, Salmonella enterica enterica serovar Typhi
aauaaagugcugaacaaua

SEQ ID NO: 1718100 - RNA, 19 nt, Salmonella enterica enterica serovar Typhi
aauaaauaguaaauagaaa

SEQ ID NO: 1718101 - RNA, 23 nt, Salmonella enterica enterica serovar Typhi
aauaaauucuuuacgcagcaaga

SEQ ID NO: 1718102 - RNA, 12 nt, Salmonella enterica enterica serovar Typhi
aauaaccgccag

SEQ ID NO: 1718103 - RNA, 16 nt, Salmonella enterica enterica serovar Typhi
aauaacaggaaucauu

SEQ ID NO: 1718104 - RNA, 20 nt, Salmonella enterica enterica serovar Typhi
aauaacaggaaucauucuau

SEQ ID NO: 1718105 - RNA, 21 nt, Salmonella enterica enterica serovar Typhi
aauaaccgguaacugucagau

SEQ ID NO: 1718106 - RNA, 23 nt, Salmonella enterica enterica serovar Typhi
aauaacagacuccgucucuuuau

SEQ ID NO: 1718107 - RNA, 14 nt, Salmonella enterica enterica serovar Typhi
aauaacaccacaac

SEQ ID NO: 1718108 - RNA, 21 nt, Salmonella enterica enterica serovar Typhi
aagugauacggcgugaucacu

SEQ ID NO: 1718109 - RNA, 14 nt, Salmonella enterica enterica serovar Typhi
aaguaauaaaauaa

SEQ ID NO: 1718110 - RNA, 18 nt, Salmonella enterica enterica serovar Typhi
aaguaaggaggaaucgcu

SEQ ID NO: 1718111 - RNA, 21 nt, Salmonella enterica enterica serovar Typhi
aagucugugagaaaagcgaaa

SEQ ID NO: 1718112 - RNA, 13 nt, Salmonella enterica enterica serovar Typhi
aaguaauaaaaua

SEQ ID NO: 1718113 - RNA, 17 nt, Salmonella enterica enterica serovar Typhi
aaguugcgccacugcca

SEQ ID NO: 1718114 - RNA, 15 nt, Salmonella enterica enterica serovar Typhi
aaguucuuguuucau

SEQ ID NO: 1718115 - RNA, 19 nt, Salmonella enterica enterica serovar Typhi
aaguuugaugcaaauguca

SEQ ID NO: 1718116 - RNA, 21 nt, Salmonella enterica enterica serovar Typhi
aaguuugaugcaaaugucaga

SEQ ID NO: 1718117 - RNA, 15 nt, Salmonella enterica enterica serovar Typhi
aaguuuagaaaaaau

SEQ ID NO: 1718118 - RNA, 14 nt, Salmonella enterica enterica serovar Typhi
aaguggugggugau

SEQ ID NO: 1718119 - RNA, 16 nt, Salmonella enterica enterica serovar Typhi
aaguguggcaccugcu

SEQ ID NO: 1718120 - RNA, 12 nt, Salmonella enterica enterica serovar Typhi
aaaaauccagua

SEQ ID NO: 1718121 - RNA, 23 nt, Salmonella enterica enterica serovar Typhi
aauaauccuucccgcuauagaau

SEQ ID NO: 1718122 - RNA, 20 nt, Salmonella enterica enterica serovar Typhi
aauaaucgcgagaaaauaga

SEQ ID NO: 1718123 - RNA, 13 nt, Salmonella enterica enterica serovar Typhi
aauaaucgccggg

SEQ ID NO: 1718124 - RNA, 18 nt, Salmonella enterica enterica serovar Typhi
aauaaucgcgagaaaaua

SEQ ID NO: 1718125 - RNA, 15 nt, Salmonella enterica enterica serovar Typhi
aauaaucgaaauaaa

SEQ ID NO: 1718126 - RNA, 15 nt, Salmonella enterica enterica serovar Typhi
aauaauuaauccaaa

SEQ ID NO: 1718127 - RNA, 23 nt, Salmonella enterica enterica serovar Typhi
aauaauucuuaacccacaagaaa

SEQ ID NO: 1718128 - RNA, 16 nt, Salmonella enterica enterica serovar Typhi
aauacaauucaacuca

SEQ ID NO: 1718129 - RNA, 24 nt, Salmonella enterica enterica serovar Typhi
aauacaauccgccgcaauagccaa

SEQ ID NO: 1718130 - RNA, 21 nt, Salmonella enterica enterica serovar Typhi
aauaacgggcacggucugcug

SEQ ID NO: 1718131 - RNA, 17 nt, Salmonella enterica enterica serovar Typhi
aauaacguguaauuuca

SEQ ID NO: 1718132 - RNA, 22 nt, Salmonella enterica enterica serovar Typhi
aauaacguguaauuucauaaua

SEQ ID NO: 1718133 - RNA, 15 nt, Salmonella enterica enterica serovar Typhi
aauaacgugucagga

SEQ ID NO: 1718134 - RNA, 19 nt, Salmonella enterica enterica serovar Typhi
aauaacgcacuaccagaaa

SEQ ID NO: 1718135 - RNA, 20 nt, Salmonella enterica enterica serovar Typhi
aauaacgaugaugaaaaaga

SEQ ID NO: 1718136 - RNA, 22 nt, Salmonella enterica enterica serovar Typhi
aauaacgaugaugaaaaagaau

SEQ ID NO: 1718137 - RNA, 21 nt, Salmonella enterica enterica serovar Typhi
aaaaauaauuacuaucuucaa

SEQ ID NO: 1718138 - RNA, 11 nt, Salmonella enterica enterica serovar Typhi
aaaaauacuga

SEQ ID NO: 1718139 - RNA, 17 nt, Salmonella enterica enterica serovar Typhi
aauaacuauaauugcuu

SEQ ID NO: 1718140 - RNA, 23 nt, Salmonella enterica enterica serovar Typhi
aauaacucagcccauaagcuuag

SEQ ID NO: 1718141 - RNA, 19 nt, Salmonella enterica enterica serovar Typhi
aauaacuccagugcagaaa

SEQ ID NO: 1718142 - RNA, 13 nt, Salmonella enterica enterica serovar Typhi
aaaaaucagcauu

SEQ ID NO: 1718143 - RNA, 16 nt, Salmonella enterica enterica serovar Typhi
aaaaaucagucacaag

SEQ ID NO: 1718144 - RNA, 20 nt, Salmonella enterica enterica serovar Typhi
aaaaaucagucacaaguaag

SEQ ID NO: 1718145 - RNA, 23 nt, Salmonella enterica enterica serovar Typhi
aaaaaucagcccggacaucaucc

SEQ ID NO: 1718146 - RNA, 22 nt, Salmonella enterica enterica serovar Typhi
aauaaucaaccauacauccuga

SEQ ID NO: 1718147 - RNA, 23 nt, Salmonella enterica enterica serovar Typhi
aauaauaugccccgacaucagau

SEQ ID NO: 1718148 - RNA, 20 nt, Salmonella enterica enterica serovar Typhi
aauaauaugccccgacauca

SEQ ID NO: 1718149 - RNA, 23 nt, Salmonella enterica enterica serovar Typhi
aauacgggagagcguauccagca

SEQ ID NO: 1718150 - RNA, 24 nt, Salmonella enterica enterica serovar Typhi
aauacgguuagccagugggcguca

SEQ ID NO: 1718151 - RNA, 20 nt, Salmonella enterica enterica serovar Typhi
aauacgucucgaguaaucac

SEQ ID NO: 1718152 - RNA, 18 nt, Salmonella enterica enterica serovar Typhi
aauacgccgccagcaaua

SEQ ID NO: 1718153 - RNA, 23 nt, Salmonella enterica enterica serovar Typhi
aauacaucaacaaagggcaccug

SEQ ID NO: 1718154 - RNA, 18 nt, Salmonella enterica enterica serovar Typhi
aauacccgacucuuuuuu

SEQ ID NO: 1718155 - RNA, 17 nt, Salmonella enterica enterica serovar Typhi
aauaccgguuauccaua

SEQ ID NO: 1718156 - RNA, 16 nt, Salmonella enterica enterica serovar Typhi
aauaccggauaugcau

SEQ ID NO: 1718157 - RNA, 19 nt, Salmonella enterica enterica serovar Typhi
aauacgaaauugagaauua

SEQ ID NO: 1718158 - RNA, 11 nt, Salmonella enterica enterica serovar Typhi
aauaccgccca

SEQ ID NO: 1718159 - RNA, 16 nt, Salmonella enterica enterica serovar Typhi
aauaccgcaauaaaca

SEQ ID NO: 1718160 - RNA, 13 nt, Salmonella enterica enterica serovar Typhi
aauaccgcccauc

SEQ ID NO: 1718161 - RNA, 19 nt, Salmonella enterica enterica serovar Typhi
aauacccgacucuuuuuuc

SEQ ID NO: 1718162 - RNA, 22 nt, Salmonella enterica enterica serovar Typhi
aauacccgacucuuuuuucaga

SEQ ID NO: 1718163 - RNA, 14 nt, Salmonella enterica enterica serovar Typhi
aauacccuucacgg

SEQ ID NO: 1718164 - RNA, 13 nt, Salmonella enterica enterica serovar Typhi
aauacuuuuuuag

SEQ ID NO: 1718165 - RNA, 22 nt, Salmonella enterica enterica serovar Typhi
aauagagcaguuaauaaugaac

SEQ ID NO: 1718166 - RNA, 17 nt, Salmonella enterica enterica serovar Typhi
aauagaggaaauaacau

SEQ ID NO: 1718167 - RNA, 15 nt, Salmonella enterica enterica serovar Typhi
aauagaguaaugaca

SEQ ID NO: 1718168 - RNA, 16 nt, Salmonella enterica enterica serovar Typhi
aauacuggaaaaaacg

SEQ ID NO: 1718169 - RNA, 19 nt, Salmonella enterica enterica serovar Typhi
aauacuggaccccagauaa

SEQ ID NO: 1718170 - RNA, 20 nt, Salmonella enterica enterica serovar Typhi
aauacugaagucgaaauuuu

SEQ ID NO: 1718171 - RNA, 14 nt, Salmonella enterica enterica serovar Typhi
aauacugaucaauu

SEQ ID NO: 1718172 - RNA, 23 nt, Salmonella enterica enterica serovar Typhi
aauacugcacgccgcguuuuagc

SEQ ID NO: 1718173 - RNA, 18 nt, Salmonella enterica enterica serovar Typhi
aauacugcuuuuccggca

SEQ ID NO: 1718174 - RNA, 22 nt, Salmonella enterica enterica serovar Typhi
aauacuacugguggaauaaaua

SEQ ID NO: 1718175 - RNA, 16 nt, Salmonella enterica enterica serovar Typhi
aagaugaggagcugga

SEQ ID NO: 1718176 - RNA, 17 nt, Salmonella enterica enterica serovar Typhi
aagaugaggagcuggag

SEQ ID NO: 1718177 - RNA, 14 nt, Salmonella enterica enterica serovar Typhi
aagaauuaacaccg

SEQ ID NO: 1718178 - RNA, 22 nt, Salmonella enterica enterica serovar Typhi
aagaauuccgaugaaaaacugg

SEQ ID NO: 1718179 - RNA, 14 nt, Salmonella enterica enterica serovar Typhi
aagaauucgcaaug

SEQ ID NO: 1718180 - RNA, 22 nt, Salmonella enterica enterica serovar Typhi
aagaauuauuaucaauuucaua

SEQ ID NO: 1718181 - RNA, 11 nt, Salmonella enterica enterica serovar Typhi
aagauguagac

SEQ ID NO: 1718182 - RNA, 15 nt, Salmonella enterica enterica serovar Typhi
aagauguagucgccu

SEQ ID NO: 1718183 - RNA, 17 nt, Salmonella enterica enterica serovar Typhi
aagaugggucagugcau

SEQ ID NO: 1718184 - RNA, 23 nt, Salmonella enterica enterica serovar Typhi
aagaugggucagugcauguacaa

SEQ ID NO: 1718185 - RNA, 22 nt, Salmonella enterica enterica serovar Typhi
aagauuacucucuugccagcgc

SEQ ID NO: 1718186 - RNA, 18 nt, Salmonella enterica enterica serovar Typhi
aagauugauuuauucacu

SEQ ID NO: 1718187 - RNA, 19 nt, Salmonella enterica enterica serovar Typhi
aagcaauauggcugcgaua

SEQ ID NO: 1718188 - RNA, 15 nt, Salmonella enterica enterica serovar Typhi
aagcaaucgccagcg

SEQ ID NO: 1718189 - RNA, 14 nt, Salmonella enterica enterica serovar Typhi
aagcaaugccagaa

SEQ ID NO: 1718190 - RNA, 20 nt, Salmonella enterica enterica serovar Typhi
aagcacauaacugagacuca

SEQ ID NO: 1718191 - RNA, 20 nt, Salmonella enterica enterica serovar Typhi
aagauugcgcagggucuggu

SEQ ID NO: 1718192 - RNA, 23 nt, Salmonella enterica enterica serovar Typhi
aagcaacugauuaaucugccgac

SEQ ID NO: 1718193 - RNA, 23 nt, Salmonella enterica enterica serovar Typhi
aagcaacugggcuugcauugcuu

SEQ ID NO: 1718194 - RNA, 16 nt, Salmonella enterica enterica serovar Typhi
aagcaaaaaucaccac

SEQ ID NO: 1718195 - RNA, 18 nt, Salmonella enterica enterica serovar Typhi
aagcaaaccuauuucagu

SEQ ID NO: 1718196 - RNA, 16 nt, Salmonella enterica enterica serovar Typhi
aagcagcauaaugaau

SEQ ID NO: 1718197 - RNA, 14 nt, Salmonella enterica enterica serovar Typhi
aagcagacgcucga

SEQ ID NO: 1718198 - RNA, 23 nt, Salmonella enterica enterica serovar Typhi
aagcagcgccuguaaacguuccu

SEQ ID NO: 1718199 - RNA, 12 nt, Salmonella enterica enterica serovar Typhi
aagcagcgacaa

SEQ ID NO: 1718200 - RNA, 18 nt, Salmonella enterica enterica serovar Typhi
aagcagaacguagcccau

SEQ ID NO: 1718201 - RNA, 19 nt, Salmonella enterica enterica serovar Typhi
aagcagaacguagcccauu

SEQ ID NO: 1718202 - RNA, 21 nt, Salmonella enterica enterica serovar Typhi
aagcacugcugcugaaagaag

SEQ ID NO: 1718203 - RNA, 22 nt, Salmonella enterica enterica serovar Typhi
aagcacugcugcugaaagaaga

SEQ ID NO: 1718204 - RNA, 14 nt, Salmonella enterica enterica serovar Typhi
aagcacuucuccac

SEQ ID NO: 1718205 - RNA, 14 nt, Salmonella enterica enterica serovar Typhi
aagcaccgccagcg

SEQ ID NO: 1718206 - RNA, 13 nt, Salmonella enterica enterica serovar Typhi
aagcagucccgcc

SEQ ID NO: 1718207 - RNA, 23 nt, Salmonella enterica enterica serovar Typhi
aagcagguagcgccuuuacuggu

SEQ ID NO: 1718208 - RNA, 23 nt, Salmonella enterica enterica serovar Typhi
aagcagcugcuuaacuucugcag

SEQ ID NO: 1718209 - RNA, 16 nt, Salmonella enterica enterica serovar Typhi
aagcagcuugcugcuu

SEQ ID NO: 1718210 - RNA, 16 nt, Salmonella enterica enterica serovar Typhi
aagcaguuccagcauc

SEQ ID NO: 1718211 - RNA, 15 nt, Salmonella enterica enterica serovar Typhi
aagcauaccuucaca

SEQ ID NO: 1718212 - RNA, 18 nt, Salmonella enterica enterica serovar Typhi
aagcauagcgccuucagg

SEQ ID NO: 1718213 - RNA, 19 nt, Salmonella enterica enterica serovar Typhi
aagcauagcgucaucaaca

SEQ ID NO: 1718214 - RNA, 15 nt, Salmonella enterica enterica serovar Typhi
aagcaucugauauau

SEQ ID NO: 1718215 - RNA, 17 nt, Salmonella enterica enterica serovar Typhi
aagccccaugugccuug

SEQ ID NO: 1718216 - RNA, 21 nt, Salmonella enterica enterica serovar Typhi
aagccccccgcacagcacaua

SEQ ID NO: 1718217 - RNA, 23 nt, Salmonella enterica enterica serovar Typhi
aagccccuuccucgggaggggcu

SEQ ID NO: 1718218 - RNA, 19 nt, Salmonella enterica enterica serovar Typhi
aagcccuuucuuuuuuugu

SEQ ID NO: 1718219 - RNA, 12 nt, Salmonella enterica enterica serovar Typhi
aagcccacgccc

SEQ ID NO: 1718220 - RNA, 12 nt, Salmonella enterica enterica serovar Typhi
aagcccagcacg

SEQ ID NO: 1718221 - RNA, 21 nt, Salmonella enterica enterica serovar Typhi
aagcccaccgcgaacauugga

SEQ ID NO: 1718222 - RNA, 23 nt, Salmonella enterica enterica serovar Typhi
aagccaucuucgguaauacaauc

SEQ ID NO: 1718223 - RNA, 19 nt, Salmonella enterica enterica serovar Typhi
aagccauccaucuccggca

SEQ ID NO: 1718224 - RNA, 13 nt, Salmonella enterica enterica serovar Typhi
aagccaccagauc

SEQ ID NO: 1718225 - RNA, 13 nt, Salmonella enterica enterica serovar Typhi
aagccacacugca

SEQ ID NO: 1718226 - RNA, 15 nt, Salmonella enterica enterica serovar Typhi
aagccacaaucugau

SEQ ID NO: 1718227 - RNA, 21 nt, Salmonella enterica enterica serovar Typhi
aagccacuugaaguaugaaag

SEQ ID NO: 1718228 - RNA, 20 nt, Salmonella enterica enterica serovar Typhi
aagccagcacggcuucacgu

SEQ ID NO: 1718229 - RNA, 17 nt, Salmonella enterica enterica serovar Typhi
aagccagacucgcuccc

SEQ ID NO: 1718230 - RNA, 19 nt, Salmonella enterica enterica serovar Typhi
aagccagccaaauagcgcc

SEQ ID NO: 1718231 - RNA, 15 nt, Salmonella enterica enterica serovar Typhi
aagccaggcuuuaaa

SEQ ID NO: 1718232 - RNA, 14 nt, Salmonella enterica enterica serovar Typhi
aagccagggaaaug

SEQ ID NO: 1718233 - RNA, 13 nt, Salmonella enterica enterica serovar Typhi
aagcauuagcgcc

SEQ ID NO: 1718234 - RNA, 18 nt, Salmonella enterica enterica serovar Typhi
aagguuauccgccggagg

SEQ ID NO: 1718235 - RNA, 15 nt, Salmonella enterica enterica serovar Typhi
aagguuauccgccgg

SEQ ID NO: 1718236 - RNA, 14 nt, Salmonella enterica enterica serovar Typhi
aaggugagcucuuu

SEQ ID NO: 1718237 - RNA, 13 nt, Salmonella enterica enterica serovar Typhi
aaggugagaaaaa

SEQ ID NO: 1718238 - RNA, 13 nt, Salmonella enterica enterica serovar Typhi
aagguccagggaa

SEQ ID NO: 1718239 - RNA, 21 nt, Salmonella enterica enterica serovar Typhi
aaggucacgccggguacauau

SEQ ID NO: 1718240 - RNA, 17 nt, Salmonella enterica enterica serovar Typhi
aaggucaaacaccugaa

SEQ ID NO: 1718241 - RNA, 13 nt, Salmonella enterica enterica serovar Typhi
aagguauguuugu

SEQ ID NO: 1718242 - RNA, 14 nt, Salmonella enterica enterica serovar Typhi
aagguaauuuucac

SEQ ID NO: 1718243 - RNA, 14 nt, Salmonella enterica enterica serovar Typhi
aaggcgccuuuuuu

SEQ ID NO: 1718244 - RNA, 17 nt, Salmonella enterica enterica serovar Typhi
aaggcgacgcuucacgu

SEQ ID NO: 1718245 - RNA, 22 nt, Salmonella enterica enterica serovar Typhi
aaggcgacgaugugcauaaccg

SEQ ID NO: 1718246 - RNA, 23 nt, Salmonella enterica enterica serovar Typhi
aaggcgacgaugugcauaaccgc

SEQ ID NO: 1718247 - RNA, 15 nt, Salmonella enterica enterica serovar Typhi
aaggcggcaaagaua

SEQ ID NO: 1718248 - RNA, 22 nt, Salmonella enterica enterica serovar Typhi
aaggcgcuugugauaucugacu

SEQ ID NO: 1718249 - RNA, 23 nt, Salmonella enterica enterica serovar Typhi
aaggcggacaacgcauauuauga

SEQ ID NO: 1718250 - RNA, 16 nt, Salmonella enterica enterica serovar Typhi
aaggcggcaaagauaa

SEQ ID NO: 1718251 - RNA, 17 nt, Salmonella enterica enterica serovar Typhi
aaggcggcaaagauaau

SEQ ID NO: 1718252 - RNA, 23 nt, Salmonella enterica enterica serovar Typhi
aaggccuggcugagaaaaauacg

SEQ ID NO: 1718253 - RNA, 22 nt, Salmonella enterica enterica serovar Typhi
aaggcaaauaugcugucuauug

SEQ ID NO: 1718254 - RNA, 20 nt, Salmonella enterica enterica serovar Typhi
aagggauaagaaagauaaaa

SEQ ID NO: 1718255 - RNA, 17 nt, Salmonella enterica enterica serovar Typhi
aagggaggugcucuccc

SEQ ID NO: 1718256 - RNA, 22 nt, Salmonella enterica enterica serovar Typhi
aaggcguaugaaugaaacaguc

SEQ ID NO: 1718257 - RNA, 22 nt, Salmonella enterica enterica serovar Typhi
aaggcguaagucguaccggcgc

SEQ ID NO: 1718258 - RNA, 17 nt, Salmonella enterica enterica serovar Typhi
aaggcguugaugaaggu

SEQ ID NO: 1718259 - RNA, 23 nt, Salmonella enterica enterica serovar Typhi
aagguaaacgcgaccagcgcgcc

SEQ ID NO: 1718260 - RNA, 11 nt, Salmonella enterica enterica serovar Typhi
aagguaacuau

SEQ ID NO: 1718261 - RNA, 15 nt, Salmonella enterica enterica serovar Typhi
aagggcaccugggca

SEQ ID NO: 1718262 - RNA, 13 nt, Salmonella enterica enterica serovar Typhi
aaggguaagcaau

SEQ ID NO: 1718263 - RNA, 20 nt, Salmonella enterica enterica serovar Typhi
aagcguacaugaauaauaau

SEQ ID NO: 1718264 - RNA, 21 nt, Salmonella enterica enterica serovar Typhi
aagcgucuuuaaagccuucau

SEQ ID NO: 1718265 - RNA, 12 nt, Salmonella enterica enterica serovar Typhi
aagcguagcgcc

SEQ ID NO: 1718266 - RNA, 23 nt, Salmonella enterica enterica serovar Typhi
aagcggaaaggacguucuucucc

SEQ ID NO: 1718267 - RNA, 17 nt, Salmonella enterica enterica serovar Typhi
aagcgcuaugcccaccg

SEQ ID NO: 1718268 - RNA, 17 nt, Salmonella enterica enterica serovar Typhi
aagcggauaagauagca

SEQ ID NO: 1718269 - RNA, 16 nt, Salmonella enterica enterica serovar Typhi
aagcggaccaaugcug

SEQ ID NO: 1718270 - RNA, 20 nt, Salmonella enterica enterica serovar Typhi
aagcggaccaaugcuggcag

SEQ ID NO: 1718271 - RNA, 17 nt, Salmonella enterica enterica serovar Typhi
aagcggacugccuaacu

SEQ ID NO: 1718272 - RNA, 18 nt, Salmonella enterica enterica serovar Typhi
aagccgcauuacaaacag

SEQ ID NO: 1718273 - RNA, 19 nt, Salmonella enterica enterica serovar Typhi
aagccgcgucgcaccugcu

SEQ ID NO: 1718274 - RNA, 20 nt, Salmonella enterica enterica serovar Typhi
aagcgcgguaaauuucuuga

SEQ ID NO: 1718275 - RNA, 12 nt, Salmonella enterica enterica serovar Typhi
aagcgcgggcug

SEQ ID NO: 1718276 - RNA, 15 nt, Salmonella enterica enterica serovar Typhi
aagccgaccuuauuc

SEQ ID NO: 1718277 - RNA, 17 nt, Salmonella enterica enterica serovar Typhi
aagccgcauuacaaaca

SEQ ID NO: 1718278 - RNA, 22 nt, Salmonella enterica enterica serovar Typhi
aagcguuuccagaguacauucu

SEQ ID NO: 1718279 - RNA, 16 nt, Salmonella enterica enterica serovar Typhi
aagcguuguaacaaac

SEQ ID NO: 1718280 - RNA, 21 nt, Salmonella enterica enterica serovar Typhi
aagcguuguacggauggggua

SEQ ID NO: 1718281 - RNA, 22 nt, Salmonella enterica enterica serovar Typhi
aagcguuaaugcguuuacacag

SEQ ID NO: 1718282 - RNA, 20 nt, Salmonella enterica enterica serovar Typhi
aagcguuacggaaaaaauac

SEQ ID NO: 1718283 - RNA, 21 nt, Salmonella enterica enterica serovar Typhi
aagcguuagcgucauccggca

SEQ ID NO: 1718284 - RNA, 15 nt, Salmonella enterica enterica serovar Typhi
aagcguuaaugcguu

SEQ ID NO: 1718285 - RNA, 18 nt, Salmonella enterica enterica serovar Typhi
aagcguuacggaaaaaau

SEQ ID NO: 1718286 - RNA, 23 nt, Salmonella enterica enterica serovar Typhi
aagcguccgguugcaguacaggc

SEQ ID NO: 1718287 - RNA, 19 nt, Salmonella enterica enterica serovar Typhi
aagcguugccguaggcaac

SEQ ID NO: 1718288 - RNA, 18 nt, Salmonella enterica enterica serovar Typhi
aagcuaauccccagcgcu

SEQ ID NO: 1718289 - RNA, 19 nt, Salmonella enterica enterica serovar Typhi
aagcugcuggcgagcagga

SEQ ID NO: 1718290 - RNA, 23 nt, Salmonella enterica enterica serovar Typhi
aagcuguuaauuugcaucaggcc

SEQ ID NO: 1718291 - RNA, 21 nt, Salmonella enterica enterica serovar Typhi
aagcuguugugucccggccca

SEQ ID NO: 1718292 - RNA, 13 nt, Salmonella enterica enterica serovar Typhi
aagcuguuguugc

SEQ ID NO: 1718293 - RNA, 21 nt, Salmonella enterica enterica serovar Typhi
aagcuguuucuccguuguugc

SEQ ID NO: 1718294 - RNA, 17 nt, Salmonella enterica enterica serovar Typhi
aagcugcaccaggagca

SEQ ID NO: 1718295 - RNA, 16 nt, Salmonella enterica enterica serovar Typhi
aaggauacggaaugga

SEQ ID NO: 1718296 - RNA, 17 nt, Salmonella enterica enterica serovar Typhi
aaggauacucagcgacg

SEQ ID NO: 1718297 - RNA, 16 nt, Salmonella enterica enterica serovar Typhi
aagcuucagcaaauaa

SEQ ID NO: 1718298 - RNA, 17 nt, Salmonella enterica enterica serovar Typhi
aacgccauugcgaacau

SEQ ID NO: 1718299 - RNA, 22 nt, Salmonella enterica enterica serovar Typhi
aacgccaggccguugugucccu

SEQ ID NO: 1718300 - RNA, 14 nt, Salmonella enterica enterica serovar Typhi
aacgccgaagccag

SEQ ID NO: 1718301 - RNA, 22 nt, Salmonella enterica enterica serovar Typhi
aacgcccgccgcgaccagcagc

SEQ ID NO: 1718302 - RNA, 20 nt, Salmonella enterica enterica serovar Typhi
aacgcccucaaguaaaaugc

SEQ ID NO: 1718303 - RNA, 19 nt, Salmonella enterica enterica serovar Typhi
aacgccgcacacucauuuu

SEQ ID NO: 1718304 - RNA, 16 nt, Salmonella enterica enterica serovar Typhi
aacgccgaagccagcg

SEQ ID NO: 1718305 - RNA, 18 nt, Salmonella enterica enterica serovar Typhi
aacgcccccugccagcgc

SEQ ID NO: 1718306 - RNA, 20 nt, Salmonella enterica enterica serovar Typhi
aacgcccgauagcguaaaga

SEQ ID NO: 1718307 - RNA, 20 nt, Salmonella enterica enterica serovar Typhi
aaccggaccagcacaaaaaa

SEQ ID NO: 1718308 - RNA, 19 nt, Salmonella enterica enterica serovar Typhi
aaccggaccagcacaaaaa

SEQ ID NO: 1718309 - RNA, 23 nt, Salmonella enterica enterica serovar Typhi
aaccggcgauguuggcgcccuga

SEQ ID NO: 1718310 - RNA, 15 nt, Salmonella enterica enterica serovar Typhi
aaccggcugccagcg

SEQ ID NO: 1718311 - RNA, 21 nt, Salmonella enterica enterica serovar Typhi
aaccggcacauccagcgccug

SEQ ID NO: 1718312 - RNA, 21 nt, Salmonella enterica enterica serovar Typhi
aaccggcgcgccuuccagcaa

SEQ ID NO: 1718313 - RNA, 22 nt, Salmonella enterica enterica serovar Typhi
aacgauguaaaaccuggcacuu

SEQ ID NO: 1718314 - RNA, 16 nt, Salmonella enterica enterica serovar Typhi
aacgaucccuaauaaa

SEQ ID NO: 1718315 - RNA, 15 nt, Salmonella enterica enterica serovar Typhi
aacgaugaccauaaa

SEQ ID NO: 1718316 - RNA, 18 nt, Salmonella enterica enterica serovar Typhi
aacgaucccuaauaaaau

SEQ ID NO: 1718317 - RNA, 17 nt, Salmonella enterica enterica serovar Typhi
aacgccguuaccagcau

SEQ ID NO: 1718318 - RNA, 16 nt, Salmonella enterica enterica serovar Typhi
aacgcugcaaaguuau

SEQ ID NO: 1718319 - RNA, 13 nt, Salmonella enterica enterica serovar Typhi
aacgccugcacca

SEQ ID NO: 1718320 - RNA, 16 nt, Salmonella enterica enterica serovar Typhi
aacgccugauccggcc

SEQ ID NO: 1718321 - RNA, 18 nt, Salmonella enterica enterica serovar Typhi
aacgccgguuccaacagc

SEQ ID NO: 1718322 - RNA, 16 nt, Salmonella enterica enterica serovar Typhi
aacgccgccugcgcca

SEQ ID NO: 1718323 - RNA, 18 nt, Salmonella enterica enterica serovar Typhi
aacgcuggugcugugccu

SEQ ID NO: 1718324 - RNA, 23 nt, Salmonella enterica enterica serovar Typhi
aacgccuccauuuuggggaaaau

SEQ ID NO: 1718325 - RNA, 23 nt, Salmonella enterica enterica serovar Typhi
aacgcuguugccgcugcuggcgu

SEQ ID NO: 1718326 - RNA, 21 nt, Salmonella enterica enterica serovar Typhi
aacgcuucacaaccugaaaga

SEQ ID NO: 1718327 - RNA, 14 nt, Salmonella enterica enterica serovar Typhi
aacgcuuaaagcgu

SEQ ID NO: 1718328 - RNA, 15 nt, Salmonella enterica enterica serovar Typhi
aacgcuuauccggcc

SEQ ID NO: 1718329 - RNA, 18 nt, Salmonella enterica enterica serovar Typhi
aacgguucauccagcagc

SEQ ID NO: 1718330 - RNA, 23 nt, Salmonella enterica enterica serovar Typhi
aacgguccagguucaucacuuuc

SEQ ID NO: 1718331 - RNA, 12 nt, Salmonella enterica enterica serovar Typhi
aacggucaggau

SEQ ID NO: 1718332 - RNA, 21 nt, Salmonella enterica enterica serovar Typhi
aacggucgguaaucgccugca

SEQ ID NO: 1718333 - RNA, 14 nt, Salmonella enterica enterica serovar Typhi
aacgguaacggaca

SEQ ID NO: 1718334 - RNA, 16 nt, Salmonella enterica enterica serovar Typhi
aacgguaaguugaaag

SEQ ID NO: 1718335 - RNA, 19 nt, Salmonella enterica enterica serovar Typhi
aacggaaaagcauugcuuc

SEQ ID NO: 1718336 - RNA, 13 nt, Salmonella enterica enterica serovar Typhi
aacggaaccaaau

SEQ ID NO: 1718337 - RNA, 17 nt, Salmonella enterica enterica serovar Typhi
aacuaauggcaauaaua

SEQ ID NO: 1718338 - RNA, 21 nt, Salmonella enterica enterica serovar Typhi
aacuaauuguuuguagaaagu

SEQ ID NO: 1718339 - RNA, 13 nt, Salmonella enterica enterica serovar Typhi
aacuacucguaau

SEQ ID NO: 1718340 - RNA, 22 nt, Salmonella enterica enterica serovar Typhi
aacuacucguaaucuaaaauua

SEQ ID NO: 1718341 - RNA, 20 nt, Salmonella enterica enterica serovar Typhi
aacuauugcugccccggcgc

SEQ ID NO: 1718342 - RNA, 23 nt, Salmonella enterica enterica serovar Typhi
aacgugcauuauuuuagugaaaa

SEQ ID NO: 1718343 - RNA, 12 nt, Salmonella enterica enterica serovar Typhi
aacgugcagaug

SEQ ID NO: 1718344 - RNA, 21 nt, Salmonella enterica enterica serovar Typhi
aacgugcuggauggcagacaa

SEQ ID NO: 1718345 - RNA, 13 nt, Salmonella enterica enterica serovar Typhi
aacgugccacagu

SEQ ID NO: 1718346 - RNA, 22 nt, Salmonella enterica enterica serovar Typhi
aacguguuuucgauuucauuca

SEQ ID NO: 1718347 - RNA, 21 nt, Salmonella enterica enterica serovar Typhi
aacguguccaguuuuuuacuu

SEQ ID NO: 1718348 - RNA, 23 nt, Salmonella enterica enterica serovar Typhi
aacguguuacguuuaaaccaugc

SEQ ID NO: 1718349 - RNA, 22 nt, Salmonella enterica enterica serovar Typhi
aacguuacauuuuccaugccuu

SEQ ID NO: 1718350 - RNA, 18 nt, Salmonella enterica enterica serovar Typhi
aacguuaccgcagcgaau

SEQ ID NO: 1718351 - RNA, 19 nt, Salmonella enterica enterica serovar Typhi
aacguuauuggcaggaugu

SEQ ID NO: 1718352 - RNA, 16 nt, Salmonella enterica enterica serovar Typhi
aacguuguccagcaga

SEQ ID NO: 1718353 - RNA, 22 nt, Salmonella enterica enterica serovar Typhi
aacguuguccagcggccaugac

SEQ ID NO: 1718354 - RNA, 21 nt, Salmonella enterica enterica serovar Typhi
aacguuuaaugucaccaucau

SEQ ID NO: 1718355 - RNA, 14 nt, Salmonella enterica enterica serovar Typhi
aacguuugccagcg

SEQ ID NO: 1718356 - RNA, 18 nt, Salmonella enterica enterica serovar Typhi
aacguuuguaacagcagg

SEQ ID NO: 1718357 - RNA, 16 nt, Salmonella enterica enterica serovar Typhi
aacguucaaaaucaaa

SEQ ID NO: 1718358 - RNA, 17 nt, Salmonella enterica enterica serovar Typhi
aacguucggugaagaaa

SEQ ID NO: 1718359 - RNA, 22 nt, Salmonella enterica enterica serovar Typhi
aacguucggugaagaaaaagaa

SEQ ID NO: 1718360 - RNA, 15 nt, Salmonella enterica enterica serovar Typhi
aacguuguauaaaca

SEQ ID NO: 1718361 - RNA, 17 nt, Salmonella enterica enterica serovar Typhi
aacgucuugccaugugc

SEQ ID NO: 1718362 - RNA, 21 nt, Salmonella enterica enterica serovar Typhi
aacgucagcuggaaugcccac

SEQ ID NO: 1718363 - RNA, 18 nt, Salmonella enterica enterica serovar Typhi
aacgucaguggaaaacag

SEQ ID NO: 1718364 - RNA, 15 nt, Salmonella enterica enterica serovar Typhi
aacguaccugagaga

SEQ ID NO: 1718365 - RNA, 21 nt, Salmonella enterica enterica serovar Typhi
aacguaacuugauuccuggcu

SEQ ID NO: 1718366 - RNA, 23 nt, Salmonella enterica enterica serovar Typhi
aacguaaagcuggccuucagguu

SEQ ID NO: 1718367 - RNA, 14 nt, Salmonella enterica enterica serovar Typhi
aacguaaauaccca

SEQ ID NO: 1718368 - RNA, 19 nt, Salmonella enterica enterica serovar Typhi
aacguauuucuuuugccau

SEQ ID NO: 1718369 - RNA, 21 nt, Salmonella enterica enterica serovar Typhi
aacguaugugauuagcccacc

SEQ ID NO: 1718370 - RNA, 16 nt, Salmonella enterica enterica serovar Typhi
aacugcucuaccaacu

SEQ ID NO: 1718371 - RNA, 20 nt, Salmonella enterica enterica serovar Typhi
aacugcggcuauauaaaauc

SEQ ID NO: 1718372 - RNA, 17 nt, Salmonella enterica enterica serovar Typhi
aacugcgcggcaaugag

SEQ ID NO: 1718373 - RNA, 20 nt, Salmonella enterica enterica serovar Typhi
aacugcggaauuuuauccug

SEQ ID NO: 1718374 - RNA, 15 nt, Salmonella enterica enterica serovar Typhi
aacugcgccugcuca

SEQ ID NO: 1718375 - RNA, 17 nt, Salmonella enterica enterica serovar Typhi
aacugcgcgccgcccug

SEQ ID NO: 1718376 - RNA, 15 nt, Salmonella enterica enterica serovar Typhi
aacugcgccugaaga

SEQ ID NO: 1718377 - RNA, 16 nt, Salmonella enterica enterica serovar Typhi
aacugcgccugcauau

SEQ ID NO: 1718378 - RNA, 13 nt, Salmonella enterica enterica serovar Typhi
aacuggaaaaaga

SEQ ID NO: 1718379 - RNA, 15 nt, Salmonella enterica enterica serovar Typhi
aacugcugccgcagc

SEQ ID NO: 1718380 - RNA, 11 nt, Salmonella enterica enterica serovar Typhi
aacugcugcuc

SEQ ID NO: 1718381 - RNA, 16 nt, Salmonella enterica enterica serovar Typhi
aacuggcagcagugac

SEQ ID NO: 1718382 - RNA, 17 nt, Salmonella enterica enterica serovar Typhi
aacuggccacagcaaau

SEQ ID NO: 1718383 - RNA, 15 nt, Salmonella enterica enterica serovar Typhi
aacuggcgcuggcag

SEQ ID NO: 1718384 - RNA, 15 nt, Salmonella enterica enterica serovar Typhi
aacugaaccaacagc

SEQ ID NO: 1718385 - RNA, 19 nt, Salmonella enterica enterica serovar Typhi
aacugaaccaacagcuggg

SEQ ID NO: 1718386 - RNA, 19 nt, Salmonella enterica enterica serovar Typhi
aacucuuuuucagcaaaua

SEQ ID NO: 1718387 - RNA, 21 nt, Salmonella enterica enterica serovar Typhi
aacucuuuuucagcaaauaca

SEQ ID NO: 1718388 - RNA, 18 nt, Salmonella enterica enterica serovar Typhi
aacugauucaaaagguga

SEQ ID NO: 1718389 - RNA, 23 nt, Salmonella enterica enterica serovar Typhi
aacucuuucagaccauaguccau

SEQ ID NO: 1718390 - RNA, 21 nt, Salmonella enterica enterica serovar Typhi
aacucuuccgggcugacauaa

SEQ ID NO: 1718391 - RNA, 23 nt, Salmonella enterica enterica serovar Typhi
aacuuaaauuaaugauuaaaaua

SEQ ID NO: 1718392 - RNA, 23 nt, Salmonella enterica enterica serovar Typhi
aacuuaguguccacucgcucauu

SEQ ID NO: 1718393 - RNA, 13 nt, Salmonella enterica enterica serovar Typhi
aacuggugaaaca

SEQ ID NO: 1718394 - RNA, 17 nt, Salmonella enterica enterica serovar Typhi
aacuggugaaacagguu

SEQ ID NO: 1718395 - RNA, 16 nt, Salmonella enterica enterica serovar Typhi
aacugggcgauaaagu

SEQ ID NO: 1718396 - RNA, 23 nt, Salmonella enterica enterica serovar Typhi
aacugggcuugcauugcuuuuag

SEQ ID NO: 1718397 - RNA, 18 nt, Salmonella enterica enterica serovar Typhi
aacuuauuuuauuuuuau

SEQ ID NO: 1718398 - RNA, 15 nt, Salmonella enterica enterica serovar Typhi
aacuuauugauuuuc

SEQ ID NO: 1718399 - RNA, 17 nt, Salmonella enterica enterica serovar Typhi
aacuuauugauuuucaa

SEQ ID NO: 1718400 - RNA, 13 nt, Salmonella enterica enterica serovar Typhi
aacuucugcaggg

SEQ ID NO: 1718401 - RNA, 22 nt, Salmonella enterica enterica serovar Typhi
aagaaauuuugcacuguuuuua

SEQ ID NO: 1718402 - RNA, 17 nt, Salmonella enterica enterica serovar Typhi
aagaaagggagaauacc

SEQ ID NO: 1718403 - RNA, 22 nt, Salmonella enterica enterica serovar Typhi
aagaaauguccauaaauagauc

SEQ ID NO: 1718404 - RNA, 14 nt, Salmonella enterica enterica serovar Typhi
aagaacaugacggc

SEQ ID NO: 1718405 - RNA, 22 nt, Salmonella enterica enterica serovar Typhi
aagaacagggggcgcaucacug

SEQ ID NO: 1718406 - RNA, 22 nt, Salmonella enterica enterica serovar Typhi
aagaaccgacugucgaaaccag

SEQ ID NO: 1718407 - RNA, 16 nt, Salmonella enterica enterica serovar Typhi
aacuugauuccuggcu

SEQ ID NO: 1718408 - RNA, 14 nt, Salmonella enterica enterica serovar Typhi
aagaaaaaagugau

SEQ ID NO: 1718409 - RNA, 12 nt, Salmonella enterica enterica serovar Typhi
aagaaaaagaag

SEQ ID NO: 1718410 - RNA, 22 nt, Salmonella enterica enterica serovar Typhi
aacuuguaaaaaugccugugcc

SEQ ID NO: 1718411 - RNA, 20 nt, Salmonella enterica enterica serovar Typhi
aagaaaaaacuuauuucuau

SEQ ID NO: 1718412 - RNA, 22 nt, Salmonella enterica enterica serovar Typhi
aagaaacgcuuaaagcguucca

SEQ ID NO: 1718413 - RNA, 15 nt, Salmonella enterica enterica serovar Typhi
aagaaacugugguua

SEQ ID NO: 1718414 - RNA, 15 nt, Salmonella enterica enterica serovar Typhi
aagaaagauaaaaua

SEQ ID NO: 1718415 - RNA, 22 nt, Salmonella enterica enterica serovar Typhi
aagaaaaaggagccuuacggcu

SEQ ID NO: 1718416 - RNA, 18 nt, Salmonella enterica enterica serovar Typhi
aagaagcacgacacaaaa

SEQ ID NO: 1718417 - RNA, 12 nt, Salmonella enterica enterica serovar Typhi
aagaagaggcga

SEQ ID NO: 1718418 - RNA, 15 nt, Salmonella enterica enterica serovar Typhi
aagaagcgcuggaga

SEQ ID NO: 1718419 - RNA, 15 nt, Salmonella enterica enterica serovar Typhi
aagaacguguuuuuc

SEQ ID NO: 1718420 - RNA, 20 nt, Salmonella enterica enterica serovar Typhi
aagaacuuaggauaauuccc

SEQ ID NO: 1718421 - RNA, 19 nt, Salmonella enterica enterica serovar Typhi
aagaagaauuauuaucaau

SEQ ID NO: 1718422 - RNA, 19 nt, Salmonella enterica enterica serovar Typhi
aagaaguaaacagaaucaa

SEQ ID NO: 1718423 - RNA, 17 nt, Salmonella enterica enterica serovar Typhi
aagaagguuaauauaca

SEQ ID NO: 1718424 - RNA, 16 nt, Salmonella enterica enterica serovar Typhi
aagaauagccugggca

SEQ ID NO: 1718425 - RNA, 22 nt, Salmonella enterica enterica serovar Typhi
aagaauaucggcgucaacguuu

SEQ ID NO: 1718426 - RNA, 13 nt, Salmonella enterica enterica serovar Typhi
aacauucagguuc

SEQ ID NO: 1718427 - RNA, 18 nt, Salmonella enterica enterica serovar Typhi
aacauuauuaaaaugucu

SEQ ID NO: 1718428 - RNA, 19 nt, Salmonella enterica enterica serovar Typhi
aacauuauuaaaaugucuu

SEQ ID NO: 1718429 - RNA, 22 nt, Salmonella enterica enterica serovar Typhi
aacauugaggcuacccagacaa

SEQ ID NO: 1718430 - RNA, 19 nt, Salmonella enterica enterica serovar Typhi
aacauuccgcccaagaaca

SEQ ID NO: 1718431 - RNA, 20 nt, Salmonella enterica enterica serovar Typhi
aacauuccgcccaagaacau

SEQ ID NO: 1718432 - RNA, 22 nt, Salmonella enterica enterica serovar Typhi
aacauuccgcccaagaacauga

SEQ ID NO: 1718433 - RNA, 12 nt, Salmonella enterica enterica serovar Typhi
aacauuccgcuu

SEQ ID NO: 1718434 - RNA, 19 nt, Salmonella enterica enterica serovar Typhi
aacauuacaauguacagaa

SEQ ID NO: 1718435 - RNA, 16 nt, Salmonella enterica enterica serovar Typhi
aacagcgccaucagga

SEQ ID NO: 1718436 - RNA, 16 nt, Salmonella enterica enterica serovar Typhi
aacagcccgauaaaca

SEQ ID NO: 1718437 - RNA, 18 nt, Salmonella enterica enterica serovar Typhi
aacagccauuuuaaaaau

SEQ ID NO: 1718438 - RNA, 15 nt, Salmonella enterica enterica serovar Typhi
aacagcgccgcgaau

SEQ ID NO: 1718439 - RNA, 15 nt, Salmonella enterica enterica serovar Typhi
aacagcgccaucagg

SEQ ID NO: 1718440 - RNA, 23 nt, Salmonella enterica enterica serovar Typhi
aacagcgaucacgccguccagca

SEQ ID NO: 1718441 - RNA, 14 nt, Salmonella enterica enterica serovar Typhi
aacauccucuccug

SEQ ID NO: 1718442 - RNA, 14 nt, Salmonella enterica enterica serovar Typhi
aacaugaccagcgc

SEQ ID NO: 1718443 - RNA, 16 nt, Salmonella enterica enterica serovar Typhi
aacaugaccagcgcaa

SEQ ID NO: 1718444 - RNA, 19 nt, Salmonella enterica enterica serovar Typhi
aacaugacgccgaaauaaa

SEQ ID NO: 1718445 - RNA, 18 nt, Salmonella enterica enterica serovar Typhi
aacaucuuccaugccuuc

SEQ ID NO: 1718446 - RNA, 22 nt, Salmonella enterica enterica serovar Typhi
aacaucauucccguaucuucau

SEQ ID NO: 1718447 - RNA, 19 nt, Salmonella enterica enterica serovar Typhi
aacauauuuuucacacaua

SEQ ID NO: 1718448 - RNA, 22 nt, Salmonella enterica enterica serovar Typhi
aacauauuuuuaugcacgcuau

SEQ ID NO: 1718449 - RNA, 19 nt, Salmonella enterica enterica serovar Typhi
aaccgaaagaagaaaccau

SEQ ID NO: 1718450 - RNA, 23 nt, Salmonella enterica enterica serovar Typhi
aaccgacugucgaaaccagcaua

SEQ ID NO: 1718451 - RNA, 20 nt, Salmonella enterica enterica serovar Typhi
aaccgacggugcucaugaca

SEQ ID NO: 1718452 - RNA, 17 nt, Salmonella enterica enterica serovar Typhi
aaccgagcauccgcgca

SEQ ID NO: 1718453 - RNA, 19 nt, Salmonella enterica enterica serovar Typhi
aacccucgaaugugaauuc

SEQ ID NO: 1718454 - RNA, 20 nt, Salmonella enterica enterica serovar Typhi
aacccugguuugcuggaaau

SEQ ID NO: 1718455 - RNA, 14 nt, Salmonella enterica enterica serovar Typhi
aaccgcgcguaaau

SEQ ID NO: 1718456 - RNA, 22 nt, Salmonella enterica enterica serovar Typhi
aaccgcgcggcguucugcgcca

SEQ ID NO: 1718457 - RNA, 19 nt, Salmonella enterica enterica serovar Typhi
aaccgcgccaaagauaaga

SEQ ID NO: 1718458 - RNA, 16 nt, Salmonella enterica enterica serovar Typhi
aaccgcgccggaugac

SEQ ID NO: 1718459 - RNA, 17 nt, Salmonella enterica enterica serovar Typhi
aaccgcagaaaaagccc

SEQ ID NO: 1718460 - RNA, 19 nt, Salmonella enterica enterica serovar Typhi
aaccgcagaaaaagccccc

SEQ ID NO: 1718461 - RNA, 15 nt, Salmonella enterica enterica serovar Typhi
aaccgcaaaugccau

SEQ ID NO: 1718462 - RNA, 13 nt, Salmonella enterica enterica serovar Typhi
aaccgaucuccca

SEQ ID NO: 1718463 - RNA, 13 nt, Salmonella enterica enterica serovar Typhi
aaccgccagcagu

SEQ ID NO: 1718464 - RNA, 14 nt, Salmonella enterica enterica serovar Typhi
aacccaccagcagg

SEQ ID NO: 1718465 - RNA, 13 nt, Salmonella enterica enterica serovar Typhi
aacccaccagcgc

SEQ ID NO: 1718466 - RNA, 15 nt, Salmonella enterica enterica serovar Typhi
aacccacgacgcggu

SEQ ID NO: 1718467 - RNA, 19 nt, Salmonella enterica enterica serovar Typhi
aacccaccagcgccaggcc

SEQ ID NO: 1718468 - RNA, 14 nt, Salmonella enterica enterica serovar Typhi
aacccacuuugcuu

SEQ ID NO: 1718469 - RNA, 21 nt, Salmonella enterica enterica serovar Typhi
aacccguuaaauaccagcacc

SEQ ID NO: 1718470 - RNA, 22 nt, Salmonella enterica enterica serovar Typhi
aaccauguugaucguaaaauga

SEQ ID NO: 1718471 - RNA, 21 nt, Salmonella enterica enterica serovar Typhi
aaccauucccguaaaagaaga

SEQ ID NO: 1718472 - RNA, 15 nt, Salmonella enterica enterica serovar Typhi
aaccacaaguuuauc

SEQ ID NO: 1718473 - RNA, 20 nt, Salmonella enterica enterica serovar Typhi
aaccacggagagacaguuca

SEQ ID NO: 1718474 - RNA, 19 nt, Salmonella enterica enterica serovar Typhi
aaccacggauaagccagcc

SEQ ID NO: 1718475 - RNA, 20 nt, Salmonella enterica enterica serovar Typhi
aaccacgccauggccgcagc

SEQ ID NO: 1718476 - RNA, 10 nt, Salmonella enterica enterica serovar Typhi
aaccacgcca

SEQ ID NO: 1718477 - RNA, 17 nt, Salmonella enterica enterica serovar Typhi
aaccacgccaaccaucg

SEQ ID NO: 1718478 - RNA, 22 nt, Salmonella enterica enterica serovar Typhi
aaauucugucucaauaaaaugu

SEQ ID NO: 1718479 - RNA, 12 nt, Salmonella enterica enterica serovar Typhi
aaauucuuuuca

SEQ ID NO: 1718480 - RNA, 14 nt, Salmonella enterica enterica serovar Typhi
aacaagugcagaag

SEQ ID NO: 1718481 - RNA, 19 nt, Salmonella enterica enterica serovar Typhi
aacaaucgcaccaggccac

SEQ ID NO: 1718482 - RNA, 19 nt, Salmonella enterica enterica serovar Typhi
aacaaugccauuauugcau

SEQ ID NO: 1718483 - RNA, 17 nt, Salmonella enterica enterica serovar Typhi
aacaaugggauaaaaug

SEQ ID NO: 1718484 - RNA, 17 nt, Salmonella enterica enterica serovar Typhi
aacaauuugcccagcgc

SEQ ID NO: 1718485 - RNA, 22 nt, Salmonella enterica enterica serovar Typhi
aaaaaggguaacgggacacugc

SEQ ID NO: 1718486 - RNA, 14 nt, Salmonella enterica enterica serovar Typhi
aacacagccagcac

SEQ ID NO: 1718487 - RNA, 23 nt, Salmonella enterica enterica serovar Typhi
aacacacguaacaaccagaauaa

SEQ ID NO: 1718488 - RNA, 16 nt, Salmonella enterica enterica serovar Typhi
aacacacuuucugcuu

SEQ ID NO: 1718489 - RNA, 21 nt, Salmonella enterica enterica serovar Typhi
aacacaaacaauuuacgcagc

SEQ ID NO: 1718490 - RNA, 13 nt, Salmonella enterica enterica serovar Typhi
aacaccagacuga

SEQ ID NO: 1718491 - RNA, 15 nt, Salmonella enterica enterica serovar Typhi
aacaccacaacacac

SEQ ID NO: 1718492 - RNA, 12 nt, Salmonella enterica enterica serovar Typhi
aacaccagauca

SEQ ID NO: 1718493 - RNA, 17 nt, Salmonella enterica enterica serovar Typhi
aacaccagcgauccaga

SEQ ID NO: 1718494 - RNA, 19 nt, Salmonella enterica enterica serovar Typhi
aacaccagggauuuugcuu

SEQ ID NO: 1718495 - RNA, 17 nt, Salmonella enterica enterica serovar Typhi
aacaccugaaccagcgc

SEQ ID NO: 1718496 - RNA, 16 nt, Salmonella enterica enterica serovar Typhi
aacaccuuauccggcc

SEQ ID NO: 1718497 - RNA, 20 nt, Salmonella enterica enterica serovar Typhi
aacaccucagccacccacug

SEQ ID NO: 1718498 - RNA, 18 nt, Salmonella enterica enterica serovar Typhi
aacacgaccagcgacagu

SEQ ID NO: 1718499 - RNA, 13 nt, Salmonella enterica enterica serovar Typhi
aacacgaauaugc

SEQ ID NO: 1718500 - RNA, 23 nt, Salmonella enterica enterica serovar Typhi
aacaccguuggcgucaaauccau

SEQ ID NO: 1718501 - RNA, 16 nt, Salmonella enterica enterica serovar Typhi
aacacccacaccaucg

SEQ ID NO: 1718502 - RNA, 18 nt, Salmonella enterica enterica serovar Typhi
aacacgauggcaaauaau

SEQ ID NO: 1718503 - RNA, 22 nt, Salmonella enterica enterica serovar Typhi
aacacgauggcaaauaauacca

SEQ ID NO: 1718504 - RNA, 16 nt, Salmonella enterica enterica serovar Typhi
aacacgccgcgcugga

SEQ ID NO: 1718505 - RNA, 13 nt, Salmonella enterica enterica serovar Typhi
aacacucuccacc

SEQ ID NO: 1718506 - RNA, 20 nt, Salmonella enterica enterica serovar Typhi
aacacuaacuaauuguuugu

SEQ ID NO: 1718507 - RNA, 20 nt, Salmonella enterica enterica serovar Typhi
aacacucacaaaacuauuuu

SEQ ID NO: 1718508 - RNA, 15 nt, Salmonella enterica enterica serovar Typhi
aacagaguaacccga

SEQ ID NO: 1718509 - RNA, 22 nt, Salmonella enterica enterica serovar Typhi
aacagagcgccggcaaagccau

SEQ ID NO: 1718510 - RNA, 22 nt, Salmonella enterica enterica serovar Typhi
aacagagagggaaaaaaauccu

SEQ ID NO: 1718511 - RNA, 18 nt, Salmonella enterica enterica serovar Typhi
aacagaaaagaucgcugc

SEQ ID NO: 1718512 - RNA, 21 nt, Salmonella enterica enterica serovar Typhi
aacagaaaaaaugcaccgccu

SEQ ID NO: 1718513 - RNA, 21 nt, Salmonella enterica enterica serovar Typhi
aacagaaaccauaaacaaaac

SEQ ID NO: 1718514 - RNA, 14 nt, Salmonella enterica enterica serovar Typhi
aacagaaaccauaa

SEQ ID NO: 1718515 - RNA, 18 nt, Salmonella enterica enterica serovar Typhi
aacagaagccugcguuau

SEQ ID NO: 1718516 - RNA, 23 nt, Salmonella enterica enterica serovar Typhi
aacagccaaucauaaacgccuga

SEQ ID NO: 1718517 - RNA, 15 nt, Salmonella enterica enterica serovar Typhi
aacagccagaagccu

SEQ ID NO: 1718518 - RNA, 13 nt, Salmonella enterica enterica serovar Typhi
aacagccagcagc

SEQ ID NO: 1718519 - RNA, 14 nt, Salmonella enterica enterica serovar Typhi
aacagccagaagcc

SEQ ID NO: 1718520 - RNA, 14 nt, Salmonella enterica enterica serovar Typhi
aacagccagcagcg

SEQ ID NO: 1718521 - RNA, 21 nt, Salmonella enterica enterica serovar Typhi
aacagcauaaacguuaccaua

SEQ ID NO: 1718522 - RNA, 12 nt, Salmonella enterica enterica serovar Typhi
aacagcaccagc

SEQ ID NO: 1718523 - RNA, 12 nt, Salmonella enterica enterica serovar Typhi
aacagcaaugcc

SEQ ID NO: 1718524 - RNA, 14 nt, Salmonella enterica enterica serovar Typhi
aacagcaccagcag

SEQ ID NO: 1718525 - RNA, 15 nt, Salmonella enterica enterica serovar Typhi
aacagcaccagcagg

SEQ ID NO: 1718526 - RNA, 14 nt, Salmonella enterica enterica serovar Typhi
aauguacgccuaaa

SEQ ID NO: 1718527 - RNA, 20 nt, Salmonella enterica enterica serovar Typhi
aauguaauucaccaaauccu

SEQ ID NO: 1718528 - RNA, 17 nt, Salmonella enterica enterica serovar Typhi
aauguaaaaaaauaaaa

SEQ ID NO: 1718529 - RNA, 13 nt, Salmonella enterica enterica serovar Typhi
aaugguuauuaau

SEQ ID NO: 1718530 - RNA, 12 nt, Salmonella enterica enterica serovar Typhi
aaugguugcguu

SEQ ID NO: 1718531 - RNA, 21 nt, Salmonella enterica enterica serovar Typhi
aauggcgcgucuuaaaauugc

SEQ ID NO: 1718532 - RNA, 22 nt, Salmonella enterica enterica serovar Typhi
aauggccgcagcgccauaaaaa

SEQ ID NO: 1718533 - RNA, 12 nt, Salmonella enterica enterica serovar Typhi
aauggccgcccc

SEQ ID NO: 1718534 - RNA, 12 nt, Salmonella enterica enterica serovar Typhi
aauggcgaaaaa

SEQ ID NO: 1718535 - RNA, 17 nt, Salmonella enterica enterica serovar Typhi
aauggauagagucgaua

SEQ ID NO: 1718536 - RNA, 18 nt, Salmonella enterica enterica serovar Typhi
aaugcgccccggcggcgu

SEQ ID NO: 1718537 - RNA, 17 nt, Salmonella enterica enterica serovar Typhi
aaugcgccgucaggcuu

SEQ ID NO: 1718538 - RNA, 21 nt, Salmonella enterica enterica serovar Typhi
aaugcgcgugcgguuuuccug

SEQ ID NO: 1718539 - RNA, 17 nt, Salmonella enterica enterica serovar Typhi
aaugcgcuuuuuuugcc

SEQ ID NO: 1718540 - RNA, 18 nt, Salmonella enterica enterica serovar Typhi
aaugcuuagucagccuua

SEQ ID NO: 1718541 - RNA, 14 nt, Salmonella enterica enterica serovar Typhi
aaugcuuuaaaugc

SEQ ID NO: 1718542 - RNA, 14 nt, Salmonella enterica enterica serovar Typhi
aauggaaaauaaua

SEQ ID NO: 1718543 - RNA, 15 nt, Salmonella enterica enterica serovar Typhi
aaugcuuucaauacu

SEQ ID NO: 1718544 - RNA, 13 nt, Salmonella enterica enterica serovar Typhi
aauggaaaauaau

SEQ ID NO: 1718545 - RNA, 21 nt, Salmonella enterica enterica serovar Typhi
aaugcagcggaauucccacau

SEQ ID NO: 1718546 - RNA, 13 nt, Salmonella enterica enterica serovar Typhi
aaugccacugccc

SEQ ID NO: 1718547 - RNA, 13 nt, Salmonella enterica enterica serovar Typhi
aaugcgagcaaaa

SEQ ID NO: 1718548 - RNA, 14 nt, Salmonella enterica enterica serovar Typhi
aaugcgauagguga

SEQ ID NO: 1718549 - RNA, 13 nt, Salmonella enterica enterica serovar Typhi
aaugcccacgccg

SEQ ID NO: 1718550 - RNA, 12 nt, Salmonella enterica enterica serovar Typhi
aaugcccaaaau

SEQ ID NO: 1718551 - RNA, 13 nt, Salmonella enterica enterica serovar Typhi
aaugccuguuuau

SEQ ID NO: 1718552 - RNA, 16 nt, Salmonella enterica enterica serovar Typhi
aaugccuguuuauauu

SEQ ID NO: 1718553 - RNA, 24 nt, Salmonella enterica enterica serovar Typhi
aaugccuuauccggccugcaggca

SEQ ID NO: 1718554 - RNA, 17 nt, Salmonella enterica enterica serovar Typhi
aaugccuuccuguggaa

SEQ ID NO: 1718555 - RNA, 23 nt, Salmonella enterica enterica serovar Typhi
aaugauuuuguguauauauugca

SEQ ID NO: 1718556 - RNA, 22 nt, Salmonella enterica enterica serovar Typhi
aauguuagcauuauuuuuaacc

SEQ ID NO: 1718557 - RNA, 17 nt, Salmonella enterica enterica serovar Typhi
aauguuaauaagcagaa

SEQ ID NO: 1718558 - RNA, 19 nt, Salmonella enterica enterica serovar Typhi
aaugugccgguaagaagaa

SEQ ID NO: 1718559 - RNA, 13 nt, Salmonella enterica enterica serovar Typhi
aauguccagcagu

SEQ ID NO: 1718560 - RNA, 20 nt, Salmonella enterica enterica serovar Typhi
aaugucaugacugguuuuuc

SEQ ID NO: 1718561 - RNA, 20 nt, Salmonella enterica enterica serovar Typhi
aaugucccaguaauaucgcc

SEQ ID NO: 1718562 - RNA, 20 nt, Salmonella enterica enterica serovar Typhi
aauguccagcagugucugcu

SEQ ID NO: 1718563 - RNA, 17 nt, Salmonella enterica enterica serovar Typhi
aauguccauaaauagau

SEQ ID NO: 1718564 - RNA, 20 nt, Salmonella enterica enterica serovar Typhi
aauguccauaaauagaucau

SEQ ID NO: 1718565 - RNA, 20 nt, Salmonella enterica enterica serovar Typhi
aauguccguuuucgacaugg

SEQ ID NO: 1718566 - RNA, 23 nt, Salmonella enterica enterica serovar Typhi
aauguauucucccgucagcaaca

SEQ ID NO: 1718567 - RNA, 14 nt, Salmonella enterica enterica serovar Typhi
aauguauuucagac

SEQ ID NO: 1718568 - RNA, 15 nt, Salmonella enterica enterica serovar Typhi
aauguaaaacugacu

SEQ ID NO: 1718569 - RNA, 23 nt, Salmonella enterica enterica serovar Typhi
aaugucuuccuuuucuagccaau

SEQ ID NO: 1718570 - RNA, 22 nt, Salmonella enterica enterica serovar Typhi
aaugucugaauauuaaaguuca

SEQ ID NO: 1718571 - RNA, 18 nt, Salmonella enterica enterica serovar Typhi
aaugucuggcgcuaaaau

SEQ ID NO: 1718572 - RNA, 19 nt, Salmonella enterica enterica serovar Typhi
aaugucuggcgcuaaaauc

SEQ ID NO: 1718573 - RNA, 18 nt, Salmonella enterica enterica serovar Typhi
aaugugaaauacagccag

SEQ ID NO: 1718574 - RNA, 21 nt, Salmonella enterica enterica serovar Typhi
aaugugaaauacagccagguu

SEQ ID NO: 1718575 - RNA, 16 nt, Salmonella enterica enterica serovar Typhi
aaugugauccgccccc

SEQ ID NO: 1718576 - RNA, 21 nt, Salmonella enterica enterica serovar Typhi
aaugucggccugauuucugac

SEQ ID NO: 1718577 - RNA, 17 nt, Salmonella enterica enterica serovar Typhi
aaugucgcgucagguuu

SEQ ID NO: 1718578 - RNA, 16 nt, Salmonella enterica enterica serovar Typhi
aaugucgcgucagguu

SEQ ID NO: 1718579 - RNA, 15 nt, Salmonella enterica enterica serovar Typhi
aaugucgcgcaggcg

SEQ ID NO: 1718580 - RNA, 14 nt, Salmonella enterica enterica serovar Typhi
aaugucgcgucagg

SEQ ID NO: 1718581 - RNA, 13 nt, Salmonella enterica enterica serovar Typhi
aauuaaccgauaa

SEQ ID NO: 1718582 - RNA, 17 nt, Salmonella enterica enterica serovar Typhi
aauuaacauuuaagaaa

SEQ ID NO: 1718583 - RNA, 21 nt, Salmonella enterica enterica serovar Typhi
aauuaacauuuaagaaacaau

SEQ ID NO: 1718584 - RNA, 13 nt, Salmonella enterica enterica serovar Typhi
aauuaacccacau

SEQ ID NO: 1718585 - RNA, 16 nt, Salmonella enterica enterica serovar Typhi
aauuaaaugcuugcuu

SEQ ID NO: 1718586 - RNA, 18 nt, Salmonella enterica enterica serovar Typhi
aauuaaauaacaaaugaa

SEQ ID NO: 1718587 - RNA, 11 nt, Salmonella enterica enterica serovar Typhi
aauuaaaaaua

SEQ ID NO: 1718588 - RNA, 17 nt, Salmonella enterica enterica serovar Typhi
aauguugguauauucga

SEQ ID NO: 1718589 - RNA, 22 nt, Salmonella enterica enterica serovar Typhi
aauguuuaaucggccagcgaaa

SEQ ID NO: 1718590 - RNA, 21 nt, Salmonella enterica enterica serovar Typhi
aauucucccaaauuuuuuuag

SEQ ID NO: 1718591 - RNA, 21 nt, Salmonella enterica enterica serovar Typhi
aauucucagaaacaacacaaa

SEQ ID NO: 1718592 - RNA, 17 nt, Salmonella enterica enterica serovar Typhi
aauuccuuguuuuaacg

SEQ ID NO: 1718593 - RNA, 20 nt, Salmonella enterica enterica serovar Typhi
aauucauuacgaaguuuaau

SEQ ID NO: 1718594 - RNA, 19 nt, Salmonella enterica enterica serovar Typhi
aauuccauuagcauucccu

SEQ ID NO: 1718595 - RNA, 22 nt, Salmonella enterica enterica serovar Typhi
aauuccaggcccggugucagac

SEQ ID NO: 1718596 - RNA, 15 nt, Salmonella enterica enterica serovar Typhi
aauuccaccaccucg

SEQ ID NO: 1718597 - RNA, 14 nt, Salmonella enterica enterica serovar Typhi
aauuccaauauuua

SEQ ID NO: 1718598 - RNA, 22 nt, Salmonella enterica enterica serovar Typhi
aauuauauugcguaaaaacccu

SEQ ID NO: 1718599 - RNA, 22 nt, Salmonella enterica enterica serovar Typhi
aauuaucuguugauaaaacacu

SEQ ID NO: 1718600 - RNA, 23 nt, Salmonella enterica enterica serovar Typhi
aauuaagcaauccauuuuaaaua

SEQ ID NO: 1718601 - RNA, 12 nt, Salmonella enterica enterica serovar Typhi
aauuauaaagca

SEQ ID NO: 1718602 - RNA, 21 nt, Salmonella enterica enterica serovar Typhi
aauuaacgacaaaaauaccac

SEQ ID NO: 1718603 - RNA, 15 nt, Salmonella enterica enterica serovar Typhi
aauuaacucaucaca

SEQ ID NO: 1718604 - RNA, 18 nt, Salmonella enterica enterica serovar Typhi
aauucacgcuucucuggc

SEQ ID NO: 1718605 - RNA, 23 nt, Salmonella enterica enterica serovar Typhi
aauucacuuccgucauguagcaa

SEQ ID NO: 1718606 - RNA, 22 nt, Salmonella enterica enterica serovar Typhi
aauucagcauuaggcguaaaau

SEQ ID NO: 1718607 - RNA, 18 nt, Salmonella enterica enterica serovar Typhi
aauuauuccuuaucacau

SEQ ID NO: 1718608 - RNA, 22 nt, Salmonella enterica enterica serovar Typhi
aauuauuaucaauuucauauua

SEQ ID NO: 1718609 - RNA, 19 nt, Salmonella enterica enterica serovar Typhi
aauucaccaaauccucacu

SEQ ID NO: 1718610 - RNA, 21 nt, Salmonella enterica enterica serovar Typhi
aauucacccguuauucauuca

SEQ ID NO: 1718611 - RNA, 15 nt, Salmonella enterica enterica serovar Typhi
aauucaccgcaugac

SEQ ID NO: 1718612 - RNA, 14 nt, Salmonella enterica enterica serovar Typhi
aauugguuauauua

SEQ ID NO: 1718613 - RNA, 18 nt, Salmonella enterica enterica serovar Typhi
aauugucuuuuuaaccau

SEQ ID NO: 1718614 - RNA, 17 nt, Salmonella enterica enterica serovar Typhi
aauuguuccuguaaagc

SEQ ID NO: 1718615 - RNA, 16 nt, Salmonella enterica enterica serovar Typhi
aauuguuuaaaaacag

SEQ ID NO: 1718616 - RNA, 18 nt, Salmonella enterica enterica serovar Typhi
aauuuaagcuuaaugaua

SEQ ID NO: 1718617 - RNA, 22 nt, Salmonella enterica enterica serovar Typhi
aauuuaagccagacgcgcagca

SEQ ID NO: 1718618 - RNA, 14 nt, Salmonella enterica enterica serovar Typhi
aaaacaagcaguau

SEQ ID NO: 1718619 - RNA, 23 nt, Salmonella enterica enterica serovar Typhi
aauugaaauacucuuugaacagc

SEQ ID NO: 1718620 - RNA, 19 nt, Salmonella enterica enterica serovar Typhi
aauucugaucgauaaaagu

SEQ ID NO: 1718621 - RNA, 13 nt, Salmonella enterica enterica serovar Typhi
aauugguagacgc

SEQ ID NO: 1718622 - RNA, 22 nt, Salmonella enterica enterica serovar Typhi
aauugccacgaacgauauaaaa

SEQ ID NO: 1718623 - RNA, 22 nt, Salmonella enterica enterica serovar Typhi
aauugcugauccuguaaaaaau

SEQ ID NO: 1718624 - RNA, 11 nt, Salmonella enterica enterica serovar Typhi
aauugcugaag

SEQ ID NO: 1718625 - RNA, 12 nt, Salmonella enterica enterica serovar Typhi
aaucaaacucac

SEQ ID NO: 1718626 - RNA, 15 nt, Salmonella enterica enterica serovar Typhi
aaucaacguagaauc

SEQ ID NO: 1718627 - RNA, 22 nt, Salmonella enterica enterica serovar Typhi
aaucaacgccacaccgagacag

SEQ ID NO: 1718628 - RNA, 14 nt, Salmonella enterica enterica serovar Typhi
aaucaaccggguaa

SEQ ID NO: 1718629 - RNA, 20 nt, Salmonella enterica enterica serovar Typhi
aaucaacauuauuaaaaugu

SEQ ID NO: 1718630 - RNA, 16 nt, Salmonella enterica enterica serovar Typhi
aaucacaaagccgucg

SEQ ID NO: 1718631 - RNA, 13 nt, Salmonella enterica enterica serovar Typhi
aaucaagauuaau

SEQ ID NO: 1718632 - RNA, 17 nt, Salmonella enterica enterica serovar Typhi
aaucaagcccagcucag

SEQ ID NO: 1718633 - RNA, 18 nt, Salmonella enterica enterica serovar Typhi
aaucaacuccauaauuug

SEQ ID NO: 1718634 - RNA, 20 nt, Salmonella enterica enterica serovar Typhi
aaucaacugcgccacaucau

SEQ ID NO: 1718635 - RNA, 16 nt, Salmonella enterica enterica serovar Typhi
aaucaccugcaucacg

SEQ ID NO: 1718636 - RNA, 21 nt, Salmonella enterica enterica serovar Typhi
aaucaccguuguggcgaccag

SEQ ID NO: 1718637 - RNA, 15 nt, Salmonella enterica enterica serovar Typhi
aaucaccgccagcaa

SEQ ID NO: 1718638 - RNA, 13 nt, Salmonella enterica enterica serovar Typhi
aaucaccagcgca

SEQ ID NO: 1718639 - RNA, 22 nt, Salmonella enterica enterica serovar Typhi
aaucacccagaugcgaaucuuc

SEQ ID NO: 1718640 - RNA, 17 nt, Salmonella enterica enterica serovar Typhi
aaucacaacguaaucau

SEQ ID NO: 1718641 - RNA, 16 nt, Salmonella enterica enterica serovar Typhi
aaucacauacagcacu

SEQ ID NO: 1718642 - RNA, 20 nt, Salmonella enterica enterica serovar Typhi
aaucacauacagcacuuccc

SEQ ID NO: 1718643 - RNA, 16 nt, Salmonella enterica enterica serovar Typhi
aaucacuuaucaaacc

SEQ ID NO: 1718644 - RNA, 20 nt, Salmonella enterica enterica serovar Typhi
aaucacuuaucaaaccagcu

SEQ ID NO: 1718645 - RNA, 21 nt, Salmonella enterica enterica serovar Typhi
aaucagacuaucuucgauaaa

SEQ ID NO: 1718646 - RNA, 18 nt, Salmonella enterica enterica serovar Typhi
aaucagagacaaauacau

SEQ ID NO: 1718647 - RNA, 15 nt, Salmonella enterica enterica serovar Typhi
aaucagaagaaauau

SEQ ID NO: 1718648 - RNA, 14 nt, Salmonella enterica enterica serovar Typhi
aaucacugacggaa

SEQ ID NO: 1718649 - RNA, 20 nt, Salmonella enterica enterica serovar Typhi
aaucacguuuacuaaaacgg

SEQ ID NO: 1718650 - RNA, 20 nt, Salmonella enterica enterica serovar Typhi
aaucacguuuugcagcgcca

SEQ ID NO: 1718651 - RNA, 15 nt, Salmonella enterica enterica serovar Typhi
aaucacuacggguuu

SEQ ID NO: 1718652 - RNA, 18 nt, Salmonella enterica enterica serovar Typhi
aaucacgcaucacuuuug

SEQ ID NO: 1718653 - RNA, 13 nt, Salmonella enterica enterica serovar Typhi
aauagccagcccc

SEQ ID NO: 1718654 - RNA, 16 nt, Salmonella enterica enterica serovar Typhi
aauagccagccccaga

SEQ ID NO: 1718655 - RNA, 20 nt, Salmonella enterica enterica serovar Typhi
aauagccagaaugccagcgc

SEQ ID NO: 1718656 - RNA, 21 nt, Salmonella enterica enterica serovar Typhi
aauagccagaaugccagcgcc

SEQ ID NO: 1718657 - RNA, 18 nt, Salmonella enterica enterica serovar Typhi
aauaugccaggcuuccug

SEQ ID NO: 1718658 - RNA, 17 nt, Salmonella enterica enterica serovar Typhi
aauaugcuggcuuaacu

SEQ ID NO: 1718659 - RNA, 16 nt, Salmonella enterica enterica serovar Typhi
aauaugccagauauuu

SEQ ID NO: 1718660 - RNA, 14 nt, Salmonella enterica enterica serovar Typhi
aauaugccaggcau

SEQ ID NO: 1718661 - RNA, 13 nt, Salmonella enterica enterica serovar Typhi
aauaugccaggcu

SEQ ID NO: 1718662 - RNA, 15 nt, Salmonella enterica enterica serovar Typhi
aauaugcgcaaucac

SEQ ID NO: 1718663 - RNA, 17 nt, Salmonella enterica enterica serovar Typhi
aauaugauuuaaaaaag

SEQ ID NO: 1718664 - RNA, 16 nt, Salmonella enterica enterica serovar Typhi
aauaugaucugcacaa

SEQ ID NO: 1718665 - RNA, 22 nt, Salmonella enterica enterica serovar Typhi
aauagccccucaauuauguauu

SEQ ID NO: 1718666 - RNA, 20 nt, Salmonella enterica enterica serovar Typhi
aauauggcugcgauaaugaa

SEQ ID NO: 1718667 - RNA, 14 nt, Salmonella enterica enterica serovar Typhi
aauaugcuggcuua

SEQ ID NO: 1718668 - RNA, 21 nt, Salmonella enterica enterica serovar Typhi
aauaugcucaacuuccagagc

SEQ ID NO: 1718669 - RNA, 13 nt, Salmonella enterica enterica serovar Typhi
aauauggaauauc

SEQ ID NO: 1718670 - RNA, 21 nt, Salmonella enterica enterica serovar Typhi
aauaugggauuugaugcccaa

SEQ ID NO: 1718671 - RNA, 22 nt, Salmonella enterica enterica serovar Typhi
aauauggugaguaauaacaaaa

SEQ ID NO: 1718672 - RNA, 15 nt, Salmonella enterica enterica serovar Typhi
aauaugguuauccag

SEQ ID NO: 1718673 - RNA, 18 nt, Salmonella enterica enterica serovar Typhi
aauauucagaauaugcca

SEQ ID NO: 1718674 - RNA, 19 nt, Salmonella enterica enterica serovar Typhi
aauauucagaauaugccag

SEQ ID NO: 1718675 - RNA, 14 nt, Salmonella enterica enterica serovar Typhi
aauauucagcacau

SEQ ID NO: 1718676 - RNA, 10 nt, Salmonella enterica enterica serovar Typhi
aauauucauu

SEQ ID NO: 1718677 - RNA, 16 nt, Salmonella enterica enterica serovar Typhi
aauauugaacauuuuu

SEQ ID NO: 1718678 - RNA, 19 nt, Salmonella enterica enterica serovar Typhi
aauauuuauuuaauguuuc

SEQ ID NO: 1718679 - RNA, 21 nt, Salmonella enterica enterica serovar Typhi
aauauuugaaucucagacgcc

SEQ ID NO: 1718680 - RNA, 21 nt, Salmonella enterica enterica serovar Typhi
aauauuuuuccgcggagagau

SEQ ID NO: 1718681 - RNA, 14 nt, Salmonella enterica enterica serovar Typhi
aaucuguuccagcg

SEQ ID NO: 1718682 - RNA, 22 nt, Salmonella enterica enterica serovar Typhi
aaucuguuccagcgagcaggaa

SEQ ID NO: 1718683 - RNA, 15 nt, Salmonella enterica enterica serovar Typhi
aaucugccaucagca

SEQ ID NO: 1718684 - RNA, 19 nt, Salmonella enterica enterica serovar Typhi
aaucugccaucagcaccuu

SEQ ID NO: 1718685 - RNA, 18 nt, Salmonella enterica enterica serovar Typhi
aaucugccgucaucgacu

SEQ ID NO: 1718686 - RNA, 21 nt, Salmonella enterica enterica serovar Typhi
aaucuggugauaaagcagacc

SEQ ID NO: 1718687 - RNA, 19 nt, Salmonella enterica enterica serovar Typhi
aaucuggucggugauauau

SEQ ID NO: 1718688 - RNA, 20 nt, Salmonella enterica enterica serovar Typhi
aaucgucguuccgccaggcg

SEQ ID NO: 1718689 - RNA, 18 nt, Salmonella enterica enterica serovar Typhi
aaucgugaccaccgccau

SEQ ID NO: 1718690 - RNA, 18 nt, Salmonella enterica enterica serovar Typhi
aaucgucgaggaagcugc

SEQ ID NO: 1718691 - RNA, 14 nt, Salmonella enterica enterica serovar Typhi
aaucgucacagacc

SEQ ID NO: 1718692 - RNA, 20 nt, Salmonella enterica enterica serovar Typhi
aaucgcgauaucaacccagu

SEQ ID NO: 1718693 - RNA, 18 nt, Salmonella enterica enterica serovar Typhi
aaucgcgauccagcccca

SEQ ID NO: 1718694 - RNA, 13 nt, Salmonella enterica enterica serovar Typhi
aaaaauucuuuua

SEQ ID NO: 1718695 - RNA, 14 nt, Salmonella enterica enterica serovar Typhi
aaucgauuuucucc

SEQ ID NO: 1718696 - RNA, 17 nt, Salmonella enterica enterica serovar Typhi
aaucuaccagaucgcgg

SEQ ID NO: 1718697 - RNA, 16 nt, Salmonella enterica enterica serovar Typhi
aaucuaagagccuguc

SEQ ID NO: 1718698 - RNA, 22 nt, Salmonella enterica enterica serovar Typhi
aaucgucauugaccggaaaaaa

SEQ ID NO: 1718699 - RNA, 17 nt, Salmonella enterica enterica serovar Typhi
aaucucacugcccauuc

SEQ ID NO: 1718700 - RNA, 22 nt, Salmonella enterica enterica serovar Typhi
aaucucagauaauagcugcggc

SEQ ID NO: 1718701 - RNA, 23 nt, Salmonella enterica enterica serovar Typhi
aaucuaccauugauaccaauaaa

SEQ ID NO: 1718702 - RNA, 17 nt, Salmonella enterica enterica serovar Typhi
aauccguuaagcccuga

SEQ ID NO: 1718703 - RNA, 17 nt, Salmonella enterica enterica serovar Typhi
aauccgcuccacauccu

SEQ ID NO: 1718704 - RNA, 19 nt, Salmonella enterica enterica serovar Typhi
aauccgcuaacgaugucau

SEQ ID NO: 1718705 - RNA, 18 nt, Salmonella enterica enterica serovar Typhi
aauccgccggaaacuggc

SEQ ID NO: 1718706 - RNA, 23 nt, Salmonella enterica enterica serovar Typhi
aauccuucuaccuucacccccau

SEQ ID NO: 1718707 - RNA, 12 nt, Salmonella enterica enterica serovar Typhi
aauccuucuucc

SEQ ID NO: 1718708 - RNA, 15 nt, Salmonella enterica enterica serovar Typhi
aauccuuauuuaaua

SEQ ID NO: 1718709 - RNA, 23 nt, Salmonella enterica enterica serovar Typhi
aauccucauuaguucaaguuuag

SEQ ID NO: 1718710 - RNA, 15 nt, Salmonella enterica enterica serovar Typhi
aauccucacugccga

SEQ ID NO: 1718711 - RNA, 19 nt, Salmonella enterica enterica serovar Typhi
aaucgauauaauuuuauua

SEQ ID NO: 1718712 - RNA, 19 nt, Salmonella enterica enterica serovar Typhi
aaucgauguaguuguucuu

SEQ ID NO: 1718713 - RNA, 19 nt, Salmonella enterica enterica serovar Typhi
aaucgauagcgauuuuuga

SEQ ID NO: 1718714 - RNA, 14 nt, Salmonella enterica enterica serovar Typhi
aaucgauaagccag

SEQ ID NO: 1718715 - RNA, 13 nt, Salmonella enterica enterica serovar Typhi
aaucgagcccaga

SEQ ID NO: 1718716 - RNA, 21 nt, Salmonella enterica enterica serovar Typhi
aaucagauugccacaggacca

SEQ ID NO: 1718717 - RNA, 22 nt, Salmonella enterica enterica serovar Typhi
aaucagauacggcuccagcaca

SEQ ID NO: 1718718 - RNA, 19 nt, Salmonella enterica enterica serovar Typhi
aaucauuuguacaaaaaau

SEQ ID NO: 1718719 - RNA, 18 nt, Salmonella enterica enterica serovar Typhi
aaucauuuagucgauggu

SEQ ID NO: 1718720 - RNA, 18 nt, Salmonella enterica enterica serovar Typhi
aaucauugugguuucccu

SEQ ID NO: 1718721 - RNA, 19 nt, Salmonella enterica enterica serovar Typhi
aauccacuccguguugcug

SEQ ID NO: 1718722 - RNA, 21 nt, Salmonella enterica enterica serovar Typhi
aauccagaauguuccugcaau

SEQ ID NO: 1718723 - RNA, 22 nt, Salmonella enterica enterica serovar Typhi
aauccagaauguuccugcaaua

SEQ ID NO: 1718724 - RNA, 17 nt, Salmonella enterica enterica serovar Typhi
aaucccaccaauugcca

SEQ ID NO: 1718725 - RNA, 18 nt, Salmonella enterica enterica serovar Typhi
aauccaugagaagaaaaa

SEQ ID NO: 1718726 - RNA, 17 nt, Salmonella enterica enterica serovar Typhi
aauccaugagaagaaaa

SEQ ID NO: 1718727 - RNA, 15 nt, Salmonella enterica enterica serovar Typhi
aauccagcagaauaa

SEQ ID NO: 1718728 - RNA, 14 nt, Salmonella enterica enterica serovar Typhi
aauccagcaggcug

SEQ ID NO: 1718729 - RNA, 19 nt, Salmonella enterica enterica serovar Typhi
acaaucgccgugaucccaa

SEQ ID NO: 1718730 - RNA, 21 nt, Salmonella enterica enterica serovar Typhi
acaaucgcguuuuccagcauc

SEQ ID NO: 1718731 - RNA, 16 nt, Salmonella enterica enterica serovar Typhi
acaauccccgaaagcc

SEQ ID NO: 1718732 - RNA, 16 nt, Salmonella enterica enterica serovar Typhi
acaauccgacgcucaa

SEQ ID NO: 1718733 - RNA, 16 nt, Salmonella enterica enterica serovar Typhi
acaauccgccacgcuc

SEQ ID NO: 1718734 - RNA, 18 nt, Salmonella enterica enterica serovar Typhi
acaauccguuauuucaca

SEQ ID NO: 1718735 - RNA, 15 nt, Salmonella enterica enterica serovar Typhi
acaaucagaagaaau

SEQ ID NO: 1718736 - RNA, 15 nt, Salmonella enterica enterica serovar Typhi
acaaucagcacacua

SEQ ID NO: 1718737 - RNA, 17 nt, Salmonella enterica enterica serovar Typhi
acaaucagcacacuaca

SEQ ID NO: 1718738 - RNA, 14 nt, Salmonella enterica enterica serovar Typhi
acaaucagcaccau

SEQ ID NO: 1718739 - RNA, 11 nt, Salmonella enterica enterica serovar Typhi
acaaucaccug

SEQ ID NO: 1718740 - RNA, 15 nt, Salmonella enterica enterica serovar Typhi
acaaucacagcgcag

SEQ ID NO: 1718741 - RNA, 16 nt, Salmonella enterica enterica serovar Typhi
acaaucacagcgcaga

SEQ ID NO: 1718742 - RNA, 18 nt, Salmonella enterica enterica serovar Typhi
acaaugaucagacgcaca

SEQ ID NO: 1718743 - RNA, 15 nt, Salmonella enterica enterica serovar Typhi
acaaugaauccucgg

SEQ ID NO: 1718744 - RNA, 22 nt, Salmonella enterica enterica serovar Typhi
acaaugccauuauugcaucaau

SEQ ID NO: 1718745 - RNA, 13 nt, Salmonella enterica enterica serovar Typhi
acaaugcccggca

SEQ ID NO: 1718746 - RNA, 14 nt, Salmonella enterica enterica serovar Typhi
acaauucauagcca

SEQ ID NO: 1718747 - RNA, 15 nt, Salmonella enterica enterica serovar Typhi
acaauugccagcagg

SEQ ID NO: 1718748 - RNA, 14 nt, Salmonella enterica enterica serovar Typhi
acaaguaauaaaau

SEQ ID NO: 1718749 - RNA, 17 nt, Salmonella enterica enterica serovar Typhi
acaaguaauaaaauaau

SEQ ID NO: 1718750 - RNA, 15 nt, Salmonella enterica enterica serovar Typhi
acaagugucgugaau

SEQ ID NO: 1718751 - RNA, 19 nt, Salmonella enterica enterica serovar Typhi
acaauaauucgugugauuu

SEQ ID NO: 1718752 - RNA, 12 nt, Salmonella enterica enterica serovar Typhi
acaauaccaaua

SEQ ID NO: 1718753 - RNA, 13 nt, Salmonella enterica enterica serovar Typhi
acaauaccaauaa

SEQ ID NO: 1718754 - RNA, 14 nt, Salmonella enterica enterica serovar Typhi
acaauacgccgagc

SEQ ID NO: 1718755 - RNA, 14 nt, Salmonella enterica enterica serovar Typhi
acaaggaaugacac

SEQ ID NO: 1718756 - RNA, 16 nt, Salmonella enterica enterica serovar Typhi
acaaggcuuuuggcuu

SEQ ID NO: 1718757 - RNA, 18 nt, Salmonella enterica enterica serovar Typhi
acaagguugaucaggaag

SEQ ID NO: 1718758 - RNA, 21 nt, Salmonella enterica enterica serovar Typhi
acaacgccgguacgcagcagg

SEQ ID NO: 1718759 - RNA, 15 nt, Salmonella enterica enterica serovar Typhi
acaagcgaucgccag

SEQ ID NO: 1718760 - RNA, 15 nt, Salmonella enterica enterica serovar Typhi
acaagcuaaucccca

SEQ ID NO: 1718761 - RNA, 13 nt, Salmonella enterica enterica serovar Typhi
acaagcucauuuc

SEQ ID NO: 1718762 - RNA, 19 nt, Salmonella enterica enterica serovar Typhi
acaacgagauucaauaaug

SEQ ID NO: 1718763 - RNA, 14 nt, Salmonella enterica enterica serovar Typhi
acaccgcuugccgg

SEQ ID NO: 1718764 - RNA, 19 nt, Salmonella enterica enterica serovar Typhi
acaccggaauucuguucag

SEQ ID NO: 1718765 - RNA, 22 nt, Salmonella enterica enterica serovar Typhi
acaccggcggcgccaucgccuc

SEQ ID NO: 1718766 - RNA, 13 nt, Salmonella enterica enterica serovar Typhi
acaccggccugcc

SEQ ID NO: 1718767 - RNA, 20 nt, Salmonella enterica enterica serovar Typhi
acaccgguugcgcaaccucc

SEQ ID NO: 1718768 - RNA, 21 nt, Salmonella enterica enterica serovar Typhi
acaccugggcuugcuuuucuc

SEQ ID NO: 1718769 - RNA, 19 nt, Salmonella enterica enterica serovar Typhi
acacgcuuuucagcgccag

SEQ ID NO: 1718770 - RNA, 17 nt, Salmonella enterica enterica serovar Typhi
acacgcuggaagagaac

SEQ ID NO: 1718771 - RNA, 16 nt, Salmonella enterica enterica serovar Typhi
acacgcuuagcuugcc

SEQ ID NO: 1718772 - RNA, 17 nt, Salmonella enterica enterica serovar Typhi
acacgcgcgcugcgccu

SEQ ID NO: 1718773 - RNA, 14 nt, Salmonella enterica enterica serovar Typhi
acacggcgcucagg

SEQ ID NO: 1718774 - RNA, 17 nt, Salmonella enterica enterica serovar Typhi
acacggcgcucaggauc

SEQ ID NO: 1718775 - RNA, 12 nt, Salmonella enterica enterica serovar Typhi
acacggcggcua

SEQ ID NO: 1718776 - RNA, 14 nt, Salmonella enterica enterica serovar Typhi
acacgaacacagaa

SEQ ID NO: 1718777 - RNA, 13 nt, Salmonella enterica enterica serovar Typhi
acacgauggcaaa

SEQ ID NO: 1718778 - RNA, 12 nt, Salmonella enterica enterica serovar Typhi
acacgauaguga

SEQ ID NO: 1718779 - RNA, 16 nt, Salmonella enterica enterica serovar Typhi
acacgauaaaccucac

SEQ ID NO: 1718780 - RNA, 16 nt, Salmonella enterica enterica serovar Typhi
acacgcagacccaggc

SEQ ID NO: 1718781 - RNA, 22 nt, Salmonella enterica enterica serovar Typhi
acacaaaagcaucguaccuuca

SEQ ID NO: 1718782 - RNA, 21 nt, Salmonella enterica enterica serovar Typhi
acaauuuugauaagagaaaau

SEQ ID NO: 1718783 - RNA, 18 nt, Salmonella enterica enterica serovar Typhi
acaauuuugauaagagaa

SEQ ID NO: 1718784 - RNA, 20 nt, Salmonella enterica enterica serovar Typhi
acaauuuugauaagagaaaa

SEQ ID NO: 1718785 - RNA, 13 nt, Salmonella enterica enterica serovar Typhi
acaccaacaaagu

SEQ ID NO: 1718786 - RNA, 14 nt, Salmonella enterica enterica serovar Typhi
acaccaacaaagug

SEQ ID NO: 1718787 - RNA, 16 nt, Salmonella enterica enterica serovar Typhi
acacauuucuuuugau

SEQ ID NO: 1718788 - RNA, 14 nt, Salmonella enterica enterica serovar Typhi
acacccgcacgccu

SEQ ID NO: 1718789 - RNA, 15 nt, Salmonella enterica enterica serovar Typhi
acacccauagcagcu

SEQ ID NO: 1718790 - RNA, 12 nt, Salmonella enterica enterica serovar Typhi
acaccacgcagg

SEQ ID NO: 1718791 - RNA, 17 nt, Salmonella enterica enterica serovar Typhi
acaccaacgcuggcccg

SEQ ID NO: 1718792 - RNA, 21 nt, Salmonella enterica enterica serovar Typhi
acaaaaccgcuaaugaggaaa

SEQ ID NO: 1718793 - RNA, 16 nt, Salmonella enterica enterica serovar Typhi
acaaaaaguaguucca

SEQ ID NO: 1718794 - RNA, 15 nt, Salmonella enterica enterica serovar Typhi
aauuuauaacguauc

SEQ ID NO: 1718795 - RNA, 14 nt, Salmonella enterica enterica serovar Typhi
acaaaagaaagcaa

SEQ ID NO: 1718796 - RNA, 18 nt, Salmonella enterica enterica serovar Typhi
acaaaagaaagcaauagc

SEQ ID NO: 1718797 - RNA, 23 nt, Salmonella enterica enterica serovar Typhi
acaaaagcgguuaagauacauau

SEQ ID NO: 1718798 - RNA, 16 nt, Salmonella enterica enterica serovar Typhi
acaaaauaaagugaaa

SEQ ID NO: 1718799 - RNA, 19 nt, Salmonella enterica enterica serovar Typhi
acaaaauaaagugaaauaa

SEQ ID NO: 1718800 - RNA, 13 nt, Salmonella enterica enterica serovar Typhi
acaaaauggcuga

SEQ ID NO: 1718801 - RNA, 17 nt, Salmonella enterica enterica serovar Typhi
acaaaauggcugauaaa

SEQ ID NO: 1718802 - RNA, 14 nt, Salmonella enterica enterica serovar Typhi
acaaaaucauugcg

SEQ ID NO: 1718803 - RNA, 14 nt, Salmonella enterica enterica serovar Typhi
acaaacgcuuuuuu

SEQ ID NO: 1718804 - RNA, 16 nt, Salmonella enterica enterica serovar Typhi
acaaaccccacccacu

SEQ ID NO: 1718805 - RNA, 18 nt, Salmonella enterica enterica serovar Typhi
acaaaccccacccacuga

SEQ ID NO: 1718806 - RNA, 16 nt, Salmonella enterica enterica serovar Typhi
acaaaauuuugcauaa

SEQ ID NO: 1718807 - RNA, 16 nt, Salmonella enterica enterica serovar Typhi
acaaacagugaaaaaa

SEQ ID NO: 1718808 - RNA, 11 nt, Salmonella enterica enterica serovar Typhi
acaaagagcuc

SEQ ID NO: 1718809 - RNA, 16 nt, Salmonella enterica enterica serovar Typhi
acaaagagcuccccac

SEQ ID NO: 1718810 - RNA, 19 nt, Salmonella enterica enterica serovar Typhi
acaaagcgguaaaucgcaa

SEQ ID NO: 1718811 - RNA, 15 nt, Salmonella enterica enterica serovar Typhi
acaaaggccagcagc

SEQ ID NO: 1718812 - RNA, 16 nt, Salmonella enterica enterica serovar Typhi
acaaaggccagcagca

SEQ ID NO: 1718813 - RNA, 19 nt, Salmonella enterica enterica serovar Typhi
acaaaggccagcagcagcu

SEQ ID NO: 1718814 - RNA, 21 nt, Salmonella enterica enterica serovar Typhi
acaaaggcagccaacaaagag

SEQ ID NO: 1718815 - RNA, 22 nt, Salmonella enterica enterica serovar Typhi
acaaaucgggcgggcauuauac

SEQ ID NO: 1718816 - RNA, 19 nt, Salmonella enterica enterica serovar Typhi
acaaauuccggcacaaccu

SEQ ID NO: 1718817 - RNA, 19 nt, Salmonella enterica enterica serovar Typhi
acaaauagcacacaaacga

SEQ ID NO: 1718818 - RNA, 15 nt, Salmonella enterica enterica serovar Typhi
acaaauaacuuuccu

SEQ ID NO: 1718819 - RNA, 13 nt, Salmonella enterica enterica serovar Typhi
acaaauacauggu

SEQ ID NO: 1718820 - RNA, 14 nt, Salmonella enterica enterica serovar Typhi
acaaauaaauccau

SEQ ID NO: 1718821 - RNA, 23 nt, Salmonella enterica enterica serovar Typhi
acaaagguugcgccaaagcaauc

SEQ ID NO: 1718822 - RNA, 23 nt, Salmonella enterica enterica serovar Typhi
acaacacacguaacaaccagaau

SEQ ID NO: 1718823 - RNA, 15 nt, Salmonella enterica enterica serovar Typhi
acaacauaaaggggu

SEQ ID NO: 1718824 - RNA, 15 nt, Salmonella enterica enterica serovar Typhi
acaacacgcuuuuca

SEQ ID NO: 1718825 - RNA, 12 nt, Salmonella enterica enterica serovar Typhi
acaaauuuaaac

SEQ ID NO: 1718826 - RNA, 21 nt, Salmonella enterica enterica serovar Typhi
acaacaaaguauaaagcuggu

SEQ ID NO: 1718827 - RNA, 17 nt, Salmonella enterica enterica serovar Typhi
acaaauuuugauaaaaa

SEQ ID NO: 1718828 - RNA, 16 nt, Salmonella enterica enterica serovar Typhi
acaaauugcagcgcgc

SEQ ID NO: 1718829 - RNA, 20 nt, Salmonella enterica enterica serovar Typhi
acaaauuguuuaaaaacagg

SEQ ID NO: 1718830 - RNA, 17 nt, Salmonella enterica enterica serovar Typhi
acaacauguuucuugug

SEQ ID NO: 1718831 - RNA, 17 nt, Salmonella enterica enterica serovar Typhi
acaacauugaggcuacc

SEQ ID NO: 1718832 - RNA, 18 nt, Salmonella enterica enterica serovar Typhi
acaacauuguuauguuuu

SEQ ID NO: 1718833 - RNA, 17 nt, Salmonella enterica enterica serovar Typhi
acaacaucccagaaaau

SEQ ID NO: 1718834 - RNA, 23 nt, Salmonella enterica enterica serovar Typhi
acaacauaucgccggggaaaaua

SEQ ID NO: 1718835 - RNA, 20 nt, Salmonella enterica enterica serovar Typhi
acaaccagcgaaaugacggc

SEQ ID NO: 1718836 - RNA, 18 nt, Salmonella enterica enterica serovar Typhi
acaaccaucacugaaccc

SEQ ID NO: 1718837 - RNA, 20 nt, Salmonella enterica enterica serovar Typhi
acaaccgcccccaacugagc

SEQ ID NO: 1718838 - RNA, 15 nt, Salmonella enterica enterica serovar Typhi
acaaccuccacgccc

SEQ ID NO: 1718839 - RNA, 19 nt, Salmonella enterica enterica serovar Typhi
acaaccuccacgcccagcg

SEQ ID NO: 1718840 - RNA, 12 nt, Salmonella enterica enterica serovar Typhi
accaaagccagg

SEQ ID NO: 1718841 - RNA, 15 nt, Salmonella enterica enterica serovar Typhi
accaaaucaauagaa

SEQ ID NO: 1718842 - RNA, 13 nt, Salmonella enterica enterica serovar Typhi
accaaaacaguac

SEQ ID NO: 1718843 - RNA, 17 nt, Salmonella enterica enterica serovar Typhi
accaaaaacgcccccag

SEQ ID NO: 1718844 - RNA, 21 nt, Salmonella enterica enterica serovar Typhi
accaaaauggcaaguaaaaua

SEQ ID NO: 1718845 - RNA, 15 nt, Salmonella enterica enterica serovar Typhi
accaaacgaauuuaa

SEQ ID NO: 1718846 - RNA, 22 nt, Salmonella enterica enterica serovar Typhi
accaaacccuuuggcaaaaaag

SEQ ID NO: 1718847 - RNA, 14 nt, Salmonella enterica enterica serovar Typhi
acauugaguaaaua

SEQ ID NO: 1718848 - RNA, 11 nt, Salmonella enterica enterica serovar Typhi
acauuacccau

SEQ ID NO: 1718849 - RNA, 13 nt, Salmonella enterica enterica serovar Typhi
acauuacauccuc

SEQ ID NO: 1718850 - RNA, 18 nt, Salmonella enterica enterica serovar Typhi
acauuaaucgccauugca

SEQ ID NO: 1718851 - RNA, 15 nt, Salmonella enterica enterica serovar Typhi
acauuaaucuuaucc

SEQ ID NO: 1718852 - RNA, 13 nt, Salmonella enterica enterica serovar Typhi
acauuuucccaac

SEQ ID NO: 1718853 - RNA, 16 nt, Salmonella enterica enterica serovar Typhi
acauuuaagauuuaaa

SEQ ID NO: 1718854 - RNA, 20 nt, Salmonella enterica enterica serovar Typhi
acauuuaagauuuaaaacaa

SEQ ID NO: 1718855 - RNA, 21 nt, Salmonella enterica enterica serovar Typhi
acauuuaagauuuaaaacaag

SEQ ID NO: 1718856 - RNA, 12 nt, Salmonella enterica enterica serovar Typhi
acauuucuuuug

SEQ ID NO: 1718857 - RNA, 16 nt, Salmonella enterica enterica serovar Typhi
acaucuguuugagaaa

SEQ ID NO: 1718858 - RNA, 15 nt, Salmonella enterica enterica serovar Typhi
acaugaauaauaaua

SEQ ID NO: 1718859 - RNA, 17 nt, Salmonella enterica enterica serovar Typhi
acaugaauaauaauaca

SEQ ID NO: 1718860 - RNA, 22 nt, Salmonella enterica enterica serovar Typhi
acaucugccgcuuugaggauca

SEQ ID NO: 1718861 - RNA, 22 nt, Salmonella enterica enterica serovar Typhi
acaucucuucguguaacgcaua

SEQ ID NO: 1718862 - RNA, 23 nt, Salmonella enterica enterica serovar Typhi
acaucucaucggcuuuuuuguau

SEQ ID NO: 1718863 - RNA, 15 nt, Salmonella enterica enterica serovar Typhi
acaucguaaaucaaa

SEQ ID NO: 1718864 - RNA, 20 nt, Salmonella enterica enterica serovar Typhi
acaugccggugcgagaaaaa

SEQ ID NO: 1718865 - RNA, 14 nt, Salmonella enterica enterica serovar Typhi
acaugaccgcacag

SEQ ID NO: 1718866 - RNA, 19 nt, Salmonella enterica enterica serovar Typhi
acaugaccgcacagcagac

SEQ ID NO: 1718867 - RNA, 18 nt, Salmonella enterica enterica serovar Typhi
acaugaccugaauauggc

SEQ ID NO: 1718868 - RNA, 22 nt, Salmonella enterica enterica serovar Typhi
acaugacguauucaccucccug

SEQ ID NO: 1718869 - RNA, 16 nt, Salmonella enterica enterica serovar Typhi
acaugccguuaauaau

SEQ ID NO: 1718870 - RNA, 17 nt, Salmonella enterica enterica serovar Typhi
acaugcgcagaaaggcg

SEQ ID NO: 1718871 - RNA, 12 nt, Salmonella enterica enterica serovar Typhi
acauguccagau

SEQ ID NO: 1718872 - RNA, 20 nt, Salmonella enterica enterica serovar Typhi
acauguccuacacucaauac

SEQ ID NO: 1718873 - RNA, 21 nt, Salmonella enterica enterica serovar Typhi
acauaacgcgauagauaccau

SEQ ID NO: 1718874 - RNA, 19 nt, Salmonella enterica enterica serovar Typhi
acauaauauuccagcgugc

SEQ ID NO: 1718875 - RNA, 16 nt, Salmonella enterica enterica serovar Typhi
acauaacugagacuca

SEQ ID NO: 1718876 - RNA, 20 nt, Salmonella enterica enterica serovar Typhi
acauaauguaaaggugagcu

SEQ ID NO: 1718877 - RNA, 16 nt, Salmonella enterica enterica serovar Typhi
acaucaagcccacaca

SEQ ID NO: 1718878 - RNA, 16 nt, Salmonella enterica enterica serovar Typhi
acaucaauagcgcuac

SEQ ID NO: 1718879 - RNA, 18 nt, Salmonella enterica enterica serovar Typhi
acaucggauuauuuucac

SEQ ID NO: 1718880 - RNA, 20 nt, Salmonella enterica enterica serovar Typhi
acaucggagauuucauccuc

SEQ ID NO: 1718881 - RNA, 14 nt, Salmonella enterica enterica serovar Typhi
acaucgcuccggca

SEQ ID NO: 1718882 - RNA, 16 nt, Salmonella enterica enterica serovar Typhi
acaucgcgucgaggaa

SEQ ID NO: 1718883 - RNA, 19 nt, Salmonella enterica enterica serovar Typhi
acaucgccugguaaggcaa

SEQ ID NO: 1718884 - RNA, 18 nt, Salmonella enterica enterica serovar Typhi
acauccugugaaguaaaa

SEQ ID NO: 1718885 - RNA, 15 nt, Salmonella enterica enterica serovar Typhi
acauccucuccugaa

SEQ ID NO: 1718886 - RNA, 15 nt, Salmonella enterica enterica serovar Typhi
acauccggcggcguc

SEQ ID NO: 1718887 - RNA, 23 nt, Salmonella enterica enterica serovar Typhi
acauccgcuuuugguuuuucaac

SEQ ID NO: 1718888 - RNA, 20 nt, Salmonella enterica enterica serovar Typhi
acagguugcguaacgccaca

SEQ ID NO: 1718889 - RNA, 15 nt, Salmonella enterica enterica serovar Typhi
acagguggaaagugc

SEQ ID NO: 1718890 - RNA, 22 nt, Salmonella enterica enterica serovar Typhi
acaggucggcaugcaucucuuc

SEQ ID NO: 1718891 - RNA, 14 nt, Salmonella enterica enterica serovar Typhi
acaggugaccaggc

SEQ ID NO: 1718892 - RNA, 19 nt, Salmonella enterica enterica serovar Typhi
acaggucgaugauuuucaa

SEQ ID NO: 1718893 - RNA, 23 nt, Salmonella enterica enterica serovar Typhi
acaggguuugccagcaccagcag

SEQ ID NO: 1718894 - RNA, 13 nt, Salmonella enterica enterica serovar Typhi
acagguaaaacaa

SEQ ID NO: 1718895 - RNA, 14 nt, Salmonella enterica enterica serovar Typhi
acagggguaagaau

SEQ ID NO: 1718896 - RNA, 23 nt, Salmonella enterica enterica serovar Typhi
acagggcguuuuauaagccgauc

SEQ ID NO: 1718897 - RNA, 18 nt, Salmonella enterica enterica serovar Typhi
acaggggccacaggcggc

SEQ ID NO: 1718898 - RNA, 22 nt, Salmonella enterica enterica serovar Typhi
acaggcuuuucaggcuguggcu

SEQ ID NO: 1718899 - RNA, 17 nt, Salmonella enterica enterica serovar Typhi
acagggcgaugccucac

SEQ ID NO: 1718900 - RNA, 22 nt, Salmonella enterica enterica serovar Typhi
acagguugcguaacgccacaua

SEQ ID NO: 1718901 - RNA, 14 nt, Salmonella enterica enterica serovar Typhi
acaguagcaggggc

SEQ ID NO: 1718902 - RNA, 15 nt, Salmonella enterica enterica serovar Typhi
acaguacgccgaggg

SEQ ID NO: 1718903 - RNA, 18 nt, Salmonella enterica enterica serovar Typhi
acaguacggucaggcuca

SEQ ID NO: 1718904 - RNA, 14 nt, Salmonella enterica enterica serovar Typhi
acagucgcagagcc

SEQ ID NO: 1718905 - RNA, 15 nt, Salmonella enterica enterica serovar Typhi
acauaaauaaacagc

SEQ ID NO: 1718906 - RNA, 12 nt, Salmonella enterica enterica serovar Typhi
acaguuugucaa

SEQ ID NO: 1718907 - RNA, 21 nt, Salmonella enterica enterica serovar Typhi
acaguuuugucaucagaucau

SEQ ID NO: 1718908 - RNA, 17 nt, Salmonella enterica enterica serovar Typhi
acauaaaaugguuauug

SEQ ID NO: 1718909 - RNA, 22 nt, Salmonella enterica enterica serovar Typhi
acauaaaauaguugguggguga

SEQ ID NO: 1718910 - RNA, 20 nt, Salmonella enterica enterica serovar Typhi
acauaaaaugguuauugcuu

SEQ ID NO: 1718911 - RNA, 21 nt, Salmonella enterica enterica serovar Typhi
acaguuuuuccuuucugcgcc

SEQ ID NO: 1718912 - RNA, 20 nt, Salmonella enterica enterica serovar Typhi
acaguuuuuucguuccagag

SEQ ID NO: 1718913 - RNA, 16 nt, Salmonella enterica enterica serovar Typhi
acagugggcuaugaag

SEQ ID NO: 1718914 - RNA, 19 nt, Salmonella enterica enterica serovar Typhi
acaguuaccacacaugcaa

SEQ ID NO: 1718915 - RNA, 17 nt, Salmonella enterica enterica serovar Typhi
acagugacccgccgcca

SEQ ID NO: 1718916 - RNA, 20 nt, Salmonella enterica enterica serovar Typhi
acagugauuuacuccaaaaa

SEQ ID NO: 1718917 - RNA, 18 nt, Salmonella enterica enterica serovar Typhi
acagugcuauacaguaaa

SEQ ID NO: 1718918 - RNA, 15 nt, Salmonella enterica enterica serovar Typhi
acagcgccagaauag

SEQ ID NO: 1718919 - RNA, 13 nt, Salmonella enterica enterica serovar Typhi
acagcgccagaca

SEQ ID NO: 1718920 - RNA, 15 nt, Salmonella enterica enterica serovar Typhi
acagcgccaucagga

SEQ ID NO: 1718921 - RNA, 15 nt, Salmonella enterica enterica serovar Typhi
acagcgcaauaugca

SEQ ID NO: 1718922 - RNA, 13 nt, Salmonella enterica enterica serovar Typhi
acagcgacgccag

SEQ ID NO: 1718923 - RNA, 20 nt, Salmonella enterica enterica serovar Typhi
acagcuugcgcccaugcuca

SEQ ID NO: 1718924 - RNA, 13 nt, Salmonella enterica enterica serovar Typhi
acagcucaccccu

SEQ ID NO: 1718925 - RNA, 13 nt, Salmonella enterica enterica serovar Typhi
acaggcugacaaa

SEQ ID NO: 1718926 - RNA, 22 nt, Salmonella enterica enterica serovar Typhi
acaggcgcaucagaaaaaccuc

SEQ ID NO: 1718927 - RNA, 18 nt, Salmonella enterica enterica serovar Typhi
acaggcgcggagacguga

SEQ ID NO: 1718928 - RNA, 19 nt, Salmonella enterica enterica serovar Typhi
acaggaacaucguguccug

SEQ ID NO: 1718929 - RNA, 17 nt, Salmonella enterica enterica serovar Typhi
acaggaagcagcuugcu

SEQ ID NO: 1718930 - RNA, 14 nt, Salmonella enterica enterica serovar Typhi
acagccgcauuuuu

SEQ ID NO: 1718931 - RNA, 16 nt, Salmonella enterica enterica serovar Typhi
acagccgcauuuuuuc

SEQ ID NO: 1718932 - RNA, 15 nt, Salmonella enterica enterica serovar Typhi
acagccaucuucugc

SEQ ID NO: 1718933 - RNA, 12 nt, Salmonella enterica enterica serovar Typhi
acagccagcauu

SEQ ID NO: 1718934 - RNA, 17 nt, Salmonella enterica enterica serovar Typhi
acagcaggcuuugcugc

SEQ ID NO: 1718935 - RNA, 21 nt, Salmonella enterica enterica serovar Typhi
acagcaggcuuugcugcugcg

SEQ ID NO: 1718936 - RNA, 22 nt, Salmonella enterica enterica serovar Typhi
acagccaaacugcuguagcugu

SEQ ID NO: 1718937 - RNA, 18 nt, Salmonella enterica enterica serovar Typhi
acacguauaaacgccgcc

SEQ ID NO: 1718938 - RNA, 21 nt, Salmonella enterica enterica serovar Typhi
acacguaacugacaauuucca

SEQ ID NO: 1718939 - RNA, 19 nt, Salmonella enterica enterica serovar Typhi
acacgguuauaaccggaca

SEQ ID NO: 1718940 - RNA, 18 nt, Salmonella enterica enterica serovar Typhi
acagcaaugcccaaaaua

SEQ ID NO: 1718941 - RNA, 15 nt, Salmonella enterica enterica serovar Typhi
acagcaaugagcagg

SEQ ID NO: 1718942 - RNA, 18 nt, Salmonella enterica enterica serovar Typhi
agacgacgguuaaaaagu

SEQ ID NO: 1718943 - RNA, 18 nt, Salmonella enterica enterica serovar Typhi
agaccucugcuuugguuu

SEQ ID NO: 1718944 - RNA, 20 nt, Salmonella enterica enterica serovar Typhi
aaaacaucgcugauauuguu

SEQ ID NO: 1718945 - RNA, 19 nt, Salmonella enterica enterica serovar Typhi
agacgcuggcacuggcagc

SEQ ID NO: 1718946 - RNA, 13 nt, Salmonella enterica enterica serovar Typhi
agacgcugguugu

SEQ ID NO: 1718947 - RNA, 19 nt, Salmonella enterica enterica serovar Typhi
agacgcuccgcaguaauca

SEQ ID NO: 1718948 - RNA, 18 nt, Salmonella enterica enterica serovar Typhi
agacgcucgacguccagc

SEQ ID NO: 1718949 - RNA, 16 nt, Salmonella enterica enterica serovar Typhi
agacgcguaaaucaga

SEQ ID NO: 1718950 - RNA, 18 nt, Salmonella enterica enterica serovar Typhi
agacgcgcuagcuucagg

SEQ ID NO: 1718951 - RNA, 14 nt, Salmonella enterica enterica serovar Typhi
agacgcgcagcacc

SEQ ID NO: 1718952 - RNA, 18 nt, Salmonella enterica enterica serovar Typhi
agacccgggacuucaggc

SEQ ID NO: 1718953 - RNA, 15 nt, Salmonella enterica enterica serovar Typhi
agaauuuccaguuca

SEQ ID NO: 1718954 - RNA, 20 nt, Salmonella enterica enterica serovar Typhi
agaauuccgaugaaaaacug

SEQ ID NO: 1718955 - RNA, 23 nt, Salmonella enterica enterica serovar Typhi
agacccacauauugcgcuucacu

SEQ ID NO: 1718956 - RNA, 23 nt, Salmonella enterica enterica serovar Typhi
agaauuuucacuuauaaauaaag

SEQ ID NO: 1718957 - RNA, 19 nt, Salmonella enterica enterica serovar Typhi
agacccaguacaaacaaau

SEQ ID NO: 1718958 - RNA, 16 nt, Salmonella enterica enterica serovar Typhi
agacucagcgacugaa

SEQ ID NO: 1718959 - RNA, 12 nt, Salmonella enterica enterica serovar Typhi
agacucaucgcc

SEQ ID NO: 1718960 - RNA, 17 nt, Salmonella enterica enterica serovar Typhi
agacuccgucaaagaaa

SEQ ID NO: 1718961 - RNA, 15 nt, Salmonella enterica enterica serovar Typhi
agacuccggcagcau

SEQ ID NO: 1718962 - RNA, 13 nt, Salmonella enterica enterica serovar Typhi
agacucagccagg

SEQ ID NO: 1718963 - RNA, 20 nt, Salmonella enterica enterica serovar Typhi
agacuauccagccagggauc

SEQ ID NO: 1718964 - RNA, 23 nt, Salmonella enterica enterica serovar Typhi
agacuauccguccucuuucccuu

SEQ ID NO: 1718965 - RNA, 19 nt, Salmonella enterica enterica serovar Typhi
agacuacgcaaaaaaagcc

SEQ ID NO: 1718966 - RNA, 21 nt, Salmonella enterica enterica serovar Typhi
agacuacuuuuacccuucaga

SEQ ID NO: 1718967 - RNA, 19 nt, Salmonella enterica enterica serovar Typhi
agacuacccaucacgcccu

SEQ ID NO: 1718968 - RNA, 13 nt, Salmonella enterica enterica serovar Typhi
agacuucuuccau

SEQ ID NO: 1718969 - RNA, 20 nt, Salmonella enterica enterica serovar Typhi
agacuucuuccauacgacca

SEQ ID NO: 1718970 - RNA, 22 nt, Salmonella enterica enterica serovar Typhi
agacuucaacgccgcacacuca

SEQ ID NO: 1718971 - RNA, 14 nt, Salmonella enterica enterica serovar Typhi
agacuuagcccugg

SEQ ID NO: 1718972 - RNA, 18 nt, Salmonella enterica enterica serovar Typhi
agacuuaggaaugcccag

SEQ ID NO: 1718973 - RNA, 20 nt, Salmonella enterica enterica serovar Typhi
agacuuagggcggagauacc

SEQ ID NO: 1718974 - RNA, 22 nt, Salmonella enterica enterica serovar Typhi
agacuggguaagcgcagcgcca

SEQ ID NO: 1718975 - RNA, 16 nt, Salmonella enterica enterica serovar Typhi
agacuggucgcccgga

SEQ ID NO: 1718976 - RNA, 14 nt, Salmonella enterica enterica serovar Typhi
agacugcacuuccu

SEQ ID NO: 1718977 - RNA, 18 nt, Salmonella enterica enterica serovar Typhi
agacucagccaggucugc

SEQ ID NO: 1718978 - RNA, 14 nt, Salmonella enterica enterica serovar Typhi
agacugcuccggca

SEQ ID NO: 1718979 - RNA, 16 nt, Salmonella enterica enterica serovar Typhi
agacugcacuuccugc

SEQ ID NO: 1718980 - RNA, 16 nt, Salmonella enterica enterica serovar Typhi
agacugauauccauug

SEQ ID NO: 1718981 - RNA, 21 nt, Salmonella enterica enterica serovar Typhi
agagcaucuaccgcauacuga

SEQ ID NO: 1718982 - RNA, 13 nt, Salmonella enterica enterica serovar Typhi
agagcaacgccau

SEQ ID NO: 1718983 - RNA, 18 nt, Salmonella enterica enterica serovar Typhi
agagcaacauaccgcaga

SEQ ID NO: 1718984 - RNA, 22 nt, Salmonella enterica enterica serovar Typhi
agagccagacgguuaagccggu

SEQ ID NO: 1718985 - RNA, 13 nt, Salmonella enterica enterica serovar Typhi
agagcugaaaaug

SEQ ID NO: 1718986 - RNA, 19 nt, Salmonella enterica enterica serovar Typhi
agagcuaaucaauaaguuu

SEQ ID NO: 1718987 - RNA, 22 nt, Salmonella enterica enterica serovar Typhi
agagcggauaagcgcagcgcca

SEQ ID NO: 1718988 - RNA, 20 nt, Salmonella enterica enterica serovar Typhi
agagcgggccguggccagga

SEQ ID NO: 1718989 - RNA, 20 nt, Salmonella enterica enterica serovar Typhi
agagauucgccguucuguuc

SEQ ID NO: 1718990 - RNA, 21 nt, Salmonella enterica enterica serovar Typhi
agagauaauuuucccaguuca

SEQ ID NO: 1718991 - RNA, 16 nt, Salmonella enterica enterica serovar Typhi
agagagccuuacaggc

SEQ ID NO: 1718992 - RNA, 12 nt, Salmonella enterica enterica serovar Typhi
agagaaaaaaau

SEQ ID NO: 1718993 - RNA, 17 nt, Salmonella enterica enterica serovar Typhi
agagaaaaaaauccagu

SEQ ID NO: 1718994 - RNA, 11 nt, Salmonella enterica enterica serovar Typhi
agagaaaaaaa

SEQ ID NO: 1718995 - RNA, 18 nt, Salmonella enterica enterica serovar Typhi
agagaaaauaacaauauu

SEQ ID NO: 1718996 - RNA, 14 nt, Salmonella enterica enterica serovar Typhi
agagaaccugaaca

SEQ ID NO: 1718997 - RNA, 16 nt, Salmonella enterica enterica serovar Typhi
agagaaccugaacaau

SEQ ID NO: 1718998 - RNA, 20 nt, Salmonella enterica enterica serovar Typhi
agagaaccugaacaauaauc

SEQ ID NO: 1718999 - RNA, 21 nt, Salmonella enterica enterica serovar Typhi
agagaaccaacgcauaaaaac

SEQ ID NO: 1719000 - RNA, 23 nt, Salmonella enterica enterica serovar Typhi
agagaacguugccgcaggcaacg

SEQ ID NO: 1719001 - RNA, 22 nt, Salmonella enterica enterica serovar Typhi
agagaagucugagcgcaaacau

SEQ ID NO: 1719002 - RNA, 19 nt, Salmonella enterica enterica serovar Typhi
agagaauaacgaugaugaa

SEQ ID NO: 1719003 - RNA, 22 nt, Salmonella enterica enterica serovar Typhi
agagacggcgacaguugauauu

SEQ ID NO: 1719004 - RNA, 17 nt, Salmonella enterica enterica serovar Typhi
agagacauugccuucca

SEQ ID NO: 1719005 - RNA, 19 nt, Salmonella enterica enterica serovar Typhi
agaugcucaggcaacacga

SEQ ID NO: 1719006 - RNA, 13 nt, Salmonella enterica enterica serovar Typhi
agauggaaaaaaa

SEQ ID NO: 1719007 - RNA, 16 nt, Salmonella enterica enterica serovar Typhi
agauguugauacagaa

SEQ ID NO: 1719008 - RNA, 21 nt, Salmonella enterica enterica serovar Typhi
agauguuuuaaucucuucuau

SEQ ID NO: 1719009 - RNA, 16 nt, Salmonella enterica enterica serovar Typhi
agauuaacagcuucau

SEQ ID NO: 1719010 - RNA, 22 nt, Salmonella enterica enterica serovar Typhi
agauuaacagcgcgaccagcgu

SEQ ID NO: 1719011 - RNA, 14 nt, Salmonella enterica enterica serovar Typhi
agaugaugauuuau

SEQ ID NO: 1719012 - RNA, 21 nt, Salmonella enterica enterica serovar Typhi
agaucuuuauccugcacgaag

SEQ ID NO: 1719013 - RNA, 17 nt, Salmonella enterica enterica serovar Typhi
agaugaaacucgcugug

SEQ ID NO: 1719014 - RNA, 19 nt, Salmonella enterica enterica serovar Typhi
agaugaugauuuaugaaua

SEQ ID NO: 1719015 - RNA, 17 nt, Salmonella enterica enterica serovar Typhi
agauccuuaacgucaaa

SEQ ID NO: 1719016 - RNA, 14 nt, Salmonella enterica enterica serovar Typhi
agauccuucauuca

SEQ ID NO: 1719017 - RNA, 19 nt, Salmonella enterica enterica serovar Typhi
agauccauaagaugaaaga

SEQ ID NO: 1719018 - RNA, 20 nt, Salmonella enterica enterica serovar Typhi
agauccauaagaugaaagau

SEQ ID NO: 1719019 - RNA, 13 nt, Salmonella enterica enterica serovar Typhi
agaucccucaccu

SEQ ID NO: 1719020 - RNA, 17 nt, Salmonella enterica enterica serovar Typhi
agaucgaaacgguccag

SEQ ID NO: 1719021 - RNA, 19 nt, Salmonella enterica enterica serovar Typhi
agaucgcagucgauuuaau

SEQ ID NO: 1719022 - RNA, 18 nt, Salmonella enterica enterica serovar Typhi
agaucgcguacagcgcca

SEQ ID NO: 1719023 - RNA, 22 nt, Salmonella enterica enterica serovar Typhi
agaucgcggggcaacagauacg

SEQ ID NO: 1719024 - RNA, 15 nt, Salmonella enterica enterica serovar Typhi
agaucucuaucggca

SEQ ID NO: 1719025 - RNA, 18 nt, Salmonella enterica enterica serovar Typhi
agaucguaugcgccuguu

SEQ ID NO: 1719026 - RNA, 17 nt, Salmonella enterica enterica serovar Typhi
agaucgguaauuuccac

SEQ ID NO: 1719027 - RNA, 17 nt, Salmonella enterica enterica serovar Typhi
agaucggcauagcggga

SEQ ID NO: 1719028 - RNA, 12 nt, Salmonella enterica enterica serovar Typhi
agaucgcugcaa

SEQ ID NO: 1719029 - RNA, 20 nt, Salmonella enterica enterica serovar Typhi
agaucguuauuaaacagaca

SEQ ID NO: 1719030 - RNA, 22 nt, Salmonella enterica enterica serovar Typhi
agaucgugcauccggacgccag

SEQ ID NO: 1719031 - RNA, 12 nt, Salmonella enterica enterica serovar Typhi
agaucuaucuga

SEQ ID NO: 1719032 - RNA, 22 nt, Salmonella enterica enterica serovar Typhi
agauaaccgucggcgccggcgu

SEQ ID NO: 1719033 - RNA, 23 nt, Salmonella enterica enterica serovar Typhi
agauaacuuccuuugccuuucuu

SEQ ID NO: 1719034 - RNA, 17 nt, Salmonella enterica enterica serovar Typhi
agauaagaaaaaacugg

SEQ ID NO: 1719035 - RNA, 16 nt, Salmonella enterica enterica serovar Typhi
agauaagaaguaaaca

SEQ ID NO: 1719036 - RNA, 20 nt, Salmonella enterica enterica serovar Typhi
agaguguaggccugauaaga

SEQ ID NO: 1719037 - RNA, 15 nt, Salmonella enterica enterica serovar Typhi
aaaaccaccuacgcc

SEQ ID NO: 1719038 - RNA, 23 nt, Salmonella enterica enterica serovar Typhi
aaaaccaccuacgccguuccagc

SEQ ID NO: 1719039 - RNA, 19 nt, Salmonella enterica enterica serovar Typhi
agagucaaggcauccagca

SEQ ID NO: 1719040 - RNA, 20 nt, Salmonella enterica enterica serovar Typhi
agagucaaggcauccagcag

SEQ ID NO: 1719041 - RNA, 22 nt, Salmonella enterica enterica serovar Typhi
aaaaccagcaucaaccaccaaa

SEQ ID NO: 1719042 - RNA, 14 nt, Salmonella enterica enterica serovar Typhi
aaaaccagcgccgc

SEQ ID NO: 1719043 - RNA, 13 nt, Salmonella enterica enterica serovar Typhi
agaguccugacgu

SEQ ID NO: 1719044 - RNA, 10 nt, Salmonella enterica enterica serovar Typhi
agagucgcca

SEQ ID NO: 1719045 - RNA, 20 nt, Salmonella enterica enterica serovar Typhi
agagugacgguuuucacugg

SEQ ID NO: 1719046 - RNA, 20 nt, Salmonella enterica enterica serovar Typhi
agagugauccaccaccagca

SEQ ID NO: 1719047 - RNA, 20 nt, Salmonella enterica enterica serovar Typhi
agagugagccacguuuuccu

SEQ ID NO: 1719048 - RNA, 17 nt, Salmonella enterica enterica serovar Typhi
agaucaaacaggcgaaa

SEQ ID NO: 1719049 - RNA, 13 nt, Salmonella enterica enterica serovar Typhi
agaucaaaaaucu

SEQ ID NO: 1719050 - RNA, 15 nt, Salmonella enterica enterica serovar Typhi
agauaguugagcagc

SEQ ID NO: 1719051 - RNA, 18 nt, Salmonella enterica enterica serovar Typhi
agauaguuuuuaauucca

SEQ ID NO: 1719052 - RNA, 20 nt, Salmonella enterica enterica serovar Typhi
agauagucacgauaguuugc

SEQ ID NO: 1719053 - RNA, 17 nt, Salmonella enterica enterica serovar Typhi
agauagucaucaccauu

SEQ ID NO: 1719054 - RNA, 16 nt, Salmonella enterica enterica serovar Typhi
agauagucgaucccca

SEQ ID NO: 1719055 - RNA, 13 nt, Salmonella enterica enterica serovar Typhi
agauaguggcuga

SEQ ID NO: 1719056 - RNA, 15 nt, Salmonella enterica enterica serovar Typhi
agauagggccaggcg

SEQ ID NO: 1719057 - RNA, 17 nt, Salmonella enterica enterica serovar Typhi
agauagcuuccaugccg

SEQ ID NO: 1719058 - RNA, 22 nt, Salmonella enterica enterica serovar Typhi
agauagcugcuuaccauacuga

SEQ ID NO: 1719059 - RNA, 22 nt, Salmonella enterica enterica serovar Typhi
agauaauccagcgucgccagca

SEQ ID NO: 1719060 - RNA, 23 nt, Salmonella enterica enterica serovar Typhi
agauaauuuucccaguucaucca

SEQ ID NO: 1719061 - RNA, 16 nt, Salmonella enterica enterica serovar Typhi
agauaauuaugccugu

SEQ ID NO: 1719062 - RNA, 19 nt, Salmonella enterica enterica serovar Typhi
agaacauuucccgaaaaaa

SEQ ID NO: 1719063 - RNA, 14 nt, Salmonella enterica enterica serovar Typhi
agaaccacuugaac

SEQ ID NO: 1719064 - RNA, 23 nt, Salmonella enterica enterica serovar Typhi
agaaccuguucaugccagauuuu

SEQ ID NO: 1719065 - RNA, 13 nt, Salmonella enterica enterica serovar Typhi
agaacgaauuuac

SEQ ID NO: 1719066 - RNA, 13 nt, Salmonella enterica enterica serovar Typhi
agaacgccgggcc

SEQ ID NO: 1719067 - RNA, 12 nt, Salmonella enterica enterica serovar Typhi
agaacguauuau

SEQ ID NO: 1719068 - RNA, 15 nt, Salmonella enterica enterica serovar Typhi
agaacguauuauuau

SEQ ID NO: 1719069 - RNA, 21 nt, Salmonella enterica enterica serovar Typhi
agaacggcacaauagcgcuaa

SEQ ID NO: 1719070 - RNA, 19 nt, Salmonella enterica enterica serovar Typhi
agaacgcuugucuucggua

SEQ ID NO: 1719071 - RNA, 17 nt, Salmonella enterica enterica serovar Typhi
agaacuuguaaaaaugc

SEQ ID NO: 1719072 - RNA, 14 nt, Salmonella enterica enterica serovar Typhi
agaagaauuauuau

SEQ ID NO: 1719073 - RNA, 19 nt, Salmonella enterica enterica serovar Typhi
agaagagaauggccagcac

SEQ ID NO: 1719074 - RNA, 22 nt, Salmonella enterica enterica serovar Typhi
agaaaucucaucugcaaaauau

SEQ ID NO: 1719075 - RNA, 13 nt, Salmonella enterica enterica serovar Typhi
agaaaucugaaug

SEQ ID NO: 1719076 - RNA, 13 nt, Salmonella enterica enterica serovar Typhi
agaaaucagcagg

SEQ ID NO: 1719077 - RNA, 17 nt, Salmonella enterica enterica serovar Typhi
agaaauguccauaaaua

SEQ ID NO: 1719078 - RNA, 17 nt, Salmonella enterica enterica serovar Typhi
aaaacacgucuggaaac

SEQ ID NO: 1719079 - RNA, 20 nt, Salmonella enterica enterica serovar Typhi
aaaacaccuaacccaccaua

SEQ ID NO: 1719080 - RNA, 22 nt, Salmonella enterica enterica serovar Typhi
aaaacagaaccccaucgccuga

SEQ ID NO: 1719081 - RNA, 14 nt, Salmonella enterica enterica serovar Typhi
agaaaucaacgaaa

SEQ ID NO: 1719082 - RNA, 18 nt, Salmonella enterica enterica serovar Typhi
agaaacaauccguuauuu

SEQ ID NO: 1719083 - RNA, 19 nt, Salmonella enterica enterica serovar Typhi
agaaaccgcucgccgccuc

SEQ ID NO: 1719084 - RNA, 17 nt, Salmonella enterica enterica serovar Typhi
agaaaccgcagaaaaag

SEQ ID NO: 1719085 - RNA, 15 nt, Salmonella enterica enterica serovar Typhi
agaaacaccagaaug

SEQ ID NO: 1719086 - RNA, 14 nt, Salmonella enterica enterica serovar Typhi
agaaacgcugaucu

SEQ ID NO: 1719087 - RNA, 13 nt, Salmonella enterica enterica serovar Typhi
agaauaacucagc

SEQ ID NO: 1719088 - RNA, 15 nt, Salmonella enterica enterica serovar Typhi
agaauaagccagguu

SEQ ID NO: 1719089 - RNA, 23 nt, Salmonella enterica enterica serovar Typhi
agaauacugaagucgaaauuuuc

SEQ ID NO: 1719090 - RNA, 22 nt, Salmonella enterica enterica serovar Typhi
agaauacacuucucaacauuga

SEQ ID NO: 1719091 - RNA, 17 nt, Salmonella enterica enterica serovar Typhi
agaauagccggauaaaa

SEQ ID NO: 1719092 - RNA, 16 nt, Salmonella enterica enterica serovar Typhi
agaauaggaaauaauu

SEQ ID NO: 1719093 - RNA, 17 nt, Salmonella enterica enterica serovar Typhi
agaagcgccugucuauu

SEQ ID NO: 1719094 - RNA, 15 nt, Salmonella enterica enterica serovar Typhi
agaagcccggccaca

SEQ ID NO: 1719095 - RNA, 22 nt, Salmonella enterica enterica serovar Typhi
agaagucugugagaaaagcgaa

SEQ ID NO: 1719096 - RNA, 16 nt, Salmonella enterica enterica serovar Typhi
agaauggaacaauaga

SEQ ID NO: 1719097 - RNA, 13 nt, Salmonella enterica enterica serovar Typhi
agaauuaucugaa

SEQ ID NO: 1719098 - RNA, 16 nt, Salmonella enterica enterica serovar Typhi
agaauuauuaccaaug

SEQ ID NO: 1719099 - RNA, 22 nt, Salmonella enterica enterica serovar Typhi
agaauuauuaccaaugagcugc

SEQ ID NO: 1719100 - RNA, 20 nt, Salmonella enterica enterica serovar Typhi
agaauuauuaucaauuucau

SEQ ID NO: 1719101 - RNA, 15 nt, Salmonella enterica enterica serovar Typhi
agaaucucugacagg

SEQ ID NO: 1719102 - RNA, 14 nt, Salmonella enterica enterica serovar Typhi
agaaucuguuucag

SEQ ID NO: 1719103 - RNA, 18 nt, Salmonella enterica enterica serovar Typhi
agaaugcgagcaaaaccc

SEQ ID NO: 1719104 - RNA, 15 nt, Salmonella enterica enterica serovar Typhi
agaaugcccagcaag

SEQ ID NO: 1719105 - RNA, 13 nt, Salmonella enterica enterica serovar Typhi
agaauaugccagg

SEQ ID NO: 1719106 - RNA, 15 nt, Salmonella enterica enterica serovar Typhi
agaauauguucuuuc

SEQ ID NO: 1719107 - RNA, 18 nt, Salmonella enterica enterica serovar Typhi
agaauauaguuagaaaau

SEQ ID NO: 1719108 - RNA, 20 nt, Salmonella enterica enterica serovar Typhi
agaaucgguagcuacucagg

SEQ ID NO: 1719109 - RNA, 23 nt, Salmonella enterica enterica serovar Typhi
agaaucauuaauacacugcguag

SEQ ID NO: 1719110 - RNA, 12 nt, Salmonella enterica enterica serovar Typhi
agaaucacguaa

SEQ ID NO: 1719111 - RNA, 20 nt, Salmonella enterica enterica serovar Typhi
agaaucaccucuuucuccac

SEQ ID NO: 1719112 - RNA, 12 nt, Salmonella enterica enterica serovar Typhi
agaaucagaugc

SEQ ID NO: 1719113 - RNA, 15 nt, Salmonella enterica enterica serovar Typhi
acuuuuagaauuauc

SEQ ID NO: 1719114 - RNA, 20 nt, Salmonella enterica enterica serovar Typhi
acuuugcccuuuuugcauuc

SEQ ID NO: 1719115 - RNA, 16 nt, Salmonella enterica enterica serovar Typhi
acuuugcgcuccugcu

SEQ ID NO: 1719116 - RNA, 16 nt, Salmonella enterica enterica serovar Typhi
acuuugccaugaauaa

SEQ ID NO: 1719117 - RNA, 17 nt, Salmonella enterica enterica serovar Typhi
acuuugcuuuucugcuu

SEQ ID NO: 1719118 - RNA, 23 nt, Salmonella enterica enterica serovar Typhi
acuuucgcccggcgccagcucaa

SEQ ID NO: 1719119 - RNA, 19 nt, Salmonella enterica enterica serovar Typhi
acuuuccuggcugucggca

SEQ ID NO: 1719120 - RNA, 19 nt, Salmonella enterica enterica serovar Typhi
acuuucauuucacuuguuc

SEQ ID NO: 1719121 - RNA, 23 nt, Salmonella enterica enterica serovar Typhi
acuuuccauauacucuuuguggg

SEQ ID NO: 1719122 - RNA, 13 nt, Salmonella enterica enterica serovar Typhi
acuuucuacaaau

SEQ ID NO: 1719123 - RNA, 21 nt, Salmonella enterica enterica serovar Typhi
acuuucuuuugauacucugcu

SEQ ID NO: 1719124 - RNA, 15 nt, Salmonella enterica enterica serovar Typhi
acuuugaccagcauc

SEQ ID NO: 1719125 - RNA, 16 nt, Salmonella enterica enterica serovar Typhi
acuuuucgccccggac

SEQ ID NO: 1719126 - RNA, 22 nt, Salmonella enterica enterica serovar Typhi
acuuuuuggcuguugguaugca

SEQ ID NO: 1719127 - RNA, 16 nt, Salmonella enterica enterica serovar Typhi
acuuuuuuaaauguuu

SEQ ID NO: 1719128 - RNA, 17 nt, Salmonella enterica enterica serovar Typhi
acuuuuuuaaauguuuu

SEQ ID NO: 1719129 - RNA, 13 nt, Salmonella enterica enterica serovar Typhi
acuuuugaacaua

SEQ ID NO: 1719130 - RNA, 20 nt, Salmonella enterica enterica serovar Typhi
agaaaauuaacgacaaaaau

SEQ ID NO: 1719131 - RNA, 15 nt, Salmonella enterica enterica serovar Typhi
agaaaaaauuaaaaa

SEQ ID NO: 1719132 - RNA, 18 nt, Salmonella enterica enterica serovar Typhi
agaaaaaacucaggaaau

SEQ ID NO: 1719133 - RNA, 15 nt, Salmonella enterica enterica serovar Typhi
agaaaaaacuggugc

SEQ ID NO: 1719134 - RNA, 22 nt, Salmonella enterica enterica serovar Typhi
acuuuaaagcccagcacggcaa

SEQ ID NO: 1719135 - RNA, 14 nt, Salmonella enterica enterica serovar Typhi
acuuuaagcggcag

SEQ ID NO: 1719136 - RNA, 21 nt, Salmonella enterica enterica serovar Typhi
acuuuacccacaucaaucacc

SEQ ID NO: 1719137 - RNA, 20 nt, Salmonella enterica enterica serovar Typhi
acuuuacccacaucaaucac

SEQ ID NO: 1719138 - RNA, 12 nt, Salmonella enterica enterica serovar Typhi
acuuucagauuu

SEQ ID NO: 1719139 - RNA, 17 nt, Salmonella enterica enterica serovar Typhi
acuuucagauuuuuaau

SEQ ID NO: 1719140 - RNA, 17 nt, Salmonella enterica enterica serovar Typhi
acuuuccagcaacugac

SEQ ID NO: 1719141 - RNA, 20 nt, Salmonella enterica enterica serovar Typhi
acuuucauuucacuuguucu

SEQ ID NO: 1719142 - RNA, 13 nt, Salmonella enterica enterica serovar Typhi
acuuuauuuuucg

SEQ ID NO: 1719143 - RNA, 18 nt, Salmonella enterica enterica serovar Typhi
acuuuauuuuucgccaga

SEQ ID NO: 1719144 - RNA, 13 nt, Salmonella enterica enterica serovar Typhi
acuuuaucaccag

SEQ ID NO: 1719145 - RNA, 13 nt, Salmonella enterica enterica serovar Typhi
acuuuacugaaua

SEQ ID NO: 1719146 - RNA, 13 nt, Salmonella enterica enterica serovar Typhi
acuuauacccuug

SEQ ID NO: 1719147 - RNA, 16 nt, Salmonella enterica enterica serovar Typhi
acuuaucaguaacaga

SEQ ID NO: 1719148 - RNA, 13 nt, Salmonella enterica enterica serovar Typhi
acuuguucuucug

SEQ ID NO: 1719149 - RNA, 15 nt, Salmonella enterica enterica serovar Typhi
acuuguucuucuguu

SEQ ID NO: 1719150 - RNA, 14 nt, Salmonella enterica enterica serovar Typhi
agccgaccaccauc

SEQ ID NO: 1719151 - RNA, 13 nt, Salmonella enterica enterica serovar Typhi
agcccugacagaa

SEQ ID NO: 1719152 - RNA, 13 nt, Salmonella enterica enterica serovar Typhi
agcccuuugcccu

SEQ ID NO: 1719153 - RNA, 12 nt, Salmonella enterica enterica serovar Typhi
agccgccaggca

SEQ ID NO: 1719154 - RNA, 20 nt, Salmonella enterica enterica serovar Typhi
agccgccaggcaaucagcag

SEQ ID NO: 1719155 - RNA, 18 nt, Salmonella enterica enterica serovar Typhi
agccgauggaaguacugg

SEQ ID NO: 1719156 - RNA, 17 nt, Salmonella enterica enterica serovar Typhi
agccaguccugccacca

SEQ ID NO: 1719157 - RNA, 16 nt, Salmonella enterica enterica serovar Typhi
agccaguagcugguga

SEQ ID NO: 1719158 - RNA, 19 nt, Salmonella enterica enterica serovar Typhi
agccaguagcuggugacuu

SEQ ID NO: 1719159 - RNA, 19 nt, Salmonella enterica enterica serovar Typhi
agccaggcuuuaaauucag

SEQ ID NO: 1719160 - RNA, 20 nt, Salmonella enterica enterica serovar Typhi
agccagguugccagaaacaa

SEQ ID NO: 1719161 - RNA, 22 nt, Salmonella enterica enterica serovar Typhi
agccagguauuuagccacgccg

SEQ ID NO: 1719162 - RNA, 18 nt, Salmonella enterica enterica serovar Typhi
agcccggccacagcgcca

SEQ ID NO: 1719163 - RNA, 20 nt, Salmonella enterica enterica serovar Typhi
agcccgcuucacgcgcggcu

SEQ ID NO: 1719164 - RNA, 17 nt, Salmonella enterica enterica serovar Typhi
agcccuauaacagcgcu

SEQ ID NO: 1719165 - RNA, 21 nt, Salmonella enterica enterica serovar Typhi
agcccuauuaggcacuaccac

SEQ ID NO: 1719166 - RNA, 16 nt, Salmonella enterica enterica serovar Typhi
agccggcgauagcgcc

SEQ ID NO: 1719167 - RNA, 21 nt, Salmonella enterica enterica serovar Typhi
agccggcgauagcgccccaaa

SEQ ID NO: 1719168 - RNA, 11 nt, Salmonella enterica enterica serovar Typhi
agccgcugccu

SEQ ID NO: 1719169 - RNA, 21 nt, Salmonella enterica enterica serovar Typhi
agccggaaaagcgcuggcugg

SEQ ID NO: 1719170 - RNA, 22 nt, Salmonella enterica enterica serovar Typhi
agccgccggugacggcggaaga

SEQ ID NO: 1719171 - RNA, 13 nt, Salmonella enterica enterica serovar Typhi
agccgccauuaau

SEQ ID NO: 1719172 - RNA, 12 nt, Salmonella enterica enterica serovar Typhi
agccgcccggcg

SEQ ID NO: 1719173 - RNA, 13 nt, Salmonella enterica enterica serovar Typhi
agccgcccggcgc

SEQ ID NO: 1719174 - RNA, 21 nt, Salmonella enterica enterica serovar Typhi
agccgcccggcgcgcuggagg

SEQ ID NO: 1719175 - RNA, 21 nt, Salmonella enterica enterica serovar Typhi
agccgcccugcggacaggcga

SEQ ID NO: 1719176 - RNA, 21 nt, Salmonella enterica enterica serovar Typhi
agccgcgccaucuccuccuca

SEQ ID NO: 1719177 - RNA, 21 nt, Salmonella enterica enterica serovar Typhi
agccgcgccguaacgcgaugc

SEQ ID NO: 1719178 - RNA, 20 nt, Salmonella enterica enterica serovar Typhi
agccgcggcgcuuucgccac

SEQ ID NO: 1719179 - RNA, 18 nt, Salmonella enterica enterica serovar Typhi
agccgcgcucaagcuggg

SEQ ID NO: 1719180 - RNA, 21 nt, Salmonella enterica enterica serovar Typhi
agccucauuuuugaguuuguc

SEQ ID NO: 1719181 - RNA, 23 nt, Salmonella enterica enterica serovar Typhi
agccuucaauuugaccugaccug

SEQ ID NO: 1719182 - RNA, 16 nt, Salmonella enterica enterica serovar Typhi
agccuuauaagaacca

SEQ ID NO: 1719183 - RNA, 21 nt, Salmonella enterica enterica serovar Typhi
agccuuacaggcgcaucagaa

SEQ ID NO: 1719184 - RNA, 22 nt, Salmonella enterica enterica serovar Typhi
agccuuacaggcgcaucagaaa

SEQ ID NO: 1719185 - RNA, 23 nt, Salmonella enterica enterica serovar Typhi
agccuuacaggcgcaucagaaaa

SEQ ID NO: 1719186 - RNA, 15 nt, Salmonella enterica enterica serovar Typhi
agccuucuccccuuc

SEQ ID NO: 1719187 - RNA, 15 nt, Salmonella enterica enterica serovar Typhi
agccuuccuggucug

SEQ ID NO: 1719188 - RNA, 19 nt, Salmonella enterica enterica serovar Typhi
agccuuccuggucugccag

SEQ ID NO: 1719189 - RNA, 17 nt, Salmonella enterica enterica serovar Typhi
agccuucgccuucacgc

SEQ ID NO: 1719190 - RNA, 23 nt, Salmonella enterica enterica serovar Typhi
agccuucgccuucacgcauucuu

SEQ ID NO: 1719191 - RNA, 21 nt, Salmonella enterica enterica serovar Typhi
agcgaaaugacggccaccagc

SEQ ID NO: 1719192 - RNA, 19 nt, Salmonella enterica enterica serovar Typhi
agcgaaaugcgaauccggc

SEQ ID NO: 1719193 - RNA, 13 nt, Salmonella enterica enterica serovar Typhi
agcgaacagucca

SEQ ID NO: 1719194 - RNA, 22 nt, Salmonella enterica enterica serovar Typhi
agcgaaggggcgggcagcagca

SEQ ID NO: 1719195 - RNA, 23 nt, Salmonella enterica enterica serovar Typhi
agcgaagcgucauccggcaauca

SEQ ID NO: 1719196 - RNA, 13 nt, Salmonella enterica enterica serovar Typhi
agccgggcaggaa

SEQ ID NO: 1719197 - RNA, 22 nt, Salmonella enterica enterica serovar Typhi
agccggguaauaaguugcacuc

SEQ ID NO: 1719198 - RNA, 20 nt, Salmonella enterica enterica serovar Typhi
agccgguuagccacaaugac

SEQ ID NO: 1719199 - RNA, 19 nt, Salmonella enterica enterica serovar Typhi
agccguaacgagugaggac

SEQ ID NO: 1719200 - RNA, 16 nt, Salmonella enterica enterica serovar Typhi
agccguagcagaagac

SEQ ID NO: 1719201 - RNA, 19 nt, Salmonella enterica enterica serovar Typhi
agccgguaaucacugccgc

SEQ ID NO: 1719202 - RNA, 19 nt, Salmonella enterica enterica serovar Typhi
agccguuuuggcagcgccc

SEQ ID NO: 1719203 - RNA, 22 nt, Salmonella enterica enterica serovar Typhi
agccguuuuggcagcgcccgcu

SEQ ID NO: 1719204 - RNA, 18 nt, Salmonella enterica enterica serovar Typhi
agccguuuugcugucugg

SEQ ID NO: 1719205 - RNA, 22 nt, Salmonella enterica enterica serovar Typhi
agccuaaugacggacgcagacc

SEQ ID NO: 1719206 - RNA, 23 nt, Salmonella enterica enterica serovar Typhi
agccuaaugggccagauucuuag

SEQ ID NO: 1719207 - RNA, 18 nt, Salmonella enterica enterica serovar Typhi
agccguuacuucccccau

SEQ ID NO: 1719208 - RNA, 13 nt, Salmonella enterica enterica serovar Typhi
agccguucuccag

SEQ ID NO: 1719209 - RNA, 16 nt, Salmonella enterica enterica serovar Typhi
agccguuacuuccccc

SEQ ID NO: 1719210 - RNA, 21 nt, Salmonella enterica enterica serovar Typhi
agcggcagaucguuuacgacc

SEQ ID NO: 1719211 - RNA, 22 nt, Salmonella enterica enterica serovar Typhi
agcggcaagccgaucagcgugu

SEQ ID NO: 1719212 - RNA, 22 nt, Salmonella enterica enterica serovar Typhi
agcggcaaggaaaaccaguaac

SEQ ID NO: 1719213 - RNA, 20 nt, Salmonella enterica enterica serovar Typhi
agcggaucgcguccauuacu

SEQ ID NO: 1719214 - RNA, 22 nt, Salmonella enterica enterica serovar Typhi
agcggaucgcguccauuacucu

SEQ ID NO: 1719215 - RNA, 14 nt, Salmonella enterica enterica serovar Typhi
agcggauuaaaacg

SEQ ID NO: 1719216 - RNA, 17 nt, Salmonella enterica enterica serovar Typhi
agcggauggccugcuca

SEQ ID NO: 1719217 - RNA, 12 nt, Salmonella enterica enterica serovar Typhi
agcggauucuuc

SEQ ID NO: 1719218 - RNA, 14 nt, Salmonella enterica enterica serovar Typhi
agcggcaacagcac

SEQ ID NO: 1719219 - RNA, 16 nt, Salmonella enterica enterica serovar Typhi
agcgcuuucuucuuca

SEQ ID NO: 1719220 - RNA, 16 nt, Salmonella enterica enterica serovar Typhi
agcgcuuuuuuuaugc

SEQ ID NO: 1719221 - RNA, 23 nt, Salmonella enterica enterica serovar Typhi
agcgcuuaccacuuugcgcuccu

SEQ ID NO: 1719222 - RNA, 16 nt, Salmonella enterica enterica serovar Typhi
agcgcuucuaacgaaa

SEQ ID NO: 1719223 - RNA, 14 nt, Salmonella enterica enterica serovar Typhi
agcgcugccgcaac

SEQ ID NO: 1719224 - RNA, 19 nt, Salmonella enterica enterica serovar Typhi
agcgcugagucauccuucc

SEQ ID NO: 1719225 - RNA, 19 nt, Salmonella enterica enterica serovar Typhi
agcgcugaggcgcuggcuu

SEQ ID NO: 1719226 - RNA, 15 nt, Salmonella enterica enterica serovar Typhi
agcguauugagcugg

SEQ ID NO: 1719227 - RNA, 20 nt, Salmonella enterica enterica serovar Typhi
agcguauaauuaagcugcga

SEQ ID NO: 1719228 - RNA, 15 nt, Salmonella enterica enterica serovar Typhi
agcguaucgccggcg

SEQ ID NO: 1719229 - RNA, 20 nt, Salmonella enterica enterica serovar Typhi
agcguaccgucuggcgaggc

SEQ ID NO: 1719230 - RNA, 14 nt, Salmonella enterica enterica serovar Typhi
agcguaguccaggu

SEQ ID NO: 1719231 - RNA, 15 nt, Salmonella enterica enterica serovar Typhi
agcguagccugcaug

SEQ ID NO: 1719232 - RNA, 13 nt, Salmonella enterica enterica serovar Typhi
agcguagcgccau

SEQ ID NO: 1719233 - RNA, 17 nt, Salmonella enterica enterica serovar Typhi
agcguagcgccaucagg

SEQ ID NO: 1719234 - RNA, 18 nt, Salmonella enterica enterica serovar Typhi
agcgguuaagauacauau

SEQ ID NO: 1719235 - RNA, 19 nt, Salmonella enterica enterica serovar Typhi
agcguaauuccgcaaucug

SEQ ID NO: 1719236 - RNA, 16 nt, Salmonella enterica enterica serovar Typhi
agcggucaucaaugau

SEQ ID NO: 1719237 - RNA, 16 nt, Salmonella enterica enterica serovar Typhi
agcggcgaaccaggac

SEQ ID NO: 1719238 - RNA, 13 nt, Salmonella enterica enterica serovar Typhi
agcggccugucag

SEQ ID NO: 1719239 - RNA, 23 nt, Salmonella enterica enterica serovar Typhi
agcggcgauuuauagagcagcac

SEQ ID NO: 1719240 - RNA, 15 nt, Salmonella enterica enterica serovar Typhi
agcggccagauggca

SEQ ID NO: 1719241 - RNA, 14 nt, Salmonella enterica enterica serovar Typhi
agcggcaguaaauu

SEQ ID NO: 1719242 - RNA, 14 nt, Salmonella enterica enterica serovar Typhi
agcggcagugauga

SEQ ID NO: 1719243 - RNA, 11 nt, Salmonella enterica enterica serovar Typhi
agcgguaaaau

SEQ ID NO: 1719244 - RNA, 18 nt, Salmonella enterica enterica serovar Typhi
agcggcgccaucaccauc

SEQ ID NO: 1719245 - RNA, 16 nt, Salmonella enterica enterica serovar Typhi
agcggguagagcuuuu

SEQ ID NO: 1719246 - RNA, 17 nt, Salmonella enterica enterica serovar Typhi
agcgaccggcgucauca

SEQ ID NO: 1719247 - RNA, 22 nt, Salmonella enterica enterica serovar Typhi
agcgaccacgccaccgccgcca

SEQ ID NO: 1719248 - RNA, 16 nt, Salmonella enterica enterica serovar Typhi
agcgcagcgagaaagc

SEQ ID NO: 1719249 - RNA, 18 nt, Salmonella enterica enterica serovar Typhi
agcgcagcgccaucaggc

SEQ ID NO: 1719250 - RNA, 20 nt, Salmonella enterica enterica serovar Typhi
agcgcagcgccaucaggcac

SEQ ID NO: 1719251 - RNA, 22 nt, Salmonella enterica enterica serovar Typhi
agcgcagcgccauugagcauuc

SEQ ID NO: 1719252 - RNA, 13 nt, Salmonella enterica enterica serovar Typhi
agcgcagcaaaac

SEQ ID NO: 1719253 - RNA, 18 nt, Salmonella enterica enterica serovar Typhi
agcgcagagugaccagcg

SEQ ID NO: 1719254 - RNA, 23 nt, Salmonella enterica enterica serovar Typhi
agcgcagaccgagcgcauguucu

SEQ ID NO: 1719255 - RNA, 16 nt, Salmonella enterica enterica serovar Typhi
agcgcauugcgcccca

SEQ ID NO: 1719256 - RNA, 20 nt, Salmonella enterica enterica serovar Typhi
agcgcauugcgccccagcac

SEQ ID NO: 1719257 - RNA, 21 nt, Salmonella enterica enterica serovar Typhi
agcgcauugcgccccagcaca

SEQ ID NO: 1719258 - RNA, 18 nt, Salmonella enterica enterica serovar Typhi
agcgcagugaccagcauc

SEQ ID NO: 1719259 - RNA, 14 nt, Salmonella enterica enterica serovar Typhi
agcgccaaucacua

SEQ ID NO: 1719260 - RNA, 23 nt, Salmonella enterica enterica serovar Typhi
agcgccaccaaagccaggccgcc

SEQ ID NO: 1719261 - RNA, 14 nt, Salmonella enterica enterica serovar Typhi
agcgccacgcccaa

SEQ ID NO: 1719262 - RNA, 14 nt, Salmonella enterica enterica serovar Typhi
agcgccccaguaac

SEQ ID NO: 1719263 - RNA, 13 nt, Salmonella enterica enterica serovar Typhi
agcgcccagcagc

SEQ ID NO: 1719264 - RNA, 17 nt, Salmonella enterica enterica serovar Typhi
agcgccaugaagauggu

SEQ ID NO: 1719265 - RNA, 16 nt, Salmonella enterica enterica serovar Typhi
agcgccgccagauaaa

SEQ ID NO: 1719266 - RNA, 18 nt, Salmonella enterica enterica serovar Typhi
agcgccgccagauaaagc

SEQ ID NO: 1719267 - RNA, 21 nt, Salmonella enterica enterica serovar Typhi
agcgccgccagauaaagcgaa

SEQ ID NO: 1719268 - RNA, 12 nt, Salmonella enterica enterica serovar Typhi
agcgcgauaaaa

SEQ ID NO: 1719269 - RNA, 22 nt, Salmonella enterica enterica serovar Typhi
agcgcgaucgccccgaccagga

SEQ ID NO: 1719270 - RNA, 17 nt, Salmonella enterica enterica serovar Typhi
agcgcgcagcugggccu

SEQ ID NO: 1719271 - RNA, 20 nt, Salmonella enterica enterica serovar Typhi
agcgcgcagcugggccugcu

SEQ ID NO: 1719272 - RNA, 20 nt, Salmonella enterica enterica serovar Typhi
agcgccgucgccaucaccag

SEQ ID NO: 1719273 - RNA, 14 nt, Salmonella enterica enterica serovar Typhi
agcgccguccgaca

SEQ ID NO: 1719274 - RNA, 18 nt, Salmonella enterica enterica serovar Typhi
agcgccguuaacgcggcc

SEQ ID NO: 1719275 - RNA, 18 nt, Salmonella enterica enterica serovar Typhi
agcgccguuaaacugcgc

SEQ ID NO: 1719276 - RNA, 16 nt, Salmonella enterica enterica serovar Typhi
agcgccggcagcaguu

SEQ ID NO: 1719277 - RNA, 19 nt, Salmonella enterica enterica serovar Typhi
agcgccgucauaccgccca

SEQ ID NO: 1719278 - RNA, 19 nt, Salmonella enterica enterica serovar Typhi
agcgccgcgcgaucaauca

SEQ ID NO: 1719279 - RNA, 16 nt, Salmonella enterica enterica serovar Typhi
agcgccgcgccuacca

SEQ ID NO: 1719280 - RNA, 13 nt, Salmonella enterica enterica serovar Typhi
agcgcggcaagga

SEQ ID NO: 1719281 - RNA, 19 nt, Salmonella enterica enterica serovar Typhi
agcgcggcauuaauuucuu

SEQ ID NO: 1719282 - RNA, 23 nt, Salmonella enterica enterica serovar Typhi
agcgcggacagcagaauauugcu

SEQ ID NO: 1719283 - RNA, 23 nt, Salmonella enterica enterica serovar Typhi
agcgcggaagccacguucuucca

SEQ ID NO: 1719284 - RNA, 23 nt, Salmonella enterica enterica serovar Typhi
agcgcgcgcuaauuuucagggug

SEQ ID NO: 1719285 - RNA, 16 nt, Salmonella enterica enterica serovar Typhi
agcgcgcuccagacca

SEQ ID NO: 1719286 - RNA, 16 nt, Salmonella enterica enterica serovar Typhi
agcgcgcguagcagca

SEQ ID NO: 1719287 - RNA, 15 nt, Salmonella enterica enterica serovar Typhi
agcgcuccggcauaa

SEQ ID NO: 1719288 - RNA, 22 nt, Salmonella enterica enterica serovar Typhi
agcgcuccaccaaccaggcaaa

SEQ ID NO: 1719289 - RNA, 13 nt, Salmonella enterica enterica serovar Typhi
agcgcgucaaugg

SEQ ID NO: 1719290 - RNA, 15 nt, Salmonella enterica enterica serovar Typhi
agcgcgucagcgccu

SEQ ID NO: 1719291 - RNA, 20 nt, Salmonella enterica enterica serovar Typhi
agcgcgucagcgccuccgcg

SEQ ID NO: 1719292 - RNA, 21 nt, Salmonella enterica enterica serovar Typhi
agcgcgguggcuuuuuccugc

SEQ ID NO: 1719293 - RNA, 18 nt, Salmonella enterica enterica serovar Typhi
aaaaccuucauaaauacg

SEQ ID NO: 1719294 - RNA, 13 nt, Salmonella enterica enterica serovar Typhi
agcagacgagaaa

SEQ ID NO: 1719295 - RNA, 14 nt, Salmonella enterica enterica serovar Typhi
aaaaccuccggcua

SEQ ID NO: 1719296 - RNA, 20 nt, Salmonella enterica enterica serovar Typhi
agcagacucauggacaaaaa

SEQ ID NO: 1719297 - RNA, 22 nt, Salmonella enterica enterica serovar Typhi
agcagacguuuaagcaugguga

SEQ ID NO: 1719298 - RNA, 19 nt, Salmonella enterica enterica serovar Typhi
agcagcgaugacagcagga

SEQ ID NO: 1719299 - RNA, 17 nt, Salmonella enterica enterica serovar Typhi
agcagcgcaucaugguc

SEQ ID NO: 1719300 - RNA, 15 nt, Salmonella enterica enterica serovar Typhi
agcagcgcaccugcc

SEQ ID NO: 1719301 - RNA, 13 nt, Salmonella enterica enterica serovar Typhi
agcagcugcugua

SEQ ID NO: 1719302 - RNA, 20 nt, Salmonella enterica enterica serovar Typhi
agcagcugcuuaacuucugc

SEQ ID NO: 1719303 - RNA, 14 nt, Salmonella enterica enterica serovar Typhi
agcagcuucaugca

SEQ ID NO: 1719304 - RNA, 18 nt, Salmonella enterica enterica serovar Typhi
agcaggucaaagacgaaa

SEQ ID NO: 1719305 - RNA, 22 nt, Salmonella enterica enterica serovar Typhi
agcagggucaggaacugcggcc

SEQ ID NO: 1719306 - RNA, 14 nt, Salmonella enterica enterica serovar Typhi
agcagggucaggaa

SEQ ID NO: 1719307 - RNA, 15 nt, Salmonella enterica enterica serovar Typhi
agcagggucaggaac

SEQ ID NO: 1719308 - RNA, 20 nt, Salmonella enterica enterica serovar Typhi
agcagggcaugauuacagau

SEQ ID NO: 1719309 - RNA, 12 nt, Salmonella enterica enterica serovar Typhi
agcaucccacga

SEQ ID NO: 1719310 - RNA, 21 nt, Salmonella enterica enterica serovar Typhi
agcauccgcaagacacgcuuc

SEQ ID NO: 1719311 - RNA, 18 nt, Salmonella enterica enterica serovar Typhi
agcauccgggauauaaaa

SEQ ID NO: 1719312 - RNA, 21 nt, Salmonella enterica enterica serovar Typhi
agcauccgggauauaaaauua

SEQ ID NO: 1719313 - RNA, 17 nt, Salmonella enterica enterica serovar Typhi
agcauaaaaaacaucau

SEQ ID NO: 1719314 - RNA, 20 nt, Salmonella enterica enterica serovar Typhi
agcaguuccccgccgcggcg

SEQ ID NO: 1719315 - RNA, 17 nt, Salmonella enterica enterica serovar Typhi
agcaguucgauaauccc

SEQ ID NO: 1719316 - RNA, 15 nt, Salmonella enterica enterica serovar Typhi
agcaguuccagcauc

SEQ ID NO: 1719317 - RNA, 16 nt, Salmonella enterica enterica serovar Typhi
agcaguucagcagcac

SEQ ID NO: 1719318 - RNA, 17 nt, Salmonella enterica enterica serovar Typhi
agcagguuaaacagaca

SEQ ID NO: 1719319 - RNA, 13 nt, Salmonella enterica enterica serovar Typhi
agcaggugcggcu

SEQ ID NO: 1719320 - RNA, 21 nt, Salmonella enterica enterica serovar Typhi
agcaggugcggacugggcuga

SEQ ID NO: 1719321 - RNA, 19 nt, Salmonella enterica enterica serovar Typhi
agccaaucagccccagcac

SEQ ID NO: 1719322 - RNA, 13 nt, Salmonella enterica enterica serovar Typhi
agccacaaugaca

SEQ ID NO: 1719323 - RNA, 23 nt, Salmonella enterica enterica serovar Typhi
agccacaaugggggcauaauacg

SEQ ID NO: 1719324 - RNA, 17 nt, Salmonella enterica enterica serovar Typhi
agccacaagagcagcaa

SEQ ID NO: 1719325 - RNA, 22 nt, Salmonella enterica enterica serovar Typhi
agccacacugcaucgaaaucuc

SEQ ID NO: 1719326 - RNA, 21 nt, Salmonella enterica enterica serovar Typhi
agccacacgacgguauuggua

SEQ ID NO: 1719327 - RNA, 16 nt, Salmonella enterica enterica serovar Typhi
agccaacaaagaggca

SEQ ID NO: 1719328 - RNA, 15 nt, Salmonella enterica enterica serovar Typhi
agccaacacauaagc

SEQ ID NO: 1719329 - RNA, 18 nt, Salmonella enterica enterica serovar Typhi
agccaauaaucaaaugau

SEQ ID NO: 1719330 - RNA, 19 nt, Salmonella enterica enterica serovar Typhi
agccaaauagcgccagaca

SEQ ID NO: 1719331 - RNA, 18 nt, Salmonella enterica enterica serovar Typhi
agccaaacuccucacugc

SEQ ID NO: 1719332 - RNA, 19 nt, Salmonella enterica enterica serovar Typhi
agccaaagcgagguaaaaa

SEQ ID NO: 1719333 - RNA, 23 nt, Salmonella enterica enterica serovar Typhi
agccaaagauuagccccagcgcc

SEQ ID NO: 1719334 - RNA, 21 nt, Salmonella enterica enterica serovar Typhi
agccacuucuuccagcggcag

SEQ ID NO: 1719335 - RNA, 11 nt, Salmonella enterica enterica serovar Typhi
agccacuggcu

SEQ ID NO: 1719336 - RNA, 13 nt, Salmonella enterica enterica serovar Typhi
agccagcagcuca

SEQ ID NO: 1719337 - RNA, 15 nt, Salmonella enterica enterica serovar Typhi
agccagcagcucaac

SEQ ID NO: 1719338 - RNA, 16 nt, Salmonella enterica enterica serovar Typhi
agccagcauuuccagc

SEQ ID NO: 1719339 - RNA, 18 nt, Salmonella enterica enterica serovar Typhi
agccagcaucaugggcuc

SEQ ID NO: 1719340 - RNA, 21 nt, Salmonella enterica enterica serovar Typhi
agccagccaaauagcgccaga

SEQ ID NO: 1719341 - RNA, 16 nt, Salmonella enterica enterica serovar Typhi
agccagccauggcccu

SEQ ID NO: 1719342 - RNA, 15 nt, Salmonella enterica enterica serovar Typhi
agccagcccucaaca

SEQ ID NO: 1719343 - RNA, 19 nt, Salmonella enterica enterica serovar Typhi
agccagccgccaaaaauau

SEQ ID NO: 1719344 - RNA, 22 nt, Salmonella enterica enterica serovar Typhi
agccagccguugugcugguuga

SEQ ID NO: 1719345 - RNA, 16 nt, Salmonella enterica enterica serovar Typhi
agccacguaaagacga

SEQ ID NO: 1719346 - RNA, 15 nt, Salmonella enterica enterica serovar Typhi
agccacguucuucca

SEQ ID NO: 1719347 - RNA, 18 nt, Salmonella enterica enterica serovar Typhi
agccacguucuuccagaa

SEQ ID NO: 1719348 - RNA, 20 nt, Salmonella enterica enterica serovar Typhi
agccacauuguaugcaagaa

SEQ ID NO: 1719349 - RNA, 22 nt, Salmonella enterica enterica serovar Typhi
agccacggcguguugaaauccu

SEQ ID NO: 1719350 - RNA, 14 nt, Salmonella enterica enterica serovar Typhi
agcauuaaaucauc

SEQ ID NO: 1719351 - RNA, 14 nt, Salmonella enterica enterica serovar Typhi
agcauuauuuuuaa

SEQ ID NO: 1719352 - RNA, 13 nt, Salmonella enterica enterica serovar Typhi
agcauuauuuuua

SEQ ID NO: 1719353 - RNA, 23 nt, Salmonella enterica enterica serovar Typhi
agcauuacccccgccauaaugca

SEQ ID NO: 1719354 - RNA, 19 nt, Salmonella enterica enterica serovar Typhi
agcauuaccccgugguggg

SEQ ID NO: 1719355 - RNA, 16 nt, Salmonella enterica enterica serovar Typhi
agcaugggcuaaagca

SEQ ID NO: 1719356 - RNA, 18 nt, Salmonella enterica enterica serovar Typhi
agcaucugcggcuuucau

SEQ ID NO: 1719357 - RNA, 14 nt, Salmonella enterica enterica serovar Typhi
agcaucugcggcuu

SEQ ID NO: 1719358 - RNA, 21 nt, Salmonella enterica enterica serovar Typhi
agcauuguaggggcuuaucuc

SEQ ID NO: 1719359 - RNA, 20 nt, Salmonella enterica enterica serovar Typhi
agcauugcuucgucccugca

SEQ ID NO: 1719360 - RNA, 16 nt, Salmonella enterica enterica serovar Typhi
agcauuggaaauucag

SEQ ID NO: 1719361 - RNA, 18 nt, Salmonella enterica enterica serovar Typhi
agcauuggaaauucaggg

SEQ ID NO: 1719362 - RNA, 19 nt, Salmonella enterica enterica serovar Typhi
agcauugggccgauaaagc

SEQ ID NO: 1719363 - RNA, 18 nt, Salmonella enterica enterica serovar Typhi
agcauugccguuuucaau

SEQ ID NO: 1719364 - RNA, 18 nt, Salmonella enterica enterica serovar Typhi
agcauuuccgcagccaac

SEQ ID NO: 1719365 - RNA, 22 nt, Salmonella enterica enterica serovar Typhi
agccaaaaauaacgcccugcgc

SEQ ID NO: 1719366 - RNA, 15 nt, Salmonella enterica enterica serovar Typhi
agccaaacacuuccc

SEQ ID NO: 1719367 - RNA, 19 nt, Salmonella enterica enterica serovar Typhi
agccaaacacuuccccugc

SEQ ID NO: 1719368 - RNA, 18 nt, Salmonella enterica enterica serovar Typhi
agcaccagaccgacaagc

SEQ ID NO: 1719369 - RNA, 14 nt, Salmonella enterica enterica serovar Typhi
agcaccaggccaac

SEQ ID NO: 1719370 - RNA, 16 nt, Salmonella enterica enterica serovar Typhi
agcaccauucuucaac

SEQ ID NO: 1719371 - RNA, 20 nt, Salmonella enterica enterica serovar Typhi
agcacccaccaucacuucca

SEQ ID NO: 1719372 - RNA, 16 nt, Salmonella enterica enterica serovar Typhi
agcacccggcccggcg

SEQ ID NO: 1719373 - RNA, 21 nt, Salmonella enterica enterica serovar Typhi
agcacaucacucauaaugaug

SEQ ID NO: 1719374 - RNA, 18 nt, Salmonella enterica enterica serovar Typhi
agcacaucagcaaaugaa

SEQ ID NO: 1719375 - RNA, 12 nt, Salmonella enterica enterica serovar Typhi
agcacacgcauc

SEQ ID NO: 1719376 - RNA, 19 nt, Salmonella enterica enterica serovar Typhi
agcacaccauuucacaaau

SEQ ID NO: 1719377 - RNA, 15 nt, Salmonella enterica enterica serovar Typhi
agcaccacgcccgga

SEQ ID NO: 1719378 - RNA, 15 nt, Salmonella enterica enterica serovar Typhi
agcacaugcagauau

SEQ ID NO: 1719379 - RNA, 14 nt, Salmonella enterica enterica serovar Typhi
agcacauccucaau

SEQ ID NO: 1719380 - RNA, 18 nt, Salmonella enterica enterica serovar Typhi
agcacaugacggcugacg

SEQ ID NO: 1719381 - RNA, 21 nt, Salmonella enterica enterica serovar Typhi
agcacaugacggcugacgcag

SEQ ID NO: 1719382 - RNA, 17 nt, Salmonella enterica enterica serovar Typhi
agcacgauauccagcac

SEQ ID NO: 1719383 - RNA, 20 nt, Salmonella enterica enterica serovar Typhi
agcaccggaacagaagccug

SEQ ID NO: 1719384 - RNA, 18 nt, Salmonella enterica enterica serovar Typhi
agcaccgauccaauauua

SEQ ID NO: 1719385 - RNA, 21 nt, Salmonella enterica enterica serovar Typhi
agcaccgccgggaagaaauua

SEQ ID NO: 1719386 - RNA, 16 nt, Salmonella enterica enterica serovar Typhi
agcaccgccgggaaga

SEQ ID NO: 1719387 - RNA, 21 nt, Salmonella enterica enterica serovar Typhi
agcacgcggaagaaauagaac

SEQ ID NO: 1719388 - RNA, 15 nt, Salmonella enterica enterica serovar Typhi
agcacugcccaggac

SEQ ID NO: 1719389 - RNA, 13 nt, Salmonella enterica enterica serovar Typhi
agcacugcugcug

SEQ ID NO: 1719390 - RNA, 16 nt, Salmonella enterica enterica serovar Typhi
agcacugcugcugaaa

SEQ ID NO: 1719391 - RNA, 17 nt, Salmonella enterica enterica serovar Typhi
agcacugcugcugaaag

SEQ ID NO: 1719392 - RNA, 21 nt, Salmonella enterica enterica serovar Typhi
agcacugcugcugaaagaaga

SEQ ID NO: 1719393 - RNA, 19 nt, Salmonella enterica enterica serovar Typhi
agcacugcuuaaauuuuuu

SEQ ID NO: 1719394 - RNA, 16 nt, Salmonella enterica enterica serovar Typhi
agcacuuccggaucgc

SEQ ID NO: 1719395 - RNA, 18 nt, Salmonella enterica enterica serovar Typhi
agcacuucacccaucgcc

SEQ ID NO: 1719396 - RNA, 22 nt, Salmonella enterica enterica serovar Typhi
agcacuucgcugauaccgcccu

SEQ ID NO: 1719397 - RNA, 20 nt, Salmonella enterica enterica serovar Typhi
aaaaccggccagcgucauca

SEQ ID NO: 1719398 - RNA, 14 nt, Salmonella enterica enterica serovar Typhi
aaaaccguucugag

SEQ ID NO: 1719399 - RNA, 22 nt, Salmonella enterica enterica serovar Typhi
aaaaccguccacauccagcgcc

SEQ ID NO: 1719400 - RNA, 21 nt, Salmonella enterica enterica serovar Typhi
aaaaccggaauuuguugguuu

SEQ ID NO: 1719401 - RNA, 13 nt, Salmonella enterica enterica serovar Typhi
agcacuucuccac

SEQ ID NO: 1719402 - RNA, 23 nt, Salmonella enterica enterica serovar Typhi
agcagaacguagcccauugucau

SEQ ID NO: 1719403 - RNA, 20 nt, Salmonella enterica enterica serovar Typhi
agcagaagacggaaaccaga

SEQ ID NO: 1719404 - RNA, 20 nt, Salmonella enterica enterica serovar Typhi
agcacaauaacgaccccaau

SEQ ID NO: 1719405 - RNA, 18 nt, Salmonella enterica enterica serovar Typhi
agcacaacgaguccccuc

SEQ ID NO: 1719406 - RNA, 21 nt, Salmonella enterica enterica serovar Typhi
agcacaaagaauucuucugug

SEQ ID NO: 1719407 - RNA, 20 nt, Salmonella enterica enterica serovar Typhi
agcaauuaacaaauaaagcg

SEQ ID NO: 1719408 - RNA, 16 nt, Salmonella enterica enterica serovar Typhi
agcaauuaauaaacaa

SEQ ID NO: 1719409 - RNA, 17 nt, Salmonella enterica enterica serovar Typhi
agcaaugugcgccagaa

SEQ ID NO: 1719410 - RNA, 21 nt, Salmonella enterica enterica serovar Typhi
agcaauugccauaaaaacaau

SEQ ID NO: 1719411 - RNA, 20 nt, Salmonella enterica enterica serovar Typhi
agcaaugcccaaaauagcgu

SEQ ID NO: 1719412 - RNA, 20 nt, Salmonella enterica enterica serovar Typhi
agcaaugcgaauaacaucau

SEQ ID NO: 1719413 - RNA, 13 nt, Salmonella enterica enterica serovar Typhi
agcaaugauuuua

SEQ ID NO: 1719414 - RNA, 20 nt, Salmonella enterica enterica serovar Typhi
agcaauccauuuuaaauaca

SEQ ID NO: 1719415 - RNA, 22 nt, Salmonella enterica enterica serovar Typhi
agcaaucucuauaccauaaaug

SEQ ID NO: 1719416 - RNA, 12 nt, Salmonella enterica enterica serovar Typhi
agcaauaauccg

SEQ ID NO: 1719417 - RNA, 16 nt, Salmonella enterica enterica serovar Typhi
agcaaucacuuccgcc

SEQ ID NO: 1719418 - RNA, 20 nt, Salmonella enterica enterica serovar Typhi
agcaaucagguauuuccugc

SEQ ID NO: 1719419 - RNA, 23 nt, Salmonella enterica enterica serovar Typhi
agcaacguaaucccgccagccuu

SEQ ID NO: 1719420 - RNA, 18 nt, Salmonella enterica enterica serovar Typhi
agcaacguuaaggccgca

SEQ ID NO: 1719421 - RNA, 22 nt, Salmonella enterica enterica serovar Typhi
agcaacgugaacugcgccugca

SEQ ID NO: 1719422 - RNA, 19 nt, Salmonella enterica enterica serovar Typhi
agauuauuuuaucaucagc

SEQ ID NO: 1719423 - RNA, 18 nt, Salmonella enterica enterica serovar Typhi
agcaagaacagagcaauu

SEQ ID NO: 1719424 - RNA, 14 nt, Salmonella enterica enterica serovar Typhi
agcaagauuucaaa

SEQ ID NO: 1719425 - RNA, 13 nt, Salmonella enterica enterica serovar Typhi
agcaagaacagag

SEQ ID NO: 1719426 - RNA, 21 nt, Salmonella enterica enterica serovar Typhi
acucacgcgcgcuuuucgcca

SEQ ID NO: 1719427 - RNA, 19 nt, Salmonella enterica enterica serovar Typhi
acucacgacuuucaccaga

SEQ ID NO: 1719428 - RNA, 17 nt, Salmonella enterica enterica serovar Typhi
acucaccgcuaauccca

SEQ ID NO: 1719429 - RNA, 19 nt, Salmonella enterica enterica serovar Typhi
acucaccugaugcgaugaa

SEQ ID NO: 1719430 - RNA, 18 nt, Salmonella enterica enterica serovar Typhi
acucacgacuuucaccag

SEQ ID NO: 1719431 - RNA, 21 nt, Salmonella enterica enterica serovar Typhi
acucaaccaucaaaaaaaaua

SEQ ID NO: 1719432 - RNA, 20 nt, Salmonella enterica enterica serovar Typhi
acucaaccaaccaacccaaa

SEQ ID NO: 1719433 - RNA, 17 nt, Salmonella enterica enterica serovar Typhi
acucaagcgaauccaga

SEQ ID NO: 1719434 - RNA, 20 nt, Salmonella enterica enterica serovar Typhi
acucaaggcuauuagccaaa

SEQ ID NO: 1719435 - RNA, 19 nt, Salmonella enterica enterica serovar Typhi
acucaagguagccacgccc

SEQ ID NO: 1719436 - RNA, 14 nt, Salmonella enterica enterica serovar Typhi
acucaauaaaaguu

SEQ ID NO: 1719437 - RNA, 14 nt, Salmonella enterica enterica serovar Typhi
acucaaucaggcua

SEQ ID NO: 1719438 - RNA, 17 nt, Salmonella enterica enterica serovar Typhi
acuauggucugaaagag

SEQ ID NO: 1719439 - RNA, 14 nt, Salmonella enterica enterica serovar Typhi
acucaaagaaaaca

SEQ ID NO: 1719440 - RNA, 23 nt, Salmonella enterica enterica serovar Typhi
acucaaaccccagauuacugccc

SEQ ID NO: 1719441 - RNA, 20 nt, Salmonella enterica enterica serovar Typhi
acuauguugaugcuaaccuc

SEQ ID NO: 1719442 - RNA, 21 nt, Salmonella enterica enterica serovar Typhi
acucaaaauaacgcuucaccu

SEQ ID NO: 1719443 - RNA, 22 nt, Salmonella enterica enterica serovar Typhi
acguucggugaagaaaaagaag

SEQ ID NO: 1719444 - RNA, 21 nt, Salmonella enterica enterica serovar Typhi
acguucggcguguagccaauc

SEQ ID NO: 1719445 - RNA, 12 nt, Salmonella enterica enterica serovar Typhi
acguucaucuuc

SEQ ID NO: 1719446 - RNA, 20 nt, Salmonella enterica enterica serovar Typhi
acuaccucuuauccggcugc

SEQ ID NO: 1719447 - RNA, 19 nt, Salmonella enterica enterica serovar Typhi
acguucguuguccacuguu

SEQ ID NO: 1719448 - RNA, 19 nt, Salmonella enterica enterica serovar Typhi
acguuccauggucucuuuu

SEQ ID NO: 1719449 - RNA, 14 nt, Salmonella enterica enterica serovar Typhi
acguuccccagcac

SEQ ID NO: 1719450 - RNA, 23 nt, Salmonella enterica enterica serovar Typhi
acguucauccgaccacggccaca

SEQ ID NO: 1719451 - RNA, 20 nt, Salmonella enterica enterica serovar Typhi
acguuacauuuuccaugccu

SEQ ID NO: 1719452 - RNA, 18 nt, Salmonella enterica enterica serovar Typhi
acguuaccauaauuugau

SEQ ID NO: 1719453 - RNA, 19 nt, Salmonella enterica enterica serovar Typhi
acguucaucaggccugcaa

SEQ ID NO: 1719454 - RNA, 17 nt, Salmonella enterica enterica serovar Typhi
acguucauccuccuucg

SEQ ID NO: 1719455 - RNA, 14 nt, Salmonella enterica enterica serovar Typhi
acuacggcaaacac

SEQ ID NO: 1719456 - RNA, 21 nt, Salmonella enterica enterica serovar Typhi
acuacggcaaacgcuggugcu

SEQ ID NO: 1719457 - RNA, 22 nt, Salmonella enterica enterica serovar Typhi
acuacggguuuuuguguugaaa

SEQ ID NO: 1719458 - RNA, 15 nt, Salmonella enterica enterica serovar Typhi
acuacuacaccaccc

SEQ ID NO: 1719459 - RNA, 19 nt, Salmonella enterica enterica serovar Typhi
acuacucguaaucuaaaau

SEQ ID NO: 1719460 - RNA, 22 nt, Salmonella enterica enterica serovar Typhi
acuacuuuuacccuucagauau

SEQ ID NO: 1719461 - RNA, 18 nt, Salmonella enterica enterica serovar Typhi
acuaucgaaagagcaaau

SEQ ID NO: 1719462 - RNA, 20 nt, Salmonella enterica enterica serovar Typhi
acuaucccauugauucccgg

SEQ ID NO: 1719463 - RNA, 23 nt, Salmonella enterica enterica serovar Typhi
acucaggccuuuuuauugccaca

SEQ ID NO: 1719464 - RNA, 18 nt, Salmonella enterica enterica serovar Typhi
acucagaccgggcgaagu

SEQ ID NO: 1719465 - RNA, 15 nt, Salmonella enterica enterica serovar Typhi
acucagcacauucag

SEQ ID NO: 1719466 - RNA, 13 nt, Salmonella enterica enterica serovar Typhi
acucagggcaaaa

SEQ ID NO: 1719467 - RNA, 22 nt, Salmonella enterica enterica serovar Typhi
acucagggugacggaagagaga

SEQ ID NO: 1719468 - RNA, 12 nt, Salmonella enterica enterica serovar Typhi
acucauaauauc

SEQ ID NO: 1719469 - RNA, 20 nt, Salmonella enterica enterica serovar Typhi
acucaucacagccacacugc

SEQ ID NO: 1719470 - RNA, 13 nt, Salmonella enterica enterica serovar Typhi
acucauccaccuu

SEQ ID NO: 1719471 - RNA, 19 nt, Salmonella enterica enterica serovar Typhi
acucauccaccuuauccug

SEQ ID NO: 1719472 - RNA, 23 nt, Salmonella enterica enterica serovar Typhi
acucaucauaauccuuauuuaau

SEQ ID NO: 1719473 - RNA, 13 nt, Salmonella enterica enterica serovar Typhi
acucauuaaaaaa

SEQ ID NO: 1719474 - RNA, 21 nt, Salmonella enterica enterica serovar Typhi
acucauggacaaaaaaggaaa

SEQ ID NO: 1719475 - RNA, 17 nt, Salmonella enterica enterica serovar Typhi
acucaugacuucacacu

SEQ ID NO: 1719476 - RNA, 16 nt, Salmonella enterica enterica serovar Typhi
acucaucgccgcaaug

SEQ ID NO: 1719477 - RNA, 18 nt, Salmonella enterica enterica serovar Typhi
acucaucgccgcaaugac

SEQ ID NO: 1719478 - RNA, 14 nt, Salmonella enterica enterica serovar Typhi
acucaucggaacag

SEQ ID NO: 1719479 - RNA, 11 nt, Salmonella enterica enterica serovar Typhi
acuccagaccu

SEQ ID NO: 1719480 - RNA, 14 nt, Salmonella enterica enterica serovar Typhi
acuccugccugaca

SEQ ID NO: 1719481 - RNA, 11 nt, Salmonella enterica enterica serovar Typhi
acuccugcaac

SEQ ID NO: 1719482 - RNA, 15 nt, Salmonella enterica enterica serovar Typhi
acuccugcaacagaa

SEQ ID NO: 1719483 - RNA, 16 nt, Salmonella enterica enterica serovar Typhi
acuccuucuaauucca

SEQ ID NO: 1719484 - RNA, 15 nt, Salmonella enterica enterica serovar Typhi
acuccugggcaaaau

SEQ ID NO: 1719485 - RNA, 16 nt, Salmonella enterica enterica serovar Typhi
acucgccucgcugcug

SEQ ID NO: 1719486 - RNA, 15 nt, Salmonella enterica enterica serovar Typhi
acucgccuuucucca

SEQ ID NO: 1719487 - RNA, 21 nt, Salmonella enterica enterica serovar Typhi
acucgccuuucuccaugguca

SEQ ID NO: 1719488 - RNA, 14 nt, Salmonella enterica enterica serovar Typhi
acucgcacaguaca

SEQ ID NO: 1719489 - RNA, 13 nt, Salmonella enterica enterica serovar Typhi
acucggugccgcu

SEQ ID NO: 1719490 - RNA, 22 nt, Salmonella enterica enterica serovar Typhi
acucggugccgcugcugaccuu

SEQ ID NO: 1719491 - RNA, 16 nt, Salmonella enterica enterica serovar Typhi
acuccauucccagcuc

SEQ ID NO: 1719492 - RNA, 18 nt, Salmonella enterica enterica serovar Typhi
acuccauucccagcucuu

SEQ ID NO: 1719493 - RNA, 17 nt, Salmonella enterica enterica serovar Typhi
acucccugcuuuuucag

SEQ ID NO: 1719494 - RNA, 18 nt, Salmonella enterica enterica serovar Typhi
acucccugagucuugccu

SEQ ID NO: 1719495 - RNA, 18 nt, Salmonella enterica enterica serovar Typhi
acuccgcgcgcguaagcu

SEQ ID NO: 1719496 - RNA, 14 nt, Salmonella enterica enterica serovar Typhi
acuccagcccauca

SEQ ID NO: 1719497 - RNA, 15 nt, Salmonella enterica enterica serovar Typhi
acuccagcccaucag

SEQ ID NO: 1719498 - RNA, 14 nt, Salmonella enterica enterica serovar Typhi
acuccagaauauug

SEQ ID NO: 1719499 - RNA, 20 nt, Salmonella enterica enterica serovar Typhi
acugcuuagcucaucagccu

SEQ ID NO: 1719500 - RNA, 23 nt, Salmonella enterica enterica serovar Typhi
acugcuuaaauuuuuugccgcuc

SEQ ID NO: 1719501 - RNA, 17 nt, Salmonella enterica enterica serovar Typhi
acugcuaaggagauaac

SEQ ID NO: 1719502 - RNA, 21 nt, Salmonella enterica enterica serovar Typhi
acugccgcccaucgccacagc

SEQ ID NO: 1719503 - RNA, 12 nt, Salmonella enterica enterica serovar Typhi
acugcccggcau

SEQ ID NO: 1719504 - RNA, 13 nt, Salmonella enterica enterica serovar Typhi
acugcccggcaua

SEQ ID NO: 1719505 - RNA, 21 nt, Salmonella enterica enterica serovar Typhi
acugccgcagccgcucagggu

SEQ ID NO: 1719506 - RNA, 15 nt, Salmonella enterica enterica serovar Typhi
acugccgcccaucgc

SEQ ID NO: 1719507 - RNA, 15 nt, Salmonella enterica enterica serovar Typhi
acugcccguggcgga

SEQ ID NO: 1719508 - RNA, 15 nt, Salmonella enterica enterica serovar Typhi
acugccagaccggcg

SEQ ID NO: 1719509 - RNA, 13 nt, Salmonella enterica enterica serovar Typhi
acugcacuuccug

SEQ ID NO: 1719510 - RNA, 14 nt, Salmonella enterica enterica serovar Typhi
acugcccagccgcc

SEQ ID NO: 1719511 - RNA, 23 nt, Salmonella enterica enterica serovar Typhi
acugcccaaauaaaagccgccgu

SEQ ID NO: 1719512 - RNA, 15 nt, Salmonella enterica enterica serovar Typhi
acugcacgccagggu

SEQ ID NO: 1719513 - RNA, 22 nt, Salmonella enterica enterica serovar Typhi
acugcacgccaggguaauacug

SEQ ID NO: 1719514 - RNA, 15 nt, Salmonella enterica enterica serovar Typhi
acugauuaauugcga

SEQ ID NO: 1719515 - RNA, 18 nt, Salmonella enterica enterica serovar Typhi
acugauuaauugcgacaa

SEQ ID NO: 1719516 - RNA, 13 nt, Salmonella enterica enterica serovar Typhi
acugauggcuggc

SEQ ID NO: 1719517 - RNA, 22 nt, Salmonella enterica enterica serovar Typhi
acugauggaguuucaucagcac

SEQ ID NO: 1719518 - RNA, 17 nt, Salmonella enterica enterica serovar Typhi
acugauucaaaagguga

SEQ ID NO: 1719519 - RNA, 23 nt, Salmonella enterica enterica serovar Typhi
acugacguugcgaaucagguaca

SEQ ID NO: 1719520 - RNA, 21 nt, Salmonella enterica enterica serovar Typhi
acugacggcgcucuuuacaua

SEQ ID NO: 1719521 - RNA, 21 nt, Salmonella enterica enterica serovar Typhi
acugacuauccacagcgaauu

SEQ ID NO: 1719522 - RNA, 19 nt, Salmonella enterica enterica serovar Typhi
acugagacucagcagcgca

SEQ ID NO: 1719523 - RNA, 20 nt, Salmonella enterica enterica serovar Typhi
acugaauuacugcguaaacc

SEQ ID NO: 1719524 - RNA, 20 nt, Salmonella enterica enterica serovar Typhi
acugacaauaagugguucgu

SEQ ID NO: 1719525 - RNA, 14 nt, Salmonella enterica enterica serovar Typhi
acugacgaaaaccg

SEQ ID NO: 1719526 - RNA, 14 nt, Salmonella enterica enterica serovar Typhi
acugaaccaacagc

SEQ ID NO: 1719527 - RNA, 19 nt, Salmonella enterica enterica serovar Typhi
acucucaccgaccugccuu

SEQ ID NO: 1719528 - RNA, 15 nt, Salmonella enterica enterica serovar Typhi
acucucaaugcccau

SEQ ID NO: 1719529 - RNA, 21 nt, Salmonella enterica enterica serovar Typhi
acucucaaugcccaucugacg

SEQ ID NO: 1719530 - RNA, 13 nt, Salmonella enterica enterica serovar Typhi
acugaagauaaac

SEQ ID NO: 1719531 - RNA, 16 nt, Salmonella enterica enterica serovar Typhi
acucuauguucaguag

SEQ ID NO: 1719532 - RNA, 23 nt, Salmonella enterica enterica serovar Typhi
acucuaugcaaaagaaaaaacuu

SEQ ID NO: 1719533 - RNA, 15 nt, Salmonella enterica enterica serovar Typhi
acucguaagaggcgu

SEQ ID NO: 1719534 - RNA, 16 nt, Salmonella enterica enterica serovar Typhi
acugguaaccuguucc

SEQ ID NO: 1719535 - RNA, 23 nt, Salmonella enterica enterica serovar Typhi
acugguaaccuguuccucacuga

SEQ ID NO: 1719536 - RNA, 21 nt, Salmonella enterica enterica serovar Typhi
acugguggcgagauaagccgu

SEQ ID NO: 1719537 - RNA, 19 nt, Salmonella enterica enterica serovar Typhi
acuggugcccgcaaaaccu

SEQ ID NO: 1719538 - RNA, 23 nt, Salmonella enterica enterica serovar Typhi
acugguggaauaaauauaagauc

SEQ ID NO: 1719539 - RNA, 20 nt, Salmonella enterica enterica serovar Typhi
acuggugcccgcaaaaccuu

SEQ ID NO: 1719540 - RNA, 14 nt, Salmonella enterica enterica serovar Typhi
acugcuuugaucac

SEQ ID NO: 1719541 - RNA, 18 nt, Salmonella enterica enterica serovar Typhi
acuggccuuuuuuuuacc

SEQ ID NO: 1719542 - RNA, 16 nt, Salmonella enterica enterica serovar Typhi
acuggcccccuguucc

SEQ ID NO: 1719543 - RNA, 22 nt, Salmonella enterica enterica serovar Typhi
acuggcugugcgugacccacag

SEQ ID NO: 1719544 - RNA, 18 nt, Salmonella enterica enterica serovar Typhi
acuggcuuuccugaucaa

SEQ ID NO: 1719545 - RNA, 21 nt, Salmonella enterica enterica serovar Typhi
acuguuuuaucagggaauggu

SEQ ID NO: 1719546 - RNA, 18 nt, Salmonella enterica enterica serovar Typhi
acuguuugucucagguau

SEQ ID NO: 1719547 - RNA, 14 nt, Salmonella enterica enterica serovar Typhi
acuguucagcugac

SEQ ID NO: 1719548 - RNA, 12 nt, Salmonella enterica enterica serovar Typhi
acuguggugugc

SEQ ID NO: 1719549 - RNA, 19 nt, Salmonella enterica enterica serovar Typhi
acuguggugugccugcgcu

SEQ ID NO: 1719550 - RNA, 16 nt, Salmonella enterica enterica serovar Typhi
acugugggauuuuugg

SEQ ID NO: 1719551 - RNA, 14 nt, Salmonella enterica enterica serovar Typhi
acugucgaaaccag

SEQ ID NO: 1719552 - RNA, 22 nt, Salmonella enterica enterica serovar Typhi
acugucccagggccaaacuggc

SEQ ID NO: 1719553 - RNA, 18 nt, Salmonella enterica enterica serovar Typhi
acugugcgucgcguucgc

SEQ ID NO: 1719554 - RNA, 21 nt, Salmonella enterica enterica serovar Typhi
acuguacgccacggcuuaaau

SEQ ID NO: 1719555 - RNA, 18 nt, Salmonella enterica enterica serovar Typhi
acuguacgcgggaaauac

SEQ ID NO: 1719556 - RNA, 14 nt, Salmonella enterica enterica serovar Typhi
acuguaaaucugcc

SEQ ID NO: 1719557 - RNA, 20 nt, Salmonella enterica enterica serovar Typhi
acuguaaaucugccgucauc

SEQ ID NO: 1719558 - RNA, 16 nt, Salmonella enterica enterica serovar Typhi
acuguauucgguggaa

SEQ ID NO: 1719559 - RNA, 18 nt, Salmonella enterica enterica serovar Typhi
acgccgggaaauuuuucg

SEQ ID NO: 1719560 - RNA, 21 nt, Salmonella enterica enterica serovar Typhi
acgccggugauuuuaaaguaa

SEQ ID NO: 1719561 - RNA, 14 nt, Salmonella enterica enterica serovar Typhi
acgccgggccugcc

SEQ ID NO: 1719562 - RNA, 14 nt, Salmonella enterica enterica serovar Typhi
acgccguccagcac

SEQ ID NO: 1719563 - RNA, 15 nt, Salmonella enterica enterica serovar Typhi
acgccguccaggcuc

SEQ ID NO: 1719564 - RNA, 14 nt, Salmonella enterica enterica serovar Typhi
acgccgucucuuuu

SEQ ID NO: 1719565 - RNA, 21 nt, Salmonella enterica enterica serovar Typhi
acgccgugaauuucugcugcc

SEQ ID NO: 1719566 - RNA, 17 nt, Salmonella enterica enterica serovar Typhi
acgccgccauccggcac

SEQ ID NO: 1719567 - RNA, 15 nt, Salmonella enterica enterica serovar Typhi
acgccgccagccacu

SEQ ID NO: 1719568 - RNA, 22 nt, Salmonella enterica enterica serovar Typhi
acgccgcacacagcagaaagca

SEQ ID NO: 1719569 - RNA, 21 nt, Salmonella enterica enterica serovar Typhi
acgccgcccgccugagcgcgc

SEQ ID NO: 1719570 - RNA, 22 nt, Salmonella enterica enterica serovar Typhi
acgccgcuggcggaaauaaaca

SEQ ID NO: 1719571 - RNA, 19 nt, Salmonella enterica enterica serovar Typhi
acgccugaaaugcuuaaaa

SEQ ID NO: 1719572 - RNA, 19 nt, Salmonella enterica enterica serovar Typhi
acgccuaccgcuucccaca

SEQ ID NO: 1719573 - RNA, 16 nt, Salmonella enterica enterica serovar Typhi
acgccuaaugaagcgc

SEQ ID NO: 1719574 - RNA, 16 nt, Salmonella enterica enterica serovar Typhi
acgccuuugcccggug

SEQ ID NO: 1719575 - RNA, 19 nt, Salmonella enterica enterica serovar Typhi
acgccuuuacccuuacggc

SEQ ID NO: 1719576 - RNA, 22 nt, Salmonella enterica enterica serovar Typhi
acgccuucguccggauguucga

SEQ ID NO: 1719577 - RNA, 17 nt, Salmonella enterica enterica serovar Typhi
acgccuuccuccagcau

SEQ ID NO: 1719578 - RNA, 21 nt, Salmonella enterica enterica serovar Typhi
acgccuucauauuaaauuccg

SEQ ID NO: 1719579 - RNA, 18 nt, Salmonella enterica enterica serovar Typhi
acgccugggcauuuguug

SEQ ID NO: 1719580 - RNA, 21 nt, Salmonella enterica enterica serovar Typhi
acgccauugcgaacaucacga

SEQ ID NO: 1719581 - RNA, 20 nt, Salmonella enterica enterica serovar Typhi
acgccauggggugaggcauc

SEQ ID NO: 1719582 - RNA, 20 nt, Salmonella enterica enterica serovar Typhi
acgccaugcucauccaacug

SEQ ID NO: 1719583 - RNA, 15 nt, Salmonella enterica enterica serovar Typhi
acgccauggccgcag

SEQ ID NO: 1719584 - RNA, 20 nt, Salmonella enterica enterica serovar Typhi
acgccaucugugccagccca

SEQ ID NO: 1719585 - RNA, 20 nt, Salmonella enterica enterica serovar Typhi
acgaucaauaaaauuaucca

SEQ ID NO: 1719586 - RNA, 21 nt, Salmonella enterica enterica serovar Typhi
acgauauccagcaccucauca

SEQ ID NO: 1719587 - RNA, 21 nt, Salmonella enterica enterica serovar Typhi
acgcccacgcggcgugcgcug

SEQ ID NO: 1719588 - RNA, 12 nt, Salmonella enterica enterica serovar Typhi
acgcccagcgcc

SEQ ID NO: 1719589 - RNA, 16 nt, Salmonella enterica enterica serovar Typhi
acgccccuaaggcagc

SEQ ID NO: 1719590 - RNA, 18 nt, Salmonella enterica enterica serovar Typhi
acgcccgccguaacgcgc

SEQ ID NO: 1719591 - RNA, 17 nt, Salmonella enterica enterica serovar Typhi
acgcccucaauaucuuu

SEQ ID NO: 1719592 - RNA, 14 nt, Salmonella enterica enterica serovar Typhi
acgcccugcaaagc

SEQ ID NO: 1719593 - RNA, 13 nt, Salmonella enterica enterica serovar Typhi
acgcccucaauau

SEQ ID NO: 1719594 - RNA, 16 nt, Salmonella enterica enterica serovar Typhi
acgcccucaauaucuu

SEQ ID NO: 1719595 - RNA, 14 nt, Salmonella enterica enterica serovar Typhi
acgcccugccauuc

SEQ ID NO: 1719596 - RNA, 23 nt, Salmonella enterica enterica serovar Typhi
acgcccuucacgccgaagugcgc

SEQ ID NO: 1719597 - RNA, 20 nt, Salmonella enterica enterica serovar Typhi
acgccgaacaacacggcggc

SEQ ID NO: 1719598 - RNA, 13 nt, Salmonella enterica enterica serovar Typhi
acgccgcaaacgc

SEQ ID NO: 1719599 - RNA, 16 nt, Salmonella enterica enterica serovar Typhi
acgccgccaaagcgau

SEQ ID NO: 1719600 - RNA, 23 nt, Salmonella enterica enterica serovar Typhi
acgccgagcaucgcuuuuaggcu

SEQ ID NO: 1719601 - RNA, 16 nt, Salmonella enterica enterica serovar Typhi
acgccgauuaaugcuc

SEQ ID NO: 1719602 - RNA, 16 nt, Salmonella enterica enterica serovar Typhi
acgcuaaaccacauga

SEQ ID NO: 1719603 - RNA, 23 nt, Salmonella enterica enterica serovar Typhi
acgcuaaucccgcucgccaggug

SEQ ID NO: 1719604 - RNA, 16 nt, Salmonella enterica enterica serovar Typhi
acgcuaaaaaaggcag

SEQ ID NO: 1719605 - RNA, 22 nt, Salmonella enterica enterica serovar Typhi
acgcucauuaacgacaacuucu

SEQ ID NO: 1719606 - RNA, 13 nt, Salmonella enterica enterica serovar Typhi
acgcgugcgaauu

SEQ ID NO: 1719607 - RNA, 17 nt, Salmonella enterica enterica serovar Typhi
acgcguucugaauaaau

SEQ ID NO: 1719608 - RNA, 20 nt, Salmonella enterica enterica serovar Typhi
acgcgucaaauagagaaaau

SEQ ID NO: 1719609 - RNA, 23 nt, Salmonella enterica enterica serovar Typhi
acgcgucuucaucagccagcauc

SEQ ID NO: 1719610 - RNA, 15 nt, Salmonella enterica enterica serovar Typhi
acgcgguacccaccu

SEQ ID NO: 1719611 - RNA, 16 nt, Salmonella enterica enterica serovar Typhi
acgcgguaugauuaua

SEQ ID NO: 1719612 - RNA, 18 nt, Salmonella enterica enterica serovar Typhi
acgcuggugcugugccug

SEQ ID NO: 1719613 - RNA, 17 nt, Salmonella enterica enterica serovar Typhi
acgcugguuucggcauc

SEQ ID NO: 1719614 - RNA, 19 nt, Salmonella enterica enterica serovar Typhi
acgcugguuugugugcagg

SEQ ID NO: 1719615 - RNA, 14 nt, Salmonella enterica enterica serovar Typhi
acgcuggcacagga

SEQ ID NO: 1719616 - RNA, 20 nt, Salmonella enterica enterica serovar Typhi
acgcuggcgcaaagaaggca

SEQ ID NO: 1719617 - RNA, 20 nt, Salmonella enterica enterica serovar Typhi
acgcuggaaaauuucaguga

SEQ ID NO: 1719618 - RNA, 21 nt, Salmonella enterica enterica serovar Typhi
acgcuggaaaauuucagugaa

SEQ ID NO: 1719619 - RNA, 16 nt, Salmonella enterica enterica serovar Typhi
acgcucgaguucuuca

SEQ ID NO: 1719620 - RNA, 19 nt, Salmonella enterica enterica serovar Typhi
acgcucgaguucuucacgc

SEQ ID NO: 1719621 - RNA, 19 nt, Salmonella enterica enterica serovar Typhi
acgcucgcugauggcgaga

SEQ ID NO: 1719622 - RNA, 16 nt, Salmonella enterica enterica serovar Typhi
acgcuccggcaggcaa

SEQ ID NO: 1719623 - RNA, 20 nt, Salmonella enterica enterica serovar Typhi
acgcugccauccucauuuug

SEQ ID NO: 1719624 - RNA, 15 nt, Salmonella enterica enterica serovar Typhi
acgcugcggccugcc

SEQ ID NO: 1719625 - RNA, 15 nt, Salmonella enterica enterica serovar Typhi
acgcugcgcaacagc

SEQ ID NO: 1719626 - RNA, 15 nt, Salmonella enterica enterica serovar Typhi
acgcugcgccgcgcc

SEQ ID NO: 1719627 - RNA, 14 nt, Salmonella enterica enterica serovar Typhi
acgcgcuuguucgu

SEQ ID NO: 1719628 - RNA, 14 nt, Salmonella enterica enterica serovar Typhi
acgcggaagaaaua

SEQ ID NO: 1719629 - RNA, 13 nt, Salmonella enterica enterica serovar Typhi
acgcgcugaccuc

SEQ ID NO: 1719630 - RNA, 15 nt, Salmonella enterica enterica serovar Typhi
acgcgcucgccagcg

SEQ ID NO: 1719631 - RNA, 17 nt, Salmonella enterica enterica serovar Typhi
acgcgcucgccagcgcu

SEQ ID NO: 1719632 - RNA, 13 nt, Salmonella enterica enterica serovar Typhi
acgcgcgcccugc

SEQ ID NO: 1719633 - RNA, 18 nt, Salmonella enterica enterica serovar Typhi
acgcgcgagaacugcugc

SEQ ID NO: 1719634 - RNA, 14 nt, Salmonella enterica enterica serovar Typhi
acgcgcgucaggac

SEQ ID NO: 1719635 - RNA, 23 nt, Salmonella enterica enterica serovar Typhi
acgcgcgccggugaucccaccag

SEQ ID NO: 1719636 - RNA, 17 nt, Salmonella enterica enterica serovar Typhi
acgcgcgucaggacggc

SEQ ID NO: 1719637 - RNA, 19 nt, Salmonella enterica enterica serovar Typhi
acgcgcucaccuccgccac

SEQ ID NO: 1719638 - RNA, 21 nt, Salmonella enterica enterica serovar Typhi
acgcggcacaaaguccgccgu

SEQ ID NO: 1719639 - RNA, 16 nt, Salmonella enterica enterica serovar Typhi
acgcggauugccgccc

SEQ ID NO: 1719640 - RNA, 16 nt, Salmonella enterica enterica serovar Typhi
acgcggguacgggacg

SEQ ID NO: 1719641 - RNA, 18 nt, Salmonella enterica enterica serovar Typhi
acgcggcuaaucagggua

SEQ ID NO: 1719642 - RNA, 23 nt, Salmonella enterica enterica serovar Typhi
acgcgccugcucccgcugcggcg

SEQ ID NO: 1719643 - RNA, 18 nt, Salmonella enterica enterica serovar Typhi
acgcgccuggaucugcgc

SEQ ID NO: 1719644 - RNA, 13 nt, Salmonella enterica enterica serovar Typhi
acgcgccagccag

SEQ ID NO: 1719645 - RNA, 15 nt, Salmonella enterica enterica serovar Typhi
acgcgccagccagcg

SEQ ID NO: 1719646 - RNA, 17 nt, Salmonella enterica enterica serovar Typhi
acgcgcccucugagcug

SEQ ID NO: 1719647 - RNA, 20 nt, Salmonella enterica enterica serovar Typhi
acgcgccacuuccagcgcgc

SEQ ID NO: 1719648 - RNA, 21 nt, Salmonella enterica enterica serovar Typhi
acgcgccagcagugggaaaau

SEQ ID NO: 1719649 - RNA, 20 nt, Salmonella enterica enterica serovar Typhi
acgcgcaucaacgccaggca

SEQ ID NO: 1719650 - RNA, 20 nt, Salmonella enterica enterica serovar Typhi
acgcgcagagauagccagcg

SEQ ID NO: 1719651 - RNA, 20 nt, Salmonella enterica enterica serovar Typhi
acgcgcagcaucucauccac

SEQ ID NO: 1719652 - RNA, 16 nt, Salmonella enterica enterica serovar Typhi
acgcgacgcgccagcc

SEQ ID NO: 1719653 - RNA, 15 nt, Salmonella enterica enterica serovar Typhi
acgcgaccagcgcgc

SEQ ID NO: 1719654 - RNA, 21 nt, Salmonella enterica enterica serovar Typhi
acgcgacuuuccgccaccaga

SEQ ID NO: 1719655 - RNA, 19 nt, Salmonella enterica enterica serovar Typhi
acgcgacucccaggcgcgc

SEQ ID NO: 1719656 - RNA, 15 nt, Salmonella enterica enterica serovar Typhi
acgcgagaagcccgg

SEQ ID NO: 1719657 - RNA, 22 nt, Salmonella enterica enterica serovar Typhi
acgcgagcugccaguucauucc

SEQ ID NO: 1719658 - RNA, 21 nt, Salmonella enterica enterica serovar Typhi
acgcgauacacuccggcgcgc

SEQ ID NO: 1719659 - RNA, 15 nt, Salmonella enterica enterica serovar Typhi
acgcgaugagauaau

SEQ ID NO: 1719660 - RNA, 13 nt, Salmonella enterica enterica serovar Typhi
acgugcaucuccu

SEQ ID NO: 1719661 - RNA, 13 nt, Salmonella enterica enterica serovar Typhi
acgugggucgaga

SEQ ID NO: 1719662 - RNA, 16 nt, Salmonella enterica enterica serovar Typhi
acguggggguucaagu

SEQ ID NO: 1719663 - RNA, 14 nt, Salmonella enterica enterica serovar Typhi
acguggcuucgccg

SEQ ID NO: 1719664 - RNA, 15 nt, Salmonella enterica enterica serovar Typhi
acguggccagcaugc

SEQ ID NO: 1719665 - RNA, 14 nt, Salmonella enterica enterica serovar Typhi
acguguaauuucau

SEQ ID NO: 1719666 - RNA, 18 nt, Salmonella enterica enterica serovar Typhi
acguggugcgggauacgu

SEQ ID NO: 1719667 - RNA, 15 nt, Salmonella enterica enterica serovar Typhi
acguuaauacaucau

SEQ ID NO: 1719668 - RNA, 19 nt, Salmonella enterica enterica serovar Typhi
acguuaauacaucaugcuu

SEQ ID NO: 1719669 - RNA, 14 nt, Salmonella enterica enterica serovar Typhi
acgucguaaaaccu

SEQ ID NO: 1719670 - RNA, 13 nt, Salmonella enterica enterica serovar Typhi
acgucgucccagg

SEQ ID NO: 1719671 - RNA, 19 nt, Salmonella enterica enterica serovar Typhi
acgugagugguagaaacug

SEQ ID NO: 1719672 - RNA, 13 nt, Salmonella enterica enterica serovar Typhi
acgucugaagaag

SEQ ID NO: 1719673 - RNA, 20 nt, Salmonella enterica enterica serovar Typhi
acgucgcucuuuucaggcgc

SEQ ID NO: 1719674 - RNA, 18 nt, Salmonella enterica enterica serovar Typhi
acgucgccuggcauggug

SEQ ID NO: 1719675 - RNA, 18 nt, Salmonella enterica enterica serovar Typhi
acgucgccuuccugcagg

SEQ ID NO: 1719676 - RNA, 17 nt, Salmonella enterica enterica serovar Typhi
acgucgcaagacgaaaa

SEQ ID NO: 1719677 - RNA, 16 nt, Salmonella enterica enterica serovar Typhi
acgucgcaagacgaaa

SEQ ID NO: 1719678 - RNA, 19 nt, Salmonella enterica enterica serovar Typhi
acguccauccggguaauuu

SEQ ID NO: 1719679 - RNA, 21 nt, Salmonella enterica enterica serovar Typhi
acguccauaccgguugcgcgc

SEQ ID NO: 1719680 - RNA, 16 nt, Salmonella enterica enterica serovar Typhi
acgucccugccacagu

SEQ ID NO: 1719681 - RNA, 16 nt, Salmonella enterica enterica serovar Typhi
acgucauuuuuucaau

SEQ ID NO: 1719682 - RNA, 10 nt, Salmonella enterica enterica serovar Typhi
acgucaugcc

SEQ ID NO: 1719683 - RNA, 15 nt, Salmonella enterica enterica serovar Typhi
acgucauaucaucca

SEQ ID NO: 1719684 - RNA, 14 nt, Salmonella enterica enterica serovar Typhi
acgucaucaugaaa

SEQ ID NO: 1719685 - RNA, 19 nt, Salmonella enterica enterica serovar Typhi
acgucagccgggauaauca

SEQ ID NO: 1719686 - RNA, 17 nt, Salmonella enterica enterica serovar Typhi
acgucaguggaaaacag

SEQ ID NO: 1719687 - RNA, 19 nt, Salmonella enterica enterica serovar Typhi
acgucaguggaaaacagca

SEQ ID NO: 1719688 - RNA, 15 nt, Salmonella enterica enterica serovar Typhi
acgguguggcccagc

SEQ ID NO: 1719689 - RNA, 16 nt, Salmonella enterica enterica serovar Typhi
acggugugccgccauc

SEQ ID NO: 1719690 - RNA, 20 nt, Salmonella enterica enterica serovar Typhi
acggugugccgccaucagcg

SEQ ID NO: 1719691 - RNA, 16 nt, Salmonella enterica enterica serovar Typhi
acggugugaucaccgc

SEQ ID NO: 1719692 - RNA, 18 nt, Salmonella enterica enterica serovar Typhi
acggugagcugaaagccg

SEQ ID NO: 1719693 - RNA, 17 nt, Salmonella enterica enterica serovar Typhi
acgguuaaaaacagcca

SEQ ID NO: 1719694 - RNA, 22 nt, Salmonella enterica enterica serovar Typhi
acgucaauguaauucaccaaau

SEQ ID NO: 1719695 - RNA, 14 nt, Salmonella enterica enterica serovar Typhi
acguauuauuauua

SEQ ID NO: 1719696 - RNA, 11 nt, Salmonella enterica enterica serovar Typhi
acggggaacag

SEQ ID NO: 1719697 - RNA, 23 nt, Salmonella enterica enterica serovar Typhi
acgggcuuaaucaguucggcauc

SEQ ID NO: 1719698 - RNA, 15 nt, Salmonella enterica enterica serovar Typhi
acgggcuuccaguac

SEQ ID NO: 1719699 - RNA, 11 nt, Salmonella enterica enterica serovar Typhi
acgggcaaagc

SEQ ID NO: 1719700 - RNA, 14 nt, Salmonella enterica enterica serovar Typhi
acgggcagucuggc

SEQ ID NO: 1719701 - RNA, 19 nt, Salmonella enterica enterica serovar Typhi
acgggcacggucugcugac

SEQ ID NO: 1719702 - RNA, 16 nt, Salmonella enterica enterica serovar Typhi
acggcguaagcgcuau

SEQ ID NO: 1719703 - RNA, 16 nt, Salmonella enterica enterica serovar Typhi
acggcguaagucgcgc

SEQ ID NO: 1719704 - RNA, 17 nt, Salmonella enterica enterica serovar Typhi
acggcguaagucgcgca

SEQ ID NO: 1719705 - RNA, 16 nt, Salmonella enterica enterica serovar Typhi
acggcggguuuaagug

SEQ ID NO: 1719706 - RNA, 23 nt, Salmonella enterica enterica serovar Typhi
acggcgguaccauaccugcggcc

SEQ ID NO: 1719707 - RNA, 23 nt, Salmonella enterica enterica serovar Typhi
acggcgucaccaccgcaggcagc

SEQ ID NO: 1719708 - RNA, 22 nt, Salmonella enterica enterica serovar Typhi
acggcgcacacgaaauccaaac

SEQ ID NO: 1719709 - RNA, 23 nt, Salmonella enterica enterica serovar Typhi
acggcgcagauauuuuccaucac

SEQ ID NO: 1719710 - RNA, 22 nt, Salmonella enterica enterica serovar Typhi
acgguaucagcgcguuuuccau

SEQ ID NO: 1719711 - RNA, 21 nt, Salmonella enterica enterica serovar Typhi
acgguauucguuaccagcauc

SEQ ID NO: 1719712 - RNA, 12 nt, Salmonella enterica enterica serovar Typhi
acgguauuucca

SEQ ID NO: 1719713 - RNA, 13 nt, Salmonella enterica enterica serovar Typhi
acgguaugaaaca

SEQ ID NO: 1719714 - RNA, 19 nt, Salmonella enterica enterica serovar Typhi
acgguaugaaacauauaua

SEQ ID NO: 1719715 - RNA, 21 nt, Salmonella enterica enterica serovar Typhi
acgguaugaaacauauauauc

SEQ ID NO: 1719716 - RNA, 20 nt, Salmonella enterica enterica serovar Typhi
acggucauaucgucaucggu

SEQ ID NO: 1719717 - RNA, 12 nt, Salmonella enterica enterica serovar Typhi
acggucaggcuc

SEQ ID NO: 1719718 - RNA, 21 nt, Salmonella enterica enterica serovar Typhi
acggcagccgccaccacaaag

SEQ ID NO: 1719719 - RNA, 14 nt, Salmonella enterica enterica serovar Typhi
acggcacacaggcc

SEQ ID NO: 1719720 - RNA, 23 nt, Salmonella enterica enterica serovar Typhi
acgcugguuugugugcaggagca

SEQ ID NO: 1719721 - RNA, 20 nt, Salmonella enterica enterica serovar Typhi
acggcaccggaaccggcauc

SEQ ID NO: 1719722 - RNA, 15 nt, Salmonella enterica enterica serovar Typhi
acggcauauucccug

SEQ ID NO: 1719723 - RNA, 12 nt, Salmonella enterica enterica serovar Typhi
acggcauaagcc

SEQ ID NO: 1719724 - RNA, 23 nt, Salmonella enterica enterica serovar Typhi
acggcaguguuucccaacaaugc

SEQ ID NO: 1719725 - RNA, 15 nt, Salmonella enterica enterica serovar Typhi
acggcauaagccagu

SEQ ID NO: 1719726 - RNA, 20 nt, Salmonella enterica enterica serovar Typhi
acggccugcaaacgaaucac

SEQ ID NO: 1719727 - RNA, 22 nt, Salmonella enterica enterica serovar Typhi
acggcgacgcccgccaucugcu

SEQ ID NO: 1719728 - RNA, 20 nt, Salmonella enterica enterica serovar Typhi
acggcgacggcuucacugcc

SEQ ID NO: 1719729 - RNA, 18 nt, Salmonella enterica enterica serovar Typhi
acggcgauaccaguaaua

SEQ ID NO: 1719730 - RNA, 16 nt, Salmonella enterica enterica serovar Typhi
acggcgauacugcucc

SEQ ID NO: 1719731 - RNA, 17 nt, Salmonella enterica enterica serovar Typhi
acggccagugaaauaaa

SEQ ID NO: 1719732 - RNA, 14 nt, Salmonella enterica enterica serovar Typhi
acggcccaggcauc

SEQ ID NO: 1719733 - RNA, 21 nt, Salmonella enterica enterica serovar Typhi
acggcccgaagggugaggagc

SEQ ID NO: 1719734 - RNA, 18 nt, Salmonella enterica enterica serovar Typhi
acggcccgugauauugac

SEQ ID NO: 1719735 - RNA, 23 nt, Salmonella enterica enterica serovar Typhi
accugcuggcggcguaagcgggu

SEQ ID NO: 1719736 - RNA, 14 nt, Salmonella enterica enterica serovar Typhi
accugcuucagguu

SEQ ID NO: 1719737 - RNA, 24 nt, Salmonella enterica enterica serovar Typhi
accugcugucgcgguacuucugac

SEQ ID NO: 1719738 - RNA, 21 nt, Salmonella enterica enterica serovar Typhi
accuggcccugcaucagcucg

SEQ ID NO: 1719739 - RNA, 19 nt, Salmonella enterica enterica serovar Typhi
accugcgcaaucaugacag

SEQ ID NO: 1719740 - RNA, 18 nt, Salmonella enterica enterica serovar Typhi
accugcggcaauggcuca

SEQ ID NO: 1719741 - RNA, 15 nt, Salmonella enterica enterica serovar Typhi
accugcggcgcgccc

SEQ ID NO: 1719742 - RNA, 13 nt, Salmonella enterica enterica serovar Typhi
accugaugugcuu

SEQ ID NO: 1719743 - RNA, 19 nt, Salmonella enterica enterica serovar Typhi
accugaugguuauuuucag

SEQ ID NO: 1719744 - RNA, 21 nt, Salmonella enterica enterica serovar Typhi
accugauguagcucuucaucu

SEQ ID NO: 1719745 - RNA, 23 nt, Salmonella enterica enterica serovar Typhi
accugauugauacgcgcccgauc

SEQ ID NO: 1719746 - RNA, 22 nt, Salmonella enterica enterica serovar Typhi
accugcccauccuuucucuggu

SEQ ID NO: 1719747 - RNA, 19 nt, Salmonella enterica enterica serovar Typhi
accugccaguccgcccgcc

SEQ ID NO: 1719748 - RNA, 20 nt, Salmonella enterica enterica serovar Typhi
accugccaguccgcccgccu

SEQ ID NO: 1719749 - RNA, 18 nt, Salmonella enterica enterica serovar Typhi
accugccgaugaaagagc

SEQ ID NO: 1719750 - RNA, 20 nt, Salmonella enterica enterica serovar Typhi
accugcccuuucuucaaugg

SEQ ID NO: 1719751 - RNA, 21 nt, Salmonella enterica enterica serovar Typhi
accugcaucccuuucuuuaca

SEQ ID NO: 1719752 - RNA, 22 nt, Salmonella enterica enterica serovar Typhi
accugcacaucgccauuaaaag

SEQ ID NO: 1719753 - RNA, 23 nt, Salmonella enterica enterica serovar Typhi
accuguaucugcugacacccucu

SEQ ID NO: 1719754 - RNA, 17 nt, Salmonella enterica enterica serovar Typhi
accuguaaccuuaaaag

SEQ ID NO: 1719755 - RNA, 19 nt, Salmonella enterica enterica serovar Typhi
accuggccguugauaaagu

SEQ ID NO: 1719756 - RNA, 15 nt, Salmonella enterica enterica serovar Typhi
accuggcggagcugc

SEQ ID NO: 1719757 - RNA, 20 nt, Salmonella enterica enterica serovar Typhi
accuggcguaguacgcgcgc

SEQ ID NO: 1719758 - RNA, 23 nt, Salmonella enterica enterica serovar Typhi
accuggcgggcagccuucaaguu

SEQ ID NO: 1719759 - RNA, 19 nt, Salmonella enterica enterica serovar Typhi
accuucacccccaucgccc

SEQ ID NO: 1719760 - RNA, 15 nt, Salmonella enterica enterica serovar Typhi
accuucaccggauac

SEQ ID NO: 1719761 - RNA, 15 nt, Salmonella enterica enterica serovar Typhi
accuucacgccgcca

SEQ ID NO: 1719762 - RNA, 21 nt, Salmonella enterica enterica serovar Typhi
accuucaucucuuugcccguc

SEQ ID NO: 1719763 - RNA, 13 nt, Salmonella enterica enterica serovar Typhi
accuuucuucucu

SEQ ID NO: 1719764 - RNA, 19 nt, Salmonella enterica enterica serovar Typhi
accuuucuucucuucuuca

SEQ ID NO: 1719765 - RNA, 13 nt, Salmonella enterica enterica serovar Typhi
accuucugugaaa

SEQ ID NO: 1719766 - RNA, 15 nt, Salmonella enterica enterica serovar Typhi
accuucucuuuaugc

SEQ ID NO: 1719767 - RNA, 19 nt, Salmonella enterica enterica serovar Typhi
accuuccauuaugaugagu

SEQ ID NO: 1719768 - RNA, 14 nt, Salmonella enterica enterica serovar Typhi
accuucuucgccaa

SEQ ID NO: 1719769 - RNA, 14 nt, Salmonella enterica enterica serovar Typhi
accuucuucacuaa

SEQ ID NO: 1719770 - RNA, 21 nt, Salmonella enterica enterica serovar Typhi
accuucuucacuaaaaacagg

SEQ ID NO: 1719771 - RNA, 17 nt, Salmonella enterica enterica serovar Typhi
acgagugcguucuucca

SEQ ID NO: 1719772 - RNA, 18 nt, Salmonella enterica enterica serovar Typhi
acgagugcguucuuccac

SEQ ID NO: 1719773 - RNA, 13 nt, Salmonella enterica enterica serovar Typhi
acgauaaaaaaag

SEQ ID NO: 1719774 - RNA, 15 nt, Salmonella enterica enterica serovar Typhi
acgauaaaccucacg

SEQ ID NO: 1719775 - RNA, 18 nt, Salmonella enterica enterica serovar Typhi
acgauaaaccucacgcaa

SEQ ID NO: 1719776 - RNA, 16 nt, Salmonella enterica enterica serovar Typhi
acgauauaggguuuuc

SEQ ID NO: 1719777 - RNA, 19 nt, Salmonella enterica enterica serovar Typhi
acgauagcgccgguuucuc

SEQ ID NO: 1719778 - RNA, 18 nt, Salmonella enterica enterica serovar Typhi
acgaccccgccgagaauu

SEQ ID NO: 1719779 - RNA, 20 nt, Salmonella enterica enterica serovar Typhi
acgaccuuucgccgucaccu

SEQ ID NO: 1719780 - RNA, 13 nt, Salmonella enterica enterica serovar Typhi
acgacgccagcca

SEQ ID NO: 1719781 - RNA, 15 nt, Salmonella enterica enterica serovar Typhi
acgacgcuccagaau

SEQ ID NO: 1719782 - RNA, 18 nt, Salmonella enterica enterica serovar Typhi
acgacgaauaagcugaau

SEQ ID NO: 1719783 - RNA, 22 nt, Salmonella enterica enterica serovar Typhi
acgacgucgacgccuuccacuu

SEQ ID NO: 1719784 - RNA, 12 nt, Salmonella enterica enterica serovar Typhi
acgaaacucagc

SEQ ID NO: 1719785 - RNA, 22 nt, Salmonella enterica enterica serovar Typhi
acgaaaauuauuuucgaugccc

SEQ ID NO: 1719786 - RNA, 16 nt, Salmonella enterica enterica serovar Typhi
acgaaaaucauccgcu

SEQ ID NO: 1719787 - RNA, 22 nt, Salmonella enterica enterica serovar Typhi
accuuugcccgagcgcuggcau

SEQ ID NO: 1719788 - RNA, 18 nt, Salmonella enterica enterica serovar Typhi
acgaauauucauuuccag

SEQ ID NO: 1719789 - RNA, 23 nt, Salmonella enterica enterica serovar Typhi
acgaaagcggcgaauauagcuaa

SEQ ID NO: 1719790 - RNA, 14 nt, Salmonella enterica enterica serovar Typhi
acgacagaauaugc

SEQ ID NO: 1719791 - RNA, 12 nt, Salmonella enterica enterica serovar Typhi
acgacagaauau

SEQ ID NO: 1719792 - RNA, 13 nt, Salmonella enterica enterica serovar Typhi
acgacagaauaug

SEQ ID NO: 1719793 - RNA, 23 nt, Salmonella enterica enterica serovar Typhi
acgaccacucuuuggacggcauc

SEQ ID NO: 1719794 - RNA, 21 nt, Salmonella enterica enterica serovar Typhi
acgacagugcuauacaguaaa

SEQ ID NO: 1719795 - RNA, 19 nt, Salmonella enterica enterica serovar Typhi
acgaauggcggcguuuucc

SEQ ID NO: 1719796 - RNA, 23 nt, Salmonella enterica enterica serovar Typhi
acgaaugccgauagucuccgcca

SEQ ID NO: 1719797 - RNA, 16 nt, Salmonella enterica enterica serovar Typhi
acgaauuuaaauagca

SEQ ID NO: 1719798 - RNA, 15 nt, Salmonella enterica enterica serovar Typhi
accguggccuccggc

SEQ ID NO: 1719799 - RNA, 21 nt, Salmonella enterica enterica serovar Typhi
accguuaacguuuuacgcugc

SEQ ID NO: 1719800 - RNA, 14 nt, Salmonella enterica enterica serovar Typhi
accgugugcaguga

SEQ ID NO: 1719801 - RNA, 16 nt, Salmonella enterica enterica serovar Typhi
accgugugcagugaca

SEQ ID NO: 1719802 - RNA, 17 nt, Salmonella enterica enterica serovar Typhi
accguucagaucgccaa

SEQ ID NO: 1719803 - RNA, 19 nt, Salmonella enterica enterica serovar Typhi
accguucucaauccgcagc

SEQ ID NO: 1719804 - RNA, 23 nt, Salmonella enterica enterica serovar Typhi
accguucuggcugccgucaaagu

SEQ ID NO: 1719805 - RNA, 19 nt, Salmonella enterica enterica serovar Typhi
accguucuuccuggggauc

SEQ ID NO: 1719806 - RNA, 22 nt, Salmonella enterica enterica serovar Typhi
accguuaacguuuuacgcugcc

SEQ ID NO: 1719807 - RNA, 20 nt, Salmonella enterica enterica serovar Typhi
accguuuaaucgcccugcgg

SEQ ID NO: 1719808 - RNA, 23 nt, Salmonella enterica enterica serovar Typhi
accguugucggggcuuuaaugcu

SEQ ID NO: 1719809 - RNA, 19 nt, Salmonella enterica enterica serovar Typhi
accguugcgcccaucauca

SEQ ID NO: 1719810 - RNA, 15 nt, Salmonella enterica enterica serovar Typhi
accguugcgcccauc

SEQ ID NO: 1719811 - RNA, 13 nt, Salmonella enterica enterica serovar Typhi
accguccacaucc

SEQ ID NO: 1719812 - RNA, 15 nt, Salmonella enterica enterica serovar Typhi
accguccacauccag

SEQ ID NO: 1719813 - RNA, 16 nt, Salmonella enterica enterica serovar Typhi
accgucagcuccggua

SEQ ID NO: 1719814 - RNA, 18 nt, Salmonella enterica enterica serovar Typhi
accgucgagaaaccgcuc

SEQ ID NO: 1719815 - RNA, 17 nt, Salmonella enterica enterica serovar Typhi
accgucgccgacaacgc

SEQ ID NO: 1719816 - RNA, 21 nt, Salmonella enterica enterica serovar Typhi
accgucgcgcccuccuccagc

SEQ ID NO: 1719817 - RNA, 14 nt, Salmonella enterica enterica serovar Typhi
accgugcacgcugc

SEQ ID NO: 1719818 - RNA, 15 nt, Salmonella enterica enterica serovar Typhi
accgugcacgcugcg

SEQ ID NO: 1719819 - RNA, 13 nt, Salmonella enterica enterica serovar Typhi
accgugagcgcgc

SEQ ID NO: 1719820 - RNA, 16 nt, Salmonella enterica enterica serovar Typhi
accgucuccaugucac

SEQ ID NO: 1719821 - RNA, 22 nt, Salmonella enterica enterica serovar Typhi
accgucuucaggucauucagga

SEQ ID NO: 1719822 - RNA, 15 nt, Salmonella enterica enterica serovar Typhi
accuccaaagcgcua

SEQ ID NO: 1719823 - RNA, 23 nt, Salmonella enterica enterica serovar Typhi
accucauccagauguuauaaacu

SEQ ID NO: 1719824 - RNA, 20 nt, Salmonella enterica enterica serovar Typhi
accuauuuuaaauucccagc

SEQ ID NO: 1719825 - RNA, 14 nt, Salmonella enterica enterica serovar Typhi
accuauuuugcaaa

SEQ ID NO: 1719826 - RNA, 19 nt, Salmonella enterica enterica serovar Typhi
accuauuucgauaccgacu

SEQ ID NO: 1719827 - RNA, 16 nt, Salmonella enterica enterica serovar Typhi
accuauuuaauaagca

SEQ ID NO: 1719828 - RNA, 18 nt, Salmonella enterica enterica serovar Typhi
accuacuguggugugccu

SEQ ID NO: 1719829 - RNA, 19 nt, Salmonella enterica enterica serovar Typhi
accuacuguggugugccug

SEQ ID NO: 1719830 - RNA, 20 nt, Salmonella enterica enterica serovar Typhi
accuacuguggugugccugc

SEQ ID NO: 1719831 - RNA, 14 nt, Salmonella enterica enterica serovar Typhi
accuauugaaaaua

SEQ ID NO: 1719832 - RNA, 13 nt, Salmonella enterica enterica serovar Typhi
accuaccggcaua

SEQ ID NO: 1719833 - RNA, 20 nt, Salmonella enterica enterica serovar Typhi
accguuuuuuuaugcagccg

SEQ ID NO: 1719834 - RNA, 22 nt, Salmonella enterica enterica serovar Typhi
accuaaauaagcgccgaguagc

SEQ ID NO: 1719835 - RNA, 23 nt, Salmonella enterica enterica serovar Typhi
accuaaucccuggcgaauaaaau

SEQ ID NO: 1719836 - RNA, 22 nt, Salmonella enterica enterica serovar Typhi
accuaaucccuggcgaauaaaa

SEQ ID NO: 1719837 - RNA, 16 nt, Salmonella enterica enterica serovar Typhi
accgggaucgggacau

SEQ ID NO: 1719838 - RNA, 14 nt, Salmonella enterica enterica serovar Typhi
accgggcaaacauu

SEQ ID NO: 1719839 - RNA, 15 nt, Salmonella enterica enterica serovar Typhi
accggguuaaagccc

SEQ ID NO: 1719840 - RNA, 15 nt, Salmonella enterica enterica serovar Typhi
accgguaaggcaggc

SEQ ID NO: 1719841 - RNA, 22 nt, Salmonella enterica enterica serovar Typhi
accgguaaauuucacuucgccc

SEQ ID NO: 1719842 - RNA, 15 nt, Salmonella enterica enterica serovar Typhi
accggucagaaaucc

SEQ ID NO: 1719843 - RNA, 15 nt, Salmonella enterica enterica serovar Typhi
accgguacucuucca

SEQ ID NO: 1719844 - RNA, 18 nt, Salmonella enterica enterica serovar Typhi
accgguagccaggcgcga

SEQ ID NO: 1719845 - RNA, 20 nt, Salmonella enterica enterica serovar Typhi
accgggagaaaacgcggccu

SEQ ID NO: 1719846 - RNA, 14 nt, Salmonella enterica enterica serovar Typhi
accggcagccugcc

SEQ ID NO: 1719847 - RNA, 15 nt, Salmonella enterica enterica serovar Typhi
accggcagcgucagc

SEQ ID NO: 1719848 - RNA, 14 nt, Salmonella enterica enterica serovar Typhi
accggcaucggcag

SEQ ID NO: 1719849 - RNA, 16 nt, Salmonella enterica enterica serovar Typhi
accggcaucucaucuu

SEQ ID NO: 1719850 - RNA, 15 nt, Salmonella enterica enterica serovar Typhi
accggccacgagcug

SEQ ID NO: 1719851 - RNA, 13 nt, Salmonella enterica enterica serovar Typhi
accggcauuucac

SEQ ID NO: 1719852 - RNA, 16 nt, Salmonella enterica enterica serovar Typhi
accguaacuacaauac

SEQ ID NO: 1719853 - RNA, 22 nt, Salmonella enterica enterica serovar Typhi
accguaauaguuucgacuuuca

SEQ ID NO: 1719854 - RNA, 13 nt, Salmonella enterica enterica serovar Typhi
accgguuuuuccg

SEQ ID NO: 1719855 - RNA, 19 nt, Salmonella enterica enterica serovar Typhi
accguaaaaugcuggugca

SEQ ID NO: 1719856 - RNA, 22 nt, Salmonella enterica enterica serovar Typhi
accgucaauaacgggcacgguc

SEQ ID NO: 1719857 - RNA, 21 nt, Salmonella enterica enterica serovar Typhi
accguaucgcccagcuuaugc

SEQ ID NO: 1719858 - RNA, 18 nt, Salmonella enterica enterica serovar Typhi
accguauugccagaucug

SEQ ID NO: 1719859 - RNA, 22 nt, Salmonella enterica enterica serovar Typhi
accguaguagguauccagcaga

SEQ ID NO: 1719860 - RNA, 19 nt, Salmonella enterica enterica serovar Typhi
accguauccagacccccgg

SEQ ID NO: 1719861 - RNA, 18 nt, Salmonella enterica enterica serovar Typhi
accguauccuuccagccc

SEQ ID NO: 1719862 - RNA, 16 nt, Salmonella enterica enterica serovar Typhi
accgcuuucccggcau

SEQ ID NO: 1719863 - RNA, 17 nt, Salmonella enterica enterica serovar Typhi
accgcuuucccggcaug

SEQ ID NO: 1719864 - RNA, 22 nt, Salmonella enterica enterica serovar Typhi
accgcuuuggcgcccauuucgu

SEQ ID NO: 1719865 - RNA, 22 nt, Salmonella enterica enterica serovar Typhi
accgcuucgaaguuuugaguuu

SEQ ID NO: 1719866 - RNA, 16 nt, Salmonella enterica enterica serovar Typhi
accgcuucgcgcgcca

SEQ ID NO: 1719867 - RNA, 20 nt, Salmonella enterica enterica serovar Typhi
accggaccuaauagccagcc

SEQ ID NO: 1719868 - RNA, 15 nt, Salmonella enterica enterica serovar Typhi
accggacuccaggca

SEQ ID NO: 1719869 - RNA, 23 nt, Salmonella enterica enterica serovar Typhi
accggaaauggucgcuccggaac

SEQ ID NO: 1719870 - RNA, 19 nt, Salmonella enterica enterica serovar Typhi
accgcucuccgcaauuaau

SEQ ID NO: 1719871 - RNA, 12 nt, Salmonella enterica enterica serovar Typhi
accgcuaugaau

SEQ ID NO: 1719872 - RNA, 13 nt, Salmonella enterica enterica serovar Typhi
accgcucaggcgc

SEQ ID NO: 1719873 - RNA, 15 nt, Salmonella enterica enterica serovar Typhi
accgcuacccggcac

SEQ ID NO: 1719874 - RNA, 16 nt, Salmonella enterica enterica serovar Typhi
accgcuaaaaaacagg

SEQ ID NO: 1719875 - RNA, 23 nt, Salmonella enterica enterica serovar Typhi
accgcguuuugcugaugaagcga

SEQ ID NO: 1719876 - RNA, 18 nt, Salmonella enterica enterica serovar Typhi
accgauguuggcgacaga

SEQ ID NO: 1719877 - RNA, 14 nt, Salmonella enterica enterica serovar Typhi
accgauuccugguu

SEQ ID NO: 1719878 - RNA, 17 nt, Salmonella enterica enterica serovar Typhi
accgauuucaucgcuga

SEQ ID NO: 1719879 - RNA, 15 nt, Salmonella enterica enterica serovar Typhi
accagcgccugcgcu

SEQ ID NO: 1719880 - RNA, 17 nt, Salmonella enterica enterica serovar Typhi
accagcgcuucgccugc

SEQ ID NO: 1719881 - RNA, 16 nt, Salmonella enterica enterica serovar Typhi
accagcggcaccagca

SEQ ID NO: 1719882 - RNA, 22 nt, Salmonella enterica enterica serovar Typhi
accagcggaauccccgccgcca

SEQ ID NO: 1719883 - RNA, 15 nt, Salmonella enterica enterica serovar Typhi
accagcgcggcgcca

SEQ ID NO: 1719884 - RNA, 17 nt, Salmonella enterica enterica serovar Typhi
accagcgugcgcucagg

SEQ ID NO: 1719885 - RNA, 19 nt, Salmonella enterica enterica serovar Typhi
accagcgguaugcaccucu

SEQ ID NO: 1719886 - RNA, 22 nt, Salmonella enterica enterica serovar Typhi
accagcgcaagcagcgccccgc

SEQ ID NO: 1719887 - RNA, 15 nt, Salmonella enterica enterica serovar Typhi
accagcgccaggcca

SEQ ID NO: 1719888 - RNA, 19 nt, Salmonella enterica enterica serovar Typhi
accagccuaccugccgcca

SEQ ID NO: 1719889 - RNA, 22 nt, Salmonella enterica enterica serovar Typhi
accagcaucaauagcagcuuca

SEQ ID NO: 1719890 - RNA, 22 nt, Salmonella enterica enterica serovar Typhi
accagcaguguaucguugucgc

SEQ ID NO: 1719891 - RNA, 16 nt, Salmonella enterica enterica serovar Typhi
accagccacugcgcca

SEQ ID NO: 1719892 - RNA, 15 nt, Salmonella enterica enterica serovar Typhi
accagccgaucauca

SEQ ID NO: 1719893 - RNA, 18 nt, Salmonella enterica enterica serovar Typhi
accagccgaucaucacga

SEQ ID NO: 1719894 - RNA, 18 nt, Salmonella enterica enterica serovar Typhi
accagccgcaucuuauau

SEQ ID NO: 1719895 - RNA, 24 nt, Salmonella enterica enterica serovar Typhi
accagccgcgcccuaacaggcgca

SEQ ID NO: 1719896 - RNA, 15 nt, Salmonella enterica enterica serovar Typhi
accagccccaaaauu

SEQ ID NO: 1719897 - RNA, 18 nt, Salmonella enterica enterica serovar Typhi
accagcccaugaaggagc

SEQ ID NO: 1719898 - RNA, 18 nt, Salmonella enterica enterica serovar Typhi
accagccaggaaccgccg

SEQ ID NO: 1719899 - RNA, 18 nt, Salmonella enterica enterica serovar Typhi
accagacucaccccuucu

SEQ ID NO: 1719900 - RNA, 21 nt, Salmonella enterica enterica serovar Typhi
accagacgcgaacguuugacc

SEQ ID NO: 1719901 - RNA, 16 nt, Salmonella enterica enterica serovar Typhi
accagaccgacaagcc

SEQ ID NO: 1719902 - RNA, 21 nt, Salmonella enterica enterica serovar Typhi
accagacacggugugccgcca

SEQ ID NO: 1719903 - RNA, 14 nt, Salmonella enterica enterica serovar Typhi
accagaaucgccag

SEQ ID NO: 1719904 - RNA, 12 nt, Salmonella enterica enterica serovar Typhi
accagcagcaga

SEQ ID NO: 1719905 - RNA, 13 nt, Salmonella enterica enterica serovar Typhi
accagcagcgcca

SEQ ID NO: 1719906 - RNA, 14 nt, Salmonella enterica enterica serovar Typhi
accagcagcgccag

SEQ ID NO: 1719907 - RNA, 14 nt, Salmonella enterica enterica serovar Typhi
accagcacaaaaaa

SEQ ID NO: 1719908 - RNA, 14 nt, Salmonella enterica enterica serovar Typhi
accagcacagccca

SEQ ID NO: 1719909 - RNA, 16 nt, Salmonella enterica enterica serovar Typhi
accagagacauugccu

SEQ ID NO: 1719910 - RNA, 18 nt, Salmonella enterica enterica serovar Typhi
accagaucaacauggugu

SEQ ID NO: 1719911 - RNA, 23 nt, Salmonella enterica enterica serovar Typhi
accaucgcguuguaaucgccuga

SEQ ID NO: 1719912 - RNA, 16 nt, Salmonella enterica enterica serovar Typhi
accaucgccagccauu

SEQ ID NO: 1719913 - RNA, 21 nt, Salmonella enterica enterica serovar Typhi
accauagccguagcccuugau

SEQ ID NO: 1719914 - RNA, 16 nt, Salmonella enterica enterica serovar Typhi
accauaaacaaaacaa

SEQ ID NO: 1719915 - RNA, 17 nt, Salmonella enterica enterica serovar Typhi
accauaaacaaaacaac

SEQ ID NO: 1719916 - RNA, 22 nt, Salmonella enterica enterica serovar Typhi
accauaaacggcaccuggaagu

SEQ ID NO: 1719917 - RNA, 18 nt, Salmonella enterica enterica serovar Typhi
accauaaaugaaaugccc

SEQ ID NO: 1719918 - RNA, 19 nt, Salmonella enterica enterica serovar Typhi
accauauuauucugcugaa

SEQ ID NO: 1719919 - RNA, 16 nt, Salmonella enterica enterica serovar Typhi
accauaucgccgcugc

SEQ ID NO: 1719920 - RNA, 15 nt, Salmonella enterica enterica serovar Typhi
accauauucccacag

SEQ ID NO: 1719921 - RNA, 14 nt, Salmonella enterica enterica serovar Typhi
accauauucacgca

SEQ ID NO: 1719922 - RNA, 21 nt, Salmonella enterica enterica serovar Typhi
accauaggccagcgucaccuc

SEQ ID NO: 1719923 - RNA, 15 nt, Salmonella enterica enterica serovar Typhi
accaguugcgucagc

SEQ ID NO: 1719924 - RNA, 15 nt, Salmonella enterica enterica serovar Typhi
accaguggcggggca

SEQ ID NO: 1719925 - RNA, 16 nt, Salmonella enterica enterica serovar Typhi
accaguuaauuucuuu

SEQ ID NO: 1719926 - RNA, 14 nt, Salmonella enterica enterica serovar Typhi
accagucccagccc

SEQ ID NO: 1719927 - RNA, 23 nt, Salmonella enterica enterica serovar Typhi
accaguccggcagaaagcagcag

SEQ ID NO: 1719928 - RNA, 17 nt, Salmonella enterica enterica serovar Typhi
accaguaccgucauuuc

SEQ ID NO: 1719929 - RNA, 22 nt, Salmonella enterica enterica serovar Typhi
accagugaacgucugcacggca

SEQ ID NO: 1719930 - RNA, 15 nt, Salmonella enterica enterica serovar Typhi
accagucggcaaaga

SEQ ID NO: 1719931 - RNA, 17 nt, Salmonella enterica enterica serovar Typhi
accaggaugccaaccac

SEQ ID NO: 1719932 - RNA, 15 nt, Salmonella enterica enterica serovar Typhi
accaggcaugcagcu

SEQ ID NO: 1719933 - RNA, 23 nt, Salmonella enterica enterica serovar Typhi
accaggauggccagcaccagcau

SEQ ID NO: 1719934 - RNA, 18 nt, Salmonella enterica enterica serovar Typhi
accaggcaaugccccgcc

SEQ ID NO: 1719935 - RNA, 21 nt, Salmonella enterica enterica serovar Typhi
accagcugacgacgccagccc

SEQ ID NO: 1719936 - RNA, 22 nt, Salmonella enterica enterica serovar Typhi
accagcugacgacgccagcccu

SEQ ID NO: 1719937 - RNA, 15 nt, Salmonella enterica enterica serovar Typhi
accagcugacgcagc

SEQ ID NO: 1719938 - RNA, 18 nt, Salmonella enterica enterica serovar Typhi
accagcugacgcagcagu

SEQ ID NO: 1719939 - RNA, 16 nt, Salmonella enterica enterica serovar Typhi
accagcuucaugcugg

SEQ ID NO: 1719940 - RNA, 21 nt, Salmonella enterica enterica serovar Typhi
accagcuuguuauccaucagc

SEQ ID NO: 1719941 - RNA, 22 nt, Salmonella enterica enterica serovar Typhi
accaggucguccguugccaccc

SEQ ID NO: 1719942 - RNA, 22 nt, Salmonella enterica enterica serovar Typhi
accaggucuuaccuauuuuaaa

SEQ ID NO: 1719943 - RNA, 14 nt, Salmonella enterica enterica serovar Typhi
accaguaaccgcca

SEQ ID NO: 1719944 - RNA, 16 nt, Salmonella enterica enterica serovar Typhi
accaguacaucuucac

SEQ ID NO: 1719945 - RNA, 21 nt, Salmonella enterica enterica serovar Typhi
accaguacaauuucuggcccc

SEQ ID NO: 1719946 - RNA, 20 nt, Salmonella enterica enterica serovar Typhi
accagggaggacgcaagagc

SEQ ID NO: 1719947 - RNA, 19 nt, Salmonella enterica enterica serovar Typhi
accagggauuuugcuuuuu

SEQ ID NO: 1719948 - RNA, 17 nt, Salmonella enterica enterica serovar Typhi
acccaccucguucaaac

SEQ ID NO: 1719949 - RNA, 19 nt, Salmonella enterica enterica serovar Typhi
acccagauuauggguaaug

SEQ ID NO: 1719950 - RNA, 18 nt, Salmonella enterica enterica serovar Typhi
acccacuuugcuuuucug

SEQ ID NO: 1719951 - RNA, 15 nt, Salmonella enterica enterica serovar Typhi
acccacuucuuccag

SEQ ID NO: 1719952 - RNA, 16 nt, Salmonella enterica enterica serovar Typhi
acccagucgcagccac

SEQ ID NO: 1719953 - RNA, 19 nt, Salmonella enterica enterica serovar Typhi
acccauaacgggaagccgu

SEQ ID NO: 1719954 - RNA, 16 nt, Salmonella enterica enterica serovar Typhi
acccauagcagcuccg

SEQ ID NO: 1719955 - RNA, 19 nt, Salmonella enterica enterica serovar Typhi
acccauaguagcuaaugau

SEQ ID NO: 1719956 - RNA, 17 nt, Salmonella enterica enterica serovar Typhi
acccagccagacgccag

SEQ ID NO: 1719957 - RNA, 18 nt, Salmonella enterica enterica serovar Typhi
acccagccagacgccagc

SEQ ID NO: 1719958 - RNA, 18 nt, Salmonella enterica enterica serovar Typhi
acccagcgccaacgccac

SEQ ID NO: 1719959 - RNA, 15 nt, Salmonella enterica enterica serovar Typhi
acccaggcaucagau

SEQ ID NO: 1719960 - RNA, 18 nt, Salmonella enterica enterica serovar Typhi
accccaaaucagcaaaaa

SEQ ID NO: 1719961 - RNA, 19 nt, Salmonella enterica enterica serovar Typhi
acccauuaccuggcaacau

SEQ ID NO: 1719962 - RNA, 13 nt, Salmonella enterica enterica serovar Typhi
acccccuggccgg

SEQ ID NO: 1719963 - RNA, 22 nt, Salmonella enterica enterica serovar Typhi
acccccuccuuguaagggaggu

SEQ ID NO: 1719964 - RNA, 15 nt, Salmonella enterica enterica serovar Typhi
acccgauucugccag

SEQ ID NO: 1719965 - RNA, 20 nt, Salmonella enterica enterica serovar Typhi
acccgaugcgaguagcaaau

SEQ ID NO: 1719966 - RNA, 20 nt, Salmonella enterica enterica serovar Typhi
acccgaucgccauccugcac

SEQ ID NO: 1719967 - RNA, 17 nt, Salmonella enterica enterica serovar Typhi
acccgcacuaccagcuc

SEQ ID NO: 1719968 - RNA, 17 nt, Salmonella enterica enterica serovar Typhi
acccgauaccgccagcc

SEQ ID NO: 1719969 - RNA, 21 nt, Salmonella enterica enterica serovar Typhi
acccuauaagcugccucuuug

SEQ ID NO: 1719970 - RNA, 13 nt, Salmonella enterica enterica serovar Typhi
acccgccggcagc

SEQ ID NO: 1719971 - RNA, 16 nt, Salmonella enterica enterica serovar Typhi
acccgccgccagcacc

SEQ ID NO: 1719972 - RNA, 20 nt, Salmonella enterica enterica serovar Typhi
acccgcagccagaacagaag

SEQ ID NO: 1719973 - RNA, 13 nt, Salmonella enterica enterica serovar Typhi
acccuuccuuuuc

SEQ ID NO: 1719974 - RNA, 14 nt, Salmonella enterica enterica serovar Typhi
acccuucaugcagc

SEQ ID NO: 1719975 - RNA, 22 nt, Salmonella enterica enterica serovar Typhi
acccugccguuugcgccagccc

SEQ ID NO: 1719976 - RNA, 15 nt, Salmonella enterica enterica serovar Typhi
acccugcugauacac

SEQ ID NO: 1719977 - RNA, 22 nt, Salmonella enterica enterica serovar Typhi
acccuggcauauggauauucau

SEQ ID NO: 1719978 - RNA, 13 nt, Salmonella enterica enterica serovar Typhi
accgaaaucuucg

SEQ ID NO: 1719979 - RNA, 16 nt, Salmonella enterica enterica serovar Typhi
accgaaaucuucgccu

SEQ ID NO: 1719980 - RNA, 12 nt, Salmonella enterica enterica serovar Typhi
accgaaagcgac

SEQ ID NO: 1719981 - RNA, 19 nt, Salmonella enterica enterica serovar Typhi
acccuuuuccggaugcccc

SEQ ID NO: 1719982 - RNA, 18 nt, Salmonella enterica enterica serovar Typhi
acccuuugaccauuacca

SEQ ID NO: 1719983 - RNA, 24 nt, Salmonella enterica enterica serovar Typhi
accgaguaauguugaugucacuca

SEQ ID NO: 1719984 - RNA, 20 nt, Salmonella enterica enterica serovar Typhi
accgagguucaccagcgcgc

SEQ ID NO: 1719985 - RNA, 21 nt, Salmonella enterica enterica serovar Typhi
accgaugugcguauugagcgc

SEQ ID NO: 1719986 - RNA, 18 nt, Salmonella enterica enterica serovar Typhi
accgauaaucaccagccc

SEQ ID NO: 1719987 - RNA, 15 nt, Salmonella enterica enterica serovar Typhi
accgacuaucagaaa

SEQ ID NO: 1719988 - RNA, 20 nt, Salmonella enterica enterica serovar Typhi
accgacagauagcccugagc

SEQ ID NO: 1719989 - RNA, 16 nt, Salmonella enterica enterica serovar Typhi
agcuccggacgcacca

SEQ ID NO: 1719990 - RNA, 16 nt, Salmonella enterica enterica serovar Typhi
agcuccgcaaagccca

SEQ ID NO: 1719991 - RNA, 21 nt, Salmonella enterica enterica serovar Typhi
agcgucuuccuguaucccaaa

SEQ ID NO: 1719992 - RNA, 15 nt, Salmonella enterica enterica serovar Typhi
agcgucugcggcuga

SEQ ID NO: 1719993 - RNA, 13 nt, Salmonella enterica enterica serovar Typhi
agcgucacaggcu

SEQ ID NO: 1719994 - RNA, 17 nt, Salmonella enterica enterica serovar Typhi
agcgucagguagcccgg

SEQ ID NO: 1719995 - RNA, 19 nt, Salmonella enterica enterica serovar Typhi
agcgucagguagcccggca

SEQ ID NO: 1719996 - RNA, 22 nt, Salmonella enterica enterica serovar Typhi
agcgucagguagcccggcaggc

SEQ ID NO: 1719997 - RNA, 17 nt, Salmonella enterica enterica serovar Typhi
agcgucaguaaaagccc

SEQ ID NO: 1719998 - RNA, 20 nt, Salmonella enterica enterica serovar Typhi
agcgucgcugauugccgcca

SEQ ID NO: 1719999 - RNA, 21 nt, Salmonella enterica enterica serovar Typhi
agcucggcaaagcccaucacc

SEQ ID NO: 1720000 - RNA, 20 nt, Salmonella enterica enterica serovar Typhi
agcucggcaaagcccaucac

SEQ ID NO: 1720001 - RNA, 15 nt, Salmonella enterica enterica serovar Typhi
agcucgcccagcacu

SEQ ID NO: 1720002 - RNA, 22 nt, Salmonella enterica enterica serovar Typhi
agcucgccgaccggcgcgccgu

SEQ ID NO: 1720003 - RNA, 21 nt, Salmonella enterica enterica serovar Typhi
agcucgcaugcauagccgcug

SEQ ID NO: 1720004 - RNA, 20 nt, Salmonella enterica enterica serovar Typhi
agcucgcaggccauaaaacg

SEQ ID NO: 1720005 - RNA, 23 nt, Salmonella enterica enterica serovar Typhi
agcucuguggggggaacggcaga

SEQ ID NO: 1720006 - RNA, 19 nt, Salmonella enterica enterica serovar Typhi
agcucuggaaaaauuguuu

SEQ ID NO: 1720007 - RNA, 15 nt, Salmonella enterica enterica serovar Typhi
agcucuccuggaugc

SEQ ID NO: 1720008 - RNA, 14 nt, Salmonella enterica enterica serovar Typhi
agcucguuauuucc

SEQ ID NO: 1720009 - RNA, 21 nt, Salmonella enterica enterica serovar Typhi
agcucgguggcgguaucaaug

SEQ ID NO: 1720010 - RNA, 17 nt, Salmonella enterica enterica serovar Typhi
agcugaaaagauaaagu

SEQ ID NO: 1720011 - RNA, 10 nt, Salmonella enterica enterica serovar Typhi
agcucuuuca

SEQ ID NO: 1720012 - RNA, 18 nt, Salmonella enterica enterica serovar Typhi
agcugaaugcuucgccac

SEQ ID NO: 1720013 - RNA, 18 nt, Salmonella enterica enterica serovar Typhi
agcugacaaugugccgga

SEQ ID NO: 1720014 - RNA, 19 nt, Salmonella enterica enterica serovar Typhi
agcugacgacgccagcccu

SEQ ID NO: 1720015 - RNA, 14 nt, Salmonella enterica enterica serovar Typhi
agcugagcgucagg

SEQ ID NO: 1720016 - RNA, 17 nt, Salmonella enterica enterica serovar Typhi
agcugagcuaaucaccc

SEQ ID NO: 1720017 - RNA, 20 nt, Salmonella enterica enterica serovar Typhi
agcugauaagcuaguaaaga

SEQ ID NO: 1720018 - RNA, 16 nt, Salmonella enterica enterica serovar Typhi
agcugauaagcuagua

SEQ ID NO: 1720019 - RNA, 15 nt, Salmonella enterica enterica serovar Typhi
agcuuaaaaaauccu

SEQ ID NO: 1720020 - RNA, 18 nt, Salmonella enterica enterica serovar Typhi
agcugggcguuacuggcg

SEQ ID NO: 1720021 - RNA, 14 nt, Salmonella enterica enterica serovar Typhi
agcugggccugcuc

SEQ ID NO: 1720022 - RNA, 23 nt, Salmonella enterica enterica serovar Typhi
agcuggcuuuauauaaaaaaugg

SEQ ID NO: 1720023 - RNA, 22 nt, Salmonella enterica enterica serovar Typhi
agcuggcggucgggaacgcugu

SEQ ID NO: 1720024 - RNA, 19 nt, Salmonella enterica enterica serovar Typhi
agcuggccggaucggcggu

SEQ ID NO: 1720025 - RNA, 14 nt, Salmonella enterica enterica serovar Typhi
agcugauugauuuu

SEQ ID NO: 1720026 - RNA, 15 nt, Salmonella enterica enterica serovar Typhi
agcugcaccaggagc

SEQ ID NO: 1720027 - RNA, 18 nt, Salmonella enterica enterica serovar Typhi
agcugaugauuggccucc

SEQ ID NO: 1720028 - RNA, 20 nt, Salmonella enterica enterica serovar Typhi
agcugauauuuuacuuuuug

SEQ ID NO: 1720029 - RNA, 15 nt, Salmonella enterica enterica serovar Typhi
agcuggagcaggaaa

SEQ ID NO: 1720030 - RNA, 17 nt, Salmonella enterica enterica serovar Typhi
agcugcgccagcgugcu

SEQ ID NO: 1720031 - RNA, 17 nt, Salmonella enterica enterica serovar Typhi
agcugcgccauaccccg

SEQ ID NO: 1720032 - RNA, 16 nt, Salmonella enterica enterica serovar Typhi
agcugcgaucaaguuu

SEQ ID NO: 1720033 - RNA, 17 nt, Salmonella enterica enterica serovar Typhi
agcugcgaucaaguuuu

SEQ ID NO: 1720034 - RNA, 22 nt, Salmonella enterica enterica serovar Typhi
agcuuggccaguggggcugcug

SEQ ID NO: 1720035 - RNA, 23 nt, Salmonella enterica enterica serovar Typhi
agcuuuacucaacggucaaaaua

SEQ ID NO: 1720036 - RNA, 16 nt, Salmonella enterica enterica serovar Typhi
agcuuuccaccagcca

SEQ ID NO: 1720037 - RNA, 15 nt, Salmonella enterica enterica serovar Typhi
agcuugcgcuggugu

SEQ ID NO: 1720038 - RNA, 22 nt, Salmonella enterica enterica serovar Typhi
agcuugcgauccauauaaucaa

SEQ ID NO: 1720039 - RNA, 17 nt, Salmonella enterica enterica serovar Typhi
agcuuaaaaaauccugc

SEQ ID NO: 1720040 - RNA, 14 nt, Salmonella enterica enterica serovar Typhi
agcuuauccugccc

SEQ ID NO: 1720041 - RNA, 23 nt, Salmonella enterica enterica serovar Typhi
agcuuaucgaacugugagccuaa

SEQ ID NO: 1720042 - RNA, 20 nt, Salmonella enterica enterica serovar Typhi
agcuuaucgccaaagauaua

SEQ ID NO: 1720043 - RNA, 18 nt, Salmonella enterica enterica serovar Typhi
agcuuaucgggccuacca

SEQ ID NO: 1720044 - RNA, 15 nt, Salmonella enterica enterica serovar Typhi
agcuuauuccaguca

SEQ ID NO: 1720045 - RNA, 16 nt, Salmonella enterica enterica serovar Typhi
agcuuauuccagucau

SEQ ID NO: 1720046 - RNA, 14 nt, Salmonella enterica enterica serovar Typhi
agcuucaccgccag

SEQ ID NO: 1720047 - RNA, 20 nt, Salmonella enterica enterica serovar Typhi
agcuucagcuggauagagua

SEQ ID NO: 1720048 - RNA, 14 nt, Salmonella enterica enterica serovar Typhi
agcuucagcaaaua

SEQ ID NO: 1720049 - RNA, 16 nt, Salmonella enterica enterica serovar Typhi
aggacgggacuugaac

SEQ ID NO: 1720050 - RNA, 14 nt, Salmonella enterica enterica serovar Typhi
aggacgccagugaa

SEQ ID NO: 1720051 - RNA, 17 nt, Salmonella enterica enterica serovar Typhi
aggaaugcccagcucag

SEQ ID NO: 1720052 - RNA, 20 nt, Salmonella enterica enterica serovar Typhi
aggaaugcccagcucagcuu

SEQ ID NO: 1720053 - RNA, 14 nt, Salmonella enterica enterica serovar Typhi
aggaaugaaaacga

SEQ ID NO: 1720054 - RNA, 19 nt, Salmonella enterica enterica serovar Typhi
aggaaucauucuauugcau

SEQ ID NO: 1720055 - RNA, 19 nt, Salmonella enterica enterica serovar Typhi
aggaauacauuaacgcugg

SEQ ID NO: 1720056 - RNA, 21 nt, Salmonella enterica enterica serovar Typhi
aggaauaagggugagagggga

SEQ ID NO: 1720057 - RNA, 22 nt, Salmonella enterica enterica serovar Typhi
aggaauaacaucguaaaucaaa

SEQ ID NO: 1720058 - RNA, 23 nt, Salmonella enterica enterica serovar Typhi
aggaaacauaaggguaagcaaua

SEQ ID NO: 1720059 - RNA, 13 nt, Salmonella enterica enterica serovar Typhi
aggaaaacgcuuc

SEQ ID NO: 1720060 - RNA, 14 nt, Salmonella enterica enterica serovar Typhi
aggacguucuucuc

SEQ ID NO: 1720061 - RNA, 21 nt, Salmonella enterica enterica serovar Typhi
aggaguccaaaacgaacaggc

SEQ ID NO: 1720062 - RNA, 21 nt, Salmonella enterica enterica serovar Typhi
aggauagcgaccagcgucagc

SEQ ID NO: 1720063 - RNA, 19 nt, Salmonella enterica enterica serovar Typhi
aggauaauucccccaguag

SEQ ID NO: 1720064 - RNA, 16 nt, Salmonella enterica enterica serovar Typhi
aggauacagccgacua

SEQ ID NO: 1720065 - RNA, 18 nt, Salmonella enterica enterica serovar Typhi
aggauaaccuuccggcac

SEQ ID NO: 1720066 - RNA, 15 nt, Salmonella enterica enterica serovar Typhi
aggauaaaaucgcca

SEQ ID NO: 1720067 - RNA, 15 nt, Salmonella enterica enterica serovar Typhi
aggauagugauauag

SEQ ID NO: 1720068 - RNA, 17 nt, Salmonella enterica enterica serovar Typhi
aggauaguacugaccag

SEQ ID NO: 1720069 - RNA, 19 nt, Salmonella enterica enterica serovar Typhi
aggaucaucggccagauaa

SEQ ID NO: 1720070 - RNA, 16 nt, Salmonella enterica enterica serovar Typhi
aggccgcuuaauaaua

SEQ ID NO: 1720071 - RNA, 15 nt, Salmonella enterica enterica serovar Typhi
aggccggauaagccg

SEQ ID NO: 1720072 - RNA, 23 nt, Salmonella enterica enterica serovar Typhi
aggccggauaagcggcagcgcca

SEQ ID NO: 1720073 - RNA, 18 nt, Salmonella enterica enterica serovar Typhi
aggccggauaaggcgcuu

SEQ ID NO: 1720074 - RNA, 17 nt, Salmonella enterica enterica serovar Typhi
aggccggaugaggcgca

SEQ ID NO: 1720075 - RNA, 18 nt, Salmonella enterica enterica serovar Typhi
aggccggauaagcaacgc

SEQ ID NO: 1720076 - RNA, 16 nt, Salmonella enterica enterica serovar Typhi
aggccgccgaggcuaa

SEQ ID NO: 1720077 - RNA, 10 nt, Salmonella enterica enterica serovar Typhi
aggccgccgc

SEQ ID NO: 1720078 - RNA, 17 nt, Salmonella enterica enterica serovar Typhi
aggccgccgcacaggcg

SEQ ID NO: 1720079 - RNA, 16 nt, Salmonella enterica enterica serovar Typhi
aggccagugccaagca

SEQ ID NO: 1720080 - RNA, 17 nt, Salmonella enterica enterica serovar Typhi
aggcauccagacccaca

SEQ ID NO: 1720081 - RNA, 16 nt, Salmonella enterica enterica serovar Typhi
aggccagcgucaccuc

SEQ ID NO: 1720082 - RNA, 17 nt, Salmonella enterica enterica serovar Typhi
aggcauaccgcccagaa

SEQ ID NO: 1720083 - RNA, 14 nt, Salmonella enterica enterica serovar Typhi
aggcauagaaaaag

SEQ ID NO: 1720084 - RNA, 11 nt, Salmonella enterica enterica serovar Typhi
aggcaguuugc

SEQ ID NO: 1720085 - RNA, 14 nt, Salmonella enterica enterica serovar Typhi
aggcauacacaucu

SEQ ID NO: 1720086 - RNA, 23 nt, Salmonella enterica enterica serovar Typhi
aggcaucccguuuucgucccagc

SEQ ID NO: 1720087 - RNA, 19 nt, Salmonella enterica enterica serovar Typhi
aggcauccgugaccugcug

SEQ ID NO: 1720088 - RNA, 17 nt, Salmonella enterica enterica serovar Typhi
aggcagcacaucaauau

SEQ ID NO: 1720089 - RNA, 18 nt, Salmonella enterica enterica serovar Typhi
aggcagccggauuuuaaa

SEQ ID NO: 1720090 - RNA, 19 nt, Salmonella enterica enterica serovar Typhi
aggcagccggauuuuaaau

SEQ ID NO: 1720091 - RNA, 22 nt, Salmonella enterica enterica serovar Typhi
aggcagccggauuuuaaauugg

SEQ ID NO: 1720092 - RNA, 20 nt, Salmonella enterica enterica serovar Typhi
aggcagcguaauacaggcga

SEQ ID NO: 1720093 - RNA, 17 nt, Salmonella enterica enterica serovar Typhi
aggcaggaaauccagca

SEQ ID NO: 1720094 - RNA, 13 nt, Salmonella enterica enterica serovar Typhi
aggcacaacaaua

SEQ ID NO: 1720095 - RNA, 18 nt, Salmonella enterica enterica serovar Typhi
aggauuagacuucuucca

SEQ ID NO: 1720096 - RNA, 14 nt, Salmonella enterica enterica serovar Typhi
aggcaaaccagcac

SEQ ID NO: 1720097 - RNA, 15 nt, Salmonella enterica enterica serovar Typhi
aggcaaaccagcacc

SEQ ID NO: 1720098 - RNA, 14 nt, Salmonella enterica enterica serovar Typhi
aggcaaagccccag

SEQ ID NO: 1720099 - RNA, 17 nt, Salmonella enterica enterica serovar Typhi
aggcaaaucaacauuau

SEQ ID NO: 1720100 - RNA, 22 nt, Salmonella enterica enterica serovar Typhi
aggcaaaucaacauuauuaaaa

SEQ ID NO: 1720101 - RNA, 23 nt, Salmonella enterica enterica serovar Typhi
aggcaaaucaacauuauuaaaau

SEQ ID NO: 1720102 - RNA, 18 nt, Salmonella enterica enterica serovar Typhi
aggcaauaugucuuaaac

SEQ ID NO: 1720103 - RNA, 16 nt, Salmonella enterica enterica serovar Typhi
aggcaauaaacaucag

SEQ ID NO: 1720104 - RNA, 15 nt, Salmonella enterica enterica serovar Typhi
aggcaaguucuuguu

SEQ ID NO: 1720105 - RNA, 17 nt, Salmonella enterica enterica serovar Typhi
aggaugcgcugcgcgcg

SEQ ID NO: 1720106 - RNA, 18 nt, Salmonella enterica enterica serovar Typhi
aggaugccacuguucaga

SEQ ID NO: 1720107 - RNA, 16 nt, Salmonella enterica enterica serovar Typhi
aggauguccaggcgac

SEQ ID NO: 1720108 - RNA, 21 nt, Salmonella enterica enterica serovar Typhi
aggcugagcguagaccgccca

SEQ ID NO: 1720109 - RNA, 21 nt, Salmonella enterica enterica serovar Typhi
aggcugcggcacgcuaaacca

SEQ ID NO: 1720110 - RNA, 15 nt, Salmonella enterica enterica serovar Typhi
aggcugcgcguuuuc

SEQ ID NO: 1720111 - RNA, 23 nt, Salmonella enterica enterica serovar Typhi
aggcugccgacaacgccuccugc

SEQ ID NO: 1720112 - RNA, 17 nt, Salmonella enterica enterica serovar Typhi
aggcuggagagcaacgc

SEQ ID NO: 1720113 - RNA, 21 nt, Salmonella enterica enterica serovar Typhi
aggcucaucagcgccauugcu

SEQ ID NO: 1720114 - RNA, 20 nt, Salmonella enterica enterica serovar Typhi
aggcuccgagacucaaagaa

SEQ ID NO: 1720115 - RNA, 22 nt, Salmonella enterica enterica serovar Typhi
aggcuccgagacucaaagaaaa

SEQ ID NO: 1720116 - RNA, 22 nt, Salmonella enterica enterica serovar Typhi
aggcuacgguacugcccaccuu

SEQ ID NO: 1720117 - RNA, 20 nt, Salmonella enterica enterica serovar Typhi
aggcucuuauucaaucaauu

SEQ ID NO: 1720118 - RNA, 22 nt, Salmonella enterica enterica serovar Typhi
aggcugacaaagguugcgccaa

SEQ ID NO: 1720119 - RNA, 19 nt, Salmonella enterica enterica serovar Typhi
aggcucuccgguugcugau

SEQ ID NO: 1720120 - RNA, 21 nt, Salmonella enterica enterica serovar Typhi
aggcucgcauucgcgagccuu

SEQ ID NO: 1720121 - RNA, 14 nt, Salmonella enterica enterica serovar Typhi
aggcucgcaaauaa

SEQ ID NO: 1720122 - RNA, 18 nt, Salmonella enterica enterica serovar Typhi
aggcggcggcgggaaguu

SEQ ID NO: 1720123 - RNA, 13 nt, Salmonella enterica enterica serovar Typhi
aggcggcgccgcg

SEQ ID NO: 1720124 - RNA, 12 nt, Salmonella enterica enterica serovar Typhi
aggcggcgagcg

SEQ ID NO: 1720125 - RNA, 18 nt, Salmonella enterica enterica serovar Typhi
aggcgggcuuuuuuugcc

SEQ ID NO: 1720126 - RNA, 13 nt, Salmonella enterica enterica serovar Typhi
aggcguaugaaug

SEQ ID NO: 1720127 - RNA, 16 nt, Salmonella enterica enterica serovar Typhi
aggcguaaaauugccg

SEQ ID NO: 1720128 - RNA, 16 nt, Salmonella enterica enterica serovar Typhi
aggcguaaccgccauc

SEQ ID NO: 1720129 - RNA, 20 nt, Salmonella enterica enterica serovar Typhi
aggcguugugcugcggcaug

SEQ ID NO: 1720130 - RNA, 18 nt, Salmonella enterica enterica serovar Typhi
aggcguuuacgcugcuau

SEQ ID NO: 1720131 - RNA, 22 nt, Salmonella enterica enterica serovar Typhi
aggcuaacagcuggcuugccag

SEQ ID NO: 1720132 - RNA, 17 nt, Salmonella enterica enterica serovar Typhi
aggcuacccagacaagc

SEQ ID NO: 1720133 - RNA, 13 nt, Salmonella enterica enterica serovar Typhi
aggcuacccagac

SEQ ID NO: 1720134 - RNA, 18 nt, Salmonella enterica enterica serovar Typhi
aggcgucauagccgcgcg

SEQ ID NO: 1720135 - RNA, 19 nt, Salmonella enterica enterica serovar Typhi
aggcgucgaccgguccacc

SEQ ID NO: 1720136 - RNA, 18 nt, Salmonella enterica enterica serovar Typhi
aggcgugccccgcaacgc

SEQ ID NO: 1720137 - RNA, 15 nt, Salmonella enterica enterica serovar Typhi
aggcguucaugccuu

SEQ ID NO: 1720138 - RNA, 18 nt, Salmonella enterica enterica serovar Typhi
aggcguugaacauuucau

SEQ ID NO: 1720139 - RNA, 13 nt, Salmonella enterica enterica serovar Typhi
agggguauuuauc

SEQ ID NO: 1720140 - RNA, 13 nt, Salmonella enterica enterica serovar Typhi
agggcgcggcugg

SEQ ID NO: 1720141 - RNA, 14 nt, Salmonella enterica enterica serovar Typhi
agggcgcggcuggu

SEQ ID NO: 1720142 - RNA, 22 nt, Salmonella enterica enterica serovar Typhi
agggucgccgcgcccagcagca

SEQ ID NO: 1720143 - RNA, 23 nt, Salmonella enterica enterica serovar Typhi
agggugggcgcacaggccuucau

SEQ ID NO: 1720144 - RNA, 20 nt, Salmonella enterica enterica serovar Typhi
agggucgccgcgcccagcag

SEQ ID NO: 1720145 - RNA, 16 nt, Salmonella enterica enterica serovar Typhi
aggcuucaaccguuuc

SEQ ID NO: 1720146 - RNA, 13 nt, Salmonella enterica enterica serovar Typhi
aggcuuccagaag

SEQ ID NO: 1720147 - RNA, 23 nt, Salmonella enterica enterica serovar Typhi
aggcuguugaggaaauucugacg

SEQ ID NO: 1720148 - RNA, 17 nt, Salmonella enterica enterica serovar Typhi
aggcuguggcugucguu

SEQ ID NO: 1720149 - RNA, 16 nt, Salmonella enterica enterica serovar Typhi
agggaugacagaaagc

SEQ ID NO: 1720150 - RNA, 22 nt, Salmonella enterica enterica serovar Typhi
agggaucgauaauugcucaccc

SEQ ID NO: 1720151 - RNA, 22 nt, Salmonella enterica enterica serovar Typhi
agggauaagguugucaaaaaau

SEQ ID NO: 1720152 - RNA, 19 nt, Salmonella enterica enterica serovar Typhi
aggcuugccgcgccagacg

SEQ ID NO: 1720153 - RNA, 23 nt, Salmonella enterica enterica serovar Typhi
aggcuucgacaaacagcuaucca

SEQ ID NO: 1720154 - RNA, 14 nt, Salmonella enterica enterica serovar Typhi
aggcuuccggcagc

SEQ ID NO: 1720155 - RNA, 14 nt, Salmonella enterica enterica serovar Typhi
aggcuuccagauac

SEQ ID NO: 1720156 - RNA, 14 nt, Salmonella enterica enterica serovar Typhi
agggcgacgucaga

SEQ ID NO: 1720157 - RNA, 19 nt, Salmonella enterica enterica serovar Typhi
agggcgaggcccaugaaug

SEQ ID NO: 1720158 - RNA, 21 nt, Salmonella enterica enterica serovar Typhi
agggcgauaauccgcuccaca

SEQ ID NO: 1720159 - RNA, 18 nt, Salmonella enterica enterica serovar Typhi
agggcgaugccucacccc

SEQ ID NO: 1720160 - RNA, 17 nt, Salmonella enterica enterica serovar Typhi
agggcgaugccucaccc

SEQ ID NO: 1720161 - RNA, 23 nt, Salmonella enterica enterica serovar Typhi
agggcaugauuacagauauccac

SEQ ID NO: 1720162 - RNA, 21 nt, Salmonella enterica enterica serovar Typhi
agggccgcguuaacgccguug

SEQ ID NO: 1720163 - RNA, 13 nt, Salmonella enterica enterica serovar Typhi
agggcagcgagca

SEQ ID NO: 1720164 - RNA, 13 nt, Salmonella enterica enterica serovar Typhi
agguucccgcccu

SEQ ID NO: 1720165 - RNA, 15 nt, Salmonella enterica enterica serovar Typhi
agguucccgccgcca

SEQ ID NO: 1720166 - RNA, 19 nt, Salmonella enterica enterica serovar Typhi
agguucaauaugccaggca

SEQ ID NO: 1720167 - RNA, 23 nt, Salmonella enterica enterica serovar Typhi
agguuuucuaucgcuuuaaucag

SEQ ID NO: 1720168 - RNA, 21 nt, Salmonella enterica enterica serovar Typhi
agguuuucucauccagcuugc

SEQ ID NO: 1720169 - RNA, 15 nt, Salmonella enterica enterica serovar Typhi
aguaaaguuauucac

SEQ ID NO: 1720170 - RNA, 21 nt, Salmonella enterica enterica serovar Typhi
aguaacggcaguguuucccaa

SEQ ID NO: 1720171 - RNA, 18 nt, Salmonella enterica enterica serovar Typhi
aguaacugcaaaucuucg

SEQ ID NO: 1720172 - RNA, 16 nt, Salmonella enterica enterica serovar Typhi
aguaaaugaacguuuu

SEQ ID NO: 1720173 - RNA, 15 nt, Salmonella enterica enterica serovar Typhi
aguaaauagaaaaua

SEQ ID NO: 1720174 - RNA, 23 nt, Salmonella enterica enterica serovar Typhi
aguaaauagaaaauaauucuuaa

SEQ ID NO: 1720175 - RNA, 16 nt, Salmonella enterica enterica serovar Typhi
aguaagcuauuccugu

SEQ ID NO: 1720176 - RNA, 19 nt, Salmonella enterica enterica serovar Typhi
aguaauggacagguaaacc

SEQ ID NO: 1720177 - RNA, 17 nt, Salmonella enterica enterica serovar Typhi
aguaaugccuucugaaa

SEQ ID NO: 1720178 - RNA, 16 nt, Salmonella enterica enterica serovar Typhi
aguaauggacagguaa

SEQ ID NO: 1720179 - RNA, 18 nt, Salmonella enterica enterica serovar Typhi
aguacagggcgauuuccg

SEQ ID NO: 1720180 - RNA, 18 nt, Salmonella enterica enterica serovar Typhi
aguacagguuaugcaagu

SEQ ID NO: 1720181 - RNA, 22 nt, Salmonella enterica enterica serovar Typhi
aguacgcaccagcccagguuac

SEQ ID NO: 1720182 - RNA, 19 nt, Salmonella enterica enterica serovar Typhi
aguacggcgcgccaauaaa

SEQ ID NO: 1720183 - RNA, 23 nt, Salmonella enterica enterica serovar Typhi
aguacgguuugcggauuggauaa

SEQ ID NO: 1720184 - RNA, 23 nt, Salmonella enterica enterica serovar Typhi
aguacgauagcaauuaauaaaca

SEQ ID NO: 1720185 - RNA, 17 nt, Salmonella enterica enterica serovar Typhi
aguaccugacuuuucca

SEQ ID NO: 1720186 - RNA, 21 nt, Salmonella enterica enterica serovar Typhi
aguaccgggcaggaaaagacu

SEQ ID NO: 1720187 - RNA, 14 nt, Salmonella enterica enterica serovar Typhi
aguaccuccggauu

SEQ ID NO: 1720188 - RNA, 17 nt, Salmonella enterica enterica serovar Typhi
aguaccgccgccgggcc

SEQ ID NO: 1720189 - RNA, 17 nt, Salmonella enterica enterica serovar Typhi
agguguaucccuauucu

SEQ ID NO: 1720190 - RNA, 15 nt, Salmonella enterica enterica serovar Typhi
aggugcggcugggcg

SEQ ID NO: 1720191 - RNA, 19 nt, Salmonella enterica enterica serovar Typhi
aggugcggcugggcgaggc

SEQ ID NO: 1720192 - RNA, 18 nt, Salmonella enterica enterica serovar Typhi
aggugcggauaguccugc

SEQ ID NO: 1720193 - RNA, 19 nt, Salmonella enterica enterica serovar Typhi
agguucagcgugcguucau

SEQ ID NO: 1720194 - RNA, 16 nt, Salmonella enterica enterica serovar Typhi
agguuauucaggugga

SEQ ID NO: 1720195 - RNA, 17 nt, Salmonella enterica enterica serovar Typhi
agguuauucagguggau

SEQ ID NO: 1720196 - RNA, 20 nt, Salmonella enterica enterica serovar Typhi
agguuaguaaugccuucuga

SEQ ID NO: 1720197 - RNA, 16 nt, Salmonella enterica enterica serovar Typhi
agguuacguucaucag

SEQ ID NO: 1720198 - RNA, 19 nt, Salmonella enterica enterica serovar Typhi
agguuacucuuccaccauc

SEQ ID NO: 1720199 - RNA, 22 nt, Salmonella enterica enterica serovar Typhi
agguuaccgaaauaguaccucc

SEQ ID NO: 1720200 - RNA, 16 nt, Salmonella enterica enterica serovar Typhi
agguuagguuaaauag

SEQ ID NO: 1720201 - RNA, 14 nt, Salmonella enterica enterica serovar Typhi
agguuaguaaugcc

SEQ ID NO: 1720202 - RNA, 13 nt, Salmonella enterica enterica serovar Typhi
agguuaagugaca

SEQ ID NO: 1720203 - RNA, 16 nt, Salmonella enterica enterica serovar Typhi
agguuaauaacugcgc

SEQ ID NO: 1720204 - RNA, 21 nt, Salmonella enterica enterica serovar Typhi
agguuaauauacauucauuuu

SEQ ID NO: 1720205 - RNA, 22 nt, Salmonella enterica enterica serovar Typhi
agguguucagguaaaugaggac

SEQ ID NO: 1720206 - RNA, 16 nt, Salmonella enterica enterica serovar Typhi
agguguucagguaaau

SEQ ID NO: 1720207 - RNA, 20 nt, Salmonella enterica enterica serovar Typhi
aggucagauccuuuuucugc

SEQ ID NO: 1720208 - RNA, 16 nt, Salmonella enterica enterica serovar Typhi
aggucagcaguuuuuc

SEQ ID NO: 1720209 - RNA, 19 nt, Salmonella enterica enterica serovar Typhi
aggucacgccggaaaucac

SEQ ID NO: 1720210 - RNA, 15 nt, Salmonella enterica enterica serovar Typhi
aggucacaucaucgc

SEQ ID NO: 1720211 - RNA, 18 nt, Salmonella enterica enterica serovar Typhi
agguauucuaacugauca

SEQ ID NO: 1720212 - RNA, 15 nt, Salmonella enterica enterica serovar Typhi
agguauugauuuuua

SEQ ID NO: 1720213 - RNA, 21 nt, Salmonella enterica enterica serovar Typhi
agguauugauuuuuaaaaugu

SEQ ID NO: 1720214 - RNA, 14 nt, Salmonella enterica enterica serovar Typhi
agguauuaaauaca

SEQ ID NO: 1720215 - RNA, 20 nt, Salmonella enterica enterica serovar Typhi
agguaaaggucguuaggcca

SEQ ID NO: 1720216 - RNA, 22 nt, Salmonella enterica enterica serovar Typhi
agguaaagaucggcuuauaaaa

SEQ ID NO: 1720217 - RNA, 23 nt, Salmonella enterica enterica serovar Typhi
agguaaagccgccauccggcauu

SEQ ID NO: 1720218 - RNA, 15 nt, Salmonella enterica enterica serovar Typhi
aggucugacaacuau

SEQ ID NO: 1720219 - RNA, 14 nt, Salmonella enterica enterica serovar Typhi
aggucgacauuuaa

SEQ ID NO: 1720220 - RNA, 17 nt, Salmonella enterica enterica serovar Typhi
aggugaaauaggggaga

SEQ ID NO: 1720221 - RNA, 20 nt, Salmonella enterica enterica serovar Typhi
aggucuugccaacaaagguu

SEQ ID NO: 1720222 - RNA, 23 nt, Salmonella enterica enterica serovar Typhi
aggucugagauaauacauaucau

SEQ ID NO: 1720223 - RNA, 15 nt, Salmonella enterica enterica serovar Typhi
agucagaggaauucu

SEQ ID NO: 1720224 - RNA, 16 nt, Salmonella enterica enterica serovar Typhi
agucacuuacuuucuu

SEQ ID NO: 1720225 - RNA, 17 nt, Salmonella enterica enterica serovar Typhi
agucacuuacuuucuug

SEQ ID NO: 1720226 - RNA, 20 nt, Salmonella enterica enterica serovar Typhi
agucacuagcacuacggcaa

SEQ ID NO: 1720227 - RNA, 20 nt, Salmonella enterica enterica serovar Typhi
agucacggcucgaucccgac

SEQ ID NO: 1720228 - RNA, 23 nt, Salmonella enterica enterica serovar Typhi
agucacccugcaacauuccuugc

SEQ ID NO: 1720229 - RNA, 23 nt, Salmonella enterica enterica serovar Typhi
agucaacucaugccgcugcuggc

SEQ ID NO: 1720230 - RNA, 16 nt, Salmonella enterica enterica serovar Typhi
aguagaccaacaauca

SEQ ID NO: 1720231 - RNA, 16 nt, Salmonella enterica enterica serovar Typhi
aguacuggaauaucua

SEQ ID NO: 1720232 - RNA, 17 nt, Salmonella enterica enterica serovar Typhi
aguccauaccguuucaa

SEQ ID NO: 1720233 - RNA, 15 nt, Salmonella enterica enterica serovar Typhi
aguccacuuucugua

SEQ ID NO: 1720234 - RNA, 19 nt, Salmonella enterica enterica serovar Typhi
agucauuacccaauaauga

SEQ ID NO: 1720235 - RNA, 20 nt, Salmonella enterica enterica serovar Typhi
agucauuacccgugagcuac

SEQ ID NO: 1720236 - RNA, 15 nt, Salmonella enterica enterica serovar Typhi
agucaucauaauuca

SEQ ID NO: 1720237 - RNA, 13 nt, Salmonella enterica enterica serovar Typhi
agucauccuuccc

SEQ ID NO: 1720238 - RNA, 14 nt, Salmonella enterica enterica serovar Typhi
agucauggcuuuua

SEQ ID NO: 1720239 - RNA, 18 nt, Salmonella enterica enterica serovar Typhi
agucaugaaaucuaucug

SEQ ID NO: 1720240 - RNA, 19 nt, Salmonella enterica enterica serovar Typhi
agucaucgccuucauccgc

SEQ ID NO: 1720241 - RNA, 18 nt, Salmonella enterica enterica serovar Typhi
agucaucugccaguuauc

SEQ ID NO: 1720242 - RNA, 18 nt, Salmonella enterica enterica serovar Typhi
agucaucuguucaacuuu

SEQ ID NO: 1720243 - RNA, 21 nt, Salmonella enterica enterica serovar Typhi
agucagcucgguggcgguauc

SEQ ID NO: 1720244 - RNA, 15 nt, Salmonella enterica enterica serovar Typhi
agucaguuuaugacu

SEQ ID NO: 1720245 - RNA, 16 nt, Salmonella enterica enterica serovar Typhi
agucauaccuguuccu

SEQ ID NO: 1720246 - RNA, 23 nt, Salmonella enterica enterica serovar Typhi
agucauaccuguuccucuuuccc

SEQ ID NO: 1720247 - RNA, 14 nt, Salmonella enterica enterica serovar Typhi
agucauaauuaaaa

SEQ ID NO: 1720248 - RNA, 14 nt, Salmonella enterica enterica serovar Typhi
agugaaaagcugga

SEQ ID NO: 1720249 - RNA, 11 nt, Salmonella enterica enterica serovar Typhi
agucuuccugc

SEQ ID NO: 1720250 - RNA, 15 nt, Salmonella enterica enterica serovar Typhi
agucucaggagugaa

SEQ ID NO: 1720251 - RNA, 18 nt, Salmonella enterica enterica serovar Typhi
agucuggguuagcuguau

SEQ ID NO: 1720252 - RNA, 20 nt, Salmonella enterica enterica serovar Typhi
agucuggccaccgauaaaaa

SEQ ID NO: 1720253 - RNA, 14 nt, Salmonella enterica enterica serovar Typhi
agucugugagaaaa

SEQ ID NO: 1720254 - RNA, 19 nt, Salmonella enterica enterica serovar Typhi
agucuggauauaaaccgga

SEQ ID NO: 1720255 - RNA, 22 nt, Salmonella enterica enterica serovar Typhi
agucuuaauuugcuguuuuuug

SEQ ID NO: 1720256 - RNA, 16 nt, Salmonella enterica enterica serovar Typhi
agugacagaggaauga

SEQ ID NO: 1720257 - RNA, 14 nt, Salmonella enterica enterica serovar Typhi
agugaauuuaaacg

SEQ ID NO: 1720258 - RNA, 19 nt, Salmonella enterica enterica serovar Typhi
agugaauuaugaccaaugu

SEQ ID NO: 1720259 - RNA, 12 nt, Salmonella enterica enterica serovar Typhi
agugaaauaaau

SEQ ID NO: 1720260 - RNA, 17 nt, Salmonella enterica enterica serovar Typhi
agugacgccaguuccca

SEQ ID NO: 1720261 - RNA, 18 nt, Salmonella enterica enterica serovar Typhi
agugacgaggccuguccc

SEQ ID NO: 1720262 - RNA, 20 nt, Salmonella enterica enterica serovar Typhi
agugacgguuuucacuggca

SEQ ID NO: 1720263 - RNA, 20 nt, Salmonella enterica enterica serovar Typhi
agugacccgccgccagcacc

SEQ ID NO: 1720264 - RNA, 13 nt, Salmonella enterica enterica serovar Typhi
agugacgccgcca

SEQ ID NO: 1720265 - RNA, 22 nt, Salmonella enterica enterica serovar Typhi
agugacguggcuucgccgagaa

SEQ ID NO: 1720266 - RNA, 23 nt, Salmonella enterica enterica serovar Typhi
agugacguuaucugucagccgca

SEQ ID NO: 1720267 - RNA, 22 nt, Salmonella enterica enterica serovar Typhi
agugacuucugcucgguaaaaa

SEQ ID NO: 1720268 - RNA, 23 nt, Salmonella enterica enterica serovar Typhi
agucguggcggauucuacugguu

SEQ ID NO: 1720269 - RNA, 15 nt, Salmonella enterica enterica serovar Typhi
agucguuauaauccu

SEQ ID NO: 1720270 - RNA, 16 nt, Salmonella enterica enterica serovar Typhi
agucguuauccagauc

SEQ ID NO: 1720271 - RNA, 20 nt, Salmonella enterica enterica serovar Typhi
agucguuucuauuauugauc

SEQ ID NO: 1720272 - RNA, 20 nt, Salmonella enterica enterica serovar Typhi
agucgucauggcguaaaucg

SEQ ID NO: 1720273 - RNA, 16 nt, Salmonella enterica enterica serovar Typhi
agucguagaacaccac

SEQ ID NO: 1720274 - RNA, 14 nt, Salmonella enterica enterica serovar Typhi
agucgccagaaggc

SEQ ID NO: 1720275 - RNA, 13 nt, Salmonella enterica enterica serovar Typhi
agucgccaggauc

SEQ ID NO: 1720276 - RNA, 12 nt, Salmonella enterica enterica serovar Typhi
agucgccaggca

SEQ ID NO: 1720277 - RNA, 17 nt, Salmonella enterica enterica serovar Typhi
agucgccaggcaagguu

SEQ ID NO: 1720278 - RNA, 17 nt, Salmonella enterica enterica serovar Typhi
agucccuccgcuuccac

SEQ ID NO: 1720279 - RNA, 14 nt, Salmonella enterica enterica serovar Typhi
aguccgacuuuuuu

SEQ ID NO: 1720280 - RNA, 22 nt, Salmonella enterica enterica serovar Typhi
aguccgaagaagcgugucucuu

SEQ ID NO: 1720281 - RNA, 18 nt, Salmonella enterica enterica serovar Typhi
agucgaaauuuucuucuu

SEQ ID NO: 1720282 - RNA, 14 nt, Salmonella enterica enterica serovar Typhi
aguccugcucaugc

SEQ ID NO: 1720283 - RNA, 13 nt, Salmonella enterica enterica serovar Typhi
aguccuguaucuu

SEQ ID NO: 1720284 - RNA, 18 nt, Salmonella enterica enterica serovar Typhi
aguccuucaacccacuuu

SEQ ID NO: 1720285 - RNA, 20 nt, Salmonella enterica enterica serovar Typhi
agugaggaccguacucagau

SEQ ID NO: 1720286 - RNA, 20 nt, Salmonella enterica enterica serovar Typhi
agugaguaacguuaauacau

SEQ ID NO: 1720287 - RNA, 20 nt, Salmonella enterica enterica serovar Typhi
agugauaaagcacagcccca

SEQ ID NO: 1720288 - RNA, 13 nt, Salmonella enterica enterica serovar Typhi
agugauaaagcac

SEQ ID NO: 1720289 - RNA, 20 nt, Salmonella enterica enterica serovar Typhi
aguggcgcaauaacugacuc

SEQ ID NO: 1720290 - RNA, 21 nt, Salmonella enterica enterica serovar Typhi
aguggcgccgcaaugccgccu

SEQ ID NO: 1720291 - RNA, 15 nt, Salmonella enterica enterica serovar Typhi
aguggcggcaaaaaa

SEQ ID NO: 1720292 - RNA, 23 nt, Salmonella enterica enterica serovar Typhi
aguggaaaacagcauaauaaagc

SEQ ID NO: 1720293 - RNA, 15 nt, Salmonella enterica enterica serovar Typhi
agugggcuaugaaga

SEQ ID NO: 1720294 - RNA, 22 nt, Salmonella enterica enterica serovar Typhi
aguguaaaaauuuuugaucugc

SEQ ID NO: 1720295 - RNA, 13 nt, Salmonella enterica enterica serovar Typhi
agugucgccauaa

SEQ ID NO: 1720296 - RNA, 15 nt, Salmonella enterica enterica serovar Typhi
aguguguaccagcag

SEQ ID NO: 1720297 - RNA, 22 nt, Salmonella enterica enterica serovar Typhi
aguguggaaaacagcgccggca

SEQ ID NO: 1720298 - RNA, 21 nt, Salmonella enterica enterica serovar Typhi
aguguuggaugaaccauauca

SEQ ID NO: 1720299 - RNA, 18 nt, Salmonella enterica enterica serovar Typhi
aguguuucccaacaaugc

SEQ ID NO: 1720300 - RNA, 23 nt, Salmonella enterica enterica serovar Typhi
aguuaacagaaugcugaacagcc

SEQ ID NO: 1720301 - RNA, 21 nt, Salmonella enterica enterica serovar Typhi
aguuaacgcguuaaucacuac

SEQ ID NO: 1720302 - RNA, 14 nt, Salmonella enterica enterica serovar Typhi
aguuaaauaaacaa

SEQ ID NO: 1720303 - RNA, 15 nt, Salmonella enterica enterica serovar Typhi
aguuaaauaaacaaa

SEQ ID NO: 1720304 - RNA, 15 nt, Salmonella enterica enterica serovar Typhi
aguugcuuaccuugu

SEQ ID NO: 1720305 - RNA, 12 nt, Salmonella enterica enterica serovar Typhi
aguugcugcauc

SEQ ID NO: 1720306 - RNA, 21 nt, Salmonella enterica enterica serovar Typhi
aguuggaaccaaacaccagau

SEQ ID NO: 1720307 - RNA, 16 nt, Salmonella enterica enterica serovar Typhi
aguugaccacaucaaa

SEQ ID NO: 1720308 - RNA, 17 nt, Salmonella enterica enterica serovar Typhi
aguugcggcaacgugaa

SEQ ID NO: 1720309 - RNA, 14 nt, Salmonella enterica enterica serovar Typhi
aguugcgccacugc

SEQ ID NO: 1720310 - RNA, 15 nt, Salmonella enterica enterica serovar Typhi
aguucgcugaggcgu

SEQ ID NO: 1720311 - RNA, 18 nt, Salmonella enterica enterica serovar Typhi
aguugaaaggaaaggucg

SEQ ID NO: 1720312 - RNA, 13 nt, Salmonella enterica enterica serovar Typhi
aguucgccgccgg

SEQ ID NO: 1720313 - RNA, 19 nt, Salmonella enterica enterica serovar Typhi
aguucgccuucuucaucuu

SEQ ID NO: 1720314 - RNA, 14 nt, Salmonella enterica enterica serovar Typhi
aguucgacuuaacg

SEQ ID NO: 1720315 - RNA, 23 nt, Salmonella enterica enterica serovar Typhi
aguuauaaauccccgccgccauc

SEQ ID NO: 1720316 - RNA, 12 nt, Salmonella enterica enterica serovar Typhi
aguuaauaauga

SEQ ID NO: 1720317 - RNA, 16 nt, Salmonella enterica enterica serovar Typhi
aguuagcuuuuuuaug

SEQ ID NO: 1720318 - RNA, 14 nt, Salmonella enterica enterica serovar Typhi
aguuaaucagcgcc

SEQ ID NO: 1720319 - RNA, 23 nt, Salmonella enterica enterica serovar Typhi
aguucccuucuccucaacagaca

SEQ ID NO: 1720320 - RNA, 18 nt, Salmonella enterica enterica serovar Typhi
aguuccgcaauccuggcu

SEQ ID NO: 1720321 - RNA, 13 nt, Salmonella enterica enterica serovar Typhi
aguuccgccagac

SEQ ID NO: 1720322 - RNA, 14 nt, Salmonella enterica enterica serovar Typhi
aguucccuacucuc

SEQ ID NO: 1720323 - RNA, 24 nt, Salmonella enterica enterica serovar Typhi
aguuccugugcggaauagccuauc

SEQ ID NO: 1720324 - RNA, 12 nt, Salmonella enterica enterica serovar Typhi
aguuccuccugg

SEQ ID NO: 1720325 - RNA, 17 nt, Salmonella enterica enterica serovar Typhi
aguucaggcacgugcau

SEQ ID NO: 1720326 - RNA, 17 nt, Salmonella enterica enterica serovar Typhi
aguucauagccguggcu

SEQ ID NO: 1720327 - RNA, 11 nt, Salmonella enterica enterica serovar Typhi
aguucccagcg

SEQ ID NO: 1720328 - RNA, 17 nt, Salmonella enterica enterica serovar Typhi
aguucccagcgguggau

SEQ ID NO: 1720329 - RNA, 20 nt, Salmonella enterica enterica serovar Typhi
aguucaucauccugcagggu

SEQ ID NO: 1720330 - RNA, 19 nt, Salmonella enterica enterica serovar Typhi
auaacucgaauuguuaaaa

SEQ ID NO: 1720331 - RNA, 13 nt, Salmonella enterica enterica serovar Typhi
auaacguuuucag

SEQ ID NO: 1720332 - RNA, 15 nt, Salmonella enterica enterica serovar Typhi
auaacucaauagcgg

SEQ ID NO: 1720333 - RNA, 14 nt, Salmonella enterica enterica serovar Typhi
auaacuuuccugcc

SEQ ID NO: 1720334 - RNA, 16 nt, Salmonella enterica enterica serovar Typhi
auaagaaaaaacuggu

SEQ ID NO: 1720335 - RNA, 20 nt, Salmonella enterica enterica serovar Typhi
auaacgaccaaacaagaucg

SEQ ID NO: 1720336 - RNA, 15 nt, Salmonella enterica enterica serovar Typhi
auaacgaaaaggguc

SEQ ID NO: 1720337 - RNA, 20 nt, Salmonella enterica enterica serovar Typhi
auaaauuugucagacaugau

SEQ ID NO: 1720338 - RNA, 14 nt, Salmonella enterica enterica serovar Typhi
auaaauuucagugg

SEQ ID NO: 1720339 - RNA, 14 nt, Salmonella enterica enterica serovar Typhi
auaacgauaaauuu

SEQ ID NO: 1720340 - RNA, 15 nt, Salmonella enterica enterica serovar Typhi
auaacgaugauuauu

SEQ ID NO: 1720341 - RNA, 22 nt, Salmonella enterica enterica serovar Typhi
auaacgcaggcgauagccccag

SEQ ID NO: 1720342 - RNA, 22 nt, Salmonella enterica enterica serovar Typhi
auaacgccgaugccgccgacaa

SEQ ID NO: 1720343 - RNA, 19 nt, Salmonella enterica enterica serovar Typhi
auaacgccgcccccaugcc

SEQ ID NO: 1720344 - RNA, 15 nt, Salmonella enterica enterica serovar Typhi
auaacguuuccuuau

SEQ ID NO: 1720345 - RNA, 14 nt, Salmonella enterica enterica serovar Typhi
auaacuauaauugc

SEQ ID NO: 1720346 - RNA, 15 nt, Salmonella enterica enterica serovar Typhi
auaagcgcucaggca

SEQ ID NO: 1720347 - RNA, 19 nt, Salmonella enterica enterica serovar Typhi
auaagcgccgaguagcuga

SEQ ID NO: 1720348 - RNA, 18 nt, Salmonella enterica enterica serovar Typhi
auaagccgcguucugucg

SEQ ID NO: 1720349 - RNA, 20 nt, Salmonella enterica enterica serovar Typhi
auaagccugagcgcgaggca

SEQ ID NO: 1720350 - RNA, 17 nt, Salmonella enterica enterica serovar Typhi
auaagcacaccauuuca

SEQ ID NO: 1720351 - RNA, 18 nt, Salmonella enterica enterica serovar Typhi
auaagcacaccauuucac

SEQ ID NO: 1720352 - RNA, 21 nt, Salmonella enterica enterica serovar Typhi
auaagcacaccauuucacaaa

SEQ ID NO: 1720353 - RNA, 11 nt, Salmonella enterica enterica serovar Typhi
auaagcagaac

SEQ ID NO: 1720354 - RNA, 18 nt, Salmonella enterica enterica serovar Typhi
auaagauuuacaacagau

SEQ ID NO: 1720355 - RNA, 19 nt, Salmonella enterica enterica serovar Typhi
auaagcaacugggcuugca

SEQ ID NO: 1720356 - RNA, 23 nt, Salmonella enterica enterica serovar Typhi
auaaggcggacaacgcauauuau

SEQ ID NO: 1720357 - RNA, 16 nt, Salmonella enterica enterica serovar Typhi
auaaggcgauaccuaa

SEQ ID NO: 1720358 - RNA, 18 nt, Salmonella enterica enterica serovar Typhi
auaaggguaagcaauaug

SEQ ID NO: 1720359 - RNA, 22 nt, Salmonella enterica enterica serovar Typhi
auaagguaacgcgaaaaaagau

SEQ ID NO: 1720360 - RNA, 14 nt, Salmonella enterica enterica serovar Typhi
auaagggcucagca

SEQ ID NO: 1720361 - RNA, 15 nt, Salmonella enterica enterica serovar Typhi
auaagggcucagcau

SEQ ID NO: 1720362 - RNA, 22 nt, Salmonella enterica enterica serovar Typhi
auaagcguagcgccaucaggcu

SEQ ID NO: 1720363 - RNA, 15 nt, Salmonella enterica enterica serovar Typhi
auaagcgucugcaau

SEQ ID NO: 1720364 - RNA, 21 nt, Salmonella enterica enterica serovar Typhi
auaagcuaguaaagaaauuuu

SEQ ID NO: 1720365 - RNA, 15 nt, Salmonella enterica enterica serovar Typhi
auaaugucauuacua

SEQ ID NO: 1720366 - RNA, 12 nt, Salmonella enterica enterica serovar Typhi
auaaugcuuacg

SEQ ID NO: 1720367 - RNA, 14 nt, Salmonella enterica enterica serovar Typhi
auaaugcgccacca

SEQ ID NO: 1720368 - RNA, 16 nt, Salmonella enterica enterica serovar Typhi
auaaugcgccaccacu

SEQ ID NO: 1720369 - RNA, 11 nt, Salmonella enterica enterica serovar Typhi
auaaugcaauc

SEQ ID NO: 1720370 - RNA, 21 nt, Salmonella enterica enterica serovar Typhi
auaaugcaaucaguuccaauc

SEQ ID NO: 1720371 - RNA, 16 nt, Salmonella enterica enterica serovar Typhi
auaaugcaaugccuaa

SEQ ID NO: 1720372 - RNA, 16 nt, Salmonella enterica enterica serovar Typhi
auaaucggccaggaug

SEQ ID NO: 1720373 - RNA, 16 nt, Salmonella enterica enterica serovar Typhi
auaaucgcgagaaaau

SEQ ID NO: 1720374 - RNA, 18 nt, Salmonella enterica enterica serovar Typhi
auaaucggcgucauuuuc

SEQ ID NO: 1720375 - RNA, 17 nt, Salmonella enterica enterica serovar Typhi
auaaucgguagcacuuu

SEQ ID NO: 1720376 - RNA, 20 nt, Salmonella enterica enterica serovar Typhi
auaauccggaauaagaauau

SEQ ID NO: 1720377 - RNA, 23 nt, Salmonella enterica enterica serovar Typhi
auaauuaacauuuaagaaacaau

SEQ ID NO: 1720378 - RNA, 15 nt, Salmonella enterica enterica serovar Typhi
auaauuaauaauggu

SEQ ID NO: 1720379 - RNA, 13 nt, Salmonella enterica enterica serovar Typhi
auaagucauauca

SEQ ID NO: 1720380 - RNA, 21 nt, Salmonella enterica enterica serovar Typhi
auaauagacaacaucccagaa

SEQ ID NO: 1720381 - RNA, 22 nt, Salmonella enterica enterica serovar Typhi
auaauaucgaauggggaaauaa

SEQ ID NO: 1720382 - RNA, 16 nt, Salmonella enterica enterica serovar Typhi
auaauagcugaaaaga

SEQ ID NO: 1720383 - RNA, 20 nt, Salmonella enterica enterica serovar Typhi
auaauacuuaauucauaacg

SEQ ID NO: 1720384 - RNA, 13 nt, Salmonella enterica enterica serovar Typhi
auaauaugcucaa

SEQ ID NO: 1720385 - RNA, 20 nt, Salmonella enterica enterica serovar Typhi
auaauaucguuaagccuuca

SEQ ID NO: 1720386 - RNA, 20 nt, Salmonella enterica enterica serovar Typhi
auaauauguuccacaaucaa

SEQ ID NO: 1720387 - RNA, 16 nt, Salmonella enterica enterica serovar Typhi
auaauauuaucauaau

SEQ ID NO: 1720388 - RNA, 15 nt, Salmonella enterica enterica serovar Typhi
auaauccagacaaau

SEQ ID NO: 1720389 - RNA, 16 nt, Salmonella enterica enterica serovar Typhi
auaaaacgcucucuuu

SEQ ID NO: 1720390 - RNA, 20 nt, Salmonella enterica enterica serovar Typhi
auaaaagagagcgccaaaaa

SEQ ID NO: 1720391 - RNA, 21 nt, Salmonella enterica enterica serovar Typhi
auaaaagagagcgccaaaaag

SEQ ID NO: 1720392 - RNA, 18 nt, Salmonella enterica enterica serovar Typhi
auaaaacugccgucaauu

SEQ ID NO: 1720393 - RNA, 21 nt, Salmonella enterica enterica serovar Typhi
auaaaagggaucuacggaucc

SEQ ID NO: 1720394 - RNA, 21 nt, Salmonella enterica enterica serovar Typhi
auaaaagccgccguguuuuuu

SEQ ID NO: 1720395 - RNA, 21 nt, Salmonella enterica enterica serovar Typhi
auaaaaagugcgcacucagaa

SEQ ID NO: 1720396 - RNA, 13 nt, Salmonella enterica enterica serovar Typhi
auaaaaagcacau

SEQ ID NO: 1720397 - RNA, 14 nt, Salmonella enterica enterica serovar Typhi
auaaaaauagcugg

SEQ ID NO: 1720398 - RNA, 20 nt, Salmonella enterica enterica serovar Typhi
auaaaacauuccugacauuu

SEQ ID NO: 1720399 - RNA, 12 nt, Salmonella enterica enterica serovar Typhi
auaaaaauuccc

SEQ ID NO: 1720400 - RNA, 14 nt, Salmonella enterica enterica serovar Typhi
auaaaaaucgggua

SEQ ID NO: 1720401 - RNA, 19 nt, Salmonella enterica enterica serovar Typhi
aguuuuugcgccagcgcaa

SEQ ID NO: 1720402 - RNA, 14 nt, Salmonella enterica enterica serovar Typhi
aguuuuucaaucuu

SEQ ID NO: 1720403 - RNA, 12 nt, Salmonella enterica enterica serovar Typhi
aguuuuuaaaca

SEQ ID NO: 1720404 - RNA, 20 nt, Salmonella enterica enterica serovar Typhi
aguuuugcuucaugcacaaa

SEQ ID NO: 1720405 - RNA, 16 nt, Salmonella enterica enterica serovar Typhi
aguuuuuaaacaacau

SEQ ID NO: 1720406 - RNA, 13 nt, Salmonella enterica enterica serovar Typhi
aguuuuuuuaaaa

SEQ ID NO: 1720407 - RNA, 20 nt, Salmonella enterica enterica serovar Typhi
aguuuuuuuaagaaggucag

SEQ ID NO: 1720408 - RNA, 18 nt, Salmonella enterica enterica serovar Typhi
auaaaaaagccguauuuu

SEQ ID NO: 1720409 - RNA, 17 nt, Salmonella enterica enterica serovar Typhi
aguuguacaaacuguga

SEQ ID NO: 1720410 - RNA, 15 nt, Salmonella enterica enterica serovar Typhi
aguuggugggugaug

SEQ ID NO: 1720411 - RNA, 13 nt, Salmonella enterica enterica serovar Typhi
aguugguucccag

SEQ ID NO: 1720412 - RNA, 17 nt, Salmonella enterica enterica serovar Typhi
aguugguuguagcacag

SEQ ID NO: 1720413 - RNA, 15 nt, Salmonella enterica enterica serovar Typhi
auaaacgccugacga

SEQ ID NO: 1720414 - RNA, 19 nt, Salmonella enterica enterica serovar Typhi
auaaacgcgccaaguaaau

SEQ ID NO: 1720415 - RNA, 18 nt, Salmonella enterica enterica serovar Typhi
auaaacggcgcguccagc

SEQ ID NO: 1720416 - RNA, 14 nt, Salmonella enterica enterica serovar Typhi
auaaacgggaagua

SEQ ID NO: 1720417 - RNA, 22 nt, Salmonella enterica enterica serovar Typhi
auaaaaguugcucggcaauuuc

SEQ ID NO: 1720418 - RNA, 17 nt, Salmonella enterica enterica serovar Typhi
auaaacagcguuuucau

SEQ ID NO: 1720419 - RNA, 16 nt, Salmonella enterica enterica serovar Typhi
auaaacagguaaaaca

SEQ ID NO: 1720420 - RNA, 17 nt, Salmonella enterica enterica serovar Typhi
auaaagauauucuccuc

SEQ ID NO: 1720421 - RNA, 22 nt, Salmonella enterica enterica serovar Typhi
auaaagauauugucgcccugca

SEQ ID NO: 1720422 - RNA, 22 nt, Salmonella enterica enterica serovar Typhi
auaaagcugguugagauccaua

SEQ ID NO: 1720423 - RNA, 19 nt, Salmonella enterica enterica serovar Typhi
auaaacuucaauucagaaa

SEQ ID NO: 1720424 - RNA, 14 nt, Salmonella enterica enterica serovar Typhi
auaaacuggagcac

SEQ ID NO: 1720425 - RNA, 18 nt, Salmonella enterica enterica serovar Typhi
auaaagaaagcauuaaau

SEQ ID NO: 1720426 - RNA, 21 nt, Salmonella enterica enterica serovar Typhi
auaaagaaaguagaucaccag

SEQ ID NO: 1720427 - RNA, 19 nt, Salmonella enterica enterica serovar Typhi
auaaagaacggccucccaa

SEQ ID NO: 1720428 - RNA, 19 nt, Salmonella enterica enterica serovar Typhi
auaaauucugucucaauaa

SEQ ID NO: 1720429 - RNA, 15 nt, Salmonella enterica enterica serovar Typhi
auaaauucgaaauaa

SEQ ID NO: 1720430 - RNA, 23 nt, Salmonella enterica enterica serovar Typhi
auaaauauugcaacgaucccuaa

SEQ ID NO: 1720431 - RNA, 16 nt, Salmonella enterica enterica serovar Typhi
auaaaugaauuauuuu

SEQ ID NO: 1720432 - RNA, 18 nt, Salmonella enterica enterica serovar Typhi
auaaaugaauuauuuuuu

SEQ ID NO: 1720433 - RNA, 13 nt, Salmonella enterica enterica serovar Typhi
auaaaucagcaca

SEQ ID NO: 1720434 - RNA, 21 nt, Salmonella enterica enterica serovar Typhi
auaaagugcugaacaauaaca

SEQ ID NO: 1720435 - RNA, 14 nt, Salmonella enterica enterica serovar Typhi
auaaaggggugcuu

SEQ ID NO: 1720436 - RNA, 20 nt, Salmonella enterica enterica serovar Typhi
auaaagggugcgcaaauugg

SEQ ID NO: 1720437 - RNA, 16 nt, Salmonella enterica enterica serovar Typhi
auaaagguauagugga

SEQ ID NO: 1720438 - RNA, 23 nt, Salmonella enterica enterica serovar Typhi
auaaaguuuauuugaauagucaa

SEQ ID NO: 1720439 - RNA, 13 nt, Salmonella enterica enterica serovar Typhi
auaaaguuuauuu

SEQ ID NO: 1720440 - RNA, 14 nt, Salmonella enterica enterica serovar Typhi
aucauacugaacuc

SEQ ID NO: 1720441 - RNA, 22 nt, Salmonella enterica enterica serovar Typhi
aaaacguuauuggcaggaugua

SEQ ID NO: 1720442 - RNA, 14 nt, Salmonella enterica enterica serovar Typhi
aucauaaucacuau

SEQ ID NO: 1720443 - RNA, 12 nt, Salmonella enterica enterica serovar Typhi
aucaucuaccuu

SEQ ID NO: 1720444 - RNA, 12 nt, Salmonella enterica enterica serovar Typhi
aucaucuucacu

SEQ ID NO: 1720445 - RNA, 14 nt, Salmonella enterica enterica serovar Typhi
aucaucuucacuuc

SEQ ID NO: 1720446 - RNA, 21 nt, Salmonella enterica enterica serovar Typhi
aucaucuucacuucacaaaca

SEQ ID NO: 1720447 - RNA, 19 nt, Salmonella enterica enterica serovar Typhi
aucaucuucacuucacaaa

SEQ ID NO: 1720448 - RNA, 21 nt, Salmonella enterica enterica serovar Typhi
aucaucgguuacuccuuauuu

SEQ ID NO: 1720449 - RNA, 18 nt, Salmonella enterica enterica serovar Typhi
aucaucuauagacgcuga

SEQ ID NO: 1720450 - RNA, 21 nt, Salmonella enterica enterica serovar Typhi
aucaugcccaaaccugagcau

SEQ ID NO: 1720451 - RNA, 14 nt, Salmonella enterica enterica serovar Typhi
aucaugaaaaauau

SEQ ID NO: 1720452 - RNA, 17 nt, Salmonella enterica enterica serovar Typhi
aucaugacagauuuaau

SEQ ID NO: 1720453 - RNA, 11 nt, Salmonella enterica enterica serovar Typhi
aaaacugcacc

SEQ ID NO: 1720454 - RNA, 17 nt, Salmonella enterica enterica serovar Typhi
aaaacugacuaaaaauc

SEQ ID NO: 1720455 - RNA, 21 nt, Salmonella enterica enterica serovar Typhi
aucaugguugacuuacaaaaa

SEQ ID NO: 1720456 - RNA, 21 nt, Salmonella enterica enterica serovar Typhi
aaaacucgccgcgaacaaagc

SEQ ID NO: 1720457 - RNA, 19 nt, Salmonella enterica enterica serovar Typhi
aucaugggcucaucaaaca

SEQ ID NO: 1720458 - RNA, 16 nt, Salmonella enterica enterica serovar Typhi
aucauggguaauuccg

SEQ ID NO: 1720459 - RNA, 22 nt, Salmonella enterica enterica serovar Typhi
aucauggcuugaucgcgcagca

SEQ ID NO: 1720460 - RNA, 20 nt, Salmonella enterica enterica serovar Typhi
aucaugcugcaccgcaucaa

SEQ ID NO: 1720461 - RNA, 15 nt, Salmonella enterica enterica serovar Typhi
aaaacuggaaaacaa

SEQ ID NO: 1720462 - RNA, 22 nt, Salmonella enterica enterica serovar Typhi
aaaacuggaaaacaagugcaga

SEQ ID NO: 1720463 - RNA, 17 nt, Salmonella enterica enterica serovar Typhi
aaaacugucccugaugu

SEQ ID NO: 1720464 - RNA, 15 nt, Salmonella enterica enterica serovar Typhi
aaaagaacucacuca

SEQ ID NO: 1720465 - RNA, 21 nt, Salmonella enterica enterica serovar Typhi
aaaagaauagccggauaaaau

SEQ ID NO: 1720466 - RNA, 23 nt, Salmonella enterica enterica serovar Typhi
aaaagaaugucccaguaauaucg

SEQ ID NO: 1720467 - RNA, 15 nt, Salmonella enterica enterica serovar Typhi
aucauugauacugua

SEQ ID NO: 1720468 - RNA, 17 nt, Salmonella enterica enterica serovar Typhi
auccaacgcggaaaugu

SEQ ID NO: 1720469 - RNA, 18 nt, Salmonella enterica enterica serovar Typhi
auccaacgcggaaaugua

SEQ ID NO: 1720470 - RNA, 19 nt, Salmonella enterica enterica serovar Typhi
auccacaguaaccccauac

SEQ ID NO: 1720471 - RNA, 20 nt, Salmonella enterica enterica serovar Typhi
auccacauuccagaccugaa

SEQ ID NO: 1720472 - RNA, 23 nt, Salmonella enterica enterica serovar Typhi
auccacgccgcuaucgaccagca

SEQ ID NO: 1720473 - RNA, 19 nt, Salmonella enterica enterica serovar Typhi
auccacaaccggcuggcua

SEQ ID NO: 1720474 - RNA, 20 nt, Salmonella enterica enterica serovar Typhi
auccacugagcgcgccauga

SEQ ID NO: 1720475 - RNA, 17 nt, Salmonella enterica enterica serovar Typhi
auccagauauggcaaac

SEQ ID NO: 1720476 - RNA, 22 nt, Salmonella enterica enterica serovar Typhi
auccagagcggauaaauaguga

SEQ ID NO: 1720477 - RNA, 16 nt, Salmonella enterica enterica serovar Typhi
auccagauguuauaaa

SEQ ID NO: 1720478 - RNA, 20 nt, Salmonella enterica enterica serovar Typhi
auccacgcggugcccugggu

SEQ ID NO: 1720479 - RNA, 20 nt, Salmonella enterica enterica serovar Typhi
auccacucccugcuuuuuca

SEQ ID NO: 1720480 - RNA, 22 nt, Salmonella enterica enterica serovar Typhi
auccacgucauaacgcgcauuc

SEQ ID NO: 1720481 - RNA, 19 nt, Salmonella enterica enterica serovar Typhi
auccagcucaguuuccagc

SEQ ID NO: 1720482 - RNA, 15 nt, Salmonella enterica enterica serovar Typhi
auccagcucuucuuc

SEQ ID NO: 1720483 - RNA, 23 nt, Salmonella enterica enterica serovar Typhi
auccagcguaggguagaucacgc

SEQ ID NO: 1720484 - RNA, 17 nt, Salmonella enterica enterica serovar Typhi
auccagcucaguuucca

SEQ ID NO: 1720485 - RNA, 17 nt, Salmonella enterica enterica serovar Typhi
auccagcgguuacuuuu

SEQ ID NO: 1720486 - RNA, 18 nt, Salmonella enterica enterica serovar Typhi
auccagcgguuacuuuug

SEQ ID NO: 1720487 - RNA, 14 nt, Salmonella enterica enterica serovar Typhi
auccagcaaaauaa

SEQ ID NO: 1720488 - RNA, 17 nt, Salmonella enterica enterica serovar Typhi
auccagcgcucaaucag

SEQ ID NO: 1720489 - RNA, 12 nt, Salmonella enterica enterica serovar Typhi
auccagcagcca

SEQ ID NO: 1720490 - RNA, 13 nt, Salmonella enterica enterica serovar Typhi
auccaucaucuau

SEQ ID NO: 1720491 - RNA, 14 nt, Salmonella enterica enterica serovar Typhi
auccauauucuucg

SEQ ID NO: 1720492 - RNA, 19 nt, Salmonella enterica enterica serovar Typhi
auccauacgguuguugauu

SEQ ID NO: 1720493 - RNA, 23 nt, Salmonella enterica enterica serovar Typhi
auccauaccgcuuuguaaaacau

SEQ ID NO: 1720494 - RNA, 17 nt, Salmonella enterica enterica serovar Typhi
auccauaagaugaaaga

SEQ ID NO: 1720495 - RNA, 17 nt, Salmonella enterica enterica serovar Typhi
auccauaauuuucccca

SEQ ID NO: 1720496 - RNA, 18 nt, Salmonella enterica enterica serovar Typhi
auccauaauuuuccccag

SEQ ID NO: 1720497 - RNA, 15 nt, Salmonella enterica enterica serovar Typhi
auccaguugaugaug

SEQ ID NO: 1720498 - RNA, 15 nt, Salmonella enterica enterica serovar Typhi
auccaguuuuuucca

SEQ ID NO: 1720499 - RNA, 15 nt, Salmonella enterica enterica serovar Typhi
auccccaccaccgcc

SEQ ID NO: 1720500 - RNA, 17 nt, Salmonella enterica enterica serovar Typhi
aucccauugcguucuau

SEQ ID NO: 1720501 - RNA, 19 nt, Salmonella enterica enterica serovar Typhi
aucccaugcaccaguccca

SEQ ID NO: 1720502 - RNA, 15 nt, Salmonella enterica enterica serovar Typhi
aucccacggagaaaa

SEQ ID NO: 1720503 - RNA, 21 nt, Salmonella enterica enterica serovar Typhi
aucccacggagaaaagcgaaa

SEQ ID NO: 1720504 - RNA, 20 nt, Salmonella enterica enterica serovar Typhi
aucccaccaauugccacaua

SEQ ID NO: 1720505 - RNA, 18 nt, Salmonella enterica enterica serovar Typhi
aucccaccauaaagcgaa

SEQ ID NO: 1720506 - RNA, 19 nt, Salmonella enterica enterica serovar Typhi
auccaugcuuucaauaaau

SEQ ID NO: 1720507 - RNA, 16 nt, Salmonella enterica enterica serovar Typhi
auccauguacgcaggc

SEQ ID NO: 1720508 - RNA, 20 nt, Salmonella enterica enterica serovar Typhi
auccaucgguucucugccau

SEQ ID NO: 1720509 - RNA, 16 nt, Salmonella enterica enterica serovar Typhi
auccccuucaggaaua

SEQ ID NO: 1720510 - RNA, 14 nt, Salmonella enterica enterica serovar Typhi
auccccauauucca

SEQ ID NO: 1720511 - RNA, 12 nt, Salmonella enterica enterica serovar Typhi
auccccauccca

SEQ ID NO: 1720512 - RNA, 12 nt, Salmonella enterica enterica serovar Typhi
auccccagcgcu

SEQ ID NO: 1720513 - RNA, 13 nt, Salmonella enterica enterica serovar Typhi
auccccugcuccu

SEQ ID NO: 1720514 - RNA, 14 nt, Salmonella enterica enterica serovar Typhi
auccccugcuccug

SEQ ID NO: 1720515 - RNA, 14 nt, Salmonella enterica enterica serovar Typhi
auccggcaaaauua

SEQ ID NO: 1720516 - RNA, 12 nt, Salmonella enterica enterica serovar Typhi
auccgguaaacg

SEQ ID NO: 1720517 - RNA, 20 nt, Salmonella enterica enterica serovar Typhi
auccggccuguaaggucuca

SEQ ID NO: 1720518 - RNA, 21 nt, Salmonella enterica enterica serovar Typhi
auccggccugcacaagaaaca

SEQ ID NO: 1720519 - RNA, 20 nt, Salmonella enterica enterica serovar Typhi
auccggcauaagauuuacaa

SEQ ID NO: 1720520 - RNA, 14 nt, Salmonella enterica enterica serovar Typhi
auccggcaagcgcu

SEQ ID NO: 1720521 - RNA, 18 nt, Salmonella enterica enterica serovar Typhi
auccguuuccgcaauaag

SEQ ID NO: 1720522 - RNA, 16 nt, Salmonella enterica enterica serovar Typhi
auccguuaagcccuga

SEQ ID NO: 1720523 - RNA, 16 nt, Salmonella enterica enterica serovar Typhi
auccuaaaucugccau

SEQ ID NO: 1720524 - RNA, 15 nt, Salmonella enterica enterica serovar Typhi
auccgguuacucgca

SEQ ID NO: 1720525 - RNA, 17 nt, Salmonella enterica enterica serovar Typhi
auccugaguauaaaacu

SEQ ID NO: 1720526 - RNA, 16 nt, Salmonella enterica enterica serovar Typhi
auccugcaaauagcgc

SEQ ID NO: 1720527 - RNA, 20 nt, Salmonella enterica enterica serovar Typhi
auccugcaaauagcgcugau

SEQ ID NO: 1720528 - RNA, 13 nt, Salmonella enterica enterica serovar Typhi
auccuguucaaac

SEQ ID NO: 1720529 - RNA, 13 nt, Salmonella enterica enterica serovar Typhi
auccugcacccgc

SEQ ID NO: 1720530 - RNA, 21 nt, Salmonella enterica enterica serovar Typhi
auccugauuuuacugacuauc

SEQ ID NO: 1720531 - RNA, 12 nt, Salmonella enterica enterica serovar Typhi
auccucgaugaa

SEQ ID NO: 1720532 - RNA, 19 nt, Salmonella enterica enterica serovar Typhi
auccuccauaaauaacauu

SEQ ID NO: 1720533 - RNA, 23 nt, Salmonella enterica enterica serovar Typhi
auccucauuuuguugcuccagca

SEQ ID NO: 1720534 - RNA, 19 nt, Salmonella enterica enterica serovar Typhi
auccucauuaguucaaguu

SEQ ID NO: 1720535 - RNA, 20 nt, Salmonella enterica enterica serovar Typhi
auccucuuggguuauuucga

SEQ ID NO: 1720536 - RNA, 19 nt, Salmonella enterica enterica serovar Typhi
aucgcgcagcguaaagcgu

SEQ ID NO: 1720537 - RNA, 16 nt, Salmonella enterica enterica serovar Typhi
aucgcgcagacagugg

SEQ ID NO: 1720538 - RNA, 20 nt, Salmonella enterica enterica serovar Typhi
aucgcgauuccggacaacgc

SEQ ID NO: 1720539 - RNA, 20 nt, Salmonella enterica enterica serovar Typhi
aucgcgcacaugcugugcgc

SEQ ID NO: 1720540 - RNA, 19 nt, Salmonella enterica enterica serovar Typhi
aucgcggucagcggcgcgc

SEQ ID NO: 1720541 - RNA, 21 nt, Salmonella enterica enterica serovar Typhi
aucgcguuacggccaaauuua

SEQ ID NO: 1720542 - RNA, 19 nt, Salmonella enterica enterica serovar Typhi
aucgcguuguaaucgccug

SEQ ID NO: 1720543 - RNA, 18 nt, Salmonella enterica enterica serovar Typhi
aucgcgguuuuccggguc

SEQ ID NO: 1720544 - RNA, 17 nt, Salmonella enterica enterica serovar Typhi
aucgcugauauuguuga

SEQ ID NO: 1720545 - RNA, 22 nt, Salmonella enterica enterica serovar Typhi
aucgcugaccaacgucagcauc

SEQ ID NO: 1720546 - RNA, 17 nt, Salmonella enterica enterica serovar Typhi
aucgccugguaaggcaa

SEQ ID NO: 1720547 - RNA, 16 nt, Salmonella enterica enterica serovar Typhi
aucgccugaugaccgc

SEQ ID NO: 1720548 - RNA, 15 nt, Salmonella enterica enterica serovar Typhi
aucgccugcgcgccu

SEQ ID NO: 1720549 - RNA, 18 nt, Salmonella enterica enterica serovar Typhi
aucgccugcgcgccugac

SEQ ID NO: 1720550 - RNA, 16 nt, Salmonella enterica enterica serovar Typhi
aucgccugccagcgcu

SEQ ID NO: 1720551 - RNA, 18 nt, Salmonella enterica enterica serovar Typhi
aucgccuccagacuggcg

SEQ ID NO: 1720552 - RNA, 16 nt, Salmonella enterica enterica serovar Typhi
aucgccucccugccua

SEQ ID NO: 1720553 - RNA, 21 nt, Salmonella enterica enterica serovar Typhi
aucgccgguuuugguaucuuc

SEQ ID NO: 1720554 - RNA, 22 nt, Salmonella enterica enterica serovar Typhi
aucgccggagccgccuggccug

SEQ ID NO: 1720555 - RNA, 22 nt, Salmonella enterica enterica serovar Typhi
aucgcccacgcaaaauggccug

SEQ ID NO: 1720556 - RNA, 16 nt, Salmonella enterica enterica serovar Typhi
aucgccgcgacagucg

SEQ ID NO: 1720557 - RNA, 16 nt, Salmonella enterica enterica serovar Typhi
aucgaaagagcaaaua

SEQ ID NO: 1720558 - RNA, 11 nt, Salmonella enterica enterica serovar Typhi
aucgagauaag

SEQ ID NO: 1720559 - RNA, 14 nt, Salmonella enterica enterica serovar Typhi
aucgagagcgggug

SEQ ID NO: 1720560 - RNA, 22 nt, Salmonella enterica enterica serovar Typhi
aucgaugccacagcgcauucac

SEQ ID NO: 1720561 - RNA, 21 nt, Salmonella enterica enterica serovar Typhi
aucgcacagagaucgugcauc

SEQ ID NO: 1720562 - RNA, 21 nt, Salmonella enterica enterica serovar Typhi
aucgcagauuccgaacucaug

SEQ ID NO: 1720563 - RNA, 21 nt, Salmonella enterica enterica serovar Typhi
aucgcacuggcgccugcgccu

SEQ ID NO: 1720564 - RNA, 15 nt, Salmonella enterica enterica serovar Typhi
aucgcaaauucugua

SEQ ID NO: 1720565 - RNA, 17 nt, Salmonella enterica enterica serovar Typhi
aucgccauauacgccac

SEQ ID NO: 1720566 - RNA, 19 nt, Salmonella enterica enterica serovar Typhi
aucgccauccugcaccgua

SEQ ID NO: 1720567 - RNA, 23 nt, Salmonella enterica enterica serovar Typhi
aucgcauagacgcccugcaaagc

SEQ ID NO: 1720568 - RNA, 17 nt, Salmonella enterica enterica serovar Typhi
aucuaacccgcucagac

SEQ ID NO: 1720569 - RNA, 19 nt, Salmonella enterica enterica serovar Typhi
aucguucuugcacaauacu

SEQ ID NO: 1720570 - RNA, 15 nt, Salmonella enterica enterica serovar Typhi
aucguucgcggaacg

SEQ ID NO: 1720571 - RNA, 18 nt, Salmonella enterica enterica serovar Typhi
aucguucgccagugacaa

SEQ ID NO: 1720572 - RNA, 19 nt, Salmonella enterica enterica serovar Typhi
aucuacgcuauuuccagaa

SEQ ID NO: 1720573 - RNA, 14 nt, Salmonella enterica enterica serovar Typhi
aucuacuucagcac

SEQ ID NO: 1720574 - RNA, 18 nt, Salmonella enterica enterica serovar Typhi
aucuacgguaucugcaua

SEQ ID NO: 1720575 - RNA, 17 nt, Salmonella enterica enterica serovar Typhi
aucguccucacaaacgg

SEQ ID NO: 1720576 - RNA, 21 nt, Salmonella enterica enterica serovar Typhi
aucgucggcgauugucaucau

SEQ ID NO: 1720577 - RNA, 23 nt, Salmonella enterica enterica serovar Typhi
aucgucgcgaucgcgccagccuu

SEQ ID NO: 1720578 - RNA, 17 nt, Salmonella enterica enterica serovar Typhi
aucggcaaacgccgccu

SEQ ID NO: 1720579 - RNA, 16 nt, Salmonella enterica enterica serovar Typhi
aucggcacacagccag

SEQ ID NO: 1720580 - RNA, 19 nt, Salmonella enterica enterica serovar Typhi
aucggcaaacgccgccugg

SEQ ID NO: 1720581 - RNA, 22 nt, Salmonella enterica enterica serovar Typhi
aucgcuucaaucagcguggcgu

SEQ ID NO: 1720582 - RNA, 17 nt, Salmonella enterica enterica serovar Typhi
aucgcuuaacggcccag

SEQ ID NO: 1720583 - RNA, 21 nt, Salmonella enterica enterica serovar Typhi
aucgcuuaacggcccaggcau

SEQ ID NO: 1720584 - RNA, 21 nt, Salmonella enterica enterica serovar Typhi
aucggagauuucauccucuug

SEQ ID NO: 1720585 - RNA, 22 nt, Salmonella enterica enterica serovar Typhi
aucguguuauuuucaaaaacaa

SEQ ID NO: 1720586 - RNA, 16 nt, Salmonella enterica enterica serovar Typhi
aucguuauccagcagc

SEQ ID NO: 1720587 - RNA, 14 nt, Salmonella enterica enterica serovar Typhi
aucguuauauauac

SEQ ID NO: 1720588 - RNA, 18 nt, Salmonella enterica enterica serovar Typhi
aucgucucucauccgcca

SEQ ID NO: 1720589 - RNA, 18 nt, Salmonella enterica enterica serovar Typhi
aucgugauaaauugcuga

SEQ ID NO: 1720590 - RNA, 16 nt, Salmonella enterica enterica serovar Typhi
aucgugccaugaccau

SEQ ID NO: 1720591 - RNA, 17 nt, Salmonella enterica enterica serovar Typhi
aucucgugaucgccaaa

SEQ ID NO: 1720592 - RNA, 14 nt, Salmonella enterica enterica serovar Typhi
aucucuccccccuc

SEQ ID NO: 1720593 - RNA, 14 nt, Salmonella enterica enterica serovar Typhi
aucucuacgccggc

SEQ ID NO: 1720594 - RNA, 15 nt, Salmonella enterica enterica serovar Typhi
aucucuacuuuccug

SEQ ID NO: 1720595 - RNA, 18 nt, Salmonella enterica enterica serovar Typhi
aucucuaucggcaaacca

SEQ ID NO: 1720596 - RNA, 15 nt, Salmonella enterica enterica serovar Typhi
aucucaagccccaug

SEQ ID NO: 1720597 - RNA, 17 nt, Salmonella enterica enterica serovar Typhi
aucucaauaccacgccg

SEQ ID NO: 1720598 - RNA, 13 nt, Salmonella enterica enterica serovar Typhi
aucuccaucucca

SEQ ID NO: 1720599 - RNA, 16 nt, Salmonella enterica enterica serovar Typhi
aucuccaucauuuccg

SEQ ID NO: 1720600 - RNA, 16 nt, Salmonella enterica enterica serovar Typhi
aucuccaguuguucac

SEQ ID NO: 1720601 - RNA, 23 nt, Salmonella enterica enterica serovar Typhi
aucucccaggccgccaccgccuc

SEQ ID NO: 1720602 - RNA, 17 nt, Salmonella enterica enterica serovar Typhi
aucuggugauaaagcag

SEQ ID NO: 1720603 - RNA, 17 nt, Salmonella enterica enterica serovar Typhi
aucugguggaaaagaaa

SEQ ID NO: 1720604 - RNA, 14 nt, Salmonella enterica enterica serovar Typhi
aucuggugauaaag

SEQ ID NO: 1720605 - RNA, 13 nt, Salmonella enterica enterica serovar Typhi
aucugccauuucu

SEQ ID NO: 1720606 - RNA, 20 nt, Salmonella enterica enterica serovar Typhi
aucugccagccgauuuuucg

SEQ ID NO: 1720607 - RNA, 13 nt, Salmonella enterica enterica serovar Typhi
aucugcccuuucu

SEQ ID NO: 1720608 - RNA, 14 nt, Salmonella enterica enterica serovar Typhi
aucugcccuuucuu

SEQ ID NO: 1720609 - RNA, 20 nt, Salmonella enterica enterica serovar Typhi
aucugcugacacccucugcg

SEQ ID NO: 1720610 - RNA, 15 nt, Salmonella enterica enterica serovar Typhi
aucugccgucaucga

SEQ ID NO: 1720611 - RNA, 17 nt, Salmonella enterica enterica serovar Typhi
aucucuugcauaauauc

SEQ ID NO: 1720612 - RNA, 19 nt, Salmonella enterica enterica serovar Typhi
aucucuugcauaauaucca

SEQ ID NO: 1720613 - RNA, 22 nt, Salmonella enterica enterica serovar Typhi
aucucuugcauaauauccagga

SEQ ID NO: 1720614 - RNA, 16 nt, Salmonella enterica enterica serovar Typhi
aucugauauaucuuca

SEQ ID NO: 1720615 - RNA, 14 nt, Salmonella enterica enterica serovar Typhi
aucugaugauuaau

SEQ ID NO: 1720616 - RNA, 13 nt, Salmonella enterica enterica serovar Typhi
aucugcaaaauau

SEQ ID NO: 1720617 - RNA, 15 nt, Salmonella enterica enterica serovar Typhi
aucugcauaggcuuu

SEQ ID NO: 1720618 - RNA, 20 nt, Salmonella enterica enterica serovar Typhi
aucugcauguaguaagccau

SEQ ID NO: 1720619 - RNA, 17 nt, Salmonella enterica enterica serovar Typhi
aucugcacguaccugcu

SEQ ID NO: 1720620 - RNA, 20 nt, Salmonella enterica enterica serovar Typhi
aucugcacguaccugcucca

SEQ ID NO: 1720621 - RNA, 14 nt, Salmonella enterica enterica serovar Typhi
aucuugugaguaau

SEQ ID NO: 1720622 - RNA, 22 nt, Salmonella enterica enterica serovar Typhi
aucuuguccucaucauucgguu

SEQ ID NO: 1720623 - RNA, 21 nt, Salmonella enterica enterica serovar Typhi
aucuuuaccagggaauaugau

SEQ ID NO: 1720624 - RNA, 14 nt, Salmonella enterica enterica serovar Typhi
aucuuucuccuggu

SEQ ID NO: 1720625 - RNA, 23 nt, Salmonella enterica enterica serovar Typhi
aucuuucuccugguuuuuccauu

SEQ ID NO: 1720626 - RNA, 16 nt, Salmonella enterica enterica serovar Typhi
aucuuugagcagauaa

SEQ ID NO: 1720627 - RNA, 12 nt, Salmonella enterica enterica serovar Typhi
aucuuucuuuuu

SEQ ID NO: 1720628 - RNA, 19 nt, Salmonella enterica enterica serovar Typhi
aucuuugaagggcauauua

SEQ ID NO: 1720629 - RNA, 16 nt, Salmonella enterica enterica serovar Typhi
aucuuugccacgucga

SEQ ID NO: 1720630 - RNA, 14 nt, Salmonella enterica enterica serovar Typhi
aucuuuuccugaag

SEQ ID NO: 1720631 - RNA, 11 nt, Salmonella enterica enterica serovar Typhi
aucuuuuuccc

SEQ ID NO: 1720632 - RNA, 15 nt, Salmonella enterica enterica serovar Typhi
aucuuuuugcuccug

SEQ ID NO: 1720633 - RNA, 14 nt, Salmonella enterica enterica serovar Typhi
aucuugcguuaugu

SEQ ID NO: 1720634 - RNA, 17 nt, Salmonella enterica enterica serovar Typhi
aucuugauaucaucauc

SEQ ID NO: 1720635 - RNA, 13 nt, Salmonella enterica enterica serovar Typhi
aucuucugcugcu

SEQ ID NO: 1720636 - RNA, 17 nt, Salmonella enterica enterica serovar Typhi
aucuucugcugcucccu

SEQ ID NO: 1720637 - RNA, 17 nt, Salmonella enterica enterica serovar Typhi
aucuugaaugauuuugu

SEQ ID NO: 1720638 - RNA, 16 nt, Salmonella enterica enterica serovar Typhi
aucuguucguugcugu

SEQ ID NO: 1720639 - RNA, 21 nt, Salmonella enterica enterica serovar Typhi
aucuguuccacagaucuaucu

SEQ ID NO: 1720640 - RNA, 14 nt, Salmonella enterica enterica serovar Typhi
aucuguuccagcga

SEQ ID NO: 1720641 - RNA, 22 nt, Salmonella enterica enterica serovar Typhi
aucugugugggcacucgaagau

SEQ ID NO: 1720642 - RNA, 15 nt, Salmonella enterica enterica serovar Typhi
aucuucuacaaugcg

SEQ ID NO: 1720643 - RNA, 14 nt, Salmonella enterica enterica serovar Typhi
aucuguugcgccag

SEQ ID NO: 1720644 - RNA, 19 nt, Salmonella enterica enterica serovar Typhi
aucuucuacaugcccuucu

SEQ ID NO: 1720645 - RNA, 17 nt, Salmonella enterica enterica serovar Typhi
aucuucuaccuggaacc

SEQ ID NO: 1720646 - RNA, 18 nt, Salmonella enterica enterica serovar Typhi
augaccguauuacaagua

SEQ ID NO: 1720647 - RNA, 16 nt, Salmonella enterica enterica serovar Typhi
augaccgcacagcaga

SEQ ID NO: 1720648 - RNA, 16 nt, Salmonella enterica enterica serovar Typhi
augaccgcgacuugga

SEQ ID NO: 1720649 - RNA, 13 nt, Salmonella enterica enterica serovar Typhi
augaccauucaca

SEQ ID NO: 1720650 - RNA, 20 nt, Salmonella enterica enterica serovar Typhi
augaccaucaaauaauacgc

SEQ ID NO: 1720651 - RNA, 16 nt, Salmonella enterica enterica serovar Typhi
augaccagcgcccaca

SEQ ID NO: 1720652 - RNA, 13 nt, Salmonella enterica enterica serovar Typhi
augaccagaacau

SEQ ID NO: 1720653 - RNA, 20 nt, Salmonella enterica enterica serovar Typhi
augacggacgcagaccaaag

SEQ ID NO: 1720654 - RNA, 16 nt, Salmonella enterica enterica serovar Typhi
augacgcuggaaguau

SEQ ID NO: 1720655 - RNA, 13 nt, Salmonella enterica enterica serovar Typhi
augacggcagggg

SEQ ID NO: 1720656 - RNA, 15 nt, Salmonella enterica enterica serovar Typhi
augacgcgcaggccg

SEQ ID NO: 1720657 - RNA, 19 nt, Salmonella enterica enterica serovar Typhi
augacguauucaccucccu

SEQ ID NO: 1720658 - RNA, 16 nt, Salmonella enterica enterica serovar Typhi
augacgauaaauaaga

SEQ ID NO: 1720659 - RNA, 19 nt, Salmonella enterica enterica serovar Typhi
augacgcccugcgccagca

SEQ ID NO: 1720660 - RNA, 14 nt, Salmonella enterica enterica serovar Typhi
augacgaccucauc

SEQ ID NO: 1720661 - RNA, 14 nt, Salmonella enterica enterica serovar Typhi
augagauaauaaau

SEQ ID NO: 1720662 - RNA, 18 nt, Salmonella enterica enterica serovar Typhi
augagaaaaggaagaaua

SEQ ID NO: 1720663 - RNA, 13 nt, Salmonella enterica enterica serovar Typhi
augagaagaaaaa

SEQ ID NO: 1720664 - RNA, 13 nt, Salmonella enterica enterica serovar Typhi
augaauaauaaua

SEQ ID NO: 1720665 - RNA, 15 nt, Salmonella enterica enterica serovar Typhi
augaauaaucucugc

SEQ ID NO: 1720666 - RNA, 15 nt, Salmonella enterica enterica serovar Typhi
augaauaaccucccg

SEQ ID NO: 1720667 - RNA, 15 nt, Salmonella enterica enterica serovar Typhi
augaagcauaaaaag

SEQ ID NO: 1720668 - RNA, 22 nt, Salmonella enterica enterica serovar Typhi
augaauaaccucccgccggggc

SEQ ID NO: 1720669 - RNA, 14 nt, Salmonella enterica enterica serovar Typhi
augaauuauuuuuu

SEQ ID NO: 1720670 - RNA, 16 nt, Salmonella enterica enterica serovar Typhi
augaauuauuuuuuca

SEQ ID NO: 1720671 - RNA, 21 nt, Salmonella enterica enterica serovar Typhi
augaauuauuuucuaaaaucu

SEQ ID NO: 1720672 - RNA, 23 nt, Salmonella enterica enterica serovar Typhi
augaaacgguuaaaaacagccag

SEQ ID NO: 1720673 - RNA, 17 nt, Salmonella enterica enterica serovar Typhi
augaaaaacuggaaaac

SEQ ID NO: 1720674 - RNA, 17 nt, Salmonella enterica enterica serovar Typhi
augaaaaaaguuauuuu

SEQ ID NO: 1720675 - RNA, 12 nt, Salmonella enterica enterica serovar Typhi
augaaaaaaacg

SEQ ID NO: 1720676 - RNA, 11 nt, Salmonella enterica enterica serovar Typhi
augaaaaaaac

SEQ ID NO: 1720677 - RNA, 13 nt, Salmonella enterica enterica serovar Typhi
augaacuuacacu

SEQ ID NO: 1720678 - RNA, 23 nt, Salmonella enterica enterica serovar Typhi
augaagacguucuaucagguauc

SEQ ID NO: 1720679 - RNA, 14 nt, Salmonella enterica enterica serovar Typhi
augaagaaaauacu

SEQ ID NO: 1720680 - RNA, 19 nt, Salmonella enterica enterica serovar Typhi
auaccccgcacaaacgcuu

SEQ ID NO: 1720681 - RNA, 16 nt, Salmonella enterica enterica serovar Typhi
auaccgguuauccaua

SEQ ID NO: 1720682 - RNA, 14 nt, Salmonella enterica enterica serovar Typhi
auaccuaauagcga

SEQ ID NO: 1720683 - RNA, 19 nt, Salmonella enterica enterica serovar Typhi
auaccgugugcagugacag

SEQ ID NO: 1720684 - RNA, 19 nt, Salmonella enterica enterica serovar Typhi
auaccguuuggaucugucg

SEQ ID NO: 1720685 - RNA, 15 nt, Salmonella enterica enterica serovar Typhi
auacguaauaccuga

SEQ ID NO: 1720686 - RNA, 14 nt, Salmonella enterica enterica serovar Typhi
auacguggcucaag

SEQ ID NO: 1720687 - RNA, 23 nt, Salmonella enterica enterica serovar Typhi
auacgggagagcguauccagcac

SEQ ID NO: 1720688 - RNA, 23 nt, Salmonella enterica enterica serovar Typhi
auacggcgugauguagcuugaaa

SEQ ID NO: 1720689 - RNA, 15 nt, Salmonella enterica enterica serovar Typhi
auacggggucuaagg

SEQ ID NO: 1720690 - RNA, 19 nt, Salmonella enterica enterica serovar Typhi
auaccuacuuuauuuuucg

SEQ ID NO: 1720691 - RNA, 22 nt, Salmonella enterica enterica serovar Typhi
auacggagaacggcacaauagc

SEQ ID NO: 1720692 - RNA, 21 nt, Salmonella enterica enterica serovar Typhi
auacggcggcaaugccgccgu

SEQ ID NO: 1720693 - RNA, 17 nt, Salmonella enterica enterica serovar Typhi
auacuaaagggaucuuc

SEQ ID NO: 1720694 - RNA, 19 nt, Salmonella enterica enterica serovar Typhi
auacguuauaaauuuuuua

SEQ ID NO: 1720695 - RNA, 12 nt, Salmonella enterica enterica serovar Typhi
auacucuucacg

SEQ ID NO: 1720696 - RNA, 21 nt, Salmonella enterica enterica serovar Typhi
auacugaaccacggagagaca

SEQ ID NO: 1720697 - RNA, 12 nt, Salmonella enterica enterica serovar Typhi
auacugaccaac

SEQ ID NO: 1720698 - RNA, 13 nt, Salmonella enterica enterica serovar Typhi
auacugauaaaaa

SEQ ID NO: 1720699 - RNA, 19 nt, Salmonella enterica enterica serovar Typhi
auagaccaggcgacuauuc

SEQ ID NO: 1720700 - RNA, 13 nt, Salmonella enterica enterica serovar Typhi
auagaccacgcca

SEQ ID NO: 1720701 - RNA, 18 nt, Salmonella enterica enterica serovar Typhi
auagacgcccugcaaagc

SEQ ID NO: 1720702 - RNA, 22 nt, Salmonella enterica enterica serovar Typhi
auagacgcccugcaaagcaaaa

SEQ ID NO: 1720703 - RNA, 17 nt, Salmonella enterica enterica serovar Typhi
auagagagcgacagccc

SEQ ID NO: 1720704 - RNA, 13 nt, Salmonella enterica enterica serovar Typhi
auagacgauauag

SEQ ID NO: 1720705 - RNA, 15 nt, Salmonella enterica enterica serovar Typhi
auagacauccagcau

SEQ ID NO: 1720706 - RNA, 21 nt, Salmonella enterica enterica serovar Typhi
auagacagcggcuaauuuauu

SEQ ID NO: 1720707 - RNA, 20 nt, Salmonella enterica enterica serovar Typhi
auagaagcucaugugcagca

SEQ ID NO: 1720708 - RNA, 16 nt, Salmonella enterica enterica serovar Typhi
auagaaguuaugcauc

SEQ ID NO: 1720709 - RNA, 20 nt, Salmonella enterica enterica serovar Typhi
auagaauaggaaauaauuaa

SEQ ID NO: 1720710 - RNA, 23 nt, Salmonella enterica enterica serovar Typhi
auagaacgguuuugcgcugguac

SEQ ID NO: 1720711 - RNA, 22 nt, Salmonella enterica enterica serovar Typhi
auagaacgcucgcgcaugaccu

SEQ ID NO: 1720712 - RNA, 22 nt, Salmonella enterica enterica serovar Typhi
auacuguuuuugcuuuaauauu

SEQ ID NO: 1720713 - RNA, 21 nt, Salmonella enterica enterica serovar Typhi
auacuuaacccugaaccggga

SEQ ID NO: 1720714 - RNA, 12 nt, Salmonella enterica enterica serovar Typhi
auacuuaacccu

SEQ ID NO: 1720715 - RNA, 15 nt, Salmonella enterica enterica serovar Typhi
auacuguuuuugcuu

SEQ ID NO: 1720716 - RNA, 16 nt, Salmonella enterica enterica serovar Typhi
auacuguuuuugcuuu

SEQ ID NO: 1720717 - RNA, 17 nt, Salmonella enterica enterica serovar Typhi
auacuguuccaggcgaa

SEQ ID NO: 1720718 - RNA, 13 nt, Salmonella enterica enterica serovar Typhi
auacugucuugug

SEQ ID NO: 1720719 - RNA, 16 nt, Salmonella enterica enterica serovar Typhi
auacugugggauuuuu

SEQ ID NO: 1720720 - RNA, 17 nt, Salmonella enterica enterica serovar Typhi
auaccagcguaauccuc

SEQ ID NO: 1720721 - RNA, 17 nt, Salmonella enterica enterica serovar Typhi
auaccaggcacuugaga

SEQ ID NO: 1720722 - RNA, 21 nt, Salmonella enterica enterica serovar Typhi
auaccaggcacuugagaaauu

SEQ ID NO: 1720723 - RNA, 15 nt, Salmonella enterica enterica serovar Typhi
auaccaaaaauaauu

SEQ ID NO: 1720724 - RNA, 15 nt, Salmonella enterica enterica serovar Typhi
auaccacaacagaau

SEQ ID NO: 1720725 - RNA, 14 nt, Salmonella enterica enterica serovar Typhi
auaccacaaauuuu

SEQ ID NO: 1720726 - RNA, 18 nt, Salmonella enterica enterica serovar Typhi
auacccaguagcagacag

SEQ ID NO: 1720727 - RNA, 22 nt, Salmonella enterica enterica serovar Typhi
auacccugcggcgaaacagagu

SEQ ID NO: 1720728 - RNA, 17 nt, Salmonella enterica enterica serovar Typhi
auacccgacucuuuuuu

SEQ ID NO: 1720729 - RNA, 19 nt, Salmonella enterica enterica serovar Typhi
auaccccgaucgauauuua

SEQ ID NO: 1720730 - RNA, 21 nt, Salmonella enterica enterica serovar Typhi
auaccaggguucgcuggccag

SEQ ID NO: 1720731 - RNA, 22 nt, Salmonella enterica enterica serovar Typhi
auaccauaaaugaaaccucaau

SEQ ID NO: 1720732 - RNA, 14 nt, Salmonella enterica enterica serovar Typhi
auaccauccccuuu

SEQ ID NO: 1720733 - RNA, 14 nt, Salmonella enterica enterica serovar Typhi
auacauucucugcc

SEQ ID NO: 1720734 - RNA, 13 nt, Salmonella enterica enterica serovar Typhi
auacauucuguuu

SEQ ID NO: 1720735 - RNA, 13 nt, Salmonella enterica enterica serovar Typhi
auaccaaaaauaa

SEQ ID NO: 1720736 - RNA, 19 nt, Salmonella enterica enterica serovar Typhi
auacauuuuuguaauaaaa

SEQ ID NO: 1720737 - RNA, 20 nt, Salmonella enterica enterica serovar Typhi
auacauuuuuguaauaaaaa

SEQ ID NO: 1720738 - RNA, 23 nt, Salmonella enterica enterica serovar Typhi
auacauuuuguauucgcagggcu

SEQ ID NO: 1720739 - RNA, 21 nt, Salmonella enterica enterica serovar Typhi
auacaugaggauuuugagcac

SEQ ID NO: 1720740 - RNA, 21 nt, Salmonella enterica enterica serovar Typhi
auacaugccugcgccauguuc

SEQ ID NO: 1720741 - RNA, 15 nt, Salmonella enterica enterica serovar Typhi
auacauccugauuau

SEQ ID NO: 1720742 - RNA, 23 nt, Salmonella enterica enterica serovar Typhi
auacauccugauuauuacaauaa

SEQ ID NO: 1720743 - RNA, 20 nt, Salmonella enterica enterica serovar Typhi
auacauauuguuuucuauuu

SEQ ID NO: 1720744 - RNA, 18 nt, Salmonella enterica enterica serovar Typhi
auacaucaguccuguuga

SEQ ID NO: 1720745 - RNA, 22 nt, Salmonella enterica enterica serovar Typhi
auacaucacuuuaugaccauac

SEQ ID NO: 1720746 - RNA, 13 nt, Salmonella enterica enterica serovar Typhi
auacauaaauccg

SEQ ID NO: 1720747 - RNA, 21 nt, Salmonella enterica enterica serovar Typhi
auacauaccacgcagcggcau

SEQ ID NO: 1720748 - RNA, 19 nt, Salmonella enterica enterica serovar Typhi
auacaguucgacaaugucc

SEQ ID NO: 1720749 - RNA, 11 nt, Salmonella enterica enterica serovar Typhi
auacauaaauc

SEQ ID NO: 1720750 - RNA, 19 nt, Salmonella enterica enterica serovar Typhi
auaauucauaacaccaaua

SEQ ID NO: 1720751 - RNA, 22 nt, Salmonella enterica enterica serovar Typhi
auaauuaugccugucaucauca

SEQ ID NO: 1720752 - RNA, 14 nt, Salmonella enterica enterica serovar Typhi
auagccccaguaaa

SEQ ID NO: 1720753 - RNA, 14 nt, Salmonella enterica enterica serovar Typhi
auagagaguuccuc

SEQ ID NO: 1720754 - RNA, 22 nt, Salmonella enterica enterica serovar Typhi
auagcccggcauguccaucaga

SEQ ID NO: 1720755 - RNA, 15 nt, Salmonella enterica enterica serovar Typhi
auagccgaaacuuau

SEQ ID NO: 1720756 - RNA, 21 nt, Salmonella enterica enterica serovar Typhi
auagcgccccggugcuuucuc

SEQ ID NO: 1720757 - RNA, 17 nt, Salmonella enterica enterica serovar Typhi
auagcgcgaaugauuuu

SEQ ID NO: 1720758 - RNA, 14 nt, Salmonella enterica enterica serovar Typhi
auagcgcgcuaaac

SEQ ID NO: 1720759 - RNA, 16 nt, Salmonella enterica enterica serovar Typhi
auagcgccauccugcc

SEQ ID NO: 1720760 - RNA, 19 nt, Salmonella enterica enterica serovar Typhi
auaggauguugcugcugcg

SEQ ID NO: 1720761 - RNA, 19 nt, Salmonella enterica enterica serovar Typhi
auagcuuuucaagaauuac

SEQ ID NO: 1720762 - RNA, 18 nt, Salmonella enterica enterica serovar Typhi
auagcuguuccgcaacac

SEQ ID NO: 1720763 - RNA, 20 nt, Salmonella enterica enterica serovar Typhi
auagcggcguuuauauaaaa

SEQ ID NO: 1720764 - RNA, 21 nt, Salmonella enterica enterica serovar Typhi
auagcggcguuuauauaaaaa

SEQ ID NO: 1720765 - RNA, 23 nt, Salmonella enterica enterica serovar Typhi
auagcggcguuuauauaaaaaua

SEQ ID NO: 1720766 - RNA, 17 nt, Salmonella enterica enterica serovar Typhi
auagcgcugaaguccgc

SEQ ID NO: 1720767 - RNA, 14 nt, Salmonella enterica enterica serovar Typhi
auagcgcggaauau

SEQ ID NO: 1720768 - RNA, 20 nt, Salmonella enterica enterica serovar Typhi
auagguuaagccaaacucac

SEQ ID NO: 1720769 - RNA, 21 nt, Salmonella enterica enterica serovar Typhi
auagguucaauaugccaggca

SEQ ID NO: 1720770 - RNA, 13 nt, Salmonella enterica enterica serovar Typhi
auagguuuuaugc

SEQ ID NO: 1720771 - RNA, 15 nt, Salmonella enterica enterica serovar Typhi
auaggucguuccuca

SEQ ID NO: 1720772 - RNA, 14 nt, Salmonella enterica enterica serovar Typhi
auagguacggggca

SEQ ID NO: 1720773 - RNA, 15 nt, Salmonella enterica enterica serovar Typhi
auagguacggggcau

SEQ ID NO: 1720774 - RNA, 19 nt, Salmonella enterica enterica serovar Typhi
auaggugacuuuccuggcu

SEQ ID NO: 1720775 - RNA, 14 nt, Salmonella enterica enterica serovar Typhi
auaggcgaggaaaa

SEQ ID NO: 1720776 - RNA, 20 nt, Salmonella enterica enterica serovar Typhi
auagucauaauacucaauau

SEQ ID NO: 1720777 - RNA, 17 nt, Salmonella enterica enterica serovar Typhi
auagucauaauuaaaaa

SEQ ID NO: 1720778 - RNA, 22 nt, Salmonella enterica enterica serovar Typhi
auaguacgauagcaauuaauaa

SEQ ID NO: 1720779 - RNA, 18 nt, Salmonella enterica enterica serovar Typhi
auaguacccucugcacca

SEQ ID NO: 1720780 - RNA, 17 nt, Salmonella enterica enterica serovar Typhi
auaguaacguaugcugg

SEQ ID NO: 1720781 - RNA, 23 nt, Salmonella enterica enterica serovar Typhi
auaguacccucugcaccagaacu

SEQ ID NO: 1720782 - RNA, 13 nt, Salmonella enterica enterica serovar Typhi
auaguaaauagaa

SEQ ID NO: 1720783 - RNA, 22 nt, Salmonella enterica enterica serovar Typhi
auauccgcugcggucaggaaug

SEQ ID NO: 1720784 - RNA, 23 nt, Salmonella enterica enterica serovar Typhi
auauccgugcgcaauuccagcaa

SEQ ID NO: 1720785 - RNA, 17 nt, Salmonella enterica enterica serovar Typhi
auauccagccaguccuc

SEQ ID NO: 1720786 - RNA, 21 nt, Salmonella enterica enterica serovar Typhi
auauccaccagcccaucuuuc

SEQ ID NO: 1720787 - RNA, 13 nt, Salmonella enterica enterica serovar Typhi
auaucauuuuacc

SEQ ID NO: 1720788 - RNA, 18 nt, Salmonella enterica enterica serovar Typhi
auaucaccaucuuuuugc

SEQ ID NO: 1720789 - RNA, 15 nt, Salmonella enterica enterica serovar Typhi
auaucacgcgcgcga

SEQ ID NO: 1720790 - RNA, 22 nt, Salmonella enterica enterica serovar Typhi
auaucauucgcgucauacuuaa

SEQ ID NO: 1720791 - RNA, 14 nt, Salmonella enterica enterica serovar Typhi
auaucaaugcgaaa

SEQ ID NO: 1720792 - RNA, 16 nt, Salmonella enterica enterica serovar Typhi
auauauucagcaaaug

SEQ ID NO: 1720793 - RNA, 18 nt, Salmonella enterica enterica serovar Typhi
auauauuacgacugcacc

SEQ ID NO: 1720794 - RNA, 14 nt, Salmonella enterica enterica serovar Typhi
auauagccguggcu

SEQ ID NO: 1720795 - RNA, 15 nt, Salmonella enterica enterica serovar Typhi
auauagccauuuaau

SEQ ID NO: 1720796 - RNA, 16 nt, Salmonella enterica enterica serovar Typhi
auauaggggccaagcg

SEQ ID NO: 1720797 - RNA, 16 nt, Salmonella enterica enterica serovar Typhi
auauagcaguuuucac

SEQ ID NO: 1720798 - RNA, 16 nt, Salmonella enterica enterica serovar Typhi
auauagccguggcugg

SEQ ID NO: 1720799 - RNA, 17 nt, Salmonella enterica enterica serovar Typhi
auauagccguggcuggc

SEQ ID NO: 1720800 - RNA, 23 nt, Salmonella enterica enterica serovar Typhi
auauaauuuuauuauauuuaaaa

SEQ ID NO: 1720801 - RNA, 22 nt, Salmonella enterica enterica serovar Typhi
auauaauuuuauuauauuuaaa

SEQ ID NO: 1720802 - RNA, 18 nt, Salmonella enterica enterica serovar Typhi
auauaaccacgaaaauua

SEQ ID NO: 1720803 - RNA, 15 nt, Salmonella enterica enterica serovar Typhi
auauaacagaauaag

SEQ ID NO: 1720804 - RNA, 21 nt, Salmonella enterica enterica serovar Typhi
auaguuauacauuuuuuucuu

SEQ ID NO: 1720805 - RNA, 12 nt, Salmonella enterica enterica serovar Typhi
auaguccagcau

SEQ ID NO: 1720806 - RNA, 16 nt, Salmonella enterica enterica serovar Typhi
auaguccacuuucugu

SEQ ID NO: 1720807 - RNA, 21 nt, Salmonella enterica enterica serovar Typhi
auauuucuguaaucgauacua

SEQ ID NO: 1720808 - RNA, 12 nt, Salmonella enterica enterica serovar Typhi
auauuuuucccu

SEQ ID NO: 1720809 - RNA, 21 nt, Salmonella enterica enterica serovar Typhi
auauucugggcuuacuuucca

SEQ ID NO: 1720810 - RNA, 21 nt, Salmonella enterica enterica serovar Typhi
auauucuucuuagaauagaau

SEQ ID NO: 1720811 - RNA, 16 nt, Salmonella enterica enterica serovar Typhi
auauuuaccgccgcuu

SEQ ID NO: 1720812 - RNA, 17 nt, Salmonella enterica enterica serovar Typhi
auauuuauuuaauguuu

SEQ ID NO: 1720813 - RNA, 18 nt, Salmonella enterica enterica serovar Typhi
auauuuauuuaauguuuc

SEQ ID NO: 1720814 - RNA, 16 nt, Salmonella enterica enterica serovar Typhi
aucaaaugagaauaga

SEQ ID NO: 1720815 - RNA, 15 nt, Salmonella enterica enterica serovar Typhi
aucaacauuauuaaa

SEQ ID NO: 1720816 - RNA, 20 nt, Salmonella enterica enterica serovar Typhi
aucaacaucgcaaaauuccg

SEQ ID NO: 1720817 - RNA, 24 nt, Salmonella enterica enterica serovar Typhi
aucaacugggugugaucgccgcga

SEQ ID NO: 1720818 - RNA, 20 nt, Salmonella enterica enterica serovar Typhi
aucaaauacgcuauuuaaaa

SEQ ID NO: 1720819 - RNA, 17 nt, Salmonella enterica enterica serovar Typhi
aucaaauaagacaugga

SEQ ID NO: 1720820 - RNA, 22 nt, Salmonella enterica enterica serovar Typhi
aucaaaggcgucgccgaauaaa

SEQ ID NO: 1720821 - RNA, 19 nt, Salmonella enterica enterica serovar Typhi
auaugcguguagcagauag

SEQ ID NO: 1720822 - RNA, 19 nt, Salmonella enterica enterica serovar Typhi
auaugcgacagaaauugaa

SEQ ID NO: 1720823 - RNA, 20 nt, Salmonella enterica enterica serovar Typhi
auauccuggcgagaauagaa

SEQ ID NO: 1720824 - RNA, 15 nt, Salmonella enterica enterica serovar Typhi
auauccuguaacuca

SEQ ID NO: 1720825 - RNA, 19 nt, Salmonella enterica enterica serovar Typhi
auaugcaggcauaaaaaag

SEQ ID NO: 1720826 - RNA, 19 nt, Salmonella enterica enterica serovar Typhi
auauccucgcauccuccau

SEQ ID NO: 1720827 - RNA, 22 nt, Salmonella enterica enterica serovar Typhi
auauccugcaccgccugcggca

SEQ ID NO: 1720828 - RNA, 22 nt, Salmonella enterica enterica serovar Typhi
auaugccugcacuaaaccagau

SEQ ID NO: 1720829 - RNA, 21 nt, Salmonella enterica enterica serovar Typhi
auaugcagugcugcugccauu

SEQ ID NO: 1720830 - RNA, 22 nt, Salmonella enterica enterica serovar Typhi
auaugccaaguaauaaagagaa

SEQ ID NO: 1720831 - RNA, 23 nt, Salmonella enterica enterica serovar Typhi
auauggcgcaaguguauggcugg

SEQ ID NO: 1720832 - RNA, 17 nt, Salmonella enterica enterica serovar Typhi
auauguuugacaagcag

SEQ ID NO: 1720833 - RNA, 22 nt, Salmonella enterica enterica serovar Typhi
auauguccaugcgcaguaggca

SEQ ID NO: 1720834 - RNA, 17 nt, Salmonella enterica enterica serovar Typhi
auauguguaucuugcuu

SEQ ID NO: 1720835 - RNA, 15 nt, Salmonella enterica enterica serovar Typhi
auauuacuaauaaaa

SEQ ID NO: 1720836 - RNA, 13 nt, Salmonella enterica enterica serovar Typhi
auauuaaauaaau

SEQ ID NO: 1720837 - RNA, 18 nt, Salmonella enterica enterica serovar Typhi
auauuccgccucguguaa

SEQ ID NO: 1720838 - RNA, 19 nt, Salmonella enterica enterica serovar Typhi
auauuagcgguacucuuuu

SEQ ID NO: 1720839 - RNA, 14 nt, Salmonella enterica enterica serovar Typhi
auauuauaaaauaa

SEQ ID NO: 1720840 - RNA, 12 nt, Salmonella enterica enterica serovar Typhi
auauuauaaaau

SEQ ID NO: 1720841 - RNA, 18 nt, Salmonella enterica enterica serovar Typhi
auauuauccuuuaauuaa

SEQ ID NO: 1720842 - RNA, 19 nt, Salmonella enterica enterica serovar Typhi
auauuauucugcugaaaaa

SEQ ID NO: 1720843 - RNA, 17 nt, Salmonella enterica enterica serovar Typhi
auauuauuaugucauag

SEQ ID NO: 1720844 - RNA, 22 nt, Salmonella enterica enterica serovar Typhi
auauuauugacgcuuucuuccc

SEQ ID NO: 1720845 - RNA, 21 nt, Salmonella enterica enterica serovar Typhi
aucacagggggaacauuuaag

SEQ ID NO: 1720846 - RNA, 17 nt, Salmonella enterica enterica serovar Typhi
aucacacccgcacgccu

SEQ ID NO: 1720847 - RNA, 18 nt, Salmonella enterica enterica serovar Typhi
aucacaaauaacagacga

SEQ ID NO: 1720848 - RNA, 14 nt, Salmonella enterica enterica serovar Typhi
aucacaaauaacag

SEQ ID NO: 1720849 - RNA, 19 nt, Salmonella enterica enterica serovar Typhi
aucacaaaauggcugauaa

SEQ ID NO: 1720850 - RNA, 22 nt, Salmonella enterica enterica serovar Typhi
aucacaccaacgcuggcccggc

SEQ ID NO: 1720851 - RNA, 19 nt, Salmonella enterica enterica serovar Typhi
aucacacauaucgccagcc

SEQ ID NO: 1720852 - RNA, 12 nt, Salmonella enterica enterica serovar Typhi
aucaauuuuucg

SEQ ID NO: 1720853 - RNA, 20 nt, Salmonella enterica enterica serovar Typhi
aucaauuucccuucaaucac

SEQ ID NO: 1720854 - RNA, 18 nt, Salmonella enterica enterica serovar Typhi
aucaccugaaugcaaaga

SEQ ID NO: 1720855 - RNA, 15 nt, Salmonella enterica enterica serovar Typhi
aucacccugaauuuc

SEQ ID NO: 1720856 - RNA, 17 nt, Salmonella enterica enterica serovar Typhi
aucacccaacguucaug

SEQ ID NO: 1720857 - RNA, 19 nt, Salmonella enterica enterica serovar Typhi
aucaccauucccagcgccc

SEQ ID NO: 1720858 - RNA, 17 nt, Salmonella enterica enterica serovar Typhi
aucaccauucccagcgc

SEQ ID NO: 1720859 - RNA, 18 nt, Salmonella enterica enterica serovar Typhi
aucaccauucccagcgcc

SEQ ID NO: 1720860 - RNA, 21 nt, Salmonella enterica enterica serovar Typhi
aucaccaucguugccagcggc

SEQ ID NO: 1720861 - RNA, 14 nt, Salmonella enterica enterica serovar Typhi
aucaccaggcaaug

SEQ ID NO: 1720862 - RNA, 12 nt, Salmonella enterica enterica serovar Typhi
aucaccagcgca

SEQ ID NO: 1720863 - RNA, 16 nt, Salmonella enterica enterica serovar Typhi
aucaccaaguagacag

SEQ ID NO: 1720864 - RNA, 19 nt, Salmonella enterica enterica serovar Typhi
aucacguuuugcagcgcca

SEQ ID NO: 1720865 - RNA, 20 nt, Salmonella enterica enterica serovar Typhi
aucacguuggggaauaaaua

SEQ ID NO: 1720866 - RNA, 22 nt, Salmonella enterica enterica serovar Typhi
aucaccugauugauacgcgccc

SEQ ID NO: 1720867 - RNA, 21 nt, Salmonella enterica enterica serovar Typhi
aucaccugaccgauauagcca

SEQ ID NO: 1720868 - RNA, 22 nt, Salmonella enterica enterica serovar Typhi
aucaccugaccgauauagccac

SEQ ID NO: 1720869 - RNA, 15 nt, Salmonella enterica enterica serovar Typhi
aucaccuggugcauu

SEQ ID NO: 1720870 - RNA, 13 nt, Salmonella enterica enterica serovar Typhi
aucacucucuugu

SEQ ID NO: 1720871 - RNA, 17 nt, Salmonella enterica enterica serovar Typhi
aucacugauauaacccu

SEQ ID NO: 1720872 - RNA, 14 nt, Salmonella enterica enterica serovar Typhi
aucacugccgccac

SEQ ID NO: 1720873 - RNA, 21 nt, Salmonella enterica enterica serovar Typhi
aucacuaucaguuuuggcaau

SEQ ID NO: 1720874 - RNA, 17 nt, Salmonella enterica enterica serovar Typhi
aucagcaguugcgacug

SEQ ID NO: 1720875 - RNA, 18 nt, Salmonella enterica enterica serovar Typhi
aucagcagccgggccaga

SEQ ID NO: 1720876 - RNA, 17 nt, Salmonella enterica enterica serovar Typhi
aucagcacacuacacag

SEQ ID NO: 1720877 - RNA, 18 nt, Salmonella enterica enterica serovar Typhi
aucagcacauucagcagc

SEQ ID NO: 1720878 - RNA, 15 nt, Salmonella enterica enterica serovar Typhi
aucagcaccacgccc

SEQ ID NO: 1720879 - RNA, 20 nt, Salmonella enterica enterica serovar Typhi
aucacuggagcgcauuuuac

SEQ ID NO: 1720880 - RNA, 18 nt, Salmonella enterica enterica serovar Typhi
aucagaaaaaccuccggc

SEQ ID NO: 1720881 - RNA, 18 nt, Salmonella enterica enterica serovar Typhi
aucacuuaucaaaccagc

SEQ ID NO: 1720882 - RNA, 21 nt, Salmonella enterica enterica serovar Typhi
aucacuuaucaaaccagcuuu

SEQ ID NO: 1720883 - RNA, 19 nt, Salmonella enterica enterica serovar Typhi
aucagaagcuaagggaugc

SEQ ID NO: 1720884 - RNA, 14 nt, Salmonella enterica enterica serovar Typhi
aucaggaucaaaau

SEQ ID NO: 1720885 - RNA, 23 nt, Salmonella enterica enterica serovar Typhi
aucaggcaagacccgaaccugcg

SEQ ID NO: 1720886 - RNA, 21 nt, Salmonella enterica enterica serovar Typhi
aucaggcaaaaaucgucauca

SEQ ID NO: 1720887 - RNA, 21 nt, Salmonella enterica enterica serovar Typhi
aucaggaguaaauaacaaaag

SEQ ID NO: 1720888 - RNA, 17 nt, Salmonella enterica enterica serovar Typhi
aucagcgauugcgccag

SEQ ID NO: 1720889 - RNA, 20 nt, Salmonella enterica enterica serovar Typhi
aucagccguuacuuccccca

SEQ ID NO: 1720890 - RNA, 22 nt, Salmonella enterica enterica serovar Typhi
aucagcccgauacccgcccaga

SEQ ID NO: 1720891 - RNA, 13 nt, Salmonella enterica enterica serovar Typhi
aucagcccgcaaa

SEQ ID NO: 1720892 - RNA, 18 nt, Salmonella enterica enterica serovar Typhi
aucagcccgcaaaggacc

SEQ ID NO: 1720893 - RNA, 23 nt, Salmonella enterica enterica serovar Typhi
aucagcccgcaaaggaccaacac

SEQ ID NO: 1720894 - RNA, 14 nt, Salmonella enterica enterica serovar Typhi
aucagccccagcac

SEQ ID NO: 1720895 - RNA, 14 nt, Salmonella enterica enterica serovar Typhi
aaaacggccaguga

SEQ ID NO: 1720896 - RNA, 13 nt, Salmonella enterica enterica serovar Typhi
aaaacgguuuuca

SEQ ID NO: 1720897 - RNA, 22 nt, Salmonella enterica enterica serovar Typhi
aaaacguaacguacgggugucc

SEQ ID NO: 1720898 - RNA, 18 nt, Salmonella enterica enterica serovar Typhi
aucaguccccacauuacg

SEQ ID NO: 1720899 - RNA, 14 nt, Salmonella enterica enterica serovar Typhi
aaaacgaaaaaccc

SEQ ID NO: 1720900 - RNA, 18 nt, Salmonella enterica enterica serovar Typhi
aucagugaacacccugcc

SEQ ID NO: 1720901 - RNA, 23 nt, Salmonella enterica enterica serovar Typhi
aucagucgcagcggcugcgccug

SEQ ID NO: 1720902 - RNA, 19 nt, Salmonella enterica enterica serovar Typhi
aucaguuccaaucucuuuu

SEQ ID NO: 1720903 - RNA, 15 nt, Salmonella enterica enterica serovar Typhi
aucaguugcaggaag

SEQ ID NO: 1720904 - RNA, 16 nt, Salmonella enterica enterica serovar Typhi
aucaguaacagaacaa

SEQ ID NO: 1720905 - RNA, 20 nt, Salmonella enterica enterica serovar Typhi
aucaguaacugacgaccggg

SEQ ID NO: 1720906 - RNA, 17 nt, Salmonella enterica enterica serovar Typhi
aucaguaauguccagau

SEQ ID NO: 1720907 - RNA, 14 nt, Salmonella enterica enterica serovar Typhi
aucagggaaaaaug

SEQ ID NO: 1720908 - RNA, 20 nt, Salmonella enterica enterica serovar Typhi
aucaggcacacguuaaaccc

SEQ ID NO: 1720909 - RNA, 17 nt, Salmonella enterica enterica serovar Typhi
aucaggcacaacccaaa

SEQ ID NO: 1720910 - RNA, 17 nt, Salmonella enterica enterica serovar Typhi
aucaggcauccugcccu

SEQ ID NO: 1720911 - RNA, 16 nt, Salmonella enterica enterica serovar Typhi
aucaggcauaaaccua

SEQ ID NO: 1720912 - RNA, 21 nt, Salmonella enterica enterica serovar Typhi
caaguccgccgcuauuacccc

SEQ ID NO: 1720913 - RNA, 15 nt, Salmonella enterica enterica serovar Typhi
caaguccaaguaugu

SEQ ID NO: 1720914 - RNA, 17 nt, Salmonella enterica enterica serovar Typhi
caaguccuucuuccccc

SEQ ID NO: 1720915 - RNA, 14 nt, Salmonella enterica enterica serovar Typhi
caagucaccaucag

SEQ ID NO: 1720916 - RNA, 23 nt, Salmonella enterica enterica serovar Typhi
caaguaguuguuauagcgcgccc

SEQ ID NO: 1720917 - RNA, 14 nt, Salmonella enterica enterica serovar Typhi
caaguaguuguuau

SEQ ID NO: 1720918 - RNA, 23 nt, Salmonella enterica enterica serovar Typhi
caagcugcuggcgagcaggaaaa

SEQ ID NO: 1720919 - RNA, 20 nt, Salmonella enterica enterica serovar Typhi
caauaaaaauaucauuaaau

SEQ ID NO: 1720920 - RNA, 15 nt, Salmonella enterica enterica serovar Typhi
caauaaaguuuauuu

SEQ ID NO: 1720921 - RNA, 13 nt, Salmonella enterica enterica serovar Typhi
caauaaagcaggg

SEQ ID NO: 1720922 - RNA, 16 nt, Salmonella enterica enterica serovar Typhi
caauaaacgccagguu

SEQ ID NO: 1720923 - RNA, 16 nt, Salmonella enterica enterica serovar Typhi
caauaaacauuuuuuu

SEQ ID NO: 1720924 - RNA, 12 nt, Salmonella enterica enterica serovar Typhi
caaguuuauccg

SEQ ID NO: 1720925 - RNA, 21 nt, Salmonella enterica enterica serovar Typhi
caaguuuggcaaucaaaucca

SEQ ID NO: 1720926 - RNA, 21 nt, Salmonella enterica enterica serovar Typhi
caauaaguuagcuuuuuuaug

SEQ ID NO: 1720927 - RNA, 23 nt, Salmonella enterica enterica serovar Typhi
caauaagggucgcgcuguauaau

SEQ ID NO: 1720928 - RNA, 17 nt, Salmonella enterica enterica serovar Typhi
caauaagugauccauac

SEQ ID NO: 1720929 - RNA, 20 nt, Salmonella enterica enterica serovar Typhi
caauaagcuugcuuuccaua

SEQ ID NO: 1720930 - RNA, 22 nt, Salmonella enterica enterica serovar Typhi
caauacagcccgccagcaccag

SEQ ID NO: 1720931 - RNA, 16 nt, Salmonella enterica enterica serovar Typhi
caauaccuucugcgcc

SEQ ID NO: 1720932 - RNA, 19 nt, Salmonella enterica enterica serovar Typhi
caauacgcugaacuucggg

SEQ ID NO: 1720933 - RNA, 19 nt, Salmonella enterica enterica serovar Typhi
caauacgagugacauuauu

SEQ ID NO: 1720934 - RNA, 16 nt, Salmonella enterica enterica serovar Typhi
caauauagccguggcu

SEQ ID NO: 1720935 - RNA, 16 nt, Salmonella enterica enterica serovar Typhi
caauauagaguccuga

SEQ ID NO: 1720936 - RNA, 12 nt, Salmonella enterica enterica serovar Typhi
caauauacuuau

SEQ ID NO: 1720937 - RNA, 20 nt, Salmonella enterica enterica serovar Typhi
caauauaccgucaguaccag

SEQ ID NO: 1720938 - RNA, 20 nt, Salmonella enterica enterica serovar Typhi
caauaucagccauuaaccag

SEQ ID NO: 1720939 - RNA, 18 nt, Salmonella enterica enterica serovar Typhi
caauaucaacgaccgucg

SEQ ID NO: 1720940 - RNA, 12 nt, Salmonella enterica enterica serovar Typhi
caauauccuccg

SEQ ID NO: 1720941 - RNA, 13 nt, Salmonella enterica enterica serovar Typhi
caauauccuccgg

SEQ ID NO: 1720942 - RNA, 18 nt, Salmonella enterica enterica serovar Typhi
caauauccucgcauccuc

SEQ ID NO: 1720943 - RNA, 15 nt, Salmonella enterica enterica serovar Typhi
caauauccccagccc

SEQ ID NO: 1720944 - RNA, 20 nt, Salmonella enterica enterica serovar Typhi
caauauccgccccgcuggcu

SEQ ID NO: 1720945 - RNA, 12 nt, Salmonella enterica enterica serovar Typhi
caaucaccguug

SEQ ID NO: 1720946 - RNA, 21 nt, Salmonella enterica enterica serovar Typhi
caaucaccugaugcccauacg

SEQ ID NO: 1720947 - RNA, 12 nt, Salmonella enterica enterica serovar Typhi
caauauuuuucc

SEQ ID NO: 1720948 - RNA, 22 nt, Salmonella enterica enterica serovar Typhi
caaucaggaaagagccgcgcag

SEQ ID NO: 1720949 - RNA, 22 nt, Salmonella enterica enterica serovar Typhi
caaucaggcgcaaacgcgugcu

SEQ ID NO: 1720950 - RNA, 17 nt, Salmonella enterica enterica serovar Typhi
caaucagguauuuccug

SEQ ID NO: 1720951 - RNA, 13 nt, Salmonella enterica enterica serovar Typhi
caaucagcaccau

SEQ ID NO: 1720952 - RNA, 22 nt, Salmonella enterica enterica serovar Typhi
caaucacuuuugcgacccacaa

SEQ ID NO: 1720953 - RNA, 19 nt, Salmonella enterica enterica serovar Typhi
caaucacuuuugcgaccca

SEQ ID NO: 1720954 - RNA, 19 nt, Salmonella enterica enterica serovar Typhi
caaucacugaugccacacc

SEQ ID NO: 1720955 - RNA, 23 nt, Salmonella enterica enterica serovar Typhi
caauccagaauaccagaaucacc

SEQ ID NO: 1720956 - RNA, 18 nt, Salmonella enterica enterica serovar Typhi
caauccauuuuaaauaca

SEQ ID NO: 1720957 - RNA, 17 nt, Salmonella enterica enterica serovar Typhi
caauccaacgaaacuca

SEQ ID NO: 1720958 - RNA, 21 nt, Salmonella enterica enterica serovar Typhi
caauccaacgaaacucagcgg

SEQ ID NO: 1720959 - RNA, 21 nt, Salmonella enterica enterica serovar Typhi
caaucauaaacgccugacgau

SEQ ID NO: 1720960 - RNA, 13 nt, Salmonella enterica enterica serovar Typhi
caaucauaauaaa

SEQ ID NO: 1720961 - RNA, 20 nt, Salmonella enterica enterica serovar Typhi
caaucaguaugaugaccugg

SEQ ID NO: 1720962 - RNA, 20 nt, Salmonella enterica enterica serovar Typhi
caauccuucuaccuucaccc

SEQ ID NO: 1720963 - RNA, 12 nt, Salmonella enterica enterica serovar Typhi
caaucuacuuuu

SEQ ID NO: 1720964 - RNA, 19 nt, Salmonella enterica enterica serovar Typhi
caaucguuaauucauggcc

SEQ ID NO: 1720965 - RNA, 15 nt, Salmonella enterica enterica serovar Typhi
caaucucaauaccac

SEQ ID NO: 1720966 - RNA, 15 nt, Salmonella enterica enterica serovar Typhi
caaucucacugccca

SEQ ID NO: 1720967 - RNA, 19 nt, Salmonella enterica enterica serovar Typhi
caagauaagaaguaaacag

SEQ ID NO: 1720968 - RNA, 19 nt, Salmonella enterica enterica serovar Typhi
caagaucaaugugcucaac

SEQ ID NO: 1720969 - RNA, 14 nt, Salmonella enterica enterica serovar Typhi
caagaucccucacc

SEQ ID NO: 1720970 - RNA, 16 nt, Salmonella enterica enterica serovar Typhi
caagauccguccaugu

SEQ ID NO: 1720971 - RNA, 23 nt, Salmonella enterica enterica serovar Typhi
caagaucauccggguuaaaccag

SEQ ID NO: 1720972 - RNA, 20 nt, Salmonella enterica enterica serovar Typhi
caagaucacauacaaagaga

SEQ ID NO: 1720973 - RNA, 20 nt, Salmonella enterica enterica serovar Typhi
caagagaaaaaucagucauu

SEQ ID NO: 1720974 - RNA, 21 nt, Salmonella enterica enterica serovar Typhi
caagagagcaacauaccgcag

SEQ ID NO: 1720975 - RNA, 13 nt, Salmonella enterica enterica serovar Typhi
caagauaaaaaga

SEQ ID NO: 1720976 - RNA, 17 nt, Salmonella enterica enterica serovar Typhi
caagagaugcagacaau

SEQ ID NO: 1720977 - RNA, 19 nt, Salmonella enterica enterica serovar Typhi
caagagauucaggccgcca

SEQ ID NO: 1720978 - RNA, 16 nt, Salmonella enterica enterica serovar Typhi
caagaauuaaauaacg

SEQ ID NO: 1720979 - RNA, 16 nt, Salmonella enterica enterica serovar Typhi
caacuucaugaguaaa

SEQ ID NO: 1720980 - RNA, 21 nt, Salmonella enterica enterica serovar Typhi
caagaagcguugaccguacug

SEQ ID NO: 1720981 - RNA, 15 nt, Salmonella enterica enterica serovar Typhi
caagaauaugcagug

SEQ ID NO: 1720982 - RNA, 13 nt, Salmonella enterica enterica serovar Typhi
caagcucauuucc

SEQ ID NO: 1720983 - RNA, 17 nt, Salmonella enterica enterica serovar Typhi
caagcucauuucccaau

SEQ ID NO: 1720984 - RNA, 15 nt, Salmonella enterica enterica serovar Typhi
caagcugauuuuucg

SEQ ID NO: 1720985 - RNA, 23 nt, Salmonella enterica enterica serovar Typhi
caagcgaagcgccgucggcaucg

SEQ ID NO: 1720986 - RNA, 17 nt, Salmonella enterica enterica serovar Typhi
caagcgccuguucaaca

SEQ ID NO: 1720987 - RNA, 18 nt, Salmonella enterica enterica serovar Typhi
caagcgccuguucaacau

SEQ ID NO: 1720988 - RNA, 17 nt, Salmonella enterica enterica serovar Typhi
caagcguuuaauuccau

SEQ ID NO: 1720989 - RNA, 15 nt, Salmonella enterica enterica serovar Typhi
caagcaguuccagca

SEQ ID NO: 1720990 - RNA, 20 nt, Salmonella enterica enterica serovar Typhi
caagccgguaaucgcgcgca

SEQ ID NO: 1720991 - RNA, 14 nt, Salmonella enterica enterica serovar Typhi
caagccgaucagcg

SEQ ID NO: 1720992 - RNA, 14 nt, Salmonella enterica enterica serovar Typhi
caagccgccaacgc

SEQ ID NO: 1720993 - RNA, 13 nt, Salmonella enterica enterica serovar Typhi
caacucagcaaua

SEQ ID NO: 1720994 - RNA, 15 nt, Salmonella enterica enterica serovar Typhi
caacucauccaccuu

SEQ ID NO: 1720995 - RNA, 19 nt, Salmonella enterica enterica serovar Typhi
caacguuucuuucaucaga

SEQ ID NO: 1720996 - RNA, 20 nt, Salmonella enterica enterica serovar Typhi
caacguuucuuucaucagau

SEQ ID NO: 1720997 - RNA, 22 nt, Salmonella enterica enterica serovar Typhi
caacguuucuuucaucagauca

SEQ ID NO: 1720998 - RNA, 15 nt, Salmonella enterica enterica serovar Typhi
caacgugcagauggu

SEQ ID NO: 1720999 - RNA, 16 nt, Salmonella enterica enterica serovar Typhi
caacguuaacugcugc

SEQ ID NO: 1721000 - RNA, 18 nt, Salmonella enterica enterica serovar Typhi
caacggucggucuuuuug

SEQ ID NO: 1721001 - RNA, 16 nt, Salmonella enterica enterica serovar Typhi
caacguaaauagagaa

SEQ ID NO: 1721002 - RNA, 14 nt, Salmonella enterica enterica serovar Typhi
caacgucagcaucu

SEQ ID NO: 1721003 - RNA, 21 nt, Salmonella enterica enterica serovar Typhi
caacgucgacagacgcaucuu

SEQ ID NO: 1721004 - RNA, 16 nt, Salmonella enterica enterica serovar Typhi
caacugcgccugaaga

SEQ ID NO: 1721005 - RNA, 19 nt, Salmonella enterica enterica serovar Typhi
caacugcugcgcgugcugu

SEQ ID NO: 1721006 - RNA, 20 nt, Salmonella enterica enterica serovar Typhi
caacugcugcgcgugcugua

SEQ ID NO: 1721007 - RNA, 19 nt, Salmonella enterica enterica serovar Typhi
caaccguuggggaaaauau

SEQ ID NO: 1721008 - RNA, 16 nt, Salmonella enterica enterica serovar Typhi
caaccguuucuuuuuc

SEQ ID NO: 1721009 - RNA, 15 nt, Salmonella enterica enterica serovar Typhi
caaccguuucuuuuu

SEQ ID NO: 1721010 - RNA, 15 nt, Salmonella enterica enterica serovar Typhi
caaccgucaucucuu

SEQ ID NO: 1721011 - RNA, 17 nt, Salmonella enterica enterica serovar Typhi
caaccggguaaacgcca

SEQ ID NO: 1721012 - RNA, 21 nt, Salmonella enterica enterica serovar Typhi
caacgcgaguauucgcgcccu

SEQ ID NO: 1721013 - RNA, 17 nt, Salmonella enterica enterica serovar Typhi
caacgccuucguccgga

SEQ ID NO: 1721014 - RNA, 22 nt, Salmonella enterica enterica serovar Typhi
caaccuccgcggggaucgguuu

SEQ ID NO: 1721015 - RNA, 17 nt, Salmonella enterica enterica serovar Typhi
caaccucacuguugaua

SEQ ID NO: 1721016 - RNA, 12 nt, Salmonella enterica enterica serovar Typhi
caaccucgcuuc

SEQ ID NO: 1721017 - RNA, 14 nt, Salmonella enterica enterica serovar Typhi
caacgcgccgccaa

SEQ ID NO: 1721018 - RNA, 16 nt, Salmonella enterica enterica serovar Typhi
caacgcguugccgccg

SEQ ID NO: 1721019 - RNA, 17 nt, Salmonella enterica enterica serovar Typhi
caacgcgugauccacag

SEQ ID NO: 1721020 - RNA, 19 nt, Salmonella enterica enterica serovar Typhi
caacgcuuuagugccgcca

SEQ ID NO: 1721021 - RNA, 20 nt, Salmonella enterica enterica serovar Typhi
caacgcuuuagugccgccau

SEQ ID NO: 1721022 - RNA, 15 nt, Salmonella enterica enterica serovar Typhi
caacggcacacaggc

SEQ ID NO: 1721023 - RNA, 20 nt, Salmonella enterica enterica serovar Typhi
caacggccagcaaaaucacc

SEQ ID NO: 1721024 - RNA, 21 nt, Salmonella enterica enterica serovar Typhi
caacgggcuuuuagccgcgcc

SEQ ID NO: 1721025 - RNA, 15 nt, Salmonella enterica enterica serovar Typhi
caacggcuugugagc

SEQ ID NO: 1721026 - RNA, 16 nt, Salmonella enterica enterica serovar Typhi
caaaucuguuaucugg

SEQ ID NO: 1721027 - RNA, 19 nt, Salmonella enterica enterica serovar Typhi
caaaucuucauuucauugc

SEQ ID NO: 1721028 - RNA, 22 nt, Salmonella enterica enterica serovar Typhi
caaaucuggugauaaagcagac

SEQ ID NO: 1721029 - RNA, 21 nt, Salmonella enterica enterica serovar Typhi
caaaucuguuaucuggaugua

SEQ ID NO: 1721030 - RNA, 23 nt, Salmonella enterica enterica serovar Typhi
caaaucgugugcgguauagauca

SEQ ID NO: 1721031 - RNA, 18 nt, Salmonella enterica enterica serovar Typhi
caaaucgggaaaaugaug

SEQ ID NO: 1721032 - RNA, 21 nt, Salmonella enterica enterica serovar Typhi
caaaugcagcggaauucccac

SEQ ID NO: 1721033 - RNA, 13 nt, Salmonella enterica enterica serovar Typhi
caaaugucagauc

SEQ ID NO: 1721034 - RNA, 22 nt, Salmonella enterica enterica serovar Typhi
caaaugaaccugaugugcuuuu

SEQ ID NO: 1721035 - RNA, 18 nt, Salmonella enterica enterica serovar Typhi
caaaugauaauaugcuca

SEQ ID NO: 1721036 - RNA, 15 nt, Salmonella enterica enterica serovar Typhi
caaaugagaauagac

SEQ ID NO: 1721037 - RNA, 20 nt, Salmonella enterica enterica serovar Typhi
caaauguuguuugaaaagug

SEQ ID NO: 1721038 - RNA, 21 nt, Salmonella enterica enterica serovar Typhi
caaagucuggccaccgauaaa

SEQ ID NO: 1721039 - RNA, 16 nt, Salmonella enterica enterica serovar Typhi
caaagucuucaugguc

SEQ ID NO: 1721040 - RNA, 14 nt, Salmonella enterica enterica serovar Typhi
caaauauuucuuug

SEQ ID NO: 1721041 - RNA, 15 nt, Salmonella enterica enterica serovar Typhi
caaagucuuuuguau

SEQ ID NO: 1721042 - RNA, 20 nt, Salmonella enterica enterica serovar Typhi
caaauauccuaccacgccgc

SEQ ID NO: 1721043 - RNA, 18 nt, Salmonella enterica enterica serovar Typhi
caaauauauugaaaaggg

SEQ ID NO: 1721044 - RNA, 16 nt, Salmonella enterica enterica serovar Typhi
caaaucgcgguaaaaa

SEQ ID NO: 1721045 - RNA, 16 nt, Salmonella enterica enterica serovar Typhi
caaaucgcccaucaca

SEQ ID NO: 1721046 - RNA, 18 nt, Salmonella enterica enterica serovar Typhi
caaaucgcccaucacaug

SEQ ID NO: 1721047 - RNA, 20 nt, Salmonella enterica enterica serovar Typhi
caaaucgcccaucacaugua

SEQ ID NO: 1721048 - RNA, 21 nt, Salmonella enterica enterica serovar Typhi
caaauccgcauuucgcccucg

SEQ ID NO: 1721049 - RNA, 17 nt, Salmonella enterica enterica serovar Typhi
caaaucccgguaaaggu

SEQ ID NO: 1721050 - RNA, 20 nt, Salmonella enterica enterica serovar Typhi
caaaucccugaucggccaga

SEQ ID NO: 1721051 - RNA, 13 nt, Salmonella enterica enterica serovar Typhi
caaauccuccaua

SEQ ID NO: 1721052 - RNA, 19 nt, Salmonella enterica enterica serovar Typhi
caaauccagcucaguuucc

SEQ ID NO: 1721053 - RNA, 15 nt, Salmonella enterica enterica serovar Typhi
caaaucaggaaauaa

SEQ ID NO: 1721054 - RNA, 16 nt, Salmonella enterica enterica serovar Typhi
caaaucaccacauggc

SEQ ID NO: 1721055 - RNA, 17 nt, Salmonella enterica enterica serovar Typhi
caaaucaccacauggcc

SEQ ID NO: 1721056 - RNA, 18 nt, Salmonella enterica enterica serovar Typhi
caaccagccgaucagcgc

SEQ ID NO: 1721057 - RNA, 17 nt, Salmonella enterica enterica serovar Typhi
caaccagcgaaaugacg

SEQ ID NO: 1721058 - RNA, 21 nt, Salmonella enterica enterica serovar Typhi
caaccagcgaaaugacggcca

SEQ ID NO: 1721059 - RNA, 22 nt, Salmonella enterica enterica serovar Typhi
caaccagcgaaaugacggccac

SEQ ID NO: 1721060 - RNA, 12 nt, Salmonella enterica enterica serovar Typhi
caaccaggcaaa

SEQ ID NO: 1721061 - RNA, 23 nt, Salmonella enterica enterica serovar Typhi
caacauugccggcaucauucugc

SEQ ID NO: 1721062 - RNA, 15 nt, Salmonella enterica enterica serovar Typhi
caacaugaccagcgc

SEQ ID NO: 1721063 - RNA, 23 nt, Salmonella enterica enterica serovar Typhi
caacaugcugaccgaaccgcugu

SEQ ID NO: 1721064 - RNA, 22 nt, Salmonella enterica enterica serovar Typhi
caacauggacaccggaagugaa

SEQ ID NO: 1721065 - RNA, 20 nt, Salmonella enterica enterica serovar Typhi
caacauuaucaaaagugauc

SEQ ID NO: 1721066 - RNA, 19 nt, Salmonella enterica enterica serovar Typhi
caaccaguuaauuucuuuc

SEQ ID NO: 1721067 - RNA, 22 nt, Salmonella enterica enterica serovar Typhi
caaccaguggcggggcagaacc

SEQ ID NO: 1721068 - RNA, 11 nt, Salmonella enterica enterica serovar Typhi
caaccauacau

SEQ ID NO: 1721069 - RNA, 22 nt, Salmonella enterica enterica serovar Typhi
caaccaugauaaccagccccgg

SEQ ID NO: 1721070 - RNA, 14 nt, Salmonella enterica enterica serovar Typhi
caacccaaaggcca

SEQ ID NO: 1721071 - RNA, 12 nt, Salmonella enterica enterica serovar Typhi
caaccggcuggc

SEQ ID NO: 1721072 - RNA, 21 nt, Salmonella enterica enterica serovar Typhi
caaccggcuccggguugccug

SEQ ID NO: 1721073 - RNA, 13 nt, Salmonella enterica enterica serovar Typhi
caaccgacgcauu

SEQ ID NO: 1721074 - RNA, 19 nt, Salmonella enterica enterica serovar Typhi
caacaguugcuggagcagg

SEQ ID NO: 1721075 - RNA, 20 nt, Salmonella enterica enterica serovar Typhi
caacagugugccgucaucca

SEQ ID NO: 1721076 - RNA, 16 nt, Salmonella enterica enterica serovar Typhi
caacagugggcuauga

SEQ ID NO: 1721077 - RNA, 21 nt, Salmonella enterica enterica serovar Typhi
caacagugggcuaugaagaga

SEQ ID NO: 1721078 - RNA, 15 nt, Salmonella enterica enterica serovar Typhi
caacagcggagagac

SEQ ID NO: 1721079 - RNA, 15 nt, Salmonella enterica enterica serovar Typhi
caacagcgagcuaug

SEQ ID NO: 1721080 - RNA, 15 nt, Salmonella enterica enterica serovar Typhi
caacaguaccuucaa

SEQ ID NO: 1721081 - RNA, 17 nt, Salmonella enterica enterica serovar Typhi
caacaucaucggaucca

SEQ ID NO: 1721082 - RNA, 19 nt, Salmonella enterica enterica serovar Typhi
caacaucagcgcuaccagc

SEQ ID NO: 1721083 - RNA, 13 nt, Salmonella enterica enterica serovar Typhi
caacaucuuugcc

SEQ ID NO: 1721084 - RNA, 16 nt, Salmonella enterica enterica serovar Typhi
caacauccugggucug

SEQ ID NO: 1721085 - RNA, 14 nt, Salmonella enterica enterica serovar Typhi
caacaacagauaua

SEQ ID NO: 1721086 - RNA, 14 nt, Salmonella enterica enterica serovar Typhi
caacaccaccgcuc

SEQ ID NO: 1721087 - RNA, 12 nt, Salmonella enterica enterica serovar Typhi
caacaaacauaa

SEQ ID NO: 1721088 - RNA, 14 nt, Salmonella enterica enterica serovar Typhi
caacaaagguuugu

SEQ ID NO: 1721089 - RNA, 19 nt, Salmonella enterica enterica serovar Typhi
caacaccgauccgaagaac

SEQ ID NO: 1721090 - RNA, 15 nt, Salmonella enterica enterica serovar Typhi
caacacccacaccau

SEQ ID NO: 1721091 - RNA, 23 nt, Salmonella enterica enterica serovar Typhi
caacaccaucccgcucuucagua

SEQ ID NO: 1721092 - RNA, 14 nt, Salmonella enterica enterica serovar Typhi
caacagcaauguuu

SEQ ID NO: 1721093 - RNA, 23 nt, Salmonella enterica enterica serovar Typhi
caaaaucguuaaccagcggcgac

SEQ ID NO: 1721094 - RNA, 16 nt, Salmonella enterica enterica serovar Typhi
caaaauccgccaccgc

SEQ ID NO: 1721095 - RNA, 20 nt, Salmonella enterica enterica serovar Typhi
caaaaucccggcuggguuca

SEQ ID NO: 1721096 - RNA, 23 nt, Salmonella enterica enterica serovar Typhi
caaaauccgccaccgcgcgcaga

SEQ ID NO: 1721097 - RNA, 24 nt, Salmonella enterica enterica serovar Typhi
caaaauccuuguugauaaaacgaa

SEQ ID NO: 1721098 - RNA, 14 nt, Salmonella enterica enterica serovar Typhi
caaaauagucaguu

SEQ ID NO: 1721099 - RNA, 22 nt, Salmonella enterica enterica serovar Typhi
caaaaugugcaaucacacuaca

SEQ ID NO: 1721100 - RNA, 17 nt, Salmonella enterica enterica serovar Typhi
caaaagccuguuuacca

SEQ ID NO: 1721101 - RNA, 15 nt, Salmonella enterica enterica serovar Typhi
caaaagccagauaaa

SEQ ID NO: 1721102 - RNA, 22 nt, Salmonella enterica enterica serovar Typhi
caaaaggccuuuuuuuuaugcg

SEQ ID NO: 1721103 - RNA, 17 nt, Salmonella enterica enterica serovar Typhi
caaaaggcuggaacaga

SEQ ID NO: 1721104 - RNA, 23 nt, Salmonella enterica enterica serovar Typhi
caaaaggcuccacuucgguuugu

SEQ ID NO: 1721105 - RNA, 21 nt, Salmonella enterica enterica serovar Typhi
caaaaggcuggaacagauguu

SEQ ID NO: 1721106 - RNA, 14 nt, Salmonella enterica enterica serovar Typhi
caaaauacuggccg

SEQ ID NO: 1721107 - RNA, 19 nt, Salmonella enterica enterica serovar Typhi
caaaaccuucauaaauacg

SEQ ID NO: 1721108 - RNA, 18 nt, Salmonella enterica enterica serovar Typhi
caaaacguagagugcuuc

SEQ ID NO: 1721109 - RNA, 21 nt, Salmonella enterica enterica serovar Typhi
caaaacgucgugaguggcggc

SEQ ID NO: 1721110 - RNA, 23 nt, Salmonella enterica enterica serovar Typhi
caaaaacguuaggcgcaaaggca

SEQ ID NO: 1721111 - RNA, 23 nt, Salmonella enterica enterica serovar Typhi
caaaaacggcuuuaauaccccug

SEQ ID NO: 1721112 - RNA, 20 nt, Salmonella enterica enterica serovar Typhi
caaaaagaacucacucagug

SEQ ID NO: 1721113 - RNA, 18 nt, Salmonella enterica enterica serovar Typhi
caaaaagccuugcugaau

SEQ ID NO: 1721114 - RNA, 21 nt, Salmonella enterica enterica serovar Typhi
caaaaagcgcgccgaaaauau

SEQ ID NO: 1721115 - RNA, 15 nt, Salmonella enterica enterica serovar Typhi
caaaaagauauuaua

SEQ ID NO: 1721116 - RNA, 21 nt, Salmonella enterica enterica serovar Typhi
caaaacugaguuguaggcuca

SEQ ID NO: 1721117 - RNA, 23 nt, Salmonella enterica enterica serovar Typhi
caaaacucucaccgaccugccuu

SEQ ID NO: 1721118 - RNA, 17 nt, Salmonella enterica enterica serovar Typhi
caaaacuacgccaauga

SEQ ID NO: 1721119 - RNA, 18 nt, Salmonella enterica enterica serovar Typhi
caaaagaaagcaauagcu

SEQ ID NO: 1721120 - RNA, 23 nt, Salmonella enterica enterica serovar Typhi
caaaagaggaaguugcucccgca

SEQ ID NO: 1721121 - RNA, 17 nt, Salmonella enterica enterica serovar Typhi
caaaagaggcuaauuau

SEQ ID NO: 1721122 - RNA, 14 nt, Salmonella enterica enterica serovar Typhi
caaaagauugauuu

SEQ ID NO: 1721123 - RNA, 22 nt, Salmonella enterica enterica serovar Typhi
caaaagauuuaucaauuuuuaa

SEQ ID NO: 1721124 - RNA, 13 nt, Salmonella enterica enterica serovar Typhi
caaaccaccacca

SEQ ID NO: 1721125 - RNA, 13 nt, Salmonella enterica enterica serovar Typhi
caaacaaauaaau

SEQ ID NO: 1721126 - RNA, 16 nt, Salmonella enterica enterica serovar Typhi
caaacaaauaaaucca

SEQ ID NO: 1721127 - RNA, 17 nt, Salmonella enterica enterica serovar Typhi
caaaccaugauaauaau

SEQ ID NO: 1721128 - RNA, 16 nt, Salmonella enterica enterica serovar Typhi
caaaccagcuuuucau

SEQ ID NO: 1721129 - RNA, 23 nt, Salmonella enterica enterica serovar Typhi
caaaccagacgcguaaccccugc

SEQ ID NO: 1721130 - RNA, 17 nt, Salmonella enterica enterica serovar Typhi
caaaccgcuuucaucau

SEQ ID NO: 1721131 - RNA, 19 nt, Salmonella enterica enterica serovar Typhi
caaaccugagcauauaaau

SEQ ID NO: 1721132 - RNA, 13 nt, Salmonella enterica enterica serovar Typhi
caaacuuuuaaau

SEQ ID NO: 1721133 - RNA, 18 nt, Salmonella enterica enterica serovar Typhi
caaacuuugcgccauuuc

SEQ ID NO: 1721134 - RNA, 20 nt, Salmonella enterica enterica serovar Typhi
caaacuuaucucuuuuucuc

SEQ ID NO: 1721135 - RNA, 19 nt, Salmonella enterica enterica serovar Typhi
caaacggcagcucuuucaa

SEQ ID NO: 1721136 - RNA, 17 nt, Salmonella enterica enterica serovar Typhi
caaacgucguaaaaccu

SEQ ID NO: 1721137 - RNA, 15 nt, Salmonella enterica enterica serovar Typhi
caaacgcuggugcug

SEQ ID NO: 1721138 - RNA, 21 nt, Salmonella enterica enterica serovar Typhi
caaaccugccacaggccaaca

SEQ ID NO: 1721139 - RNA, 15 nt, Salmonella enterica enterica serovar Typhi
caaaccugccacagg

SEQ ID NO: 1721140 - RNA, 18 nt, Salmonella enterica enterica serovar Typhi
caaaccugccacaggcca

SEQ ID NO: 1721141 - RNA, 17 nt, Salmonella enterica enterica serovar Typhi
caaagaagaauccaggg

SEQ ID NO: 1721142 - RNA, 14 nt, Salmonella enterica enterica serovar Typhi
caaacuuuccguug

SEQ ID NO: 1721143 - RNA, 12 nt, Salmonella enterica enterica serovar Typhi
caaagaaaacca

SEQ ID NO: 1721144 - RNA, 13 nt, Salmonella enterica enterica serovar Typhi
caaagaccaauaa

SEQ ID NO: 1721145 - RNA, 17 nt, Salmonella enterica enterica serovar Typhi
caaagacaccccagccu

SEQ ID NO: 1721146 - RNA, 14 nt, Salmonella enterica enterica serovar Typhi
caaagacgaauaag

SEQ ID NO: 1721147 - RNA, 23 nt, Salmonella enterica enterica serovar Typhi
caaagacgguuucagugauaaag

SEQ ID NO: 1721148 - RNA, 19 nt, Salmonella enterica enterica serovar Typhi
caaagcaauaccacgcccg

SEQ ID NO: 1721149 - RNA, 16 nt, Salmonella enterica enterica serovar Typhi
caaagcaaaaaucacc

SEQ ID NO: 1721150 - RNA, 17 nt, Salmonella enterica enterica serovar Typhi
caaagccugcuggaaag

SEQ ID NO: 1721151 - RNA, 16 nt, Salmonella enterica enterica serovar Typhi
caaagcgagguaaaaa

SEQ ID NO: 1721152 - RNA, 21 nt, Salmonella enterica enterica serovar Typhi
caaagcgguauaacggccaga

SEQ ID NO: 1721153 - RNA, 22 nt, Salmonella enterica enterica serovar Typhi
cacccuucuucuggcucagacc

SEQ ID NO: 1721154 - RNA, 22 nt, Salmonella enterica enterica serovar Typhi
cacccgcagccgcaaucagcgu

SEQ ID NO: 1721155 - RNA, 24 nt, Salmonella enterica enterica serovar Typhi
cacccgggccggaagagcgcagag

SEQ ID NO: 1721156 - RNA, 13 nt, Salmonella enterica enterica serovar Typhi
cacccgccuuacc

SEQ ID NO: 1721157 - RNA, 21 nt, Salmonella enterica enterica serovar Typhi
cacccagaauacggccuucuu

SEQ ID NO: 1721158 - RNA, 21 nt, Salmonella enterica enterica serovar Typhi
caccaguaaccgccacagcau

SEQ ID NO: 1721159 - RNA, 15 nt, Salmonella enterica enterica serovar Typhi
caccagucccagccc

SEQ ID NO: 1721160 - RNA, 20 nt, Salmonella enterica enterica serovar Typhi
caccagugauuggcuggaca

SEQ ID NO: 1721161 - RNA, 13 nt, Salmonella enterica enterica serovar Typhi
cacccacgccgga

SEQ ID NO: 1721162 - RNA, 14 nt, Salmonella enterica enterica serovar Typhi
cacccccaucgccc

SEQ ID NO: 1721163 - RNA, 21 nt, Salmonella enterica enterica serovar Typhi
caccccaaaucucccccggca

SEQ ID NO: 1721164 - RNA, 11 nt, Salmonella enterica enterica serovar Typhi
caccccagccu

SEQ ID NO: 1721165 - RNA, 18 nt, Salmonella enterica enterica serovar Typhi
cacccauagauaccuucu

SEQ ID NO: 1721166 - RNA, 16 nt, Salmonella enterica enterica serovar Typhi
cacccauugaacccga

SEQ ID NO: 1721167 - RNA, 22 nt, Salmonella enterica enterica serovar Typhi
cacccauugaacccgaccgucu

SEQ ID NO: 1721168 - RNA, 20 nt, Salmonella enterica enterica serovar Typhi
cacccauuuuauccucuuca

SEQ ID NO: 1721169 - RNA, 19 nt, Salmonella enterica enterica serovar Typhi
caccucagccaacccacgc

SEQ ID NO: 1721170 - RNA, 16 nt, Salmonella enterica enterica serovar Typhi
caccucagccacccac

SEQ ID NO: 1721171 - RNA, 20 nt, Salmonella enterica enterica serovar Typhi
caccucagaauucugcgcgu

SEQ ID NO: 1721172 - RNA, 23 nt, Salmonella enterica enterica serovar Typhi
caccucaccggcuguauacacuu

SEQ ID NO: 1721173 - RNA, 19 nt, Salmonella enterica enterica serovar Typhi
caccucacguucugcauau

SEQ ID NO: 1721174 - RNA, 16 nt, Salmonella enterica enterica serovar Typhi
caccuaacccaccaua

SEQ ID NO: 1721175 - RNA, 16 nt, Salmonella enterica enterica serovar Typhi
caccguucuggcugcc

SEQ ID NO: 1721176 - RNA, 19 nt, Salmonella enterica enterica serovar Typhi
caccguuuaaucgcccugc

SEQ ID NO: 1721177 - RNA, 19 nt, Salmonella enterica enterica serovar Typhi
caccguugugcuccagcgu

SEQ ID NO: 1721178 - RNA, 20 nt, Salmonella enterica enterica serovar Typhi
caccguuuaaucgcccugcg

SEQ ID NO: 1721179 - RNA, 18 nt, Salmonella enterica enterica serovar Typhi
caccggcuguauacacuu

SEQ ID NO: 1721180 - RNA, 14 nt, Salmonella enterica enterica serovar Typhi
caccggcggcgcca

SEQ ID NO: 1721181 - RNA, 22 nt, Salmonella enterica enterica serovar Typhi
caccgucaacaucaucccgcgc

SEQ ID NO: 1721182 - RNA, 13 nt, Salmonella enterica enterica serovar Typhi
aaaauaacaggca

SEQ ID NO: 1721183 - RNA, 21 nt, Salmonella enterica enterica serovar Typhi
aaaauaacaauauuaaauaaa

SEQ ID NO: 1721184 - RNA, 22 nt, Salmonella enterica enterica serovar Typhi
caccgauacaggacugacugcu

SEQ ID NO: 1721185 - RNA, 13 nt, Salmonella enterica enterica serovar Typhi
caccgcaucggca

SEQ ID NO: 1721186 - RNA, 12 nt, Salmonella enterica enterica serovar Typhi
caccgcauggcu

SEQ ID NO: 1721187 - RNA, 18 nt, Salmonella enterica enterica serovar Typhi
caccgccaaccgcccguc

SEQ ID NO: 1721188 - RNA, 22 nt, Salmonella enterica enterica serovar Typhi
caccgcgaauauacgcaccuga

SEQ ID NO: 1721189 - RNA, 20 nt, Salmonella enterica enterica serovar Typhi
caccgcggagaucgcucccg

SEQ ID NO: 1721190 - RNA, 17 nt, Salmonella enterica enterica serovar Typhi
caccgcggcgcucgcca

SEQ ID NO: 1721191 - RNA, 21 nt, Salmonella enterica enterica serovar Typhi
caccgcuucacauacccgcuu

SEQ ID NO: 1721192 - RNA, 19 nt, Salmonella enterica enterica serovar Typhi
caccgcuugccggcgcagc

SEQ ID NO: 1721193 - RNA, 14 nt, Salmonella enterica enterica serovar Typhi
caccgcuugccggc

SEQ ID NO: 1721194 - RNA, 20 nt, Salmonella enterica enterica serovar Typhi
caccgcuugccggcgcagcg

SEQ ID NO: 1721195 - RNA, 18 nt, Salmonella enterica enterica serovar Typhi
caccgcucaauaucauag

SEQ ID NO: 1721196 - RNA, 20 nt, Salmonella enterica enterica serovar Typhi
caccgcuaaaaaacaggcgc

SEQ ID NO: 1721197 - RNA, 16 nt, Salmonella enterica enterica serovar Typhi
cacggcgacaaccgga

SEQ ID NO: 1721198 - RNA, 18 nt, Salmonella enterica enterica serovar Typhi
cacgggguuggcccuccc

SEQ ID NO: 1721199 - RNA, 22 nt, Salmonella enterica enterica serovar Typhi
aaaauagugcggccaaauugcu

SEQ ID NO: 1721200 - RNA, 17 nt, Salmonella enterica enterica serovar Typhi
cacggaugaucuucaua

SEQ ID NO: 1721201 - RNA, 20 nt, Salmonella enterica enterica serovar Typhi
cacggagagacaguucagau

SEQ ID NO: 1721202 - RNA, 20 nt, Salmonella enterica enterica serovar Typhi
cacgcuauaaaguagccauu

SEQ ID NO: 1721203 - RNA, 16 nt, Salmonella enterica enterica serovar Typhi
cacgcuaaucccgcuc

SEQ ID NO: 1721204 - RNA, 15 nt, Salmonella enterica enterica serovar Typhi
cacgcucgaguucuu

SEQ ID NO: 1721205 - RNA, 18 nt, Salmonella enterica enterica serovar Typhi
cacgcucgaguucuucac

SEQ ID NO: 1721206 - RNA, 20 nt, Salmonella enterica enterica serovar Typhi
cacgcguaucuggucaucgu

SEQ ID NO: 1721207 - RNA, 14 nt, Salmonella enterica enterica serovar Typhi
cacgcgcggcgcca

SEQ ID NO: 1721208 - RNA, 15 nt, Salmonella enterica enterica serovar Typhi
cacgcgcgcgcguca

SEQ ID NO: 1721209 - RNA, 17 nt, Salmonella enterica enterica serovar Typhi
cacgccugcauaaagga

SEQ ID NO: 1721210 - RNA, 18 nt, Salmonella enterica enterica serovar Typhi
cacgcgaugagcugcgau

SEQ ID NO: 1721211 - RNA, 19 nt, Salmonella enterica enterica serovar Typhi
cacgcgaugcaaccccuga

SEQ ID NO: 1721212 - RNA, 14 nt, Salmonella enterica enterica serovar Typhi
cacgcgacgcgcca

SEQ ID NO: 1721213 - RNA, 13 nt, Salmonella enterica enterica serovar Typhi
cacgcgacgccag

SEQ ID NO: 1721214 - RNA, 22 nt, Salmonella enterica enterica serovar Typhi
cacgcgaauagccagacagccc

SEQ ID NO: 1721215 - RNA, 14 nt, Salmonella enterica enterica serovar Typhi
cacgcgacgccagc

SEQ ID NO: 1721216 - RNA, 17 nt, Salmonella enterica enterica serovar Typhi
cacgccuuccuccagca

SEQ ID NO: 1721217 - RNA, 13 nt, Salmonella enterica enterica serovar Typhi
cacgcgaauagcc

SEQ ID NO: 1721218 - RNA, 17 nt, Salmonella enterica enterica serovar Typhi
cacgccgacgaccggca

SEQ ID NO: 1721219 - RNA, 19 nt, Salmonella enterica enterica serovar Typhi
cacgccgacgcauccgcca

SEQ ID NO: 1721220 - RNA, 20 nt, Salmonella enterica enterica serovar Typhi
cacgccgugaauuucugcug

SEQ ID NO: 1721221 - RNA, 21 nt, Salmonella enterica enterica serovar Typhi
cacgccgugaauuucugcugc

SEQ ID NO: 1721222 - RNA, 21 nt, Salmonella enterica enterica serovar Typhi
cacgccgugcacuucugcggu

SEQ ID NO: 1721223 - RNA, 21 nt, Salmonella enterica enterica serovar Typhi
cacgccguagcugcgcgccgc

SEQ ID NO: 1721224 - RNA, 17 nt, Salmonella enterica enterica serovar Typhi
cacgccgcacacagcag

SEQ ID NO: 1721225 - RNA, 16 nt, Salmonella enterica enterica serovar Typhi
cacgcaaaauggccug

SEQ ID NO: 1721226 - RNA, 22 nt, Salmonella enterica enterica serovar Typhi
cacgcaaugccugaccaacguc

SEQ ID NO: 1721227 - RNA, 21 nt, Salmonella enterica enterica serovar Typhi
cacgcccugccauucccagcc

SEQ ID NO: 1721228 - RNA, 15 nt, Salmonella enterica enterica serovar Typhi
cacgcccugaagggc

SEQ ID NO: 1721229 - RNA, 22 nt, Salmonella enterica enterica serovar Typhi
cacgauggcgauuuucaccggc

SEQ ID NO: 1721230 - RNA, 22 nt, Salmonella enterica enterica serovar Typhi
caccuguaaccccagcaucugc

SEQ ID NO: 1721231 - RNA, 23 nt, Salmonella enterica enterica serovar Typhi
caccuguaaccccagcaucugca

SEQ ID NO: 1721232 - RNA, 17 nt, Salmonella enterica enterica serovar Typhi
caccuuaaacuugccgu

SEQ ID NO: 1721233 - RNA, 15 nt, Salmonella enterica enterica serovar Typhi
caccuuacccggcgu

SEQ ID NO: 1721234 - RNA, 22 nt, Salmonella enterica enterica serovar Typhi
caccuuacgaauuuuaucuucc

SEQ ID NO: 1721235 - RNA, 14 nt, Salmonella enterica enterica serovar Typhi
aaaauaccggcagc

SEQ ID NO: 1721236 - RNA, 16 nt, Salmonella enterica enterica serovar Typhi
caccucaucaacgcca

SEQ ID NO: 1721237 - RNA, 22 nt, Salmonella enterica enterica serovar Typhi
caccucagguaaauccgccagu

SEQ ID NO: 1721238 - RNA, 14 nt, Salmonella enterica enterica serovar Typhi
caccuccagcgccu

SEQ ID NO: 1721239 - RNA, 18 nt, Salmonella enterica enterica serovar Typhi
caccuggagcgccuccca

SEQ ID NO: 1721240 - RNA, 17 nt, Salmonella enterica enterica serovar Typhi
caccuggaugcugccug

SEQ ID NO: 1721241 - RNA, 18 nt, Salmonella enterica enterica serovar Typhi
caccuggaugcugccugc

SEQ ID NO: 1721242 - RNA, 21 nt, Salmonella enterica enterica serovar Typhi
aaaauagccgaaacuuauacu

SEQ ID NO: 1721243 - RNA, 13 nt, Salmonella enterica enterica serovar Typhi
cacgaaaaauaaa

SEQ ID NO: 1721244 - RNA, 14 nt, Salmonella enterica enterica serovar Typhi
cacgaaaaauaaaa

SEQ ID NO: 1721245 - RNA, 21 nt, Salmonella enterica enterica serovar Typhi
cacgaaaaguguguaccagca

SEQ ID NO: 1721246 - RNA, 21 nt, Salmonella enterica enterica serovar Typhi
cacgaaauaacgcacuaccag

SEQ ID NO: 1721247 - RNA, 16 nt, Salmonella enterica enterica serovar Typhi
cacgaggccacgcagc

SEQ ID NO: 1721248 - RNA, 15 nt, Salmonella enterica enterica serovar Typhi
cacgacuuucaccag

SEQ ID NO: 1721249 - RNA, 22 nt, Salmonella enterica enterica serovar Typhi
cacgaaucuggucguaagaauu

SEQ ID NO: 1721250 - RNA, 13 nt, Salmonella enterica enterica serovar Typhi
cacgacacaaaag

SEQ ID NO: 1721251 - RNA, 15 nt, Salmonella enterica enterica serovar Typhi
cacgacagugcuaua

SEQ ID NO: 1721252 - RNA, 20 nt, Salmonella enterica enterica serovar Typhi
cacgaucuugucacaauaac

SEQ ID NO: 1721253 - RNA, 12 nt, Salmonella enterica enterica serovar Typhi
cacgauggcaaa

SEQ ID NO: 1721254 - RNA, 22 nt, Salmonella enterica enterica serovar Typhi
caccacaaacgccgucacaaag

SEQ ID NO: 1721255 - RNA, 21 nt, Salmonella enterica enterica serovar Typhi
caccacauaccgucaccacgc

SEQ ID NO: 1721256 - RNA, 20 nt, Salmonella enterica enterica serovar Typhi
cacaucgccauuaaaagcca

SEQ ID NO: 1721257 - RNA, 15 nt, Salmonella enterica enterica serovar Typhi
cacaucgccguucca

SEQ ID NO: 1721258 - RNA, 15 nt, Salmonella enterica enterica serovar Typhi
cacaucgcgcagcag

SEQ ID NO: 1721259 - RNA, 17 nt, Salmonella enterica enterica serovar Typhi
cacaucgcccugauggc

SEQ ID NO: 1721260 - RNA, 13 nt, Salmonella enterica enterica serovar Typhi
cacauucagcagc

SEQ ID NO: 1721261 - RNA, 22 nt, Salmonella enterica enterica serovar Typhi
cacauucagagcguccacgcca

SEQ ID NO: 1721262 - RNA, 13 nt, Salmonella enterica enterica serovar Typhi
cacauuuuuauca

SEQ ID NO: 1721263 - RNA, 18 nt, Salmonella enterica enterica serovar Typhi
cacauagcauccagaccc

SEQ ID NO: 1721264 - RNA, 23 nt, Salmonella enterica enterica serovar Typhi
cacauaucgcaauugauacauuu

SEQ ID NO: 1721265 - RNA, 19 nt, Salmonella enterica enterica serovar Typhi
cacauauucaauaauauua

SEQ ID NO: 1721266 - RNA, 17 nt, Salmonella enterica enterica serovar Typhi
cacagccccagcaccaa

SEQ ID NO: 1721267 - RNA, 15 nt, Salmonella enterica enterica serovar Typhi
cacagccagcacgag

SEQ ID NO: 1721268 - RNA, 22 nt, Salmonella enterica enterica serovar Typhi
cacagcguacaauggcaggcau

SEQ ID NO: 1721269 - RNA, 16 nt, Salmonella enterica enterica serovar Typhi
cacaucaggaaugcca

SEQ ID NO: 1721270 - RNA, 23 nt, Salmonella enterica enterica serovar Typhi
cacaucaugaugaucuucagccc

SEQ ID NO: 1721271 - RNA, 12 nt, Salmonella enterica enterica serovar Typhi
cacaucauuaaa

SEQ ID NO: 1721272 - RNA, 17 nt, Salmonella enterica enterica serovar Typhi
cacaucauuaaagcgcu

SEQ ID NO: 1721273 - RNA, 23 nt, Salmonella enterica enterica serovar Typhi
cacauccagcgccagcgccaccu

SEQ ID NO: 1721274 - RNA, 20 nt, Salmonella enterica enterica serovar Typhi
cacauccagacagccgacgg

SEQ ID NO: 1721275 - RNA, 14 nt, Salmonella enterica enterica serovar Typhi
cacauccugcggga

SEQ ID NO: 1721276 - RNA, 17 nt, Salmonella enterica enterica serovar Typhi
cacauccgccagcgccu

SEQ ID NO: 1721277 - RNA, 13 nt, Salmonella enterica enterica serovar Typhi
caccagcccaacg

SEQ ID NO: 1721278 - RNA, 12 nt, Salmonella enterica enterica serovar Typhi
caccagcccauc

SEQ ID NO: 1721279 - RNA, 11 nt, Salmonella enterica enterica serovar Typhi
caccagcgccg

SEQ ID NO: 1721280 - RNA, 13 nt, Salmonella enterica enterica serovar Typhi
caccagcgcgccg

SEQ ID NO: 1721281 - RNA, 17 nt, Salmonella enterica enterica serovar Typhi
caccagcgcgccgccgc

SEQ ID NO: 1721282 - RNA, 19 nt, Salmonella enterica enterica serovar Typhi
caccagcgcgccgccgccc

SEQ ID NO: 1721283 - RNA, 17 nt, Salmonella enterica enterica serovar Typhi
caccagcgccugcgcug

SEQ ID NO: 1721284 - RNA, 19 nt, Salmonella enterica enterica serovar Typhi
aaaaguguguaccagcagc

SEQ ID NO: 1721285 - RNA, 18 nt, Salmonella enterica enterica serovar Typhi
aaaauaaacacuaaauca

SEQ ID NO: 1721286 - RNA, 18 nt, Salmonella enterica enterica serovar Typhi
aaaauaaaauuauauucu

SEQ ID NO: 1721287 - RNA, 19 nt, Salmonella enterica enterica serovar Typhi
caccagcguggcuauccau

SEQ ID NO: 1721288 - RNA, 18 nt, Salmonella enterica enterica serovar Typhi
caccagcggaauccccgc

SEQ ID NO: 1721289 - RNA, 13 nt, Salmonella enterica enterica serovar Typhi
caccaccugguua

SEQ ID NO: 1721290 - RNA, 19 nt, Salmonella enterica enterica serovar Typhi
caccacgccuaaugaagcg

SEQ ID NO: 1721291 - RNA, 11 nt, Salmonella enterica enterica serovar Typhi
caccacgcggg

SEQ ID NO: 1721292 - RNA, 15 nt, Salmonella enterica enterica serovar Typhi
caccacgcaaaccgc

SEQ ID NO: 1721293 - RNA, 13 nt, Salmonella enterica enterica serovar Typhi
caccacgcacagu

SEQ ID NO: 1721294 - RNA, 14 nt, Salmonella enterica enterica serovar Typhi
caccacgcagcccg

SEQ ID NO: 1721295 - RNA, 16 nt, Salmonella enterica enterica serovar Typhi
caccacgucauccucc

SEQ ID NO: 1721296 - RNA, 23 nt, Salmonella enterica enterica serovar Typhi
caccacugaaaaauaauuacuau

SEQ ID NO: 1721297 - RNA, 23 nt, Salmonella enterica enterica serovar Typhi
caccagcaacguaaucccgccag

SEQ ID NO: 1721298 - RNA, 14 nt, Salmonella enterica enterica serovar Typhi
caccagaucggcau

SEQ ID NO: 1721299 - RNA, 16 nt, Salmonella enterica enterica serovar Typhi
cacacgucugagcagg

SEQ ID NO: 1721300 - RNA, 19 nt, Salmonella enterica enterica serovar Typhi
cacaccaaugucauauuug

SEQ ID NO: 1721301 - RNA, 15 nt, Salmonella enterica enterica serovar Typhi
cacaccaacgcuggc

SEQ ID NO: 1721302 - RNA, 14 nt, Salmonella enterica enterica serovar Typhi
cacacaucacaauc

SEQ ID NO: 1721303 - RNA, 18 nt, Salmonella enterica enterica serovar Typhi
cacacauaagcacaccau

SEQ ID NO: 1721304 - RNA, 18 nt, Salmonella enterica enterica serovar Typhi
cacacaggaguucaucau

SEQ ID NO: 1721305 - RNA, 19 nt, Salmonella enterica enterica serovar Typhi
cacaaucgucgugccuucc

SEQ ID NO: 1721306 - RNA, 20 nt, Salmonella enterica enterica serovar Typhi
cacaaucgcgccugccagga

SEQ ID NO: 1721307 - RNA, 22 nt, Salmonella enterica enterica serovar Typhi
cacagauuaugcaguucuucgc

SEQ ID NO: 1721308 - RNA, 21 nt, Salmonella enterica enterica serovar Typhi
cacagcaccauguugaccagg

SEQ ID NO: 1721309 - RNA, 21 nt, Salmonella enterica enterica serovar Typhi
cacagcagaaagcaacagcaa

SEQ ID NO: 1721310 - RNA, 19 nt, Salmonella enterica enterica serovar Typhi
cacagcacgauaugcauaa

SEQ ID NO: 1721311 - RNA, 20 nt, Salmonella enterica enterica serovar Typhi
cacagcacuaacgaggccac

SEQ ID NO: 1721312 - RNA, 19 nt, Salmonella enterica enterica serovar Typhi
cacagaucgaaugaaaaug

SEQ ID NO: 1721313 - RNA, 21 nt, Salmonella enterica enterica serovar Typhi
cacagaaaaaccaaaaaauau

SEQ ID NO: 1721314 - RNA, 13 nt, Salmonella enterica enterica serovar Typhi
cacagaagcgccu

SEQ ID NO: 1721315 - RNA, 20 nt, Salmonella enterica enterica serovar Typhi
cacagaaaaaccaaaaaaua

SEQ ID NO: 1721316 - RNA, 24 nt, Salmonella enterica enterica serovar Typhi
cacacuuucgcccggcgccagcuc

SEQ ID NO: 1721317 - RNA, 15 nt, Salmonella enterica enterica serovar Typhi
cacaagcuguuucuc

SEQ ID NO: 1721318 - RNA, 17 nt, Salmonella enterica enterica serovar Typhi
cacaagccccacgcccg

SEQ ID NO: 1721319 - RNA, 13 nt, Salmonella enterica enterica serovar Typhi
cacaaguuuaucc

SEQ ID NO: 1721320 - RNA, 20 nt, Salmonella enterica enterica serovar Typhi
cacaauaugguuauccagca

SEQ ID NO: 1721321 - RNA, 13 nt, Salmonella enterica enterica serovar Typhi
cacaaucacagcg

SEQ ID NO: 1721322 - RNA, 22 nt, Salmonella enterica enterica serovar Typhi
cacaacgugccagaaacaagaa

SEQ ID NO: 1721323 - RNA, 21 nt, Salmonella enterica enterica serovar Typhi
cacaacgucaguggaaaacag

SEQ ID NO: 1721324 - RNA, 13 nt, Salmonella enterica enterica serovar Typhi
cacaacuguucuu

SEQ ID NO: 1721325 - RNA, 14 nt, Salmonella enterica enterica serovar Typhi
cacaacgcauuggc

SEQ ID NO: 1721326 - RNA, 13 nt, Salmonella enterica enterica serovar Typhi
cacaaccuccacg

SEQ ID NO: 1721327 - RNA, 16 nt, Salmonella enterica enterica serovar Typhi
cacaacgaguccccuc

SEQ ID NO: 1721328 - RNA, 21 nt, Salmonella enterica enterica serovar Typhi
cacaacauuccgcuuccagaa

SEQ ID NO: 1721329 - RNA, 16 nt, Salmonella enterica enterica serovar Typhi
cacaacccaaaggcca

SEQ ID NO: 1721330 - RNA, 13 nt, Salmonella enterica enterica serovar Typhi
caauuugaaaagg

SEQ ID NO: 1721331 - RNA, 16 nt, Salmonella enterica enterica serovar Typhi
caauggccgcagcgcc

SEQ ID NO: 1721332 - RNA, 18 nt, Salmonella enterica enterica serovar Typhi
caauggccagaugaaacu

SEQ ID NO: 1721333 - RNA, 20 nt, Salmonella enterica enterica serovar Typhi
caauggcgacgaucagcgcc

SEQ ID NO: 1721334 - RNA, 17 nt, Salmonella enterica enterica serovar Typhi
caauggcgcgucuuaaa

SEQ ID NO: 1721335 - RNA, 22 nt, Salmonella enterica enterica serovar Typhi
caauggcgcucggaugugcauu

SEQ ID NO: 1721336 - RNA, 17 nt, Salmonella enterica enterica serovar Typhi
caaugucgcaaucggcu

SEQ ID NO: 1721337 - RNA, 14 nt, Salmonella enterica enterica serovar Typhi
caaugucauauuug

SEQ ID NO: 1721338 - RNA, 21 nt, Salmonella enterica enterica serovar Typhi
caauguauuguucaugcaauu

SEQ ID NO: 1721339 - RNA, 19 nt, Salmonella enterica enterica serovar Typhi
caauguaaaacugacuaaa

SEQ ID NO: 1721340 - RNA, 22 nt, Salmonella enterica enterica serovar Typhi
caauguaacaccuguaacguca

SEQ ID NO: 1721341 - RNA, 17 nt, Salmonella enterica enterica serovar Typhi
caauguacguaaaacca

SEQ ID NO: 1721342 - RNA, 19 nt, Salmonella enterica enterica serovar Typhi
caaugguguuuuccagcgu

SEQ ID NO: 1721343 - RNA, 23 nt, Salmonella enterica enterica serovar Typhi
caauguaaaacgguaugaaacau

SEQ ID NO: 1721344 - RNA, 15 nt, Salmonella enterica enterica serovar Typhi
caaugcuuucaccag

SEQ ID NO: 1721345 - RNA, 17 nt, Salmonella enterica enterica serovar Typhi
caaugaccacaaauucu

SEQ ID NO: 1721346 - RNA, 19 nt, Salmonella enterica enterica serovar Typhi
caaucuguucguugcugua

SEQ ID NO: 1721347 - RNA, 14 nt, Salmonella enterica enterica serovar Typhi
caaucuggugacga

SEQ ID NO: 1721348 - RNA, 18 nt, Salmonella enterica enterica serovar Typhi
caaucugguggcguuccu

SEQ ID NO: 1721349 - RNA, 21 nt, Salmonella enterica enterica serovar Typhi
caauuucucgcucgcccauca

SEQ ID NO: 1721350 - RNA, 20 nt, Salmonella enterica enterica serovar Typhi
caauuuccgcugaaauagcc

SEQ ID NO: 1721351 - RNA, 14 nt, Salmonella enterica enterica serovar Typhi
caauuuccgccgcc

SEQ ID NO: 1721352 - RNA, 15 nt, Salmonella enterica enterica serovar Typhi
caauuucccccacuu

SEQ ID NO: 1721353 - RNA, 16 nt, Salmonella enterica enterica serovar Typhi
caauuucauauuauua

SEQ ID NO: 1721354 - RNA, 15 nt, Salmonella enterica enterica serovar Typhi
caauuucaaugaugc

SEQ ID NO: 1721355 - RNA, 15 nt, Salmonella enterica enterica serovar Typhi
caauuuaucugcgug

SEQ ID NO: 1721356 - RNA, 17 nt, Salmonella enterica enterica serovar Typhi
caauuuaucugcgugau

SEQ ID NO: 1721357 - RNA, 12 nt, Salmonella enterica enterica serovar Typhi
caauuuaucugc

SEQ ID NO: 1721358 - RNA, 14 nt, Salmonella enterica enterica serovar Typhi
caauugcaggcagc

SEQ ID NO: 1721359 - RNA, 23 nt, Salmonella enterica enterica serovar Typhi
caauuccaccaccucggcacgga

SEQ ID NO: 1721360 - RNA, 19 nt, Salmonella enterica enterica serovar Typhi
caauuccggcccaggccau

SEQ ID NO: 1721361 - RNA, 18 nt, Salmonella enterica enterica serovar Typhi
caaugucggccugauuuc

SEQ ID NO: 1721362 - RNA, 18 nt, Salmonella enterica enterica serovar Typhi
caauguucauacaccgca

SEQ ID NO: 1721363 - RNA, 16 nt, Salmonella enterica enterica serovar Typhi
caauucuggaaucaau

SEQ ID NO: 1721364 - RNA, 20 nt, Salmonella enterica enterica serovar Typhi
caauucuggcgcacauugcu

SEQ ID NO: 1721365 - RNA, 18 nt, Salmonella enterica enterica serovar Typhi
caauucuggaaucaauuu

SEQ ID NO: 1721366 - RNA, 17 nt, Salmonella enterica enterica serovar Typhi
augcaagcagcauaaug

SEQ ID NO: 1721367 - RNA, 19 nt, Salmonella enterica enterica serovar Typhi
augcaaucaguuccaaucu

SEQ ID NO: 1721368 - RNA, 18 nt, Salmonella enterica enterica serovar Typhi
augcaauuccgcuuucuu

SEQ ID NO: 1721369 - RNA, 14 nt, Salmonella enterica enterica serovar Typhi
augcaaccccugac

SEQ ID NO: 1721370 - RNA, 14 nt, Salmonella enterica enterica serovar Typhi
augcaacuggcaag

SEQ ID NO: 1721371 - RNA, 13 nt, Salmonella enterica enterica serovar Typhi
augcaaaagaaaa

SEQ ID NO: 1721372 - RNA, 15 nt, Salmonella enterica enterica serovar Typhi
augcaaaagaaaaaa

SEQ ID NO: 1721373 - RNA, 16 nt, Salmonella enterica enterica serovar Typhi
augcaaaagaaaaaac

SEQ ID NO: 1721374 - RNA, 21 nt, Salmonella enterica enterica serovar Typhi
augauuugcaaccgcucuuuu

SEQ ID NO: 1721375 - RNA, 14 nt, Salmonella enterica enterica serovar Typhi
augauuuucuuauu

SEQ ID NO: 1721376 - RNA, 22 nt, Salmonella enterica enterica serovar Typhi
augauuuucuuauuacaagaaa

SEQ ID NO: 1721377 - RNA, 17 nt, Salmonella enterica enterica serovar Typhi
augauucaaucggcgau

SEQ ID NO: 1721378 - RNA, 24 nt, Salmonella enterica enterica serovar Typhi
augauugcuggcagaugaacauaa

SEQ ID NO: 1721379 - RNA, 17 nt, Salmonella enterica enterica serovar Typhi
augauguacaggugaaa

SEQ ID NO: 1721380 - RNA, 14 nt, Salmonella enterica enterica serovar Typhi
augauggugagagc

SEQ ID NO: 1721381 - RNA, 19 nt, Salmonella enterica enterica serovar Typhi
augauggcgaacagcccca

SEQ ID NO: 1721382 - RNA, 13 nt, Salmonella enterica enterica serovar Typhi
augaugcguuacu

SEQ ID NO: 1721383 - RNA, 14 nt, Salmonella enterica enterica serovar Typhi
augauuaaagccac

SEQ ID NO: 1721384 - RNA, 15 nt, Salmonella enterica enterica serovar Typhi
augauuacggaacaa

SEQ ID NO: 1721385 - RNA, 15 nt, Salmonella enterica enterica serovar Typhi
augauuauuguuaaa

SEQ ID NO: 1721386 - RNA, 19 nt, Salmonella enterica enterica serovar Typhi
augauuagauagauauuuu

SEQ ID NO: 1721387 - RNA, 19 nt, Salmonella enterica enterica serovar Typhi
augaugagauacgucauca

SEQ ID NO: 1721388 - RNA, 23 nt, Salmonella enterica enterica serovar Typhi
augaugccuugcgaauggagaag

SEQ ID NO: 1721389 - RNA, 14 nt, Salmonella enterica enterica serovar Typhi
augaugaauauuuu

SEQ ID NO: 1721390 - RNA, 14 nt, Salmonella enterica enterica serovar Typhi
augaucuucauaaa

SEQ ID NO: 1721391 - RNA, 15 nt, Salmonella enterica enterica serovar Typhi
augaucuuuccuuuu

SEQ ID NO: 1721392 - RNA, 15 nt, Salmonella enterica enterica serovar Typhi
augagcaggccaggg

SEQ ID NO: 1721393 - RNA, 22 nt, Salmonella enterica enterica serovar Typhi
augccucguuucccucauauuu

SEQ ID NO: 1721394 - RNA, 17 nt, Salmonella enterica enterica serovar Typhi
augccucuuacagggcg

SEQ ID NO: 1721395 - RNA, 15 nt, Salmonella enterica enterica serovar Typhi
augccuaacccuuuu

SEQ ID NO: 1721396 - RNA, 14 nt, Salmonella enterica enterica serovar Typhi
augccucaccccau

SEQ ID NO: 1721397 - RNA, 22 nt, Salmonella enterica enterica serovar Typhi
augccgccugccgcgccgccgc

SEQ ID NO: 1721398 - RNA, 17 nt, Salmonella enterica enterica serovar Typhi
augccuuccuguggaag

SEQ ID NO: 1721399 - RNA, 21 nt, Salmonella enterica enterica serovar Typhi
augccuucauaaugaauacgc

SEQ ID NO: 1721400 - RNA, 22 nt, Salmonella enterica enterica serovar Typhi
augccuuauccggccugcaggc

SEQ ID NO: 1721401 - RNA, 14 nt, Salmonella enterica enterica serovar Typhi
augccugucaucau

SEQ ID NO: 1721402 - RNA, 17 nt, Salmonella enterica enterica serovar Typhi
augccuggggucgucag

SEQ ID NO: 1721403 - RNA, 22 nt, Salmonella enterica enterica serovar Typhi
augccugcgccauguucauaaa

SEQ ID NO: 1721404 - RNA, 16 nt, Salmonella enterica enterica serovar Typhi
augcgcaugugagcau

SEQ ID NO: 1721405 - RNA, 15 nt, Salmonella enterica enterica serovar Typhi
augcgacugaaaauc

SEQ ID NO: 1721406 - RNA, 16 nt, Salmonella enterica enterica serovar Typhi
augcgacgcccaacca

SEQ ID NO: 1721407 - RNA, 15 nt, Salmonella enterica enterica serovar Typhi
augcgaauaaucgcc

SEQ ID NO: 1721408 - RNA, 19 nt, Salmonella enterica enterica serovar Typhi
augcgccgcgucagcacau

SEQ ID NO: 1721409 - RNA, 13 nt, Salmonella enterica enterica serovar Typhi
augcgccugcaau

SEQ ID NO: 1721410 - RNA, 16 nt, Salmonella enterica enterica serovar Typhi
augcgccugucuuaaa

SEQ ID NO: 1721411 - RNA, 15 nt, Salmonella enterica enterica serovar Typhi
augcgccaggugacg

SEQ ID NO: 1721412 - RNA, 19 nt, Salmonella enterica enterica serovar Typhi
augcgccaucccaugcacc

SEQ ID NO: 1721413 - RNA, 12 nt, Salmonella enterica enterica serovar Typhi
augcgcccagcc

SEQ ID NO: 1721414 - RNA, 18 nt, Salmonella enterica enterica serovar Typhi
augcgccaggcagcaccu

SEQ ID NO: 1721415 - RNA, 23 nt, Salmonella enterica enterica serovar Typhi
augcgccagccagucgccaggca

SEQ ID NO: 1721416 - RNA, 20 nt, Salmonella enterica enterica serovar Typhi
augccauaaucgauauaauu

SEQ ID NO: 1721417 - RNA, 21 nt, Salmonella enterica enterica serovar Typhi
augccaugcuggcucuugguu

SEQ ID NO: 1721418 - RNA, 20 nt, Salmonella enterica enterica serovar Typhi
augccaucucuuaauguaaa

SEQ ID NO: 1721419 - RNA, 19 nt, Salmonella enterica enterica serovar Typhi
augccgcacuccccagaau

SEQ ID NO: 1721420 - RNA, 21 nt, Salmonella enterica enterica serovar Typhi
augccgcacuccccagaauga

SEQ ID NO: 1721421 - RNA, 21 nt, Salmonella enterica enterica serovar Typhi
augcagcaggucgaccaccug

SEQ ID NO: 1721422 - RNA, 23 nt, Salmonella enterica enterica serovar Typhi
augcagcaccagauauuuuuccg

SEQ ID NO: 1721423 - RNA, 20 nt, Salmonella enterica enterica serovar Typhi
augcacauuagcaauugcca

SEQ ID NO: 1721424 - RNA, 21 nt, Salmonella enterica enterica serovar Typhi
augccaaguaauaaagagaac

SEQ ID NO: 1721425 - RNA, 20 nt, Salmonella enterica enterica serovar Typhi
augccaaguaauaaagagaa

SEQ ID NO: 1721426 - RNA, 14 nt, Salmonella enterica enterica serovar Typhi
augccaccagcgcc

SEQ ID NO: 1721427 - RNA, 20 nt, Salmonella enterica enterica serovar Typhi
augccacaacagaagcggcc

SEQ ID NO: 1721428 - RNA, 21 nt, Salmonella enterica enterica serovar Typhi
augcucuccuggcauggcucg

SEQ ID NO: 1721429 - RNA, 22 nt, Salmonella enterica enterica serovar Typhi
augcucgccgucggcagacugg

SEQ ID NO: 1721430 - RNA, 21 nt, Salmonella enterica enterica serovar Typhi
augcgcgcgugaccccaggca

SEQ ID NO: 1721431 - RNA, 16 nt, Salmonella enterica enterica serovar Typhi
augcgcguagcccaca

SEQ ID NO: 1721432 - RNA, 20 nt, Salmonella enterica enterica serovar Typhi
augcgcguuuagcgccagca

SEQ ID NO: 1721433 - RNA, 21 nt, Salmonella enterica enterica serovar Typhi
augcgcgucccggcagugcau

SEQ ID NO: 1721434 - RNA, 19 nt, Salmonella enterica enterica serovar Typhi
augcugugugaccagcagu

SEQ ID NO: 1721435 - RNA, 23 nt, Salmonella enterica enterica serovar Typhi
augcuguuaccguaagcgggaug

SEQ ID NO: 1721436 - RNA, 21 nt, Salmonella enterica enterica serovar Typhi
augcuuaaaaucccgccgcug

SEQ ID NO: 1721437 - RNA, 14 nt, Salmonella enterica enterica serovar Typhi
augcuucuucgcca

SEQ ID NO: 1721438 - RNA, 18 nt, Salmonella enterica enterica serovar Typhi
augcuuucgcgauaauca

SEQ ID NO: 1721439 - RNA, 17 nt, Salmonella enterica enterica serovar Typhi
augcuuucaauacucca

SEQ ID NO: 1721440 - RNA, 14 nt, Salmonella enterica enterica serovar Typhi
augcuuuaaaugcc

SEQ ID NO: 1721441 - RNA, 20 nt, Salmonella enterica enterica serovar Typhi
augcuugcuuugcggcauaa

SEQ ID NO: 1721442 - RNA, 17 nt, Salmonella enterica enterica serovar Typhi
auggacgggauacggcg

SEQ ID NO: 1721443 - RNA, 13 nt, Salmonella enterica enterica serovar Typhi
auggacuuccgca

SEQ ID NO: 1721444 - RNA, 11 nt, Salmonella enterica enterica serovar Typhi
auggcacugcg

SEQ ID NO: 1721445 - RNA, 22 nt, Salmonella enterica enterica serovar Typhi
auggaugcccaccugaaaaagg

SEQ ID NO: 1721446 - RNA, 16 nt, Salmonella enterica enterica serovar Typhi
auggauagucaugaaa

SEQ ID NO: 1721447 - RNA, 16 nt, Salmonella enterica enterica serovar Typhi
auggauaacgaaaagg

SEQ ID NO: 1721448 - RNA, 12 nt, Salmonella enterica enterica serovar Typhi
auggaaguacug

SEQ ID NO: 1721449 - RNA, 19 nt, Salmonella enterica enterica serovar Typhi
auggaaucggcuaguaaua

SEQ ID NO: 1721450 - RNA, 22 nt, Salmonella enterica enterica serovar Typhi
augcuuuccagccaugccagca

SEQ ID NO: 1721451 - RNA, 17 nt, Salmonella enterica enterica serovar Typhi
augcuuuuugugccgaa

SEQ ID NO: 1721452 - RNA, 23 nt, Salmonella enterica enterica serovar Typhi
augcuuuuuauaaagugauuaua

SEQ ID NO: 1721453 - RNA, 15 nt, Salmonella enterica enterica serovar Typhi
auggaaaauaauaau

SEQ ID NO: 1721454 - RNA, 14 nt, Salmonella enterica enterica serovar Typhi
auggaaaugcacgu

SEQ ID NO: 1721455 - RNA, 15 nt, Salmonella enterica enterica serovar Typhi
auggcgucgugcagc

SEQ ID NO: 1721456 - RNA, 20 nt, Salmonella enterica enterica serovar Typhi
auggccguuuucaugcacga

SEQ ID NO: 1721457 - RNA, 18 nt, Salmonella enterica enterica serovar Typhi
auggcgucgcuacgggcg

SEQ ID NO: 1721458 - RNA, 17 nt, Salmonella enterica enterica serovar Typhi
auggcuaugaagcugga

SEQ ID NO: 1721459 - RNA, 12 nt, Salmonella enterica enterica serovar Typhi
auggccgcagcc

SEQ ID NO: 1721460 - RNA, 15 nt, Salmonella enterica enterica serovar Typhi
auggcagauaaacca

SEQ ID NO: 1721461 - RNA, 15 nt, Salmonella enterica enterica serovar Typhi
auggcccaauguuuu

SEQ ID NO: 1721462 - RNA, 19 nt, Salmonella enterica enterica serovar Typhi
auggggauuaucaggauga

SEQ ID NO: 1721463 - RNA, 14 nt, Salmonella enterica enterica serovar Typhi
augguaaaauccuu

SEQ ID NO: 1721464 - RNA, 20 nt, Salmonella enterica enterica serovar Typhi
augguaaaauccuuuuucau

SEQ ID NO: 1721465 - RNA, 23 nt, Salmonella enterica enterica serovar Typhi
augguaaaauuauugugagaaaa

SEQ ID NO: 1721466 - RNA, 22 nt, Salmonella enterica enterica serovar Typhi
augggcgugcugacggagcugg

SEQ ID NO: 1721467 - RNA, 18 nt, Salmonella enterica enterica serovar Typhi
augggccuacgccuggau

SEQ ID NO: 1721468 - RNA, 16 nt, Salmonella enterica enterica serovar Typhi
augggcgggauccugc

SEQ ID NO: 1721469 - RNA, 16 nt, Salmonella enterica enterica serovar Typhi
auggcucagauugaac

SEQ ID NO: 1721470 - RNA, 22 nt, Salmonella enterica enterica serovar Typhi
auggcugcacccggagagaaac

SEQ ID NO: 1721471 - RNA, 23 nt, Salmonella enterica enterica serovar Typhi
auggcugcgauaaugaagcauaa

SEQ ID NO: 1721472 - RNA, 23 nt, Salmonella enterica enterica serovar Typhi
augggcgaaaacggcgcaggcaa

SEQ ID NO: 1721473 - RNA, 23 nt, Salmonella enterica enterica serovar Typhi
auggugauagcgcgccagcacca

SEQ ID NO: 1721474 - RNA, 16 nt, Salmonella enterica enterica serovar Typhi
augguacucaacauca

SEQ ID NO: 1721475 - RNA, 19 nt, Salmonella enterica enterica serovar Typhi
augguaggccugauaagcg

SEQ ID NO: 1721476 - RNA, 22 nt, Salmonella enterica enterica serovar Typhi
augguauaaaucccggugggga

SEQ ID NO: 1721477 - RNA, 18 nt, Salmonella enterica enterica serovar Typhi
augguggucgcggccacc

SEQ ID NO: 1721478 - RNA, 23 nt, Salmonella enterica enterica serovar Typhi
augguugacuuacaaaaaauaca

SEQ ID NO: 1721479 - RNA, 22 nt, Salmonella enterica enterica serovar Typhi
augguuaaauuaaauaacaaau

SEQ ID NO: 1721480 - RNA, 17 nt, Salmonella enterica enterica serovar Typhi
augguuaagcagacgcu

SEQ ID NO: 1721481 - RNA, 16 nt, Salmonella enterica enterica serovar Typhi
auguaaaggugagcuc

SEQ ID NO: 1721482 - RNA, 22 nt, Salmonella enterica enterica serovar Typhi
auguaaagucggccauuuuuuu

SEQ ID NO: 1721483 - RNA, 18 nt, Salmonella enterica enterica serovar Typhi
auguaaacuccauuaaau

SEQ ID NO: 1721484 - RNA, 18 nt, Salmonella enterica enterica serovar Typhi
auguaauuugcaaaccau

SEQ ID NO: 1721485 - RNA, 20 nt, Salmonella enterica enterica serovar Typhi
auguacgccuaaaaaugagg

SEQ ID NO: 1721486 - RNA, 19 nt, Salmonella enterica enterica serovar Typhi
auguacagaaugguauuau

SEQ ID NO: 1721487 - RNA, 23 nt, Salmonella enterica enterica serovar Typhi
augugauuuuugacccgcagcaa

SEQ ID NO: 1721488 - RNA, 22 nt, Salmonella enterica enterica serovar Typhi
augugagcaucggcgauuaagu

SEQ ID NO: 1721489 - RNA, 13 nt, Salmonella enterica enterica serovar Typhi
augugacaaucac

SEQ ID NO: 1721490 - RNA, 16 nt, Salmonella enterica enterica serovar Typhi
augugaauccaggcca

SEQ ID NO: 1721491 - RNA, 15 nt, Salmonella enterica enterica serovar Typhi
augucuuccuuuucu

SEQ ID NO: 1721492 - RNA, 17 nt, Salmonella enterica enterica serovar Typhi
augugaaauacagccag

SEQ ID NO: 1721493 - RNA, 18 nt, Salmonella enterica enterica serovar Typhi
augucuggugcagcaagc

SEQ ID NO: 1721494 - RNA, 12 nt, Salmonella enterica enterica serovar Typhi
augucuggcgcu

SEQ ID NO: 1721495 - RNA, 13 nt, Salmonella enterica enterica serovar Typhi
augugcgccagcc

SEQ ID NO: 1721496 - RNA, 13 nt, Salmonella enterica enterica serovar Typhi
auguuccacaauc

SEQ ID NO: 1721497 - RNA, 14 nt, Salmonella enterica enterica serovar Typhi
auguuccgcagggg

SEQ ID NO: 1721498 - RNA, 18 nt, Salmonella enterica enterica serovar Typhi
auguuccgcaggggauuc

SEQ ID NO: 1721499 - RNA, 14 nt, Salmonella enterica enterica serovar Typhi
auguguuucagcag

SEQ ID NO: 1721500 - RNA, 22 nt, Salmonella enterica enterica serovar Typhi
auguuaaauacgccgccagcaa

SEQ ID NO: 1721501 - RNA, 16 nt, Salmonella enterica enterica serovar Typhi
auguuagaaucuauua

SEQ ID NO: 1721502 - RNA, 16 nt, Salmonella enterica enterica serovar Typhi
auguuaggguagaaaa

SEQ ID NO: 1721503 - RNA, 17 nt, Salmonella enterica enterica serovar Typhi
auguuaggguagaaaaa

SEQ ID NO: 1721504 - RNA, 15 nt, Salmonella enterica enterica serovar Typhi
auguucuaucuuuca

SEQ ID NO: 1721505 - RNA, 14 nt, Salmonella enterica enterica serovar Typhi
auguucuaacagau

SEQ ID NO: 1721506 - RNA, 15 nt, Salmonella enterica enterica serovar Typhi
auguuugcugauaag

SEQ ID NO: 1721507 - RNA, 16 nt, Salmonella enterica enterica serovar Typhi
auguuugccacgccaa

SEQ ID NO: 1721508 - RNA, 18 nt, Salmonella enterica enterica serovar Typhi
auguugauacagaaaacc

SEQ ID NO: 1721509 - RNA, 16 nt, Salmonella enterica enterica serovar Typhi
auguugaugucacuca

SEQ ID NO: 1721510 - RNA, 15 nt, Salmonella enterica enterica serovar Typhi
auuaaaaauacccca

SEQ ID NO: 1721511 - RNA, 21 nt, Salmonella enterica enterica serovar Typhi
auuaaaaauaccccaggggca

SEQ ID NO: 1721512 - RNA, 17 nt, Salmonella enterica enterica serovar Typhi
auuaaagauuagcguuu

SEQ ID NO: 1721513 - RNA, 20 nt, Salmonella enterica enterica serovar Typhi
auuaaagauuagcguuuuua

SEQ ID NO: 1721514 - RNA, 21 nt, Salmonella enterica enterica serovar Typhi
auuaaagauuagcguuuuuau

SEQ ID NO: 1721515 - RNA, 17 nt, Salmonella enterica enterica serovar Typhi
auuaaaagaccccauuu

SEQ ID NO: 1721516 - RNA, 12 nt, Salmonella enterica enterica serovar Typhi
auuaaagccacg

SEQ ID NO: 1721517 - RNA, 21 nt, Salmonella enterica enterica serovar Typhi
auuaaagcacaagaacuuaaa

SEQ ID NO: 1721518 - RNA, 15 nt, Salmonella enterica enterica serovar Typhi
auuaaaucaucauaa

SEQ ID NO: 1721519 - RNA, 17 nt, Salmonella enterica enterica serovar Typhi
auuaaaucaucauaauc

SEQ ID NO: 1721520 - RNA, 13 nt, Salmonella enterica enterica serovar Typhi
auuaagcaggccg

SEQ ID NO: 1721521 - RNA, 15 nt, Salmonella enterica enterica serovar Typhi
auuaagcaauccauu

SEQ ID NO: 1721522 - RNA, 20 nt, Salmonella enterica enterica serovar Typhi
auuaagcaauccauuuuaaa

SEQ ID NO: 1721523 - RNA, 21 nt, Salmonella enterica enterica serovar Typhi
auuaagaccauacuuugcauu

SEQ ID NO: 1721524 - RNA, 23 nt, Salmonella enterica enterica serovar Typhi
auuaaggcguuaucuugacauga

SEQ ID NO: 1721525 - RNA, 17 nt, Salmonella enterica enterica serovar Typhi
auuaaguuuuuuuaaaa

SEQ ID NO: 1721526 - RNA, 22 nt, Salmonella enterica enterica serovar Typhi
auuaagcggauuuuuucgcuuu

SEQ ID NO: 1721527 - RNA, 18 nt, Salmonella enterica enterica serovar Typhi
auuaagcgaauccagcgc

SEQ ID NO: 1721528 - RNA, 21 nt, Salmonella enterica enterica serovar Typhi
auuaagcugauauuuuacuuu

SEQ ID NO: 1721529 - RNA, 16 nt, Salmonella enterica enterica serovar Typhi
auuaauaaaauuuuug

SEQ ID NO: 1721530 - RNA, 17 nt, Salmonella enterica enterica serovar Typhi
auuaauaaacaaugcag

SEQ ID NO: 1721531 - RNA, 12 nt, Salmonella enterica enterica serovar Typhi
auuaacucauca

SEQ ID NO: 1721532 - RNA, 15 nt, Salmonella enterica enterica serovar Typhi
auuaacgcgaaaaua

SEQ ID NO: 1721533 - RNA, 16 nt, Salmonella enterica enterica serovar Typhi
auuaacgcgaaaauac

SEQ ID NO: 1721534 - RNA, 16 nt, Salmonella enterica enterica serovar Typhi
auuaacgacaaaaaua

SEQ ID NO: 1721535 - RNA, 18 nt, Salmonella enterica enterica serovar Typhi
auuaucgauuugguaaau

SEQ ID NO: 1721536 - RNA, 17 nt, Salmonella enterica enterica serovar Typhi
auuauauugcguaaaaa

SEQ ID NO: 1721537 - RNA, 14 nt, Salmonella enterica enterica serovar Typhi
auuagucagcaaca

SEQ ID NO: 1721538 - RNA, 14 nt, Salmonella enterica enterica serovar Typhi
auuaguaauaucag

SEQ ID NO: 1721539 - RNA, 16 nt, Salmonella enterica enterica serovar Typhi
auuaugccugucauca

SEQ ID NO: 1721540 - RNA, 18 nt, Salmonella enterica enterica serovar Typhi
auuaugccugucaucauc

SEQ ID NO: 1721541 - RNA, 16 nt, Salmonella enterica enterica serovar Typhi
auuaugcuggccugca

SEQ ID NO: 1721542 - RNA, 16 nt, Salmonella enterica enterica serovar Typhi
auuauuaaaucaauac

SEQ ID NO: 1721543 - RNA, 21 nt, Salmonella enterica enterica serovar Typhi
auucaaaccuucaagaaucaa

SEQ ID NO: 1721544 - RNA, 17 nt, Salmonella enterica enterica serovar Typhi
auuauuuuagugaaaaa

SEQ ID NO: 1721545 - RNA, 19 nt, Salmonella enterica enterica serovar Typhi
auuauuuuagugaaaaaau

SEQ ID NO: 1721546 - RNA, 22 nt, Salmonella enterica enterica serovar Typhi
auuauuuuuaaauaacuuuuaa

SEQ ID NO: 1721547 - RNA, 15 nt, Salmonella enterica enterica serovar Typhi
auuauugcguugcuu

SEQ ID NO: 1721548 - RNA, 15 nt, Salmonella enterica enterica serovar Typhi
auuauuggucaguag

SEQ ID NO: 1721549 - RNA, 15 nt, Salmonella enterica enterica serovar Typhi
auuauuggugaaaaa

SEQ ID NO: 1721550 - RNA, 22 nt, Salmonella enterica enterica serovar Typhi
auuauugucuuuguugccuucg

SEQ ID NO: 1721551 - RNA, 14 nt, Salmonella enterica enterica serovar Typhi
auuacucuuuaugc

SEQ ID NO: 1721552 - RNA, 22 nt, Salmonella enterica enterica serovar Typhi
auuacguuggggauaaccagaa

SEQ ID NO: 1721553 - RNA, 21 nt, Salmonella enterica enterica serovar Typhi
auuacuaucuucaaagccaca

SEQ ID NO: 1721554 - RNA, 16 nt, Salmonella enterica enterica serovar Typhi
auuaccugguauuauu

SEQ ID NO: 1721555 - RNA, 15 nt, Salmonella enterica enterica serovar Typhi
auuaccggacggucg

SEQ ID NO: 1721556 - RNA, 23 nt, Salmonella enterica enterica serovar Typhi
auuaccgggauuuccauauuaac

SEQ ID NO: 1721557 - RNA, 22 nt, Salmonella enterica enterica serovar Typhi
auuacguguaguuauaaauuua

SEQ ID NO: 1721558 - RNA, 18 nt, Salmonella enterica enterica serovar Typhi
auuacagguguuaaucau

SEQ ID NO: 1721559 - RNA, 18 nt, Salmonella enterica enterica serovar Typhi
auuacaucaauaaacauu

SEQ ID NO: 1721560 - RNA, 20 nt, Salmonella enterica enterica serovar Typhi
auuacaugccguuaauaaug

SEQ ID NO: 1721561 - RNA, 20 nt, Salmonella enterica enterica serovar Typhi
auuaccgcucguuaauccaa

SEQ ID NO: 1721562 - RNA, 17 nt, Salmonella enterica enterica serovar Typhi
aaaagccagauaaagca

SEQ ID NO: 1721563 - RNA, 13 nt, Salmonella enterica enterica serovar Typhi
aaaagcaauaauc

SEQ ID NO: 1721564 - RNA, 13 nt, Salmonella enterica enterica serovar Typhi
auuaauacccaua

SEQ ID NO: 1721565 - RNA, 14 nt, Salmonella enterica enterica serovar Typhi
auuagaaacccaua

SEQ ID NO: 1721566 - RNA, 15 nt, Salmonella enterica enterica serovar Typhi
auuagacuucuucca

SEQ ID NO: 1721567 - RNA, 15 nt, Salmonella enterica enterica serovar Typhi
auuacuucaggcugc

SEQ ID NO: 1721568 - RNA, 23 nt, Salmonella enterica enterica serovar Typhi
auuacugcguaaaccauuucucc

SEQ ID NO: 1721569 - RNA, 13 nt, Salmonella enterica enterica serovar Typhi
auuacuggaucau

SEQ ID NO: 1721570 - RNA, 16 nt, Salmonella enterica enterica serovar Typhi
auuacuuauauuuauu

SEQ ID NO: 1721571 - RNA, 15 nt, Salmonella enterica enterica serovar Typhi
aaaagcgcgggcugg

SEQ ID NO: 1721572 - RNA, 14 nt, Salmonella enterica enterica serovar Typhi
aaaagcggauaaga

SEQ ID NO: 1721573 - RNA, 14 nt, Salmonella enterica enterica serovar Typhi
aaaagcgaaaauaa

SEQ ID NO: 1721574 - RNA, 21 nt, Salmonella enterica enterica serovar Typhi
auuagaggucagaauaacuca

SEQ ID NO: 1721575 - RNA, 16 nt, Salmonella enterica enterica serovar Typhi
auuagaggucagaaua

SEQ ID NO: 1721576 - RNA, 19 nt, Salmonella enterica enterica serovar Typhi
auuagaugcgaauaagcug

SEQ ID NO: 1721577 - RNA, 21 nt, Salmonella enterica enterica serovar Typhi
auuagcaauugccauaaaaac

SEQ ID NO: 1721578 - RNA, 17 nt, Salmonella enterica enterica serovar Typhi
auuagcaccguuucuga

SEQ ID NO: 1721579 - RNA, 20 nt, Salmonella enterica enterica serovar Typhi
auuccauuagcauucccuua

SEQ ID NO: 1721580 - RNA, 13 nt, Salmonella enterica enterica serovar Typhi
auuccaucggcau

SEQ ID NO: 1721581 - RNA, 20 nt, Salmonella enterica enterica serovar Typhi
auuccauauaacagaauaag

SEQ ID NO: 1721582 - RNA, 17 nt, Salmonella enterica enterica serovar Typhi
auuccgugucugaauga

SEQ ID NO: 1721583 - RNA, 13 nt, Salmonella enterica enterica serovar Typhi
auuccuuaucaca

SEQ ID NO: 1721584 - RNA, 14 nt, Salmonella enterica enterica serovar Typhi
auucccgccuuaag

SEQ ID NO: 1721585 - RNA, 22 nt, Salmonella enterica enterica serovar Typhi
auucccugcgcauacgucaugc

SEQ ID NO: 1721586 - RNA, 18 nt, Salmonella enterica enterica serovar Typhi
auucccguaaaagaagaa

SEQ ID NO: 1721587 - RNA, 15 nt, Salmonella enterica enterica serovar Typhi
auucccgucccugca

SEQ ID NO: 1721588 - RNA, 16 nt, Salmonella enterica enterica serovar Typhi
auucaucacguucagg

SEQ ID NO: 1721589 - RNA, 16 nt, Salmonella enterica enterica serovar Typhi
auucaucaucuugucc

SEQ ID NO: 1721590 - RNA, 20 nt, Salmonella enterica enterica serovar Typhi
auucaucgauacgcggaugu

SEQ ID NO: 1721591 - RNA, 15 nt, Salmonella enterica enterica serovar Typhi
aaaaggaaagauuac

SEQ ID NO: 1721592 - RNA, 15 nt, Salmonella enterica enterica serovar Typhi
aaaaggcaauaaagu

SEQ ID NO: 1721593 - RNA, 16 nt, Salmonella enterica enterica serovar Typhi
auucauauuagcuccg

SEQ ID NO: 1721594 - RNA, 20 nt, Salmonella enterica enterica serovar Typhi
auucaugguacucaacauca

SEQ ID NO: 1721595 - RNA, 15 nt, Salmonella enterica enterica serovar Typhi
auucaugaucuuucc

SEQ ID NO: 1721596 - RNA, 23 nt, Salmonella enterica enterica serovar Typhi
auucaugccagaagcaaauucag

SEQ ID NO: 1721597 - RNA, 19 nt, Salmonella enterica enterica serovar Typhi
auucaugcaacuucaccuc

SEQ ID NO: 1721598 - RNA, 16 nt, Salmonella enterica enterica serovar Typhi
auucauuauuuuuaaa

SEQ ID NO: 1721599 - RNA, 18 nt, Salmonella enterica enterica serovar Typhi
auucauugucuuuuucuc

SEQ ID NO: 1721600 - RNA, 16 nt, Salmonella enterica enterica serovar Typhi
auucauucugucagaa

SEQ ID NO: 1721601 - RNA, 14 nt, Salmonella enterica enterica serovar Typhi
auucauuauuuuua

SEQ ID NO: 1721602 - RNA, 14 nt, Salmonella enterica enterica serovar Typhi
auucauuucaaugu

SEQ ID NO: 1721603 - RNA, 15 nt, Salmonella enterica enterica serovar Typhi
auuccuuuaaauauc

SEQ ID NO: 1721604 - RNA, 18 nt, Salmonella enterica enterica serovar Typhi
auucgcgaugcucaacca

SEQ ID NO: 1721605 - RNA, 20 nt, Salmonella enterica enterica serovar Typhi
auucgcgcuaaaugacaaau

SEQ ID NO: 1721606 - RNA, 12 nt, Salmonella enterica enterica serovar Typhi
auucgcuugccc

SEQ ID NO: 1721607 - RNA, 15 nt, Salmonella enterica enterica serovar Typhi
auucgguggaaaccg

SEQ ID NO: 1721608 - RNA, 23 nt, Salmonella enterica enterica serovar Typhi
auucucacagaaucaucaggcua

SEQ ID NO: 1721609 - RNA, 15 nt, Salmonella enterica enterica serovar Typhi
auucgucuucaucuu

SEQ ID NO: 1721610 - RNA, 14 nt, Salmonella enterica enterica serovar Typhi
auucucuucuacca

SEQ ID NO: 1721611 - RNA, 15 nt, Salmonella enterica enterica serovar Typhi
auucugccaguucac

SEQ ID NO: 1721612 - RNA, 12 nt, Salmonella enterica enterica serovar Typhi
auucugcagcga

SEQ ID NO: 1721613 - RNA, 21 nt, Salmonella enterica enterica serovar Typhi
auucugauuuuacuaaugaau

SEQ ID NO: 1721614 - RNA, 18 nt, Salmonella enterica enterica serovar Typhi
auucugacgcagcuucug

SEQ ID NO: 1721615 - RNA, 18 nt, Salmonella enterica enterica serovar Typhi
auucuucgaaugucucaa

SEQ ID NO: 1721616 - RNA, 22 nt, Salmonella enterica enterica serovar Typhi
auucuucgccgaagugugccag

SEQ ID NO: 1721617 - RNA, 23 nt, Salmonella enterica enterica serovar Typhi
auucuugcccuauaauaacaagc

SEQ ID NO: 1721618 - RNA, 17 nt, Salmonella enterica enterica serovar Typhi
auucuugcccuauaaua

SEQ ID NO: 1721619 - RNA, 20 nt, Salmonella enterica enterica serovar Typhi
auucugcugaaaaagaacaa

SEQ ID NO: 1721620 - RNA, 13 nt, Salmonella enterica enterica serovar Typhi
auucugcugaugc

SEQ ID NO: 1721621 - RNA, 16 nt, Salmonella enterica enterica serovar Typhi
auucugcugaugcugg

SEQ ID NO: 1721622 - RNA, 13 nt, Salmonella enterica enterica serovar Typhi
auucugcgguaau

SEQ ID NO: 1721623 - RNA, 16 nt, Salmonella enterica enterica serovar Typhi
auucugcgccagccag

SEQ ID NO: 1721624 - RNA, 15 nt, Salmonella enterica enterica serovar Typhi
auucugcuuccagaa

SEQ ID NO: 1721625 - RNA, 22 nt, Salmonella enterica enterica serovar Typhi
auucugcuuccagaauucguac

SEQ ID NO: 1721626 - RNA, 22 nt, Salmonella enterica enterica serovar Typhi
auugcaacgaucccuaauaaaa

SEQ ID NO: 1721627 - RNA, 17 nt, Salmonella enterica enterica serovar Typhi
auugcaacgaucccuaa

SEQ ID NO: 1721628 - RNA, 20 nt, Salmonella enterica enterica serovar Typhi
auugcagcgguaaacaccac

SEQ ID NO: 1721629 - RNA, 20 nt, Salmonella enterica enterica serovar Typhi
auugcagauaauuuugcaua

SEQ ID NO: 1721630 - RNA, 21 nt, Salmonella enterica enterica serovar Typhi
auugcagcauuacacuauguu

SEQ ID NO: 1721631 - RNA, 20 nt, Salmonella enterica enterica serovar Typhi
auugaugccugcccaucuaa

SEQ ID NO: 1721632 - RNA, 15 nt, Salmonella enterica enterica serovar Typhi
auugauggccagccc

SEQ ID NO: 1721633 - RNA, 13 nt, Salmonella enterica enterica serovar Typhi
auugcgagaaaaa

SEQ ID NO: 1721634 - RNA, 22 nt, Salmonella enterica enterica serovar Typhi
auugcgacaacuagaauuuuca

SEQ ID NO: 1721635 - RNA, 20 nt, Salmonella enterica enterica serovar Typhi
auugcgacaagcucauuucc

SEQ ID NO: 1721636 - RNA, 16 nt, Salmonella enterica enterica serovar Typhi
auugcgaauaaaacug

SEQ ID NO: 1721637 - RNA, 18 nt, Salmonella enterica enterica serovar Typhi
auugcgaauaaaacugcc

SEQ ID NO: 1721638 - RNA, 16 nt, Salmonella enterica enterica serovar Typhi
auugccuaaauaacuc

SEQ ID NO: 1721639 - RNA, 20 nt, Salmonella enterica enterica serovar Typhi
auugcugcuauauaacauau

SEQ ID NO: 1721640 - RNA, 16 nt, Salmonella enterica enterica serovar Typhi
auugcguaaugagcgu

SEQ ID NO: 1721641 - RNA, 17 nt, Salmonella enterica enterica serovar Typhi
auugcccaucgcgccau

SEQ ID NO: 1721642 - RNA, 12 nt, Salmonella enterica enterica serovar Typhi
auugccaggacu

SEQ ID NO: 1721643 - RNA, 13 nt, Salmonella enterica enterica serovar Typhi
auugccacuuaau

SEQ ID NO: 1721644 - RNA, 21 nt, Salmonella enterica enterica serovar Typhi
auugccacuuaauaucaauau

SEQ ID NO: 1721645 - RNA, 16 nt, Salmonella enterica enterica serovar Typhi
auugccacagccucag

SEQ ID NO: 1721646 - RNA, 15 nt, Salmonella enterica enterica serovar Typhi
auugcccuuuuguuu

SEQ ID NO: 1721647 - RNA, 13 nt, Salmonella enterica enterica serovar Typhi
auugccgaccauu

SEQ ID NO: 1721648 - RNA, 15 nt, Salmonella enterica enterica serovar Typhi
auugccgcacauguu

SEQ ID NO: 1721649 - RNA, 22 nt, Salmonella enterica enterica serovar Typhi
auugccgaccgccagcagagcg

SEQ ID NO: 1721650 - RNA, 18 nt, Salmonella enterica enterica serovar Typhi
auugccgccagcuccugc

SEQ ID NO: 1721651 - RNA, 21 nt, Salmonella enterica enterica serovar Typhi
auugccgccaucuuuacccug

SEQ ID NO: 1721652 - RNA, 21 nt, Salmonella enterica enterica serovar Typhi
auugccggcgaccaugccagc

SEQ ID NO: 1721653 - RNA, 18 nt, Salmonella enterica enterica serovar Typhi
auugucugcgcugggccg

SEQ ID NO: 1721654 - RNA, 13 nt, Salmonella enterica enterica serovar Typhi
auuguuaaaaaga

SEQ ID NO: 1721655 - RNA, 14 nt, Salmonella enterica enterica serovar Typhi
auuguuccagguuu

SEQ ID NO: 1721656 - RNA, 18 nt, Salmonella enterica enterica serovar Typhi
auuguuacugguuuuuuc

SEQ ID NO: 1721657 - RNA, 22 nt, Salmonella enterica enterica serovar Typhi
auuuaacagagagggaaaaaaa

SEQ ID NO: 1721658 - RNA, 17 nt, Salmonella enterica enterica serovar Typhi
auuuaaauaucgguuca

SEQ ID NO: 1721659 - RNA, 15 nt, Salmonella enterica enterica serovar Typhi
auuuaaauacuuuuu

SEQ ID NO: 1721660 - RNA, 19 nt, Salmonella enterica enterica serovar Typhi
auuuaaauagcaauuauau

SEQ ID NO: 1721661 - RNA, 19 nt, Salmonella enterica enterica serovar Typhi
auuguuggugaguggccug

SEQ ID NO: 1721662 - RNA, 20 nt, Salmonella enterica enterica serovar Typhi
auuguuuaacguuucaugga

SEQ ID NO: 1721663 - RNA, 18 nt, Salmonella enterica enterica serovar Typhi
auuuaaacgggguaaacu

SEQ ID NO: 1721664 - RNA, 19 nt, Salmonella enterica enterica serovar Typhi
auuguuucggauaauucug

SEQ ID NO: 1721665 - RNA, 20 nt, Salmonella enterica enterica serovar Typhi
auugucaugcuaaaacagau

SEQ ID NO: 1721666 - RNA, 16 nt, Salmonella enterica enterica serovar Typhi
auuguagcugcgccag

SEQ ID NO: 1721667 - RNA, 12 nt, Salmonella enterica enterica serovar Typhi
auuguaaaaccg

SEQ ID NO: 1721668 - RNA, 15 nt, Salmonella enterica enterica serovar Typhi
auuguaaaaccgacu

SEQ ID NO: 1721669 - RNA, 19 nt, Salmonella enterica enterica serovar Typhi
auugcuggcagaugaacau

SEQ ID NO: 1721670 - RNA, 23 nt, Salmonella enterica enterica serovar Typhi
auugcuguaggcacuuuccagac

SEQ ID NO: 1721671 - RNA, 15 nt, Salmonella enterica enterica serovar Typhi
auugcuguuaauuuc

SEQ ID NO: 1721672 - RNA, 15 nt, Salmonella enterica enterica serovar Typhi
auugcuguauuuuau

SEQ ID NO: 1721673 - RNA, 15 nt, Salmonella enterica enterica serovar Typhi
auuggcguuuuauga

SEQ ID NO: 1721674 - RNA, 17 nt, Salmonella enterica enterica serovar Typhi
auuggugaaaaaucauu

SEQ ID NO: 1721675 - RNA, 15 nt, Salmonella enterica enterica serovar Typhi
auuggugauauaaac

SEQ ID NO: 1721676 - RNA, 16 nt, Salmonella enterica enterica serovar Typhi
caaaaaaucagcaauc

SEQ ID NO: 1721677 - RNA, 22 nt, Salmonella enterica enterica serovar Typhi
caaaaaauauagccauuuaaug

SEQ ID NO: 1721678 - RNA, 13 nt, Salmonella enterica enterica serovar Typhi
caaaaaaaaccag

SEQ ID NO: 1721679 - RNA, 13 nt, Salmonella enterica enterica serovar Typhi
caaaaaaaaaccg

SEQ ID NO: 1721680 - RNA, 16 nt, Salmonella enterica enterica serovar Typhi
auuuuucgguuuucca

SEQ ID NO: 1721681 - RNA, 20 nt, Salmonella enterica enterica serovar Typhi
auuuuucuggcuucuuaaaa

SEQ ID NO: 1721682 - RNA, 14 nt, Salmonella enterica enterica serovar Typhi
auuuuucugguaaa

SEQ ID NO: 1721683 - RNA, 15 nt, Salmonella enterica enterica serovar Typhi
auuuuucgaucuucu

SEQ ID NO: 1721684 - RNA, 18 nt, Salmonella enterica enterica serovar Typhi
auuuuucccuggccggaa

SEQ ID NO: 1721685 - RNA, 17 nt, Salmonella enterica enterica serovar Typhi
auuuuuccagcucagaa

SEQ ID NO: 1721686 - RNA, 17 nt, Salmonella enterica enterica serovar Typhi
auuuuugaucugcuuga

SEQ ID NO: 1721687 - RNA, 15 nt, Salmonella enterica enterica serovar Typhi
auuuuuuaucuucca

SEQ ID NO: 1721688 - RNA, 16 nt, Salmonella enterica enterica serovar Typhi
auuuucggcaucagca

SEQ ID NO: 1721689 - RNA, 17 nt, Salmonella enterica enterica serovar Typhi
auuuucggcaucagcag

SEQ ID NO: 1721690 - RNA, 14 nt, Salmonella enterica enterica serovar Typhi
auuuucguaaaaua

SEQ ID NO: 1721691 - RNA, 13 nt, Salmonella enterica enterica serovar Typhi
auuuugcuuuuuc

SEQ ID NO: 1721692 - RNA, 16 nt, Salmonella enterica enterica serovar Typhi
auuuuggggaaaauac

SEQ ID NO: 1721693 - RNA, 17 nt, Salmonella enterica enterica serovar Typhi
auuuuggggaaaauacc

SEQ ID NO: 1721694 - RNA, 19 nt, Salmonella enterica enterica serovar Typhi
auuuugucauguccagggc

SEQ ID NO: 1721695 - RNA, 22 nt, Salmonella enterica enterica serovar Typhi
auuuuguugcuccagcaucaca

SEQ ID NO: 1721696 - RNA, 24 nt, Salmonella enterica enterica serovar Typhi
auuuuguugcuccagcaucacauc

SEQ ID NO: 1721697 - RNA, 21 nt, Salmonella enterica enterica serovar Typhi
auuuuuaagguauugauuuuu

SEQ ID NO: 1721698 - RNA, 14 nt, Salmonella enterica enterica serovar Typhi
auuuuaaaaauauc

SEQ ID NO: 1721699 - RNA, 21 nt, Salmonella enterica enterica serovar Typhi
auuuuacccgcgcaucccaca

SEQ ID NO: 1721700 - RNA, 14 nt, Salmonella enterica enterica serovar Typhi
auuuuacuuucauu

SEQ ID NO: 1721701 - RNA, 17 nt, Salmonella enterica enterica serovar Typhi
auuuuagaaauagaaau

SEQ ID NO: 1721702 - RNA, 16 nt, Salmonella enterica enterica serovar Typhi
auuuuauagcagucag

SEQ ID NO: 1721703 - RNA, 22 nt, Salmonella enterica enterica serovar Typhi
auuuuaucgacgcuauuuuuca

SEQ ID NO: 1721704 - RNA, 14 nt, Salmonella enterica enterica serovar Typhi
auuuuagaucccca

SEQ ID NO: 1721705 - RNA, 22 nt, Salmonella enterica enterica serovar Typhi
auuuucaacggcaucaauaauu

SEQ ID NO: 1721706 - RNA, 19 nt, Salmonella enterica enterica serovar Typhi
auuuucaacggcaucaaua

SEQ ID NO: 1721707 - RNA, 12 nt, Salmonella enterica enterica serovar Typhi
auuuuauuuuua

SEQ ID NO: 1721708 - RNA, 13 nt, Salmonella enterica enterica serovar Typhi
auuuuauuuuuca

SEQ ID NO: 1721709 - RNA, 15 nt, Salmonella enterica enterica serovar Typhi
auuuucaaaaacaag

SEQ ID NO: 1721710 - RNA, 17 nt, Salmonella enterica enterica serovar Typhi
auuuucaaaaacaaggg

SEQ ID NO: 1721711 - RNA, 13 nt, Salmonella enterica enterica serovar Typhi
auuuucaaaaaca

SEQ ID NO: 1721712 - RNA, 18 nt, Salmonella enterica enterica serovar Typhi
auuuucauacuauuuccu

SEQ ID NO: 1721713 - RNA, 14 nt, Salmonella enterica enterica serovar Typhi
auuuucaucauauc

SEQ ID NO: 1721714 - RNA, 21 nt, Salmonella enterica enterica serovar Typhi
auuuucaucauaucugauaaa

SEQ ID NO: 1721715 - RNA, 19 nt, Salmonella enterica enterica serovar Typhi
auuuucaugauauucuguc

SEQ ID NO: 1721716 - RNA, 16 nt, Salmonella enterica enterica serovar Typhi
auuucuugcaauagcg

SEQ ID NO: 1721717 - RNA, 17 nt, Salmonella enterica enterica serovar Typhi
auuucuugcaauagcgc

SEQ ID NO: 1721718 - RNA, 20 nt, Salmonella enterica enterica serovar Typhi
auuucuugagcggcaucacu

SEQ ID NO: 1721719 - RNA, 16 nt, Salmonella enterica enterica serovar Typhi
auuucuugaucaaucu

SEQ ID NO: 1721720 - RNA, 13 nt, Salmonella enterica enterica serovar Typhi
auuucuuccauua

SEQ ID NO: 1721721 - RNA, 22 nt, Salmonella enterica enterica serovar Typhi
auuucguccggcugccacucuu

SEQ ID NO: 1721722 - RNA, 13 nt, Salmonella enterica enterica serovar Typhi
auuucucgcccgc

SEQ ID NO: 1721723 - RNA, 21 nt, Salmonella enterica enterica serovar Typhi
auuucucgcucgcccaucacu

SEQ ID NO: 1721724 - RNA, 22 nt, Salmonella enterica enterica serovar Typhi
auuucugccugcuucagacaac

SEQ ID NO: 1721725 - RNA, 20 nt, Salmonella enterica enterica serovar Typhi
auuucaguacagccaaaaau

SEQ ID NO: 1721726 - RNA, 17 nt, Salmonella enterica enterica serovar Typhi
auuucagggaaaagaag

SEQ ID NO: 1721727 - RNA, 18 nt, Salmonella enterica enterica serovar Typhi
auuucagggaaaagaagu

SEQ ID NO: 1721728 - RNA, 14 nt, Salmonella enterica enterica serovar Typhi
auuucagcgcagaa

SEQ ID NO: 1721729 - RNA, 16 nt, Salmonella enterica enterica serovar Typhi
auuucaggaauacauu

SEQ ID NO: 1721730 - RNA, 20 nt, Salmonella enterica enterica serovar Typhi
auuucaggcaaaaaaaaacc

SEQ ID NO: 1721731 - RNA, 17 nt, Salmonella enterica enterica serovar Typhi
auuucaggcaaaggaau

SEQ ID NO: 1721732 - RNA, 18 nt, Salmonella enterica enterica serovar Typhi
auuucaccgucaauaacg

SEQ ID NO: 1721733 - RNA, 15 nt, Salmonella enterica enterica serovar Typhi
auuucacgaauaucg

SEQ ID NO: 1721734 - RNA, 22 nt, Salmonella enterica enterica serovar Typhi
auuucacgcuucacgucagcga

SEQ ID NO: 1721735 - RNA, 22 nt, Salmonella enterica enterica serovar Typhi
auuucgccuuugcgacgguuuu

SEQ ID NO: 1721736 - RNA, 13 nt, Salmonella enterica enterica serovar Typhi
auuuccauuuuuc

SEQ ID NO: 1721737 - RNA, 12 nt, Salmonella enterica enterica serovar Typhi
auuuccgcagcc

SEQ ID NO: 1721738 - RNA, 15 nt, Salmonella enterica enterica serovar Typhi
auuuaucuucucuau

SEQ ID NO: 1721739 - RNA, 21 nt, Salmonella enterica enterica serovar Typhi
aaaagugaacgguugagcuuu

SEQ ID NO: 1721740 - RNA, 17 nt, Salmonella enterica enterica serovar Typhi
aaaagucguucagacau

SEQ ID NO: 1721741 - RNA, 21 nt, Salmonella enterica enterica serovar Typhi
auuuauggcgucaccauuacu

SEQ ID NO: 1721742 - RNA, 16 nt, Salmonella enterica enterica serovar Typhi
auuuaugcgcugggca

SEQ ID NO: 1721743 - RNA, 19 nt, Salmonella enterica enterica serovar Typhi
auuuaugauuuuaacauca

SEQ ID NO: 1721744 - RNA, 21 nt, Salmonella enterica enterica serovar Typhi
aaaagugcgcacucagaaaau

SEQ ID NO: 1721745 - RNA, 16 nt, Salmonella enterica enterica serovar Typhi
auuuauuagugagugc

SEQ ID NO: 1721746 - RNA, 22 nt, Salmonella enterica enterica serovar Typhi
auuucaaacguuucaagaugcc

SEQ ID NO: 1721747 - RNA, 14 nt, Salmonella enterica enterica serovar Typhi
auuucaaucaucau

SEQ ID NO: 1721748 - RNA, 17 nt, Salmonella enterica enterica serovar Typhi
auuucaaucaucauauc

SEQ ID NO: 1721749 - RNA, 14 nt, Salmonella enterica enterica serovar Typhi
auuucaauguaauu

SEQ ID NO: 1721750 - RNA, 22 nt, Salmonella enterica enterica serovar Typhi
auuuauuuuuaguaacuuacaa

SEQ ID NO: 1721751 - RNA, 23 nt, Salmonella enterica enterica serovar Typhi
auuuauuuuuugggcgcuuagaa

SEQ ID NO: 1721752 - RNA, 21 nt, Salmonella enterica enterica serovar Typhi
auuuauuugcauuguacuuuu

SEQ ID NO: 1721753 - RNA, 23 nt, Salmonella enterica enterica serovar Typhi
auuuauuugcauuguacuuuuaa

SEQ ID NO: 1721754 - RNA, 13 nt, Salmonella enterica enterica serovar Typhi
auuuauccaguaa

SEQ ID NO: 1721755 - RNA, 19 nt, Salmonella enterica enterica serovar Typhi
auuuaucccgugguggggu

SEQ ID NO: 1721756 - RNA, 23 nt, Salmonella enterica enterica serovar Typhi
auuuaucccguggugggguuccc

SEQ ID NO: 1721757 - RNA, 14 nt, Salmonella enterica enterica serovar Typhi
auuuauccagcagg

SEQ ID NO: 1721758 - RNA, 17 nt, Salmonella enterica enterica serovar Typhi
auuuaucaaucugcuuu

SEQ ID NO: 1721759 - RNA, 16 nt, Salmonella enterica enterica serovar Typhi
auuuauauugugccuc

SEQ ID NO: 1721760 - RNA, 14 nt, Salmonella enterica enterica serovar Typhi
auuuaucugcguga

SEQ ID NO: 1721761 - RNA, 22 nt, Salmonella enterica enterica serovar Typhi
auuuaucuuccggcaucacauc

SEQ ID NO: 1721762 - RNA, 13 nt, Salmonella enterica enterica serovar Typhi
auuuauaacguau

SEQ ID NO: 1721763 - RNA, 13 nt, Salmonella enterica enterica serovar Typhi
auuuaauauauga

SEQ ID NO: 1721764 - RNA, 19 nt, Salmonella enterica enterica serovar Typhi
cagcuaaaaacgccaauca

SEQ ID NO: 1721765 - RNA, 19 nt, Salmonella enterica enterica serovar Typhi
cagcuaaaaccguagauuu

SEQ ID NO: 1721766 - RNA, 13 nt, Salmonella enterica enterica serovar Typhi
aaaauugaauuaa

SEQ ID NO: 1721767 - RNA, 23 nt, Salmonella enterica enterica serovar Typhi
cagcguuuccggaaugagaugca

SEQ ID NO: 1721768 - RNA, 13 nt, Salmonella enterica enterica serovar Typhi
cagcucuuuucug

SEQ ID NO: 1721769 - RNA, 21 nt, Salmonella enterica enterica serovar Typhi
cagcucguacuccgcgcgcgu

SEQ ID NO: 1721770 - RNA, 21 nt, Salmonella enterica enterica serovar Typhi
cagcugagcuaaucacccacu

SEQ ID NO: 1721771 - RNA, 22 nt, Salmonella enterica enterica serovar Typhi
caggaaucgcguuaauuuuccc

SEQ ID NO: 1721772 - RNA, 14 nt, Salmonella enterica enterica serovar Typhi
caggaacugacuga

SEQ ID NO: 1721773 - RNA, 20 nt, Salmonella enterica enterica serovar Typhi
caggaaauccagcagaauaa

SEQ ID NO: 1721774 - RNA, 21 nt, Salmonella enterica enterica serovar Typhi
caggaaaccgguaaaggcgac

SEQ ID NO: 1721775 - RNA, 17 nt, Salmonella enterica enterica serovar Typhi
caggaaagagccgcgca

SEQ ID NO: 1721776 - RNA, 14 nt, Salmonella enterica enterica serovar Typhi
cagcuuguuuacgc

SEQ ID NO: 1721777 - RNA, 14 nt, Salmonella enterica enterica serovar Typhi
cagcuuggcggcuu

SEQ ID NO: 1721778 - RNA, 16 nt, Salmonella enterica enterica serovar Typhi
cagcugguauaggcca

SEQ ID NO: 1721779 - RNA, 20 nt, Salmonella enterica enterica serovar Typhi
cagcuucgcugcgcgggcgu

SEQ ID NO: 1721780 - RNA, 22 nt, Salmonella enterica enterica serovar Typhi
cagcuucgcugcgcgggcgucu

SEQ ID NO: 1721781 - RNA, 22 nt, Salmonella enterica enterica serovar Typhi
cagcuggcgauauccgugccgc

SEQ ID NO: 1721782 - RNA, 16 nt, Salmonella enterica enterica serovar Typhi
cagcugggucgcgcuu

SEQ ID NO: 1721783 - RNA, 17 nt, Salmonella enterica enterica serovar Typhi
cagcugggucgcgcuuu

SEQ ID NO: 1721784 - RNA, 19 nt, Salmonella enterica enterica serovar Typhi
caggaugugaggcagauau

SEQ ID NO: 1721785 - RNA, 22 nt, Salmonella enterica enterica serovar Typhi
caggaucgguaaacgccccuuc

SEQ ID NO: 1721786 - RNA, 20 nt, Salmonella enterica enterica serovar Typhi
caggauggccagcaccagca

SEQ ID NO: 1721787 - RNA, 19 nt, Salmonella enterica enterica serovar Typhi
caggaugcuuuuuauaaag

SEQ ID NO: 1721788 - RNA, 18 nt, Salmonella enterica enterica serovar Typhi
caggauccguaaccaguc

SEQ ID NO: 1721789 - RNA, 15 nt, Salmonella enterica enterica serovar Typhi
caggaucggaagcga

SEQ ID NO: 1721790 - RNA, 16 nt, Salmonella enterica enterica serovar Typhi
caggauaaaauccugc

SEQ ID NO: 1721791 - RNA, 17 nt, Salmonella enterica enterica serovar Typhi
caggauaaaauccugca

SEQ ID NO: 1721792 - RNA, 12 nt, Salmonella enterica enterica serovar Typhi
caggauaaagac

SEQ ID NO: 1721793 - RNA, 19 nt, Salmonella enterica enterica serovar Typhi
caggaauuccaguccuuuc

SEQ ID NO: 1721794 - RNA, 13 nt, Salmonella enterica enterica serovar Typhi
caggacaaccccu

SEQ ID NO: 1721795 - RNA, 17 nt, Salmonella enterica enterica serovar Typhi
caggacaucaaaggcag

SEQ ID NO: 1721796 - RNA, 18 nt, Salmonella enterica enterica serovar Typhi
caggaguaaauaacaaaa

SEQ ID NO: 1721797 - RNA, 19 nt, Salmonella enterica enterica serovar Typhi
caggcaaucagcagccggg

SEQ ID NO: 1721798 - RNA, 18 nt, Salmonella enterica enterica serovar Typhi
caggcacagaagcgccug

SEQ ID NO: 1721799 - RNA, 22 nt, Salmonella enterica enterica serovar Typhi
caggcaaaaaucggccucuuca

SEQ ID NO: 1721800 - RNA, 15 nt, Salmonella enterica enterica serovar Typhi
caggcaaaccagcac

SEQ ID NO: 1721801 - RNA, 17 nt, Salmonella enterica enterica serovar Typhi
caggcaaaucuggugau

SEQ ID NO: 1721802 - RNA, 16 nt, Salmonella enterica enterica serovar Typhi
caggcaaaggaaugcu

SEQ ID NO: 1721803 - RNA, 22 nt, Salmonella enterica enterica serovar Typhi
caggauugcugugaaguaauuc

SEQ ID NO: 1721804 - RNA, 17 nt, Salmonella enterica enterica serovar Typhi
caggauucgaaccugcg

SEQ ID NO: 1721805 - RNA, 18 nt, Salmonella enterica enterica serovar Typhi
caggauuuacugagcgcc

SEQ ID NO: 1721806 - RNA, 17 nt, Salmonella enterica enterica serovar Typhi
caggcaguuugcgaaaa

SEQ ID NO: 1721807 - RNA, 23 nt, Salmonella enterica enterica serovar Typhi
caggcauagaaaaagaacugcaa

SEQ ID NO: 1721808 - RNA, 16 nt, Salmonella enterica enterica serovar Typhi
caggcauaauggaacu

SEQ ID NO: 1721809 - RNA, 21 nt, Salmonella enterica enterica serovar Typhi
caggcauaauggaacugccug

SEQ ID NO: 1721810 - RNA, 15 nt, Salmonella enterica enterica serovar Typhi
caggcauuuuauuac

SEQ ID NO: 1721811 - RNA, 15 nt, Salmonella enterica enterica serovar Typhi
caggcauugucaccu

SEQ ID NO: 1721812 - RNA, 22 nt, Salmonella enterica enterica serovar Typhi
caggcaguagccggaaaacaua

SEQ ID NO: 1721813 - RNA, 21 nt, Salmonella enterica enterica serovar Typhi
caggcaggcccgcgcuuuaau

SEQ ID NO: 1721814 - RNA, 23 nt, Salmonella enterica enterica serovar Typhi
caggcacuguggugugccugcgc

SEQ ID NO: 1721815 - RNA, 14 nt, Salmonella enterica enterica serovar Typhi
caggcacuugagaa

SEQ ID NO: 1721816 - RNA, 21 nt, Salmonella enterica enterica serovar Typhi
caggcacugaauuuacgccgu

SEQ ID NO: 1721817 - RNA, 16 nt, Salmonella enterica enterica serovar Typhi
caggcacguuaaacac

SEQ ID NO: 1721818 - RNA, 15 nt, Salmonella enterica enterica serovar Typhi
caggcacgugcauaa

SEQ ID NO: 1721819 - RNA, 15 nt, Salmonella enterica enterica serovar Typhi
caggcagccacaaug

SEQ ID NO: 1721820 - RNA, 13 nt, Salmonella enterica enterica serovar Typhi
caggcagaaauaa

SEQ ID NO: 1721821 - RNA, 19 nt, Salmonella enterica enterica serovar Typhi
caggcgcgaccucaucaaa

SEQ ID NO: 1721822 - RNA, 22 nt, Salmonella enterica enterica serovar Typhi
caggcgcgaccucaucaaacag

SEQ ID NO: 1721823 - RNA, 22 nt, Salmonella enterica enterica serovar Typhi
caggcgcuaucuucaauacgaa

SEQ ID NO: 1721824 - RNA, 22 nt, Salmonella enterica enterica serovar Typhi
caggcgcgaaucgacaauccgc

SEQ ID NO: 1721825 - RNA, 16 nt, Salmonella enterica enterica serovar Typhi
caggcgcaucagaaaa

SEQ ID NO: 1721826 - RNA, 14 nt, Salmonella enterica enterica serovar Typhi
caggccaacauagc

SEQ ID NO: 1721827 - RNA, 18 nt, Salmonella enterica enterica serovar Typhi
caggccaauuccgccaua

SEQ ID NO: 1721828 - RNA, 16 nt, Salmonella enterica enterica serovar Typhi
caggccaagcagcgcc

SEQ ID NO: 1721829 - RNA, 17 nt, Salmonella enterica enterica serovar Typhi
caggcauuuuauuaccu

SEQ ID NO: 1721830 - RNA, 18 nt, Salmonella enterica enterica serovar Typhi
caggcauuuuauuaccug

SEQ ID NO: 1721831 - RNA, 14 nt, Salmonella enterica enterica serovar Typhi
caggccaaaaccac

SEQ ID NO: 1721832 - RNA, 18 nt, Salmonella enterica enterica serovar Typhi
caggccgucggcgccagc

SEQ ID NO: 1721833 - RNA, 16 nt, Salmonella enterica enterica serovar Typhi
caggccuaacacaugc

SEQ ID NO: 1721834 - RNA, 16 nt, Salmonella enterica enterica serovar Typhi
caggccuccugacgaa

SEQ ID NO: 1721835 - RNA, 20 nt, Salmonella enterica enterica serovar Typhi
caggccuacacguucgcuua

SEQ ID NO: 1721836 - RNA, 16 nt, Salmonella enterica enterica serovar Typhi
caggccuaccagccga

SEQ ID NO: 1721837 - RNA, 17 nt, Salmonella enterica enterica serovar Typhi
caggccuaccagccgag

SEQ ID NO: 1721838 - RNA, 17 nt, Salmonella enterica enterica serovar Typhi
caggcgacgccgccauc

SEQ ID NO: 1721839 - RNA, 16 nt, Salmonella enterica enterica serovar Typhi
caggcgacgccgccau

SEQ ID NO: 1721840 - RNA, 20 nt, Salmonella enterica enterica serovar Typhi
caggcgacgaaccgcguaac

SEQ ID NO: 1721841 - RNA, 17 nt, Salmonella enterica enterica serovar Typhi
caggcgaccagaugcag

SEQ ID NO: 1721842 - RNA, 18 nt, Salmonella enterica enterica serovar Typhi
caggcgaauagcgcgcua

SEQ ID NO: 1721843 - RNA, 16 nt, Salmonella enterica enterica serovar Typhi
cagggaaaccauguug

SEQ ID NO: 1721844 - RNA, 20 nt, Salmonella enterica enterica serovar Typhi
cagggaaaagaaguggacuu

SEQ ID NO: 1721845 - RNA, 13 nt, Salmonella enterica enterica serovar Typhi
cagggagggccaa

SEQ ID NO: 1721846 - RNA, 21 nt, Salmonella enterica enterica serovar Typhi
caggcuugccgcgccagacgc

SEQ ID NO: 1721847 - RNA, 19 nt, Salmonella enterica enterica serovar Typhi
caggcuuuaaauucagcac

SEQ ID NO: 1721848 - RNA, 16 nt, Salmonella enterica enterica serovar Typhi
caggcuuuccacguuc

SEQ ID NO: 1721849 - RNA, 23 nt, Salmonella enterica enterica serovar Typhi
caggcugagcguagaccgcccag

SEQ ID NO: 1721850 - RNA, 17 nt, Salmonella enterica enterica serovar Typhi
caggcucucgguggugg

SEQ ID NO: 1721851 - RNA, 19 nt, Salmonella enterica enterica serovar Typhi
caggcgggaagcuucagca

SEQ ID NO: 1721852 - RNA, 21 nt, Salmonella enterica enterica serovar Typhi
caggcggggagggucagcagg

SEQ ID NO: 1721853 - RNA, 19 nt, Salmonella enterica enterica serovar Typhi
caggcggguagucccagga

SEQ ID NO: 1721854 - RNA, 22 nt, Salmonella enterica enterica serovar Typhi
caggcggguagucccaggauag

SEQ ID NO: 1721855 - RNA, 14 nt, Salmonella enterica enterica serovar Typhi
caggcuaccccccc

SEQ ID NO: 1721856 - RNA, 15 nt, Salmonella enterica enterica serovar Typhi
caggcguugugcaga

SEQ ID NO: 1721857 - RNA, 22 nt, Salmonella enterica enterica serovar Typhi
caggcguugaccgcuucgccuu

SEQ ID NO: 1721858 - RNA, 16 nt, Salmonella enterica enterica serovar Typhi
caggcguuagccgcca

SEQ ID NO: 1721859 - RNA, 16 nt, Salmonella enterica enterica serovar Typhi
caggcggcugcgcaug

SEQ ID NO: 1721860 - RNA, 22 nt, Salmonella enterica enterica serovar Typhi
caggcggcaaaaaaugcauuga

SEQ ID NO: 1721861 - RNA, 21 nt, Salmonella enterica enterica serovar Typhi
cagggcugcuggugcgccugu

SEQ ID NO: 1721862 - RNA, 14 nt, Salmonella enterica enterica serovar Typhi
cagggcuuuauuuu

SEQ ID NO: 1721863 - RNA, 20 nt, Salmonella enterica enterica serovar Typhi
caggggaugauuuucaggca

SEQ ID NO: 1721864 - RNA, 13 nt, Salmonella enterica enterica serovar Typhi
caggggauucugc

SEQ ID NO: 1721865 - RNA, 13 nt, Salmonella enterica enterica serovar Typhi
cagggcugcuggc

SEQ ID NO: 1721866 - RNA, 17 nt, Salmonella enterica enterica serovar Typhi
cagggcuuauucaagca

SEQ ID NO: 1721867 - RNA, 14 nt, Salmonella enterica enterica serovar Typhi
cagggucaggaacu

SEQ ID NO: 1721868 - RNA, 19 nt, Salmonella enterica enterica serovar Typhi
caggguaucauuaugggca

SEQ ID NO: 1721869 - RNA, 22 nt, Salmonella enterica enterica serovar Typhi
caggguaucauuaugggcagca

SEQ ID NO: 1721870 - RNA, 16 nt, Salmonella enterica enterica serovar Typhi
cagggcaacggccagc

SEQ ID NO: 1721871 - RNA, 21 nt, Salmonella enterica enterica serovar Typhi
cagggcaaauuaucccuuccu

SEQ ID NO: 1721872 - RNA, 17 nt, Salmonella enterica enterica serovar Typhi
cagggauaugcugaucu

SEQ ID NO: 1721873 - RNA, 16 nt, Salmonella enterica enterica serovar Typhi
cagggauugauggcca

SEQ ID NO: 1721874 - RNA, 23 nt, Salmonella enterica enterica serovar Typhi
cagggcgaacauuccgcccaaga

SEQ ID NO: 1721875 - RNA, 15 nt, Salmonella enterica enterica serovar Typhi
cagguaccccgccac

SEQ ID NO: 1721876 - RNA, 17 nt, Salmonella enterica enterica serovar Typhi
cagguaccccgccaccg

SEQ ID NO: 1721877 - RNA, 20 nt, Salmonella enterica enterica serovar Typhi
cagguaccccgccaccgccg

SEQ ID NO: 1721878 - RNA, 16 nt, Salmonella enterica enterica serovar Typhi
cagguacagguaauga

SEQ ID NO: 1721879 - RNA, 20 nt, Salmonella enterica enterica serovar Typhi
cagguaagcuauuacaaaaa

SEQ ID NO: 1721880 - RNA, 15 nt, Salmonella enterica enterica serovar Typhi
cagguaaucaucacc

SEQ ID NO: 1721881 - RNA, 23 nt, Salmonella enterica enterica serovar Typhi
cagguaaucaucaccguuuucca

SEQ ID NO: 1721882 - RNA, 23 nt, Salmonella enterica enterica serovar Typhi
caggguuugcgcagacugcgcca

SEQ ID NO: 1721883 - RNA, 13 nt, Salmonella enterica enterica serovar Typhi
caggguuugccag

SEQ ID NO: 1721884 - RNA, 18 nt, Salmonella enterica enterica serovar Typhi
caggguuugccagcacca

SEQ ID NO: 1721885 - RNA, 21 nt, Salmonella enterica enterica serovar Typhi
caggguuugccagcaccagca

SEQ ID NO: 1721886 - RNA, 22 nt, Salmonella enterica enterica serovar Typhi
cagguaacauaucgacauaagu

SEQ ID NO: 1721887 - RNA, 20 nt, Salmonella enterica enterica serovar Typhi
cagguaacgacuacuuccag

SEQ ID NO: 1721888 - RNA, 18 nt, Salmonella enterica enterica serovar Typhi
cagguaaaccggucaggu

SEQ ID NO: 1721889 - RNA, 23 nt, Salmonella enterica enterica serovar Typhi
cagguaaaccggucagguagcag

SEQ ID NO: 1721890 - RNA, 13 nt, Salmonella enterica enterica serovar Typhi
caggguucacugc

SEQ ID NO: 1721891 - RNA, 22 nt, Salmonella enterica enterica serovar Typhi
caggguuccguucccaaugcuu

SEQ ID NO: 1721892 - RNA, 14 nt, Salmonella enterica enterica serovar Typhi
caggguuuaaucac

SEQ ID NO: 1721893 - RNA, 16 nt, Salmonella enterica enterica serovar Typhi
cagggugaugguguca

SEQ ID NO: 1721894 - RNA, 12 nt, Salmonella enterica enterica serovar Typhi
caggguggcgcu

SEQ ID NO: 1721895 - RNA, 16 nt, Salmonella enterica enterica serovar Typhi
cagccguuucuugucu

SEQ ID NO: 1721896 - RNA, 21 nt, Salmonella enterica enterica serovar Typhi
cagccugugaucggagaaaua

SEQ ID NO: 1721897 - RNA, 13 nt, Salmonella enterica enterica serovar Typhi
cagccuaucgcca

SEQ ID NO: 1721898 - RNA, 14 nt, Salmonella enterica enterica serovar Typhi
cagccgugagcaga

SEQ ID NO: 1721899 - RNA, 17 nt, Salmonella enterica enterica serovar Typhi
cagccgguuagccacaa

SEQ ID NO: 1721900 - RNA, 15 nt, Salmonella enterica enterica serovar Typhi
cagccguaccacccg

SEQ ID NO: 1721901 - RNA, 23 nt, Salmonella enterica enterica serovar Typhi
cagccgucaaacaucgcgcucca

SEQ ID NO: 1721902 - RNA, 21 nt, Salmonella enterica enterica serovar Typhi
cagccguaccacccgggaaaa

SEQ ID NO: 1721903 - RNA, 17 nt, Salmonella enterica enterica serovar Typhi
cagccgguauccagcgc

SEQ ID NO: 1721904 - RNA, 15 nt, Salmonella enterica enterica serovar Typhi
cagccgggcaggaaa

SEQ ID NO: 1721905 - RNA, 14 nt, Salmonella enterica enterica serovar Typhi
cagcccgucggcgu

SEQ ID NO: 1721906 - RNA, 21 nt, Salmonella enterica enterica serovar Typhi
cagccgcggcgcuuucgccac

SEQ ID NO: 1721907 - RNA, 14 nt, Salmonella enterica enterica serovar Typhi
cagccgcucugcug

SEQ ID NO: 1721908 - RNA, 18 nt, Salmonella enterica enterica serovar Typhi
cagccuucggacugcugg

SEQ ID NO: 1721909 - RNA, 11 nt, Salmonella enterica enterica serovar Typhi
cagccuuauag

SEQ ID NO: 1721910 - RNA, 18 nt, Salmonella enterica enterica serovar Typhi
cagccuugauaccgccgc

SEQ ID NO: 1721911 - RNA, 17 nt, Salmonella enterica enterica serovar Typhi
cagccuuauaagaacca

SEQ ID NO: 1721912 - RNA, 11 nt, Salmonella enterica enterica serovar Typhi
cagccugugca

SEQ ID NO: 1721913 - RNA, 14 nt, Salmonella enterica enterica serovar Typhi
cagcgacaggcugu

SEQ ID NO: 1721914 - RNA, 15 nt, Salmonella enterica enterica serovar Typhi
cagcgacgcccagug

SEQ ID NO: 1721915 - RNA, 23 nt, Salmonella enterica enterica serovar Typhi
cagcgacgccagauuaucggcca

SEQ ID NO: 1721916 - RNA, 23 nt, Salmonella enterica enterica serovar Typhi
cagcgacgaugaaauaaacgacc

SEQ ID NO: 1721917 - RNA, 17 nt, Salmonella enterica enterica serovar Typhi
cagcgaccacgccaccg

SEQ ID NO: 1721918 - RNA, 14 nt, Salmonella enterica enterica serovar Typhi
cagcgcaacgcgca

SEQ ID NO: 1721919 - RNA, 22 nt, Salmonella enterica enterica serovar Typhi
cagcgcaaacaacccggcugcc

SEQ ID NO: 1721920 - RNA, 13 nt, Salmonella enterica enterica serovar Typhi
cagcgauuauuuc

SEQ ID NO: 1721921 - RNA, 16 nt, Salmonella enterica enterica serovar Typhi
cagcgauugcgccaga

SEQ ID NO: 1721922 - RNA, 18 nt, Salmonella enterica enterica serovar Typhi
cagcgaugagcgccagca

SEQ ID NO: 1721923 - RNA, 14 nt, Salmonella enterica enterica serovar Typhi
cagcgauauuucuc

SEQ ID NO: 1721924 - RNA, 13 nt, Salmonella enterica enterica serovar Typhi
cagcgauccugcg

SEQ ID NO: 1721925 - RNA, 19 nt, Salmonella enterica enterica serovar Typhi
cagcgaucugucgccgcgu

SEQ ID NO: 1721926 - RNA, 22 nt, Salmonella enterica enterica serovar Typhi
cagcgauccgccgucggcaaua

SEQ ID NO: 1721927 - RNA, 22 nt, Salmonella enterica enterica serovar Typhi
cagcgaggugauaaucagcgcu

SEQ ID NO: 1721928 - RNA, 12 nt, Salmonella enterica enterica serovar Typhi
cagccaguccuc

SEQ ID NO: 1721929 - RNA, 23 nt, Salmonella enterica enterica serovar Typhi
cagccauaaucaguacugcgccc

SEQ ID NO: 1721930 - RNA, 15 nt, Salmonella enterica enterica serovar Typhi
cagccagcauuucca

SEQ ID NO: 1721931 - RNA, 12 nt, Salmonella enterica enterica serovar Typhi
cagccagcagcu

SEQ ID NO: 1721932 - RNA, 12 nt, Salmonella enterica enterica serovar Typhi
cagccagcagcg

SEQ ID NO: 1721933 - RNA, 11 nt, Salmonella enterica enterica serovar Typhi
cagccagcagc

SEQ ID NO: 1721934 - RNA, 16 nt, Salmonella enterica enterica serovar Typhi
cagccagaacucaucu

SEQ ID NO: 1721935 - RNA, 20 nt, Salmonella enterica enterica serovar Typhi
cagccacuucuuccagcggc

SEQ ID NO: 1721936 - RNA, 13 nt, Salmonella enterica enterica serovar Typhi
cagccagaaaaag

SEQ ID NO: 1721937 - RNA, 23 nt, Salmonella enterica enterica serovar Typhi
cagccacugacuuuccugguaau

SEQ ID NO: 1721938 - RNA, 16 nt, Salmonella enterica enterica serovar Typhi
cagccacugcgccauu

SEQ ID NO: 1721939 - RNA, 15 nt, Salmonella enterica enterica serovar Typhi
cagccacuucuucca

SEQ ID NO: 1721940 - RNA, 19 nt, Salmonella enterica enterica serovar Typhi
cagccagacgccagccacu

SEQ ID NO: 1721941 - RNA, 16 nt, Salmonella enterica enterica serovar Typhi
cagccagacggcgccc

SEQ ID NO: 1721942 - RNA, 18 nt, Salmonella enterica enterica serovar Typhi
cagcagcgacgcauugag

SEQ ID NO: 1721943 - RNA, 15 nt, Salmonella enterica enterica serovar Typhi
cagcagcgagauggc

SEQ ID NO: 1721944 - RNA, 12 nt, Salmonella enterica enterica serovar Typhi
cagcagccagaa

SEQ ID NO: 1721945 - RNA, 19 nt, Salmonella enterica enterica serovar Typhi
cagccaaacuccucacugc

SEQ ID NO: 1721946 - RNA, 16 nt, Salmonella enterica enterica serovar Typhi
cagccaacaaagaggc

SEQ ID NO: 1721947 - RNA, 12 nt, Salmonella enterica enterica serovar Typhi
cagccacucccg

SEQ ID NO: 1721948 - RNA, 20 nt, Salmonella enterica enterica serovar Typhi
cagcccgccagcaccaggcu

SEQ ID NO: 1721949 - RNA, 14 nt, Salmonella enterica enterica serovar Typhi
cagcccgccagcac

SEQ ID NO: 1721950 - RNA, 17 nt, Salmonella enterica enterica serovar Typhi
cagccccuucgcugucc

SEQ ID NO: 1721951 - RNA, 17 nt, Salmonella enterica enterica serovar Typhi
cagcccgauacccgccc

SEQ ID NO: 1721952 - RNA, 16 nt, Salmonella enterica enterica serovar Typhi
cagccccuucgcuguc

SEQ ID NO: 1721953 - RNA, 22 nt, Salmonella enterica enterica serovar Typhi
cagcccccaguuuuugaacaua

SEQ ID NO: 1721954 - RNA, 17 nt, Salmonella enterica enterica serovar Typhi
cagccccagcgccagcc

SEQ ID NO: 1721955 - RNA, 14 nt, Salmonella enterica enterica serovar Typhi
cagccccagcgcca

SEQ ID NO: 1721956 - RNA, 16 nt, Salmonella enterica enterica serovar Typhi
cagccccagcgccagc

SEQ ID NO: 1721957 - RNA, 22 nt, Salmonella enterica enterica serovar Typhi
cagccccagcaccaacgccgcu

SEQ ID NO: 1721958 - RNA, 16 nt, Salmonella enterica enterica serovar Typhi
cagccccagcaccaga

SEQ ID NO: 1721959 - RNA, 20 nt, Salmonella enterica enterica serovar Typhi
cagcccauaccacaacagaa

SEQ ID NO: 1721960 - RNA, 15 nt, Salmonella enterica enterica serovar Typhi
cagccauagcccacu

SEQ ID NO: 1721961 - RNA, 16 nt, Salmonella enterica enterica serovar Typhi
cagccauagcgcgccg

SEQ ID NO: 1721962 - RNA, 22 nt, Salmonella enterica enterica serovar Typhi
cagccauagcgcgccgcuccag

SEQ ID NO: 1721963 - RNA, 22 nt, Salmonella enterica enterica serovar Typhi
aaaauguuuuuguuguuaauuu

SEQ ID NO: 1721964 - RNA, 22 nt, Salmonella enterica enterica serovar Typhi
aaaauuaacgacaaaaauacca

SEQ ID NO: 1721965 - RNA, 14 nt, Salmonella enterica enterica serovar Typhi
aaaauuaaucccaa

SEQ ID NO: 1721966 - RNA, 23 nt, Salmonella enterica enterica serovar Typhi
cagcggauugccauacacgcggc

SEQ ID NO: 1721967 - RNA, 23 nt, Salmonella enterica enterica serovar Typhi
cagcggcaaaggcauggcaggua

SEQ ID NO: 1721968 - RNA, 21 nt, Salmonella enterica enterica serovar Typhi
cagcggcaggauccccauccc

SEQ ID NO: 1721969 - RNA, 19 nt, Salmonella enterica enterica serovar Typhi
cagcggcgccaucaccauc

SEQ ID NO: 1721970 - RNA, 13 nt, Salmonella enterica enterica serovar Typhi
aaaauuaccaggc

SEQ ID NO: 1721971 - RNA, 22 nt, Salmonella enterica enterica serovar Typhi
cagcggcccgcgcugaauagcg

SEQ ID NO: 1721972 - RNA, 15 nt, Salmonella enterica enterica serovar Typhi
cagcggcggaaugcu

SEQ ID NO: 1721973 - RNA, 15 nt, Salmonella enterica enterica serovar Typhi
cagcggcgcgccgcu

SEQ ID NO: 1721974 - RNA, 23 nt, Salmonella enterica enterica serovar Typhi
cagcggcguuggcgauuuccagc

SEQ ID NO: 1721975 - RNA, 21 nt, Salmonella enterica enterica serovar Typhi
cagcggcguaucuuccagcgu

SEQ ID NO: 1721976 - RNA, 22 nt, Salmonella enterica enterica serovar Typhi
cagcggcggcuugccuucaucc

SEQ ID NO: 1721977 - RNA, 19 nt, Salmonella enterica enterica serovar Typhi
cagcggcgguuauccgcca

SEQ ID NO: 1721978 - RNA, 13 nt, Salmonella enterica enterica serovar Typhi
cagcggcggcagu

SEQ ID NO: 1721979 - RNA, 20 nt, Salmonella enterica enterica serovar Typhi
cagcgcuaucaggcacugaa

SEQ ID NO: 1721980 - RNA, 15 nt, Salmonella enterica enterica serovar Typhi
cagcgcuauccggcc

SEQ ID NO: 1721981 - RNA, 20 nt, Salmonella enterica enterica serovar Typhi
cagcgcuugccgcagcgcag

SEQ ID NO: 1721982 - RNA, 20 nt, Salmonella enterica enterica serovar Typhi
cagcgcuaccagcgcggcgc

SEQ ID NO: 1721983 - RNA, 22 nt, Salmonella enterica enterica serovar Typhi
cagcgcuaccagcgcggcgcca

SEQ ID NO: 1721984 - RNA, 24 nt, Salmonella enterica enterica serovar Typhi
cagcgcggccugcgugcgccguga

SEQ ID NO: 1721985 - RNA, 13 nt, Salmonella enterica enterica serovar Typhi
cagcggaugcucu

SEQ ID NO: 1721986 - RNA, 15 nt, Salmonella enterica enterica serovar Typhi
cagcggaauucccac

SEQ ID NO: 1721987 - RNA, 20 nt, Salmonella enterica enterica serovar Typhi
cagcggaaaauauucagcac

SEQ ID NO: 1721988 - RNA, 20 nt, Salmonella enterica enterica serovar Typhi
cagcggaaagugaaggccag

SEQ ID NO: 1721989 - RNA, 15 nt, Salmonella enterica enterica serovar Typhi
cagcgcuuugccgcu

SEQ ID NO: 1721990 - RNA, 23 nt, Salmonella enterica enterica serovar Typhi
cagcgcuuugccgcugcugccuu

SEQ ID NO: 1721991 - RNA, 16 nt, Salmonella enterica enterica serovar Typhi
cagcgcuuuugccgcg

SEQ ID NO: 1721992 - RNA, 20 nt, Salmonella enterica enterica serovar Typhi
cagcgcuuuugccgcgccca

SEQ ID NO: 1721993 - RNA, 18 nt, Salmonella enterica enterica serovar Typhi
cagcgcuugugccugcug

SEQ ID NO: 1721994 - RNA, 20 nt, Salmonella enterica enterica serovar Typhi
cagcgcuuucaccgcgucgu

SEQ ID NO: 1721995 - RNA, 17 nt, Salmonella enterica enterica serovar Typhi
cagcgcgcuccagacca

SEQ ID NO: 1721996 - RNA, 14 nt, Salmonella enterica enterica serovar Typhi
cagcgcggcaagga

SEQ ID NO: 1721997 - RNA, 15 nt, Salmonella enterica enterica serovar Typhi
cagcgcgcuccagac

SEQ ID NO: 1721998 - RNA, 16 nt, Salmonella enterica enterica serovar Typhi
cagcgccaacgccacu

SEQ ID NO: 1721999 - RNA, 13 nt, Salmonella enterica enterica serovar Typhi
cagcgccugcgcu

SEQ ID NO: 1722000 - RNA, 16 nt, Salmonella enterica enterica serovar Typhi
cagcgcauaccggcca

SEQ ID NO: 1722001 - RNA, 14 nt, Salmonella enterica enterica serovar Typhi
cagcgcauggaaga

SEQ ID NO: 1722002 - RNA, 15 nt, Salmonella enterica enterica serovar Typhi
aaaauucagacucaa

SEQ ID NO: 1722003 - RNA, 20 nt, Salmonella enterica enterica serovar Typhi
aaaauuauuggcuuuguaaa

SEQ ID NO: 1722004 - RNA, 22 nt, Salmonella enterica enterica serovar Typhi
aaaauuauuuuuacuuaaaauu

SEQ ID NO: 1722005 - RNA, 17 nt, Salmonella enterica enterica serovar Typhi
cagcgggccgcugaugu

SEQ ID NO: 1722006 - RNA, 18 nt, Salmonella enterica enterica serovar Typhi
aaaauuacuucguagacu

SEQ ID NO: 1722007 - RNA, 23 nt, Salmonella enterica enterica serovar Typhi
aaaauuacuucguagacucaggc

SEQ ID NO: 1722008 - RNA, 16 nt, Salmonella enterica enterica serovar Typhi
cagcgucaccucuuuc

SEQ ID NO: 1722009 - RNA, 16 nt, Salmonella enterica enterica serovar Typhi
cagcguauugagcugg

SEQ ID NO: 1722010 - RNA, 18 nt, Salmonella enterica enterica serovar Typhi
cagcguaaaacuuuucug

SEQ ID NO: 1722011 - RNA, 19 nt, Salmonella enterica enterica serovar Typhi
cagcguaagucugauaaac

SEQ ID NO: 1722012 - RNA, 22 nt, Salmonella enterica enterica serovar Typhi
cagcguaaugcgccaggcagca

SEQ ID NO: 1722013 - RNA, 18 nt, Salmonella enterica enterica serovar Typhi
cagcguacaauggcaggc

SEQ ID NO: 1722014 - RNA, 21 nt, Salmonella enterica enterica serovar Typhi
cagcguaccugcggcaauggc

SEQ ID NO: 1722015 - RNA, 22 nt, Salmonella enterica enterica serovar Typhi
cagcgguccaauaaacgccagg

SEQ ID NO: 1722016 - RNA, 22 nt, Salmonella enterica enterica serovar Typhi
cagcgguuacuuuugaacauaa

SEQ ID NO: 1722017 - RNA, 15 nt, Salmonella enterica enterica serovar Typhi
cagcgguuugccggu

SEQ ID NO: 1722018 - RNA, 18 nt, Salmonella enterica enterica serovar Typhi
aaaauucccggcggaaau

SEQ ID NO: 1722019 - RNA, 16 nt, Salmonella enterica enterica serovar Typhi
cagcguggaugaacuc

SEQ ID NO: 1722020 - RNA, 20 nt, Salmonella enterica enterica serovar Typhi
cagcguguucaugcgcggcg

SEQ ID NO: 1722021 - RNA, 21 nt, Salmonella enterica enterica serovar Typhi
cagcguuacugcaacugcgcg

SEQ ID NO: 1722022 - RNA, 21 nt, Salmonella enterica enterica serovar Typhi
cagcgugaaacgcccuuccca

SEQ ID NO: 1722023 - RNA, 14 nt, Salmonella enterica enterica serovar Typhi
cagcgucuuccugu

SEQ ID NO: 1722024 - RNA, 18 nt, Salmonella enterica enterica serovar Typhi
cagcgucugcccuccuga

SEQ ID NO: 1722025 - RNA, 22 nt, Salmonella enterica enterica serovar Typhi
cagcgugaaacgcccuucccag

SEQ ID NO: 1722026 - RNA, 22 nt, Salmonella enterica enterica serovar Typhi
cagcgucugccccaaacgcuca

SEQ ID NO: 1722027 - RNA, 14 nt, Salmonella enterica enterica serovar Typhi
cagcgucuguuuca

SEQ ID NO: 1722028 - RNA, 17 nt, Salmonella enterica enterica serovar Typhi
cagcgucuauagaugau

SEQ ID NO: 1722029 - RNA, 18 nt, Salmonella enterica enterica serovar Typhi
cagcgucuauagaugaua

SEQ ID NO: 1722030 - RNA, 15 nt, Salmonella enterica enterica serovar Typhi
cagcgucggugaaga

SEQ ID NO: 1722031 - RNA, 20 nt, Salmonella enterica enterica serovar Typhi
cagcgucaggaacgcggcgc

SEQ ID NO: 1722032 - RNA, 14 nt, Salmonella enterica enterica serovar Typhi
cagcguccggagca

SEQ ID NO: 1722033 - RNA, 15 nt, Salmonella enterica enterica serovar Typhi
cacugcccgccgcca

SEQ ID NO: 1722034 - RNA, 18 nt, Salmonella enterica enterica serovar Typhi
cacugcccucaaguuaug

SEQ ID NO: 1722035 - RNA, 23 nt, Salmonella enterica enterica serovar Typhi
cacugcgaacgcaucaaagccac

SEQ ID NO: 1722036 - RNA, 16 nt, Salmonella enterica enterica serovar Typhi
cacugcuguguccagg

SEQ ID NO: 1722037 - RNA, 23 nt, Salmonella enterica enterica serovar Typhi
cacugcugcugaaagaagacgaa

SEQ ID NO: 1722038 - RNA, 22 nt, Salmonella enterica enterica serovar Typhi
cacugcuguagcgucucaucaa

SEQ ID NO: 1722039 - RNA, 16 nt, Salmonella enterica enterica serovar Typhi
cacuggaaacagccaa

SEQ ID NO: 1722040 - RNA, 21 nt, Salmonella enterica enterica serovar Typhi
cacugcggagguuucuuuuuc

SEQ ID NO: 1722041 - RNA, 19 nt, Salmonella enterica enterica serovar Typhi
cacugcgcuuauccggccu

SEQ ID NO: 1722042 - RNA, 21 nt, Salmonella enterica enterica serovar Typhi
cacugauggaguuucaucagc

SEQ ID NO: 1722043 - RNA, 18 nt, Salmonella enterica enterica serovar Typhi
cacugcaauuucugcugg

SEQ ID NO: 1722044 - RNA, 19 nt, Salmonella enterica enterica serovar Typhi
cacugcaauuucugcugga

SEQ ID NO: 1722045 - RNA, 18 nt, Salmonella enterica enterica serovar Typhi
cacugagcugugauaaaa

SEQ ID NO: 1722046 - RNA, 17 nt, Salmonella enterica enterica serovar Typhi
cacugagcuucaccgcc

SEQ ID NO: 1722047 - RNA, 23 nt, Salmonella enterica enterica serovar Typhi
cacugacauuuaaggcgcggccu

SEQ ID NO: 1722048 - RNA, 14 nt, Salmonella enterica enterica serovar Typhi
cacugaaccugccu

SEQ ID NO: 1722049 - RNA, 22 nt, Salmonella enterica enterica serovar Typhi
cacugaaaaauaauuacuaucu

SEQ ID NO: 1722050 - RNA, 14 nt, Salmonella enterica enterica serovar Typhi
cacugaagaggaga

SEQ ID NO: 1722051 - RNA, 20 nt, Salmonella enterica enterica serovar Typhi
cacucuucgggaauggggaa

SEQ ID NO: 1722052 - RNA, 22 nt, Salmonella enterica enterica serovar Typhi
cacucuuuggacggcaucagga

SEQ ID NO: 1722053 - RNA, 16 nt, Salmonella enterica enterica serovar Typhi
cacucucuuguauuac

SEQ ID NO: 1722054 - RNA, 16 nt, Salmonella enterica enterica serovar Typhi
cacucuauucaugcau

SEQ ID NO: 1722055 - RNA, 21 nt, Salmonella enterica enterica serovar Typhi
cacucgcuuccuuuauugguu

SEQ ID NO: 1722056 - RNA, 22 nt, Salmonella enterica enterica serovar Typhi
cacucguaacgcauauccagca

SEQ ID NO: 1722057 - RNA, 16 nt, Salmonella enterica enterica serovar Typhi
cacuccggcugcacca

SEQ ID NO: 1722058 - RNA, 15 nt, Salmonella enterica enterica serovar Typhi
cacuccuaagagaaa

SEQ ID NO: 1722059 - RNA, 14 nt, Salmonella enterica enterica serovar Typhi
cacuccaucgccug

SEQ ID NO: 1722060 - RNA, 18 nt, Salmonella enterica enterica serovar Typhi
cacuaacuaauuguuugu

SEQ ID NO: 1722061 - RNA, 19 nt, Salmonella enterica enterica serovar Typhi
cacuaauccccauuuuuuu

SEQ ID NO: 1722062 - RNA, 22 nt, Salmonella enterica enterica serovar Typhi
cacuaccugauuggcuccccgc

SEQ ID NO: 1722063 - RNA, 22 nt, Salmonella enterica enterica serovar Typhi
cacuaccauuuccggcgcgccu

SEQ ID NO: 1722064 - RNA, 14 nt, Salmonella enterica enterica serovar Typhi
cacuaaaaacaggc

SEQ ID NO: 1722065 - RNA, 13 nt, Salmonella enterica enterica serovar Typhi
cacuaaaacaccg

SEQ ID NO: 1722066 - RNA, 22 nt, Salmonella enterica enterica serovar Typhi
cacguugccguaggcgacgcca

SEQ ID NO: 1722067 - RNA, 23 nt, Salmonella enterica enterica serovar Typhi
cacguuccauuucagcgagugcg

SEQ ID NO: 1722068 - RNA, 22 nt, Salmonella enterica enterica serovar Typhi
cacguuaccgcgcaguucaaua

SEQ ID NO: 1722069 - RNA, 18 nt, Salmonella enterica enterica serovar Typhi
cacguuacccgccagucg

SEQ ID NO: 1722070 - RNA, 16 nt, Salmonella enterica enterica serovar Typhi
cacguuaaacaccuca

SEQ ID NO: 1722071 - RNA, 18 nt, Salmonella enterica enterica serovar Typhi
cacuacuacaccacccgu

SEQ ID NO: 1722072 - RNA, 19 nt, Salmonella enterica enterica serovar Typhi
cacucaaucauugucauua

SEQ ID NO: 1722073 - RNA, 16 nt, Salmonella enterica enterica serovar Typhi
cacucacaaaacuauu

SEQ ID NO: 1722074 - RNA, 22 nt, Salmonella enterica enterica serovar Typhi
cacucagaaaauuauuuuaaau

SEQ ID NO: 1722075 - RNA, 12 nt, Salmonella enterica enterica serovar Typhi
cacuccagaccu

SEQ ID NO: 1722076 - RNA, 14 nt, Salmonella enterica enterica serovar Typhi
cacuccaauauacu

SEQ ID NO: 1722077 - RNA, 16 nt, Salmonella enterica enterica serovar Typhi
cacuccaauauacuga

SEQ ID NO: 1722078 - RNA, 15 nt, Salmonella enterica enterica serovar Typhi
cacucauccagacca

SEQ ID NO: 1722079 - RNA, 12 nt, Salmonella enterica enterica serovar Typhi
cacucauccagc

SEQ ID NO: 1722080 - RNA, 14 nt, Salmonella enterica enterica serovar Typhi
cacucauccagcaa

SEQ ID NO: 1722081 - RNA, 16 nt, Salmonella enterica enterica serovar Typhi
cacucauccagcaaaa

SEQ ID NO: 1722082 - RNA, 14 nt, Salmonella enterica enterica serovar Typhi
cacuguugcaucuu

SEQ ID NO: 1722083 - RNA, 21 nt, Salmonella enterica enterica serovar Typhi
cacuguuuuuagccuguuauu

SEQ ID NO: 1722084 - RNA, 22 nt, Salmonella enterica enterica serovar Typhi
cacuguuugcugacaaucugcu

SEQ ID NO: 1722085 - RNA, 22 nt, Salmonella enterica enterica serovar Typhi
cacuuacuuucuugccacuggc

SEQ ID NO: 1722086 - RNA, 17 nt, Salmonella enterica enterica serovar Typhi
cacuuagcacaaagaau

SEQ ID NO: 1722087 - RNA, 20 nt, Salmonella enterica enterica serovar Typhi
cacuggccucccaguucccc

SEQ ID NO: 1722088 - RNA, 23 nt, Salmonella enterica enterica serovar Typhi
cacuggcgagcggcaccggacau

SEQ ID NO: 1722089 - RNA, 21 nt, Salmonella enterica enterica serovar Typhi
cacuggagcgcauuuuacugc

SEQ ID NO: 1722090 - RNA, 21 nt, Salmonella enterica enterica serovar Typhi
cacuggaugacgcuguucaaa

SEQ ID NO: 1722091 - RNA, 20 nt, Salmonella enterica enterica serovar Typhi
cacugucaugguuauuuugu

SEQ ID NO: 1722092 - RNA, 22 nt, Salmonella enterica enterica serovar Typhi
cacugucaaaaauaacaggcac

SEQ ID NO: 1722093 - RNA, 13 nt, Salmonella enterica enterica serovar Typhi
cacuguaaaaggg

SEQ ID NO: 1722094 - RNA, 14 nt, Salmonella enterica enterica serovar Typhi
cacuguaaaaggga

SEQ ID NO: 1722095 - RNA, 14 nt, Salmonella enterica enterica serovar Typhi
cacuugagaaauua

SEQ ID NO: 1722096 - RNA, 22 nt, Salmonella enterica enterica serovar Typhi
cacuucuuucacugucaugguu

SEQ ID NO: 1722097 - RNA, 23 nt, Salmonella enterica enterica serovar Typhi
cacuucuucgcgaucgugauaaa

SEQ ID NO: 1722098 - RNA, 22 nt, Salmonella enterica enterica serovar Typhi
cacuucugaguucggcaugggg

SEQ ID NO: 1722099 - RNA, 23 nt, Salmonella enterica enterica serovar Typhi
cacuucugaguucggcauggggu

SEQ ID NO: 1722100 - RNA, 13 nt, Salmonella enterica enterica serovar Typhi
cacuucugcggua

SEQ ID NO: 1722101 - RNA, 14 nt, Salmonella enterica enterica serovar Typhi
cacuucaucaucau

SEQ ID NO: 1722102 - RNA, 14 nt, Salmonella enterica enterica serovar Typhi
cacuucgauaaacg

SEQ ID NO: 1722103 - RNA, 15 nt, Salmonella enterica enterica serovar Typhi
cacuucgaaacgauc

SEQ ID NO: 1722104 - RNA, 21 nt, Salmonella enterica enterica serovar Typhi
cacuucgcugauaccgcccuc

SEQ ID NO: 1722105 - RNA, 17 nt, Salmonella enterica enterica serovar Typhi
cacuucgcgcauugcga

SEQ ID NO: 1722106 - RNA, 13 nt, Salmonella enterica enterica serovar Typhi
cacuuccccugcc

SEQ ID NO: 1722107 - RNA, 16 nt, Salmonella enterica enterica serovar Typhi
cacuuccagccacggc

SEQ ID NO: 1722108 - RNA, 21 nt, Salmonella enterica enterica serovar Typhi
cacuucaugccgaacagguua

SEQ ID NO: 1722109 - RNA, 15 nt, Salmonella enterica enterica serovar Typhi
cacuuccgccaccac

SEQ ID NO: 1722110 - RNA, 15 nt, Salmonella enterica enterica serovar Typhi
cacuuccgccucgcc

SEQ ID NO: 1722111 - RNA, 19 nt, Salmonella enterica enterica serovar Typhi
cacuuuacugaauaacagc

SEQ ID NO: 1722112 - RNA, 20 nt, Salmonella enterica enterica serovar Typhi
cacuuuacugaauaacagca

SEQ ID NO: 1722113 - RNA, 11 nt, Salmonella enterica enterica serovar Typhi
cacuuguucuu

SEQ ID NO: 1722114 - RNA, 22 nt, Salmonella enterica enterica serovar Typhi
cacuuuaccaggcauaauggaa

SEQ ID NO: 1722115 - RNA, 13 nt, Salmonella enterica enterica serovar Typhi
aaaauauccugua

SEQ ID NO: 1722116 - RNA, 19 nt, Salmonella enterica enterica serovar Typhi
aaaauauccgccaucgaca

SEQ ID NO: 1722117 - RNA, 13 nt, Salmonella enterica enterica serovar Typhi
cagaaaggaugcc

SEQ ID NO: 1722118 - RNA, 16 nt, Salmonella enterica enterica serovar Typhi
cagaaaagaaccgacu

SEQ ID NO: 1722119 - RNA, 19 nt, Salmonella enterica enterica serovar Typhi
cagaaaauccuucagcguu

SEQ ID NO: 1722120 - RNA, 15 nt, Salmonella enterica enterica serovar Typhi
cacuuugccuggguu

SEQ ID NO: 1722121 - RNA, 14 nt, Salmonella enterica enterica serovar Typhi
cagaaaaagccccc

SEQ ID NO: 1722122 - RNA, 21 nt, Salmonella enterica enterica serovar Typhi
cacuuuucuuuccugcaaauu

SEQ ID NO: 1722123 - RNA, 13 nt, Salmonella enterica enterica serovar Typhi
cagaacgagagga

SEQ ID NO: 1722124 - RNA, 15 nt, Salmonella enterica enterica serovar Typhi
cagaacgagaggagg

SEQ ID NO: 1722125 - RNA, 20 nt, Salmonella enterica enterica serovar Typhi
cagaaccuguucaugccaga

SEQ ID NO: 1722126 - RNA, 16 nt, Salmonella enterica enterica serovar Typhi
cagaacguagcccauu

SEQ ID NO: 1722127 - RNA, 15 nt, Salmonella enterica enterica serovar Typhi
cagaacgggaaagcg

SEQ ID NO: 1722128 - RNA, 14 nt, Salmonella enterica enterica serovar Typhi
cagaacucaucuuc

SEQ ID NO: 1722129 - RNA, 13 nt, Salmonella enterica enterica serovar Typhi
cagaacaucaagc

SEQ ID NO: 1722130 - RNA, 13 nt, Salmonella enterica enterica serovar Typhi
cagaaccauuucc

SEQ ID NO: 1722131 - RNA, 15 nt, Salmonella enterica enterica serovar Typhi
cagaaccacuugaac

SEQ ID NO: 1722132 - RNA, 14 nt, Salmonella enterica enterica serovar Typhi
cagaagcuaaggga

SEQ ID NO: 1722133 - RNA, 15 nt, Salmonella enterica enterica serovar Typhi
cagaagaaucugccu

SEQ ID NO: 1722134 - RNA, 16 nt, Salmonella enterica enterica serovar Typhi
cagaagaaucugccuu

SEQ ID NO: 1722135 - RNA, 11 nt, Salmonella enterica enterica serovar Typhi
cagaagcuucg

SEQ ID NO: 1722136 - RNA, 12 nt, Salmonella enterica enterica serovar Typhi
cagaaggcaaaa

SEQ ID NO: 1722137 - RNA, 19 nt, Salmonella enterica enterica serovar Typhi
cagaaggcgaacauaagag

SEQ ID NO: 1722138 - RNA, 17 nt, Salmonella enterica enterica serovar Typhi
cagaaggcuaacagcug

SEQ ID NO: 1722139 - RNA, 21 nt, Salmonella enterica enterica serovar Typhi
cagaaggcuaacagcuggcuu

SEQ ID NO: 1722140 - RNA, 14 nt, Salmonella enterica enterica serovar Typhi
cagaaggcgaacau

SEQ ID NO: 1722141 - RNA, 19 nt, Salmonella enterica enterica serovar Typhi
cagaaggccagugguaaaa

SEQ ID NO: 1722142 - RNA, 20 nt, Salmonella enterica enterica serovar Typhi
cagaagugccaguaacucau

SEQ ID NO: 1722143 - RNA, 22 nt, Salmonella enterica enterica serovar Typhi
cagaccgaucucaugcaacugg

SEQ ID NO: 1722144 - RNA, 17 nt, Salmonella enterica enterica serovar Typhi
cagaccggcaucucauc

SEQ ID NO: 1722145 - RNA, 18 nt, Salmonella enterica enterica serovar Typhi
cagaccggagcgugcuuc

SEQ ID NO: 1722146 - RNA, 16 nt, Salmonella enterica enterica serovar Typhi
cagaccggcaaaaauu

SEQ ID NO: 1722147 - RNA, 14 nt, Salmonella enterica enterica serovar Typhi
cagaccggcagccu

SEQ ID NO: 1722148 - RNA, 17 nt, Salmonella enterica enterica serovar Typhi
cagaccgcugcggaaca

SEQ ID NO: 1722149 - RNA, 20 nt, Salmonella enterica enterica serovar Typhi
cagaccgcuuaacuccggcg

SEQ ID NO: 1722150 - RNA, 21 nt, Salmonella enterica enterica serovar Typhi
cagaccucguucggcgcaccu

SEQ ID NO: 1722151 - RNA, 13 nt, Salmonella enterica enterica serovar Typhi
cagaccucugcaa

SEQ ID NO: 1722152 - RNA, 17 nt, Salmonella enterica enterica serovar Typhi
cagaccgucaugacguc

SEQ ID NO: 1722153 - RNA, 20 nt, Salmonella enterica enterica serovar Typhi
cagaccgaucucaugcaacu

SEQ ID NO: 1722154 - RNA, 15 nt, Salmonella enterica enterica serovar Typhi
cagacccgcaaacca

SEQ ID NO: 1722155 - RNA, 19 nt, Salmonella enterica enterica serovar Typhi
cagacccgcauacaggaag

SEQ ID NO: 1722156 - RNA, 21 nt, Salmonella enterica enterica serovar Typhi
cagacccgcauacaggaagcc

SEQ ID NO: 1722157 - RNA, 17 nt, Salmonella enterica enterica serovar Typhi
cagaccaaagucaaacu

SEQ ID NO: 1722158 - RNA, 13 nt, Salmonella enterica enterica serovar Typhi
cagaccaauagag

SEQ ID NO: 1722159 - RNA, 21 nt, Salmonella enterica enterica serovar Typhi
cagacggcuccagcgccagcu

SEQ ID NO: 1722160 - RNA, 18 nt, Salmonella enterica enterica serovar Typhi
cagaccuuuauaagguua

SEQ ID NO: 1722161 - RNA, 16 nt, Salmonella enterica enterica serovar Typhi
cagaccuguaaaaaaa

SEQ ID NO: 1722162 - RNA, 15 nt, Salmonella enterica enterica serovar Typhi
cagacucgcuucacg

SEQ ID NO: 1722163 - RNA, 19 nt, Salmonella enterica enterica serovar Typhi
cagacucgcuucacgcgga

SEQ ID NO: 1722164 - RNA, 14 nt, Salmonella enterica enterica serovar Typhi
cagaaucgccagca

SEQ ID NO: 1722165 - RNA, 19 nt, Salmonella enterica enterica serovar Typhi
cagaaucaucaugucguca

SEQ ID NO: 1722166 - RNA, 13 nt, Salmonella enterica enterica serovar Typhi
cagaaucaggcca

SEQ ID NO: 1722167 - RNA, 21 nt, Salmonella enterica enterica serovar Typhi
cagaaucaccucuuucuccac

SEQ ID NO: 1722168 - RNA, 17 nt, Salmonella enterica enterica serovar Typhi
cagaauauuuuucucag

SEQ ID NO: 1722169 - RNA, 13 nt, Salmonella enterica enterica serovar Typhi
cagaauaauguug

SEQ ID NO: 1722170 - RNA, 13 nt, Salmonella enterica enterica serovar Typhi
cagaauaccagaa

SEQ ID NO: 1722171 - RNA, 17 nt, Salmonella enterica enterica serovar Typhi
cagaauacgaauauuca

SEQ ID NO: 1722172 - RNA, 18 nt, Salmonella enterica enterica serovar Typhi
cagaauacgaccucaaau

SEQ ID NO: 1722173 - RNA, 16 nt, Salmonella enterica enterica serovar Typhi
cagacaacgccgccug

SEQ ID NO: 1722174 - RNA, 23 nt, Salmonella enterica enterica serovar Typhi
cagacaucggagauuucauccuc

SEQ ID NO: 1722175 - RNA, 14 nt, Salmonella enterica enterica serovar Typhi
cagacaugcacaug

SEQ ID NO: 1722176 - RNA, 15 nt, Salmonella enterica enterica serovar Typhi
cagacaugcacaugg

SEQ ID NO: 1722177 - RNA, 15 nt, Salmonella enterica enterica serovar Typhi
cagacaugcgccgga

SEQ ID NO: 1722178 - RNA, 23 nt, Salmonella enterica enterica serovar Typhi
cagaaugauaaugccgcugauaa

SEQ ID NO: 1722179 - RNA, 24 nt, Salmonella enterica enterica serovar Typhi
cagaaugauaaugccgcugauaau

SEQ ID NO: 1722180 - RNA, 15 nt, Salmonella enterica enterica serovar Typhi
cagaaugccagcgcc

SEQ ID NO: 1722181 - RNA, 16 nt, Salmonella enterica enterica serovar Typhi
cagaaugcccugcugu

SEQ ID NO: 1722182 - RNA, 20 nt, Salmonella enterica enterica serovar Typhi
cagaaugcccugcuguucca

SEQ ID NO: 1722183 - RNA, 16 nt, Salmonella enterica enterica serovar Typhi
cagaaugccagcgccg

SEQ ID NO: 1722184 - RNA, 12 nt, Salmonella enterica enterica serovar Typhi
cagagcaacgag

SEQ ID NO: 1722185 - RNA, 22 nt, Salmonella enterica enterica serovar Typhi
cagagauucgccguucuguucu

SEQ ID NO: 1722186 - RNA, 19 nt, Salmonella enterica enterica serovar Typhi
cagagauccacauugguuu

SEQ ID NO: 1722187 - RNA, 21 nt, Salmonella enterica enterica serovar Typhi
aaaaucacuaagaccagcauc

SEQ ID NO: 1722188 - RNA, 23 nt, Salmonella enterica enterica serovar Typhi
aaaaucacgcuggauaagacgac

SEQ ID NO: 1722189 - RNA, 13 nt, Salmonella enterica enterica serovar Typhi
aaaaucaccacac

SEQ ID NO: 1722190 - RNA, 13 nt, Salmonella enterica enterica serovar Typhi
aaaaucagcaauc

SEQ ID NO: 1722191 - RNA, 16 nt, Salmonella enterica enterica serovar Typhi
cagaggccugaaugca

SEQ ID NO: 1722192 - RNA, 16 nt, Salmonella enterica enterica serovar Typhi
cagagcggggaaacuc

SEQ ID NO: 1722193 - RNA, 17 nt, Salmonella enterica enterica serovar Typhi
cagaggugaaccauuga

SEQ ID NO: 1722194 - RNA, 22 nt, Salmonella enterica enterica serovar Typhi
cagaguaacccgauacccugag

SEQ ID NO: 1722195 - RNA, 20 nt, Salmonella enterica enterica serovar Typhi
cagauaggcggcaaauaaag

SEQ ID NO: 1722196 - RNA, 24 nt, Salmonella enterica enterica serovar Typhi
cagauaggcggcaaauaaagccag

SEQ ID NO: 1722197 - RNA, 17 nt, Salmonella enterica enterica serovar Typhi
aaaauccccaccugacu

SEQ ID NO: 1722198 - RNA, 20 nt, Salmonella enterica enterica serovar Typhi
cagauagcaaaaaagcgccu

SEQ ID NO: 1722199 - RNA, 17 nt, Salmonella enterica enterica serovar Typhi
cagauacggcuccagca

SEQ ID NO: 1722200 - RNA, 16 nt, Salmonella enterica enterica serovar Typhi
cagauacggcgcgucg

SEQ ID NO: 1722201 - RNA, 23 nt, Salmonella enterica enterica serovar Typhi
cagauaaccgucggcgccggcgu

SEQ ID NO: 1722202 - RNA, 15 nt, Salmonella enterica enterica serovar Typhi
cagauaacaccagcg

SEQ ID NO: 1722203 - RNA, 18 nt, Salmonella enterica enterica serovar Typhi
cagauaacaggcaguuuc

SEQ ID NO: 1722204 - RNA, 19 nt, Salmonella enterica enterica serovar Typhi
cagauaccagcguugaauc

SEQ ID NO: 1722205 - RNA, 15 nt, Salmonella enterica enterica serovar Typhi
cagauacgcgccggc

SEQ ID NO: 1722206 - RNA, 19 nt, Salmonella enterica enterica serovar Typhi
cagauaaugccgcuggcgu

SEQ ID NO: 1722207 - RNA, 17 nt, Salmonella enterica enterica serovar Typhi
cagauaauuaauaaugg

SEQ ID NO: 1722208 - RNA, 19 nt, Salmonella enterica enterica serovar Typhi
aaaauccugcacuuccagc

SEQ ID NO: 1722209 - RNA, 19 nt, Salmonella enterica enterica serovar Typhi
aaaauccuuguugauaaaa

SEQ ID NO: 1722210 - RNA, 18 nt, Salmonella enterica enterica serovar Typhi
aaaauccuucuuccauuc

SEQ ID NO: 1722211 - RNA, 23 nt, Salmonella enterica enterica serovar Typhi
cagauauuuucggcauacucuuu

SEQ ID NO: 1722212 - RNA, 15 nt, Salmonella enterica enterica serovar Typhi
cagauaugcgggcuc

SEQ ID NO: 1722213 - RNA, 17 nt, Salmonella enterica enterica serovar Typhi
cagauagggccaggcgc

SEQ ID NO: 1722214 - RNA, 14 nt, Salmonella enterica enterica serovar Typhi
cagcaccgccggga

SEQ ID NO: 1722215 - RNA, 17 nt, Salmonella enterica enterica serovar Typhi
cagcacgcuuacccagc

SEQ ID NO: 1722216 - RNA, 16 nt, Salmonella enterica enterica serovar Typhi
cagcaccaacgccgcu

SEQ ID NO: 1722217 - RNA, 13 nt, Salmonella enterica enterica serovar Typhi
cagcaccacgccc

SEQ ID NO: 1722218 - RNA, 15 nt, Salmonella enterica enterica serovar Typhi
cagcaauauaugagc

SEQ ID NO: 1722219 - RNA, 20 nt, Salmonella enterica enterica serovar Typhi
cagcaaucacuuccgccucg

SEQ ID NO: 1722220 - RNA, 13 nt, Salmonella enterica enterica serovar Typhi
cagcaauacccag

SEQ ID NO: 1722221 - RNA, 13 nt, Salmonella enterica enterica serovar Typhi
cagcaccagcauu

SEQ ID NO: 1722222 - RNA, 15 nt, Salmonella enterica enterica serovar Typhi
cagcaccaucaugca

SEQ ID NO: 1722223 - RNA, 17 nt, Salmonella enterica enterica serovar Typhi
cagcaccaucuuuuccg

SEQ ID NO: 1722224 - RNA, 17 nt, Salmonella enterica enterica serovar Typhi
cagcaccaucaugcaag

SEQ ID NO: 1722225 - RNA, 14 nt, Salmonella enterica enterica serovar Typhi
cagcacgggccugu

SEQ ID NO: 1722226 - RNA, 18 nt, Salmonella enterica enterica serovar Typhi
cagcacguuaccggcggu

SEQ ID NO: 1722227 - RNA, 18 nt, Salmonella enterica enterica serovar Typhi
cagcagauguggcggccc

SEQ ID NO: 1722228 - RNA, 14 nt, Salmonella enterica enterica serovar Typhi
cagcagauguggcg

SEQ ID NO: 1722229 - RNA, 22 nt, Salmonella enterica enterica serovar Typhi
aaaaugucuuuucgguauuuau

SEQ ID NO: 1722230 - RNA, 15 nt, Salmonella enterica enterica serovar Typhi
cagcagcaccggcug

SEQ ID NO: 1722231 - RNA, 13 nt, Salmonella enterica enterica serovar Typhi
cagcagcagcucg

SEQ ID NO: 1722232 - RNA, 23 nt, Salmonella enterica enterica serovar Typhi
cagcagcaggcuggagagcaacg

SEQ ID NO: 1722233 - RNA, 14 nt, Salmonella enterica enterica serovar Typhi
cagauugagacaaa

SEQ ID NO: 1722234 - RNA, 18 nt, Salmonella enterica enterica serovar Typhi
cagauucuuaguccucag

SEQ ID NO: 1722235 - RNA, 17 nt, Salmonella enterica enterica serovar Typhi
cagauuccgaacucaug

SEQ ID NO: 1722236 - RNA, 12 nt, Salmonella enterica enterica serovar Typhi
cagcaaaauggc

SEQ ID NO: 1722237 - RNA, 22 nt, Salmonella enterica enterica serovar Typhi
cagcaaaaucacgcacacgucu

SEQ ID NO: 1722238 - RNA, 15 nt, Salmonella enterica enterica serovar Typhi
cagcaaaauggcaau

SEQ ID NO: 1722239 - RNA, 19 nt, Salmonella enterica enterica serovar Typhi
cagcaaaacgcgcuaucaa

SEQ ID NO: 1722240 - RNA, 21 nt, Salmonella enterica enterica serovar Typhi
aaaaucugguggccggaggag

SEQ ID NO: 1722241 - RNA, 15 nt, Salmonella enterica enterica serovar Typhi
cagauccuuuuucug

SEQ ID NO: 1722242 - RNA, 14 nt, Salmonella enterica enterica serovar Typhi
cagauccuuuuucu

SEQ ID NO: 1722243 - RNA, 16 nt, Salmonella enterica enterica serovar Typhi
cagauccaucgccugc

SEQ ID NO: 1722244 - RNA, 18 nt, Salmonella enterica enterica serovar Typhi
cagaucagcacgcgccgu

SEQ ID NO: 1722245 - RNA, 16 nt, Salmonella enterica enterica serovar Typhi
cagaucaggucugaga

SEQ ID NO: 1722246 - RNA, 14 nt, Salmonella enterica enterica serovar Typhi
cagauccaaauggc

SEQ ID NO: 1722247 - RNA, 20 nt, Salmonella enterica enterica serovar Typhi
cagcaacagugggcuaugaa

SEQ ID NO: 1722248 - RNA, 21 nt, Salmonella enterica enterica serovar Typhi
cagcaacagugggcuaugaag

SEQ ID NO: 1722249 - RNA, 23 nt, Salmonella enterica enterica serovar Typhi
aaaaugaugacucauuaaaaaaa

SEQ ID NO: 1722250 - RNA, 15 nt, Salmonella enterica enterica serovar Typhi
cagcaaauacagaug

SEQ ID NO: 1722251 - RNA, 14 nt, Salmonella enterica enterica serovar Typhi
cagcaaaucagcua

SEQ ID NO: 1722252 - RNA, 15 nt, Salmonella enterica enterica serovar Typhi
cagcaaacauccccg

SEQ ID NO: 1722253 - RNA, 20 nt, Salmonella enterica enterica serovar Typhi
cagcaaaucgggaaaaugau

SEQ ID NO: 1722254 - RNA, 17 nt, Salmonella enterica enterica serovar Typhi
cagcaaaucugacacua

SEQ ID NO: 1722255 - RNA, 18 nt, Salmonella enterica enterica serovar Typhi
aaaaugcauugauaggcu

SEQ ID NO: 1722256 - RNA, 17 nt, Salmonella enterica enterica serovar Typhi
cagcaacggcugauggc

SEQ ID NO: 1722257 - RNA, 14 nt, Salmonella enterica enterica serovar Typhi
cagcaacggcugau

SEQ ID NO: 1722258 - RNA, 14 nt, Salmonella enterica enterica serovar Typhi
aaaaugcgcaugau

SEQ ID NO: 1722259 - RNA, 19 nt, Salmonella enterica enterica serovar Typhi
aaaaugcgccaggaaacuc

SEQ ID NO: 1722260 - RNA, 14 nt, Salmonella enterica enterica serovar Typhi
cagcaauaaaagga

SEQ ID NO: 1722261 - RNA, 15 nt, Salmonella enterica enterica serovar Typhi
cagcaauaaaaggaa

SEQ ID NO: 1722262 - RNA, 22 nt, Salmonella enterica enterica serovar Typhi
cagcaauaacaccggcggcgcc

SEQ ID NO: 1722263 - RNA, 22 nt, Salmonella enterica enterica serovar Typhi
cagcaagaaguuccgcuuuucu

SEQ ID NO: 1722264 - RNA, 23 nt, Salmonella enterica enterica serovar Typhi
cagcaacugcugcgcgugcugua

SEQ ID NO: 1722265 - RNA, 16 nt, Salmonella enterica enterica serovar Typhi
cagugcgauaccggcc

SEQ ID NO: 1722266 - RNA, 12 nt, Salmonella enterica enterica serovar Typhi
cagugcgauacc

SEQ ID NO: 1722267 - RNA, 22 nt, Salmonella enterica enterica serovar Typhi
cagugcgcauacuaccgcugcg

SEQ ID NO: 1722268 - RNA, 21 nt, Salmonella enterica enterica serovar Typhi
cagguaguuaccguauucugc

SEQ ID NO: 1722269 - RNA, 16 nt, Salmonella enterica enterica serovar Typhi
cagguauucaccaaaa

SEQ ID NO: 1722270 - RNA, 13 nt, Salmonella enterica enterica serovar Typhi
cagguauuaaaua

SEQ ID NO: 1722271 - RNA, 16 nt, Salmonella enterica enterica serovar Typhi
cagguauuaauccugc

SEQ ID NO: 1722272 - RNA, 18 nt, Salmonella enterica enterica serovar Typhi
cagugcgucacuuuaacc

SEQ ID NO: 1722273 - RNA, 17 nt, Salmonella enterica enterica serovar Typhi
caguggacgauaagcac

SEQ ID NO: 1722274 - RNA, 18 nt, Salmonella enterica enterica serovar Typhi
caguggcuuuaacgucag

SEQ ID NO: 1722275 - RNA, 19 nt, Salmonella enterica enterica serovar Typhi
cagugggaaaacgugcccc

SEQ ID NO: 1722276 - RNA, 16 nt, Salmonella enterica enterica serovar Typhi
caguggccaucuucca

SEQ ID NO: 1722277 - RNA, 19 nt, Salmonella enterica enterica serovar Typhi
cagugguggcuauagcuca

SEQ ID NO: 1722278 - RNA, 24 nt, Salmonella enterica enterica serovar Typhi
caguguacauagcuuugccacugg

SEQ ID NO: 1722279 - RNA, 16 nt, Salmonella enterica enterica serovar Typhi
caguuagcgaaacagu

SEQ ID NO: 1722280 - RNA, 20 nt, Salmonella enterica enterica serovar Typhi
caguuaaugccgacccaccu

SEQ ID NO: 1722281 - RNA, 17 nt, Salmonella enterica enterica serovar Typhi
caguuaaauaaacaaaa

SEQ ID NO: 1722282 - RNA, 19 nt, Salmonella enterica enterica serovar Typhi
caguuaacagaaugcugaa

SEQ ID NO: 1722283 - RNA, 14 nt, Salmonella enterica enterica serovar Typhi
caguuaauaaugaa

SEQ ID NO: 1722284 - RNA, 21 nt, Salmonella enterica enterica serovar Typhi
caguuaacgcguaaucuucca

SEQ ID NO: 1722285 - RNA, 20 nt, Salmonella enterica enterica serovar Typhi
caguguuaaucucacgcuca

SEQ ID NO: 1722286 - RNA, 20 nt, Salmonella enterica enterica serovar Typhi
caguucaaacggcccggcgu

SEQ ID NO: 1722287 - RNA, 21 nt, Salmonella enterica enterica serovar Typhi
caguucacuccuaagagaaaa

SEQ ID NO: 1722288 - RNA, 14 nt, Salmonella enterica enterica serovar Typhi
caguucagaaacgg

SEQ ID NO: 1722289 - RNA, 22 nt, Salmonella enterica enterica serovar Typhi
caguuauuaaucaagcccagcu

SEQ ID NO: 1722290 - RNA, 23 nt, Salmonella enterica enterica serovar Typhi
caguuauagcgcagauugaggcu

SEQ ID NO: 1722291 - RNA, 19 nt, Salmonella enterica enterica serovar Typhi
caguucauuucaggcaaag

SEQ ID NO: 1722292 - RNA, 20 nt, Salmonella enterica enterica serovar Typhi
caguuccaccguaugugcgc

SEQ ID NO: 1722293 - RNA, 17 nt, Salmonella enterica enterica serovar Typhi
caguucauuucaggcaa

SEQ ID NO: 1722294 - RNA, 14 nt, Salmonella enterica enterica serovar Typhi
caguucagccgcca

SEQ ID NO: 1722295 - RNA, 18 nt, Salmonella enterica enterica serovar Typhi
caguucauaagucaucca

SEQ ID NO: 1722296 - RNA, 17 nt, Salmonella enterica enterica serovar Typhi
caguucauccacgcggg

SEQ ID NO: 1722297 - RNA, 17 nt, Salmonella enterica enterica serovar Typhi
caguugccuugccucac

SEQ ID NO: 1722298 - RNA, 20 nt, Salmonella enterica enterica serovar Typhi
caguugcgacuguucaucaa

SEQ ID NO: 1722299 - RNA, 12 nt, Salmonella enterica enterica serovar Typhi
caguugcagcgc

SEQ ID NO: 1722300 - RNA, 16 nt, Salmonella enterica enterica serovar Typhi
caguugcccauuuucc

SEQ ID NO: 1722301 - RNA, 16 nt, Salmonella enterica enterica serovar Typhi
caguugaccaaacagc

SEQ ID NO: 1722302 - RNA, 14 nt, Salmonella enterica enterica serovar Typhi
caguucggcaaagc

SEQ ID NO: 1722303 - RNA, 14 nt, Salmonella enterica enterica serovar Typhi
caguucguucugcg

SEQ ID NO: 1722304 - RNA, 16 nt, Salmonella enterica enterica serovar Typhi
caguucguucugcguc

SEQ ID NO: 1722305 - RNA, 21 nt, Salmonella enterica enterica serovar Typhi
caguucggcgauuuccagcgc

SEQ ID NO: 1722306 - RNA, 23 nt, Salmonella enterica enterica serovar Typhi
caguucggcgauuuccagcgccg

SEQ ID NO: 1722307 - RNA, 18 nt, Salmonella enterica enterica serovar Typhi
caguucgccuucuucauc

SEQ ID NO: 1722308 - RNA, 21 nt, Salmonella enterica enterica serovar Typhi
caguucgccuucuucaucuuc

SEQ ID NO: 1722309 - RNA, 15 nt, Salmonella enterica enterica serovar Typhi
caguuccccgccgcg

SEQ ID NO: 1722310 - RNA, 16 nt, Salmonella enterica enterica serovar Typhi
caguuguuccagcagc

SEQ ID NO: 1722311 - RNA, 17 nt, Salmonella enterica enterica serovar Typhi
caguuggucgcguuuac

SEQ ID NO: 1722312 - RNA, 17 nt, Salmonella enterica enterica serovar Typhi
caguuggcuucagcaaa

SEQ ID NO: 1722313 - RNA, 13 nt, Salmonella enterica enterica serovar Typhi
caguuucggcccc

SEQ ID NO: 1722314 - RNA, 23 nt, Salmonella enterica enterica serovar Typhi
caguuuagagguuccccagccgc

SEQ ID NO: 1722315 - RNA, 23 nt, Salmonella enterica enterica serovar Typhi
caguuuacgagugcguucuucca

SEQ ID NO: 1722316 - RNA, 19 nt, Salmonella enterica enterica serovar Typhi
caguuuuuugaccauucca

SEQ ID NO: 1722317 - RNA, 13 nt, Salmonella enterica enterica serovar Typhi
caguuuuuuccag

SEQ ID NO: 1722318 - RNA, 22 nt, Salmonella enterica enterica serovar Typhi
caguuuuuucaguagccgccgc

SEQ ID NO: 1722319 - RNA, 12 nt, Salmonella enterica enterica serovar Typhi
cauaaaaaaacg

SEQ ID NO: 1722320 - RNA, 16 nt, Salmonella enterica enterica serovar Typhi
caguuugguaauacua

SEQ ID NO: 1722321 - RNA, 13 nt, Salmonella enterica enterica serovar Typhi
caguuugucauca

SEQ ID NO: 1722322 - RNA, 18 nt, Salmonella enterica enterica serovar Typhi
caguuuguaaccaacaaa

SEQ ID NO: 1722323 - RNA, 17 nt, Salmonella enterica enterica serovar Typhi
caguuuucacuggcauu

SEQ ID NO: 1722324 - RNA, 19 nt, Salmonella enterica enterica serovar Typhi
caguuucucgucauaguga

SEQ ID NO: 1722325 - RNA, 20 nt, Salmonella enterica enterica serovar Typhi
caguuucucaaacacuucua

SEQ ID NO: 1722326 - RNA, 14 nt, Salmonella enterica enterica serovar Typhi
caguuugcgaaaag

SEQ ID NO: 1722327 - RNA, 15 nt, Salmonella enterica enterica serovar Typhi
caguuugcgaaaagc

SEQ ID NO: 1722328 - RNA, 17 nt, Salmonella enterica enterica serovar Typhi
cauaccgcuuaacagcg

SEQ ID NO: 1722329 - RNA, 20 nt, Salmonella enterica enterica serovar Typhi
cauaccggugcgccccagca

SEQ ID NO: 1722330 - RNA, 18 nt, Salmonella enterica enterica serovar Typhi
cauaccggacuccaggca

SEQ ID NO: 1722331 - RNA, 12 nt, Salmonella enterica enterica serovar Typhi
cauacccgcuua

SEQ ID NO: 1722332 - RNA, 19 nt, Salmonella enterica enterica serovar Typhi
cauacccuauuuacagagc

SEQ ID NO: 1722333 - RNA, 13 nt, Salmonella enterica enterica serovar Typhi
cauacccuuccag

SEQ ID NO: 1722334 - RNA, 14 nt, Salmonella enterica enterica serovar Typhi
cauacccagguuug

SEQ ID NO: 1722335 - RNA, 17 nt, Salmonella enterica enterica serovar Typhi
cauacccaguagcagac

SEQ ID NO: 1722336 - RNA, 19 nt, Salmonella enterica enterica serovar Typhi
cauaccugcggccaugauc

SEQ ID NO: 1722337 - RNA, 15 nt, Salmonella enterica enterica serovar Typhi
cauaccguuucaacu

SEQ ID NO: 1722338 - RNA, 16 nt, Salmonella enterica enterica serovar Typhi
cauaccuauaaaaaug

SEQ ID NO: 1722339 - RNA, 22 nt, Salmonella enterica enterica serovar Typhi
cauacgaucgcgcacaugcugu

SEQ ID NO: 1722340 - RNA, 15 nt, Salmonella enterica enterica serovar Typhi
cauacgcgcgccaca

SEQ ID NO: 1722341 - RNA, 19 nt, Salmonella enterica enterica serovar Typhi
cauacagcgauaaccgccg

SEQ ID NO: 1722342 - RNA, 24 nt, Salmonella enterica enterica serovar Typhi
cauacacgccgggcacgcugacca

SEQ ID NO: 1722343 - RNA, 19 nt, Salmonella enterica enterica serovar Typhi
cauacacguaauacaugag

SEQ ID NO: 1722344 - RNA, 14 nt, Salmonella enterica enterica serovar Typhi
cauacacgcggcga

SEQ ID NO: 1722345 - RNA, 19 nt, Salmonella enterica enterica serovar Typhi
cauacacugcauaaauauc

SEQ ID NO: 1722346 - RNA, 14 nt, Salmonella enterica enterica serovar Typhi
cauacacucaacca

SEQ ID NO: 1722347 - RNA, 14 nt, Salmonella enterica enterica serovar Typhi
cauacacugcauaa

SEQ ID NO: 1722348 - RNA, 15 nt, Salmonella enterica enterica serovar Typhi
cauaauuuuugccuu

SEQ ID NO: 1722349 - RNA, 16 nt, Salmonella enterica enterica serovar Typhi
cauaauuuuugccuuu

SEQ ID NO: 1722350 - RNA, 16 nt, Salmonella enterica enterica serovar Typhi
cauaccacaacagaau

SEQ ID NO: 1722351 - RNA, 19 nt, Salmonella enterica enterica serovar Typhi
cauaccagcgaaaugcgaa

SEQ ID NO: 1722352 - RNA, 14 nt, Salmonella enterica enterica serovar Typhi
cauacauaaauccg

SEQ ID NO: 1722353 - RNA, 19 nt, Salmonella enterica enterica serovar Typhi
cauacauccaucacuccuu

SEQ ID NO: 1722354 - RNA, 23 nt, Salmonella enterica enterica serovar Typhi
cauaaucgccgacuaauuauuuu

SEQ ID NO: 1722355 - RNA, 17 nt, Salmonella enterica enterica serovar Typhi
cauaaucgcuuuuuccu

SEQ ID NO: 1722356 - RNA, 20 nt, Salmonella enterica enterica serovar Typhi
cauaaucggccaggauggcc

SEQ ID NO: 1722357 - RNA, 21 nt, Salmonella enterica enterica serovar Typhi
cauaaucggccaggauggccc

SEQ ID NO: 1722358 - RNA, 19 nt, Salmonella enterica enterica serovar Typhi
cauaaugacgauaaauaag

SEQ ID NO: 1722359 - RNA, 20 nt, Salmonella enterica enterica serovar Typhi
cauaaugacgauaaauaaga

SEQ ID NO: 1722360 - RNA, 17 nt, Salmonella enterica enterica serovar Typhi
cauaaugguggaaugcc

SEQ ID NO: 1722361 - RNA, 14 nt, Salmonella enterica enterica serovar Typhi
cauaauggaacugc

SEQ ID NO: 1722362 - RNA, 14 nt, Salmonella enterica enterica serovar Typhi
cauaauggcccagu

SEQ ID NO: 1722363 - RNA, 22 nt, Salmonella enterica enterica serovar Typhi
cauaaugauggggucacagguu

SEQ ID NO: 1722364 - RNA, 16 nt, Salmonella enterica enterica serovar Typhi
cauacaaagagaaaau

SEQ ID NO: 1722365 - RNA, 17 nt, Salmonella enterica enterica serovar Typhi
cauaauuguucagcuac

SEQ ID NO: 1722366 - RNA, 21 nt, Salmonella enterica enterica serovar Typhi
cauaauugcugcccgccgccg

SEQ ID NO: 1722367 - RNA, 20 nt, Salmonella enterica enterica serovar Typhi
cauaauugcugcccgccgcc

SEQ ID NO: 1722368 - RNA, 23 nt, Salmonella enterica enterica serovar Typhi
cauaauaucucccguuuguauaa

SEQ ID NO: 1722369 - RNA, 15 nt, Salmonella enterica enterica serovar Typhi
cauaaucgacagugg

SEQ ID NO: 1722370 - RNA, 19 nt, Salmonella enterica enterica serovar Typhi
cauaaucgacaguggcuuu

SEQ ID NO: 1722371 - RNA, 15 nt, Salmonella enterica enterica serovar Typhi
cauaaucgauauaau

SEQ ID NO: 1722372 - RNA, 19 nt, Salmonella enterica enterica serovar Typhi
cauaaucgauauaauuuua

SEQ ID NO: 1722373 - RNA, 18 nt, Salmonella enterica enterica serovar Typhi
cauaaucgccgacuaauu

SEQ ID NO: 1722374 - RNA, 23 nt, Salmonella enterica enterica serovar Typhi
cauaauaagcgcucaggcagcca

SEQ ID NO: 1722375 - RNA, 17 nt, Salmonella enterica enterica serovar Typhi
cauaauaaugacuaauu

SEQ ID NO: 1722376 - RNA, 19 nt, Salmonella enterica enterica serovar Typhi
cauaaaccccgauaaacca

SEQ ID NO: 1722377 - RNA, 19 nt, Salmonella enterica enterica serovar Typhi
cauaaaccgccgcuuugau

SEQ ID NO: 1722378 - RNA, 12 nt, Salmonella enterica enterica serovar Typhi
cauaaaaaagag

SEQ ID NO: 1722379 - RNA, 19 nt, Salmonella enterica enterica serovar Typhi
cauaaaaagcguacaaaaa

SEQ ID NO: 1722380 - RNA, 24 nt, Salmonella enterica enterica serovar Typhi
cauaaaaagacgaucuucgcagua

SEQ ID NO: 1722381 - RNA, 21 nt, Salmonella enterica enterica serovar Typhi
cauaaauauuggcggcaaaga

SEQ ID NO: 1722382 - RNA, 21 nt, Salmonella enterica enterica serovar Typhi
cauaaaugcgaugaacaucga

SEQ ID NO: 1722383 - RNA, 14 nt, Salmonella enterica enterica serovar Typhi
cauaaauuggcuca

SEQ ID NO: 1722384 - RNA, 22 nt, Salmonella enterica enterica serovar Typhi
cauaaaugcugucgcccauuga

SEQ ID NO: 1722385 - RNA, 18 nt, Salmonella enterica enterica serovar Typhi
cauaaagucagacaagua

SEQ ID NO: 1722386 - RNA, 22 nt, Salmonella enterica enterica serovar Typhi
cauaaauaaugccguuuuagcg

SEQ ID NO: 1722387 - RNA, 16 nt, Salmonella enterica enterica serovar Typhi
cauaaauacguaacac

SEQ ID NO: 1722388 - RNA, 20 nt, Salmonella enterica enterica serovar Typhi
cauaaauacaauucaacuca

SEQ ID NO: 1722389 - RNA, 17 nt, Salmonella enterica enterica serovar Typhi
cauaaaguagccaaugc

SEQ ID NO: 1722390 - RNA, 15 nt, Salmonella enterica enterica serovar Typhi
cauaaagccucucuu

SEQ ID NO: 1722391 - RNA, 15 nt, Salmonella enterica enterica serovar Typhi
cauaagcgcggcgga

SEQ ID NO: 1722392 - RNA, 22 nt, Salmonella enterica enterica serovar Typhi
cauaagccgcguucugucgaua

SEQ ID NO: 1722393 - RNA, 15 nt, Salmonella enterica enterica serovar Typhi
cauaaguaaauaaca

SEQ ID NO: 1722394 - RNA, 14 nt, Salmonella enterica enterica serovar Typhi
cauaagccaguccu

SEQ ID NO: 1722395 - RNA, 18 nt, Salmonella enterica enterica serovar Typhi
cauaagccaguccugcca

SEQ ID NO: 1722396 - RNA, 15 nt, Salmonella enterica enterica serovar Typhi
cauaagcaaacagug

SEQ ID NO: 1722397 - RNA, 22 nt, Salmonella enterica enterica serovar Typhi
cauaagcaaacagugggaagca

SEQ ID NO: 1722398 - RNA, 18 nt, Salmonella enterica enterica serovar Typhi
cauaacgugccaucuuug

SEQ ID NO: 1722399 - RNA, 18 nt, Salmonella enterica enterica serovar Typhi
cauaacguuuccuuauau

SEQ ID NO: 1722400 - RNA, 18 nt, Salmonella enterica enterica serovar Typhi
cauaacggccuuuuuccg

SEQ ID NO: 1722401 - RNA, 18 nt, Salmonella enterica enterica serovar Typhi
cauaacggcuacgcagcg

SEQ ID NO: 1722402 - RNA, 14 nt, Salmonella enterica enterica serovar Typhi
cauaacgggaagcc

SEQ ID NO: 1722403 - RNA, 23 nt, Salmonella enterica enterica serovar Typhi
cauaacgggguauaacucagcgg

SEQ ID NO: 1722404 - RNA, 22 nt, Salmonella enterica enterica serovar Typhi
cauaaccaaacgcgcauuuuau

SEQ ID NO: 1722405 - RNA, 14 nt, Salmonella enterica enterica serovar Typhi
cauaacaacuauuu

SEQ ID NO: 1722406 - RNA, 15 nt, Salmonella enterica enterica serovar Typhi
cauaacaaaaccagc

SEQ ID NO: 1722407 - RNA, 16 nt, Salmonella enterica enterica serovar Typhi
cauaacgccuuauucg

SEQ ID NO: 1722408 - RNA, 14 nt, Salmonella enterica enterica serovar Typhi
cauaaccucuccuu

SEQ ID NO: 1722409 - RNA, 21 nt, Salmonella enterica enterica serovar Typhi
caucaagcccacacaucacaa

SEQ ID NO: 1722410 - RNA, 19 nt, Salmonella enterica enterica serovar Typhi
caucaaacgcagcaaacgc

SEQ ID NO: 1722411 - RNA, 14 nt, Salmonella enterica enterica serovar Typhi
caucaacguaaaua

SEQ ID NO: 1722412 - RNA, 15 nt, Salmonella enterica enterica serovar Typhi
caucaaagaaaacca

SEQ ID NO: 1722413 - RNA, 16 nt, Salmonella enterica enterica serovar Typhi
caucaaacuuuuaaau

SEQ ID NO: 1722414 - RNA, 20 nt, Salmonella enterica enterica serovar Typhi
caucaaccaccaaaaagcca

SEQ ID NO: 1722415 - RNA, 18 nt, Salmonella enterica enterica serovar Typhi
caucaaaaucaucgccac

SEQ ID NO: 1722416 - RNA, 14 nt, Salmonella enterica enterica serovar Typhi
cauauuauuauaua

SEQ ID NO: 1722417 - RNA, 14 nt, Salmonella enterica enterica serovar Typhi
cauaugcucuccug

SEQ ID NO: 1722418 - RNA, 16 nt, Salmonella enterica enterica serovar Typhi
cauauggcauucgcag

SEQ ID NO: 1722419 - RNA, 17 nt, Salmonella enterica enterica serovar Typhi
cauaugggaagacauuc

SEQ ID NO: 1722420 - RNA, 15 nt, Salmonella enterica enterica serovar Typhi
cauauuacauagaaa

SEQ ID NO: 1722421 - RNA, 22 nt, Salmonella enterica enterica serovar Typhi
cauaucaguggggccuuuuuaa

SEQ ID NO: 1722422 - RNA, 16 nt, Salmonella enterica enterica serovar Typhi
cauauccaagccccuc

SEQ ID NO: 1722423 - RNA, 11 nt, Salmonella enterica enterica serovar Typhi
cauauccagcc

SEQ ID NO: 1722424 - RNA, 19 nt, Salmonella enterica enterica serovar Typhi
cauauagcagcagucucua

SEQ ID NO: 1722425 - RNA, 23 nt, Salmonella enterica enterica serovar Typhi
cauaucaccgcugacugaacuca

SEQ ID NO: 1722426 - RNA, 22 nt, Salmonella enterica enterica serovar Typhi
cauauacugucuuguggaacac

SEQ ID NO: 1722427 - RNA, 14 nt, Salmonella enterica enterica serovar Typhi
cauauacucacuga

SEQ ID NO: 1722428 - RNA, 18 nt, Salmonella enterica enterica serovar Typhi
cauauacucuucgccauu

SEQ ID NO: 1722429 - RNA, 23 nt, Salmonella enterica enterica serovar Typhi
cauaucgucaucggucaguuugc

SEQ ID NO: 1722430 - RNA, 14 nt, Salmonella enterica enterica serovar Typhi
cauaucuauauuuu

SEQ ID NO: 1722431 - RNA, 15 nt, Salmonella enterica enterica serovar Typhi
cauaucugcgccgcc

SEQ ID NO: 1722432 - RNA, 23 nt, Salmonella enterica enterica serovar Typhi
cauaucuggcgaggcuuuguccu

SEQ ID NO: 1722433 - RNA, 14 nt, Salmonella enterica enterica serovar Typhi
cauaucuuccaggc

SEQ ID NO: 1722434 - RNA, 22 nt, Salmonella enterica enterica serovar Typhi
cauauacgccacggccagcagc

SEQ ID NO: 1722435 - RNA, 19 nt, Salmonella enterica enterica serovar Typhi
cauauaccgcaccugggua

SEQ ID NO: 1722436 - RNA, 15 nt, Salmonella enterica enterica serovar Typhi
cauaguuuuccagcc

SEQ ID NO: 1722437 - RNA, 23 nt, Salmonella enterica enterica serovar Typhi
cauacgggcaugaagaaaauacu

SEQ ID NO: 1722438 - RNA, 17 nt, Salmonella enterica enterica serovar Typhi
cauacguuuaaagcgcu

SEQ ID NO: 1722439 - RNA, 18 nt, Salmonella enterica enterica serovar Typhi
cauaguacccucugcacc

SEQ ID NO: 1722440 - RNA, 17 nt, Salmonella enterica enterica serovar Typhi
cauacucacgaauaaga

SEQ ID NO: 1722441 - RNA, 21 nt, Salmonella enterica enterica serovar Typhi
cauacuccugccugacaauga

SEQ ID NO: 1722442 - RNA, 19 nt, Salmonella enterica enterica serovar Typhi
cauacuauccaacagaagg

SEQ ID NO: 1722443 - RNA, 19 nt, Salmonella enterica enterica serovar Typhi
caucagccguuacuucccc

SEQ ID NO: 1722444 - RNA, 21 nt, Salmonella enterica enterica serovar Typhi
caucagccguuacuuccccca

SEQ ID NO: 1722445 - RNA, 16 nt, Salmonella enterica enterica serovar Typhi
caucagauucaacagg

SEQ ID NO: 1722446 - RNA, 16 nt, Salmonella enterica enterica serovar Typhi
caucagccagcagcuc

SEQ ID NO: 1722447 - RNA, 17 nt, Salmonella enterica enterica serovar Typhi
caucagccagccgccaa

SEQ ID NO: 1722448 - RNA, 22 nt, Salmonella enterica enterica serovar Typhi
caucagcccuaucgcugcgcug

SEQ ID NO: 1722449 - RNA, 23 nt, Salmonella enterica enterica serovar Typhi
caucagccagccgccaaaaauau

SEQ ID NO: 1722450 - RNA, 12 nt, Salmonella enterica enterica serovar Typhi
caucagccaggc

SEQ ID NO: 1722451 - RNA, 18 nt, Salmonella enterica enterica serovar Typhi
caucagcgcuaccagcgc

SEQ ID NO: 1722452 - RNA, 20 nt, Salmonella enterica enterica serovar Typhi
caucagcgggcuaugcugaa

SEQ ID NO: 1722453 - RNA, 13 nt, Salmonella enterica enterica serovar Typhi
caucaggaaugcc

SEQ ID NO: 1722454 - RNA, 20 nt, Salmonella enterica enterica serovar Typhi
caucaggaucuucaucccau

SEQ ID NO: 1722455 - RNA, 13 nt, Salmonella enterica enterica serovar Typhi
caucaggcaucug

SEQ ID NO: 1722456 - RNA, 13 nt, Salmonella enterica enterica serovar Typhi
caucaaugcccag

SEQ ID NO: 1722457 - RNA, 23 nt, Salmonella enterica enterica serovar Typhi
caucaaucacuacggguuuuugu

SEQ ID NO: 1722458 - RNA, 16 nt, Salmonella enterica enterica serovar Typhi
caucaauccaacgaaa

SEQ ID NO: 1722459 - RNA, 22 nt, Salmonella enterica enterica serovar Typhi
caucaaugcccagcgcaaucac

SEQ ID NO: 1722460 - RNA, 19 nt, Salmonella enterica enterica serovar Typhi
caucaauggcgauuuuuag

SEQ ID NO: 1722461 - RNA, 21 nt, Salmonella enterica enterica serovar Typhi
caucacgaucuggcaaaccau

SEQ ID NO: 1722462 - RNA, 17 nt, Salmonella enterica enterica serovar Typhi
caucacgcaacggugag

SEQ ID NO: 1722463 - RNA, 20 nt, Salmonella enterica enterica serovar Typhi
caucacggagcgguaguuca

SEQ ID NO: 1722464 - RNA, 19 nt, Salmonella enterica enterica serovar Typhi
caucacggcagcaccgcug

SEQ ID NO: 1722465 - RNA, 14 nt, Salmonella enterica enterica serovar Typhi
caucacguucaggc

SEQ ID NO: 1722466 - RNA, 16 nt, Salmonella enterica enterica serovar Typhi
caucagaagugccagu

SEQ ID NO: 1722467 - RNA, 15 nt, Salmonella enterica enterica serovar Typhi
caucagacuguaugu

SEQ ID NO: 1722468 - RNA, 21 nt, Salmonella enterica enterica serovar Typhi
caucagacucucaaugcccau

SEQ ID NO: 1722469 - RNA, 21 nt, Salmonella enterica enterica serovar Typhi
caucagaccgagacccagcgc

SEQ ID NO: 1722470 - RNA, 17 nt, Salmonella enterica enterica serovar Typhi
caucagaccgauaaaua

SEQ ID NO: 1722471 - RNA, 19 nt, Salmonella enterica enterica serovar Typhi
caucaucggcacagccagu

SEQ ID NO: 1722472 - RNA, 22 nt, Salmonella enterica enterica serovar Typhi
caucaucgcuggugugcagcca

SEQ ID NO: 1722473 - RNA, 18 nt, Salmonella enterica enterica serovar Typhi
caucaucguuugcgcgca

SEQ ID NO: 1722474 - RNA, 14 nt, Salmonella enterica enterica serovar Typhi
caucaucucauaaa

SEQ ID NO: 1722475 - RNA, 23 nt, Salmonella enterica enterica serovar Typhi
caucauuaccuuuuccggcggca

SEQ ID NO: 1722476 - RNA, 14 nt, Salmonella enterica enterica serovar Typhi
caucauuaauauaa

SEQ ID NO: 1722477 - RNA, 19 nt, Salmonella enterica enterica serovar Typhi
caucaucugccauuucugc

SEQ ID NO: 1722478 - RNA, 13 nt, Salmonella enterica enterica serovar Typhi
caucaucuugucc

SEQ ID NO: 1722479 - RNA, 21 nt, Salmonella enterica enterica serovar Typhi
caucaucuuguccucaucauu

SEQ ID NO: 1722480 - RNA, 18 nt, Salmonella enterica enterica serovar Typhi
caucaucaggacucaauc

SEQ ID NO: 1722481 - RNA, 19 nt, Salmonella enterica enterica serovar Typhi
caucaucaggacucaauca

SEQ ID NO: 1722482 - RNA, 22 nt, Salmonella enterica enterica serovar Typhi
caucaucaggguuauccuccag

SEQ ID NO: 1722483 - RNA, 14 nt, Salmonella enterica enterica serovar Typhi
caucaucccgcgcc

SEQ ID NO: 1722484 - RNA, 22 nt, Salmonella enterica enterica serovar Typhi
caucaucgaacgccgccugcgc

SEQ ID NO: 1722485 - RNA, 18 nt, Salmonella enterica enterica serovar Typhi
caucagguggaagaaacg

SEQ ID NO: 1722486 - RNA, 13 nt, Salmonella enterica enterica serovar Typhi
caucaguaacuga

SEQ ID NO: 1722487 - RNA, 15 nt, Salmonella enterica enterica serovar Typhi
caucaguccuguuga

SEQ ID NO: 1722488 - RNA, 22 nt, Salmonella enterica enterica serovar Typhi
caucauaaaaggcaucgcucuu

SEQ ID NO: 1722489 - RNA, 16 nt, Salmonella enterica enterica serovar Typhi
caucauaaauggcuga

SEQ ID NO: 1722490 - RNA, 19 nt, Salmonella enterica enterica serovar Typhi
caucauaucccggcugaca

SEQ ID NO: 1722491 - RNA, 22 nt, Salmonella enterica enterica serovar Typhi
caucauauaaccacgaaaauua

SEQ ID NO: 1722492 - RNA, 20 nt, Salmonella enterica enterica serovar Typhi
caucauauaaccacgaaaau

SEQ ID NO: 1722493 - RNA, 14 nt, Salmonella enterica enterica serovar Typhi
caucgccgccgagu

SEQ ID NO: 1722494 - RNA, 14 nt, Salmonella enterica enterica serovar Typhi
caucgauuuuucau

SEQ ID NO: 1722495 - RNA, 18 nt, Salmonella enterica enterica serovar Typhi
caucgauuuccugaugac

SEQ ID NO: 1722496 - RNA, 13 nt, Salmonella enterica enterica serovar Typhi
caucgccugauga

SEQ ID NO: 1722497 - RNA, 19 nt, Salmonella enterica enterica serovar Typhi
caucgccugaucgcgcaga

SEQ ID NO: 1722498 - RNA, 15 nt, Salmonella enterica enterica serovar Typhi
caucgccgcggcgcu

SEQ ID NO: 1722499 - RNA, 14 nt, Salmonella enterica enterica serovar Typhi
caucgccgcgccgu

SEQ ID NO: 1722500 - RNA, 16 nt, Salmonella enterica enterica serovar Typhi
caucgcgacacccaau

SEQ ID NO: 1722501 - RNA, 16 nt, Salmonella enterica enterica serovar Typhi
caucgcgccgcuggcg

SEQ ID NO: 1722502 - RNA, 15 nt, Salmonella enterica enterica serovar Typhi
caucgcgccuccccu

SEQ ID NO: 1722503 - RNA, 14 nt, Salmonella enterica enterica serovar Typhi
caucgcgcuuaacu

SEQ ID NO: 1722504 - RNA, 13 nt, Salmonella enterica enterica serovar Typhi
cauccugcggguu

SEQ ID NO: 1722505 - RNA, 15 nt, Salmonella enterica enterica serovar Typhi
cauccuguucaagca

SEQ ID NO: 1722506 - RNA, 14 nt, Salmonella enterica enterica serovar Typhi
caucgacagcgcca

SEQ ID NO: 1722507 - RNA, 21 nt, Salmonella enterica enterica serovar Typhi
caucgacaagcuaauccccag

SEQ ID NO: 1722508 - RNA, 23 nt, Salmonella enterica enterica serovar Typhi
caucgacaagcuaauccccagcg

SEQ ID NO: 1722509 - RNA, 19 nt, Salmonella enterica enterica serovar Typhi
caucgacgaaauggugugc

SEQ ID NO: 1722510 - RNA, 12 nt, Salmonella enterica enterica serovar Typhi
caucgacgccag

SEQ ID NO: 1722511 - RNA, 21 nt, Salmonella enterica enterica serovar Typhi
caucgacccccaccucaauca

SEQ ID NO: 1722512 - RNA, 14 nt, Salmonella enterica enterica serovar Typhi
caucgauggcgcca

SEQ ID NO: 1722513 - RNA, 14 nt, Salmonella enterica enterica serovar Typhi
caucccugauuuau

SEQ ID NO: 1722514 - RNA, 20 nt, Salmonella enterica enterica serovar Typhi
caucccguuuucgucccagc

SEQ ID NO: 1722515 - RNA, 17 nt, Salmonella enterica enterica serovar Typhi
caucauuggcugucuua

SEQ ID NO: 1722516 - RNA, 15 nt, Salmonella enterica enterica serovar Typhi
caucauucaacgcau

SEQ ID NO: 1722517 - RNA, 13 nt, Salmonella enterica enterica serovar Typhi
caucauugcgcca

SEQ ID NO: 1722518 - RNA, 16 nt, Salmonella enterica enterica serovar Typhi
caucauuauuccccuc

SEQ ID NO: 1722519 - RNA, 15 nt, Salmonella enterica enterica serovar Typhi
cauccggacgccagu

SEQ ID NO: 1722520 - RNA, 19 nt, Salmonella enterica enterica serovar Typhi
cauccggaugguuaagcag

SEQ ID NO: 1722521 - RNA, 21 nt, Salmonella enterica enterica serovar Typhi
cauccgcuucggacuccugac

SEQ ID NO: 1722522 - RNA, 15 nt, Salmonella enterica enterica serovar Typhi
cauccgcgcuuucug

SEQ ID NO: 1722523 - RNA, 15 nt, Salmonella enterica enterica serovar Typhi
cauccgcucccgcuu

SEQ ID NO: 1722524 - RNA, 15 nt, Salmonella enterica enterica serovar Typhi
cauccgaccacggcc

SEQ ID NO: 1722525 - RNA, 13 nt, Salmonella enterica enterica serovar Typhi
cauccggcacagu

SEQ ID NO: 1722526 - RNA, 15 nt, Salmonella enterica enterica serovar Typhi
cauccggcaaacuca

SEQ ID NO: 1722527 - RNA, 16 nt, Salmonella enterica enterica serovar Typhi
cauccggcaaucagac

SEQ ID NO: 1722528 - RNA, 14 nt, Salmonella enterica enterica serovar Typhi
cauccgucaggccc

SEQ ID NO: 1722529 - RNA, 22 nt, Salmonella enterica enterica serovar Typhi
cauccucauuuuguugcuccag

SEQ ID NO: 1722530 - RNA, 21 nt, Salmonella enterica enterica serovar Typhi
cauccuccggcgacugaaugc

SEQ ID NO: 1722531 - RNA, 14 nt, Salmonella enterica enterica serovar Typhi
cauccucacgcaac

SEQ ID NO: 1722532 - RNA, 22 nt, Salmonella enterica enterica serovar Typhi
cauccuccauccagguaacaua

SEQ ID NO: 1722533 - RNA, 13 nt, Salmonella enterica enterica serovar Typhi
cauccucauuuug

SEQ ID NO: 1722534 - RNA, 13 nt, Salmonella enterica enterica serovar Typhi
cauccucuccuga

SEQ ID NO: 1722535 - RNA, 19 nt, Salmonella enterica enterica serovar Typhi
cauccucuuggguuauuuc

SEQ ID NO: 1722536 - RNA, 21 nt, Salmonella enterica enterica serovar Typhi
cauccucuuggguuauuucga

SEQ ID NO: 1722537 - RNA, 16 nt, Salmonella enterica enterica serovar Typhi
cauccugauuuuacug

SEQ ID NO: 1722538 - RNA, 20 nt, Salmonella enterica enterica serovar Typhi
cauccugauuauuacaauaa

SEQ ID NO: 1722539 - RNA, 17 nt, Salmonella enterica enterica serovar Typhi
cauccugcaacucaaaa

SEQ ID NO: 1722540 - RNA, 19 nt, Salmonella enterica enterica serovar Typhi
cauccugcaacucaaaaua

SEQ ID NO: 1722541 - RNA, 16 nt, Salmonella enterica enterica serovar Typhi
caucucaucuugcagg

SEQ ID NO: 1722542 - RNA, 14 nt, Salmonella enterica enterica serovar Typhi
caucuccagcgcau

SEQ ID NO: 1722543 - RNA, 21 nt, Salmonella enterica enterica serovar Typhi
caucucccaggccgccaccgc

SEQ ID NO: 1722544 - RNA, 22 nt, Salmonella enterica enterica serovar Typhi
caucuccuccucauucagcggc

SEQ ID NO: 1722545 - RNA, 23 nt, Salmonella enterica enterica serovar Typhi
caucuauaauaccuccugucuau

SEQ ID NO: 1722546 - RNA, 15 nt, Salmonella enterica enterica serovar Typhi
caucuacuucagcac

SEQ ID NO: 1722547 - RNA, 13 nt, Salmonella enterica enterica serovar Typhi
caucuaucgccag

SEQ ID NO: 1722548 - RNA, 12 nt, Salmonella enterica enterica serovar Typhi
caucuauuuaac

SEQ ID NO: 1722549 - RNA, 14 nt, Salmonella enterica enterica serovar Typhi
caucgcuccccaac

SEQ ID NO: 1722550 - RNA, 23 nt, Salmonella enterica enterica serovar Typhi
caucgcugaauuuggcggcgcgc

SEQ ID NO: 1722551 - RNA, 17 nt, Salmonella enterica enterica serovar Typhi
caucguaccaauaccca

SEQ ID NO: 1722552 - RNA, 18 nt, Salmonella enterica enterica serovar Typhi
caucguagucguagaaca

SEQ ID NO: 1722553 - RNA, 13 nt, Salmonella enterica enterica serovar Typhi
caucgcuccagac

SEQ ID NO: 1722554 - RNA, 18 nt, Salmonella enterica enterica serovar Typhi
caucgcuaaccggcggcg

SEQ ID NO: 1722555 - RNA, 15 nt, Salmonella enterica enterica serovar Typhi
caucgcgguuuuccg

SEQ ID NO: 1722556 - RNA, 19 nt, Salmonella enterica enterica serovar Typhi
caucugaaaugcucaauca

SEQ ID NO: 1722557 - RNA, 16 nt, Salmonella enterica enterica serovar Typhi
caucugccauuucugc

SEQ ID NO: 1722558 - RNA, 16 nt, Salmonella enterica enterica serovar Typhi
caucucuucaaacaau

SEQ ID NO: 1722559 - RNA, 14 nt, Salmonella enterica enterica serovar Typhi
caucugaccgugag

SEQ ID NO: 1722560 - RNA, 15 nt, Salmonella enterica enterica serovar Typhi
caucucuuucagaau

SEQ ID NO: 1722561 - RNA, 23 nt, Salmonella enterica enterica serovar Typhi
caucuccucgcgcguuugcaaua

SEQ ID NO: 1722562 - RNA, 17 nt, Salmonella enterica enterica serovar Typhi
caucuccucgcacuggc

SEQ ID NO: 1722563 - RNA, 18 nt, Salmonella enterica enterica serovar Typhi
caucucgguuaugaccaa

SEQ ID NO: 1722564 - RNA, 15 nt, Salmonella enterica enterica serovar Typhi
caucucuggcggcgu

SEQ ID NO: 1722565 - RNA, 13 nt, Salmonella enterica enterica serovar Typhi
caucucuccgcgu

SEQ ID NO: 1722566 - RNA, 18 nt, Salmonella enterica enterica serovar Typhi
caucuguucaacuuuucg

SEQ ID NO: 1722567 - RNA, 18 nt, Salmonella enterica enterica serovar Typhi
caucugugccagcccaau

SEQ ID NO: 1722568 - RNA, 17 nt, Salmonella enterica enterica serovar Typhi
caucuguggcaauuuuc

SEQ ID NO: 1722569 - RNA, 16 nt, Salmonella enterica enterica serovar Typhi
caucuuauauuuuggu

SEQ ID NO: 1722570 - RNA, 16 nt, Salmonella enterica enterica serovar Typhi
caucugcuucaacagc

SEQ ID NO: 1722571 - RNA, 23 nt, Salmonella enterica enterica serovar Typhi
caucugcuccggcguacgggcaa

SEQ ID NO: 1722572 - RNA, 20 nt, Salmonella enterica enterica serovar Typhi
caucugcguugcgcgcguca

SEQ ID NO: 1722573 - RNA, 17 nt, Salmonella enterica enterica serovar Typhi
caucugcggcuuucauc

SEQ ID NO: 1722574 - RNA, 22 nt, Salmonella enterica enterica serovar Typhi
caucugcggcaugaauugccgu

SEQ ID NO: 1722575 - RNA, 16 nt, Salmonella enterica enterica serovar Typhi
caucugggggaagaua

SEQ ID NO: 1722576 - RNA, 17 nt, Salmonella enterica enterica serovar Typhi
ccaacaacaggccgccg

SEQ ID NO: 1722577 - RNA, 15 nt, Salmonella enterica enterica serovar Typhi
ccaacaaaguggauu

SEQ ID NO: 1722578 - RNA, 14 nt, Salmonella enterica enterica serovar Typhi
ccaacaacccauuc

SEQ ID NO: 1722579 - RNA, 13 nt, Salmonella enterica enterica serovar Typhi
ccaacaacccauu

SEQ ID NO: 1722580 - RNA, 16 nt, Salmonella enterica enterica serovar Typhi
ccaaaucuguucuguc

SEQ ID NO: 1722581 - RNA, 13 nt, Salmonella enterica enterica serovar Typhi
ccaacagcugggu

SEQ ID NO: 1722582 - RNA, 22 nt, Salmonella enterica enterica serovar Typhi
ccaacaggaacaucguguccug

SEQ ID NO: 1722583 - RNA, 19 nt, Salmonella enterica enterica serovar Typhi
ccaacaaugccacgccccu

SEQ ID NO: 1722584 - RNA, 19 nt, Salmonella enterica enterica serovar Typhi
ccaacaaucagaagaaaua

SEQ ID NO: 1722585 - RNA, 15 nt, Salmonella enterica enterica serovar Typhi
ccaacagucaugaaa

SEQ ID NO: 1722586 - RNA, 15 nt, Salmonella enterica enterica serovar Typhi
ccaacauacaugccu

SEQ ID NO: 1722587 - RNA, 15 nt, Salmonella enterica enterica serovar Typhi
ccaaagcgcugcugc

SEQ ID NO: 1722588 - RNA, 18 nt, Salmonella enterica enterica serovar Typhi
ccaaagucaucaauugcu

SEQ ID NO: 1722589 - RNA, 17 nt, Salmonella enterica enterica serovar Typhi
cauuuuauuuaaaaagg

SEQ ID NO: 1722590 - RNA, 16 nt, Salmonella enterica enterica serovar Typhi
ccaaagcgcuacaggg

SEQ ID NO: 1722591 - RNA, 17 nt, Salmonella enterica enterica serovar Typhi
cauuuuccgcugucuau

SEQ ID NO: 1722592 - RNA, 22 nt, Salmonella enterica enterica serovar Typhi
cauuuuccgcugucuauccacu

SEQ ID NO: 1722593 - RNA, 21 nt, Salmonella enterica enterica serovar Typhi
cauuuuaucgacgcuauuuuu

SEQ ID NO: 1722594 - RNA, 15 nt, Salmonella enterica enterica serovar Typhi
cauuuuaucuuuugu

SEQ ID NO: 1722595 - RNA, 16 nt, Salmonella enterica enterica serovar Typhi
ccaacgccagcagcgc

SEQ ID NO: 1722596 - RNA, 15 nt, Salmonella enterica enterica serovar Typhi
ccaacgccagcagcg

SEQ ID NO: 1722597 - RNA, 13 nt, Salmonella enterica enterica serovar Typhi
ccaacgcaaugcg

SEQ ID NO: 1722598 - RNA, 18 nt, Salmonella enterica enterica serovar Typhi
ccaacgcaaugcgauaag

SEQ ID NO: 1722599 - RNA, 21 nt, Salmonella enterica enterica serovar Typhi
ccaacauagcuaaauaaaaau

SEQ ID NO: 1722600 - RNA, 15 nt, Salmonella enterica enterica serovar Typhi
ccaacugccaaacca

SEQ ID NO: 1722601 - RNA, 16 nt, Salmonella enterica enterica serovar Typhi
ccaacugcgccugaag

SEQ ID NO: 1722602 - RNA, 15 nt, Salmonella enterica enterica serovar Typhi
ccaacgucagcaucu

SEQ ID NO: 1722603 - RNA, 16 nt, Salmonella enterica enterica serovar Typhi
ccaacugccaaaccac

SEQ ID NO: 1722604 - RNA, 21 nt, Salmonella enterica enterica serovar Typhi
ccaacuguauuuugaaaacac

SEQ ID NO: 1722605 - RNA, 15 nt, Salmonella enterica enterica serovar Typhi
ccaagauuuuucaga

SEQ ID NO: 1722606 - RNA, 14 nt, Salmonella enterica enterica serovar Typhi
ccaagauccagcgg

SEQ ID NO: 1722607 - RNA, 13 nt, Salmonella enterica enterica serovar Typhi
ccaagcagcgcca

SEQ ID NO: 1722608 - RNA, 14 nt, Salmonella enterica enterica serovar Typhi
ccaagcacaaaaag

SEQ ID NO: 1722609 - RNA, 18 nt, Salmonella enterica enterica serovar Typhi
ccaagcaacacggcgaca

SEQ ID NO: 1722610 - RNA, 19 nt, Salmonella enterica enterica serovar Typhi
ccaauagagcaguuaauaa

SEQ ID NO: 1722611 - RNA, 22 nt, Salmonella enterica enterica serovar Typhi
ccaauagagcaguuaauaauga

SEQ ID NO: 1722612 - RNA, 23 nt, Salmonella enterica enterica serovar Typhi
ccaauaccggcguaauugcgccu

SEQ ID NO: 1722613 - RNA, 16 nt, Salmonella enterica enterica serovar Typhi
ccaaucaacgccgcca

SEQ ID NO: 1722614 - RNA, 12 nt, Salmonella enterica enterica serovar Typhi
ccaauauuuauu

SEQ ID NO: 1722615 - RNA, 14 nt, Salmonella enterica enterica serovar Typhi
ccaauauccccagc

SEQ ID NO: 1722616 - RNA, 22 nt, Salmonella enterica enterica serovar Typhi
ccaaucaugucaaauucaagcc

SEQ ID NO: 1722617 - RNA, 12 nt, Salmonella enterica enterica serovar Typhi
ccaauuuuucac

SEQ ID NO: 1722618 - RNA, 20 nt, Salmonella enterica enterica serovar Typhi
ccacaauuguagcugcgcca

SEQ ID NO: 1722619 - RNA, 18 nt, Salmonella enterica enterica serovar Typhi
ccaaugucauauuuguga

SEQ ID NO: 1722620 - RNA, 15 nt, Salmonella enterica enterica serovar Typhi
ccaaucuccagcauc

SEQ ID NO: 1722621 - RNA, 14 nt, Salmonella enterica enterica serovar Typhi
ccacacaugcaaaa

SEQ ID NO: 1722622 - RNA, 15 nt, Salmonella enterica enterica serovar Typhi
ccacacaugcaaaaa

SEQ ID NO: 1722623 - RNA, 17 nt, Salmonella enterica enterica serovar Typhi
ccacagccgcauuuuuu

SEQ ID NO: 1722624 - RNA, 20 nt, Salmonella enterica enterica serovar Typhi
ccacagccgguuagccacaa

SEQ ID NO: 1722625 - RNA, 23 nt, Salmonella enterica enterica serovar Typhi
ccacagccgguuagccacaauga

SEQ ID NO: 1722626 - RNA, 22 nt, Salmonella enterica enterica serovar Typhi
ccacagcauaccgugugcagug

SEQ ID NO: 1722627 - RNA, 23 nt, Salmonella enterica enterica serovar Typhi
ccacaggaaccgguagccaggcg

SEQ ID NO: 1722628 - RNA, 14 nt, Salmonella enterica enterica serovar Typhi
ccaccgggccguca

SEQ ID NO: 1722629 - RNA, 22 nt, Salmonella enterica enterica serovar Typhi
ccaccggguccagucgcgccgc

SEQ ID NO: 1722630 - RNA, 20 nt, Salmonella enterica enterica serovar Typhi
ccaccggguuaaagcccuga

SEQ ID NO: 1722631 - RNA, 14 nt, Salmonella enterica enterica serovar Typhi
ccaccucaaucacc

SEQ ID NO: 1722632 - RNA, 16 nt, Salmonella enterica enterica serovar Typhi
ccaccgguauccgcau

SEQ ID NO: 1722633 - RNA, 11 nt, Salmonella enterica enterica serovar Typhi
ccaccgaauuc

SEQ ID NO: 1722634 - RNA, 15 nt, Salmonella enterica enterica serovar Typhi
ccaccgccaaccgcc

SEQ ID NO: 1722635 - RNA, 15 nt, Salmonella enterica enterica serovar Typhi
ccaccugaucgccaa

SEQ ID NO: 1722636 - RNA, 16 nt, Salmonella enterica enterica serovar Typhi
ccaccugaucgccaac

SEQ ID NO: 1722637 - RNA, 16 nt, Salmonella enterica enterica serovar Typhi
ccaccucguucaaaca

SEQ ID NO: 1722638 - RNA, 15 nt, Salmonella enterica enterica serovar Typhi
ccaccugccaguccg

SEQ ID NO: 1722639 - RNA, 15 nt, Salmonella enterica enterica serovar Typhi
ccacgaaugccgaua

SEQ ID NO: 1722640 - RNA, 18 nt, Salmonella enterica enterica serovar Typhi
ccacgaccuacaccguau

SEQ ID NO: 1722641 - RNA, 14 nt, Salmonella enterica enterica serovar Typhi
ccacgcaaaccgcu

SEQ ID NO: 1722642 - RNA, 16 nt, Salmonella enterica enterica serovar Typhi
ccacgagaaauccaca

SEQ ID NO: 1722643 - RNA, 16 nt, Salmonella enterica enterica serovar Typhi
ccacgauacgccccug

SEQ ID NO: 1722644 - RNA, 17 nt, Salmonella enterica enterica serovar Typhi
ccacccggcuuuuuuau

SEQ ID NO: 1722645 - RNA, 15 nt, Salmonella enterica enterica serovar Typhi
ccacccgguuuacca

SEQ ID NO: 1722646 - RNA, 18 nt, Salmonella enterica enterica serovar Typhi
ccaccauuacgcccccuc

SEQ ID NO: 1722647 - RNA, 22 nt, Salmonella enterica enterica serovar Typhi
ccaccauaucgcagaccaucca

SEQ ID NO: 1722648 - RNA, 19 nt, Salmonella enterica enterica serovar Typhi
ccaccauauucgccaccgc

SEQ ID NO: 1722649 - RNA, 21 nt, Salmonella enterica enterica serovar Typhi
ccaccauauucgccaccgcgc

SEQ ID NO: 1722650 - RNA, 20 nt, Salmonella enterica enterica serovar Typhi
ccaccaguaaccgccacagc

SEQ ID NO: 1722651 - RNA, 14 nt, Salmonella enterica enterica serovar Typhi
ccaccagaucuuca

SEQ ID NO: 1722652 - RNA, 14 nt, Salmonella enterica enterica serovar Typhi
ccaccaccuccugc

SEQ ID NO: 1722653 - RNA, 21 nt, Salmonella enterica enterica serovar Typhi
ccacaggccguucauucgccc

SEQ ID NO: 1722654 - RNA, 15 nt, Salmonella enterica enterica serovar Typhi
ccacaggccaacaua

SEQ ID NO: 1722655 - RNA, 21 nt, Salmonella enterica enterica serovar Typhi
ccaccacccagugccaccagc

SEQ ID NO: 1722656 - RNA, 23 nt, Salmonella enterica enterica serovar Typhi
ccacggcguagcgagaaggcuuu

SEQ ID NO: 1722657 - RNA, 18 nt, Salmonella enterica enterica serovar Typhi
ccacggcuucagcggcgc

SEQ ID NO: 1722658 - RNA, 18 nt, Salmonella enterica enterica serovar Typhi
ccacgguucucaccgugg

SEQ ID NO: 1722659 - RNA, 20 nt, Salmonella enterica enterica serovar Typhi
ccacguauuucgcagcgguc

SEQ ID NO: 1722660 - RNA, 16 nt, Salmonella enterica enterica serovar Typhi
ccacguagcugcggua

SEQ ID NO: 1722661 - RNA, 16 nt, Salmonella enterica enterica serovar Typhi
ccacguacugcuuacc

SEQ ID NO: 1722662 - RNA, 15 nt, Salmonella enterica enterica serovar Typhi
ccacuacgcagcucc

SEQ ID NO: 1722663 - RNA, 24 nt, Salmonella enterica enterica serovar Typhi
ccacguuuuccugcgcuugcaugg

SEQ ID NO: 1722664 - RNA, 14 nt, Salmonella enterica enterica serovar Typhi
ccacuaacccggcg

SEQ ID NO: 1722665 - RNA, 18 nt, Salmonella enterica enterica serovar Typhi
ccacgugcggacguagcg

SEQ ID NO: 1722666 - RNA, 14 nt, Salmonella enterica enterica serovar Typhi
ccacguucuuccag

SEQ ID NO: 1722667 - RNA, 21 nt, Salmonella enterica enterica serovar Typhi
ccacguucggcguguagccaa

SEQ ID NO: 1722668 - RNA, 13 nt, Salmonella enterica enterica serovar Typhi
ccacgcccgccgc

SEQ ID NO: 1722669 - RNA, 13 nt, Salmonella enterica enterica serovar Typhi
ccacgcccagcua

SEQ ID NO: 1722670 - RNA, 20 nt, Salmonella enterica enterica serovar Typhi
ccacgccgaccaccagcuug

SEQ ID NO: 1722671 - RNA, 13 nt, Salmonella enterica enterica serovar Typhi
ccacgccaucauu

SEQ ID NO: 1722672 - RNA, 18 nt, Salmonella enterica enterica serovar Typhi
ccacgccauggccgcagc

SEQ ID NO: 1722673 - RNA, 15 nt, Salmonella enterica enterica serovar Typhi
ccacgcccagcgccg

SEQ ID NO: 1722674 - RNA, 14 nt, Salmonella enterica enterica serovar Typhi
ccacgcgccgccga

SEQ ID NO: 1722675 - RNA, 19 nt, Salmonella enterica enterica serovar Typhi
ccacgcggcgugcgcugca

SEQ ID NO: 1722676 - RNA, 18 nt, Salmonella enterica enterica serovar Typhi
ccacgcgaugcaaccccu

SEQ ID NO: 1722677 - RNA, 14 nt, Salmonella enterica enterica serovar Typhi
ccacgccgccgcgu

SEQ ID NO: 1722678 - RNA, 14 nt, Salmonella enterica enterica serovar Typhi
ccacgccguagcug

SEQ ID NO: 1722679 - RNA, 14 nt, Salmonella enterica enterica serovar Typhi
ccacgcucacuuuu

SEQ ID NO: 1722680 - RNA, 15 nt, Salmonella enterica enterica serovar Typhi
ccacggaaugaaugu

SEQ ID NO: 1722681 - RNA, 20 nt, Salmonella enterica enterica serovar Typhi
ccacggauauuuaccgccgc

SEQ ID NO: 1722682 - RNA, 12 nt, Salmonella enterica enterica serovar Typhi
ccacggccagca

SEQ ID NO: 1722683 - RNA, 15 nt, Salmonella enterica enterica serovar Typhi
ccacggccacagcca

SEQ ID NO: 1722684 - RNA, 14 nt, Salmonella enterica enterica serovar Typhi
cauguccccaggug

SEQ ID NO: 1722685 - RNA, 20 nt, Salmonella enterica enterica serovar Typhi
cauguacgcaggcgacuggc

SEQ ID NO: 1722686 - RNA, 15 nt, Salmonella enterica enterica serovar Typhi
cauguaccauuguca

SEQ ID NO: 1722687 - RNA, 20 nt, Salmonella enterica enterica serovar Typhi
cauguacggguccuuuuuug

SEQ ID NO: 1722688 - RNA, 19 nt, Salmonella enterica enterica serovar Typhi
cauguacaacuucaugagu

SEQ ID NO: 1722689 - RNA, 14 nt, Salmonella enterica enterica serovar Typhi
cauguaaccaaagc

SEQ ID NO: 1722690 - RNA, 20 nt, Salmonella enterica enterica serovar Typhi
cauguaaccaaagcaccauu

SEQ ID NO: 1722691 - RNA, 16 nt, Salmonella enterica enterica serovar Typhi
cauggcguuaaugcgc

SEQ ID NO: 1722692 - RNA, 20 nt, Salmonella enterica enterica serovar Typhi
cauggcgucggcgacuuuca

SEQ ID NO: 1722693 - RNA, 18 nt, Salmonella enterica enterica serovar Typhi
cauggcuugaucgcgcag

SEQ ID NO: 1722694 - RNA, 17 nt, Salmonella enterica enterica serovar Typhi
caugggaaauaacguua

SEQ ID NO: 1722695 - RNA, 23 nt, Salmonella enterica enterica serovar Typhi
cauggucgccguccauuucaaug

SEQ ID NO: 1722696 - RNA, 15 nt, Salmonella enterica enterica serovar Typhi
cauggguuugaccca

SEQ ID NO: 1722697 - RNA, 14 nt, Salmonella enterica enterica serovar Typhi
caugcugugugacc

SEQ ID NO: 1722698 - RNA, 20 nt, Salmonella enterica enterica serovar Typhi
caugcugugugaccagcagu

SEQ ID NO: 1722699 - RNA, 22 nt, Salmonella enterica enterica serovar Typhi
caugcuguauaaacucagcaau

SEQ ID NO: 1722700 - RNA, 12 nt, Salmonella enterica enterica serovar Typhi
caugcugguugg

SEQ ID NO: 1722701 - RNA, 16 nt, Salmonella enterica enterica serovar Typhi
caugcuuucaauaaau

SEQ ID NO: 1722702 - RNA, 21 nt, Salmonella enterica enterica serovar Typhi
cauggcaaaagacauccccgc

SEQ ID NO: 1722703 - RNA, 18 nt, Salmonella enterica enterica serovar Typhi
cauggcaggcagcacaau

SEQ ID NO: 1722704 - RNA, 15 nt, Salmonella enterica enterica serovar Typhi
cauggcagccccggc

SEQ ID NO: 1722705 - RNA, 14 nt, Salmonella enterica enterica serovar Typhi
caucuucgcccggc

SEQ ID NO: 1722706 - RNA, 22 nt, Salmonella enterica enterica serovar Typhi
caucuucgagggugggcgcaca

SEQ ID NO: 1722707 - RNA, 16 nt, Salmonella enterica enterica serovar Typhi
caucuucaccuuucca

SEQ ID NO: 1722708 - RNA, 17 nt, Salmonella enterica enterica serovar Typhi
caucuucaccuuuccag

SEQ ID NO: 1722709 - RNA, 20 nt, Salmonella enterica enterica serovar Typhi
caugcucaugcgaucgggca

SEQ ID NO: 1722710 - RNA, 15 nt, Salmonella enterica enterica serovar Typhi
caucuucuaccugga

SEQ ID NO: 1722711 - RNA, 21 nt, Salmonella enterica enterica serovar Typhi
caugcugaccgaaccgcugua

SEQ ID NO: 1722712 - RNA, 21 nt, Salmonella enterica enterica serovar Typhi
caugcugcaccgcaucaaacu

SEQ ID NO: 1722713 - RNA, 23 nt, Salmonella enterica enterica serovar Typhi
caugcugaugacuaauggcauuu

SEQ ID NO: 1722714 - RNA, 16 nt, Salmonella enterica enterica serovar Typhi
caugcugccauuuuau

SEQ ID NO: 1722715 - RNA, 13 nt, Salmonella enterica enterica serovar Typhi
cauuaccuuuucc

SEQ ID NO: 1722716 - RNA, 13 nt, Salmonella enterica enterica serovar Typhi
cauuacauccuca

SEQ ID NO: 1722717 - RNA, 13 nt, Salmonella enterica enterica serovar Typhi
cauuacccccgcc

SEQ ID NO: 1722718 - RNA, 23 nt, Salmonella enterica enterica serovar Typhi
cauuagacaguuuuuucguucca

SEQ ID NO: 1722719 - RNA, 21 nt, Salmonella enterica enterica serovar Typhi
cauuagaccggacguugaaaa

SEQ ID NO: 1722720 - RNA, 14 nt, Salmonella enterica enterica serovar Typhi
cauuacucguccuu

SEQ ID NO: 1722721 - RNA, 16 nt, Salmonella enterica enterica serovar Typhi
caugugguaggcuuca

SEQ ID NO: 1722722 - RNA, 22 nt, Salmonella enterica enterica serovar Typhi
caugucugucuaugcacaggcg

SEQ ID NO: 1722723 - RNA, 19 nt, Salmonella enterica enterica serovar Typhi
caugucucacccguuuucu

SEQ ID NO: 1722724 - RNA, 22 nt, Salmonella enterica enterica serovar Typhi
cauguuaauaccagcgccaauc

SEQ ID NO: 1722725 - RNA, 22 nt, Salmonella enterica enterica serovar Typhi
cauguuaauugucagcucuuug

SEQ ID NO: 1722726 - RNA, 17 nt, Salmonella enterica enterica serovar Typhi
cauuaauaucagcccca

SEQ ID NO: 1722727 - RNA, 16 nt, Salmonella enterica enterica serovar Typhi
cauuaauacacugcgu

SEQ ID NO: 1722728 - RNA, 20 nt, Salmonella enterica enterica serovar Typhi
cauucagcggcugcgccugc

SEQ ID NO: 1722729 - RNA, 19 nt, Salmonella enterica enterica serovar Typhi
cauucagcagcgcccagcc

SEQ ID NO: 1722730 - RNA, 16 nt, Salmonella enterica enterica serovar Typhi
cauuauuuuuaaauaa

SEQ ID NO: 1722731 - RNA, 17 nt, Salmonella enterica enterica serovar Typhi
cauuauuuuuaaauaac

SEQ ID NO: 1722732 - RNA, 15 nt, Salmonella enterica enterica serovar Typhi
cauuauuuuuaaaua

SEQ ID NO: 1722733 - RNA, 15 nt, Salmonella enterica enterica serovar Typhi
cauuagcgcgauaaa

SEQ ID NO: 1722734 - RNA, 20 nt, Salmonella enterica enterica serovar Typhi
cauuagcggcauugaagagu

SEQ ID NO: 1722735 - RNA, 22 nt, Salmonella enterica enterica serovar Typhi
cauuaggcuuuucauucagcgc

SEQ ID NO: 1722736 - RNA, 15 nt, Salmonella enterica enterica serovar Typhi
cauuauaaauaucau

SEQ ID NO: 1722737 - RNA, 17 nt, Salmonella enterica enterica serovar Typhi
cauucaggccucugcuu

SEQ ID NO: 1722738 - RNA, 18 nt, Salmonella enterica enterica serovar Typhi
cauucaggccucugcuuu

SEQ ID NO: 1722739 - RNA, 22 nt, Salmonella enterica enterica serovar Typhi
cauucaguacgcuuuggcaggc

SEQ ID NO: 1722740 - RNA, 14 nt, Salmonella enterica enterica serovar Typhi
cauucauaaaagau

SEQ ID NO: 1722741 - RNA, 18 nt, Salmonella enterica enterica serovar Typhi
cauucauaagcaaacagu

SEQ ID NO: 1722742 - RNA, 12 nt, Salmonella enterica enterica serovar Typhi
cauuccgccugc

SEQ ID NO: 1722743 - RNA, 22 nt, Salmonella enterica enterica serovar Typhi
cauuccgcgcaaauacugaaau

SEQ ID NO: 1722744 - RNA, 17 nt, Salmonella enterica enterica serovar Typhi
cauucgauaaccgccga

SEQ ID NO: 1722745 - RNA, 15 nt, Salmonella enterica enterica serovar Typhi
cauucgauaaccgcc

SEQ ID NO: 1722746 - RNA, 16 nt, Salmonella enterica enterica serovar Typhi
cauucgaauccuccug

SEQ ID NO: 1722747 - RNA, 16 nt, Salmonella enterica enterica serovar Typhi
cauuccugccgccgca

SEQ ID NO: 1722748 - RNA, 13 nt, Salmonella enterica enterica serovar Typhi
cauucgccccagc

SEQ ID NO: 1722749 - RNA, 18 nt, Salmonella enterica enterica serovar Typhi
cauucgcccgcaauguuu

SEQ ID NO: 1722750 - RNA, 17 nt, Salmonella enterica enterica serovar Typhi
cauucgcccagucauca

SEQ ID NO: 1722751 - RNA, 23 nt, Salmonella enterica enterica serovar Typhi
cauugcuuuuggcaacggcagcc

SEQ ID NO: 1722752 - RNA, 14 nt, Salmonella enterica enterica serovar Typhi
cauugcuuucuuga

SEQ ID NO: 1722753 - RNA, 17 nt, Salmonella enterica enterica serovar Typhi
cauugcuuucuugaauc

SEQ ID NO: 1722754 - RNA, 16 nt, Salmonella enterica enterica serovar Typhi
cauugcgccccagcac

SEQ ID NO: 1722755 - RNA, 18 nt, Salmonella enterica enterica serovar Typhi
cauugcgagaaaaaacuc

SEQ ID NO: 1722756 - RNA, 20 nt, Salmonella enterica enterica serovar Typhi
cauugccguuaacugcugcu

SEQ ID NO: 1722757 - RNA, 17 nt, Salmonella enterica enterica serovar Typhi
cauugccuuccaggcgg

SEQ ID NO: 1722758 - RNA, 19 nt, Salmonella enterica enterica serovar Typhi
cauugccguuaacugcugc

SEQ ID NO: 1722759 - RNA, 14 nt, Salmonella enterica enterica serovar Typhi
cauugccguaaauu

SEQ ID NO: 1722760 - RNA, 17 nt, Salmonella enterica enterica serovar Typhi
cauugccguuaacugcu

SEQ ID NO: 1722761 - RNA, 23 nt, Salmonella enterica enterica serovar Typhi
cauugccaugcgacuaaccugau

SEQ ID NO: 1722762 - RNA, 19 nt, Salmonella enterica enterica serovar Typhi
cauugccauguuaauacca

SEQ ID NO: 1722763 - RNA, 15 nt, Salmonella enterica enterica serovar Typhi
cauugccccucccug

SEQ ID NO: 1722764 - RNA, 13 nt, Salmonella enterica enterica serovar Typhi
cauugccacccau

SEQ ID NO: 1722765 - RNA, 16 nt, Salmonella enterica enterica serovar Typhi
cauugcagcauuacac

SEQ ID NO: 1722766 - RNA, 11 nt, Salmonella enterica enterica serovar Typhi
cauugcagcgg

SEQ ID NO: 1722767 - RNA, 22 nt, Salmonella enterica enterica serovar Typhi
cauucgggacaaacccccagcc

SEQ ID NO: 1722768 - RNA, 16 nt, Salmonella enterica enterica serovar Typhi
cauucgcgucauacuu

SEQ ID NO: 1722769 - RNA, 16 nt, Salmonella enterica enterica serovar Typhi
cauucgcucaggacag

SEQ ID NO: 1722770 - RNA, 14 nt, Salmonella enterica enterica serovar Typhi
cauucgcuccucag

SEQ ID NO: 1722771 - RNA, 16 nt, Salmonella enterica enterica serovar Typhi
cauucgcgcacggcgc

SEQ ID NO: 1722772 - RNA, 16 nt, Salmonella enterica enterica serovar Typhi
cauucgcuugcccggc

SEQ ID NO: 1722773 - RNA, 19 nt, Salmonella enterica enterica serovar Typhi
cauuguccuuuaucugccc

SEQ ID NO: 1722774 - RNA, 23 nt, Salmonella enterica enterica serovar Typhi
cauuguccuuuaucugcccuuuc

SEQ ID NO: 1722775 - RNA, 17 nt, Salmonella enterica enterica serovar Typhi
cauugucggcgcuaucu

SEQ ID NO: 1722776 - RNA, 13 nt, Salmonella enterica enterica serovar Typhi
cauuguuaaucca

SEQ ID NO: 1722777 - RNA, 20 nt, Salmonella enterica enterica serovar Typhi
cauuguuauguuuuuagaca

SEQ ID NO: 1722778 - RNA, 22 nt, Salmonella enterica enterica serovar Typhi
cauuuaacaggacgcuccauca

SEQ ID NO: 1722779 - RNA, 20 nt, Salmonella enterica enterica serovar Typhi
cauuuaagauuuaaaacaag

SEQ ID NO: 1722780 - RNA, 17 nt, Salmonella enterica enterica serovar Typhi
cauuuaaucgccugcgc

SEQ ID NO: 1722781 - RNA, 14 nt, Salmonella enterica enterica serovar Typhi
cauuguaaaaccga

SEQ ID NO: 1722782 - RNA, 12 nt, Salmonella enterica enterica serovar Typhi
cauugucaaaaa

SEQ ID NO: 1722783 - RNA, 18 nt, Salmonella enterica enterica serovar Typhi
cauuggggaaccuggcag

SEQ ID NO: 1722784 - RNA, 17 nt, Salmonella enterica enterica serovar Typhi
cauuggcccggcgcgcg

SEQ ID NO: 1722785 - RNA, 20 nt, Salmonella enterica enterica serovar Typhi
cauuucugucugacgacccg

SEQ ID NO: 1722786 - RNA, 16 nt, Salmonella enterica enterica serovar Typhi
cauuucugccugcuuc

SEQ ID NO: 1722787 - RNA, 16 nt, Salmonella enterica enterica serovar Typhi
cauuucuucuucaagc

SEQ ID NO: 1722788 - RNA, 12 nt, Salmonella enterica enterica serovar Typhi
cauuugcagguu

SEQ ID NO: 1722789 - RNA, 14 nt, Salmonella enterica enterica serovar Typhi
cauuugcagguuac

SEQ ID NO: 1722790 - RNA, 21 nt, Salmonella enterica enterica serovar Typhi
cauuugcggcgucugcaccgg

SEQ ID NO: 1722791 - RNA, 23 nt, Salmonella enterica enterica serovar Typhi
cauuugcgacaucagccagccgc

SEQ ID NO: 1722792 - RNA, 17 nt, Salmonella enterica enterica serovar Typhi
cauuugauuuguuuuuu

SEQ ID NO: 1722793 - RNA, 20 nt, Salmonella enterica enterica serovar Typhi
cauuuguuccucgaaacgcu

SEQ ID NO: 1722794 - RNA, 16 nt, Salmonella enterica enterica serovar Typhi
cauuuguacaaaaaau

SEQ ID NO: 1722795 - RNA, 19 nt, Salmonella enterica enterica serovar Typhi
cauuuguagcggcaacagc

SEQ ID NO: 1722796 - RNA, 22 nt, Salmonella enterica enterica serovar Typhi
cauuugucucuuacguugcauu

SEQ ID NO: 1722797 - RNA, 16 nt, Salmonella enterica enterica serovar Typhi
cauuuuauccaacagc

SEQ ID NO: 1722798 - RNA, 13 nt, Salmonella enterica enterica serovar Typhi
cauuuuaaaaaua

SEQ ID NO: 1722799 - RNA, 23 nt, Salmonella enterica enterica serovar Typhi
cauuuuaaauacaccaaacgaau

SEQ ID NO: 1722800 - RNA, 16 nt, Salmonella enterica enterica serovar Typhi
cauuucaggcaaaaaa

SEQ ID NO: 1722801 - RNA, 23 nt, Salmonella enterica enterica serovar Typhi
cauuucaaucgccaccacauuca

SEQ ID NO: 1722802 - RNA, 13 nt, Salmonella enterica enterica serovar Typhi
cauuucaaugcau

SEQ ID NO: 1722803 - RNA, 13 nt, Salmonella enterica enterica serovar Typhi
cauuucaaucgcc

SEQ ID NO: 1722804 - RNA, 12 nt, Salmonella enterica enterica serovar Typhi
cauuucaagcag

SEQ ID NO: 1722805 - RNA, 15 nt, Salmonella enterica enterica serovar Typhi
cauuuauguuugccc

SEQ ID NO: 1722806 - RNA, 21 nt, Salmonella enterica enterica serovar Typhi
cauuuauggguuccaguugca

SEQ ID NO: 1722807 - RNA, 17 nt, Salmonella enterica enterica serovar Typhi
cauuucaggcacuggcu

SEQ ID NO: 1722808 - RNA, 14 nt, Salmonella enterica enterica serovar Typhi
cauuucagucuaau

SEQ ID NO: 1722809 - RNA, 12 nt, Salmonella enterica enterica serovar Typhi
cauuucaugacc

SEQ ID NO: 1722810 - RNA, 23 nt, Salmonella enterica enterica serovar Typhi
cauuucaucuaucugcuucuggc

SEQ ID NO: 1722811 - RNA, 14 nt, Salmonella enterica enterica serovar Typhi
cauuuccgcagcca

SEQ ID NO: 1722812 - RNA, 14 nt, Salmonella enterica enterica serovar Typhi
cauuuccggcgcgc

SEQ ID NO: 1722813 - RNA, 13 nt, Salmonella enterica enterica serovar Typhi
cauuuccucugcg

SEQ ID NO: 1722814 - RNA, 17 nt, Salmonella enterica enterica serovar Typhi
cauuuccugcauuaacg

SEQ ID NO: 1722815 - RNA, 15 nt, Salmonella enterica enterica serovar Typhi
cauuucgaucuguuu

SEQ ID NO: 1722816 - RNA, 19 nt, Salmonella enterica enterica serovar Typhi
ccagcuuguuauccaucag

SEQ ID NO: 1722817 - RNA, 14 nt, Salmonella enterica enterica serovar Typhi
ccagcuucgccccg

SEQ ID NO: 1722818 - RNA, 16 nt, Salmonella enterica enterica serovar Typhi
ccagcuucgccccggc

SEQ ID NO: 1722819 - RNA, 23 nt, Salmonella enterica enterica serovar Typhi
ccaggacaacgccgguacgcagc

SEQ ID NO: 1722820 - RNA, 23 nt, Salmonella enterica enterica serovar Typhi
ccaggaaguaaauuauuccuuga

SEQ ID NO: 1722821 - RNA, 21 nt, Salmonella enterica enterica serovar Typhi
ccaggaagaguaucucucugg

SEQ ID NO: 1722822 - RNA, 16 nt, Salmonella enterica enterica serovar Typhi
ccagcucuacaucgcc

SEQ ID NO: 1722823 - RNA, 20 nt, Salmonella enterica enterica serovar Typhi
ccagcucuacaucgccgcga

SEQ ID NO: 1722824 - RNA, 19 nt, Salmonella enterica enterica serovar Typhi
ccagcugacgacgccagcc

SEQ ID NO: 1722825 - RNA, 21 nt, Salmonella enterica enterica serovar Typhi
ccagcugacgacgccagcccu

SEQ ID NO: 1722826 - RNA, 12 nt, Salmonella enterica enterica serovar Typhi
ccagcugacgac

SEQ ID NO: 1722827 - RNA, 13 nt, Salmonella enterica enterica serovar Typhi
ccagcucugccgg

SEQ ID NO: 1722828 - RNA, 13 nt, Salmonella enterica enterica serovar Typhi
ccagcuuaucuga

SEQ ID NO: 1722829 - RNA, 22 nt, Salmonella enterica enterica serovar Typhi
ccaggcaaaugauuaucuccau

SEQ ID NO: 1722830 - RNA, 21 nt, Salmonella enterica enterica serovar Typhi
ccaggcaaagauccaccagau

SEQ ID NO: 1722831 - RNA, 13 nt, Salmonella enterica enterica serovar Typhi
ccaggcaaagccc

SEQ ID NO: 1722832 - RNA, 19 nt, Salmonella enterica enterica serovar Typhi
ccaggcaaagccccaguca

SEQ ID NO: 1722833 - RNA, 17 nt, Salmonella enterica enterica serovar Typhi
ccaggcaaucagcagcc

SEQ ID NO: 1722834 - RNA, 19 nt, Salmonella enterica enterica serovar Typhi
ccaggcaaugccccgccgc

SEQ ID NO: 1722835 - RNA, 14 nt, Salmonella enterica enterica serovar Typhi
ccaggcacugcagg

SEQ ID NO: 1722836 - RNA, 20 nt, Salmonella enterica enterica serovar Typhi
ccaggcagcaccucaauaug

SEQ ID NO: 1722837 - RNA, 19 nt, Salmonella enterica enterica serovar Typhi
ccaggcagauccaaauggc

SEQ ID NO: 1722838 - RNA, 16 nt, Salmonella enterica enterica serovar Typhi
ccaggcacuugagaaa

SEQ ID NO: 1722839 - RNA, 15 nt, Salmonella enterica enterica serovar Typhi
ccaggccagauggcu

SEQ ID NO: 1722840 - RNA, 13 nt, Salmonella enterica enterica serovar Typhi
ccaggccaucaga

SEQ ID NO: 1722841 - RNA, 13 nt, Salmonella enterica enterica serovar Typhi
ccaggcauagaaa

SEQ ID NO: 1722842 - RNA, 16 nt, Salmonella enterica enterica serovar Typhi
ccaggcauaaaaaaag

SEQ ID NO: 1722843 - RNA, 21 nt, Salmonella enterica enterica serovar Typhi
ccaggcauagaaaaagaacug

SEQ ID NO: 1722844 - RNA, 19 nt, Salmonella enterica enterica serovar Typhi
ccaggcagcguggcgagcu

SEQ ID NO: 1722845 - RNA, 11 nt, Salmonella enterica enterica serovar Typhi
ccaggcauccg

SEQ ID NO: 1722846 - RNA, 20 nt, Salmonella enterica enterica serovar Typhi
ccaggcaucgacgccagcgg

SEQ ID NO: 1722847 - RNA, 15 nt, Salmonella enterica enterica serovar Typhi
ccaggagcauuggaa

SEQ ID NO: 1722848 - RNA, 13 nt, Salmonella enterica enterica serovar Typhi
ccaggaucgccgc

SEQ ID NO: 1722849 - RNA, 15 nt, Salmonella enterica enterica serovar Typhi
ccaggaucgccgccg

SEQ ID NO: 1722850 - RNA, 19 nt, Salmonella enterica enterica serovar Typhi
ccaggaugccaaccaccgc

SEQ ID NO: 1722851 - RNA, 20 nt, Salmonella enterica enterica serovar Typhi
ccaggauggccagcaccagc

SEQ ID NO: 1722852 - RNA, 22 nt, Salmonella enterica enterica serovar Typhi
ccaggcggcuuuuucaucaucg

SEQ ID NO: 1722853 - RNA, 20 nt, Salmonella enterica enterica serovar Typhi
ccaggcguaagaucccaggg

SEQ ID NO: 1722854 - RNA, 15 nt, Salmonella enterica enterica serovar Typhi
ccaggcguccaguug

SEQ ID NO: 1722855 - RNA, 20 nt, Salmonella enterica enterica serovar Typhi
ccaggcggauaaaacagaaa

SEQ ID NO: 1722856 - RNA, 20 nt, Salmonella enterica enterica serovar Typhi
ccaggcgcuauucccaggca

SEQ ID NO: 1722857 - RNA, 13 nt, Salmonella enterica enterica serovar Typhi
ccaggccugagcc

SEQ ID NO: 1722858 - RNA, 19 nt, Salmonella enterica enterica serovar Typhi
ccaggcgaaccccaugccg

SEQ ID NO: 1722859 - RNA, 18 nt, Salmonella enterica enterica serovar Typhi
ccaggccgccaccgccuc

SEQ ID NO: 1722860 - RNA, 15 nt, Salmonella enterica enterica serovar Typhi
ccaggccguggcgca

SEQ ID NO: 1722861 - RNA, 18 nt, Salmonella enterica enterica serovar Typhi
ccaggccggcauaaugau

SEQ ID NO: 1722862 - RNA, 20 nt, Salmonella enterica enterica serovar Typhi
ccagggcgggauccccugcu

SEQ ID NO: 1722863 - RNA, 18 nt, Salmonella enterica enterica serovar Typhi
ccagggggauccuuauuc

SEQ ID NO: 1722864 - RNA, 18 nt, Salmonella enterica enterica serovar Typhi
ccagggcugcuggccuuc

SEQ ID NO: 1722865 - RNA, 16 nt, Salmonella enterica enterica serovar Typhi
ccagguauuuagccac

SEQ ID NO: 1722866 - RNA, 18 nt, Salmonella enterica enterica serovar Typhi
ccaggcuauccagcucac

SEQ ID NO: 1722867 - RNA, 14 nt, Salmonella enterica enterica serovar Typhi
ccaggcuauccagc

SEQ ID NO: 1722868 - RNA, 18 nt, Salmonella enterica enterica serovar Typhi
ccagggcaucaugauguu

SEQ ID NO: 1722869 - RNA, 22 nt, Salmonella enterica enterica serovar Typhi
ccagggcaaauuaucccuuccu

SEQ ID NO: 1722870 - RNA, 14 nt, Salmonella enterica enterica serovar Typhi
ccagggagggccaa

SEQ ID NO: 1722871 - RNA, 20 nt, Salmonella enterica enterica serovar Typhi
ccagggauugauggccagcc

SEQ ID NO: 1722872 - RNA, 23 nt, Salmonella enterica enterica serovar Typhi
ccagggauugauggccagccccu

SEQ ID NO: 1722873 - RNA, 21 nt, Salmonella enterica enterica serovar Typhi
ccaggcuuuaaauucagcacc

SEQ ID NO: 1722874 - RNA, 22 nt, Salmonella enterica enterica serovar Typhi
ccaggcuuccugcgcugucacc

SEQ ID NO: 1722875 - RNA, 21 nt, Salmonella enterica enterica serovar Typhi
ccaggcuuuaguuuccgguaa

SEQ ID NO: 1722876 - RNA, 23 nt, Salmonella enterica enterica serovar Typhi
ccagcgauuuuuacgccauucau

SEQ ID NO: 1722877 - RNA, 22 nt, Salmonella enterica enterica serovar Typhi
ccagcgcaaagggacacucaag

SEQ ID NO: 1722878 - RNA, 15 nt, Salmonella enterica enterica serovar Typhi
ccagcgcagucaaaa

SEQ ID NO: 1722879 - RNA, 13 nt, Salmonella enterica enterica serovar Typhi
ccagcgccagccg

SEQ ID NO: 1722880 - RNA, 17 nt, Salmonella enterica enterica serovar Typhi
ccagcgaugagcgccag

SEQ ID NO: 1722881 - RNA, 16 nt, Salmonella enterica enterica serovar Typhi
ccagcgauuauuucau

SEQ ID NO: 1722882 - RNA, 18 nt, Salmonella enterica enterica serovar Typhi
ccagcgaucccaguugau

SEQ ID NO: 1722883 - RNA, 19 nt, Salmonella enterica enterica serovar Typhi
ccagcgagaugaaaaguca

SEQ ID NO: 1722884 - RNA, 20 nt, Salmonella enterica enterica serovar Typhi
ccagcgacgguaauaccaac

SEQ ID NO: 1722885 - RNA, 13 nt, Salmonella enterica enterica serovar Typhi
ccagcgccgcgcg

SEQ ID NO: 1722886 - RNA, 22 nt, Salmonella enterica enterica serovar Typhi
ccagcgccggauaauccagaca

SEQ ID NO: 1722887 - RNA, 18 nt, Salmonella enterica enterica serovar Typhi
ccagcgccgcgacaagca

SEQ ID NO: 1722888 - RNA, 12 nt, Salmonella enterica enterica serovar Typhi
ccagcgccgcga

SEQ ID NO: 1722889 - RNA, 21 nt, Salmonella enterica enterica serovar Typhi
ccagcgccugcuguaaaauau

SEQ ID NO: 1722890 - RNA, 20 nt, Salmonella enterica enterica serovar Typhi
ccagcgccugcgcugcaaua

SEQ ID NO: 1722891 - RNA, 16 nt, Salmonella enterica enterica serovar Typhi
ccagcgcgaauuugcc

SEQ ID NO: 1722892 - RNA, 24 nt, Salmonella enterica enterica serovar Typhi
ccagcgcgaauuugccccagauac

SEQ ID NO: 1722893 - RNA, 14 nt, Salmonella enterica enterica serovar Typhi
ccagcgcccgcuuc

SEQ ID NO: 1722894 - RNA, 14 nt, Salmonella enterica enterica serovar Typhi
ccagcgccagcgcc

SEQ ID NO: 1722895 - RNA, 14 nt, Salmonella enterica enterica serovar Typhi
ccagcgccagcucc

SEQ ID NO: 1722896 - RNA, 14 nt, Salmonella enterica enterica serovar Typhi
ccagcgccaggcca

SEQ ID NO: 1722897 - RNA, 21 nt, Salmonella enterica enterica serovar Typhi
ccagcgccgagaaaaucagug

SEQ ID NO: 1722898 - RNA, 12 nt, Salmonella enterica enterica serovar Typhi
ccagcgccgccu

SEQ ID NO: 1722899 - RNA, 18 nt, Salmonella enterica enterica serovar Typhi
ccagcgccgccagaauca

SEQ ID NO: 1722900 - RNA, 14 nt, Salmonella enterica enterica serovar Typhi
ccacugcacauccc

SEQ ID NO: 1722901 - RNA, 17 nt, Salmonella enterica enterica serovar Typhi
ccagccgggcaggaaaa

SEQ ID NO: 1722902 - RNA, 20 nt, Salmonella enterica enterica serovar Typhi
ccacugauaguccaucaccu

SEQ ID NO: 1722903 - RNA, 22 nt, Salmonella enterica enterica serovar Typhi
ccacugauaguccaucaccucu

SEQ ID NO: 1722904 - RNA, 22 nt, Salmonella enterica enterica serovar Typhi
ccacucggcgagcaguacgccu

SEQ ID NO: 1722905 - RNA, 16 nt, Salmonella enterica enterica serovar Typhi
ccacuccggugcccau

SEQ ID NO: 1722906 - RNA, 18 nt, Salmonella enterica enterica serovar Typhi
ccacuccguguugcugcc

SEQ ID NO: 1722907 - RNA, 22 nt, Salmonella enterica enterica serovar Typhi
ccacuccuuacgguaaagcgua

SEQ ID NO: 1722908 - RNA, 15 nt, Salmonella enterica enterica serovar Typhi
ccagccucucccagc

SEQ ID NO: 1722909 - RNA, 15 nt, Salmonella enterica enterica serovar Typhi
ccagccugccugccu

SEQ ID NO: 1722910 - RNA, 16 nt, Salmonella enterica enterica serovar Typhi
ccagccuaccugccgc

SEQ ID NO: 1722911 - RNA, 18 nt, Salmonella enterica enterica serovar Typhi
ccagccguucaccagcca

SEQ ID NO: 1722912 - RNA, 20 nt, Salmonella enterica enterica serovar Typhi
ccagccguugugcugguuga

SEQ ID NO: 1722913 - RNA, 16 nt, Salmonella enterica enterica serovar Typhi
ccagccugucgggcca

SEQ ID NO: 1722914 - RNA, 15 nt, Salmonella enterica enterica serovar Typhi
ccagcgaaaaccagc

SEQ ID NO: 1722915 - RNA, 23 nt, Salmonella enterica enterica serovar Typhi
ccagcgaaaugacggccaccagc

SEQ ID NO: 1722916 - RNA, 13 nt, Salmonella enterica enterica serovar Typhi
ccagcgaauaaug

SEQ ID NO: 1722917 - RNA, 14 nt, Salmonella enterica enterica serovar Typhi
ccagcgaauaauga

SEQ ID NO: 1722918 - RNA, 13 nt, Salmonella enterica enterica serovar Typhi
ccagcgacaguag

SEQ ID NO: 1722919 - RNA, 23 nt, Salmonella enterica enterica serovar Typhi
ccagcgacaguaguaucauccau

SEQ ID NO: 1722920 - RNA, 14 nt, Salmonella enterica enterica serovar Typhi
ccagcgacggccag

SEQ ID NO: 1722921 - RNA, 21 nt, Salmonella enterica enterica serovar Typhi
ccagcgacggcguauucggca

SEQ ID NO: 1722922 - RNA, 19 nt, Salmonella enterica enterica serovar Typhi
ccagcgacgguaauaccaa

SEQ ID NO: 1722923 - RNA, 17 nt, Salmonella enterica enterica serovar Typhi
ccagcgugacccagaca

SEQ ID NO: 1722924 - RNA, 19 nt, Salmonella enterica enterica serovar Typhi
ccagcgugccgagcaacag

SEQ ID NO: 1722925 - RNA, 23 nt, Salmonella enterica enterica serovar Typhi
ccagcgugccgagcaacagaaac

SEQ ID NO: 1722926 - RNA, 22 nt, Salmonella enterica enterica serovar Typhi
ccagcgucgucauagcguugau

SEQ ID NO: 1722927 - RNA, 21 nt, Salmonella enterica enterica serovar Typhi
ccagcguacguaacuucuugg

SEQ ID NO: 1722928 - RNA, 20 nt, Salmonella enterica enterica serovar Typhi
ccagcguagcuaaacccgua

SEQ ID NO: 1722929 - RNA, 15 nt, Salmonella enterica enterica serovar Typhi
ccagcguaagcgccc

SEQ ID NO: 1722930 - RNA, 15 nt, Salmonella enterica enterica serovar Typhi
ccagcucauuuuuac

SEQ ID NO: 1722931 - RNA, 18 nt, Salmonella enterica enterica serovar Typhi
ccagcuccauccaccagc

SEQ ID NO: 1722932 - RNA, 15 nt, Salmonella enterica enterica serovar Typhi
ccagcuccauagaaa

SEQ ID NO: 1722933 - RNA, 16 nt, Salmonella enterica enterica serovar Typhi
ccagcuccauccacca

SEQ ID NO: 1722934 - RNA, 22 nt, Salmonella enterica enterica serovar Typhi
ccagcucgcgcaguuccagcgg

SEQ ID NO: 1722935 - RNA, 22 nt, Salmonella enterica enterica serovar Typhi
ccagcucaaaugacgaauaccg

SEQ ID NO: 1722936 - RNA, 16 nt, Salmonella enterica enterica serovar Typhi
ccagcuacaccugggc

SEQ ID NO: 1722937 - RNA, 14 nt, Salmonella enterica enterica serovar Typhi
ccagcucaacgccu

SEQ ID NO: 1722938 - RNA, 14 nt, Salmonella enterica enterica serovar Typhi
ccagcucaccagcc

SEQ ID NO: 1722939 - RNA, 18 nt, Salmonella enterica enterica serovar Typhi
ccagcucaggguccccau

SEQ ID NO: 1722940 - RNA, 16 nt, Salmonella enterica enterica serovar Typhi
ccagcguugaccagcc

SEQ ID NO: 1722941 - RNA, 18 nt, Salmonella enterica enterica serovar Typhi
ccagcuacuggccacgga

SEQ ID NO: 1722942 - RNA, 18 nt, Salmonella enterica enterica serovar Typhi
ccagcgcuauccaggccg

SEQ ID NO: 1722943 - RNA, 22 nt, Salmonella enterica enterica serovar Typhi
ccagcgcuucuguuaaaaaauu

SEQ ID NO: 1722944 - RNA, 17 nt, Salmonella enterica enterica serovar Typhi
ccagcgcuucuguuaaa

SEQ ID NO: 1722945 - RNA, 22 nt, Salmonella enterica enterica serovar Typhi
ccagcggaauauucgcuucuuc

SEQ ID NO: 1722946 - RNA, 19 nt, Salmonella enterica enterica serovar Typhi
ccagcggaauccccgccgc

SEQ ID NO: 1722947 - RNA, 19 nt, Salmonella enterica enterica serovar Typhi
ccagcggcgacaguaacug

SEQ ID NO: 1722948 - RNA, 14 nt, Salmonella enterica enterica serovar Typhi
ccagcggcccgcgc

SEQ ID NO: 1722949 - RNA, 22 nt, Salmonella enterica enterica serovar Typhi
ccagcggaugucggucaucagg

SEQ ID NO: 1722950 - RNA, 23 nt, Salmonella enterica enterica serovar Typhi
ccagcggcaaaggcauggcaggu

SEQ ID NO: 1722951 - RNA, 14 nt, Salmonella enterica enterica serovar Typhi
ccagcggccagcca

SEQ ID NO: 1722952 - RNA, 15 nt, Salmonella enterica enterica serovar Typhi
ccagcggccagccau

SEQ ID NO: 1722953 - RNA, 20 nt, Salmonella enterica enterica serovar Typhi
ccagcgguaugcaccucuuu

SEQ ID NO: 1722954 - RNA, 16 nt, Salmonella enterica enterica serovar Typhi
ccaucaauccaacgaa

SEQ ID NO: 1722955 - RNA, 19 nt, Salmonella enterica enterica serovar Typhi
ccaucaacuucucgcaggc

SEQ ID NO: 1722956 - RNA, 13 nt, Salmonella enterica enterica serovar Typhi
ccauauaucugaa

SEQ ID NO: 1722957 - RNA, 14 nt, Salmonella enterica enterica serovar Typhi
ccauauauuuacug

SEQ ID NO: 1722958 - RNA, 20 nt, Salmonella enterica enterica serovar Typhi
ccauauauuuacugaauaaa

SEQ ID NO: 1722959 - RNA, 20 nt, Salmonella enterica enterica serovar Typhi
ccauaagcuuaggauaagaa

SEQ ID NO: 1722960 - RNA, 18 nt, Salmonella enterica enterica serovar Typhi
ccauauaacagaauaagc

SEQ ID NO: 1722961 - RNA, 13 nt, Salmonella enterica enterica serovar Typhi
ccauacuuugcau

SEQ ID NO: 1722962 - RNA, 15 nt, Salmonella enterica enterica serovar Typhi
ccaguuucaaugccc

SEQ ID NO: 1722963 - RNA, 18 nt, Salmonella enterica enterica serovar Typhi
ccaguuucaaugcccagg

SEQ ID NO: 1722964 - RNA, 16 nt, Salmonella enterica enterica serovar Typhi
ccaguuguucuuucac

SEQ ID NO: 1722965 - RNA, 22 nt, Salmonella enterica enterica serovar Typhi
ccaguuguuuauuccauucauc

SEQ ID NO: 1722966 - RNA, 22 nt, Salmonella enterica enterica serovar Typhi
ccaguucggcgauuuccagcgc

SEQ ID NO: 1722967 - RNA, 17 nt, Salmonella enterica enterica serovar Typhi
ccaguucuggcugcgcu

SEQ ID NO: 1722968 - RNA, 12 nt, Salmonella enterica enterica serovar Typhi
ccauaaaugaaa

SEQ ID NO: 1722969 - RNA, 13 nt, Salmonella enterica enterica serovar Typhi
ccauaaaggccuc

SEQ ID NO: 1722970 - RNA, 19 nt, Salmonella enterica enterica serovar Typhi
ccaguuuccugacccgcuc

SEQ ID NO: 1722971 - RNA, 21 nt, Salmonella enterica enterica serovar Typhi
ccaguuucucaaacacuucua

SEQ ID NO: 1722972 - RNA, 22 nt, Salmonella enterica enterica serovar Typhi
ccaguuucugacguaacuuauc

SEQ ID NO: 1722973 - RNA, 19 nt, Salmonella enterica enterica serovar Typhi
ccaguuugcguucacagca

SEQ ID NO: 1722974 - RNA, 20 nt, Salmonella enterica enterica serovar Typhi
ccaguuugcguucacagcac

SEQ ID NO: 1722975 - RNA, 21 nt, Salmonella enterica enterica serovar Typhi
ccaguuugcguucacagcacc

SEQ ID NO: 1722976 - RNA, 15 nt, Salmonella enterica enterica serovar Typhi
ccaguguuguucucu

SEQ ID NO: 1722977 - RNA, 20 nt, Salmonella enterica enterica serovar Typhi
ccagugguuccauuccagaa

SEQ ID NO: 1722978 - RNA, 16 nt, Salmonella enterica enterica serovar Typhi
ccaggucgcccagcca

SEQ ID NO: 1722979 - RNA, 23 nt, Salmonella enterica enterica serovar Typhi
ccaggucggcuuuuuuuuaugcc

SEQ ID NO: 1722980 - RNA, 19 nt, Salmonella enterica enterica serovar Typhi
ccaucucauucgccagcgg

SEQ ID NO: 1722981 - RNA, 16 nt, Salmonella enterica enterica serovar Typhi
ccaucuccggcagcgu

SEQ ID NO: 1722982 - RNA, 14 nt, Salmonella enterica enterica serovar Typhi
ccaucuccaucauu

SEQ ID NO: 1722983 - RNA, 14 nt, Salmonella enterica enterica serovar Typhi
ccaugauucauccc

SEQ ID NO: 1722984 - RNA, 22 nt, Salmonella enterica enterica serovar Typhi
ccaugaugggcaagcguagucc

SEQ ID NO: 1722985 - RNA, 22 nt, Salmonella enterica enterica serovar Typhi
ccaugaucgauagcgacggcgc

SEQ ID NO: 1722986 - RNA, 11 nt, Salmonella enterica enterica serovar Typhi
ccaugccuuug

SEQ ID NO: 1722987 - RNA, 15 nt, Salmonella enterica enterica serovar Typhi
ccaugccuuuauuuc

SEQ ID NO: 1722988 - RNA, 12 nt, Salmonella enterica enterica serovar Typhi
ccaugcaaaaaa

SEQ ID NO: 1722989 - RNA, 17 nt, Salmonella enterica enterica serovar Typhi
ccaugcaaaaugcuucu

SEQ ID NO: 1722990 - RNA, 13 nt, Salmonella enterica enterica serovar Typhi
ccaucuucacgca

SEQ ID NO: 1722991 - RNA, 12 nt, Salmonella enterica enterica serovar Typhi
ccaucuuccuca

SEQ ID NO: 1722992 - RNA, 18 nt, Salmonella enterica enterica serovar Typhi
ccaugauccguucgauca

SEQ ID NO: 1722993 - RNA, 23 nt, Salmonella enterica enterica serovar Typhi
ccaucacguuggggaauaaauau

SEQ ID NO: 1722994 - RNA, 13 nt, Salmonella enterica enterica serovar Typhi
ccaucagcaccuu

SEQ ID NO: 1722995 - RNA, 15 nt, Salmonella enterica enterica serovar Typhi
ccaucaccgccaguc

SEQ ID NO: 1722996 - RNA, 14 nt, Salmonella enterica enterica serovar Typhi
ccaucaccucuucg

SEQ ID NO: 1722997 - RNA, 22 nt, Salmonella enterica enterica serovar Typhi
ccaucaggcaaucuuuaacgcu

SEQ ID NO: 1722998 - RNA, 16 nt, Salmonella enterica enterica serovar Typhi
ccaucaggcacaaugc

SEQ ID NO: 1722999 - RNA, 20 nt, Salmonella enterica enterica serovar Typhi
ccaucagcgccagcccugcg

SEQ ID NO: 1723000 - RNA, 17 nt, Salmonella enterica enterica serovar Typhi
ccaucagcgccagcccu

SEQ ID NO: 1723001 - RNA, 21 nt, Salmonella enterica enterica serovar Typhi
ccaucagcaaaauaccggcag

SEQ ID NO: 1723002 - RNA, 17 nt, Salmonella enterica enterica serovar Typhi
ccaucccagguuauuca

SEQ ID NO: 1723003 - RNA, 22 nt, Salmonella enterica enterica serovar Typhi
ccaucccagguuauucaggugg

SEQ ID NO: 1723004 - RNA, 15 nt, Salmonella enterica enterica serovar Typhi
ccaucauucaacgca

SEQ ID NO: 1723005 - RNA, 14 nt, Salmonella enterica enterica serovar Typhi
ccaucccccugccg

SEQ ID NO: 1723006 - RNA, 22 nt, Salmonella enterica enterica serovar Typhi
ccaucauggcuuucagauuagc

SEQ ID NO: 1723007 - RNA, 13 nt, Salmonella enterica enterica serovar Typhi
ccaucauuaauau

SEQ ID NO: 1723008 - RNA, 17 nt, Salmonella enterica enterica serovar Typhi
ccaucaugcccacaggc

SEQ ID NO: 1723009 - RNA, 22 nt, Salmonella enterica enterica serovar Typhi
ccaucaugcaagagucccagaa

SEQ ID NO: 1723010 - RNA, 15 nt, Salmonella enterica enterica serovar Typhi
ccaucaugcgccagg

SEQ ID NO: 1723011 - RNA, 22 nt, Salmonella enterica enterica serovar Typhi
aaacaagugcagaagcaauccu

SEQ ID NO: 1723012 - RNA, 18 nt, Salmonella enterica enterica serovar Typhi
cccaccuuuugcagcgcg

SEQ ID NO: 1723013 - RNA, 17 nt, Salmonella enterica enterica serovar Typhi
cccacgauacgccccug

SEQ ID NO: 1723014 - RNA, 14 nt, Salmonella enterica enterica serovar Typhi
cccacacaucacaa

SEQ ID NO: 1723015 - RNA, 22 nt, Salmonella enterica enterica serovar Typhi
cccacacaucacaaucuccaga

SEQ ID NO: 1723016 - RNA, 14 nt, Salmonella enterica enterica serovar Typhi
cccacaccacagcc

SEQ ID NO: 1723017 - RNA, 12 nt, Salmonella enterica enterica serovar Typhi
cccacagguagg

SEQ ID NO: 1723018 - RNA, 19 nt, Salmonella enterica enterica serovar Typhi
cccacagcuugccguagcg

SEQ ID NO: 1723019 - RNA, 13 nt, Salmonella enterica enterica serovar Typhi
cccaccagcgcca

SEQ ID NO: 1723020 - RNA, 15 nt, Salmonella enterica enterica serovar Typhi
cccaccagcgccagg

SEQ ID NO: 1723021 - RNA, 15 nt, Salmonella enterica enterica serovar Typhi
cccaccacgcagcca

SEQ ID NO: 1723022 - RNA, 14 nt, Salmonella enterica enterica serovar Typhi
cccacauuggcccc

SEQ ID NO: 1723023 - RNA, 15 nt, Salmonella enterica enterica serovar Typhi
cccacauguuggcau

SEQ ID NO: 1723024 - RNA, 16 nt, Salmonella enterica enterica serovar Typhi
cccagcaucccgcugg

SEQ ID NO: 1723025 - RNA, 19 nt, Salmonella enterica enterica serovar Typhi
cccagauauccgcgcucaa

SEQ ID NO: 1723026 - RNA, 20 nt, Salmonella enterica enterica serovar Typhi
cccagauaucagucugcaag

SEQ ID NO: 1723027 - RNA, 17 nt, Salmonella enterica enterica serovar Typhi
cccagacugugauggcg

SEQ ID NO: 1723028 - RNA, 20 nt, Salmonella enterica enterica serovar Typhi
cccagauaauagcugaaaag

SEQ ID NO: 1723029 - RNA, 21 nt, Salmonella enterica enterica serovar Typhi
cccagacggcgauacugcucc

SEQ ID NO: 1723030 - RNA, 15 nt, Salmonella enterica enterica serovar Typhi
cccacuauuuuucau

SEQ ID NO: 1723031 - RNA, 15 nt, Salmonella enterica enterica serovar Typhi
cccacugcacauccc

SEQ ID NO: 1723032 - RNA, 14 nt, Salmonella enterica enterica serovar Typhi
cccagacagcaaaa

SEQ ID NO: 1723033 - RNA, 13 nt, Salmonella enterica enterica serovar Typhi
cccacuguucaau

SEQ ID NO: 1723034 - RNA, 23 nt, Salmonella enterica enterica serovar Typhi
cccacgccagcagcucgccgacc

SEQ ID NO: 1723035 - RNA, 21 nt, Salmonella enterica enterica serovar Typhi
cccacgcaaaauggccugcug

SEQ ID NO: 1723036 - RNA, 19 nt, Salmonella enterica enterica serovar Typhi
cccacgcccgccaucgccg

SEQ ID NO: 1723037 - RNA, 24 nt, Salmonella enterica enterica serovar Typhi
cccacgccagcagcucgccgaccg

SEQ ID NO: 1723038 - RNA, 21 nt, Salmonella enterica enterica serovar Typhi
cccacggagaaaagcgaaaau

SEQ ID NO: 1723039 - RNA, 15 nt, Salmonella enterica enterica serovar Typhi
cccacgcuuuuuuau

SEQ ID NO: 1723040 - RNA, 19 nt, Salmonella enterica enterica serovar Typhi
cccacggagaaaagcgaaa

SEQ ID NO: 1723041 - RNA, 18 nt, Salmonella enterica enterica serovar Typhi
cccacgguacgacgcggc

SEQ ID NO: 1723042 - RNA, 22 nt, Salmonella enterica enterica serovar Typhi
ccauuuuuuuguccgucauuua

SEQ ID NO: 1723043 - RNA, 13 nt, Salmonella enterica enterica serovar Typhi
cccaaaauaauuc

SEQ ID NO: 1723044 - RNA, 11 nt, Salmonella enterica enterica serovar Typhi
ccauuucacaa

SEQ ID NO: 1723045 - RNA, 13 nt, Salmonella enterica enterica serovar Typhi
cccaaacaccaac

SEQ ID NO: 1723046 - RNA, 23 nt, Salmonella enterica enterica serovar Typhi
cccaaaggaaagguccggcccgc

SEQ ID NO: 1723047 - RNA, 20 nt, Salmonella enterica enterica serovar Typhi
cccaaauuaauuuauugacg

SEQ ID NO: 1723048 - RNA, 15 nt, Salmonella enterica enterica serovar Typhi
cccaaugcccccauc

SEQ ID NO: 1723049 - RNA, 15 nt, Salmonella enterica enterica serovar Typhi
cccaauugcugcuau

SEQ ID NO: 1723050 - RNA, 18 nt, Salmonella enterica enterica serovar Typhi
cccacaaucccgccagac

SEQ ID NO: 1723051 - RNA, 13 nt, Salmonella enterica enterica serovar Typhi
cccaauaccggcg

SEQ ID NO: 1723052 - RNA, 14 nt, Salmonella enterica enterica serovar Typhi
cccaaccagcccag

SEQ ID NO: 1723053 - RNA, 12 nt, Salmonella enterica enterica serovar Typhi
cccaaccagccc

SEQ ID NO: 1723054 - RNA, 16 nt, Salmonella enterica enterica serovar Typhi
cccaacaucaguucag

SEQ ID NO: 1723055 - RNA, 23 nt, Salmonella enterica enterica serovar Typhi
ccauuguugucauuguaaaaccg

SEQ ID NO: 1723056 - RNA, 16 nt, Salmonella enterica enterica serovar Typhi
ccauugaugccugccc

SEQ ID NO: 1723057 - RNA, 22 nt, Salmonella enterica enterica serovar Typhi
ccauucuuucgcguaaacacuc

SEQ ID NO: 1723058 - RNA, 21 nt, Salmonella enterica enterica serovar Typhi
ccauucccagcgcccccagca

SEQ ID NO: 1723059 - RNA, 13 nt, Salmonella enterica enterica serovar Typhi
ccauucuucaaca

SEQ ID NO: 1723060 - RNA, 18 nt, Salmonella enterica enterica serovar Typhi
ccauucagcuuauucguc

SEQ ID NO: 1723061 - RNA, 13 nt, Salmonella enterica enterica serovar Typhi
ccaugcuuucaau

SEQ ID NO: 1723062 - RNA, 16 nt, Salmonella enterica enterica serovar Typhi
ccaugcuuucaauaaa

SEQ ID NO: 1723063 - RNA, 13 nt, Salmonella enterica enterica serovar Typhi
ccaugcugguugg

SEQ ID NO: 1723064 - RNA, 23 nt, Salmonella enterica enterica serovar Typhi
ccaugcugucgucgacagcgccc

SEQ ID NO: 1723065 - RNA, 21 nt, Salmonella enterica enterica serovar Typhi
ccaugcugugugaccagcagu

SEQ ID NO: 1723066 - RNA, 21 nt, Salmonella enterica enterica serovar Typhi
ccaugcucauccaacugcgcc

SEQ ID NO: 1723067 - RNA, 13 nt, Salmonella enterica enterica serovar Typhi
cccgaaguggugg

SEQ ID NO: 1723068 - RNA, 19 nt, Salmonella enterica enterica serovar Typhi
cccgacaaaaccguucuga

SEQ ID NO: 1723069 - RNA, 13 nt, Salmonella enterica enterica serovar Typhi
cccgauagcgccg

SEQ ID NO: 1723070 - RNA, 14 nt, Salmonella enterica enterica serovar Typhi
cccgauacccgccc

SEQ ID NO: 1723071 - RNA, 13 nt, Salmonella enterica enterica serovar Typhi
cccgauacccuga

SEQ ID NO: 1723072 - RNA, 18 nt, Salmonella enterica enterica serovar Typhi
cccgauaaccgcguucau

SEQ ID NO: 1723073 - RNA, 23 nt, Salmonella enterica enterica serovar Typhi
ccccucaaacaggcugucugcca

SEQ ID NO: 1723074 - RNA, 14 nt, Salmonella enterica enterica serovar Typhi
ccccguucgacaac

SEQ ID NO: 1723075 - RNA, 17 nt, Salmonella enterica enterica serovar Typhi
ccccgguagccacaccc

SEQ ID NO: 1723076 - RNA, 18 nt, Salmonella enterica enterica serovar Typhi
ccccggucaacgcgccgc

SEQ ID NO: 1723077 - RNA, 22 nt, Salmonella enterica enterica serovar Typhi
ccccggucaacgcgccgccaac

SEQ ID NO: 1723078 - RNA, 20 nt, Salmonella enterica enterica serovar Typhi
ccccuguuccagggcuucca

SEQ ID NO: 1723079 - RNA, 21 nt, Salmonella enterica enterica serovar Typhi
ccccuggacgcgagccacagg

SEQ ID NO: 1723080 - RNA, 15 nt, Salmonella enterica enterica serovar Typhi
ccccugcuccugcca

SEQ ID NO: 1723081 - RNA, 12 nt, Salmonella enterica enterica serovar Typhi
cccgccugcugc

SEQ ID NO: 1723082 - RNA, 16 nt, Salmonella enterica enterica serovar Typhi
cccgccugagcgcgca

SEQ ID NO: 1723083 - RNA, 14 nt, Salmonella enterica enterica serovar Typhi
cccgccuccgucac

SEQ ID NO: 1723084 - RNA, 20 nt, Salmonella enterica enterica serovar Typhi
cccgccucggucaguauuuc

SEQ ID NO: 1723085 - RNA, 15 nt, Salmonella enterica enterica serovar Typhi
cccgccgcuggcggg

SEQ ID NO: 1723086 - RNA, 15 nt, Salmonella enterica enterica serovar Typhi
cccgccgcgcggccc

SEQ ID NO: 1723087 - RNA, 16 nt, Salmonella enterica enterica serovar Typhi
cccgccgcgcggcccc

SEQ ID NO: 1723088 - RNA, 16 nt, Salmonella enterica enterica serovar Typhi
cccgcccugcccgcca

SEQ ID NO: 1723089 - RNA, 22 nt, Salmonella enterica enterica serovar Typhi
cccgccgcggcgguuauccucc

SEQ ID NO: 1723090 - RNA, 23 nt, Salmonella enterica enterica serovar Typhi
cccgccgcgauguuugcucgcca

SEQ ID NO: 1723091 - RNA, 15 nt, Salmonella enterica enterica serovar Typhi
cccgauucgcaugaa

SEQ ID NO: 1723092 - RNA, 20 nt, Salmonella enterica enterica serovar Typhi
cccgauucgcaugaauucaa

SEQ ID NO: 1723093 - RNA, 20 nt, Salmonella enterica enterica serovar Typhi
cccgauguccgucuuuucug

SEQ ID NO: 1723094 - RNA, 21 nt, Salmonella enterica enterica serovar Typhi
cccgaugucgccacgccgccc

SEQ ID NO: 1723095 - RNA, 13 nt, Salmonella enterica enterica serovar Typhi
cccgcaggccugg

SEQ ID NO: 1723096 - RNA, 15 nt, Salmonella enterica enterica serovar Typhi
cccgcccagcauuac

SEQ ID NO: 1723097 - RNA, 20 nt, Salmonella enterica enterica serovar Typhi
ccccagaccgauauuuugcu

SEQ ID NO: 1723098 - RNA, 19 nt, Salmonella enterica enterica serovar Typhi
ccccagaaucccgccuugc

SEQ ID NO: 1723099 - RNA, 12 nt, Salmonella enterica enterica serovar Typhi
ccccagaaaauu

SEQ ID NO: 1723100 - RNA, 19 nt, Salmonella enterica enterica serovar Typhi
ccccacacggccaccauau

SEQ ID NO: 1723101 - RNA, 21 nt, Salmonella enterica enterica serovar Typhi
ccccagggagacggccaccca

SEQ ID NO: 1723102 - RNA, 15 nt, Salmonella enterica enterica serovar Typhi
ccccaugacggccug

SEQ ID NO: 1723103 - RNA, 18 nt, Salmonella enterica enterica serovar Typhi
cccagccagacgccagcc

SEQ ID NO: 1723104 - RNA, 21 nt, Salmonella enterica enterica serovar Typhi
cccagcaucccgcuggcgcca

SEQ ID NO: 1723105 - RNA, 16 nt, Salmonella enterica enterica serovar Typhi
cccauuccgccugccg

SEQ ID NO: 1723106 - RNA, 13 nt, Salmonella enterica enterica serovar Typhi
cccauuauugauc

SEQ ID NO: 1723107 - RNA, 18 nt, Salmonella enterica enterica serovar Typhi
cccauugaugccugccca

SEQ ID NO: 1723108 - RNA, 13 nt, Salmonella enterica enterica serovar Typhi
cccauucugcuga

SEQ ID NO: 1723109 - RNA, 17 nt, Salmonella enterica enterica serovar Typhi
ccccaaucuugcguacc

SEQ ID NO: 1723110 - RNA, 23 nt, Salmonella enterica enterica serovar Typhi
cccauuguucuuucauuuuaccu

SEQ ID NO: 1723111 - RNA, 13 nt, Salmonella enterica enterica serovar Typhi
ccccaaccgccag

SEQ ID NO: 1723112 - RNA, 14 nt, Salmonella enterica enterica serovar Typhi
ccccaugugccuug

SEQ ID NO: 1723113 - RNA, 18 nt, Salmonella enterica enterica serovar Typhi
cccccaacgucaccauca

SEQ ID NO: 1723114 - RNA, 19 nt, Salmonella enterica enterica serovar Typhi
ccccgaaagucaucugcca

SEQ ID NO: 1723115 - RNA, 22 nt, Salmonella enterica enterica serovar Typhi
ccccgacaaaaccguucugagc

SEQ ID NO: 1723116 - RNA, 17 nt, Salmonella enterica enterica serovar Typhi
ccccgacauucccaguc

SEQ ID NO: 1723117 - RNA, 20 nt, Salmonella enterica enterica serovar Typhi
ccccggcgagugccugcugg

SEQ ID NO: 1723118 - RNA, 11 nt, Salmonella enterica enterica serovar Typhi
ccccggccucg

SEQ ID NO: 1723119 - RNA, 22 nt, Salmonella enterica enterica serovar Typhi
ccccgggcgaccacccgcgacc

SEQ ID NO: 1723120 - RNA, 20 nt, Salmonella enterica enterica serovar Typhi
ccccggcuuuaugaugguga

SEQ ID NO: 1723121 - RNA, 13 nt, Salmonella enterica enterica serovar Typhi
ccccggcuugcgg

SEQ ID NO: 1723122 - RNA, 22 nt, Salmonella enterica enterica serovar Typhi
ccccggcagcuuuaaucuacca

SEQ ID NO: 1723123 - RNA, 13 nt, Salmonella enterica enterica serovar Typhi
ccccggcaccacg

SEQ ID NO: 1723124 - RNA, 15 nt, Salmonella enterica enterica serovar Typhi
ccccgccaccgccgc

SEQ ID NO: 1723125 - RNA, 17 nt, Salmonella enterica enterica serovar Typhi
ccccgacggccucuuca

SEQ ID NO: 1723126 - RNA, 11 nt, Salmonella enterica enterica serovar Typhi
ccccgccgcca

SEQ ID NO: 1723127 - RNA, 12 nt, Salmonella enterica enterica serovar Typhi
ccccgccccagc

SEQ ID NO: 1723128 - RNA, 14 nt, Salmonella enterica enterica serovar Typhi
cccgcuuuaccgaa

SEQ ID NO: 1723129 - RNA, 16 nt, Salmonella enterica enterica serovar Typhi
cccgcuggcgccaccg

SEQ ID NO: 1723130 - RNA, 21 nt, Salmonella enterica enterica serovar Typhi
cccgcuggcgcggggaucggu

SEQ ID NO: 1723131 - RNA, 13 nt, Salmonella enterica enterica serovar Typhi
cccgcugacgaug

SEQ ID NO: 1723132 - RNA, 15 nt, Salmonella enterica enterica serovar Typhi
cccgcuaucaccgcc

SEQ ID NO: 1723133 - RNA, 16 nt, Salmonella enterica enterica serovar Typhi
cccgcuaucaccgccc

SEQ ID NO: 1723134 - RNA, 21 nt, Salmonella enterica enterica serovar Typhi
cccggcaauuaccgccagcgg

SEQ ID NO: 1723135 - RNA, 18 nt, Salmonella enterica enterica serovar Typhi
cccggagggguuuucgcc

SEQ ID NO: 1723136 - RNA, 16 nt, Salmonella enterica enterica serovar Typhi
cccggacaaggcgcgc

SEQ ID NO: 1723137 - RNA, 17 nt, Salmonella enterica enterica serovar Typhi
cccggacaaggcgcgcc

SEQ ID NO: 1723138 - RNA, 20 nt, Salmonella enterica enterica serovar Typhi
cccggacguaccgcuuuauc

SEQ ID NO: 1723139 - RNA, 21 nt, Salmonella enterica enterica serovar Typhi
cccgcgauaaaaauccugcuc

SEQ ID NO: 1723140 - RNA, 15 nt, Salmonella enterica enterica serovar Typhi
cccgcgcagcgccag

SEQ ID NO: 1723141 - RNA, 22 nt, Salmonella enterica enterica serovar Typhi
cccgcgcagaaucacuucaucc

SEQ ID NO: 1723142 - RNA, 12 nt, Salmonella enterica enterica serovar Typhi
cccgcgccagca

SEQ ID NO: 1723143 - RNA, 13 nt, Salmonella enterica enterica serovar Typhi
cccgcgcucuccg

SEQ ID NO: 1723144 - RNA, 14 nt, Salmonella enterica enterica serovar Typhi
cccgcgcucuccgg

SEQ ID NO: 1723145 - RNA, 17 nt, Salmonella enterica enterica serovar Typhi
cccgcguuaagccccuc

SEQ ID NO: 1723146 - RNA, 23 nt, Salmonella enterica enterica serovar Typhi
cccgcgugcggacguagggcugc

SEQ ID NO: 1723147 - RNA, 17 nt, Salmonella enterica enterica serovar Typhi
cccggccacagcgccag

SEQ ID NO: 1723148 - RNA, 12 nt, Salmonella enterica enterica serovar Typhi
cccggcaggcau

SEQ ID NO: 1723149 - RNA, 22 nt, Salmonella enterica enterica serovar Typhi
cccggcagcuuuaaucuaccag

SEQ ID NO: 1723150 - RNA, 15 nt, Salmonella enterica enterica serovar Typhi
cccggcgcgacgccg

SEQ ID NO: 1723151 - RNA, 12 nt, Salmonella enterica enterica serovar Typhi
cccggcgcgcca

SEQ ID NO: 1723152 - RNA, 16 nt, Salmonella enterica enterica serovar Typhi
cccggcgccagcucaa

SEQ ID NO: 1723153 - RNA, 22 nt, Salmonella enterica enterica serovar Typhi
cccggccuucgaacagcucauu

SEQ ID NO: 1723154 - RNA, 14 nt, Salmonella enterica enterica serovar Typhi
cccggucgcgccag

SEQ ID NO: 1723155 - RNA, 17 nt, Salmonella enterica enterica serovar Typhi
cccggucugucgguaaa

SEQ ID NO: 1723156 - RNA, 22 nt, Salmonella enterica enterica serovar Typhi
cccgguucgccgcuucaaaaac

SEQ ID NO: 1723157 - RNA, 18 nt, Salmonella enterica enterica serovar Typhi
cccguaaugcccaggcgg

SEQ ID NO: 1723158 - RNA, 15 nt, Salmonella enterica enterica serovar Typhi
aaacacucuccacca

SEQ ID NO: 1723159 - RNA, 18 nt, Salmonella enterica enterica serovar Typhi
aaacacucuccaccaaau

SEQ ID NO: 1723160 - RNA, 21 nt, Salmonella enterica enterica serovar Typhi
cccggcggcgcgaugccugcc

SEQ ID NO: 1723161 - RNA, 15 nt, Salmonella enterica enterica serovar Typhi
cccggcguagcgcgc

SEQ ID NO: 1723162 - RNA, 21 nt, Salmonella enterica enterica serovar Typhi
cccggcggguauggcaaugcc

SEQ ID NO: 1723163 - RNA, 23 nt, Salmonella enterica enterica serovar Typhi
ccgauacaggacugacugcuguc

SEQ ID NO: 1723164 - RNA, 17 nt, Salmonella enterica enterica serovar Typhi
ccgauagcuaucacaca

SEQ ID NO: 1723165 - RNA, 15 nt, Salmonella enterica enterica serovar Typhi
ccgauagcggcgcag

SEQ ID NO: 1723166 - RNA, 12 nt, Salmonella enterica enterica serovar Typhi
ccgaucagauug

SEQ ID NO: 1723167 - RNA, 13 nt, Salmonella enterica enterica serovar Typhi
ccgaucagauuga

SEQ ID NO: 1723168 - RNA, 23 nt, Salmonella enterica enterica serovar Typhi
ccgauccgaagaacagauucauu

SEQ ID NO: 1723169 - RNA, 22 nt, Salmonella enterica enterica serovar Typhi
ccgaucgagucacccugcaaca

SEQ ID NO: 1723170 - RNA, 19 nt, Salmonella enterica enterica serovar Typhi
ccgaucucaugcaacuggc

SEQ ID NO: 1723171 - RNA, 16 nt, Salmonella enterica enterica serovar Typhi
ccgaugaaaaacugga

SEQ ID NO: 1723172 - RNA, 21 nt, Salmonella enterica enterica serovar Typhi
ccgaucugguuauccaccagc

SEQ ID NO: 1723173 - RNA, 21 nt, Salmonella enterica enterica serovar Typhi
ccgcaccuggguauuccacug

SEQ ID NO: 1723174 - RNA, 23 nt, Salmonella enterica enterica serovar Typhi
ccgcagcaaucagguauuuccug

SEQ ID NO: 1723175 - RNA, 18 nt, Salmonella enterica enterica serovar Typhi
ccgcaacggcuugugagc

SEQ ID NO: 1723176 - RNA, 20 nt, Salmonella enterica enterica serovar Typhi
ccgcaaauccacuggucguc

SEQ ID NO: 1723177 - RNA, 21 nt, Salmonella enterica enterica serovar Typhi
ccgcaaauucgucgccgccaa

SEQ ID NO: 1723178 - RNA, 20 nt, Salmonella enterica enterica serovar Typhi
ccgcaaaggaucaucggcca

SEQ ID NO: 1723179 - RNA, 17 nt, Salmonella enterica enterica serovar Typhi
ccgcaaccacggcgcag

SEQ ID NO: 1723180 - RNA, 20 nt, Salmonella enterica enterica serovar Typhi
ccgcaaaggaccaacaccag

SEQ ID NO: 1723181 - RNA, 21 nt, Salmonella enterica enterica serovar Typhi
ccgcaaacuggccacagcaaa

SEQ ID NO: 1723182 - RNA, 22 nt, Salmonella enterica enterica serovar Typhi
ccgcaaacgccgugaacgccaa

SEQ ID NO: 1723183 - RNA, 21 nt, Salmonella enterica enterica serovar Typhi
ccgcaaacggaauagcgccuu

SEQ ID NO: 1723184 - RNA, 16 nt, Salmonella enterica enterica serovar Typhi
ccgaugguauuuauuc

SEQ ID NO: 1723185 - RNA, 19 nt, Salmonella enterica enterica serovar Typhi
ccgaggacgggacuugaac

SEQ ID NO: 1723186 - RNA, 22 nt, Salmonella enterica enterica serovar Typhi
ccgauaaagcgaccgaucauca

SEQ ID NO: 1723187 - RNA, 21 nt, Salmonella enterica enterica serovar Typhi
ccgauaagcaagcgccaucgg

SEQ ID NO: 1723188 - RNA, 18 nt, Salmonella enterica enterica serovar Typhi
ccgauaaauucugucuca

SEQ ID NO: 1723189 - RNA, 21 nt, Salmonella enterica enterica serovar Typhi
ccgagguucaccagcgcgccg

SEQ ID NO: 1723190 - RNA, 15 nt, Salmonella enterica enterica serovar Typhi
ccgagguucaccagc

SEQ ID NO: 1723191 - RNA, 19 nt, Salmonella enterica enterica serovar Typhi
ccgagucuacaucaagaga

SEQ ID NO: 1723192 - RNA, 16 nt, Salmonella enterica enterica serovar Typhi
ccgacucugacgccgg

SEQ ID NO: 1723193 - RNA, 13 nt, Salmonella enterica enterica serovar Typhi
ccgagacugcccg

SEQ ID NO: 1723194 - RNA, 21 nt, Salmonella enterica enterica serovar Typhi
ccgagcgaaggggcgggcagc

SEQ ID NO: 1723195 - RNA, 23 nt, Salmonella enterica enterica serovar Typhi
ccgacggccucuucacgcagcgc

SEQ ID NO: 1723196 - RNA, 21 nt, Salmonella enterica enterica serovar Typhi
ccgacuaauuauuuuucaaau

SEQ ID NO: 1723197 - RNA, 19 nt, Salmonella enterica enterica serovar Typhi
ccgacuaccggcaccagca

SEQ ID NO: 1723198 - RNA, 17 nt, Salmonella enterica enterica serovar Typhi
ccgacuaauuauuuuuc

SEQ ID NO: 1723199 - RNA, 14 nt, Salmonella enterica enterica serovar Typhi
ccgacuaauuauuu

SEQ ID NO: 1723200 - RNA, 16 nt, Salmonella enterica enterica serovar Typhi
cccgucgccuguuucu

SEQ ID NO: 1723201 - RNA, 20 nt, Salmonella enterica enterica serovar Typhi
cccgucgccuguuucugcgc

SEQ ID NO: 1723202 - RNA, 14 nt, Salmonella enterica enterica serovar Typhi
cccugcaacgccug

SEQ ID NO: 1723203 - RNA, 15 nt, Salmonella enterica enterica serovar Typhi
cccugcaacgccugc

SEQ ID NO: 1723204 - RNA, 18 nt, Salmonella enterica enterica serovar Typhi
cccugcgaacagcgcucc

SEQ ID NO: 1723205 - RNA, 23 nt, Salmonella enterica enterica serovar Typhi
cccugcgaacagcgcuccacgcg

SEQ ID NO: 1723206 - RNA, 13 nt, Salmonella enterica enterica serovar Typhi
cccugcaucagcu

SEQ ID NO: 1723207 - RNA, 14 nt, Salmonella enterica enterica serovar Typhi
cccuggauugugau

SEQ ID NO: 1723208 - RNA, 22 nt, Salmonella enterica enterica serovar Typhi
cccuggauugugauuccaguug

SEQ ID NO: 1723209 - RNA, 19 nt, Salmonella enterica enterica serovar Typhi
cccuggcgcaguggcgggu

SEQ ID NO: 1723210 - RNA, 19 nt, Salmonella enterica enterica serovar Typhi
cccuggcucaauccaggug

SEQ ID NO: 1723211 - RNA, 21 nt, Salmonella enterica enterica serovar Typhi
cccuggcucaauccaggugga

SEQ ID NO: 1723212 - RNA, 14 nt, Salmonella enterica enterica serovar Typhi
cccuggcgcgccag

SEQ ID NO: 1723213 - RNA, 22 nt, Salmonella enterica enterica serovar Typhi
cccugcuugucgaucaucagac

SEQ ID NO: 1723214 - RNA, 16 nt, Salmonella enterica enterica serovar Typhi
cccugcuguuccagug

SEQ ID NO: 1723215 - RNA, 21 nt, Salmonella enterica enterica serovar Typhi
cccugcggauuacgaauaccg

SEQ ID NO: 1723216 - RNA, 18 nt, Salmonella enterica enterica serovar Typhi
cccugcgcuuucaaccac

SEQ ID NO: 1723217 - RNA, 19 nt, Salmonella enterica enterica serovar Typhi
cccugcggaaccgcccauc

SEQ ID NO: 1723218 - RNA, 21 nt, Salmonella enterica enterica serovar Typhi
cccugcgcuucuauccacugg

SEQ ID NO: 1723219 - RNA, 13 nt, Salmonella enterica enterica serovar Typhi
cccugcgcggccu

SEQ ID NO: 1723220 - RNA, 21 nt, Salmonella enterica enterica serovar Typhi
cccuucuuuuacugccccgcc

SEQ ID NO: 1723221 - RNA, 15 nt, Salmonella enterica enterica serovar Typhi
cccuucuuuuacugc

SEQ ID NO: 1723222 - RNA, 17 nt, Salmonella enterica enterica serovar Typhi
cccuucucgcuaauauc

SEQ ID NO: 1723223 - RNA, 23 nt, Salmonella enterica enterica serovar Typhi
cccuucuccgguaaucaccagau

SEQ ID NO: 1723224 - RNA, 18 nt, Salmonella enterica enterica serovar Typhi
cccuucuucuggcucaga

SEQ ID NO: 1723225 - RNA, 19 nt, Salmonella enterica enterica serovar Typhi
cccuucuuuaucuucugcu

SEQ ID NO: 1723226 - RNA, 20 nt, Salmonella enterica enterica serovar Typhi
cccuucuuuaugcgccuucu

SEQ ID NO: 1723227 - RNA, 16 nt, Salmonella enterica enterica serovar Typhi
cccuugccgcuuccag

SEQ ID NO: 1723228 - RNA, 22 nt, Salmonella enterica enterica serovar Typhi
cccuuguacaggauauacuuca

SEQ ID NO: 1723229 - RNA, 18 nt, Salmonella enterica enterica serovar Typhi
cccuuguuauccuaaauc

SEQ ID NO: 1723230 - RNA, 16 nt, Salmonella enterica enterica serovar Typhi
cccuuuacacguucca

SEQ ID NO: 1723231 - RNA, 20 nt, Salmonella enterica enterica serovar Typhi
cccuuuaggcggcgccgcgc

SEQ ID NO: 1723232 - RNA, 19 nt, Salmonella enterica enterica serovar Typhi
cccuuucgguucgccgcgc

SEQ ID NO: 1723233 - RNA, 19 nt, Salmonella enterica enterica serovar Typhi
cccuuucauucgucaaauu

SEQ ID NO: 1723234 - RNA, 14 nt, Salmonella enterica enterica serovar Typhi
cccuguucaaaagc

SEQ ID NO: 1723235 - RNA, 18 nt, Salmonella enterica enterica serovar Typhi
cccuguuccuguauuuga

SEQ ID NO: 1723236 - RNA, 14 nt, Salmonella enterica enterica serovar Typhi
cccuguucaaaaua

SEQ ID NO: 1723237 - RNA, 19 nt, Salmonella enterica enterica serovar Typhi
cccuucaugcagcccgcac

SEQ ID NO: 1723238 - RNA, 12 nt, Salmonella enterica enterica serovar Typhi
cccuucgcccuc

SEQ ID NO: 1723239 - RNA, 17 nt, Salmonella enterica enterica serovar Typhi
cccuucgcccucgccag

SEQ ID NO: 1723240 - RNA, 15 nt, Salmonella enterica enterica serovar Typhi
cccuuccucuccccc

SEQ ID NO: 1723241 - RNA, 23 nt, Salmonella enterica enterica serovar Typhi
cccuucgcuauccaucgccgcgc

SEQ ID NO: 1723242 - RNA, 16 nt, Salmonella enterica enterica serovar Typhi
cccuucgcuguccauu

SEQ ID NO: 1723243 - RNA, 16 nt, Salmonella enterica enterica serovar Typhi
cccuuccagacagcuu

SEQ ID NO: 1723244 - RNA, 23 nt, Salmonella enterica enterica serovar Typhi
cccuucccccagaaugccgccca

SEQ ID NO: 1723245 - RNA, 14 nt, Salmonella enterica enterica serovar Typhi
cccuucccaggugg

SEQ ID NO: 1723246 - RNA, 21 nt, Salmonella enterica enterica serovar Typhi
cccuuccagcagccagccguu

SEQ ID NO: 1723247 - RNA, 17 nt, Salmonella enterica enterica serovar Typhi
cccuuccccggcagccu

SEQ ID NO: 1723248 - RNA, 18 nt, Salmonella enterica enterica serovar Typhi
cccuuccgccacggcuuu

SEQ ID NO: 1723249 - RNA, 16 nt, Salmonella enterica enterica serovar Typhi
cccuucgaccgucagc

SEQ ID NO: 1723250 - RNA, 17 nt, Salmonella enterica enterica serovar Typhi
aaacagugaaaaaacgg

SEQ ID NO: 1723251 - RNA, 18 nt, Salmonella enterica enterica serovar Typhi
aaacaguuuugucaucag

SEQ ID NO: 1723252 - RNA, 16 nt, Salmonella enterica enterica serovar Typhi
ccgaacgcguccauga

SEQ ID NO: 1723253 - RNA, 13 nt, Salmonella enterica enterica serovar Typhi
aaaccacagugac

SEQ ID NO: 1723254 - RNA, 19 nt, Salmonella enterica enterica serovar Typhi
aaaccacaugaccagcgcc

SEQ ID NO: 1723255 - RNA, 13 nt, Salmonella enterica enterica serovar Typhi
aaaccaacagccg

SEQ ID NO: 1723256 - RNA, 21 nt, Salmonella enterica enterica serovar Typhi
aaaccaacaucgcugaauuuc

SEQ ID NO: 1723257 - RNA, 20 nt, Salmonella enterica enterica serovar Typhi
aaaccaauacgcauuagcuu

SEQ ID NO: 1723258 - RNA, 16 nt, Salmonella enterica enterica serovar Typhi
aaaccaaacaccagau

SEQ ID NO: 1723259 - RNA, 14 nt, Salmonella enterica enterica serovar Typhi
aaaccaaacagcga

SEQ ID NO: 1723260 - RNA, 23 nt, Salmonella enterica enterica serovar Typhi
aaaccaaacagcgacacauccug

SEQ ID NO: 1723261 - RNA, 19 nt, Salmonella enterica enterica serovar Typhi
ccgacaauauucgccgcga

SEQ ID NO: 1723262 - RNA, 20 nt, Salmonella enterica enterica serovar Typhi
ccgaauuugaaaaaaacauc

SEQ ID NO: 1723263 - RNA, 21 nt, Salmonella enterica enterica serovar Typhi
ccgacaaccccaaacaccaac

SEQ ID NO: 1723264 - RNA, 18 nt, Salmonella enterica enterica serovar Typhi
ccgaaugcguuuuuucac

SEQ ID NO: 1723265 - RNA, 15 nt, Salmonella enterica enterica serovar Typhi
ccugucaggcgagcg

SEQ ID NO: 1723266 - RNA, 14 nt, Salmonella enterica enterica serovar Typhi
ccuguauuaccuga

SEQ ID NO: 1723267 - RNA, 15 nt, Salmonella enterica enterica serovar Typhi
ccuguaucugcugac

SEQ ID NO: 1723268 - RNA, 15 nt, Salmonella enterica enterica serovar Typhi
ccuguccauugcgag

SEQ ID NO: 1723269 - RNA, 18 nt, Salmonella enterica enterica serovar Typhi
ccugucccuucgcccggc

SEQ ID NO: 1723270 - RNA, 18 nt, Salmonella enterica enterica serovar Typhi
ccuguaaccuuaaaaggc

SEQ ID NO: 1723271 - RNA, 16 nt, Salmonella enterica enterica serovar Typhi
ccuguaacaacuguuu

SEQ ID NO: 1723272 - RNA, 19 nt, Salmonella enterica enterica serovar Typhi
ccuguauacaggcauggcc

SEQ ID NO: 1723273 - RNA, 13 nt, Salmonella enterica enterica serovar Typhi
ccuguaaaaaauc

SEQ ID NO: 1723274 - RNA, 17 nt, Salmonella enterica enterica serovar Typhi
ccugguuuguccaaggc

SEQ ID NO: 1723275 - RNA, 19 nt, Salmonella enterica enterica serovar Typhi
ccuguaaaaaauccagcgu

SEQ ID NO: 1723276 - RNA, 19 nt, Salmonella enterica enterica serovar Typhi
ccuguaaacgcuucugcgc

SEQ ID NO: 1723277 - RNA, 17 nt, Salmonella enterica enterica serovar Typhi
ccuguaaaccgccucca

SEQ ID NO: 1723278 - RNA, 17 nt, Salmonella enterica enterica serovar Typhi
ccugcucuggacguuga

SEQ ID NO: 1723279 - RNA, 23 nt, Salmonella enterica enterica serovar Typhi
ccugcugcaacauugcaggucug

SEQ ID NO: 1723280 - RNA, 15 nt, Salmonella enterica enterica serovar Typhi
ccugguugacccgca

SEQ ID NO: 1723281 - RNA, 18 nt, Salmonella enterica enterica serovar Typhi
ccugcugccagccgccgc

SEQ ID NO: 1723282 - RNA, 21 nt, Salmonella enterica enterica serovar Typhi
ccugcugccagccgccgccgg

SEQ ID NO: 1723283 - RNA, 21 nt, Salmonella enterica enterica serovar Typhi
ccugucuauuguuuagacaga

SEQ ID NO: 1723284 - RNA, 17 nt, Salmonella enterica enterica serovar Typhi
ccugucugcgcaacgcu

SEQ ID NO: 1723285 - RNA, 22 nt, Salmonella enterica enterica serovar Typhi
ccugucugucaaaacccagccc

SEQ ID NO: 1723286 - RNA, 15 nt, Salmonella enterica enterica serovar Typhi
ccugucgucaccagc

SEQ ID NO: 1723287 - RNA, 16 nt, Salmonella enterica enterica serovar Typhi
ccugucguacgccuaa

SEQ ID NO: 1723288 - RNA, 16 nt, Salmonella enterica enterica serovar Typhi
ccugucguccucaggc

SEQ ID NO: 1723289 - RNA, 19 nt, Salmonella enterica enterica serovar Typhi
ccugucugucgcgggcgaa

SEQ ID NO: 1723290 - RNA, 15 nt, Salmonella enterica enterica serovar Typhi
ccugucuuaaagaaa

SEQ ID NO: 1723291 - RNA, 14 nt, Salmonella enterica enterica serovar Typhi
ccugucuccagcgc

SEQ ID NO: 1723292 - RNA, 13 nt, Salmonella enterica enterica serovar Typhi
ccugugccauacu

SEQ ID NO: 1723293 - RNA, 20 nt, Salmonella enterica enterica serovar Typhi
ccugugccauacuguuuauc

SEQ ID NO: 1723294 - RNA, 22 nt, Salmonella enterica enterica serovar Typhi
ccugugucguuucauccugaca

SEQ ID NO: 1723295 - RNA, 23 nt, Salmonella enterica enterica serovar Typhi
ccuguguuacgccaauaauauug

SEQ ID NO: 1723296 - RNA, 20 nt, Salmonella enterica enterica serovar Typhi
ccuguuagggcgcggcuggu

SEQ ID NO: 1723297 - RNA, 16 nt, Salmonella enterica enterica serovar Typhi
ccuguuauucaauucu

SEQ ID NO: 1723298 - RNA, 13 nt, Salmonella enterica enterica serovar Typhi
ccuguucaacaug

SEQ ID NO: 1723299 - RNA, 16 nt, Salmonella enterica enterica serovar Typhi
ccuguucaaaagccug

SEQ ID NO: 1723300 - RNA, 11 nt, Salmonella enterica enterica serovar Typhi
ccugugcuuug

SEQ ID NO: 1723301 - RNA, 16 nt, Salmonella enterica enterica serovar Typhi
ccuguuuaucugaugc

SEQ ID NO: 1723302 - RNA, 22 nt, Salmonella enterica enterica serovar Typhi
ccuguuucgccaggccgcggcu

SEQ ID NO: 1723303 - RNA, 15 nt, Salmonella enterica enterica serovar Typhi
ccuguuucgcccgcu

SEQ ID NO: 1723304 - RNA, 13 nt, Salmonella enterica enterica serovar Typhi
ccuguuuauauuc

SEQ ID NO: 1723305 - RNA, 20 nt, Salmonella enterica enterica serovar Typhi
ccuguuuuuucagcgcgccg

SEQ ID NO: 1723306 - RNA, 22 nt, Salmonella enterica enterica serovar Typhi
ccuguugcgggccagcagccag

SEQ ID NO: 1723307 - RNA, 21 nt, Salmonella enterica enterica serovar Typhi
ccuguucaaguggcaaucgac

SEQ ID NO: 1723308 - RNA, 20 nt, Salmonella enterica enterica serovar Typhi
ccuguuccagggcuuccaga

SEQ ID NO: 1723309 - RNA, 14 nt, Salmonella enterica enterica serovar Typhi
ccuguucgcuuauu

SEQ ID NO: 1723310 - RNA, 18 nt, Salmonella enterica enterica serovar Typhi
ccuugccagugaaaaaaa

SEQ ID NO: 1723311 - RNA, 22 nt, Salmonella enterica enterica serovar Typhi
ccuugaucaggaaaucuuccag

SEQ ID NO: 1723312 - RNA, 14 nt, Salmonella enterica enterica serovar Typhi
ccuucugcgcccgc

SEQ ID NO: 1723313 - RNA, 20 nt, Salmonella enterica enterica serovar Typhi
ccuugccgcuuccaguccag

SEQ ID NO: 1723314 - RNA, 19 nt, Salmonella enterica enterica serovar Typhi
ccuugcccuggaauuuuuc

SEQ ID NO: 1723315 - RNA, 15 nt, Salmonella enterica enterica serovar Typhi
ccuugcccgcgccag

SEQ ID NO: 1723316 - RNA, 13 nt, Salmonella enterica enterica serovar Typhi
ccuugcgaagacc

SEQ ID NO: 1723317 - RNA, 21 nt, Salmonella enterica enterica serovar Typhi
ccuugcgggcaugggaaauaa

SEQ ID NO: 1723318 - RNA, 19 nt, Salmonella enterica enterica serovar Typhi
ccuucccgcgauaaaaaca

SEQ ID NO: 1723319 - RNA, 15 nt, Salmonella enterica enterica serovar Typhi
ccuuccccggcagcc

SEQ ID NO: 1723320 - RNA, 23 nt, Salmonella enterica enterica serovar Typhi
ccuuccccggcagccucaggccu

SEQ ID NO: 1723321 - RNA, 19 nt, Salmonella enterica enterica serovar Typhi
ccuucccccagaaugccgc

SEQ ID NO: 1723322 - RNA, 12 nt, Salmonella enterica enterica serovar Typhi
ccuucgggcgau

SEQ ID NO: 1723323 - RNA, 14 nt, Salmonella enterica enterica serovar Typhi
ccuuccgccaccag

SEQ ID NO: 1723324 - RNA, 14 nt, Salmonella enterica enterica serovar Typhi
ccuucuccccuuca

SEQ ID NO: 1723325 - RNA, 16 nt, Salmonella enterica enterica serovar Typhi
ccuucuccgguaauca

SEQ ID NO: 1723326 - RNA, 11 nt, Salmonella enterica enterica serovar Typhi
ccuucuccuuc

SEQ ID NO: 1723327 - RNA, 15 nt, Salmonella enterica enterica serovar Typhi
ccuucgucaaaaugg

SEQ ID NO: 1723328 - RNA, 21 nt, Salmonella enterica enterica serovar Typhi
ccuucggugaaaucacgaccg

SEQ ID NO: 1723329 - RNA, 14 nt, Salmonella enterica enterica serovar Typhi
ccuucggugccaua

SEQ ID NO: 1723330 - RNA, 12 nt, Salmonella enterica enterica serovar Typhi
ccuuauaaugcu

SEQ ID NO: 1723331 - RNA, 17 nt, Salmonella enterica enterica serovar Typhi
ccuuauauuccgcgcau

SEQ ID NO: 1723332 - RNA, 19 nt, Salmonella enterica enterica serovar Typhi
ccuuaucaagccuacaccu

SEQ ID NO: 1723333 - RNA, 18 nt, Salmonella enterica enterica serovar Typhi
ccuuaggccgucagacau

SEQ ID NO: 1723334 - RNA, 15 nt, Salmonella enterica enterica serovar Typhi
ccuuaguaaaaccga

SEQ ID NO: 1723335 - RNA, 15 nt, Salmonella enterica enterica serovar Typhi
ccuuucuguucuuug

SEQ ID NO: 1723336 - RNA, 14 nt, Salmonella enterica enterica serovar Typhi
ccuuucugcgccag

SEQ ID NO: 1723337 - RNA, 11 nt, Salmonella enterica enterica serovar Typhi
ccuuugugauc

SEQ ID NO: 1723338 - RNA, 16 nt, Salmonella enterica enterica serovar Typhi
ccuuuucguacauguc

SEQ ID NO: 1723339 - RNA, 14 nt, Salmonella enterica enterica serovar Typhi
ccuuuuaacgcggu

SEQ ID NO: 1723340 - RNA, 20 nt, Salmonella enterica enterica serovar Typhi
ccuuuuuuauacuccagcag

SEQ ID NO: 1723341 - RNA, 17 nt, Salmonella enterica enterica serovar Typhi
ccuuuuuuauugccuga

SEQ ID NO: 1723342 - RNA, 22 nt, Salmonella enterica enterica serovar Typhi
ccuuuuugauccguuucagaaa

SEQ ID NO: 1723343 - RNA, 22 nt, Salmonella enterica enterica serovar Typhi
cgaaaacguugacuuaaaaagc

SEQ ID NO: 1723344 - RNA, 13 nt, Salmonella enterica enterica serovar Typhi
cgaaaaaagaugg

SEQ ID NO: 1723345 - RNA, 22 nt, Salmonella enterica enterica serovar Typhi
cgaaacaaccgucgauuuuaau

SEQ ID NO: 1723346 - RNA, 15 nt, Salmonella enterica enterica serovar Typhi
cgaaaauaucggccu

SEQ ID NO: 1723347 - RNA, 13 nt, Salmonella enterica enterica serovar Typhi
cgaaaaucgguaa

SEQ ID NO: 1723348 - RNA, 17 nt, Salmonella enterica enterica serovar Typhi
cgaaagaaacgccgacc

SEQ ID NO: 1723349 - RNA, 11 nt, Salmonella enterica enterica serovar Typhi
cgaaacucagc

SEQ ID NO: 1723350 - RNA, 13 nt, Salmonella enterica enterica serovar Typhi
cgaaacucagcgg

SEQ ID NO: 1723351 - RNA, 23 nt, Salmonella enterica enterica serovar Typhi
cgaaacgaaucucaucagacugu

SEQ ID NO: 1723352 - RNA, 20 nt, Salmonella enterica enterica serovar Typhi
cgaaaccggcggcgacuggc

SEQ ID NO: 1723353 - RNA, 19 nt, Salmonella enterica enterica serovar Typhi
cgaaacguccccugcgguu

SEQ ID NO: 1723354 - RNA, 15 nt, Salmonella enterica enterica serovar Typhi
cgaaaugaccaccgc

SEQ ID NO: 1723355 - RNA, 22 nt, Salmonella enterica enterica serovar Typhi
cgaaaugaccaccgcaucggca

SEQ ID NO: 1723356 - RNA, 18 nt, Salmonella enterica enterica serovar Typhi
cgaaaucagagacaaaua

SEQ ID NO: 1723357 - RNA, 13 nt, Salmonella enterica enterica serovar Typhi
cgaaaggaagcgg

SEQ ID NO: 1723358 - RNA, 23 nt, Salmonella enterica enterica serovar Typhi
cgaaaucaaagaccuccgcccgg

SEQ ID NO: 1723359 - RNA, 18 nt, Salmonella enterica enterica serovar Typhi
cgaaagucaucugccagu

SEQ ID NO: 1723360 - RNA, 19 nt, Salmonella enterica enterica serovar Typhi
cgaacgcccggugaucggu

SEQ ID NO: 1723361 - RNA, 20 nt, Salmonella enterica enterica serovar Typhi
cgaaccaucauuaauauaau

SEQ ID NO: 1723362 - RNA, 13 nt, Salmonella enterica enterica serovar Typhi
cgaacauuucagc

SEQ ID NO: 1723363 - RNA, 12 nt, Salmonella enterica enterica serovar Typhi
cgaacauuggaa

SEQ ID NO: 1723364 - RNA, 15 nt, Salmonella enterica enterica serovar Typhi
cgaacauucuuaugc

SEQ ID NO: 1723365 - RNA, 21 nt, Salmonella enterica enterica serovar Typhi
cgaaccacggcuucagcggcg

SEQ ID NO: 1723366 - RNA, 19 nt, Salmonella enterica enterica serovar Typhi
cgaacaguguaaacgccag

SEQ ID NO: 1723367 - RNA, 14 nt, Salmonella enterica enterica serovar Typhi
cgaacaacacggcg

SEQ ID NO: 1723368 - RNA, 12 nt, Salmonella enterica enterica serovar Typhi
cgaaauuuaaua

SEQ ID NO: 1723369 - RNA, 18 nt, Salmonella enterica enterica serovar Typhi
cgaaauuggaguuaucau

SEQ ID NO: 1723370 - RNA, 18 nt, Salmonella enterica enterica serovar Typhi
cgaaauuggccaucaggu

SEQ ID NO: 1723371 - RNA, 21 nt, Salmonella enterica enterica serovar Typhi
cgaacagaaaaaaugcaccgc

SEQ ID NO: 1723372 - RNA, 18 nt, Salmonella enterica enterica serovar Typhi
cgaacaggcucagcgcca

SEQ ID NO: 1723373 - RNA, 13 nt, Salmonella enterica enterica serovar Typhi
cgaacagcgcucc

SEQ ID NO: 1723374 - RNA, 21 nt, Salmonella enterica enterica serovar Typhi
cgaaggcuacugcgucgcgcg

SEQ ID NO: 1723375 - RNA, 16 nt, Salmonella enterica enterica serovar Typhi
cgaaggucagauccuu

SEQ ID NO: 1723376 - RNA, 18 nt, Salmonella enterica enterica serovar Typhi
cgaaggucagauccuuuu

SEQ ID NO: 1723377 - RNA, 16 nt, Salmonella enterica enterica serovar Typhi
cgaagggugaggagcu

SEQ ID NO: 1723378 - RNA, 23 nt, Salmonella enterica enterica serovar Typhi
cgaaggguagggauagcaucuuc

SEQ ID NO: 1723379 - RNA, 18 nt, Salmonella enterica enterica serovar Typhi
cgaagguuaccuacgguu

SEQ ID NO: 1723380 - RNA, 18 nt, Salmonella enterica enterica serovar Typhi
cgaauaaucaaccauaca

SEQ ID NO: 1723381 - RNA, 16 nt, Salmonella enterica enterica serovar Typhi
cgaauaaggaauggua

SEQ ID NO: 1723382 - RNA, 15 nt, Salmonella enterica enterica serovar Typhi
cgaagucgccacccg

SEQ ID NO: 1723383 - RNA, 23 nt, Salmonella enterica enterica serovar Typhi
cgaacggcuuuccagcagccaga

SEQ ID NO: 1723384 - RNA, 15 nt, Salmonella enterica enterica serovar Typhi
cgaacgcuccacugc

SEQ ID NO: 1723385 - RNA, 22 nt, Salmonella enterica enterica serovar Typhi
ccugacagagcucgucaaaaau

SEQ ID NO: 1723386 - RNA, 23 nt, Salmonella enterica enterica serovar Typhi
ccugacauuacccggccaggcgu

SEQ ID NO: 1723387 - RNA, 14 nt, Salmonella enterica enterica serovar Typhi
ccugacagaaauag

SEQ ID NO: 1723388 - RNA, 15 nt, Salmonella enterica enterica serovar Typhi
ccugacauagcucac

SEQ ID NO: 1723389 - RNA, 19 nt, Salmonella enterica enterica serovar Typhi
ccugaaugcucucauauuc

SEQ ID NO: 1723390 - RNA, 15 nt, Salmonella enterica enterica serovar Typhi
ccugaaucgccgcac

SEQ ID NO: 1723391 - RNA, 19 nt, Salmonella enterica enterica serovar Typhi
ccugaaucgccgcacguaa

SEQ ID NO: 1723392 - RNA, 21 nt, Salmonella enterica enterica serovar Typhi
ccugaauuucaauaaucccuu

SEQ ID NO: 1723393 - RNA, 18 nt, Salmonella enterica enterica serovar Typhi
ccugacgauaucgucacc

SEQ ID NO: 1723394 - RNA, 23 nt, Salmonella enterica enterica serovar Typhi
ccugaccauugauuuccgcgcaa

SEQ ID NO: 1723395 - RNA, 19 nt, Salmonella enterica enterica serovar Typhi
ccugaccgauauagccacu

SEQ ID NO: 1723396 - RNA, 20 nt, Salmonella enterica enterica serovar Typhi
ccugaccgguaaauuucacu

SEQ ID NO: 1723397 - RNA, 13 nt, Salmonella enterica enterica serovar Typhi
ccugaguaucaau

SEQ ID NO: 1723398 - RNA, 19 nt, Salmonella enterica enterica serovar Typhi
ccugagucuugccuguccg

SEQ ID NO: 1723399 - RNA, 22 nt, Salmonella enterica enterica serovar Typhi
ccugauaaaaaaacgccgccuu

SEQ ID NO: 1723400 - RNA, 19 nt, Salmonella enterica enterica serovar Typhi
ccugagcgcgcagcugggc

SEQ ID NO: 1723401 - RNA, 19 nt, Salmonella enterica enterica serovar Typhi
ccugacuggcugagcucac

SEQ ID NO: 1723402 - RNA, 23 nt, Salmonella enterica enterica serovar Typhi
ccucuuuaucuuuuagcgcgccg

SEQ ID NO: 1723403 - RNA, 20 nt, Salmonella enterica enterica serovar Typhi
ccucuuucagaucgccgccg

SEQ ID NO: 1723404 - RNA, 13 nt, Salmonella enterica enterica serovar Typhi
ccucuuuggaggc

SEQ ID NO: 1723405 - RNA, 12 nt, Salmonella enterica enterica serovar Typhi
ccucuuuccguu

SEQ ID NO: 1723406 - RNA, 21 nt, Salmonella enterica enterica serovar Typhi
ccucuuuugucguccccugga

SEQ ID NO: 1723407 - RNA, 21 nt, Salmonella enterica enterica serovar Typhi
ccucuggccgcgcuuuuuuaa

SEQ ID NO: 1723408 - RNA, 22 nt, Salmonella enterica enterica serovar Typhi
ccucuggccgcgcuuuuuuaac

SEQ ID NO: 1723409 - RNA, 19 nt, Salmonella enterica enterica serovar Typhi
ccucuuccaucagccaggc

SEQ ID NO: 1723410 - RNA, 18 nt, Salmonella enterica enterica serovar Typhi
ccucuuccgccaggucgc

SEQ ID NO: 1723411 - RNA, 21 nt, Salmonella enterica enterica serovar Typhi
ccucuuccgguagcgccugug

SEQ ID NO: 1723412 - RNA, 20 nt, Salmonella enterica enterica serovar Typhi
ccugaaauacccgacucuuu

SEQ ID NO: 1723413 - RNA, 17 nt, Salmonella enterica enterica serovar Typhi
ccugaacgccuaccgcu

SEQ ID NO: 1723414 - RNA, 11 nt, Salmonella enterica enterica serovar Typhi
ccugaacaggg

SEQ ID NO: 1723415 - RNA, 14 nt, Salmonella enterica enterica serovar Typhi
ccugaaccagcggc

SEQ ID NO: 1723416 - RNA, 16 nt, Salmonella enterica enterica serovar Typhi
ccugaaaaaauucccg

SEQ ID NO: 1723417 - RNA, 13 nt, Salmonella enterica enterica serovar Typhi
ccugaaaaagggu

SEQ ID NO: 1723418 - RNA, 15 nt, Salmonella enterica enterica serovar Typhi
ccucuuuugucgucc

SEQ ID NO: 1723419 - RNA, 12 nt, Salmonella enterica enterica serovar Typhi
ccucuuuuucau

SEQ ID NO: 1723420 - RNA, 22 nt, Salmonella enterica enterica serovar Typhi
ccugaauaacccgcagcccugc

SEQ ID NO: 1723421 - RNA, 19 nt, Salmonella enterica enterica serovar Typhi
ccugaauaacccgcagccc

SEQ ID NO: 1723422 - RNA, 14 nt, Salmonella enterica enterica serovar Typhi
ccugaagacaugcu

SEQ ID NO: 1723423 - RNA, 20 nt, Salmonella enterica enterica serovar Typhi
ccugaagaccuuaucccgcu

SEQ ID NO: 1723424 - RNA, 23 nt, Salmonella enterica enterica serovar Typhi
ccugaagauagucgauccccaac

SEQ ID NO: 1723425 - RNA, 19 nt, Salmonella enterica enterica serovar Typhi
ccugaagcccuuuagugaa

SEQ ID NO: 1723426 - RNA, 23 nt, Salmonella enterica enterica serovar Typhi
ccugaugauagcgccauauaaau

SEQ ID NO: 1723427 - RNA, 19 nt, Salmonella enterica enterica serovar Typhi
ccugaugagcgcagcgacu

SEQ ID NO: 1723428 - RNA, 12 nt, Salmonella enterica enterica serovar Typhi
ccugauggcgcu

SEQ ID NO: 1723429 - RNA, 12 nt, Salmonella enterica enterica serovar Typhi
ccugauggcgcg

SEQ ID NO: 1723430 - RNA, 21 nt, Salmonella enterica enterica serovar Typhi
ccugauuaaguuuuuuuaaaa

SEQ ID NO: 1723431 - RNA, 15 nt, Salmonella enterica enterica serovar Typhi
ccugaugugcuuuuu

SEQ ID NO: 1723432 - RNA, 14 nt, Salmonella enterica enterica serovar Typhi
ccugauucugcagc

SEQ ID NO: 1723433 - RNA, 18 nt, Salmonella enterica enterica serovar Typhi
ccugauucugcagcgagc

SEQ ID NO: 1723434 - RNA, 19 nt, Salmonella enterica enterica serovar Typhi
ccugauucaccaacugcug

SEQ ID NO: 1723435 - RNA, 21 nt, Salmonella enterica enterica serovar Typhi
ccugaucgcgcagacaguggc

SEQ ID NO: 1723436 - RNA, 15 nt, Salmonella enterica enterica serovar Typhi
ccugaucggccagcg

SEQ ID NO: 1723437 - RNA, 22 nt, Salmonella enterica enterica serovar Typhi
ccugauccggaauagagauaga

SEQ ID NO: 1723438 - RNA, 18 nt, Salmonella enterica enterica serovar Typhi
ccugauccggcuguucca

SEQ ID NO: 1723439 - RNA, 19 nt, Salmonella enterica enterica serovar Typhi
ccugauccugcaacagcac

SEQ ID NO: 1723440 - RNA, 15 nt, Salmonella enterica enterica serovar Typhi
ccugaucaaggcgca

SEQ ID NO: 1723441 - RNA, 23 nt, Salmonella enterica enterica serovar Typhi
ccugcaauuccggcgaaaaaccg

SEQ ID NO: 1723442 - RNA, 15 nt, Salmonella enterica enterica serovar Typhi
ccugauuuaucacgu

SEQ ID NO: 1723443 - RNA, 14 nt, Salmonella enterica enterica serovar Typhi
ccugauuuaucacg

SEQ ID NO: 1723444 - RNA, 22 nt, Salmonella enterica enterica serovar Typhi
ccugcaaagcaaaaaucaccac

SEQ ID NO: 1723445 - RNA, 14 nt, Salmonella enterica enterica serovar Typhi
ccugcaaaccucuc

SEQ ID NO: 1723446 - RNA, 21 nt, Salmonella enterica enterica serovar Typhi
ccugcaaacuauguacgccaa

SEQ ID NO: 1723447 - RNA, 17 nt, Salmonella enterica enterica serovar Typhi
ccugcgcugauuuucuc

SEQ ID NO: 1723448 - RNA, 14 nt, Salmonella enterica enterica serovar Typhi
ccugcgcguaaauu

SEQ ID NO: 1723449 - RNA, 16 nt, Salmonella enterica enterica serovar Typhi
ccugcgcuugcggccg

SEQ ID NO: 1723450 - RNA, 15 nt, Salmonella enterica enterica serovar Typhi
ccugcgcuuugacau

SEQ ID NO: 1723451 - RNA, 23 nt, Salmonella enterica enterica serovar Typhi
ccugcgcuuuggguuaaugccag

SEQ ID NO: 1723452 - RNA, 15 nt, Salmonella enterica enterica serovar Typhi
ccugcggaaccgccc

SEQ ID NO: 1723453 - RNA, 14 nt, Salmonella enterica enterica serovar Typhi
ccugcgucacagac

SEQ ID NO: 1723454 - RNA, 19 nt, Salmonella enterica enterica serovar Typhi
ccugcgguagcuccagaca

SEQ ID NO: 1723455 - RNA, 16 nt, Salmonella enterica enterica serovar Typhi
ccugcgucgccccaau

SEQ ID NO: 1723456 - RNA, 18 nt, Salmonella enterica enterica serovar Typhi
ccugcguuaaacgcugug

SEQ ID NO: 1723457 - RNA, 14 nt, Salmonella enterica enterica serovar Typhi
ccugcgccagccgg

SEQ ID NO: 1723458 - RNA, 15 nt, Salmonella enterica enterica serovar Typhi
ccugcgccagccgga

SEQ ID NO: 1723459 - RNA, 16 nt, Salmonella enterica enterica serovar Typhi
ccugcauauuuuucau

SEQ ID NO: 1723460 - RNA, 14 nt, Salmonella enterica enterica serovar Typhi
ccugccaccagcgu

SEQ ID NO: 1723461 - RNA, 22 nt, Salmonella enterica enterica serovar Typhi
ccugccacaacggcaauuuuua

SEQ ID NO: 1723462 - RNA, 18 nt, Salmonella enterica enterica serovar Typhi
ccugcauguacauaaaau

SEQ ID NO: 1723463 - RNA, 15 nt, Salmonella enterica enterica serovar Typhi
ccugccggguuuaau

SEQ ID NO: 1723464 - RNA, 20 nt, Salmonella enterica enterica serovar Typhi
ccugccgucgcggcuuucag

SEQ ID NO: 1723465 - RNA, 22 nt, Salmonella enterica enterica serovar Typhi
ccugcgauaccggacacccggc

SEQ ID NO: 1723466 - RNA, 15 nt, Salmonella enterica enterica serovar Typhi
ccugccgcgccgccg

SEQ ID NO: 1723467 - RNA, 15 nt, Salmonella enterica enterica serovar Typhi
ccugccgcauguccc

SEQ ID NO: 1723468 - RNA, 22 nt, Salmonella enterica enterica serovar Typhi
ccucaacaaguccuucuucccc

SEQ ID NO: 1723469 - RNA, 16 nt, Salmonella enterica enterica serovar Typhi
ccucaacgcccugcuc

SEQ ID NO: 1723470 - RNA, 16 nt, Salmonella enterica enterica serovar Typhi
ccucaccguagcucca

SEQ ID NO: 1723471 - RNA, 17 nt, Salmonella enterica enterica serovar Typhi
ccucaccucccccgccc

SEQ ID NO: 1723472 - RNA, 18 nt, Salmonella enterica enterica serovar Typhi
ccucacugcguaaaaucg

SEQ ID NO: 1723473 - RNA, 12 nt, Salmonella enterica enterica serovar Typhi
ccucacuguuga

SEQ ID NO: 1723474 - RNA, 15 nt, Salmonella enterica enterica serovar Typhi
ccucacguacuacgu

SEQ ID NO: 1723475 - RNA, 18 nt, Salmonella enterica enterica serovar Typhi
ccucacgcaaccagguca

SEQ ID NO: 1723476 - RNA, 22 nt, Salmonella enterica enterica serovar Typhi
ccucacgcuuaucgccaaacca

SEQ ID NO: 1723477 - RNA, 23 nt, Salmonella enterica enterica serovar Typhi
ccucacgcuuaucgccaaaccag

SEQ ID NO: 1723478 - RNA, 18 nt, Salmonella enterica enterica serovar Typhi
ccucagucgcuuguaccg

SEQ ID NO: 1723479 - RNA, 14 nt, Salmonella enterica enterica serovar Typhi
ccuauuaggcacua

SEQ ID NO: 1723480 - RNA, 13 nt, Salmonella enterica enterica serovar Typhi
ccuaucgccauau

SEQ ID NO: 1723481 - RNA, 14 nt, Salmonella enterica enterica serovar Typhi
ccgugccgccgcga

SEQ ID NO: 1723482 - RNA, 23 nt, Salmonella enterica enterica serovar Typhi
ccgugaugcggacgcugacgcca

SEQ ID NO: 1723483 - RNA, 23 nt, Salmonella enterica enterica serovar Typhi
ccucccggugcgggaggaauaaa

SEQ ID NO: 1723484 - RNA, 15 nt, Salmonella enterica enterica serovar Typhi
ccucccugacuggcu

SEQ ID NO: 1723485 - RNA, 21 nt, Salmonella enterica enterica serovar Typhi
ccucauuuuguugcuccagca

SEQ ID NO: 1723486 - RNA, 20 nt, Salmonella enterica enterica serovar Typhi
ccucauuuuguugcuccagc

SEQ ID NO: 1723487 - RNA, 17 nt, Salmonella enterica enterica serovar Typhi
ccuccagcuccgcguau

SEQ ID NO: 1723488 - RNA, 14 nt, Salmonella enterica enterica serovar Typhi
ccuccagcgacccu

SEQ ID NO: 1723489 - RNA, 14 nt, Salmonella enterica enterica serovar Typhi
ccucauucagcggc

SEQ ID NO: 1723490 - RNA, 16 nt, Salmonella enterica enterica serovar Typhi
ccucauuaguucaagu

SEQ ID NO: 1723491 - RNA, 15 nt, Salmonella enterica enterica serovar Typhi
aaacgccgucacaaa

SEQ ID NO: 1723492 - RNA, 16 nt, Salmonella enterica enterica serovar Typhi
aaacgccgcagaaaau

SEQ ID NO: 1723493 - RNA, 23 nt, Salmonella enterica enterica serovar Typhi
aaacgccauugcgaacaucacga

SEQ ID NO: 1723494 - RNA, 18 nt, Salmonella enterica enterica serovar Typhi
aaacgccaggcgcugcgu

SEQ ID NO: 1723495 - RNA, 15 nt, Salmonella enterica enterica serovar Typhi
aaacgccaagaauga

SEQ ID NO: 1723496 - RNA, 19 nt, Salmonella enterica enterica serovar Typhi
ccucauacagcccgcgcag

SEQ ID NO: 1723497 - RNA, 14 nt, Salmonella enterica enterica serovar Typhi
ccucauauuuguau

SEQ ID NO: 1723498 - RNA, 13 nt, Salmonella enterica enterica serovar Typhi
ccucauauuugua

SEQ ID NO: 1723499 - RNA, 18 nt, Salmonella enterica enterica serovar Typhi
ccuccugaauagcuuuca

SEQ ID NO: 1723500 - RNA, 17 nt, Salmonella enterica enterica serovar Typhi
ccucgcaaaacauggcu

SEQ ID NO: 1723501 - RNA, 13 nt, Salmonella enterica enterica serovar Typhi
ccucgcauccucc

SEQ ID NO: 1723502 - RNA, 17 nt, Salmonella enterica enterica serovar Typhi
ccucgcauaacuucgaa

SEQ ID NO: 1723503 - RNA, 16 nt, Salmonella enterica enterica serovar Typhi
ccucgccaaagcagcg

SEQ ID NO: 1723504 - RNA, 18 nt, Salmonella enterica enterica serovar Typhi
ccucgccaaagcgcugcu

SEQ ID NO: 1723505 - RNA, 13 nt, Salmonella enterica enterica serovar Typhi
ccucgcccgcgau

SEQ ID NO: 1723506 - RNA, 21 nt, Salmonella enterica enterica serovar Typhi
ccuccgcguagcccagcgccg

SEQ ID NO: 1723507 - RNA, 17 nt, Salmonella enterica enterica serovar Typhi
ccuccgcguaccucagc

SEQ ID NO: 1723508 - RNA, 18 nt, Salmonella enterica enterica serovar Typhi
ccuccgccacuagcgcuu

SEQ ID NO: 1723509 - RNA, 22 nt, Salmonella enterica enterica serovar Typhi
ccuccgcguagcccagcgccgc

SEQ ID NO: 1723510 - RNA, 16 nt, Salmonella enterica enterica serovar Typhi
ccuccgucaccuccgc

SEQ ID NO: 1723511 - RNA, 22 nt, Salmonella enterica enterica serovar Typhi
ccuccguaugaccgccgcgcgu

SEQ ID NO: 1723512 - RNA, 18 nt, Salmonella enterica enterica serovar Typhi
ccuccucgacguuuucca

SEQ ID NO: 1723513 - RNA, 17 nt, Salmonella enterica enterica serovar Typhi
ccuccucauucagcggc

SEQ ID NO: 1723514 - RNA, 17 nt, Salmonella enterica enterica serovar Typhi
ccucgcguagcgccaac

SEQ ID NO: 1723515 - RNA, 21 nt, Salmonella enterica enterica serovar Typhi
ccucgcucaccggucccggaa

SEQ ID NO: 1723516 - RNA, 15 nt, Salmonella enterica enterica serovar Typhi
ccucgcuaaugcccg

SEQ ID NO: 1723517 - RNA, 20 nt, Salmonella enterica enterica serovar Typhi
ccucgguauguccugccgca

SEQ ID NO: 1723518 - RNA, 16 nt, Salmonella enterica enterica serovar Typhi
ccucugcaccagaacu

SEQ ID NO: 1723519 - RNA, 14 nt, Salmonella enterica enterica serovar Typhi
ccucucuucucgcu

SEQ ID NO: 1723520 - RNA, 22 nt, Salmonella enterica enterica serovar Typhi
ccucucccgaacugucugaauc

SEQ ID NO: 1723521 - RNA, 21 nt, Salmonella enterica enterica serovar Typhi
ccucuccugaauugcaaggcg

SEQ ID NO: 1723522 - RNA, 13 nt, Salmonella enterica enterica serovar Typhi
ccucuaucuuuuc

SEQ ID NO: 1723523 - RNA, 18 nt, Salmonella enterica enterica serovar Typhi
ccucuaucuuuucaauca

SEQ ID NO: 1723524 - RNA, 15 nt, Salmonella enterica enterica serovar Typhi
ccucuaccuacacau

SEQ ID NO: 1723525 - RNA, 22 nt, Salmonella enterica enterica serovar Typhi
ccucuauaguaaauugacgcuu

SEQ ID NO: 1723526 - RNA, 13 nt, Salmonella enterica enterica serovar Typhi
ccucuacauuuuc

SEQ ID NO: 1723527 - RNA, 17 nt, Salmonella enterica enterica serovar Typhi
ccucguaucugucccag

SEQ ID NO: 1723528 - RNA, 13 nt, Salmonella enterica enterica serovar Typhi
ccucgucuugauu

SEQ ID NO: 1723529 - RNA, 17 nt, Salmonella enterica enterica serovar Typhi
ccucguugauguuuuua

SEQ ID NO: 1723530 - RNA, 17 nt, Salmonella enterica enterica serovar Typhi
ccgcgccaaacguggcg

SEQ ID NO: 1723531 - RNA, 12 nt, Salmonella enterica enterica serovar Typhi
ccgcgcagcgcc

SEQ ID NO: 1723532 - RNA, 16 nt, Salmonella enterica enterica serovar Typhi
ccgcgcagaaucacuu

SEQ ID NO: 1723533 - RNA, 18 nt, Salmonella enterica enterica serovar Typhi
ccgcgcaauaugcggcgc

SEQ ID NO: 1723534 - RNA, 16 nt, Salmonella enterica enterica serovar Typhi
ccgcgcaaagcaauac

SEQ ID NO: 1723535 - RNA, 22 nt, Salmonella enterica enterica serovar Typhi
ccgcgcaaggcguucacaccgc

SEQ ID NO: 1723536 - RNA, 17 nt, Salmonella enterica enterica serovar Typhi
ccgcgagaacuuccgcc

SEQ ID NO: 1723537 - RNA, 16 nt, Salmonella enterica enterica serovar Typhi
ccgcgaucgcggcaac

SEQ ID NO: 1723538 - RNA, 23 nt, Salmonella enterica enterica serovar Typhi
ccgcgauagaccacgccaucaac

SEQ ID NO: 1723539 - RNA, 16 nt, Salmonella enterica enterica serovar Typhi
ccgcgacagucgcaga

SEQ ID NO: 1723540 - RNA, 23 nt, Salmonella enterica enterica serovar Typhi
ccgcgacaaaaagcgcgccgaaa

SEQ ID NO: 1723541 - RNA, 12 nt, Salmonella enterica enterica serovar Typhi
ccgcagcccgcc

SEQ ID NO: 1723542 - RNA, 21 nt, Salmonella enterica enterica serovar Typhi
ccgcagcccgcccacaggcug

SEQ ID NO: 1723543 - RNA, 21 nt, Salmonella enterica enterica serovar Typhi
ccgcagccaacaacaggccgc

SEQ ID NO: 1723544 - RNA, 12 nt, Salmonella enterica enterica serovar Typhi
ccgcagccagaa

SEQ ID NO: 1723545 - RNA, 15 nt, Salmonella enterica enterica serovar Typhi
ccgcagccagaauca

SEQ ID NO: 1723546 - RNA, 14 nt, Salmonella enterica enterica serovar Typhi
ccgcagccaacaac

SEQ ID NO: 1723547 - RNA, 19 nt, Salmonella enterica enterica serovar Typhi
ccgccugauuuaaugaacc

SEQ ID NO: 1723548 - RNA, 15 nt, Salmonella enterica enterica serovar Typhi
ccgcagcgcggaagc

SEQ ID NO: 1723549 - RNA, 14 nt, Salmonella enterica enterica serovar Typhi
ccgccugccgcgcc

SEQ ID NO: 1723550 - RNA, 15 nt, Salmonella enterica enterica serovar Typhi
ccgccugccgcgccg

SEQ ID NO: 1723551 - RNA, 18 nt, Salmonella enterica enterica serovar Typhi
ccgccugcgccagcgccg

SEQ ID NO: 1723552 - RNA, 17 nt, Salmonella enterica enterica serovar Typhi
ccgcgaaccggaccagc

SEQ ID NO: 1723553 - RNA, 15 nt, Salmonella enterica enterica serovar Typhi
ccgccuugcggcggc

SEQ ID NO: 1723554 - RNA, 18 nt, Salmonella enterica enterica serovar Typhi
ccgccuuuaagcaccgcu

SEQ ID NO: 1723555 - RNA, 12 nt, Salmonella enterica enterica serovar Typhi
ccgccugcugug

SEQ ID NO: 1723556 - RNA, 15 nt, Salmonella enterica enterica serovar Typhi
ccgccuggcgcgacu

SEQ ID NO: 1723557 - RNA, 15 nt, Salmonella enterica enterica serovar Typhi
ccgccuuaccgcggu

SEQ ID NO: 1723558 - RNA, 14 nt, Salmonella enterica enterica serovar Typhi
ccgcgccgccgccg

SEQ ID NO: 1723559 - RNA, 11 nt, Salmonella enterica enterica serovar Typhi
ccgcgccgccg

SEQ ID NO: 1723560 - RNA, 15 nt, Salmonella enterica enterica serovar Typhi
ccgcgccuaccagcg

SEQ ID NO: 1723561 - RNA, 16 nt, Salmonella enterica enterica serovar Typhi
ccgcgcggcguucugc

SEQ ID NO: 1723562 - RNA, 14 nt, Salmonella enterica enterica serovar Typhi
ccgcgcggcguucu

SEQ ID NO: 1723563 - RNA, 16 nt, Salmonella enterica enterica serovar Typhi
ccgcgcgcgcggcauc

SEQ ID NO: 1723564 - RNA, 15 nt, Salmonella enterica enterica serovar Typhi
ccgcgcgcuuuccac

SEQ ID NO: 1723565 - RNA, 14 nt, Salmonella enterica enterica serovar Typhi
ccgcgcgccgccuc

SEQ ID NO: 1723566 - RNA, 13 nt, Salmonella enterica enterica serovar Typhi
aaaccgauaauca

SEQ ID NO: 1723567 - RNA, 17 nt, Salmonella enterica enterica serovar Typhi
aaaccgauaaucaccag

SEQ ID NO: 1723568 - RNA, 15 nt, Salmonella enterica enterica serovar Typhi
ccgcgcuccaucaua

SEQ ID NO: 1723569 - RNA, 16 nt, Salmonella enterica enterica serovar Typhi
ccgcgcucgccagcau

SEQ ID NO: 1723570 - RNA, 20 nt, Salmonella enterica enterica serovar Typhi
ccgcgcuaucgggucugcgc

SEQ ID NO: 1723571 - RNA, 22 nt, Salmonella enterica enterica serovar Typhi
ccgcgcuagugccgccaggcaa

SEQ ID NO: 1723572 - RNA, 14 nt, Salmonella enterica enterica serovar Typhi
ccgcgcucaacaca

SEQ ID NO: 1723573 - RNA, 15 nt, Salmonella enterica enterica serovar Typhi
ccgcgcgucagcgug

SEQ ID NO: 1723574 - RNA, 19 nt, Salmonella enterica enterica serovar Typhi
ccgcgcuuucuggcgcaga

SEQ ID NO: 1723575 - RNA, 19 nt, Salmonella enterica enterica serovar Typhi
ccgcgcuuuaugcagucgg

SEQ ID NO: 1723576 - RNA, 18 nt, Salmonella enterica enterica serovar Typhi
ccgcggagaucgcucccg

SEQ ID NO: 1723577 - RNA, 17 nt, Salmonella enterica enterica serovar Typhi
ccgcguauugcccucgg

SEQ ID NO: 1723578 - RNA, 16 nt, Salmonella enterica enterica serovar Typhi
ccgcguaaucuucgcg

SEQ ID NO: 1723579 - RNA, 22 nt, Salmonella enterica enterica serovar Typhi
ccgcguaaucuucgcggcugcc

SEQ ID NO: 1723580 - RNA, 13 nt, Salmonella enterica enterica serovar Typhi
ccgcguaaugacu

SEQ ID NO: 1723581 - RNA, 19 nt, Salmonella enterica enterica serovar Typhi
ccgcguagcccagcgccgc

SEQ ID NO: 1723582 - RNA, 20 nt, Salmonella enterica enterica serovar Typhi
ccgcgugaacaccacugaaa

SEQ ID NO: 1723583 - RNA, 17 nt, Salmonella enterica enterica serovar Typhi
ccgcggcgaucuccuga

SEQ ID NO: 1723584 - RNA, 21 nt, Salmonella enterica enterica serovar Typhi
ccgcggggaucgguuuauccc

SEQ ID NO: 1723585 - RNA, 13 nt, Salmonella enterica enterica serovar Typhi
ccgcgguccagcc

SEQ ID NO: 1723586 - RNA, 21 nt, Salmonella enterica enterica serovar Typhi
ccgcgguacgaaucgccgcgc

SEQ ID NO: 1723587 - RNA, 18 nt, Salmonella enterica enterica serovar Typhi
ccgcuacaauccaggacg

SEQ ID NO: 1723588 - RNA, 14 nt, Salmonella enterica enterica serovar Typhi
ccgcuacaauccag

SEQ ID NO: 1723589 - RNA, 19 nt, Salmonella enterica enterica serovar Typhi
ccgcguuuaacgcagcgcg

SEQ ID NO: 1723590 - RNA, 21 nt, Salmonella enterica enterica serovar Typhi
ccgcuacccggcacaaugccc

SEQ ID NO: 1723591 - RNA, 19 nt, Salmonella enterica enterica serovar Typhi
ccgcuacguaauucaugca

SEQ ID NO: 1723592 - RNA, 14 nt, Salmonella enterica enterica serovar Typhi
ccgcuacuccgccc

SEQ ID NO: 1723593 - RNA, 19 nt, Salmonella enterica enterica serovar Typhi
ccgcuagcugcagcgcucc

SEQ ID NO: 1723594 - RNA, 15 nt, Salmonella enterica enterica serovar Typhi
ccgcuaucgaccagc

SEQ ID NO: 1723595 - RNA, 20 nt, Salmonella enterica enterica serovar Typhi
ccgcuaucugcuccgccagc

SEQ ID NO: 1723596 - RNA, 22 nt, Salmonella enterica enterica serovar Typhi
ccgcucauuagggugcagugaa

SEQ ID NO: 1723597 - RNA, 22 nt, Salmonella enterica enterica serovar Typhi
ccgcucacgguuucaacuucca

SEQ ID NO: 1723598 - RNA, 21 nt, Salmonella enterica enterica serovar Typhi
ccgcucaauaucauagugccg

SEQ ID NO: 1723599 - RNA, 17 nt, Salmonella enterica enterica serovar Typhi
ccgcucgccgccucccc

SEQ ID NO: 1723600 - RNA, 15 nt, Salmonella enterica enterica serovar Typhi
ccgcucgccauaucu

SEQ ID NO: 1723601 - RNA, 19 nt, Salmonella enterica enterica serovar Typhi
ccgcucgcccgccgcaaaa

SEQ ID NO: 1723602 - RNA, 13 nt, Salmonella enterica enterica serovar Typhi
ccgcuucuuccau

SEQ ID NO: 1723603 - RNA, 20 nt, Salmonella enterica enterica serovar Typhi
ccgcugguugccuuccugau

SEQ ID NO: 1723604 - RNA, 19 nt, Salmonella enterica enterica serovar Typhi
ccggaaauuugcagcgcug

SEQ ID NO: 1723605 - RNA, 20 nt, Salmonella enterica enterica serovar Typhi
ccggaaauaaacgccagugg

SEQ ID NO: 1723606 - RNA, 13 nt, Salmonella enterica enterica serovar Typhi
ccggaaaucugca

SEQ ID NO: 1723607 - RNA, 21 nt, Salmonella enterica enterica serovar Typhi
ccggaacauacacguaauaca

SEQ ID NO: 1723608 - RNA, 21 nt, Salmonella enterica enterica serovar Typhi
ccggaaaggauauaagcgcca

SEQ ID NO: 1723609 - RNA, 23 nt, Salmonella enterica enterica serovar Typhi
ccggaaagaauaaucgccgccgg

SEQ ID NO: 1723610 - RNA, 15 nt, Salmonella enterica enterica serovar Typhi
ccgcuuuaccgccuu

SEQ ID NO: 1723611 - RNA, 18 nt, Salmonella enterica enterica serovar Typhi
ccggagauuuaucuucuc

SEQ ID NO: 1723612 - RNA, 18 nt, Salmonella enterica enterica serovar Typhi
ccggagagcuugauaaau

SEQ ID NO: 1723613 - RNA, 20 nt, Salmonella enterica enterica serovar Typhi
ccggaaugguauaaaucccg

SEQ ID NO: 1723614 - RNA, 20 nt, Salmonella enterica enterica serovar Typhi
ccggaauggucgcgccaggg

SEQ ID NO: 1723615 - RNA, 13 nt, Salmonella enterica enterica serovar Typhi
ccggaacgggcau

SEQ ID NO: 1723616 - RNA, 17 nt, Salmonella enterica enterica serovar Typhi
ccggaacgggcaugacu

SEQ ID NO: 1723617 - RNA, 19 nt, Salmonella enterica enterica serovar Typhi
ccgcugaaauagccccguc

SEQ ID NO: 1723618 - RNA, 16 nt, Salmonella enterica enterica serovar Typhi
ccgcucuucagcgucc

SEQ ID NO: 1723619 - RNA, 22 nt, Salmonella enterica enterica serovar Typhi
ccgcucggcauacaccgccagc

SEQ ID NO: 1723620 - RNA, 24 nt, Salmonella enterica enterica serovar Typhi
ccgcugacgcugcccgccggacag

SEQ ID NO: 1723621 - RNA, 11 nt, Salmonella enterica enterica serovar Typhi
ccgcugcugug

SEQ ID NO: 1723622 - RNA, 19 nt, Salmonella enterica enterica serovar Typhi
ccgcugcugccuuccaguu

SEQ ID NO: 1723623 - RNA, 13 nt, Salmonella enterica enterica serovar Typhi
ccgcuggccgguu

SEQ ID NO: 1723624 - RNA, 19 nt, Salmonella enterica enterica serovar Typhi
ccgcuggcgccaccgcugc

SEQ ID NO: 1723625 - RNA, 22 nt, Salmonella enterica enterica serovar Typhi
ccgcuggcgcggggaacaccca

SEQ ID NO: 1723626 - RNA, 22 nt, Salmonella enterica enterica serovar Typhi
ccgcuggcgcggggaacacucu

SEQ ID NO: 1723627 - RNA, 22 nt, Salmonella enterica enterica serovar Typhi
ccgcuggcgcggggaucgguuu

SEQ ID NO: 1723628 - RNA, 15 nt, Salmonella enterica enterica serovar Typhi
ccgcuggcgcgggga

SEQ ID NO: 1723629 - RNA, 19 nt, Salmonella enterica enterica serovar Typhi
ccgcuggcgaccagccugc

SEQ ID NO: 1723630 - RNA, 20 nt, Salmonella enterica enterica serovar Typhi
ccgcuggcuggccagggcau

SEQ ID NO: 1723631 - RNA, 23 nt, Salmonella enterica enterica serovar Typhi
ccgcugcggaacaccagcgccgc

SEQ ID NO: 1723632 - RNA, 20 nt, Salmonella enterica enterica serovar Typhi
ccgcugcgcucacgcggcgc

SEQ ID NO: 1723633 - RNA, 19 nt, Salmonella enterica enterica serovar Typhi
ccgcugcggucaggaauga

SEQ ID NO: 1723634 - RNA, 19 nt, Salmonella enterica enterica serovar Typhi
ccgggccgcuagcugcagc

SEQ ID NO: 1723635 - RNA, 19 nt, Salmonella enterica enterica serovar Typhi
ccgggccugagcgcgcagc

SEQ ID NO: 1723636 - RNA, 16 nt, Salmonella enterica enterica serovar Typhi
ccgggccgugacacau

SEQ ID NO: 1723637 - RNA, 13 nt, Salmonella enterica enterica serovar Typhi
ccgggauauaaaa

SEQ ID NO: 1723638 - RNA, 14 nt, Salmonella enterica enterica serovar Typhi
ccggggaagcgcgc

SEQ ID NO: 1723639 - RNA, 16 nt, Salmonella enterica enterica serovar Typhi
ccggggaagcgcgcgc

SEQ ID NO: 1723640 - RNA, 17 nt, Salmonella enterica enterica serovar Typhi
ccggggaagcgcgcgca

SEQ ID NO: 1723641 - RNA, 18 nt, Salmonella enterica enterica serovar Typhi
ccgggcggcugucccaga

SEQ ID NO: 1723642 - RNA, 17 nt, Salmonella enterica enterica serovar Typhi
aaaccggcggccuacca

SEQ ID NO: 1723643 - RNA, 19 nt, Salmonella enterica enterica serovar Typhi
aaaccggcggucaugcugg

SEQ ID NO: 1723644 - RNA, 17 nt, Salmonella enterica enterica serovar Typhi
aaaccggaauuuguugg

SEQ ID NO: 1723645 - RNA, 15 nt, Salmonella enterica enterica serovar Typhi
ccggcggcaaggucu

SEQ ID NO: 1723646 - RNA, 19 nt, Salmonella enterica enterica serovar Typhi
ccggcggcaaggucugcgc

SEQ ID NO: 1723647 - RNA, 18 nt, Salmonella enterica enterica serovar Typhi
ccggcucgccuugcgguu

SEQ ID NO: 1723648 - RNA, 11 nt, Salmonella enterica enterica serovar Typhi
ccggcucgccu

SEQ ID NO: 1723649 - RNA, 20 nt, Salmonella enterica enterica serovar Typhi
aaaccgguaaugauaccaau

SEQ ID NO: 1723650 - RNA, 16 nt, Salmonella enterica enterica serovar Typhi
aaaccgggaaaucccg

SEQ ID NO: 1723651 - RNA, 22 nt, Salmonella enterica enterica serovar Typhi
aaaccguagauuuucaucauau

SEQ ID NO: 1723652 - RNA, 11 nt, Salmonella enterica enterica serovar Typhi
ccggcucgccc

SEQ ID NO: 1723653 - RNA, 22 nt, Salmonella enterica enterica serovar Typhi
ccgggagaacgccgggccugcc

SEQ ID NO: 1723654 - RNA, 17 nt, Salmonella enterica enterica serovar Typhi
ccgggacugacugagcc

SEQ ID NO: 1723655 - RNA, 13 nt, Salmonella enterica enterica serovar Typhi
ccgggacuucagg

SEQ ID NO: 1723656 - RNA, 23 nt, Salmonella enterica enterica serovar Typhi
ccgggacuuuaaacgucaugcug

SEQ ID NO: 1723657 - RNA, 16 nt, Salmonella enterica enterica serovar Typhi
ccgggaagaaggcucc

SEQ ID NO: 1723658 - RNA, 21 nt, Salmonella enterica enterica serovar Typhi
ccgggaaauggcaauggcggc

SEQ ID NO: 1723659 - RNA, 18 nt, Salmonella enterica enterica serovar Typhi
ccgggaaaugucuggcgc

SEQ ID NO: 1723660 - RNA, 15 nt, Salmonella enterica enterica serovar Typhi
ccggcuuuauuacuu

SEQ ID NO: 1723661 - RNA, 17 nt, Salmonella enterica enterica serovar Typhi
ccggcuuuccgcaccgc

SEQ ID NO: 1723662 - RNA, 21 nt, Salmonella enterica enterica serovar Typhi
ccgggaaaacaucacccggcg

SEQ ID NO: 1723663 - RNA, 19 nt, Salmonella enterica enterica serovar Typhi
ccggcuucuccaccauauc

SEQ ID NO: 1723664 - RNA, 19 nt, Salmonella enterica enterica serovar Typhi
ccggcuuaaugcccggccc

SEQ ID NO: 1723665 - RNA, 16 nt, Salmonella enterica enterica serovar Typhi
ccggcuuccagcggcg

SEQ ID NO: 1723666 - RNA, 11 nt, Salmonella enterica enterica serovar Typhi
ccggcgcgccu

SEQ ID NO: 1723667 - RNA, 13 nt, Salmonella enterica enterica serovar Typhi
ccggcgcgccagc

SEQ ID NO: 1723668 - RNA, 12 nt, Salmonella enterica enterica serovar Typhi
ccggcgcggcgc

SEQ ID NO: 1723669 - RNA, 13 nt, Salmonella enterica enterica serovar Typhi
ccggcgcggcauc

SEQ ID NO: 1723670 - RNA, 16 nt, Salmonella enterica enterica serovar Typhi
ccggcgcgggcgagau

SEQ ID NO: 1723671 - RNA, 22 nt, Salmonella enterica enterica serovar Typhi
ccggcgcuggacaaaccacagu

SEQ ID NO: 1723672 - RNA, 17 nt, Salmonella enterica enterica serovar Typhi
ccggcgcuggcgcacgc

SEQ ID NO: 1723673 - RNA, 18 nt, Salmonella enterica enterica serovar Typhi
ccggcgcuaaccagcgcu

SEQ ID NO: 1723674 - RNA, 19 nt, Salmonella enterica enterica serovar Typhi
ccggcgccagcucaacgcc

SEQ ID NO: 1723675 - RNA, 21 nt, Salmonella enterica enterica serovar Typhi
ccggcgccaaucaccgccagc

SEQ ID NO: 1723676 - RNA, 15 nt, Salmonella enterica enterica serovar Typhi
ccggccugacgcagc

SEQ ID NO: 1723677 - RNA, 21 nt, Salmonella enterica enterica serovar Typhi
ccggagggcgaacuggcgguc

SEQ ID NO: 1723678 - RNA, 22 nt, Salmonella enterica enterica serovar Typhi
ccggaggauauuuauucccccu

SEQ ID NO: 1723679 - RNA, 16 nt, Salmonella enterica enterica serovar Typhi
ccggauacaagguauc

SEQ ID NO: 1723680 - RNA, 21 nt, Salmonella enterica enterica serovar Typhi
ccggauaaggccacgccgcca

SEQ ID NO: 1723681 - RNA, 18 nt, Salmonella enterica enterica serovar Typhi
ccggauaauccagacaaa

SEQ ID NO: 1723682 - RNA, 22 nt, Salmonella enterica enterica serovar Typhi
ccggauaaggcguucacgccgc

SEQ ID NO: 1723683 - RNA, 16 nt, Salmonella enterica enterica serovar Typhi
ccggauaagcggcagc

SEQ ID NO: 1723684 - RNA, 19 nt, Salmonella enterica enterica serovar Typhi
ccggauaagcggcagcgcc

SEQ ID NO: 1723685 - RNA, 23 nt, Salmonella enterica enterica serovar Typhi
ccggauaaggcauuucgccgcca

SEQ ID NO: 1723686 - RNA, 17 nt, Salmonella enterica enterica serovar Typhi
ccggauaaccgcccgcg

SEQ ID NO: 1723687 - RNA, 18 nt, Salmonella enterica enterica serovar Typhi
ccggccauugccgcgccg

SEQ ID NO: 1723688 - RNA, 23 nt, Salmonella enterica enterica serovar Typhi
ccggugccguuaauuuucacgca

SEQ ID NO: 1723689 - RNA, 15 nt, Salmonella enterica enterica serovar Typhi
ccgguguagcuggca

SEQ ID NO: 1723690 - RNA, 15 nt, Salmonella enterica enterica serovar Typhi
ccgguguaaaaaaug

SEQ ID NO: 1723691 - RNA, 14 nt, Salmonella enterica enterica serovar Typhi
ccggugcgccccag

SEQ ID NO: 1723692 - RNA, 15 nt, Salmonella enterica enterica serovar Typhi
ccggugcgccccagc

SEQ ID NO: 1723693 - RNA, 17 nt, Salmonella enterica enterica serovar Typhi
ccggguaaacgcagcgu

SEQ ID NO: 1723694 - RNA, 14 nt, Salmonella enterica enterica serovar Typhi
ccggguaaacgcca

SEQ ID NO: 1723695 - RNA, 14 nt, Salmonella enterica enterica serovar Typhi
ccggguaauaaguu

SEQ ID NO: 1723696 - RNA, 14 nt, Salmonella enterica enterica serovar Typhi
ccggguacaaaaac

SEQ ID NO: 1723697 - RNA, 19 nt, Salmonella enterica enterica serovar Typhi
ccgggguaucuguuuauuc

SEQ ID NO: 1723698 - RNA, 15 nt, Salmonella enterica enterica serovar Typhi
ccgguccgguggcgc

SEQ ID NO: 1723699 - RNA, 13 nt, Salmonella enterica enterica serovar Typhi
ccgucaauaauau

SEQ ID NO: 1723700 - RNA, 20 nt, Salmonella enterica enterica serovar Typhi
ccgucaaugccuggcagacg

SEQ ID NO: 1723701 - RNA, 19 nt, Salmonella enterica enterica serovar Typhi
ccgucaaaacgcgcauccu

SEQ ID NO: 1723702 - RNA, 16 nt, Salmonella enterica enterica serovar Typhi
ccgucaacacgcagac

SEQ ID NO: 1723703 - RNA, 19 nt, Salmonella enterica enterica serovar Typhi
ccguaugacguggccagca

SEQ ID NO: 1723704 - RNA, 17 nt, Salmonella enterica enterica serovar Typhi
ccguauccgccaccaug

SEQ ID NO: 1723705 - RNA, 14 nt, Salmonella enterica enterica serovar Typhi
ccguauccagaccc

SEQ ID NO: 1723706 - RNA, 19 nt, Salmonella enterica enterica serovar Typhi
ccguagcguacuuucaaau

SEQ ID NO: 1723707 - RNA, 16 nt, Salmonella enterica enterica serovar Typhi
ccguagcucagcugga

SEQ ID NO: 1723708 - RNA, 16 nt, Salmonella enterica enterica serovar Typhi
ccguagcuccagaccu

SEQ ID NO: 1723709 - RNA, 14 nt, Salmonella enterica enterica serovar Typhi
ccguaaaaugcugg

SEQ ID NO: 1723710 - RNA, 13 nt, Salmonella enterica enterica serovar Typhi
ccguaaaguuccc

SEQ ID NO: 1723711 - RNA, 20 nt, Salmonella enterica enterica serovar Typhi
ccgguuugggcgcgaaacug

SEQ ID NO: 1723712 - RNA, 16 nt, Salmonella enterica enterica serovar Typhi
ccgguuuuugcgcgcu

SEQ ID NO: 1723713 - RNA, 13 nt, Salmonella enterica enterica serovar Typhi
ccgguuuuuuaau

SEQ ID NO: 1723714 - RNA, 23 nt, Salmonella enterica enterica serovar Typhi
ccguacagccuaaaaaaccggcc

SEQ ID NO: 1723715 - RNA, 19 nt, Salmonella enterica enterica serovar Typhi
ccguaagcggcggaccagc

SEQ ID NO: 1723716 - RNA, 21 nt, Salmonella enterica enterica serovar Typhi
ccguagauaagcgccacgucg

SEQ ID NO: 1723717 - RNA, 14 nt, Salmonella enterica enterica serovar Typhi
ccguacucagaucg

SEQ ID NO: 1723718 - RNA, 15 nt, Salmonella enterica enterica serovar Typhi
ccgucgaugauggcg

SEQ ID NO: 1723719 - RNA, 17 nt, Salmonella enterica enterica serovar Typhi
ccgucgaugauggcggc

SEQ ID NO: 1723720 - RNA, 17 nt, Salmonella enterica enterica serovar Typhi
ccgucgccaucaccagg

SEQ ID NO: 1723721 - RNA, 20 nt, Salmonella enterica enterica serovar Typhi
ccgucccuuccgccaccagg

SEQ ID NO: 1723722 - RNA, 22 nt, Salmonella enterica enterica serovar Typhi
ccgucccuaagccggcaggcag

SEQ ID NO: 1723723 - RNA, 19 nt, Salmonella enterica enterica serovar Typhi
ccguccccagcccaucggu

SEQ ID NO: 1723724 - RNA, 13 nt, Salmonella enterica enterica serovar Typhi
ccgucccagcgga

SEQ ID NO: 1723725 - RNA, 14 nt, Salmonella enterica enterica serovar Typhi
ccgucuuuuuccug

SEQ ID NO: 1723726 - RNA, 14 nt, Salmonella enterica enterica serovar Typhi
ccgugaccugcuga

SEQ ID NO: 1723727 - RNA, 23 nt, Salmonella enterica enterica serovar Typhi
ccgugaaugcccggcggcgcgau

SEQ ID NO: 1723728 - RNA, 22 nt, Salmonella enterica enterica serovar Typhi
ccgugaauaaugaccagcgccc

SEQ ID NO: 1723729 - RNA, 18 nt, Salmonella enterica enterica serovar Typhi
ccgugaauuucugcugcc

SEQ ID NO: 1723730 - RNA, 18 nt, Salmonella enterica enterica serovar Typhi
ccgucggcgccagccaca

SEQ ID NO: 1723731 - RNA, 21 nt, Salmonella enterica enterica serovar Typhi
aaacgaaucaccucgcuuccc

SEQ ID NO: 1723732 - RNA, 13 nt, Salmonella enterica enterica serovar Typhi
aaaccuuucuucu

SEQ ID NO: 1723733 - RNA, 15 nt, Salmonella enterica enterica serovar Typhi
aaaccuguuuguuua

SEQ ID NO: 1723734 - RNA, 18 nt, Salmonella enterica enterica serovar Typhi
ccguccagaccgucauga

SEQ ID NO: 1723735 - RNA, 16 nt, Salmonella enterica enterica serovar Typhi
ccgucaugcuucaccu

SEQ ID NO: 1723736 - RNA, 14 nt, Salmonella enterica enterica serovar Typhi
ccguccaccuggcc

SEQ ID NO: 1723737 - RNA, 15 nt, Salmonella enterica enterica serovar Typhi
ccguccaccuggccc

SEQ ID NO: 1723738 - RNA, 16 nt, Salmonella enterica enterica serovar Typhi
ccgucaugauguuugu

SEQ ID NO: 1723739 - RNA, 18 nt, Salmonella enterica enterica serovar Typhi
ccgucacaggcggccagg

SEQ ID NO: 1723740 - RNA, 14 nt, Salmonella enterica enterica serovar Typhi
ccgucaccacgcgc

SEQ ID NO: 1723741 - RNA, 19 nt, Salmonella enterica enterica serovar Typhi
ccgucacgccgacgaccgg

SEQ ID NO: 1723742 - RNA, 21 nt, Salmonella enterica enterica serovar Typhi
ccgucacugaaccugccuuug

SEQ ID NO: 1723743 - RNA, 14 nt, Salmonella enterica enterica serovar Typhi
ccgucagcaacccc

SEQ ID NO: 1723744 - RNA, 15 nt, Salmonella enterica enterica serovar Typhi
ccgucagcaaccccu

SEQ ID NO: 1723745 - RNA, 14 nt, Salmonella enterica enterica serovar Typhi
ccgucagggcgagg

SEQ ID NO: 1723746 - RNA, 18 nt, Salmonella enterica enterica serovar Typhi
ccgucagggcgaggccca

SEQ ID NO: 1723747 - RNA, 18 nt, Salmonella enterica enterica serovar Typhi
ccgucaguaccagcgaga

SEQ ID NO: 1723748 - RNA, 23 nt, Salmonella enterica enterica serovar Typhi
ccgucagggucuuauuucuccug

SEQ ID NO: 1723749 - RNA, 23 nt, Salmonella enterica enterica serovar Typhi
ccgucagcgguuguucagugcca

SEQ ID NO: 1723750 - RNA, 20 nt, Salmonella enterica enterica serovar Typhi
ccgucauccagcagcagagc

SEQ ID NO: 1723751 - RNA, 23 nt, Salmonella enterica enterica serovar Typhi
ccgucaguuauaggucagguuua

SEQ ID NO: 1723752 - RNA, 20 nt, Salmonella enterica enterica serovar Typhi
ccgucauauagccgcgcagu

SEQ ID NO: 1723753 - RNA, 23 nt, Salmonella enterica enterica serovar Typhi
ccgucagucgccagaaggcaggc

SEQ ID NO: 1723754 - RNA, 15 nt, Salmonella enterica enterica serovar Typhi
ccgucaucgcccagg

SEQ ID NO: 1723755 - RNA, 16 nt, Salmonella enterica enterica serovar Typhi
ccgucaucgacuucaa

SEQ ID NO: 1723756 - RNA, 17 nt, Salmonella enterica enterica serovar Typhi
ccgucaucgacuucgaa

SEQ ID NO: 1723757 - RNA, 16 nt, Salmonella enterica enterica serovar Typhi
cgcgagaacugcugca

SEQ ID NO: 1723758 - RNA, 20 nt, Salmonella enterica enterica serovar Typhi
cgcgagaagaagaauuauua

SEQ ID NO: 1723759 - RNA, 22 nt, Salmonella enterica enterica serovar Typhi
cgcgacuuuaaucaccugccag

SEQ ID NO: 1723760 - RNA, 15 nt, Salmonella enterica enterica serovar Typhi
cgcgacgacgccagc

SEQ ID NO: 1723761 - RNA, 19 nt, Salmonella enterica enterica serovar Typhi
cgcgacgacgccagccagc

SEQ ID NO: 1723762 - RNA, 24 nt, Salmonella enterica enterica serovar Typhi
cgcgagagucgccaggaucgccgc

SEQ ID NO: 1723763 - RNA, 19 nt, Salmonella enterica enterica serovar Typhi
cgcgagaaaauagaggaaa

SEQ ID NO: 1723764 - RNA, 15 nt, Salmonella enterica enterica serovar Typhi
cgcgauauccaccug

SEQ ID NO: 1723765 - RNA, 23 nt, Salmonella enterica enterica serovar Typhi
cgcgauauccaccaccugauucu

SEQ ID NO: 1723766 - RNA, 17 nt, Salmonella enterica enterica serovar Typhi
cgcgaucaaucacgccg

SEQ ID NO: 1723767 - RNA, 22 nt, Salmonella enterica enterica serovar Typhi
cgcgaguguaaagauuaauaau

SEQ ID NO: 1723768 - RNA, 23 nt, Salmonella enterica enterica serovar Typhi
cgcgauaauaauuaccacgcagc

SEQ ID NO: 1723769 - RNA, 20 nt, Salmonella enterica enterica serovar Typhi
cgcgauacacuccggcgcgc

SEQ ID NO: 1723770 - RNA, 22 nt, Salmonella enterica enterica serovar Typhi
cgcgauacacuccggcgcgcgc

SEQ ID NO: 1723771 - RNA, 15 nt, Salmonella enterica enterica serovar Typhi
cgcgauacgcagcac

SEQ ID NO: 1723772 - RNA, 18 nt, Salmonella enterica enterica serovar Typhi
cgcgauacgcagcaccgc

SEQ ID NO: 1723773 - RNA, 16 nt, Salmonella enterica enterica serovar Typhi
cgcgauacugccgccc

SEQ ID NO: 1723774 - RNA, 14 nt, Salmonella enterica enterica serovar Typhi
cgcgaucacagaca

SEQ ID NO: 1723775 - RNA, 14 nt, Salmonella enterica enterica serovar Typhi
cgcgauccgccagc

SEQ ID NO: 1723776 - RNA, 22 nt, Salmonella enterica enterica serovar Typhi
cgcgaucaguucuugcaggcag

SEQ ID NO: 1723777 - RNA, 23 nt, Salmonella enterica enterica serovar Typhi
cgccuuuuuuaaauuugaccucg

SEQ ID NO: 1723778 - RNA, 12 nt, Salmonella enterica enterica serovar Typhi
cgcgaaaacagc

SEQ ID NO: 1723779 - RNA, 23 nt, Salmonella enterica enterica serovar Typhi
cgcgaaaauaccccagcgcgccg

SEQ ID NO: 1723780 - RNA, 16 nt, Salmonella enterica enterica serovar Typhi
cgcgaaaaucgguaac

SEQ ID NO: 1723781 - RNA, 19 nt, Salmonella enterica enterica serovar Typhi
cgcgaaaaucgguaacauc

SEQ ID NO: 1723782 - RNA, 18 nt, Salmonella enterica enterica serovar Typhi
cgcgaaaacagcuggcga

SEQ ID NO: 1723783 - RNA, 20 nt, Salmonella enterica enterica serovar Typhi
cgcgaaaucaaagaccuccg

SEQ ID NO: 1723784 - RNA, 22 nt, Salmonella enterica enterica serovar Typhi
cgcgaagaucguuauccagcag

SEQ ID NO: 1723785 - RNA, 19 nt, Salmonella enterica enterica serovar Typhi
cgcgaauaguggcgcgcca

SEQ ID NO: 1723786 - RNA, 15 nt, Salmonella enterica enterica serovar Typhi
cgcgaauagccagac

SEQ ID NO: 1723787 - RNA, 20 nt, Salmonella enterica enterica serovar Typhi
cgcgaauaccuaacagccgc

SEQ ID NO: 1723788 - RNA, 20 nt, Salmonella enterica enterica serovar Typhi
cgcgaauagccagacagccc

SEQ ID NO: 1723789 - RNA, 18 nt, Salmonella enterica enterica serovar Typhi
cgcgaauaguggcgcgcc

SEQ ID NO: 1723790 - RNA, 22 nt, Salmonella enterica enterica serovar Typhi
cgccugcgcucauauacccugc

SEQ ID NO: 1723791 - RNA, 14 nt, Salmonella enterica enterica serovar Typhi
cgccugcgcgccug

SEQ ID NO: 1723792 - RNA, 13 nt, Salmonella enterica enterica serovar Typhi
cgccugcgcgccu

SEQ ID NO: 1723793 - RNA, 15 nt, Salmonella enterica enterica serovar Typhi
cgccugucuccagcg

SEQ ID NO: 1723794 - RNA, 17 nt, Salmonella enterica enterica serovar Typhi
cgccugucuccagcgcc

SEQ ID NO: 1723795 - RNA, 22 nt, Salmonella enterica enterica serovar Typhi
cgccugugcuuucgccaccagc

SEQ ID NO: 1723796 - RNA, 11 nt, Salmonella enterica enterica serovar Typhi
cgccugcugcg

SEQ ID NO: 1723797 - RNA, 15 nt, Salmonella enterica enterica serovar Typhi
cgccuuucagauggu

SEQ ID NO: 1723798 - RNA, 14 nt, Salmonella enterica enterica serovar Typhi
cgccuugcggcggc

SEQ ID NO: 1723799 - RNA, 14 nt, Salmonella enterica enterica serovar Typhi
cgccuugcccgcgc

SEQ ID NO: 1723800 - RNA, 20 nt, Salmonella enterica enterica serovar Typhi
cgccuuaagaauguccaucu

SEQ ID NO: 1723801 - RNA, 18 nt, Salmonella enterica enterica serovar Typhi
cgccuguuuacugacgcc

SEQ ID NO: 1723802 - RNA, 15 nt, Salmonella enterica enterica serovar Typhi
cgccuuauccggccu

SEQ ID NO: 1723803 - RNA, 22 nt, Salmonella enterica enterica serovar Typhi
cgccuucggcgucgugcugggc

SEQ ID NO: 1723804 - RNA, 14 nt, Salmonella enterica enterica serovar Typhi
cgccuucuucaucu

SEQ ID NO: 1723805 - RNA, 15 nt, Salmonella enterica enterica serovar Typhi
cgccuucuucaucuu

SEQ ID NO: 1723806 - RNA, 16 nt, Salmonella enterica enterica serovar Typhi
cgcgccuccccugccg

SEQ ID NO: 1723807 - RNA, 17 nt, Salmonella enterica enterica serovar Typhi
cgcgccuagcgcgcgca

SEQ ID NO: 1723808 - RNA, 11 nt, Salmonella enterica enterica serovar Typhi
cgcgccguucg

SEQ ID NO: 1723809 - RNA, 15 nt, Salmonella enterica enterica serovar Typhi
cgcgccgugcccagc

SEQ ID NO: 1723810 - RNA, 16 nt, Salmonella enterica enterica serovar Typhi
cgcgccugacgcggac

SEQ ID NO: 1723811 - RNA, 22 nt, Salmonella enterica enterica serovar Typhi
cgcgccuccccugccggcggca

SEQ ID NO: 1723812 - RNA, 21 nt, Salmonella enterica enterica serovar Typhi
cgcgcgccgcuuccggcaggu

SEQ ID NO: 1723813 - RNA, 13 nt, Salmonella enterica enterica serovar Typhi
cgcgcgccgccuc

SEQ ID NO: 1723814 - RNA, 13 nt, Salmonella enterica enterica serovar Typhi
cgcgccgcgcagc

SEQ ID NO: 1723815 - RNA, 17 nt, Salmonella enterica enterica serovar Typhi
cgcgccgguagcgagaa

SEQ ID NO: 1723816 - RNA, 14 nt, Salmonella enterica enterica serovar Typhi
cgcgcccgccgcca

SEQ ID NO: 1723817 - RNA, 15 nt, Salmonella enterica enterica serovar Typhi
cgcgcccgccgccaa

SEQ ID NO: 1723818 - RNA, 17 nt, Salmonella enterica enterica serovar Typhi
cgcgcccaucuccagcc

SEQ ID NO: 1723819 - RNA, 15 nt, Salmonella enterica enterica serovar Typhi
cgcgccaaaccguuc

SEQ ID NO: 1723820 - RNA, 16 nt, Salmonella enterica enterica serovar Typhi
cgcgccaaacggcagc

SEQ ID NO: 1723821 - RNA, 17 nt, Salmonella enterica enterica serovar Typhi
cgcgccaaacggcagcu

SEQ ID NO: 1723822 - RNA, 21 nt, Salmonella enterica enterica serovar Typhi
cgcgccaauccaugccggcuu

SEQ ID NO: 1723823 - RNA, 14 nt, Salmonella enterica enterica serovar Typhi
cgcgcccagcagca

SEQ ID NO: 1723824 - RNA, 17 nt, Salmonella enterica enterica serovar Typhi
cgcgccauuugccagau

SEQ ID NO: 1723825 - RNA, 20 nt, Salmonella enterica enterica serovar Typhi
cgcgccaaaagaggcagcaa

SEQ ID NO: 1723826 - RNA, 14 nt, Salmonella enterica enterica serovar Typhi
cgcgcacgcgcgcg

SEQ ID NO: 1723827 - RNA, 13 nt, Salmonella enterica enterica serovar Typhi
cgcgcacgcgcgc

SEQ ID NO: 1723828 - RNA, 15 nt, Salmonella enterica enterica serovar Typhi
cgcgauucgggccgc

SEQ ID NO: 1723829 - RNA, 18 nt, Salmonella enterica enterica serovar Typhi
cgcgauguuugcucgcca

SEQ ID NO: 1723830 - RNA, 19 nt, Salmonella enterica enterica serovar Typhi
cgcgauggugacuauucuu

SEQ ID NO: 1723831 - RNA, 15 nt, Salmonella enterica enterica serovar Typhi
cgcgcaaccgcauca

SEQ ID NO: 1723832 - RNA, 20 nt, Salmonella enterica enterica serovar Typhi
cgcgcaaaacucucaccgac

SEQ ID NO: 1723833 - RNA, 23 nt, Salmonella enterica enterica serovar Typhi
cgcgauuuuuuuccgcccgccuu

SEQ ID NO: 1723834 - RNA, 11 nt, Salmonella enterica enterica serovar Typhi
cgcgaugcugc

SEQ ID NO: 1723835 - RNA, 17 nt, Salmonella enterica enterica serovar Typhi
cgcgaucgcgccagccu

SEQ ID NO: 1723836 - RNA, 13 nt, Salmonella enterica enterica serovar Typhi
cgcgguugacgcu

SEQ ID NO: 1723837 - RNA, 15 nt, Salmonella enterica enterica serovar Typhi
cgcggucgccugccg

SEQ ID NO: 1723838 - RNA, 16 nt, Salmonella enterica enterica serovar Typhi
cgcggguucuuuccac

SEQ ID NO: 1723839 - RNA, 21 nt, Salmonella enterica enterica serovar Typhi
cgcggucaacguuaacugcug

SEQ ID NO: 1723840 - RNA, 21 nt, Salmonella enterica enterica serovar Typhi
cgcgguauuucgcaacgccgc

SEQ ID NO: 1723841 - RNA, 12 nt, Salmonella enterica enterica serovar Typhi
cgcggucagcgg

SEQ ID NO: 1723842 - RNA, 14 nt, Salmonella enterica enterica serovar Typhi
cgcggucagcggcg

SEQ ID NO: 1723843 - RNA, 18 nt, Salmonella enterica enterica serovar Typhi
cgcggucagcggcgcgcc

SEQ ID NO: 1723844 - RNA, 23 nt, Salmonella enterica enterica serovar Typhi
cgcggucagggugaaucccgcca

SEQ ID NO: 1723845 - RNA, 19 nt, Salmonella enterica enterica serovar Typhi
cgcguauucucaaccagcc

SEQ ID NO: 1723846 - RNA, 19 nt, Salmonella enterica enterica serovar Typhi
cgcguauaacgccgccccc

SEQ ID NO: 1723847 - RNA, 17 nt, Salmonella enterica enterica serovar Typhi
cgcguauaacgccgccc

SEQ ID NO: 1723848 - RNA, 14 nt, Salmonella enterica enterica serovar Typhi
cgcgucccucucca

SEQ ID NO: 1723849 - RNA, 15 nt, Salmonella enterica enterica serovar Typhi
cgcgucccucuccag

SEQ ID NO: 1723850 - RNA, 14 nt, Salmonella enterica enterica serovar Typhi
cgcguaccucagca

SEQ ID NO: 1723851 - RNA, 18 nt, Salmonella enterica enterica serovar Typhi
cgcguagcccacagguag

SEQ ID NO: 1723852 - RNA, 23 nt, Salmonella enterica enterica serovar Typhi
cgcguaaguuugcguacucagca

SEQ ID NO: 1723853 - RNA, 19 nt, Salmonella enterica enterica serovar Typhi
cgcguaaucuuccacccgc

SEQ ID NO: 1723854 - RNA, 20 nt, Salmonella enterica enterica serovar Typhi
cgcguaaucuuccacccgcg

SEQ ID NO: 1723855 - RNA, 19 nt, Salmonella enterica enterica serovar Typhi
cgcguaaacuuccgccagc

SEQ ID NO: 1723856 - RNA, 20 nt, Salmonella enterica enterica serovar Typhi
cgcguaaauccacauuccag

SEQ ID NO: 1723857 - RNA, 20 nt, Salmonella enterica enterica serovar Typhi
cgcguguuuguaaaaauaga

SEQ ID NO: 1723858 - RNA, 16 nt, Salmonella enterica enterica serovar Typhi
cgcguuuuccauuuua

SEQ ID NO: 1723859 - RNA, 12 nt, Salmonella enterica enterica serovar Typhi
cgcgucuucauc

SEQ ID NO: 1723860 - RNA, 21 nt, Salmonella enterica enterica serovar Typhi
cgcgucguucacgucgcgaag

SEQ ID NO: 1723861 - RNA, 22 nt, Salmonella enterica enterica serovar Typhi
cgcgucguucacgucgcgaagc

SEQ ID NO: 1723862 - RNA, 21 nt, Salmonella enterica enterica serovar Typhi
cgcgucugaaugacgccgucu

SEQ ID NO: 1723863 - RNA, 21 nt, Salmonella enterica enterica serovar Typhi
cgcggcgaaaaagccggcgga

SEQ ID NO: 1723864 - RNA, 15 nt, Salmonella enterica enterica serovar Typhi
cgcgggcuggccggc

SEQ ID NO: 1723865 - RNA, 20 nt, Salmonella enterica enterica serovar Typhi
cgcggcaucguagucaggca

SEQ ID NO: 1723866 - RNA, 13 nt, Salmonella enterica enterica serovar Typhi
cgcggcaggaaug

SEQ ID NO: 1723867 - RNA, 22 nt, Salmonella enterica enterica serovar Typhi
cgcggcaaugagcggccagcgg

SEQ ID NO: 1723868 - RNA, 15 nt, Salmonella enterica enterica serovar Typhi
cgcggcaaccagccc

SEQ ID NO: 1723869 - RNA, 16 nt, Salmonella enterica enterica serovar Typhi
cgcggauaagcccggc

SEQ ID NO: 1723870 - RNA, 22 nt, Salmonella enterica enterica serovar Typhi
cgcggcaaccguauccagaccc

SEQ ID NO: 1723871 - RNA, 22 nt, Salmonella enterica enterica serovar Typhi
cgcggcacacaacacggcggcu

SEQ ID NO: 1723872 - RNA, 13 nt, Salmonella enterica enterica serovar Typhi
cgcggccaaaacc

SEQ ID NO: 1723873 - RNA, 13 nt, Salmonella enterica enterica serovar Typhi
cgcggccaccaga

SEQ ID NO: 1723874 - RNA, 18 nt, Salmonella enterica enterica serovar Typhi
cgcggagagucgaccagc

SEQ ID NO: 1723875 - RNA, 15 nt, Salmonella enterica enterica serovar Typhi
cgcgcuuccugccag

SEQ ID NO: 1723876 - RNA, 20 nt, Salmonella enterica enterica serovar Typhi
cgcgcuggugggacuguuca

SEQ ID NO: 1723877 - RNA, 22 nt, Salmonella enterica enterica serovar Typhi
cgcccgauaauaucacucccgc

SEQ ID NO: 1723878 - RNA, 14 nt, Salmonella enterica enterica serovar Typhi
cgcccgcaaaagcg

SEQ ID NO: 1723879 - RNA, 15 nt, Salmonella enterica enterica serovar Typhi
cgcccgcaccgccga

SEQ ID NO: 1723880 - RNA, 13 nt, Salmonella enterica enterica serovar Typhi
cgcccgccgccug

SEQ ID NO: 1723881 - RNA, 15 nt, Salmonella enterica enterica serovar Typhi
cgcccgccaucgccc

SEQ ID NO: 1723882 - RNA, 15 nt, Salmonella enterica enterica serovar Typhi
cgcccgaccacgccc

SEQ ID NO: 1723883 - RNA, 19 nt, Salmonella enterica enterica serovar Typhi
cgcccgauaauaucacucc

SEQ ID NO: 1723884 - RNA, 13 nt, Salmonella enterica enterica serovar Typhi
cgccccgaccagg

SEQ ID NO: 1723885 - RNA, 12 nt, Salmonella enterica enterica serovar Typhi
cgcccccugcca

SEQ ID NO: 1723886 - RNA, 14 nt, Salmonella enterica enterica serovar Typhi
cgcccccugccagc

SEQ ID NO: 1723887 - RNA, 20 nt, Salmonella enterica enterica serovar Typhi
cgccccagaagagcgagucu

SEQ ID NO: 1723888 - RNA, 16 nt, Salmonella enterica enterica serovar Typhi
cgccccaaucgccagu

SEQ ID NO: 1723889 - RNA, 15 nt, Salmonella enterica enterica serovar Typhi
cgccccaaucgccag

SEQ ID NO: 1723890 - RNA, 17 nt, Salmonella enterica enterica serovar Typhi
cgcccauuccgccugcc

SEQ ID NO: 1723891 - RNA, 15 nt, Salmonella enterica enterica serovar Typhi
cgcccauuccgccug

SEQ ID NO: 1723892 - RNA, 16 nt, Salmonella enterica enterica serovar Typhi
cgcccauuccgccugc

SEQ ID NO: 1723893 - RNA, 16 nt, Salmonella enterica enterica serovar Typhi
cgcccaggucgcccag

SEQ ID NO: 1723894 - RNA, 12 nt, Salmonella enterica enterica serovar Typhi
cgcccagucacg

SEQ ID NO: 1723895 - RNA, 17 nt, Salmonella enterica enterica serovar Typhi
cgcccaguccuuccggc

SEQ ID NO: 1723896 - RNA, 22 nt, Salmonella enterica enterica serovar Typhi
cgcccauuaauaucagccccac

SEQ ID NO: 1723897 - RNA, 21 nt, Salmonella enterica enterica serovar Typhi
cgcccauuagcauuccgcccg

SEQ ID NO: 1723898 - RNA, 16 nt, Salmonella enterica enterica serovar Typhi
cgccacggccagcagc

SEQ ID NO: 1723899 - RNA, 15 nt, Salmonella enterica enterica serovar Typhi
cgccacgcuccuucu

SEQ ID NO: 1723900 - RNA, 20 nt, Salmonella enterica enterica serovar Typhi
cgccacgcgacgccagccga

SEQ ID NO: 1723901 - RNA, 19 nt, Salmonella enterica enterica serovar Typhi
cgccaccgggcaacacacg

SEQ ID NO: 1723902 - RNA, 15 nt, Salmonella enterica enterica serovar Typhi
cgccacgccgcccgc

SEQ ID NO: 1723903 - RNA, 19 nt, Salmonella enterica enterica serovar Typhi
cgccacgccgcuccacagc

SEQ ID NO: 1723904 - RNA, 17 nt, Salmonella enterica enterica serovar Typhi
cgccaucuccuccucau

SEQ ID NO: 1723905 - RNA, 14 nt, Salmonella enterica enterica serovar Typhi
cgccaucugugcca

SEQ ID NO: 1723906 - RNA, 18 nt, Salmonella enterica enterica serovar Typhi
cgccaucuuccgggucag

SEQ ID NO: 1723907 - RNA, 16 nt, Salmonella enterica enterica serovar Typhi
cgccaucuuucaccca

SEQ ID NO: 1723908 - RNA, 18 nt, Salmonella enterica enterica serovar Typhi
cgccaucguuccgguucu

SEQ ID NO: 1723909 - RNA, 14 nt, Salmonella enterica enterica serovar Typhi
cgccaucucacgca

SEQ ID NO: 1723910 - RNA, 18 nt, Salmonella enterica enterica serovar Typhi
cgccaucucauucgccag

SEQ ID NO: 1723911 - RNA, 16 nt, Salmonella enterica enterica serovar Typhi
cgccaucuccggcagc

SEQ ID NO: 1723912 - RNA, 15 nt, Salmonella enterica enterica serovar Typhi
cgccauggccgcagc

SEQ ID NO: 1723913 - RNA, 23 nt, Salmonella enterica enterica serovar Typhi
cgccaugcugugugaccagcagu

SEQ ID NO: 1723914 - RNA, 22 nt, Salmonella enterica enterica serovar Typhi
cgcccacaucuguuugagaaaa

SEQ ID NO: 1723915 - RNA, 21 nt, Salmonella enterica enterica serovar Typhi
cgcccaccgccaaccgcccgu

SEQ ID NO: 1723916 - RNA, 11 nt, Salmonella enterica enterica serovar Typhi
cgcccagcagc

SEQ ID NO: 1723917 - RNA, 15 nt, Salmonella enterica enterica serovar Typhi
cgcccagcaugggca

SEQ ID NO: 1723918 - RNA, 13 nt, Salmonella enterica enterica serovar Typhi
cgcccagccaaag

SEQ ID NO: 1723919 - RNA, 14 nt, Salmonella enterica enterica serovar Typhi
cgcccagccaaagc

SEQ ID NO: 1723920 - RNA, 14 nt, Salmonella enterica enterica serovar Typhi
cgccgccaucacca

SEQ ID NO: 1723921 - RNA, 13 nt, Salmonella enterica enterica serovar Typhi
cgccgccaccaug

SEQ ID NO: 1723922 - RNA, 22 nt, Salmonella enterica enterica serovar Typhi
cgccgccaccauguugcgcagc

SEQ ID NO: 1723923 - RNA, 20 nt, Salmonella enterica enterica serovar Typhi
cgccgcaucuuuugccgcgg

SEQ ID NO: 1723924 - RNA, 13 nt, Salmonella enterica enterica serovar Typhi
cgccgccaccaaa

SEQ ID NO: 1723925 - RNA, 21 nt, Salmonella enterica enterica serovar Typhi
cgccgccaaacugcgcgccgc

SEQ ID NO: 1723926 - RNA, 13 nt, Salmonella enterica enterica serovar Typhi
cgccgagcgccgu

SEQ ID NO: 1723927 - RNA, 17 nt, Salmonella enterica enterica serovar Typhi
cgccgacgaccggcagc

SEQ ID NO: 1723928 - RNA, 17 nt, Salmonella enterica enterica serovar Typhi
cgccgacgcauccgcca

SEQ ID NO: 1723929 - RNA, 19 nt, Salmonella enterica enterica serovar Typhi
cgccgagugcuugcauuuu

SEQ ID NO: 1723930 - RNA, 16 nt, Salmonella enterica enterica serovar Typhi
cgccgaguaauuugaa

SEQ ID NO: 1723931 - RNA, 22 nt, Salmonella enterica enterica serovar Typhi
cgccgauaaauccuccggcgcg

SEQ ID NO: 1723932 - RNA, 13 nt, Salmonella enterica enterica serovar Typhi
cgcccucgccagc

SEQ ID NO: 1723933 - RNA, 17 nt, Salmonella enterica enterica serovar Typhi
cgcccggauaacggcgc

SEQ ID NO: 1723934 - RNA, 23 nt, Salmonella enterica enterica serovar Typhi
cgcccggagggguuuucgccagc

SEQ ID NO: 1723935 - RNA, 16 nt, Salmonella enterica enterica serovar Typhi
cgcccgccucgcugau

SEQ ID NO: 1723936 - RNA, 11 nt, Salmonella enterica enterica serovar Typhi
cgcccgcuuca

SEQ ID NO: 1723937 - RNA, 18 nt, Salmonella enterica enterica serovar Typhi
cgcccugcucccacagcu

SEQ ID NO: 1723938 - RNA, 21 nt, Salmonella enterica enterica serovar Typhi
cgcccuggaggaacagcgccg

SEQ ID NO: 1723939 - RNA, 23 nt, Salmonella enterica enterica serovar Typhi
cgcccuguggaaacuccagcggc

SEQ ID NO: 1723940 - RNA, 23 nt, Salmonella enterica enterica serovar Typhi
cgcccuggcgggaaacagguacu

SEQ ID NO: 1723941 - RNA, 15 nt, Salmonella enterica enterica serovar Typhi
cgcccuguaagaggc

SEQ ID NO: 1723942 - RNA, 15 nt, Salmonella enterica enterica serovar Typhi
cgcccugucauuaag

SEQ ID NO: 1723943 - RNA, 14 nt, Salmonella enterica enterica serovar Typhi
cgccgaagccagcg

SEQ ID NO: 1723944 - RNA, 22 nt, Salmonella enterica enterica serovar Typhi
cgccgaaggcaacgccgccagc

SEQ ID NO: 1723945 - RNA, 17 nt, Salmonella enterica enterica serovar Typhi
cgccggcaacacccgcc

SEQ ID NO: 1723946 - RNA, 18 nt, Salmonella enterica enterica serovar Typhi
cgccggauuuaccagcgc

SEQ ID NO: 1723947 - RNA, 23 nt, Salmonella enterica enterica serovar Typhi
cgccggcagcaguucuucgccgg

SEQ ID NO: 1723948 - RNA, 19 nt, Salmonella enterica enterica serovar Typhi
cgccggaaucgcgauccag

SEQ ID NO: 1723949 - RNA, 16 nt, Salmonella enterica enterica serovar Typhi
cgccggagccgccugg

SEQ ID NO: 1723950 - RNA, 16 nt, Salmonella enterica enterica serovar Typhi
cgccggccccgcuucc

SEQ ID NO: 1723951 - RNA, 14 nt, Salmonella enterica enterica serovar Typhi
cgccggccccgcuu

SEQ ID NO: 1723952 - RNA, 17 nt, Salmonella enterica enterica serovar Typhi
cgccgggaugcuuuccg

SEQ ID NO: 1723953 - RNA, 18 nt, Salmonella enterica enterica serovar Typhi
cgccggcugcgcugccag

SEQ ID NO: 1723954 - RNA, 16 nt, Salmonella enterica enterica serovar Typhi
cgccgucggcaauaaa

SEQ ID NO: 1723955 - RNA, 17 nt, Salmonella enterica enterica serovar Typhi
cgccguacuccagccca

SEQ ID NO: 1723956 - RNA, 19 nt, Salmonella enterica enterica serovar Typhi
cgccguagcugcgcgccgc

SEQ ID NO: 1723957 - RNA, 17 nt, Salmonella enterica enterica serovar Typhi
cgccguagaacgggccg

SEQ ID NO: 1723958 - RNA, 15 nt, Salmonella enterica enterica serovar Typhi
cgccguaaccgccug

SEQ ID NO: 1723959 - RNA, 19 nt, Salmonella enterica enterica serovar Typhi
cgccguaaggcguaccgcc

SEQ ID NO: 1723960 - RNA, 22 nt, Salmonella enterica enterica serovar Typhi
aaacguugcuggacauauucca

SEQ ID NO: 1723961 - RNA, 15 nt, Salmonella enterica enterica serovar Typhi
aaacguuccugccag

SEQ ID NO: 1723962 - RNA, 17 nt, Salmonella enterica enterica serovar Typhi
aaacguucggugaagaa

SEQ ID NO: 1723963 - RNA, 16 nt, Salmonella enterica enterica serovar Typhi
aaacguucauccgacc

SEQ ID NO: 1723964 - RNA, 13 nt, Salmonella enterica enterica serovar Typhi
aaacgucaugcug

SEQ ID NO: 1723965 - RNA, 16 nt, Salmonella enterica enterica serovar Typhi
aaacgucguaaaaccu

SEQ ID NO: 1723966 - RNA, 21 nt, Salmonella enterica enterica serovar Typhi
cgccgcguaaucuucgcggcu

SEQ ID NO: 1723967 - RNA, 22 nt, Salmonella enterica enterica serovar Typhi
cgccgcguaaauccacauucca

SEQ ID NO: 1723968 - RNA, 13 nt, Salmonella enterica enterica serovar Typhi
cgccgcuggcggg

SEQ ID NO: 1723969 - RNA, 13 nt, Salmonella enterica enterica serovar Typhi
cgccgcuuccccc

SEQ ID NO: 1723970 - RNA, 19 nt, Salmonella enterica enterica serovar Typhi
cgccgcuuuucaggggucc

SEQ ID NO: 1723971 - RNA, 17 nt, Salmonella enterica enterica serovar Typhi
cgccgcuuuuuccgccg

SEQ ID NO: 1723972 - RNA, 22 nt, Salmonella enterica enterica serovar Typhi
cgccgcuuuuuucagcggcagc

SEQ ID NO: 1723973 - RNA, 19 nt, Salmonella enterica enterica serovar Typhi
cgccggaaaaaaugggcug

SEQ ID NO: 1723974 - RNA, 19 nt, Salmonella enterica enterica serovar Typhi
cgccggaaagaaacgccgc

SEQ ID NO: 1723975 - RNA, 22 nt, Salmonella enterica enterica serovar Typhi
cgccggaaagaauaaucgccgc

SEQ ID NO: 1723976 - RNA, 17 nt, Salmonella enterica enterica serovar Typhi
cgccgcuauuaccccgc

SEQ ID NO: 1723977 - RNA, 24 nt, Salmonella enterica enterica serovar Typhi
cgccgccggccugacgaccguugc

SEQ ID NO: 1723978 - RNA, 16 nt, Salmonella enterica enterica serovar Typhi
cgccgccuaucgccag

SEQ ID NO: 1723979 - RNA, 21 nt, Salmonella enterica enterica serovar Typhi
cgccgccucgcgauccgccag

SEQ ID NO: 1723980 - RNA, 16 nt, Salmonella enterica enterica serovar Typhi
aaacguaccugagaga

SEQ ID NO: 1723981 - RNA, 18 nt, Salmonella enterica enterica serovar Typhi
aaacgucacaauacuucc

SEQ ID NO: 1723982 - RNA, 18 nt, Salmonella enterica enterica serovar Typhi
cgccgcgaacaaagcccc

SEQ ID NO: 1723983 - RNA, 13 nt, Salmonella enterica enterica serovar Typhi
cgccgcgagcagc

SEQ ID NO: 1723984 - RNA, 20 nt, Salmonella enterica enterica serovar Typhi
cgccgcgauguuugcucgcc

SEQ ID NO: 1723985 - RNA, 21 nt, Salmonella enterica enterica serovar Typhi
cgauuggccgucucuuucaug

SEQ ID NO: 1723986 - RNA, 12 nt, Salmonella enterica enterica serovar Typhi
cgauuugccccg

SEQ ID NO: 1723987 - RNA, 13 nt, Salmonella enterica enterica serovar Typhi
cgauugucaucau

SEQ ID NO: 1723988 - RNA, 20 nt, Salmonella enterica enterica serovar Typhi
cgauucucugaggguguuca

SEQ ID NO: 1723989 - RNA, 18 nt, Salmonella enterica enterica serovar Typhi
cgcaaaauuccggcugau

SEQ ID NO: 1723990 - RNA, 18 nt, Salmonella enterica enterica serovar Typhi
cgcaaacgccugcuccgu

SEQ ID NO: 1723991 - RNA, 19 nt, Salmonella enterica enterica serovar Typhi
cgcaaacugccaggcaauc

SEQ ID NO: 1723992 - RNA, 22 nt, Salmonella enterica enterica serovar Typhi
cgcaaacuuugcgccauuucaa

SEQ ID NO: 1723993 - RNA, 23 nt, Salmonella enterica enterica serovar Typhi
cgcaaacugcgcgcccgccuccg

SEQ ID NO: 1723994 - RNA, 15 nt, Salmonella enterica enterica serovar Typhi
cgauuuuuaggccaa

SEQ ID NO: 1723995 - RNA, 15 nt, Salmonella enterica enterica serovar Typhi
cgcaaaagcgcgccc

SEQ ID NO: 1723996 - RNA, 22 nt, Salmonella enterica enterica serovar Typhi
cgauuuugacaaugaugguuaa

SEQ ID NO: 1723997 - RNA, 16 nt, Salmonella enterica enterica serovar Typhi
cgauuuuaugcauggu

SEQ ID NO: 1723998 - RNA, 17 nt, Salmonella enterica enterica serovar Typhi
cgaugaugaaaaagaau

SEQ ID NO: 1723999 - RNA, 23 nt, Salmonella enterica enterica serovar Typhi
cgauaugaauaauuucggcggcg

SEQ ID NO: 1724000 - RNA, 23 nt, Salmonella enterica enterica serovar Typhi
cgauauuucgccuaucaugcugc

SEQ ID NO: 1724001 - RNA, 21 nt, Salmonella enterica enterica serovar Typhi
cgauauucgggcgcaugucag

SEQ ID NO: 1724002 - RNA, 19 nt, Salmonella enterica enterica serovar Typhi
cgaugauaacgcgccgcgc

SEQ ID NO: 1724003 - RNA, 14 nt, Salmonella enterica enterica serovar Typhi
cgaugcgcuuuucc

SEQ ID NO: 1724004 - RNA, 21 nt, Salmonella enterica enterica serovar Typhi
cgaugcggagauagcggugcc

SEQ ID NO: 1724005 - RNA, 17 nt, Salmonella enterica enterica serovar Typhi
cgaugcgguucaacgcg

SEQ ID NO: 1724006 - RNA, 21 nt, Salmonella enterica enterica serovar Typhi
cgaugcugaauagccagcccc

SEQ ID NO: 1724007 - RNA, 18 nt, Salmonella enterica enterica serovar Typhi
cgaugcuaugauggccga

SEQ ID NO: 1724008 - RNA, 15 nt, Salmonella enterica enterica serovar Typhi
cgaugcguucaaaaa

SEQ ID NO: 1724009 - RNA, 19 nt, Salmonella enterica enterica serovar Typhi
cgaugcguucaaaaagcug

SEQ ID NO: 1724010 - RNA, 15 nt, Salmonella enterica enterica serovar Typhi
cgauggucgccuccg

SEQ ID NO: 1724011 - RNA, 18 nt, Salmonella enterica enterica serovar Typhi
cgaugcuguuucaguaaa

SEQ ID NO: 1724012 - RNA, 14 nt, Salmonella enterica enterica serovar Typhi
cgcacuuuuccagc

SEQ ID NO: 1724013 - RNA, 16 nt, Salmonella enterica enterica serovar Typhi
cgcacuuuucccgcca

SEQ ID NO: 1724014 - RNA, 13 nt, Salmonella enterica enterica serovar Typhi
cgcacgcgcgccc

SEQ ID NO: 1724015 - RNA, 13 nt, Salmonella enterica enterica serovar Typhi
cgcacuccccaga

SEQ ID NO: 1724016 - RNA, 14 nt, Salmonella enterica enterica serovar Typhi
cgcacucagaaaau

SEQ ID NO: 1724017 - RNA, 20 nt, Salmonella enterica enterica serovar Typhi
cgcacgccggccccgcuucc

SEQ ID NO: 1724018 - RNA, 14 nt, Salmonella enterica enterica serovar Typhi
cgcacgccagcggu

SEQ ID NO: 1724019 - RNA, 20 nt, Salmonella enterica enterica serovar Typhi
cgcacagggugaaaucacgc

SEQ ID NO: 1724020 - RNA, 21 nt, Salmonella enterica enterica serovar Typhi
cgcaacguuucuuucaucaga

SEQ ID NO: 1724021 - RNA, 23 nt, Salmonella enterica enterica serovar Typhi
cgcaacguuucuuucaucagauc

SEQ ID NO: 1724022 - RNA, 16 nt, Salmonella enterica enterica serovar Typhi
cgcaacguuucuuuca

SEQ ID NO: 1724023 - RNA, 15 nt, Salmonella enterica enterica serovar Typhi
cgcaacgucaguacg

SEQ ID NO: 1724024 - RNA, 12 nt, Salmonella enterica enterica serovar Typhi
cgcaagcagcac

SEQ ID NO: 1724025 - RNA, 19 nt, Salmonella enterica enterica serovar Typhi
cgcaaagcaauguaaaacu

SEQ ID NO: 1724026 - RNA, 16 nt, Salmonella enterica enterica serovar Typhi
cgcaaagcccaucagc

SEQ ID NO: 1724027 - RNA, 19 nt, Salmonella enterica enterica serovar Typhi
cgcaaauucaucgccgccg

SEQ ID NO: 1724028 - RNA, 21 nt, Salmonella enterica enterica serovar Typhi
cgcaacauucugcuuccagaa

SEQ ID NO: 1724029 - RNA, 18 nt, Salmonella enterica enterica serovar Typhi
cgcaacgcuaggcaaccu

SEQ ID NO: 1724030 - RNA, 22 nt, Salmonella enterica enterica serovar Typhi
cgcaacgcuuccaccucuucug

SEQ ID NO: 1724031 - RNA, 18 nt, Salmonella enterica enterica serovar Typhi
cgcaacggucggucuuuu

SEQ ID NO: 1724032 - RNA, 15 nt, Salmonella enterica enterica serovar Typhi
cgcaggcuugcccau

SEQ ID NO: 1724033 - RNA, 22 nt, Salmonella enterica enterica serovar Typhi
cgcaggcauuaaaaaaacguag

SEQ ID NO: 1724034 - RNA, 12 nt, Salmonella enterica enterica serovar Typhi
cgcaggccaaac

SEQ ID NO: 1724035 - RNA, 13 nt, Salmonella enterica enterica serovar Typhi
cgcaggagggagg

SEQ ID NO: 1724036 - RNA, 22 nt, Salmonella enterica enterica serovar Typhi
cgcaggauaaagaccggcacaa

SEQ ID NO: 1724037 - RNA, 21 nt, Salmonella enterica enterica serovar Typhi
cgcagaguaaaaaaaccggcg

SEQ ID NO: 1724038 - RNA, 15 nt, Salmonella enterica enterica serovar Typhi
cgcagagucgcagcg

SEQ ID NO: 1724039 - RNA, 19 nt, Salmonella enterica enterica serovar Typhi
cgcagauaucuuccagcgc

SEQ ID NO: 1724040 - RNA, 18 nt, Salmonella enterica enterica serovar Typhi
cgcagaguguaggccuga

SEQ ID NO: 1724041 - RNA, 16 nt, Salmonella enterica enterica serovar Typhi
cgcagcuccagcucag

SEQ ID NO: 1724042 - RNA, 12 nt, Salmonella enterica enterica serovar Typhi
cgcagcggcggu

SEQ ID NO: 1724043 - RNA, 22 nt, Salmonella enterica enterica serovar Typhi
cgcaucguggccgauauugccu

SEQ ID NO: 1724044 - RNA, 19 nt, Salmonella enterica enterica serovar Typhi
cgcaucggcccuguauaca

SEQ ID NO: 1724045 - RNA, 18 nt, Salmonella enterica enterica serovar Typhi
cgcaucgggucgcgcgcc

SEQ ID NO: 1724046 - RNA, 16 nt, Salmonella enterica enterica serovar Typhi
cgcaucugggcugaga

SEQ ID NO: 1724047 - RNA, 21 nt, Salmonella enterica enterica serovar Typhi
cgcaucugggcugagaaaaau

SEQ ID NO: 1724048 - RNA, 22 nt, Salmonella enterica enterica serovar Typhi
cgcaugaucucuugcauaauau

SEQ ID NO: 1724049 - RNA, 15 nt, Salmonella enterica enterica serovar Typhi
cgcaugacccaggca

SEQ ID NO: 1724050 - RNA, 16 nt, Salmonella enterica enterica serovar Typhi
cgcaucgauaucuuua

SEQ ID NO: 1724051 - RNA, 14 nt, Salmonella enterica enterica serovar Typhi
cgcaucagaaaaac

SEQ ID NO: 1724052 - RNA, 22 nt, Salmonella enterica enterica serovar Typhi
cgcaucaggaucuucaucccau

SEQ ID NO: 1724053 - RNA, 18 nt, Salmonella enterica enterica serovar Typhi
cgcaucaggaucuucauc

SEQ ID NO: 1724054 - RNA, 23 nt, Salmonella enterica enterica serovar Typhi
aaacggcagccgccaccacaaag

SEQ ID NO: 1724055 - RNA, 18 nt, Salmonella enterica enterica serovar Typhi
aaacggccagugaaauaa

SEQ ID NO: 1724056 - RNA, 15 nt, Salmonella enterica enterica serovar Typhi
aaacggccugcgcug

SEQ ID NO: 1724057 - RNA, 14 nt, Salmonella enterica enterica serovar Typhi
aaacggcccggcgu

SEQ ID NO: 1724058 - RNA, 20 nt, Salmonella enterica enterica serovar Typhi
aaacggcuuuaauaccccug

SEQ ID NO: 1724059 - RNA, 14 nt, Salmonella enterica enterica serovar Typhi
aaacgggcgcggca

SEQ ID NO: 1724060 - RNA, 19 nt, Salmonella enterica enterica serovar Typhi
cgcaucaacguaaauagag

SEQ ID NO: 1724061 - RNA, 22 nt, Salmonella enterica enterica serovar Typhi
cgcaucaaacuugcccagcgcc

SEQ ID NO: 1724062 - RNA, 23 nt, Salmonella enterica enterica serovar Typhi
cgcauauuuuuuaccgcccgcuu

SEQ ID NO: 1724063 - RNA, 21 nt, Salmonella enterica enterica serovar Typhi
cgcauaggcuuugcugagcgc

SEQ ID NO: 1724064 - RNA, 16 nt, Salmonella enterica enterica serovar Typhi
cgcauagcggccagau

SEQ ID NO: 1724065 - RNA, 21 nt, Salmonella enterica enterica serovar Typhi
cgcauagauauaaacgcccga

SEQ ID NO: 1724066 - RNA, 15 nt, Salmonella enterica enterica serovar Typhi
cgcaugggcauaauc

SEQ ID NO: 1724067 - RNA, 22 nt, Salmonella enterica enterica serovar Typhi
cgcauuaauauuucacgagcga

SEQ ID NO: 1724068 - RNA, 12 nt, Salmonella enterica enterica serovar Typhi
cgcauucauaag

SEQ ID NO: 1724069 - RNA, 19 nt, Salmonella enterica enterica serovar Typhi
cgcauugcgccccagcaca

SEQ ID NO: 1724070 - RNA, 13 nt, Salmonella enterica enterica serovar Typhi
cgcauucuuuuuu

SEQ ID NO: 1724071 - RNA, 23 nt, Salmonella enterica enterica serovar Typhi
cgcauuuaaucgccugcgcgccu

SEQ ID NO: 1724072 - RNA, 15 nt, Salmonella enterica enterica serovar Typhi
cgcauuugcuuucau

SEQ ID NO: 1724073 - RNA, 19 nt, Salmonella enterica enterica serovar Typhi
cgccaaacugcgcgccgcc

SEQ ID NO: 1724074 - RNA, 18 nt, Salmonella enterica enterica serovar Typhi
cgccaaagcagcugcugg

SEQ ID NO: 1724075 - RNA, 23 nt, Salmonella enterica enterica serovar Typhi
cgccaaagcagugaauccccaga

SEQ ID NO: 1724076 - RNA, 16 nt, Salmonella enterica enterica serovar Typhi
cgccaaaagaggcagc

SEQ ID NO: 1724077 - RNA, 21 nt, Salmonella enterica enterica serovar Typhi
cgccaaaagaggcagcaaagc

SEQ ID NO: 1724078 - RNA, 14 nt, Salmonella enterica enterica serovar Typhi
cgccaaaccacacc

SEQ ID NO: 1724079 - RNA, 15 nt, Salmonella enterica enterica serovar Typhi
cgccaacguccgccg

SEQ ID NO: 1724080 - RNA, 16 nt, Salmonella enterica enterica serovar Typhi
cgccaacuuuuugcgc

SEQ ID NO: 1724081 - RNA, 20 nt, Salmonella enterica enterica serovar Typhi
cgccaagaccgccuaacagc

SEQ ID NO: 1724082 - RNA, 20 nt, Salmonella enterica enterica serovar Typhi
cgccaaccgugagcgcgccg

SEQ ID NO: 1724083 - RNA, 13 nt, Salmonella enterica enterica serovar Typhi
cgccaaccgccau

SEQ ID NO: 1724084 - RNA, 15 nt, Salmonella enterica enterica serovar Typhi
cgccaaccugcuggu

SEQ ID NO: 1724085 - RNA, 16 nt, Salmonella enterica enterica serovar Typhi
cgccaaguucggugac

SEQ ID NO: 1724086 - RNA, 13 nt, Salmonella enterica enterica serovar Typhi
cgccaagcgcgga

SEQ ID NO: 1724087 - RNA, 20 nt, Salmonella enterica enterica serovar Typhi
cgccaagcgcggcagcagcu

SEQ ID NO: 1724088 - RNA, 17 nt, Salmonella enterica enterica serovar Typhi
cgccaauggccgccccc

SEQ ID NO: 1724089 - RNA, 20 nt, Salmonella enterica enterica serovar Typhi
cgccaaucaacgccgccagg

SEQ ID NO: 1724090 - RNA, 15 nt, Salmonella enterica enterica serovar Typhi
cgccaaugccgcagc

SEQ ID NO: 1724091 - RNA, 14 nt, Salmonella enterica enterica serovar Typhi
cgccacaaaagauu

SEQ ID NO: 1724092 - RNA, 14 nt, Salmonella enterica enterica serovar Typhi
cgccacaauauccg

SEQ ID NO: 1724093 - RNA, 22 nt, Salmonella enterica enterica serovar Typhi
cgccacaauauccgccccgcug

SEQ ID NO: 1724094 - RNA, 15 nt, Salmonella enterica enterica serovar Typhi
cgccacaugcggcag

SEQ ID NO: 1724095 - RNA, 17 nt, Salmonella enterica enterica serovar Typhi
cgccacauugcgcgccg

SEQ ID NO: 1724096 - RNA, 22 nt, Salmonella enterica enterica serovar Typhi
cgccacagcggaauagacggcc

SEQ ID NO: 1724097 - RNA, 20 nt, Salmonella enterica enterica serovar Typhi
cgccaccaaagccaggccgc

SEQ ID NO: 1724098 - RNA, 12 nt, Salmonella enterica enterica serovar Typhi
cgccaccacaaa

SEQ ID NO: 1724099 - RNA, 22 nt, Salmonella enterica enterica serovar Typhi
cgccaccacagucaucgcgcca

SEQ ID NO: 1724100 - RNA, 13 nt, Salmonella enterica enterica serovar Typhi
cgccaccaccagc

SEQ ID NO: 1724101 - RNA, 20 nt, Salmonella enterica enterica serovar Typhi
cgccaccacgcccaacgacc

SEQ ID NO: 1724102 - RNA, 13 nt, Salmonella enterica enterica serovar Typhi
cgccacccggcuu

SEQ ID NO: 1724103 - RNA, 14 nt, Salmonella enterica enterica serovar Typhi
aaacgcgcaaaacu

SEQ ID NO: 1724104 - RNA, 16 nt, Salmonella enterica enterica serovar Typhi
aaacgcuauuuaaccc

SEQ ID NO: 1724105 - RNA, 17 nt, Salmonella enterica enterica serovar Typhi
aaacgcuccggcaggca

SEQ ID NO: 1724106 - RNA, 12 nt, Salmonella enterica enterica serovar Typhi
aaacgccuguaa

SEQ ID NO: 1724107 - RNA, 20 nt, Salmonella enterica enterica serovar Typhi
cgagcgaucauaagggagcu

SEQ ID NO: 1724108 - RNA, 20 nt, Salmonella enterica enterica serovar Typhi
cgagcgacgcccugcccaug

SEQ ID NO: 1724109 - RNA, 20 nt, Salmonella enterica enterica serovar Typhi
cgagcgaaggggcgggcagc

SEQ ID NO: 1724110 - RNA, 22 nt, Salmonella enterica enterica serovar Typhi
cgagcgaaggggcgggcagcag

SEQ ID NO: 1724111 - RNA, 22 nt, Salmonella enterica enterica serovar Typhi
cgagcaguucagcagcaccacu

SEQ ID NO: 1724112 - RNA, 18 nt, Salmonella enterica enterica serovar Typhi
cgagcauccgcgcaauau

SEQ ID NO: 1724113 - RNA, 20 nt, Salmonella enterica enterica serovar Typhi
cgagauacugcaacgccaga

SEQ ID NO: 1724114 - RNA, 13 nt, Salmonella enterica enterica serovar Typhi
cgagauaaaaacg

SEQ ID NO: 1724115 - RNA, 14 nt, Salmonella enterica enterica serovar Typhi
cgagauucaauaau

SEQ ID NO: 1724116 - RNA, 16 nt, Salmonella enterica enterica serovar Typhi
cgagauucaauaaugu

SEQ ID NO: 1724117 - RNA, 15 nt, Salmonella enterica enterica serovar Typhi
cgagcaggaaccaca

SEQ ID NO: 1724118 - RNA, 17 nt, Salmonella enterica enterica serovar Typhi
cgagcaguucagcagca

SEQ ID NO: 1724119 - RNA, 19 nt, Salmonella enterica enterica serovar Typhi
cgagcacuuuuuccuccug

SEQ ID NO: 1724120 - RNA, 19 nt, Salmonella enterica enterica serovar Typhi
cgagaauguguucucccug

SEQ ID NO: 1724121 - RNA, 13 nt, Salmonella enterica enterica serovar Typhi
cgagaauuuuaug

SEQ ID NO: 1724122 - RNA, 18 nt, Salmonella enterica enterica serovar Typhi
cgagagaguauccacaga

SEQ ID NO: 1724123 - RNA, 14 nt, Salmonella enterica enterica serovar Typhi
cgagagucaaggca

SEQ ID NO: 1724124 - RNA, 17 nt, Salmonella enterica enterica serovar Typhi
cgagagugacgacgcca

SEQ ID NO: 1724125 - RNA, 13 nt, Salmonella enterica enterica serovar Typhi
cgagagaaaaaaa

SEQ ID NO: 1724126 - RNA, 23 nt, Salmonella enterica enterica serovar Typhi
cgagagaauuaacagcgcgacca

SEQ ID NO: 1724127 - RNA, 22 nt, Salmonella enterica enterica serovar Typhi
cgagagaauuaacagcgcgacc

SEQ ID NO: 1724128 - RNA, 23 nt, Salmonella enterica enterica serovar Typhi
cgagacuacccaucacgcccugu

SEQ ID NO: 1724129 - RNA, 17 nt, Salmonella enterica enterica serovar Typhi
cgagacucaaagaaaac

SEQ ID NO: 1724130 - RNA, 15 nt, Salmonella enterica enterica serovar Typhi
cgagagaaaaaaauc

SEQ ID NO: 1724131 - RNA, 20 nt, Salmonella enterica enterica serovar Typhi
cgacuguuguucuucauaca

SEQ ID NO: 1724132 - RNA, 16 nt, Salmonella enterica enterica serovar Typhi
cgacuucauucaggca

SEQ ID NO: 1724133 - RNA, 14 nt, Salmonella enterica enterica serovar Typhi
cgacuucaagguuc

SEQ ID NO: 1724134 - RNA, 14 nt, Salmonella enterica enterica serovar Typhi
cgacuguuguucuu

SEQ ID NO: 1724135 - RNA, 15 nt, Salmonella enterica enterica serovar Typhi
cgacuucgaagguuc

SEQ ID NO: 1724136 - RNA, 15 nt, Salmonella enterica enterica serovar Typhi
cgacuucgcuuccug

SEQ ID NO: 1724137 - RNA, 21 nt, Salmonella enterica enterica serovar Typhi
cgacuuuaaacuuauccgcca

SEQ ID NO: 1724138 - RNA, 23 nt, Salmonella enterica enterica serovar Typhi
cgacuuuaaacuuauccgccauc

SEQ ID NO: 1724139 - RNA, 21 nt, Salmonella enterica enterica serovar Typhi
cgagaaaaucagugaacaccc

SEQ ID NO: 1724140 - RNA, 22 nt, Salmonella enterica enterica serovar Typhi
cgagaaagcguugccguaggca

SEQ ID NO: 1724141 - RNA, 14 nt, Salmonella enterica enterica serovar Typhi
cgagaaacaccaga

SEQ ID NO: 1724142 - RNA, 18 nt, Salmonella enterica enterica serovar Typhi
cgagaagaagaauuauua

SEQ ID NO: 1724143 - RNA, 21 nt, Salmonella enterica enterica serovar Typhi
cgacugguaaugucauccagc

SEQ ID NO: 1724144 - RNA, 16 nt, Salmonella enterica enterica serovar Typhi
cgacugaccagacaga

SEQ ID NO: 1724145 - RNA, 23 nt, Salmonella enterica enterica serovar Typhi
cgacucuguauuuaauaccuggu

SEQ ID NO: 1724146 - RNA, 15 nt, Salmonella enterica enterica serovar Typhi
cgacugauaacggcg

SEQ ID NO: 1724147 - RNA, 21 nt, Salmonella enterica enterica serovar Typhi
cgacugccaccgucgcggcau

SEQ ID NO: 1724148 - RNA, 13 nt, Salmonella enterica enterica serovar Typhi
cgacucucccggc

SEQ ID NO: 1724149 - RNA, 16 nt, Salmonella enterica enterica serovar Typhi
cgacucacgcagcgcu

SEQ ID NO: 1724150 - RNA, 16 nt, Salmonella enterica enterica serovar Typhi
cgaauaccugaaagag

SEQ ID NO: 1724151 - RNA, 20 nt, Salmonella enterica enterica serovar Typhi
cgaauacuccugcaacagaa

SEQ ID NO: 1724152 - RNA, 17 nt, Salmonella enterica enterica serovar Typhi
cgaauacuguuccaggc

SEQ ID NO: 1724153 - RNA, 13 nt, Salmonella enterica enterica serovar Typhi
cgacgucuuucuu

SEQ ID NO: 1724154 - RNA, 14 nt, Salmonella enterica enterica serovar Typhi
cgagggaaggggau

SEQ ID NO: 1724155 - RNA, 18 nt, Salmonella enterica enterica serovar Typhi
cgaggcuuauaacccugu

SEQ ID NO: 1724156 - RNA, 18 nt, Salmonella enterica enterica serovar Typhi
cgaggauaaaaucgccaa

SEQ ID NO: 1724157 - RNA, 21 nt, Salmonella enterica enterica serovar Typhi
cgaggaacaucagccagcagc

SEQ ID NO: 1724158 - RNA, 15 nt, Salmonella enterica enterica serovar Typhi
cgaggaacgcgcaga

SEQ ID NO: 1724159 - RNA, 19 nt, Salmonella enterica enterica serovar Typhi
cgaggaacgcgcagaccgu

SEQ ID NO: 1724160 - RNA, 20 nt, Salmonella enterica enterica serovar Typhi
cgaggaacuguucagccagc

SEQ ID NO: 1724161 - RNA, 20 nt, Salmonella enterica enterica serovar Typhi
cgaggcauaccgcccagaac

SEQ ID NO: 1724162 - RNA, 18 nt, Salmonella enterica enterica serovar Typhi
cgaggccacgcagcgcag

SEQ ID NO: 1724163 - RNA, 16 nt, Salmonella enterica enterica serovar Typhi
cgaggcccauagaugg

SEQ ID NO: 1724164 - RNA, 14 nt, Salmonella enterica enterica serovar Typhi
aaacggaucuucca

SEQ ID NO: 1724165 - RNA, 15 nt, Salmonella enterica enterica serovar Typhi
aaacggaucuuccac

SEQ ID NO: 1724166 - RNA, 13 nt, Salmonella enterica enterica serovar Typhi
aaacgcugcgcaa

SEQ ID NO: 1724167 - RNA, 12 nt, Salmonella enterica enterica serovar Typhi
aaacgcuuuuuu

SEQ ID NO: 1724168 - RNA, 17 nt, Salmonella enterica enterica serovar Typhi
cgagcgcgucagcgccu

SEQ ID NO: 1724169 - RNA, 20 nt, Salmonella enterica enterica serovar Typhi
cgagcguucugcacgccggu

SEQ ID NO: 1724170 - RNA, 21 nt, Salmonella enterica enterica serovar Typhi
cgagcucaguccagccgccgc

SEQ ID NO: 1724171 - RNA, 15 nt, Salmonella enterica enterica serovar Typhi
cgagcugguuucaau

SEQ ID NO: 1724172 - RNA, 18 nt, Salmonella enterica enterica serovar Typhi
cgauaaucccggcgcgcg

SEQ ID NO: 1724173 - RNA, 21 nt, Salmonella enterica enterica serovar Typhi
cgauaaugaagcauaaaaaga

SEQ ID NO: 1724174 - RNA, 14 nt, Salmonella enterica enterica serovar Typhi
cgauaaccagcgcg

SEQ ID NO: 1724175 - RNA, 15 nt, Salmonella enterica enterica serovar Typhi
cgauaaccaggucac

SEQ ID NO: 1724176 - RNA, 17 nt, Salmonella enterica enterica serovar Typhi
cgauaaccucucaccgc

SEQ ID NO: 1724177 - RNA, 14 nt, Salmonella enterica enterica serovar Typhi
cgauaaccuguaaa

SEQ ID NO: 1724178 - RNA, 19 nt, Salmonella enterica enterica serovar Typhi
cgauaaccaugcucagcgg

SEQ ID NO: 1724179 - RNA, 15 nt, Salmonella enterica enterica serovar Typhi
cgauacaccuucaca

SEQ ID NO: 1724180 - RNA, 18 nt, Salmonella enterica enterica serovar Typhi
cgauacacgccgacgcau

SEQ ID NO: 1724181 - RNA, 13 nt, Salmonella enterica enterica serovar Typhi
cgauacaccuuca

SEQ ID NO: 1724182 - RNA, 21 nt, Salmonella enterica enterica serovar Typhi
cgauacaggacugacugcugu

SEQ ID NO: 1724183 - RNA, 15 nt, Salmonella enterica enterica serovar Typhi
cgauagcgccccaaa

SEQ ID NO: 1724184 - RNA, 19 nt, Salmonella enterica enterica serovar Typhi
cgauagagaguuccuccug

SEQ ID NO: 1724185 - RNA, 18 nt, Salmonella enterica enterica serovar Typhi
cgauagacguugagcuca

SEQ ID NO: 1724186 - RNA, 16 nt, Salmonella enterica enterica serovar Typhi
cgauagagaguuccuc

SEQ ID NO: 1724187 - RNA, 18 nt, Salmonella enterica enterica serovar Typhi
cgauagagaguuccuccu

SEQ ID NO: 1724188 - RNA, 14 nt, Salmonella enterica enterica serovar Typhi
cgauaaaaaagccu

SEQ ID NO: 1724189 - RNA, 18 nt, Salmonella enterica enterica serovar Typhi
cgauaaaaacccaccagc

SEQ ID NO: 1724190 - RNA, 19 nt, Salmonella enterica enterica serovar Typhi
cgauaaaaacccaccagcg

SEQ ID NO: 1724191 - RNA, 13 nt, Salmonella enterica enterica serovar Typhi
cgauaaauccucc

SEQ ID NO: 1724192 - RNA, 15 nt, Salmonella enterica enterica serovar Typhi
cgauaaauaagaagg

SEQ ID NO: 1724193 - RNA, 19 nt, Salmonella enterica enterica serovar Typhi
cgauaaagcgguuaucggc

SEQ ID NO: 1724194 - RNA, 14 nt, Salmonella enterica enterica serovar Typhi
cgauaaacgccagc

SEQ ID NO: 1724195 - RNA, 23 nt, Salmonella enterica enterica serovar Typhi
cgaguaacaccgcggcgcucgcc

SEQ ID NO: 1724196 - RNA, 20 nt, Salmonella enterica enterica serovar Typhi
cgaguaauccauagccaaca

SEQ ID NO: 1724197 - RNA, 14 nt, Salmonella enterica enterica serovar Typhi
cgaguuaauagaau

SEQ ID NO: 1724198 - RNA, 16 nt, Salmonella enterica enterica serovar Typhi
cgagugcguucuucca

SEQ ID NO: 1724199 - RNA, 19 nt, Salmonella enterica enterica serovar Typhi
cgagugcguucuuccacuu

SEQ ID NO: 1724200 - RNA, 19 nt, Salmonella enterica enterica serovar Typhi
cgaguggaaucagccagga

SEQ ID NO: 1724201 - RNA, 16 nt, Salmonella enterica enterica serovar Typhi
cgagucgucaguucca

SEQ ID NO: 1724202 - RNA, 22 nt, Salmonella enterica enterica serovar Typhi
cgaggucaucuuucagaugcag

SEQ ID NO: 1724203 - RNA, 14 nt, Salmonella enterica enterica serovar Typhi
cgaggggccaaaac

SEQ ID NO: 1724204 - RNA, 19 nt, Salmonella enterica enterica serovar Typhi
cgaggugauaaucagcgcu

SEQ ID NO: 1724205 - RNA, 18 nt, Salmonella enterica enterica serovar Typhi
cgaggugaauaaauccuu

SEQ ID NO: 1724206 - RNA, 22 nt, Salmonella enterica enterica serovar Typhi
cgagguucaccagcgcgccgcc

SEQ ID NO: 1724207 - RNA, 14 nt, Salmonella enterica enterica serovar Typhi
cggccacagcgcca

SEQ ID NO: 1724208 - RNA, 14 nt, Salmonella enterica enterica serovar Typhi
cggcagcagcuuca

SEQ ID NO: 1724209 - RNA, 14 nt, Salmonella enterica enterica serovar Typhi
cggcagcacccggc

SEQ ID NO: 1724210 - RNA, 23 nt, Salmonella enterica enterica serovar Typhi
cggcacugacucuuccgggcgcg

SEQ ID NO: 1724211 - RNA, 18 nt, Salmonella enterica enterica serovar Typhi
cggcacugcuuccugccg

SEQ ID NO: 1724212 - RNA, 14 nt, Salmonella enterica enterica serovar Typhi
cggccacgagcugu

SEQ ID NO: 1724213 - RNA, 15 nt, Salmonella enterica enterica serovar Typhi
cggccacgcgcguca

SEQ ID NO: 1724214 - RNA, 14 nt, Salmonella enterica enterica serovar Typhi
cggccacuauuucg

SEQ ID NO: 1724215 - RNA, 20 nt, Salmonella enterica enterica serovar Typhi
cggccacgcgcgucaggacg

SEQ ID NO: 1724216 - RNA, 13 nt, Salmonella enterica enterica serovar Typhi
cggccagcaaaau

SEQ ID NO: 1724217 - RNA, 15 nt, Salmonella enterica enterica serovar Typhi
cggccacagccaucc

SEQ ID NO: 1724218 - RNA, 14 nt, Salmonella enterica enterica serovar Typhi
cggccaccacauac

SEQ ID NO: 1724219 - RNA, 19 nt, Salmonella enterica enterica serovar Typhi
cggcccgcuaucaccgccc

SEQ ID NO: 1724220 - RNA, 15 nt, Salmonella enterica enterica serovar Typhi
cggcccacgcgcaga

SEQ ID NO: 1724221 - RNA, 18 nt, Salmonella enterica enterica serovar Typhi
cggccauugccgcgccga

SEQ ID NO: 1724222 - RNA, 18 nt, Salmonella enterica enterica serovar Typhi
cggccaguagcgggggcc

SEQ ID NO: 1724223 - RNA, 19 nt, Salmonella enterica enterica serovar Typhi
cggccagcgagucgccgcu

SEQ ID NO: 1724224 - RNA, 19 nt, Salmonella enterica enterica serovar Typhi
cggccagcgccagcguaga

SEQ ID NO: 1724225 - RNA, 14 nt, Salmonella enterica enterica serovar Typhi
cggccagcgccagc

SEQ ID NO: 1724226 - RNA, 14 nt, Salmonella enterica enterica serovar Typhi
cggccuggcccggc

SEQ ID NO: 1724227 - RNA, 18 nt, Salmonella enterica enterica serovar Typhi
cggccuccgcuuccugcg

SEQ ID NO: 1724228 - RNA, 15 nt, Salmonella enterica enterica serovar Typhi
cggccuggcucuucc

SEQ ID NO: 1724229 - RNA, 17 nt, Salmonella enterica enterica serovar Typhi
cggccuacaaagccaaa

SEQ ID NO: 1724230 - RNA, 13 nt, Salmonella enterica enterica serovar Typhi
cggccucccagcu

SEQ ID NO: 1724231 - RNA, 13 nt, Salmonella enterica enterica serovar Typhi
cggccuuauuuuu

SEQ ID NO: 1724232 - RNA, 21 nt, Salmonella enterica enterica serovar Typhi
cggccuuuuuccgucagcaac

SEQ ID NO: 1724233 - RNA, 14 nt, Salmonella enterica enterica serovar Typhi
cggcgacagcgacc

SEQ ID NO: 1724234 - RNA, 22 nt, Salmonella enterica enterica serovar Typhi
cggcccuggcucaauccaggug

SEQ ID NO: 1724235 - RNA, 15 nt, Salmonella enterica enterica serovar Typhi
cggcgccacgcgcca

SEQ ID NO: 1724236 - RNA, 23 nt, Salmonella enterica enterica serovar Typhi
cggcgcaaaggccuuauccggcc

SEQ ID NO: 1724237 - RNA, 17 nt, Salmonella enterica enterica serovar Typhi
cggcgcaaauggcugcg

SEQ ID NO: 1724238 - RNA, 15 nt, Salmonella enterica enterica serovar Typhi
cggcgccaucgccuc

SEQ ID NO: 1724239 - RNA, 15 nt, Salmonella enterica enterica serovar Typhi
cggcgccgaagcagg

SEQ ID NO: 1724240 - RNA, 14 nt, Salmonella enterica enterica serovar Typhi
cgcuuuuugcgcca

SEQ ID NO: 1724241 - RNA, 19 nt, Salmonella enterica enterica serovar Typhi
cgcuuuuacucuuccugcu

SEQ ID NO: 1724242 - RNA, 13 nt, Salmonella enterica enterica serovar Typhi
cgcuuuuccccgc

SEQ ID NO: 1724243 - RNA, 15 nt, Salmonella enterica enterica serovar Typhi
cgcuuuuccccgcag

SEQ ID NO: 1724244 - RNA, 20 nt, Salmonella enterica enterica serovar Typhi
cggaaaauauucagcacauc

SEQ ID NO: 1724245 - RNA, 21 nt, Salmonella enterica enterica serovar Typhi
cgcuuuuuuaacgauuucccc

SEQ ID NO: 1724246 - RNA, 17 nt, Salmonella enterica enterica serovar Typhi
cgcuuuuugcuucgcca

SEQ ID NO: 1724247 - RNA, 14 nt, Salmonella enterica enterica serovar Typhi
cgcuuuuuucucug

SEQ ID NO: 1724248 - RNA, 13 nt, Salmonella enterica enterica serovar Typhi
cggaaaaaacguu

SEQ ID NO: 1724249 - RNA, 21 nt, Salmonella enterica enterica serovar Typhi
cgcuuugauguccggcgcguu

SEQ ID NO: 1724250 - RNA, 15 nt, Salmonella enterica enterica serovar Typhi
cgcuuuggaggucau

SEQ ID NO: 1724251 - RNA, 17 nt, Salmonella enterica enterica serovar Typhi
cgcuuugagcugcugcu

SEQ ID NO: 1724252 - RNA, 19 nt, Salmonella enterica enterica serovar Typhi
cgcuuucugagccgcccgg

SEQ ID NO: 1724253 - RNA, 20 nt, Salmonella enterica enterica serovar Typhi
cgcuuucgucguccacucuu

SEQ ID NO: 1724254 - RNA, 20 nt, Salmonella enterica enterica serovar Typhi
cgcuuucgccacgcucacuu

SEQ ID NO: 1724255 - RNA, 14 nt, Salmonella enterica enterica serovar Typhi
cgcuuucccggcau

SEQ ID NO: 1724256 - RNA, 16 nt, Salmonella enterica enterica serovar Typhi
cgcuuucaccgccuca

SEQ ID NO: 1724257 - RNA, 21 nt, Salmonella enterica enterica serovar Typhi
cgcuuuaggguaucauuucca

SEQ ID NO: 1724258 - RNA, 12 nt, Salmonella enterica enterica serovar Typhi
cgcuuucaaucg

SEQ ID NO: 1724259 - RNA, 17 nt, Salmonella enterica enterica serovar Typhi
cgcuaccagcgcggcgc

SEQ ID NO: 1724260 - RNA, 23 nt, Salmonella enterica enterica serovar Typhi
cgcuuggugcguaccucauggua

SEQ ID NO: 1724261 - RNA, 17 nt, Salmonella enterica enterica serovar Typhi
cgcuuuaccgccuuccu

SEQ ID NO: 1724262 - RNA, 14 nt, Salmonella enterica enterica serovar Typhi
cgcuaaaugcauag

SEQ ID NO: 1724263 - RNA, 22 nt, Salmonella enterica enterica serovar Typhi
cgcuaaccagcgcuucgccugc

SEQ ID NO: 1724264 - RNA, 23 nt, Salmonella enterica enterica serovar Typhi
cgcuaaaccacaugaccagcgcc

SEQ ID NO: 1724265 - RNA, 23 nt, Salmonella enterica enterica serovar Typhi
cgcuaauguacgccuaaaaauga

SEQ ID NO: 1724266 - RNA, 17 nt, Salmonella enterica enterica serovar Typhi
cgcuaauuuucagggug

SEQ ID NO: 1724267 - RNA, 22 nt, Salmonella enterica enterica serovar Typhi
cgcuaaugcccggcgcggcauc

SEQ ID NO: 1724268 - RNA, 12 nt, Salmonella enterica enterica serovar Typhi
cgcuaauaauuc

SEQ ID NO: 1724269 - RNA, 16 nt, Salmonella enterica enterica serovar Typhi
cgcuaaccggcggcgu

SEQ ID NO: 1724270 - RNA, 16 nt, Salmonella enterica enterica serovar Typhi
cggaauaauguaaaaa

SEQ ID NO: 1724271 - RNA, 20 nt, Salmonella enterica enterica serovar Typhi
cggaauaauguaaaaaaaua

SEQ ID NO: 1724272 - RNA, 22 nt, Salmonella enterica enterica serovar Typhi
cggaaggcuaccgcugggauga

SEQ ID NO: 1724273 - RNA, 15 nt, Salmonella enterica enterica serovar Typhi
cggaagcugaccagg

SEQ ID NO: 1724274 - RNA, 21 nt, Salmonella enterica enterica serovar Typhi
cggaagcugaccagggcaaau

SEQ ID NO: 1724275 - RNA, 18 nt, Salmonella enterica enterica serovar Typhi
cggaagcagauaccagcc

SEQ ID NO: 1724276 - RNA, 15 nt, Salmonella enterica enterica serovar Typhi
cggaagcgaccggcg

SEQ ID NO: 1724277 - RNA, 22 nt, Salmonella enterica enterica serovar Typhi
cggaagcgauugucggcgccgg

SEQ ID NO: 1724278 - RNA, 16 nt, Salmonella enterica enterica serovar Typhi
cggaagagcucgacca

SEQ ID NO: 1724279 - RNA, 19 nt, Salmonella enterica enterica serovar Typhi
cggaacuuuaucaccagcg

SEQ ID NO: 1724280 - RNA, 19 nt, Salmonella enterica enterica serovar Typhi
cggaagacuggcgcagcaa

SEQ ID NO: 1724281 - RNA, 16 nt, Salmonella enterica enterica serovar Typhi
cggaagagaaacucuu

SEQ ID NO: 1724282 - RNA, 18 nt, Salmonella enterica enterica serovar Typhi
cggaagacuggcgcagca

SEQ ID NO: 1724283 - RNA, 12 nt, Salmonella enterica enterica serovar Typhi
cggaacaccagc

SEQ ID NO: 1724284 - RNA, 18 nt, Salmonella enterica enterica serovar Typhi
cggaaaugaaaaagauag

SEQ ID NO: 1724285 - RNA, 16 nt, Salmonella enterica enterica serovar Typhi
cggaacaggcuuuuca

SEQ ID NO: 1724286 - RNA, 14 nt, Salmonella enterica enterica serovar Typhi
cggaacccagcaaa

SEQ ID NO: 1724287 - RNA, 19 nt, Salmonella enterica enterica serovar Typhi
cggaaccaaaauagauaau

SEQ ID NO: 1724288 - RNA, 22 nt, Salmonella enterica enterica serovar Typhi
cggaaccgcccaucaacaccag

SEQ ID NO: 1724289 - RNA, 14 nt, Salmonella enterica enterica serovar Typhi
cggaaccuguccug

SEQ ID NO: 1724290 - RNA, 20 nt, Salmonella enterica enterica serovar Typhi
cggaaacgucauuuuuucaa

SEQ ID NO: 1724291 - RNA, 16 nt, Salmonella enterica enterica serovar Typhi
cggaaagcuguuguug

SEQ ID NO: 1724292 - RNA, 20 nt, Salmonella enterica enterica serovar Typhi
cggaaaggacguucuucucc

SEQ ID NO: 1724293 - RNA, 17 nt, Salmonella enterica enterica serovar Typhi
cggaaacuauccuggcc

SEQ ID NO: 1724294 - RNA, 15 nt, Salmonella enterica enterica serovar Typhi
cggaaagaauaaucg

SEQ ID NO: 1724295 - RNA, 16 nt, Salmonella enterica enterica serovar Typhi
cggaaaucaacaaucc

SEQ ID NO: 1724296 - RNA, 15 nt, Salmonella enterica enterica serovar Typhi
cggaaaucgcggcga

SEQ ID NO: 1724297 - RNA, 15 nt, Salmonella enterica enterica serovar Typhi
cggagcgucauuuuc

SEQ ID NO: 1724298 - RNA, 23 nt, Salmonella enterica enterica serovar Typhi
cggagauuaacagcgcgaccagc

SEQ ID NO: 1724299 - RNA, 22 nt, Salmonella enterica enterica serovar Typhi
cggagcaaaaaaugagaacacc

SEQ ID NO: 1724300 - RNA, 17 nt, Salmonella enterica enterica serovar Typhi
cggagauuaacagcgcg

SEQ ID NO: 1724301 - RNA, 17 nt, Salmonella enterica enterica serovar Typhi
cggagagagcaacuggc

SEQ ID NO: 1724302 - RNA, 21 nt, Salmonella enterica enterica serovar Typhi
cggagaguucauaacgcacaa

SEQ ID NO: 1724303 - RNA, 17 nt, Salmonella enterica enterica serovar Typhi
cggacgguaccugaagc

SEQ ID NO: 1724304 - RNA, 12 nt, Salmonella enterica enterica serovar Typhi
cggacuccagca

SEQ ID NO: 1724305 - RNA, 14 nt, Salmonella enterica enterica serovar Typhi
cggacucaggccuu

SEQ ID NO: 1724306 - RNA, 13 nt, Salmonella enterica enterica serovar Typhi
cggacucagggug

SEQ ID NO: 1724307 - RNA, 16 nt, Salmonella enterica enterica serovar Typhi
cggacucauacuugcc

SEQ ID NO: 1724308 - RNA, 21 nt, Salmonella enterica enterica serovar Typhi
cggacugcggccugcaaagac

SEQ ID NO: 1724309 - RNA, 23 nt, Salmonella enterica enterica serovar Typhi
cggagaaauagacgagcgaaaaa

SEQ ID NO: 1724310 - RNA, 15 nt, Salmonella enterica enterica serovar Typhi
cggacagcggcagcg

SEQ ID NO: 1724311 - RNA, 12 nt, Salmonella enterica enterica serovar Typhi
cggacacuaauu

SEQ ID NO: 1724312 - RNA, 15 nt, Salmonella enterica enterica serovar Typhi
cggacagcagaauau

SEQ ID NO: 1724313 - RNA, 17 nt, Salmonella enterica enterica serovar Typhi
cggacaacgcuccagca

SEQ ID NO: 1724314 - RNA, 15 nt, Salmonella enterica enterica serovar Typhi
cggacaaggcgcgcc

SEQ ID NO: 1724315 - RNA, 21 nt, Salmonella enterica enterica serovar Typhi
cggaaugugaaauacagccag

SEQ ID NO: 1724316 - RNA, 19 nt, Salmonella enterica enterica serovar Typhi
cggaauggcacagcgcagc

SEQ ID NO: 1724317 - RNA, 21 nt, Salmonella enterica enterica serovar Typhi
cggaauggcacagcgcagcaa

SEQ ID NO: 1724318 - RNA, 18 nt, Salmonella enterica enterica serovar Typhi
cggaauggcgggcgcagg

SEQ ID NO: 1724319 - RNA, 23 nt, Salmonella enterica enterica serovar Typhi
cggaaugacaaacgccaccgcca

SEQ ID NO: 1724320 - RNA, 15 nt, Salmonella enterica enterica serovar Typhi
cggaaugagagaagg

SEQ ID NO: 1724321 - RNA, 15 nt, Salmonella enterica enterica serovar Typhi
cggaaugaugugcua

SEQ ID NO: 1724322 - RNA, 11 nt, Salmonella enterica enterica serovar Typhi
cggaauaacuc

SEQ ID NO: 1724323 - RNA, 20 nt, Salmonella enterica enterica serovar Typhi
cggaauagacggccugcaaa

SEQ ID NO: 1724324 - RNA, 22 nt, Salmonella enterica enterica serovar Typhi
cggaauccaucccccugccguu

SEQ ID NO: 1724325 - RNA, 18 nt, Salmonella enterica enterica serovar Typhi
cggaaucggacacuugca

SEQ ID NO: 1724326 - RNA, 17 nt, Salmonella enterica enterica serovar Typhi
cggacgcaccagccagg

SEQ ID NO: 1724327 - RNA, 19 nt, Salmonella enterica enterica serovar Typhi
cggacgcagaccaaaguca

SEQ ID NO: 1724328 - RNA, 16 nt, Salmonella enterica enterica serovar Typhi
cggacgccagugcgca

SEQ ID NO: 1724329 - RNA, 15 nt, Salmonella enterica enterica serovar Typhi
cggacgaaccuggcg

SEQ ID NO: 1724330 - RNA, 20 nt, Salmonella enterica enterica serovar Typhi
cggacgaaccuggcgguaaa

SEQ ID NO: 1724331 - RNA, 20 nt, Salmonella enterica enterica serovar Typhi
cggaccuaauagccagcccc

SEQ ID NO: 1724332 - RNA, 19 nt, Salmonella enterica enterica serovar Typhi
cggaccgauaacaggaacg

SEQ ID NO: 1724333 - RNA, 17 nt, Salmonella enterica enterica serovar Typhi
cggaccccucuucuuuu

SEQ ID NO: 1724334 - RNA, 15 nt, Salmonella enterica enterica serovar Typhi
cggaccccucuucuu

SEQ ID NO: 1724335 - RNA, 21 nt, Salmonella enterica enterica serovar Typhi
cggacauuuauuucacuggcc

SEQ ID NO: 1724336 - RNA, 19 nt, Salmonella enterica enterica serovar Typhi
cggacaucauccccggcag

SEQ ID NO: 1724337 - RNA, 12 nt, Salmonella enterica enterica serovar Typhi
cggacaucccaa

SEQ ID NO: 1724338 - RNA, 21 nt, Salmonella enterica enterica serovar Typhi
cggcacgucgucccaggccag

SEQ ID NO: 1724339 - RNA, 16 nt, Salmonella enterica enterica serovar Typhi
cggcacguuuuccagg

SEQ ID NO: 1724340 - RNA, 17 nt, Salmonella enterica enterica serovar Typhi
cggcacguuuuccaggu

SEQ ID NO: 1724341 - RNA, 12 nt, Salmonella enterica enterica serovar Typhi
cggcacuacagc

SEQ ID NO: 1724342 - RNA, 18 nt, Salmonella enterica enterica serovar Typhi
cggcacgguuaaugaaau

SEQ ID NO: 1724343 - RNA, 18 nt, Salmonella enterica enterica serovar Typhi
cggcaccggaaccggcau

SEQ ID NO: 1724344 - RNA, 23 nt, Salmonella enterica enterica serovar Typhi
cggcaccggaaccggcaucggga

SEQ ID NO: 1724345 - RNA, 13 nt, Salmonella enterica enterica serovar Typhi
cggcacacagcac

SEQ ID NO: 1724346 - RNA, 17 nt, Salmonella enterica enterica serovar Typhi
cggcacauccagcgccu

SEQ ID NO: 1724347 - RNA, 19 nt, Salmonella enterica enterica serovar Typhi
cggcacauauuccggcgcu

SEQ ID NO: 1724348 - RNA, 17 nt, Salmonella enterica enterica serovar Typhi
cggcacauucaccacgc

SEQ ID NO: 1724349 - RNA, 20 nt, Salmonella enterica enterica serovar Typhi
cggcacauucaccacgcagc

SEQ ID NO: 1724350 - RNA, 17 nt, Salmonella enterica enterica serovar Typhi
cggcaauuaccgccagc

SEQ ID NO: 1724351 - RNA, 12 nt, Salmonella enterica enterica serovar Typhi
cggcaauggcca

SEQ ID NO: 1724352 - RNA, 17 nt, Salmonella enterica enterica serovar Typhi
cggcaauuuacaaccgu

SEQ ID NO: 1724353 - RNA, 18 nt, Salmonella enterica enterica serovar Typhi
cggcacaaugcccggcau

SEQ ID NO: 1724354 - RNA, 21 nt, Salmonella enterica enterica serovar Typhi
cggcaccagcgaugcgcgcgc

SEQ ID NO: 1724355 - RNA, 20 nt, Salmonella enterica enterica serovar Typhi
cggcaccauguggcgcggcc

SEQ ID NO: 1724356 - RNA, 15 nt, Salmonella enterica enterica serovar Typhi
cggcacaucaauaaa

SEQ ID NO: 1724357 - RNA, 15 nt, Salmonella enterica enterica serovar Typhi
cggcaccacauuaaa

SEQ ID NO: 1724358 - RNA, 14 nt, Salmonella enterica enterica serovar Typhi
cggcaccagcaaug

SEQ ID NO: 1724359 - RNA, 11 nt, Salmonella enterica enterica serovar Typhi
cggcaccagca

SEQ ID NO: 1724360 - RNA, 15 nt, Salmonella enterica enterica serovar Typhi
cggcaaucaauacag

SEQ ID NO: 1724361 - RNA, 13 nt, Salmonella enterica enterica serovar Typhi
cggcaaucucacu

SEQ ID NO: 1724362 - RNA, 18 nt, Salmonella enterica enterica serovar Typhi
cggcaaugagcggccagc

SEQ ID NO: 1724363 - RNA, 15 nt, Salmonella enterica enterica serovar Typhi
cggcaauaaacuccc

SEQ ID NO: 1724364 - RNA, 23 nt, Salmonella enterica enterica serovar Typhi
cggcaauaaacucccgcauauau

SEQ ID NO: 1724365 - RNA, 18 nt, Salmonella enterica enterica serovar Typhi
cggcaaggucugcgccca

SEQ ID NO: 1724366 - RNA, 13 nt, Salmonella enterica enterica serovar Typhi
cggcaaaagaggc

SEQ ID NO: 1724367 - RNA, 14 nt, Salmonella enterica enterica serovar Typhi
cggcaaaaacguug

SEQ ID NO: 1724368 - RNA, 21 nt, Salmonella enterica enterica serovar Typhi
cggcaaacgggcgaccgucgg

SEQ ID NO: 1724369 - RNA, 23 nt, Salmonella enterica enterica serovar Typhi
cggcaaacggggggauucauuau

SEQ ID NO: 1724370 - RNA, 24 nt, Salmonella enterica enterica serovar Typhi
cggcaaaccaugaucgucaggcgc

SEQ ID NO: 1724371 - RNA, 17 nt, Salmonella enterica enterica serovar Typhi
cggauuggucugauuca

SEQ ID NO: 1724372 - RNA, 19 nt, Salmonella enterica enterica serovar Typhi
cggauuuaccagcgcuucu

SEQ ID NO: 1724373 - RNA, 17 nt, Salmonella enterica enterica serovar Typhi
cggcaaagaccaauaaa

SEQ ID NO: 1724374 - RNA, 21 nt, Salmonella enterica enterica serovar Typhi
cggcaaagaaaaagaguugca

SEQ ID NO: 1724375 - RNA, 14 nt, Salmonella enterica enterica serovar Typhi
cggcaaagucuuca

SEQ ID NO: 1724376 - RNA, 17 nt, Salmonella enterica enterica serovar Typhi
cggcaaagguugccgca

SEQ ID NO: 1724377 - RNA, 14 nt, Salmonella enterica enterica serovar Typhi
cggcaaauucuuuu

SEQ ID NO: 1724378 - RNA, 20 nt, Salmonella enterica enterica serovar Typhi
cggcaaauucuuuucacgca

SEQ ID NO: 1724379 - RNA, 14 nt, Salmonella enterica enterica serovar Typhi
cggcaacaguaccu

SEQ ID NO: 1724380 - RNA, 13 nt, Salmonella enterica enterica serovar Typhi
cggaugugcauug

SEQ ID NO: 1724381 - RNA, 24 nt, Salmonella enterica enterica serovar Typhi
cggauuacgaauaccguaagacca

SEQ ID NO: 1724382 - RNA, 14 nt, Salmonella enterica enterica serovar Typhi
cggauuccagaaua

SEQ ID NO: 1724383 - RNA, 16 nt, Salmonella enterica enterica serovar Typhi
cggauuauuggucagu

SEQ ID NO: 1724384 - RNA, 17 nt, Salmonella enterica enterica serovar Typhi
cggaugaucuucauaaa

SEQ ID NO: 1724385 - RNA, 14 nt, Salmonella enterica enterica serovar Typhi
cggauggcgcggca

SEQ ID NO: 1724386 - RNA, 16 nt, Salmonella enterica enterica serovar Typhi
cggauggaauuuugca

SEQ ID NO: 1724387 - RNA, 15 nt, Salmonella enterica enterica serovar Typhi
cggaugacgccgcuu

SEQ ID NO: 1724388 - RNA, 13 nt, Salmonella enterica enterica serovar Typhi
cggaugaccagaa

SEQ ID NO: 1724389 - RNA, 16 nt, Salmonella enterica enterica serovar Typhi
cggaugaaacaguccg

SEQ ID NO: 1724390 - RNA, 21 nt, Salmonella enterica enterica serovar Typhi
cggaugaaacaguccggcgaa

SEQ ID NO: 1724391 - RNA, 13 nt, Salmonella enterica enterica serovar Typhi
cggauccagaacu

SEQ ID NO: 1724392 - RNA, 17 nt, Salmonella enterica enterica serovar Typhi
cggaucggccauaucca

SEQ ID NO: 1724393 - RNA, 19 nt, Salmonella enterica enterica serovar Typhi
cggaucgccgauaaagugg

SEQ ID NO: 1724394 - RNA, 19 nt, Salmonella enterica enterica serovar Typhi
cggaucaaaaaggugagca

SEQ ID NO: 1724395 - RNA, 15 nt, Salmonella enterica enterica serovar Typhi
cggaucaauaaacag

SEQ ID NO: 1724396 - RNA, 16 nt, Salmonella enterica enterica serovar Typhi
cggauaugcagcagcc

SEQ ID NO: 1724397 - RNA, 14 nt, Salmonella enterica enterica serovar Typhi
cggauagcucgcug

SEQ ID NO: 1724398 - RNA, 18 nt, Salmonella enterica enterica serovar Typhi
cggauacggcugucagga

SEQ ID NO: 1724399 - RNA, 16 nt, Salmonella enterica enterica serovar Typhi
cggauaagcggcagcg

SEQ ID NO: 1724400 - RNA, 16 nt, Salmonella enterica enterica serovar Typhi
cggauaacgcgcuggc

SEQ ID NO: 1724401 - RNA, 19 nt, Salmonella enterica enterica serovar Typhi
cggauaacgcgcuggcgga

SEQ ID NO: 1724402 - RNA, 23 nt, Salmonella enterica enterica serovar Typhi
cggauaagguguuuacgccgcca

SEQ ID NO: 1724403 - RNA, 14 nt, Salmonella enterica enterica serovar Typhi
cggaggcacugccu

SEQ ID NO: 1724404 - RNA, 19 nt, Salmonella enterica enterica serovar Typhi
cggaggccagauucaccac

SEQ ID NO: 1724405 - RNA, 16 nt, Salmonella enterica enterica serovar Typhi
cggaggcgggcgcgca

SEQ ID NO: 1724406 - RNA, 22 nt, Salmonella enterica enterica serovar Typhi
cggaguggccgcaaaugauaau

SEQ ID NO: 1724407 - RNA, 22 nt, Salmonella enterica enterica serovar Typhi
cggauaaauagugacgccgcca

SEQ ID NO: 1724408 - RNA, 23 nt, Salmonella enterica enterica serovar Typhi
cggauaaacgcgucuucaucagc

SEQ ID NO: 1724409 - RNA, 16 nt, Human
uguuugcuaagcauuc

SEQ ID NO: 1724410 - RNA, 16 nt, Human
uuacagagacagaaag

SEQ ID NO: 1724411 - RNA, 16 nt, Human
ugauuuugugauugau

SEQ ID NO: 1724412 - RNA, 22 nt, Human
ugauaaauggcuuccuggcaau

SEQ ID NO: 1724413 - RNA, 16 nt, Human
ugagguaaaagcauca

SEQ ID NO: 1724414 - RNA, 20 nt, Human
ugauaacuggaaacuucagc

SEQ ID NO: 1724415 - RNA, 16 nt, Human
ugaaguccaagcauuu

SEQ ID NO: 1724416 - RNA, 21 nt, Human
ugcugagccccaaguggaacg

SEQ ID NO: 1724417 - RNA, 22 nt, Human
ugccaaaacaucaaccugccag

SEQ ID NO: 1724418 - RNA, 22 nt, Human
ugggacagucaccucauggaau

SEQ ID NO: 1724419 - RNA, 21 nt, Human
ugggacauuugcucauggaau

SEQ ID NO: 1724420 - RNA, 19 nt, Human
ucacaccuuaucuauguag

SEQ ID NO: 1724421 - RNA, 20 nt, Human
ucacauuccaagccucaugu

SEQ ID NO: 1724422 - RNA, 17 nt, Human
uaguuguaccgcaaugu

SEQ ID NO: 1724423 - RNA, 15 nt, Human
uaaccaacacccuga

SEQ ID NO: 1724424 - RNA, 20 nt, Human
uaaccaggggccaugaauca

SEQ ID NO: 1724425 - RNA, 16 nt, Human
uaacuggaaacuucag

SEQ ID NO: 1724426 - RNA, 17 nt, Human
uaaaguaaaggcaaacu

SEQ ID NO: 1724427 - RNA, 20 nt, Human
uaaaagaaugauuaugaauu

SEQ ID NO: 1724428 - RNA, 23 nt, Human
uaaaauggugugaccacugcaga

SEQ ID NO: 1724429 - RNA, 13 nt, Human
cccuggggcuuua

SEQ ID NO: 1724430 - RNA, 22 nt, Human
cccucuguucugcacacagcac

SEQ ID NO: 1724431 - RNA, 18 nt, Human
ccuuggggcugaugcagu

SEQ ID NO: 1724432 - RNA, 19 nt, Human
ccuucggccuccauccuga

SEQ ID NO: 1724433 - RNA, 22 nt, Human
cgagaaaacaauaacgauaaaa

SEQ ID NO: 1724434 - RNA, 17 nt, Human
cccugcaaagcccagcu

SEQ ID NO: 1724435 - RNA, 16 nt, Human
uucagauaaucacaau

SEQ ID NO: 1724436 - RNA, 21 nt, Human
cugauaugggucuugauaaau

SEQ ID NO: 1724437 - RNA, 16 nt, Human
cugaaauggaacagau

SEQ ID NO: 1724438 - RNA, 19 nt, Human
cggccuccauccugaggcu

SEQ ID NO: 1724439 - RNA, 16 nt, Human
cguugaacgucacauc

SEQ ID NO: 1724440 - RNA, 23 nt, Human
cguugagccaccaagcugguggc

SEQ ID NO: 1724441 - RNA, 14 nt, Human
cugcaagaagaaau

SEQ ID NO: 1724442 - RNA, 20 nt, Human
cugcccugcugagucccagg

SEQ ID NO: 1724443 - RNA, 13 nt, Human
cuggaaaacugcu

SEQ ID NO: 1724444 - RNA, 18 nt, Human
cuguauguccuuggugcc

SEQ ID NO: 1724445 - RNA, 15 nt, Human
cuucagccugaaaga

SEQ ID NO: 1724446 - RNA, 19 nt, Human
cuguuauuuuaucugcuau

SEQ ID NO: 1724447 - RNA, 18 nt, Human
gaaaacugcuacuaucug

SEQ ID NO: 1724448 - RNA, 15 nt, Human
gaaaugauguuucau

SEQ ID NO: 1724449 - RNA, 12 nt, Human
gaaauguauucu

SEQ ID NO: 1724450 - RNA, 20 nt, Human
gaaagaaaauaacgauaaaa

SEQ ID NO: 1724451 - RNA, 21 nt, Human
gaacucucgagcguugcuggg

SEQ ID NO: 1724452 - RNA, 20 nt, Human
gaacuuccagauccuggaaa

SEQ ID NO: 1724453 - RNA, 19 nt, Human
gaacagucucuugaggcac

SEQ ID NO: 1724454 - RNA, 13 nt, Human
gagacaagcagcc

SEQ ID NO: 1724455 - RNA, 13 nt, Human
gagcucaccaguc

SEQ ID NO: 1724456 - RNA, 22 nt, Human
gaguuuagcuggaaaaguaugu

SEQ ID NO: 1724457 - RNA, 16 nt, Human
gaucagccugggcaac

SEQ ID NO: 1724458 - RNA, 15 nt, Human
gaugcuuugagaaca

SEQ ID NO: 1724459 - RNA, 14 nt, Human
gauaucuucagaaa

SEQ ID NO: 1724460 - RNA, 19 nt, Human
gcagcauuguuggcuguuc

SEQ ID NO: 1724461 - RNA, 15 nt, Human
gcagcaucagcaucc

SEQ ID NO: 1724462 - RNA, 17 nt, Human
aacacaugauccugcaa

SEQ ID NO: 1724463 - RNA, 14 nt, Human
aacaaggaugaauu

SEQ ID NO: 1724464 - RNA, 17 nt, Human
aaaaaccccacaaucua

SEQ ID NO: 1724465 - RNA, 21 nt, Human
aaauauuauguuaaaacuggg

SEQ ID NO: 1724466 - RNA, 17 nt, Human
aagccaugugcagccac

SEQ ID NO: 1724467 - RNA, 11 nt, Human
aaccuauguuu

SEQ ID NO: 1724468 - RNA, 22 nt, Human
ugguucuucuuggucucagugu

SEQ ID NO: 1724469 - RNA, 15 nt, Human
uggccgggagccuga

SEQ ID NO: 1724470 - RNA, 20 nt, Human
uggccacaucugagccccga

SEQ ID NO: 1724471 - RNA, 13 nt, Human
uggacgagaaaac

SEQ ID NO: 1724472 - RNA, 23 nt, Human
uggaacgagacaagcagcccuua

SEQ ID NO: 1724473 - RNA, 19 nt, Human
ugaaagaggaaugaaguac

SEQ ID NO: 1724474 - RNA, 14 nt, Human
uaaaaaaaaaccug

SEQ ID NO: 1724475 - RNA, 13 nt, Human
guuuuauaugcuu

SEQ ID NO: 1724476 - RNA, 15 nt, Human
guuuaugauuccacc

SEQ ID NO: 1724477 - RNA, 17 nt, Human
guauuucuaugaaauau

SEQ ID NO: 1724478 - RNA, 12 nt, Human
gugaaacccugu

SEQ ID NO: 1724479 - RNA, 21 nt, Human
gucccuguggaaguaucuugg

SEQ ID NO: 1724480 - RNA, 24 nt, Human
guaguccuguaauggaagcaucua

SEQ ID NO: 1724481 - RNA, 22 nt, Human
ggagucucagcuucacccugag

SEQ ID NO: 1724482 - RNA, 23 nt, Human
uaaaccaaggcuagaaccaccug

SEQ ID NO: 1724483 - RNA, 20 nt, Human
uccaggcuggcgugcagcau

SEQ ID NO: 1724484 - RNA, 21 nt, Human
uauuucuaugaaauauuaugu

SEQ ID NO: 1724485 - RNA, 19 nt, Human
cuuauugucuagugaaacu

SEQ ID NO: 1724486 - RNA, 18 nt, Human
gaauugaggacacugaua

SEQ ID NO: 1724487 - RNA, 23 nt, Human
cgcucucuggccuucggccucca

SEQ ID NO: 1724488 - RNA, 13 nt, Human
cgcucucuggccu

SEQ ID NO: 1724489 - RNA, 21 nt, Human
gccccgucccccucuggcucc

SEQ ID NO: 1724490 - RNA, 16 nt, Human
gauaaucacaauacau

SEQ ID NO: 1724491 - RNA, 17 nt, Human
gauccugcaauuccacu

SEQ ID NO: 1724492 - RNA, 14 nt, Human
gaucacuugagccc

SEQ ID NO: 1724493 - RNA, 18 nt, Human
gacacauaucaaacugaa

SEQ ID NO: 1724494 - RNA, 23 nt, Human
gagccgagauugugccccugcac

SEQ ID NO: 1724495 - RNA, 16 nt, Human
gaggacgcucucuggc

SEQ ID NO: 1724496 - RNA, 16 nt, Human
gcucucuggccuucgg

SEQ ID NO: 1724497 - RNA, 16 nt, Human
gcucuggacaggcacu

SEQ ID NO: 1724498 - RNA, 19 nt, Human
gcccuuucucagggcagau

SEQ ID NO: 1724499 - RNA, 13 nt, Human
ggaauuggagcuc

SEQ ID NO: 1724500 - RNA, 19 nt, Human
ggaaaaaauaacaaugaaa

SEQ ID NO: 1724501 - RNA, 15 nt, Human
cacaccuuaucuaug

SEQ ID NO: 1724502 - RNA, 15 nt, Human
augucauuugcugga

SEQ ID NO: 1724503 - RNA, 14 nt, Human
caggaggaucacuu

SEQ ID NO: 1724504 - RNA, 13 nt, Human
cauccugaggcuc

SEQ ID NO: 1724505 - RNA, 20 nt, Human
cauggaaacgaagcaccauc

SEQ ID NO: 1724506 - RNA, 22 nt, Human
caugggacagggaggacgcucu

SEQ ID NO: 1724507 - RNA, 12 nt, Human
ccacaagaaccc

SEQ ID NO: 1724508 - RNA, 21 nt, Human
ccacuuggucugugagaugcu

SEQ ID NO: 1724509 - RNA, 18 nt, Human
cccacuugccauaaaacu

SEQ ID NO: 1724510 - RNA, 15 nt, Human
cgagacaagcagccc

SEQ ID NO: 1724511 - RNA, 16 nt, Human
agaucacuugagcuca

SEQ ID NO: 1724512 - RNA, 22 nt, Human
agguacugagagugaacaaauu

SEQ ID NO: 1724513 - RNA, 16 nt, Human
aggggccaugaaucac

SEQ ID NO: 1724514 - RNA, 22 nt, Human
agaagcaccaaucaugaauuag

SEQ ID NO: 1724515 - RNA, 20 nt, Human
agguuguguguggaagguga

SEQ ID NO: 1724516 - RNA, 21 nt, Human
aguguuggagaagaacugaaa

SEQ ID NO: 1724517 - RNA, 15 nt, Human
auauuuuauaucaau

SEQ ID NO: 1724518 - RNA, 22 nt, Human
aagccuuggggcugaugcaguu

SEQ ID NO: 1724519 - RNA, 17 nt, Human
aacaguguguuggcgcu

SEQ ID NO: 1724520 - RNA, 17 nt, Human
accucauggaauuggag

SEQ ID NO: 1724521 - RNA, 16 nt, Human
accuucugaggagcug

SEQ ID NO: 1724522 - RNA, 15 nt, Human
acaagaaaugaaagc

SEQ ID NO: 1724523 - RNA, 15 nt, Human
acacagauuugagcu

SEQ ID NO: 1724524 - RNA, 23 nt, Human
acucugcaagaagaaaucaugau

SEQ ID NO: 1724525 - RNA, 20 nt, Human
uuuuaaaagaaugauuauga

SEQ ID NO: 1724526 - RNA, 22 nt, Human
uugagcaggauuagauaaggcu

SEQ ID NO: 1724527 - RNA, 13 nt, Human
uucugcagauaaa

SEQ ID NO: 1724528 - RNA, 17 nt, Human
uuguggggcuaaggcag

SEQ ID NO: 1724529 - RNA, 14 nt, Human
uuguauuuaaggau

SEQ ID NO: 1724530 - RNA, 16 nt, Human
uuccaagugauugaaa

SEQ ID NO: 1724531 - RNA, 19 nt, Human
ugugcuaaaacaagcacua

SEQ ID NO: 1724532 - RNA, 21 nt, Human
uguggccugaguaaugcauua

SEQ ID NO: 1724533 - RNA, 16 nt, Human
uuccuaauuccacagc

SEQ ID NO: 1724534 - RNA, 18 nt, Human
ugucuugcuugauuguau

SEQ ID NO: 1724535 - RNA, 20 nt, Human
ucuuaggguuaugauuaagu

SEQ ID NO: 1724536 - RNA, 14 nt, Human
ugaaagaaaauaac

SEQ ID NO: 1724537 - RNA, 15 nt, Human
ugaaagguacuucaa

SEQ ID NO: 1724538 - RNA, 21 nt, Human
gggagaaucacuugaacccgg

SEQ ID NO: 1724539 - RNA, 19 nt, Human
guagaaugggggcagcacc

SEQ ID NO: 1724540 - RNA, 23 nt, Human
gcuggagcucugcccauccugcc

SEQ ID NO: 1724541 - RNA, 21 nt, Human
ccccuuccuaauuccacagcu

SEQ ID NO: 1724542 - RNA, 22 nt, Human
ggagcaucuccucaacucugag

SEQ ID NO: 1724543 - RNA, 23 nt, Human
uccagugauaagagauguugacu

SEQ ID NO: 1724544 - RNA, 13 nt, Human
ucaaaacuucaga

SEQ ID NO: 1724545 - RNA, 15 nt, Human
uaccucugcuauuug

SEQ ID NO: 1724546 - RNA, 21 nt, Human
uaugccuuuucccaacuccag

SEQ ID NO: 1724547 - RNA, 17 nt, Human
guccgaggugggcagau

SEQ ID NO: 1724548 - RNA, 17 nt, Human
gucaucugaugagaaca

SEQ ID NO: 1724549 - RNA, 16 nt, Human
guauguacuucaugcu

SEQ ID NO: 1724550 - RNA, 15 nt, Human
guauuagaauaccac

SEQ ID NO: 1724551 - RNA, 13 nt, Human
guucaaaacuuau

SEQ ID NO: 1724552 - RNA, 12 nt, Human
uaagugaaauaa

SEQ ID NO: 1724553 - RNA, 13 nt, Human
aaacaggcaaauu

SEQ ID NO: 1724554 - RNA, 19 nt, Human
agcucuaaaugucaaucag

SEQ ID NO: 1724555 - RNA, 21 nt, Human
agcuggccuugugaggagcug

SEQ ID NO: 1724556 - RNA, 22 nt, Human
aguuuuugugaaaagcuccauu

SEQ ID NO: 1724557 - RNA, 19 nt, Human
acagaccuuugaacuagag

SEQ ID NO: 1724558 - RNA, 14 nt, Human
acaugauccugcaa

SEQ ID NO: 1724559 - RNA, 14 nt, Human
agccagacaucaac

SEQ ID NO: 1724560 - RNA, 15 nt, Human
agcaucaucuucugg

SEQ ID NO: 1724561 - RNA, 18 nt, Human
agccucuuagaugcaguu

SEQ ID NO: 1724562 - RNA, 20 nt, Human
agcucacagaccuuugaacu

SEQ ID NO: 1724563 - RNA, 14 nt, Human
caaauccaaugaaa

SEQ ID NO: 1724564 - RNA, 14 nt, Human
caccucccccaucu

SEQ ID NO: 1724565 - RNA, 14 nt, Human
auuuuauuaggagu

SEQ ID NO: 1724566 - RNA, 23 nt, Human
auuugggcacaacacaucaggaa

SEQ ID NO: 1724567 - RNA, 16 nt, Human
caaacugaaacaaaau

SEQ ID NO: 1724568 - RNA, 14 nt, Human
auuuauuacuguaa

SEQ ID NO: 1724569 - RNA, 15 nt, Human
auuucuaaagccauu

SEQ ID NO: 1724570 - RNA, 19 nt, Human
auuccucacuuugaagagu

SEQ ID NO: 1724571 - RNA, 15 nt, Human
auuauggauaaagau

SEQ ID NO: 1724572 - RNA, 12 nt, Human
aucuggcucugg

SEQ ID NO: 1724573 - RNA, 19 nt, Human
acuuggucugugagaugcu

SEQ ID NO: 1724574 - RNA, 15 nt, Human
agaaaacaauaacga

SEQ ID NO: 1724575 - RNA, 12 nt, Human
aauaaaauccau

SEQ ID NO: 1724576 - RNA, 21 nt, Human
aauaauuuuuauauuugaaau

SEQ ID NO: 1724577 - RNA, 22 nt, Human
aauaagccagacaucaacagau

SEQ ID NO: 1724578 - RNA, 16 nt, Human
acucauuaggauggcu

SEQ ID NO: 1724579 - RNA, 20 nt, Human
acuacauggaagaccucauu

SEQ ID NO: 1724580 - RNA, 16 nt, Human
acuggccacacaggau

SEQ ID NO: 1724581 - RNA, 14 nt, Human
aaugauaacuggaa

SEQ ID NO: 1724582 - RNA, 13 nt, Human
acaucaacagaua

SEQ ID NO: 1724583 - RNA, 15 nt, Human
acagagacagaaagc

SEQ ID NO: 1724584 - RNA, 19 nt, Human
aaaaucucaauauuucaga

SEQ ID NO: 1724585 - RNA, 15 nt, Human
aaagagaacuuccag

SEQ ID NO: 1724586 - RNA, 15 nt, Human
aauauuccuuaagau

SEQ ID NO: 1724587 - RNA, 13 nt, Human
aaucaggcuggcc

SEQ ID NO: 1724588 - RNA, 17 nt, Human
agagacagaaagcagaa

SEQ ID NO: 1724589 - RNA, 20 nt, Human
cugaugggcaaaaaaccaau

SEQ ID NO: 1724590 - RNA, 20 nt, Human
agauacaguggagacaucug

SEQ ID NO: 1724591 - RNA, 19 nt, Human
agcauaguaccucugcuau

SEQ ID NO: 1724592 - RNA, 20 nt, Human
cagguccugcugaaacugcc

SEQ ID NO: 1724593 - RNA, 22 nt, Human
caggucuaccaaaaaucucaau

SEQ ID NO: 1724594 - RNA, 13 nt, Human
cacuuuuauaaga

SEQ ID NO: 1724595 - RNA, 16 nt, Human
cucagcuucacccuga

SEQ ID NO: 1724596 - RNA, 16 nt, Human
cucaggaggucaagau

SEQ ID NO: 1724597 - RNA, 18 nt, Human
gacauugaggcaggcacu

SEQ ID NO: 1724598 - RNA, 20 nt, Human
gaaaucaggguuaguauugu

SEQ ID NO: 1724599 - RNA, 14 nt, Human
gacuuaaugccacu

SEQ ID NO: 1724600 - RNA, 13 nt, Human
gaaacguauucaa

SEQ ID NO: 1724601 - RNA, 19 nt, Human
gcaccuccuaagaaggcac

SEQ ID NO: 1724602 - RNA, 13 nt, Human
gcagccaccaguc

SEQ ID NO: 1724603 - RNA, 23 nt, Human
gacugcauuauauuuauuacugu

SEQ ID NO: 1724604 - RNA, 16 nt, Human
gagaagaacugaaauc

SEQ ID NO: 1724605 - RNA, 17 nt, Human
gagaugaggccgccaug

SEQ ID NO: 1724606 - RNA, 16 nt, Human
gauuuuauaugcuauu

SEQ ID NO: 1724607 - RNA, 14 nt, Human
gauguuucauaaga

SEQ ID NO: 1724608 - RNA, 21 nt, Human
gauguugaaaaaguucugcag

SEQ ID NO: 1724609 - RNA, 18 nt, Human
ggcugagccucagucucc

SEQ ID NO: 1724610 - RNA, 19 nt, Human
gcucauggaauuggagcuc

SEQ ID NO: 1724611 - RNA, 14 nt, Human
ggccaccugcugag

SEQ ID NO: 1724612 - RNA, 20 nt, Human
ggccacaccaaccuucugag

SEQ ID NO: 1724613 - RNA, 13 nt, Human
ggcauagcccugc

SEQ ID NO: 1724614 - RNA, 21 nt, Human
gccaggaaucacuggcuguua

SEQ ID NO: 1724615 - RNA, 13 nt, Human
gcuagaacucccu

SEQ ID NO: 1724616 - RNA, 20 nt, Human
guaaaggggcagcagugcca

SEQ ID NO: 1724617 - RNA, 17 nt, Human
gggaagccuuggggcug

SEQ ID NO: 1724618 - RNA, 19 nt, Human
ucuccacuggaaaacugcu

SEQ ID NO: 1724619 - RNA, 15 nt, Human
ugagcucagcccugg

SEQ ID NO: 1724620 - RNA, 21 nt, Human
uaauuuuuauauuugaaauau

SEQ ID NO: 1724621 - RNA, 15 nt, Human
uaaguaaugauaacu

SEQ ID NO: 1724622 - RNA, 17 nt, Human
aggauguggggaaguua

SEQ ID NO: 1724623 - RNA, 18 nt, Human
agugaaagaaaauaacga

SEQ ID NO: 1724624 - RNA, 17 nt, Human
aguuaggaacugguguc

SEQ ID NO: 1724625 - RNA, 14 nt, Human
aggcaccucucugg

SEQ ID NO: 1724626 - RNA, 15 nt, Human
agcugguggcucugu

SEQ ID NO: 1724627 - RNA, 20 nt, Human
uuuucaggcuagauguaugu

SEQ ID NO: 1724628 - RNA, 16 nt, Human
auauuuguacaccaau

SEQ ID NO: 1724629 - RNA, 13 nt, Human
aucaacagauaaa

SEQ ID NO: 1724630 - RNA, 18 nt, Human
auaaaaauauauagcgac

SEQ ID NO: 1724631 - RNA, 15 nt, Human
aucugcuaugcuauu

SEQ ID NO: 1724632 - RNA, 20 nt, Human
auccugaggcuccacuuggu

SEQ ID NO: 1724633 - RNA, 15 nt, Human
auuaaguaaugauaa

SEQ ID NO: 1724634 - RNA, 19 nt, Human
augggacagggaggacgcu

SEQ ID NO: 1724635 - RNA, 17 nt, Human
ccaugaacuauaugacu

SEQ ID NO: 1724636 - RNA, 12 nt, Human
caugauccugca

SEQ ID NO: 1724637 - RNA, 18 nt, Human
cagccucuuagaugcagu

SEQ ID NO: 1724638 - RNA, 21 nt, Human
auuucagcagcugcagcucau

SEQ ID NO: 1724639 - RNA, 20 nt, Human
auucuuuuaguuuuuaaagu

SEQ ID NO: 1724640 - RNA, 21 nt, Human
auuaggauggcuaguaucaaa

SEQ ID NO: 1724641 - RNA, 16 nt, Human
caaacuuuacagaaag

SEQ ID NO: 1724642 - RNA, 12 nt, Human
caacacccugag

SEQ ID NO: 1724643 - RNA, 13 nt, Human
caccucccccauc

SEQ ID NO: 1724644 - RNA, 13 nt, Human
cagagauaaagcu

SEQ ID NO: 1724645 - RNA, 16 nt, Human
uggaaacgaagcacca

SEQ ID NO: 1724646 - RNA, 13 nt, Human
uaaagaaacaaaa

SEQ ID NO: 1724647 - RNA, 16 nt, Human
uauguucuaagaagug

SEQ ID NO: 1724648 - RNA, 19 nt, Human
cauaucaaacugaaacaaa

SEQ ID NO: 1724649 - RNA, 17 nt, Human
agguccacaacacacag

SEQ ID NO: 1724650 - RNA, 12 nt, Human
cuacagugagcc

SEQ ID NO: 1724651 - RNA, 18 nt, Human
auggccacaucugagccc

SEQ ID NO: 1724652 - RNA, 13 nt, Human
uguccacaaguaa

SEQ ID NO: 1724653 - RNA, 12 nt, Human
cauuauauuuau

SEQ ID NO: 1724654 - RNA, 15 nt, Human
ugcuugucccugugg

SEQ ID NO: 1724655 - RNA, 22 nt, Human
agaaagugacaagcucacagac

SEQ ID NO: 1724656 - RNA, 15 nt, Human
agaauaccacaggaa

SEQ ID NO: 1724657 - RNA, 22 nt, Human
ggguuccuuccucugagccuug

SEQ ID NO: 1724658 - RNA, 12 nt, Human
ccccuugccaua

SEQ ID NO: 1724659 - RNA, 22 nt, Human
ugaguuuuucuuuucauuuacc

SEQ ID NO: 1724660 - RNA, 17 nt, Human
auuuucuauaauuuaaa

SEQ ID NO: 1724661 - RNA, 12 nt, Human
cuuaagcuuuca

SEQ ID NO: 1724662 - RNA, 17 nt, Human
aggguguguaaguagau

SEQ ID NO: 1724663 - RNA, 15 nt, Human
aaauaauuuuuauau

SEQ ID NO: 1724664 - RNA, 22 nt, Human
aauuuuuucucuaggaaauauu

SEQ ID NO: 1724665 - RNA, 20 nt, Human
ugaggcuccacuuggucugu

SEQ ID NO: 1724666 - RNA, 22 nt, Human
uuuccaagcaaguauuagaaua

SEQ ID NO: 1724667 - RNA, 23 nt, Human
cuggggcuuuaacuccugcuaga

SEQ ID NO: 1724668 - RNA, 21 nt, Human
cuguguccucaugagggcugg

SEQ ID NO: 1724669 - RNA, 13 nt, Human
agcuucuguuccg

SEQ ID NO: 1724670 - RNA, 20 nt, Human
gaaacauuugguaaggggaa

SEQ ID NO: 1724671 - RNA, 19 nt, Human
gcugaugggcaaaaaacca

SEQ ID NO: 1724672 - RNA, 14 nt, Human
acccgggaggcaga

SEQ ID NO: 1724673 - RNA, 16 nt, Human
cauuucuaaagccauu

SEQ ID NO: 1724674 - RNA, 18 nt, Human
cccacuggacucaccucc

SEQ ID NO: 1724675 - RNA, 22 nt, Human
aucucuucuggguuccuuccuc

SEQ ID NO: 1724676 - RNA, 21 nt, Human
ccucuguucugcacacagcac

SEQ ID NO: 1724677 - RNA, 16 nt, Human
caaguaaaaggaaaug

SEQ ID NO: 1724678 - RNA, 22 nt, Human
ucugcuggagacauugaggcag

SEQ ID NO: 1724679 - RNA, 14 nt, Human
auacaaaaaaaaaa

SEQ ID NO: 1724680 - RNA, 14 nt, Human
aaauauuauuuuau

SEQ ID NO: 1724681 - RNA, 15 nt, Human
cuugaaaacuuuaug

SEQ ID NO: 1724682 - RNA, 17 nt, Human
ggagcucguggaacagu

SEQ ID NO: 1724683 - RNA, 18 nt, Human
acugacucuuaagaagac

SEQ ID NO: 1724684 - RNA, 14 nt, Human
gauuaguacacacu

SEQ ID NO: 1724685 - RNA, 22 nt, Human
cuucagccugaaagaggaauga

SEQ ID NO: 1724686 - RNA, 13 nt, Human
ggaaguagaggag

SEQ ID NO: 1724687 - RNA, 23 nt, Human
uagauguauagguugaugguggu

SEQ ID NO: 1724688 - RNA, 16 nt, Human
ucaaaagaaagaaaau

SEQ ID NO: 1724689 - RNA, 19 nt, Human
gguuccuuccucugagccu

SEQ ID NO: 1724690 - RNA, 22 nt, Human
aacugcccacucugcaagaaga

SEQ ID NO: 1724691 - RNA, 14 nt, Human
aaaacuuauuggaa

SEQ ID NO: 1724692 - RNA, 12 nt, Human
cuaagaagugaa

SEQ ID NO: 1724693 - RNA, 21 nt, Human
aagaaauaggaaauauuuuaa

SEQ ID NO: 1724694 - RNA, 13 nt, Human
cugccuucucaac

SEQ ID NO: 1724695 - RNA, 18 nt, Human
uggccaccugcugagccc

SEQ ID NO: 1724696 - RNA, 19 nt, Human
acagucaccucauggaauu

SEQ ID NO: 1724697 - RNA, 14 nt, Human
guccacaaguaaaa

SEQ ID NO: 1724698 - RNA, 21 nt, Human
uuuguauaaaauaauuuuuau

SEQ ID NO: 1724699 - RNA, 14 nt, Human
cuggccgggagccu

SEQ ID NO: 1724700 - RNA, 19 nt, Human
ggagcuggaaacacauguu

SEQ ID NO: 1724701 - RNA, 14 nt, Human
aaugauuaugaauu

SEQ ID NO: 1724702 - RNA, 22 nt, Human
gauaaaagacagugaaagaaaa

SEQ ID NO: 1724703 - RNA, 12 nt, Human
gauaaaagacag

SEQ ID NO: 1724704 - RNA, 18 nt, Human
guuucaaacauauauaac

SEQ ID NO: 1724705 - RNA, 16 nt, Human
aagacugcacaucaaa

SEQ ID NO: 1724706 - RNA, 21 nt, Human
aacauggugaaaccuggucuc

SEQ ID NO: 1724707 - RNA, 15 nt, Human
cagaacuaaaaauua

SEQ ID NO: 1724708 - RNA, 18 nt, Human
aagaaauaggaaauauuu

SEQ ID NO: 1724709 - RNA, 15 nt, Human
aaugaauggcuaagc

SEQ ID NO: 1724710 - RNA, 22 nt, Human
cuccuccagggagucucagcuu

SEQ ID NO: 1724711 - RNA, 18 nt, Human
auaucaaacugaaacaaa

SEQ ID NO: 1724712 - RNA, 18 nt, Human
guauuauuuuuuaaaaaa

SEQ ID NO: 1724713 - RNA, 20 nt, Human
cuaaaugucaaucagccuag

SEQ ID NO: 1724714 - RNA, 17 nt, Human
cuggagggaagccuugg

SEQ ID NO: 1724715 - RNA, 15 nt, Human
cauuccaagccucau

SEQ ID NO: 1724716 - RNA, 13 nt, Human
ucuaccaaaaaaa

SEQ ID NO: 1724717 - RNA, 21 nt, Human
guccccuauccuacuuccccu

SEQ ID NO: 1724718 - RNA, 18 nt, Human
cagaaagcagaacaguga

SEQ ID NO: 1724719 - RNA, 15 nt, Human
ccugcaaagcccagc

SEQ ID NO: 1724720 - RNA, 18 nt, Human
ugaagagugugaggaaaa

SEQ ID NO: 1724721 - RNA, 14 nt, Human
agucucccucccuu

SEQ ID NO: 1724722 - RNA, 13 nt, Human
aagaucagccugg

SEQ ID NO: 1724723 - RNA, 23 nt, Human
ccacaccaaccuucugaggagcu

SEQ ID NO: 1724724 - RNA, 18 nt, Human
auagcuacuaauuuuaaa

SEQ ID NO: 1724725 - RNA, 23 nt, Human
uuagaugcaguucugaagaagau

SEQ ID NO: 1724726 - RNA, 16 nt, Human
uaccccuggccaagga

SEQ ID NO: 1724727 - RNA, 21 nt, Human
aaauaauuuuuauauuugaaa

SEQ ID NO: 1724728 - RNA, 23 nt, Human
caggcauggugguuuacgccuau

SEQ ID NO: 1724729 - RNA, 18 nt, Human
cagggaggacgcucucug

SEQ ID NO: 1724730 - RNA, 20 nt, Human
acagcccuucuuuccacaga

SEQ ID NO: 1724731 - RNA, 14 nt, Human
aagcaucacaugaa

SEQ ID NO: 1724732 - RNA, 20 nt, Human
cccugccccccagcccuccu

SEQ ID NO: 1724733 - RNA, 15 nt, Human
gugaccacugcagaa

SEQ ID NO: 1724734 - RNA, 15 nt, Human
agcagugccaaaaua

SEQ ID NO: 1724735 - RNA, 19 nt, Human
ucaguuauuauauuuacaa

SEQ ID NO: 1724736 - RNA, 13 nt, Human
aucuacacuccag

SEQ ID NO: 1724737 - RNA, 22 nt, Human
gcuaaaacaagcacuaaacaaa

SEQ ID NO: 1724738 - RNA, 23 nt, Human
ccccucuggcuccagcuggccgg

SEQ ID NO: 1724739 - RNA, 18 nt, Human
ggaaguauaggccaggca

SEQ ID NO: 1724740 - RNA, 14 nt, Human
aagcugaguguuuc

SEQ ID NO: 1724741 - RNA, 21 nt, Human
uccagccuucucucaaggaga

SEQ ID NO: 1724742 - RNA, 16 nt, Human
auuugaugcuacagga

SEQ ID NO: 1724743 - RNA, 10 nt, Human
caacucccug

SEQ ID NO: 1724744 - RNA, 21 nt, Human
acagugauuaccagggacuga

SEQ ID NO: 1724745 - RNA, 12 nt, Human
aucguguccccu

SEQ ID NO: 1724746 - RNA, 17 nt, Human
ucgcagacacaugugcu

SEQ ID NO: 1724747 - RNA, 14 nt, Human
uuaugauuaaguaa

SEQ ID NO: 1724748 - RNA, 16 nt, Human
acaaaaggaaugugua

SEQ ID NO: 1724749 - RNA, 17 nt, Human
aagacaaggaaaaaaua

SEQ ID NO: 1724750 - RNA, 21 nt, Human
ugagcucagcccuggugggca

SEQ ID NO: 1724751 - RNA, 18 nt, Human
cauguuccccuugggggu

SEQ ID NO: 1724752 - RNA, 21 nt, Human
ucaagucuuucacauuuaaau

SEQ ID NO: 1724753 - RNA, 16 nt, Human
gacaaggaaaaaauaa

SEQ ID NO: 1724754 - RNA, 12 nt, Human
cuacauaaaaua

SEQ ID NO: 1724755 - RNA, 13 nt, Human
caaaaggaaugug

SEQ ID NO: 1724756 - RNA, 19 nt, Human
uguaguguuggagaagaac

SEQ ID NO: 1724757 - RNA, 11 nt, Human
aaaaaaaaacc

SEQ ID NO: 1724758 - RNA, 20 nt, Human
uugaacccgggaggcagagg

SEQ ID NO: 1724759 - RNA, 14 nt, Human
augcuccuccaggg

SEQ ID NO: 1724760 - RNA, 13 nt, Human
acagcccuucuuu

SEQ ID NO: 1724761 - RNA, 19 nt, Human
guuguauuauuuuuuaaaa

SEQ ID NO: 1724762 - RNA, 23 nt, Human
uccaacuaucucauuuccaagca

SEQ ID NO: 1724763 - RNA, 14 nt, Human
acuggacucaccuc

SEQ ID NO: 1724764 - RNA, 17 nt, Human
uaucuuuuuuuuaauaa

SEQ ID NO: 1724765 - RNA, 14 nt, Human
gggcaagagagcga

SEQ ID NO: 1724766 - RNA, 23 nt, Human
gcuuuggucuaucuuugagcgcc

SEQ ID NO: 1724767 - RNA, 21 nt, Human
ugaccauacuaauuauacccc

SEQ ID NO: 1724768 - RNA, 22 nt, Human
ccccuuccuaauuccacagcug

SEQ ID NO: 1724769 - RNA, 21 nt, Human
auuuacaaaugggaaacaaaa

SEQ ID NO: 1724770 - RNA, 18 nt, Human
cagccucuuagaugcagu

SEQ ID NO: 1724771 - RNA, 12 nt, Human
aagaaaggaagu

SEQ ID NO: 1724772 - RNA, 19 nt, Human
uacuucuuaggguuaugau

SEQ ID NO: 1724773 - RNA, 15 nt, Human
aucaauuuaaaaaaa

SEQ ID NO: 1724774 - RNA, 19 nt, Human
acccccagcuuugaggaaa

SEQ ID NO: 1724775 - RNA, 16 nt, Human
ccccugcacuccagcc

SEQ ID NO: 1724776 - RNA, 23 nt, Human
ggccuccauccugaggcuccacu

SEQ ID NO: 1724777 - RNA, 20 nt, Human
aauuaaguuuuuuuuuaaaa

SEQ ID NO: 1724778 - RNA, 19 nt, Human
agaucuacaugucuagaga

SEQ ID NO: 1724779 - RNA, 15 nt, Human
agagugugaggaaaa

SEQ ID NO: 1724780 - RNA, 15 nt, Human
uggacucaccucccc

SEQ ID NO: 1724781 - RNA, 12 nt, Human
aauaaaguacaa

SEQ ID NO: 1724782 - RNA, 15 nt, Human
aagugaaaaucuaca

SEQ ID NO: 1724783 - RNA, 18 nt, Human
ucuucaacucccugcccc

SEQ ID NO: 1724784 - RNA, 18 nt, Human
uaaugaauacuuuauaaa

SEQ ID NO: 1724785 - RNA, 21 nt, Human
gcaaaauuuuuucucuaggaa

SEQ ID NO: 1724786 - RNA, 19 nt, Human
caguccauugggcaggcag

SEQ ID NO: 1724787 - RNA, 22 nt, Human
aaguggaacgagacaagcagcc

SEQ ID NO: 1724788 - RNA, 14 nt, Human
cguguccccuaucc

SEQ ID NO: 1724789 - RNA, 18 nt, Human
ugccuaggcauagcccug

SEQ ID NO: 1724790 - RNA, 22 nt, Human
caaggaugccccgucccccucu

SEQ ID NO: 1724791 - RNA, 18 nt, Human
uggcuguuaaucuuucaa

SEQ ID NO: 1724792 - RNA, 18 nt, Human
uuuucucuccucucccca

SEQ ID NO: 1724793 - RNA, 20 nt, Human
caagccuccuuuuaaaguaa

SEQ ID NO: 1724794 - RNA, 16 nt, Human
gaagccagaucuaugc

SEQ ID NO: 1724795 - RNA, 22 nt, Human
aaggagaggcaaagaaaggaga

SEQ ID NO: 1724796 - RNA, 18 nt, Human
ccugcaaagcccagcuug

SEQ ID NO: 1724797 - RNA, 15 nt, Human
ucucaauaaauaaau

SEQ ID NO: 1724798 - RNA, 16 nt, Human
ggcugagccucagucu

SEQ ID NO: 1724799 - RNA, 22 nt, Human
gagucccaggcugagccucagu

SEQ ID NO: 1724800 - RNA, 23 nt, Human
gaaaaucuuauaauuuaaaauau

SEQ ID NO: 1724801 - RNA, 15 nt, Human
ucauaauaaguugca

SEQ ID NO: 1724802 - RNA, 18 nt, Human
auuuuaacucuauaaugu

SEQ ID NO: 1724803 - RNA, 17 nt, Human
ccccuggccaaggaaga

SEQ ID NO: 1724804 - RNA, 17 nt, Human
ccacugcagaagacagu

SEQ ID NO: 1724805 - RNA, 14 nt, Human
agaauauauuuccu

SEQ ID NO: 1724806 - RNA, 17 nt, Human
gugggauacuauuuaau

SEQ ID NO: 1724807 - RNA, 16 nt, Human
cugagccucagucucc

SEQ ID NO: 1724808 - RNA, 18 nt, Human
cccaagccuggcaaggga

SEQ ID NO: 1724809 - RNA, 15 nt, Human
uaucaauuuaaaaaa

SEQ ID NO: 1724810 - RNA, 18 nt, Human
ccugccuaagugcagccc

SEQ ID NO: 1724811 - RNA, 16 nt, Human
uaaugaauacuuuaua

SEQ ID NO: 1724812 - RNA, 18 nt, Human
uuuuagugaaauauuauu

SEQ ID NO: 1724813 - RNA, 19 nt, Human
gcuuguauuccuuuuucuc

SEQ ID NO: 1724814 - RNA, 15 nt, Human
aagccaugugcagcc

SEQ ID NO: 1724815 - RNA, 21 nt, Human
uguauaaaauaauuuuuauau

SEQ ID NO: 1724816 - RNA, 19 nt, Human
auucagaauuucuaaaagu

SEQ ID NO: 1724817 - RNA, 17 nt, Human
aggccaggcacaguggc

SEQ ID NO: 1724818 - RNA, 13 nt, Human
gagacagcucugc

SEQ ID NO: 1724819 - RNA, 21 nt, Human
gucucagugucaaugcagccc

SEQ ID NO: 1724820 - RNA, 19 nt, Human
uggggcuuuaacuccugcu

SEQ ID NO: 1724821 - RNA, 18 nt, Human
acagagacagaaagcaga

SEQ ID NO: 1724822 - RNA, 19 nt, Human
aauauaugaggcuacagaa

SEQ ID NO: 1724823 - RNA, 16 nt, Human
cugagcuugcagagau

SEQ ID NO: 1724824 - RNA, 15 nt, Human
aaaaaagaaacauuu

SEQ ID NO: 1724825 - RNA, 21 nt, Human
auuauauggcuugaguuuaaa

SEQ ID NO: 1724826 - RNA, 22 nt, Human
aaagacagugaaagaaaauaac

SEQ ID NO: 1724827 - RNA, 16 nt, Human
gucucuacauaaaaua

SEQ ID NO: 1724828 - RNA, 17 nt, Human
uagaauauauuuccuua

SEQ ID NO: 1724829 - RNA, 14 nt, Human
auaaauaaauaaaa

SEQ ID NO: 1724830 - RNA, 14 nt, Human
uuuuauaagaaaua

SEQ ID NO: 1724831 - RNA, 22 nt, Human
caauaaaagacaaggaaaaaau

SEQ ID NO: 1724832 - RNA, 18 nt, Human
uuacagguccugcugaaa

SEQ ID NO: 1724833 - RNA, 20 nt, Human
aaaugauguuucauaagaau

SEQ ID NO: 1724834 - RNA, 16 nt, Human
caucugaugagaacaa

SEQ ID NO: 1724835 - RNA, 16 nt, Human
agaacuaaaaauuaaa

SEQ ID NO: 1724836 - RNA, 21 nt, Human
auauaugcuaagucuuauaua

SEQ ID NO: 1724837 - RNA, 15 nt, Human
cuguaaaauaauaac

SEQ ID NO: 1724838 - RNA, 20 nt, Human
gaaacugcccacucugcaag

SEQ ID NO: 1724839 - RNA, 17 nt, Human
acaaaugggaaacaaaa

SEQ ID NO: 1724840 - RNA, 18 nt, Human
acauuugcucauggaauu

SEQ ID NO: 1724841 - RNA, 17 nt, Human
agcuaaauauauauuuu

SEQ ID NO: 1724842 - RNA, 13 nt, Human
aaguucaaaacuu

SEQ ID NO: 1724843 - RNA, 13 nt, Human
uuaaauuguaaua

SEQ ID NO: 1724844 - RNA, 16 nt, Human
gucauuauuaggaagu

SEQ ID NO: 1724845 - RNA, 17 nt, Human
cguaaucguguccccua

SEQ ID NO: 1724846 - RNA, 14 nt, Human
cauuuaguuauaaa

SEQ ID NO: 1724847 - RNA, 15 nt, Human
ggcaauagucaaauu

SEQ ID NO: 1724848 - RNA, 23 nt, Human
uaggauggcuaguaucaaaagaa

SEQ ID NO: 1724849 - RNA, 14 nt, Human
auuaagaaaggaag

SEQ ID NO: 1724850 - RNA, 18 nt, Human
auguuagagaauuuccuu

SEQ ID NO: 1724851 - RNA, 18 nt, Human
uaaaagacagugaaagaa

SEQ ID NO: 1724852 - RNA, 21 nt, Human
ccaaauauaaauaaaaauaau

SEQ ID NO: 1724853 - RNA, 21 nt, Human
gaaaaguauguuagugcaaau

SEQ ID NO: 1724854 - RNA, 13 nt, Human
acuauuauauuuc

SEQ ID NO: 1724855 - RNA, 17 nt, Human
ccaagcugguggcucug

SEQ ID NO: 1724856 - RNA, 15 nt, Human
augucugaaauggaa

SEQ ID NO: 1724857 - RNA, 19 nt, Human
gcuccagugauaagagaug

SEQ ID NO: 1724858 - RNA, 15 nt, Human
cuuaagaagacugca

SEQ ID NO: 1724859 - RNA, 15 nt, Human
uacaggauuugaaau

SEQ ID NO: 1724860 - RNA, 23 nt, Human
auuuauguuccuuuuaaagaaac

SEQ ID NO: 1724861 - RNA, 17 nt, Human
aggcaggaggaucacuu

SEQ ID NO: 1724862 - RNA, 21 nt, Human
acugccaaaacaucaaccugc

SEQ ID NO: 1724863 - RNA, 16 nt, Human
uggucugugagaugcu

SEQ ID NO: 1724864 - RNA, 15 nt, Human
ggccauuacccccag

SEQ ID NO: 1724865 - RNA, 20 nt, Human
ugagagugaacaaauuuaca

SEQ ID NO: 1724866 - RNA, 19 nt, Human
cauggccacaucugagccc

SEQ ID NO: 1724867 - RNA, 22 nt, Human
aauuguaggugacuauuauauu

SEQ ID NO: 1724868 - RNA, 20 nt, Human
uguaauaggcguaacuaauu

SEQ ID NO: 1724869 - RNA, 20 nt, Human
uccaagccucauguccacug

SEQ ID NO: 1724870 - RNA, 20 nt, Human
uuaaguuuuuuuuuaaaaaa

SEQ ID NO: 1724871 - RNA, 13 nt, Human
auaacgauaaaag

SEQ ID NO: 1724872 - RNA, 15 nt, Human
uccagauccuggaaa

SEQ ID NO: 1724873 - RNA, 15 nt, Human
aggaacuggugucuu

SEQ ID NO: 1724874 - RNA, 19 nt, Human
guacaagagcuuaacagug

SEQ ID NO: 1724875 - RNA, 15 nt, Human
aaucagagauaaagc

SEQ ID NO: 1724876 - RNA, 21 nt, Human
ggaagacaagaaggaaagauu

SEQ ID NO: 1724877 - RNA, 19 nt, Human
caggcagauguuccuaaua

SEQ ID NO: 1724878 - RNA, 19 nt, Human
aaaagacagugaaagaaaa

SEQ ID NO: 1724879 - RNA, 19 nt, Human
acuggacucaccuccccca

SEQ ID NO: 1724880 - RNA, 14 nt, Human
cuggaaaucagggu

SEQ ID NO: 1724881 - RNA, 22 nt, Human
gucucuacuaaaaauacaaaaa

SEQ ID NO: 1724882 - RNA, 22 nt, Human
uuugaugcuacaggauuugaaa

SEQ ID NO: 1724883 - RNA, 14 nt, Human
cgugcuugucccug

SEQ ID NO: 1724884 - RNA, 20 nt, Human
acaagacccaaaaggcagaa

SEQ ID NO: 1724885 - RNA, 14 nt, Human
auuuccaagaaaua

SEQ ID NO: 1724886 - RNA, 21 nt, Human
ugcucaauaaaguacaagagc

SEQ ID NO: 1724887 - RNA, 23 nt, Human
aauaauccucaguuuuugugaaa

SEQ ID NO: 1724888 - RNA, 18 nt, Human
ccucaagcuaugugagcu

SEQ ID NO: 1724889 - RNA, 16 nt, Human
ccaggcugagccucag

SEQ ID NO: 1724890 - RNA, 17 nt, Human
gccaugugcagccacca

SEQ ID NO: 1724891 - RNA, 23 nt, Human
agccuugggaccccugagcuugc

SEQ ID NO: 1724892 - RNA, 17 nt, Human
ugaaggauuuauguuua

SEQ ID NO: 1724893 - RNA, 22 nt, Human
caacacaucaggaaagagagca

SEQ ID NO: 1724894 - RNA, 13 nt, Human
uaacaauaaaaga

SEQ ID NO: 1724895 - RNA, 16 nt, Human
cacuggacucaccucc

SEQ ID NO: 1724896 - RNA, 15 nt, Human
ugccccccagcccuc

SEQ ID NO: 1724897 - RNA, 18 nt, Human
ccuuugcaccuccaugga

SEQ ID NO: 1724898 - RNA, 14 nt, Human
aauuguauuacaaa

SEQ ID NO: 1724899 - RNA, 19 nt, Human
aaugagcacgcauggaaaa

SEQ ID NO: 1724900 - RNA, 20 nt, Human
aauaauuuuuauauuugaaa

SEQ ID NO: 1724901 - RNA, 16 nt, Human
ggaugccccguccccc

SEQ ID NO: 1724902 - RNA, 22 nt, Human
aauaauccuaaacauaugaauu

SEQ ID NO: 1724903 - RNA, 14 nt, Human
acccugaggugagc

SEQ ID NO: 1724904 - RNA, 19 nt, Human
cuaccaaaaaaaggaagga

SEQ ID NO: 1724905 - RNA, 13 nt, Human
guuuaaguucuau

SEQ ID NO: 1724906 - RNA, 17 nt, Human
ccaaaaaucucaauauu

SEQ ID NO: 1724907 - RNA, 14 nt, Human
ugcuaagucuuaua

SEQ ID NO: 1724908 - RNA, 16 nt, Human
acaaggaugaauuaag

SEQ ID NO: 1724909 - RNA, 20 nt, Human
ggaaggcugaggcaggagga

SEQ ID NO: 1724910 - RNA, 19 nt, Human
caaggaugccccguccccc

SEQ ID NO: 1724911 - RNA, 15 nt, Human
ggccaccugcugagc

SEQ ID NO: 1724912 - RNA, 19 nt, Human
cuccuuggagacagggccc

SEQ ID NO: 1724913 - RNA, 13 nt, Human
auugauuauaugu

SEQ ID NO: 1724914 - RNA, 19 nt, Human
cucugcauacucauuagga

SEQ ID NO: 1724915 - RNA, 18 nt, Human
acuguacuccagccaggg

SEQ ID NO: 1724916 - RNA, 14 nt, Human
augaugcuuugaga

SEQ ID NO: 1724917 - RNA, 16 nt, Human
cugcacuccagccuga

SEQ ID NO: 1724918 - RNA, 15 nt, Human
ugcagccaccagucc

SEQ ID NO: 1724919 - RNA, 20 nt, Human
uaugcuauuuauuaaguauu

SEQ ID NO: 1724920 - RNA, 13 nt, Human
gacaaggaaaaaa

SEQ ID NO: 1724921 - RNA, 17 nt, Human
aggaaaaugggcuuugg

SEQ ID NO: 1724922 - RNA, 18 nt, Human
cagagacagaaagcagaa

SEQ ID NO: 1724923 - RNA, 14 nt, Human
caucaucuucuggg

SEQ ID NO: 1724924 - RNA, 19 nt, Human
agucaaauugugugaaagg

SEQ ID NO: 1724925 - RNA, 18 nt, Human
gccuuggggcugaugcag

SEQ ID NO: 1724926 - RNA, 17 nt, Human
aagcuuuuuuugaauca

SEQ ID NO: 1724927 - RNA, 18 nt, Human
uucagcagagaaguuuuc

SEQ ID NO: 1724928 - RNA, 17 nt, Human
agcuggaaacacauguu

SEQ ID NO: 1724929 - RNA, 18 nt, Human
gcuauaggauguggggaa

SEQ ID NO: 1724930 - RNA, 14 nt, Human
gaacgagacaagca

SEQ ID NO: 1724931 - RNA, 18 nt, Human
cagagucaagggugugug

SEQ ID NO: 1724932 - RNA, 15 nt, Human
aacgauaaaagacag

SEQ ID NO: 1724933 - RNA, 14 nt, Human
cuuguacucugaaa

SEQ ID NO: 1724934 - RNA, 20 nt, Human
aggugggcagaucacuugag

SEQ ID NO: 1724935 - RNA, 11 nt, Human
uucacagggga

SEQ ID NO: 1724936 - RNA, 20 nt, Human
auucccagccagcacagccu

SEQ ID NO: 1724937 - RNA, 19 nt, Human
cagagaugaggccgccaug

SEQ ID NO: 1724938 - RNA, 20 nt, Human
agagaucucuguagaaggag

SEQ ID NO: 1724939 - RNA, 20 nt, Human
guugagccaccaagcuggug

SEQ ID NO: 1724940 - RNA, 21 nt, Human
uuguuuuucagcguuaaugua

SEQ ID NO: 1724941 - RNA, 14 nt, Human
aagcaacccaaaug

SEQ ID NO: 1724942 - RNA, 14 nt, Human
ucuccucaacucug

SEQ ID NO: 1724943 - RNA, 12 nt, Human
gacgagaaaaca

SEQ ID NO: 1724944 - RNA, 19 nt, Human
gaaggcaccucucuggguu

SEQ ID NO: 1724945 - RNA, 20 nt, Human
uuugcaagccagauuuuccu

SEQ ID NO: 1724946 - RNA, 17 nt, Human
aaauaacaauaaaagac

SEQ ID NO: 1724947 - RNA, 12 nt, Human
uguuugaaagcu

SEQ ID NO: 1724948 - RNA, 13 nt, Human
cagaaacuccugu

SEQ ID NO: 1724949 - RNA, 20 nt, Human
aauaagucaucugaugagaa

SEQ ID NO: 1724950 - RNA, 17 nt, Human
acaucgcagacacaugu

SEQ ID NO: 1724951 - RNA, 20 nt, Human
ggugggcagaucacuugagc

SEQ ID NO: 1724952 - RNA, 17 nt, Human
cuacagaacuaaaaauu

SEQ ID NO: 1724953 - RNA, 23 nt, Human
caagagagcgagacccugucuca

SEQ ID NO: 1724954 - RNA, 15 nt, Human
uuaauucugaaagca

SEQ ID NO: 1724955 - RNA, 16 nt, Human
cagauccccaagccug

SEQ ID NO: 1724956 - RNA, 22 nt, Human
gagccucagucucccucccuug

SEQ ID NO: 1724957 - RNA, 19 nt, Human
cuuacucuugauuguggga

SEQ ID NO: 1724958 - RNA, 11 nt, Human
aaccugagccc

SEQ ID NO: 1724959 - RNA, 21 nt, Human
caguaguuagcuuucuuccug

SEQ ID NO: 1724960 - RNA, 12 nt, Human
acaagaaaugaa

SEQ ID NO: 1724961 - RNA, 14 nt, Human
acgcauggaaaagu

SEQ ID NO: 1724962 - RNA, 15 nt, Human
ugaaacccugucucu

SEQ ID NO: 1724963 - RNA, 21 nt, Human
cuggccuucggccuccauccu

SEQ ID NO: 1724964 - RNA, 16 nt, Human
acaugaaguccaagca

SEQ ID NO: 1724965 - RNA, 15 nt, Human
ucccuuuguccacaa

SEQ ID NO: 1724966 - RNA, 20 nt, Human
cagcuuccaggcuggcgugc

SEQ ID NO: 1724967 - RNA, 16 nt, Human
ugaaguacucauacau

SEQ ID NO: 1724968 - RNA, 13 nt, Human
aaaaauccuacuu

SEQ ID NO: 1724969 - RNA, 13 nt, Human
acaagaaaugaaa

SEQ ID NO: 1724970 - RNA, 21 nt, Human
uauuauuuuauagcuacuaau

SEQ ID NO: 1724971 - RNA, 13 nt, Human
aacauuuauguuc

SEQ ID NO: 1724972 - RNA, 20 nt, Human
gcauuguuggcuguuccugc

SEQ ID NO: 1724973 - RNA, 12 nt, Human
cugaggagcugu

SEQ ID NO: 1724974 - RNA, 14 nt, Human
aaauuuaucauuua

SEQ ID NO: 1724975 - RNA, 19 nt, Human
agagaacagggcugaagcu

SEQ ID NO: 1724976 - RNA, 21 nt, Human
auuuuccugaaaacccuugcc

SEQ ID NO: 1724977 - RNA, 17 nt, Human
cagucucuugaggcaca

SEQ ID NO: 1724978 - RNA, 10 nt, Human
accugagccc

SEQ ID NO: 1724979 - RNA, 18 nt, Human
cugaugggcaaaaaacca

SEQ ID NO: 1724980 - RNA, 19 nt, Human
aauuuuuauauuugaaaua

SEQ ID NO: 1724981 - RNA, 21 nt, Human
auuuuuucucuaggaaauauu

SEQ ID NO: 1724982 - RNA, 18 nt, Human
uacuuuauuuucuauaau

SEQ ID NO: 1724983 - RNA, 19 nt, Human
auuucuucaacucccugcc

SEQ ID NO: 1724984 - RNA, 12 nt, Human
auauaaauaaaa

SEQ ID NO: 1724985 - RNA, 21 nt, Human
guuuguuuauuuguuuuucca

SEQ ID NO: 1724986 - RNA, 16 nt, Human
cuguggauuuaaugug

SEQ ID NO: 1724987 - RNA, 16 nt, Human
gccaaggaagaucccu

SEQ ID NO: 1724988 - RNA, 17 nt, Human
gcaagcucuaucaccaa

SEQ ID NO: 1724989 - RNA, 20 nt, Human
aagaugguaccaccagucug

SEQ ID NO: 1724990 - RNA, 20 nt, Human
agaauucuguugauggaaau

SEQ ID NO: 1724991 - RNA, 14 nt, Human
aaaauacaaaaaaa

SEQ ID NO: 1724992 - RNA, 19 nt, Human
uugugggauacuauuuaau

SEQ ID NO: 1724993 - RNA, 17 nt, Human
ucuauaauguguucauu

SEQ ID NO: 1724994 - RNA, 22 nt, Human
ugaccauacuaauuauaccccc

SEQ ID NO: 1724995 - RNA, 14 nt, Human
gucccaggcugagc

SEQ ID NO: 1724996 - RNA, 14 nt, Human
auuuauuuuaauaa

SEQ ID NO: 1724997 - RNA, 21 nt, Human
gcccccacuugccauaaaacu

SEQ ID NO: 1724998 - RNA, 15 nt, Human
gccucagucucccuc

SEQ ID NO: 1724999 - RNA, 22 nt, Human
gcuaauuagcauggccacaucu

SEQ ID NO: 1725000 - RNA, 17 nt, Human
aggccaugggacaggga

SEQ ID NO: 1725001 - RNA, 22 nt, Human
uucugguagcuaaauauauauu

SEQ ID NO: 1725002 - RNA, 13 nt, Human
ccccagcccuccu

SEQ ID NO: 1725003 - RNA, 14 nt, Human
guauuuuaaaagaa

SEQ ID NO: 1725004 - RNA, 16 nt, Human
uuuauauuugaaauau

SEQ ID NO: 1725005 - RNA, 22 nt, Human
agcagcauaaauguugacaugg

SEQ ID NO: 1725006 - RNA, 13 nt, Human
caucugagccccg

SEQ ID NO: 1725007 - RNA, 23 nt, Human
acuggcuaauuagcauggccaca

SEQ ID NO: 1725008 - RNA, 16 nt, Human
cuaggcauagcccugc

SEQ ID NO: 1725009 - RNA, 20 nt, Human
cagagaaguuuucuggaggu

SEQ ID NO: 1725010 - RNA, 18 nt, Human
cuggggcuuuaacuccug

SEQ ID NO: 1725011 - RNA, 16 nt, Human
ugcuguauuuuaaaag

SEQ ID NO: 1725012 - RNA, 13 nt, Human
agaaguaaaaaca

SEQ ID NO: 1725013 - RNA, 18 nt, Human
aggcauagcccugccuca

SEQ ID NO: 1725014 - RNA, 19 nt, Human
agccuucucucaaggagag

SEQ ID NO: 1725015 - RNA, 16 nt, Human
agguugcagugagccg

SEQ ID NO: 1725016 - RNA, 19 nt, Human
acugccaucauuuacuuuu

SEQ ID NO: 1725017 - RNA, 15 nt, Human
auuuaauuauuucac

SEQ ID NO: 1725018 - RNA, 13 nt, Human
ccucccccaucuc

SEQ ID NO: 1725019 - RNA, 13 nt, Human
ugaauauaaauuu

SEQ ID NO: 1725020 - RNA, 23 nt, Human
agaguuuagcuggaaaaguaugu

SEQ ID NO: 1725021 - RNA, 13 nt, Human
uaaauaaauaaau

SEQ ID NO: 1725022 - RNA, 19 nt, Human
cucacauuuauauuuuugu

SEQ ID NO: 1725023 - RNA, 14 nt, Human
cagagaaguuuucu

SEQ ID NO: 1725024 - RNA, 17 nt, Human
aaagacaaggaaaaaau

SEQ ID NO: 1725025 - RNA, 15 nt, Human
cucgugggacaguca

SEQ ID NO: 1725026 - RNA, 19 nt, Human
auacuaauuauacccccug

SEQ ID NO: 1725027 - RNA, 21 nt, Human
ccggccuuugcaccuccaugg

SEQ ID NO: 1725028 - RNA, 12 nt, Human
auaaaaacaaag

SEQ ID NO: 1725029 - RNA, 20 nt, Human
aauuuugugaagcaaaauuu

SEQ ID NO: 1725030 - RNA, 20 nt, Human
uaauaaguugcauagguuua

SEQ ID NO: 1725031 - RNA, 20 nt, Human
agcccuggugggcagagagg

SEQ ID NO: 1725032 - RNA, 16 nt, Human
ucuuggucucaguguc

SEQ ID NO: 1725033 - RNA, 22 nt, Human
cuuuaaugccgauaucuucaga

SEQ ID NO: 1725034 - RNA, 22 nt, Human
aauaugccccauucaacaucua

SEQ ID NO: 1725035 - RNA, 17 nt, Human
ucugguagcuaaauaua

SEQ ID NO: 1725036 - RNA, 14 nt, Human
auugucuagugaaa

SEQ ID NO: 1725037 - RNA, 13 nt, Human
ugcauuucuaaag

SEQ ID NO: 1725038 - RNA, 22 nt, Human
aagagccuuuuuuugaaaaaaa

SEQ ID NO: 1725039 - RNA, 18 nt, Human
cacuccagugagacagcu

SEQ ID NO: 1725040 - RNA, 16 nt, Human
cuuagcccuuccccuc

SEQ ID NO: 1725041 - RNA, 19 nt, Human
uggaaauguuuacagaucc

SEQ ID NO: 1725042 - RNA, 13 nt, Human
cucugagccuugg

SEQ ID NO: 1725043 - RNA, 15 nt, Human
augaauuaaguuuuu

SEQ ID NO: 1725044 - RNA, 21 nt, Human
ucuuaggguuaugauuaagua

SEQ ID NO: 1725045 - RNA, 18 nt, Human
uuuugugaagcaaaauuu

SEQ ID NO: 1725046 - RNA, 17 nt, Human
guccgaggugggcagau

SEQ ID NO: 1725047 - RNA, 20 nt, Human
gaaauacacuguuaucuuca

SEQ ID NO: 1725048 - RNA, 21 nt, Human
ugaaacgaggauugggaaaaa

SEQ ID NO: 1725049 - RNA, 18 nt, Human
cuaauaucuuaucuuccu

SEQ ID NO: 1725050 - RNA, 21 nt, Human
ucaguuccagccuucucucaa

SEQ ID NO: 1725051 - RNA, 24 nt, Human
cuggcuaauuagcauggccacauc

SEQ ID NO: 1725052 - RNA, 17 nt, Human
guuuaauaauuuuuaau

SEQ ID NO: 1725053 - RNA, 22 nt, Human
gaugcaguucugaagaagaugg

SEQ ID NO: 1725054 - RNA, 14 nt, Human
ugggcagaucacuu

SEQ ID NO: 1725055 - RNA, 15 nt, Human
caaaacuuauuggaa

SEQ ID NO: 1725056 - RNA, 18 nt, Human
ugcagugucugcuggaga

SEQ ID NO: 1725057 - RNA, 19 nt, Human
guggauuuaauguggaaau

SEQ ID NO: 1725058 - RNA, 23 nt, Human
cuuaagaagacugcauuauauuu

SEQ ID NO: 1725059 - RNA, 14 nt, Human
uaaaauagugaaua

SEQ ID NO: 1725060 - RNA, 17 nt, Human
ugaauauaaauuuauca

SEQ ID NO: 1725061 - RNA, 23 nt, Human
uacaaaugggaaacaaaaggaua

SEQ ID NO: 1725062 - RNA, 19 nt, Human
accaaaaaaaggaaggaag

SEQ ID NO: 1725063 - RNA, 15 nt, Human
cuggacucaccuccc

SEQ ID NO: 1725064 - RNA, 13 nt, Human
uaaacauguuuau

SEQ ID NO: 1725065 - RNA, 19 nt, Human
acuuuuauaagaaauagga

SEQ ID NO: 1725066 - RNA, 22 nt, Human
agcccuccuuaucaaaggacac

SEQ ID NO: 1725067 - RNA, 18 nt, Human
cagucucccucccuuggg

SEQ ID NO: 1725068 - RNA, 18 nt, Human
ggccuugugaggagcugg

SEQ ID NO: 1725069 - RNA, 12 nt, Human
gcugaggcagga

SEQ ID NO: 1725070 - RNA, 18 nt, Human
cugagggcauagaaguaa

SEQ ID NO: 1725071 - RNA, 18 nt, Human
agucuguuuucccuccuu

SEQ ID NO: 1725072 - RNA, 21 nt, Human
auaauuuuuauauuugaaaua

SEQ ID NO: 1725073 - RNA, 20 nt, Human
uggggcuaaggcaggaggau

SEQ ID NO: 1725074 - RNA, 15 nt, Human
ccaugugcagccacc

SEQ ID NO: 1725075 - RNA, 22 nt, Human
aggacaccauuuuggcaagcuc

SEQ ID NO: 1725076 - RNA, 21 nt, Human
uuuuauggcacuaguauuucu

SEQ ID NO: 1725077 - RNA, 20 nt, Human
guguggaaggugaucuggcu

SEQ ID NO: 1725078 - RNA, 12 nt, Human
aauuuaaauaua

SEQ ID NO: 1725079 - RNA, 12 nt, Human
agaauauauuuc

SEQ ID NO: 1725080 - RNA, 21 nt, Human
cugcccugcugagucccaggc

SEQ ID NO: 1725081 - RNA, 23 nt, Human
aacuccugcuagaacagucucuu

SEQ ID NO: 1725082 - RNA, 15 nt, Human
uaacgauaaaagaca

SEQ ID NO: 1725083 - RNA, 16 nt, Human
gacaagcucacagacc

SEQ ID NO: 1725084 - RNA, 23 nt, Human
gucucccucccuuggggccuaug

SEQ ID NO: 1725085 - RNA, 21 nt, Human
gcgagacccugucucaauaaa

SEQ ID NO: 1725086 - RNA, 19 nt, Human
cccacuggacucaccuccc

SEQ ID NO: 1725087 - RNA, 21 nt, Human
uaguauuucuaugaaauauua

SEQ ID NO: 1725088 - RNA, 22 nt, Human
uguauacugugugcuaaaacaa

SEQ ID NO: 1725089 - RNA, 15 nt, Human
cgagacaagcagccc

SEQ ID NO: 1725090 - RNA, 17 nt, Human
cccccugcaaagcccag

SEQ ID NO: 1725091 - RNA, 19 nt, Human
aagucuuucacauuuaaau

SEQ ID NO: 1725092 - RNA, 16 nt, Human
cacaucaggaaagaga

SEQ ID NO: 1725093 - RNA, 14 nt, Human
uauuuauuuuaaua

SEQ ID NO: 1725094 - RNA, 17 nt, Human
gcucaggaggucaagau

SEQ ID NO: 1725095 - RNA, 18 nt, Human
uguugcagugucugcugg

SEQ ID NO: 1725096 - RNA, 22 nt, Human
uacaugagguacugagagugaa

SEQ ID NO: 1725097 - RNA, 18 nt, Human
caugaauuaguuuuauau

SEQ ID NO: 1725098 - RNA, 21 nt, Human
ucccuggggcuuuaacuccug

SEQ ID NO: 1725099 - RNA, 22 nt, Human
ugaauggcuaagcaaaauguga

SEQ ID NO: 1725100 - RNA, 22 nt, Human
agaaauaggaaauauuuuaaug

SEQ ID NO: 1725101 - RNA, 21 nt, Human
aagacaagaaggaaagauuuu

SEQ ID NO: 1725102 - RNA, 14 nt, Human
auuuguauaaaaua

SEQ ID NO: 1725103 - RNA, 20 nt, Human
cuugccauaauuacuauguc

SEQ ID NO: 1725104 - RNA, 18 nt, Human
ggggcuuuaacuccugcu

SEQ ID NO: 1725105 - RNA, 12 nt, Human
aucuucagaaaa

SEQ ID NO: 1725106 - RNA, 18 nt, Human
agagaaugagagacacac

SEQ ID NO: 1725107 - RNA, 22 nt, Human
aggaugccccgucccccucugg

SEQ ID NO: 1725108 - RNA, 23 nt, Human
cuagucuguuuucccuccuugga

SEQ ID NO: 1725109 - RNA, 14 nt, Human
uuccccucugcagc

SEQ ID NO: 1725110 - RNA, 13 nt, Human
acaaggaaaaaau

SEQ ID NO: 1725111 - RNA, 19 nt, Human
cuucuggguuccuuccucu

SEQ ID NO: 1725112 - RNA, 12 nt, Human
guugauggaaau

SEQ ID NO: 1725113 - RNA, 20 nt, Human
uaagugaaauaagccagaca

SEQ ID NO: 1725114 - RNA, 14 nt, Human
agaaauaggaaaua

SEQ ID NO: 1725115 - RNA, 19 nt, Human
ugcuauuugcuguuauuuu

SEQ ID NO: 1725116 - RNA, 18 nt, Human
aacaaugcuguauuuuaa

SEQ ID NO: 1725117 - RNA, 14 nt, Human
uaacuaauuuuaac

SEQ ID NO: 1725118 - RNA, 17 nt, Human
acucugcaagaagaaau

SEQ ID NO: 1725119 - RNA, 14 nt, Human
cacaagaaaugaaa

SEQ ID NO: 1725120 - RNA, 15 nt, Human
auauugacuuuuuau

SEQ ID NO: 1725121 - RNA, 22 nt, Human
uaaaguugauuuaaggccaggc

SEQ ID NO: 1725122 - RNA, 22 nt, Human
cccagcccuccuuaucaaagga

SEQ ID NO: 1725123 - RNA, 20 nt, Human
acaagacacagugaccauac

SEQ ID NO: 1725124 - RNA, 23 nt, Human
cuagacccacuggacucaccucc

SEQ ID NO: 1725125 - RNA, 23 nt, Human
cucauguccacugguucuucuug

SEQ ID NO: 1725126 - RNA, 15 nt, Human
agucaccucauggaa

SEQ ID NO: 1725127 - RNA, 15 nt, Human
acaaggaaaaaauaa

SEQ ID NO: 1725128 - RNA, 16 nt, Human
gcaggcagauguuccu

SEQ ID NO: 1725129 - RNA, 14 nt, Human
uucuaugaaauauu

SEQ ID NO: 1725130 - RNA, 15 nt, Human
cgggagccugaucac

SEQ ID NO: 1725131 - RNA, 16 nt, Human
auacauguuacaacac

SEQ ID NO: 1725132 - RNA, 18 nt, Human
cucccuuggggccuaugc

SEQ ID NO: 1725133 - RNA, 18 nt, Human
cuggaaacuucagcgguu

SEQ ID NO: 1725134 - RNA, 14 nt, Human
aaccugagccccaa

SEQ ID NO: 1725135 - RNA, 21 nt, Human
gaaggaaagaauaaccaacac

SEQ ID NO: 1725136 - RNA, 17 nt, Human
ucugugagaugcuagaa

SEQ ID NO: 1725137 - RNA, 22 nt, Human
ucccuagaaagccaugugcagc

SEQ ID NO: 1725138 - RNA, 17 nt, Human
cucgugggacagucacc

SEQ ID NO: 1725139 - RNA, 22 nt, Human
aaaucaggguuaguauugucca

SEQ ID NO: 1725140 - RNA, 17 nt, Human
ugaccacugcagaagac

SEQ ID NO: 1725141 - RNA, 17 nt, Human
acacuguuaucuucacu

SEQ ID NO: 1725142 - RNA, 16 nt, Human
auuccaccuacaugag

SEQ ID NO: 1725143 - RNA, 13 nt, Human
ugaaagaaaauaa

SEQ ID NO: 1725144 - RNA, 14 nt, Human
cccugucucaauaa

SEQ ID NO: 1725145 - RNA, 12 nt, Human
uauucacaagac

SEQ ID NO: 1725146 - RNA, 22 nt, Human
cccuauccuacuuccccuuccu

SEQ ID NO: 1725147 - RNA, 16 nt, Human
auuuaaggauucugag

SEQ ID NO: 1725148 - RNA, 20 nt, Human
cauaucaaacugaaacaaaa

SEQ ID NO: 1725149 - RNA, 20 nt, Human
auguuccuuuuaaagaaaca

SEQ ID NO: 1725150 - RNA, 20 nt, Human
ugauuauaugucacuuugcu

SEQ ID NO: 1725151 - RNA, 13 nt, Human
ccuccuuuuaaag

SEQ ID NO: 1725152 - RNA, 15 nt, Human
ugguuuagaaagcuu

SEQ ID NO: 1725153 - RNA, 16 nt, Human
auaucaauuuaaaaaa

SEQ ID NO: 1725154 - RNA, 21 nt, Human
aaagauuugauguauguaaua

SEQ ID NO: 1725155 - RNA, 13 nt, Human
aagaccagccugg

SEQ ID NO: 1725156 - RNA, 23 nt, Human
auaauguguucauucuggaauaa

SEQ ID NO: 1725157 - RNA, 18 nt, Human
cacuugccauaaaacuua

SEQ ID NO: 1725158 - RNA, 13 nt, Human
ccaccugccuaua

SEQ ID NO: 1725159 - RNA, 12 nt, Human
ugccaaaauaua

SEQ ID NO: 1725160 - RNA, 14 nt, Human
agauuucaaaaaaa

SEQ ID NO: 1725161 - RNA, 21 nt, Human
cuaagcuucacuguaaaauaa

SEQ ID NO: 1725162 - RNA, 17 nt, Human
aagaaacaaaaaucaaa

SEQ ID NO: 1725163 - RNA, 19 nt, Human
ccuccauccugaggcucca

SEQ ID NO: 1725164 - RNA, 11 nt, Human
uaguuagcuuu

SEQ ID NO: 1725165 - RNA, 15 nt, Human
aaggaauuuaaaaau

SEQ ID NO: 1725166 - RNA, 23 nt, Human
acugcuaguuuauauagaaaugu

SEQ ID NO: 1725167 - RNA, 12 nt, Human
cuguuaucuuca

SEQ ID NO: 1725168 - RNA, 20 nt, Human
gacauuugcucauggaauug

SEQ ID NO: 1725169 - RNA, 21 nt, Human
cucaaaacuucagacauagaa

SEQ ID NO: 1725170 - RNA, 22 nt, Human
gaugguucccuugaugaagaag

SEQ ID NO: 1725171 - RNA, 12 nt, Human
uucucuaggaaa

SEQ ID NO: 1725172 - RNA, 14 nt, Human
uauguauauuuuau

SEQ ID NO: 1725173 - RNA, 15 nt, Human
cccugccccccagcc

SEQ ID NO: 1725174 - RNA, 14 nt, Human
acauagugaggagc

SEQ ID NO: 1725175 - RNA, 14 nt, Human
uaaauaguuuauga

SEQ ID NO: 1725176 - RNA, 15 nt, Human
gaacuaaaaauuaaa

SEQ ID NO: 1725177 - RNA, 20 nt, Human
auuacccccagcuuugagga

SEQ ID NO: 1725178 - RNA, 21 nt, Human
accaccugccuauauuuuuug

SEQ ID NO: 1725179 - RNA, 16 nt, Human
aaaauaacaauaaaag

SEQ ID NO: 1725180 - RNA, 22 nt, Human
acaugagguacugagagugaac

SEQ ID NO: 1725181 - RNA, 19 nt, Human
uauuuuaauaauguuucaa

SEQ ID NO: 1725182 - RNA, 19 nt, Human
aaacaauaacgauaaaaga

SEQ ID NO: 1725183 - RNA, 21 nt, Human
aaguuuaugguuguauuauuu

SEQ ID NO: 1725184 - RNA, 15 nt, Human
uagggugauauuaac

SEQ ID NO: 1725185 - RNA, 21 nt, Human
aauaauccucaguuuuuguga

SEQ ID NO: 1725186 - RNA, 16 nt, Human
uauucagaauuucuaa

SEQ ID NO: 1725187 - RNA, 15 nt, Human
uccauccugaggcuc

SEQ ID NO: 1725188 - RNA, 13 nt, Human
augaguugcaguu

SEQ ID NO: 1725189 - RNA, 22 nt, Human
ggcuaagcuucacuguaaaaua

SEQ ID NO: 1725190 - RNA, 14 nt, Human
ugcuguauuuuaaa

SEQ ID NO: 1725191 - RNA, 17 nt, Human
ggaacauuuauguuccu

SEQ ID NO: 1725192 - RNA, 16 nt, Human
gaaguaucuugguugu

SEQ ID NO: 1725193 - RNA, 20 nt, Human
auuacuguaagaaaauauca

SEQ ID NO: 1725194 - RNA, 17 nt, Human
auucagaauuucuaaaa

SEQ ID NO: 1725195 - RNA, 19 nt, Human
ccagaucuaugccacaaga

SEQ ID NO: 1725196 - RNA, 16 nt, Human
cuggguugaagggcag

SEQ ID NO: 1725197 - RNA, 18 nt, Human
ugugcuggccaccugcug

SEQ ID NO: 1725198 - RNA, 22 nt, Human
ugguuguauuauuuuuuaaaaa

SEQ ID NO: 1725199 - RNA, 19 nt, Human
cuuccuaauuccacagcug

SEQ ID NO: 1725200 - RNA, 16 nt, Human
auuuuuagugaaauau

SEQ ID NO: 1725201 - RNA, 20 nt, Human
ggccaugggacagggaggac

SEQ ID NO: 1725202 - RNA, 16 nt, Human
acaugaacuuguaaag

SEQ ID NO: 1725203 - RNA, 20 nt, Human
cucccugccccccagcccuc

SEQ ID NO: 1725204 - RNA, 12 nt, Human
uuuuuuuuaaaa

SEQ ID NO: 1725205 - RNA, 15 nt, Human
aaaaauaacaaugaa

SEQ ID NO: 1725206 - RNA, 17 nt, Human
caagacccaaaaggcag

SEQ ID NO: 1725207 - RNA, 18 nt, Human
ugggcacaggguuuaugu

SEQ ID NO: 1725208 - RNA, 16 nt, Human
uaaauaaauaaauaaa

SEQ ID NO: 1725209 - RNA, 16 nt, Human
aaauaaauaaauaaau

SEQ ID NO: 1725210 - RNA, 16 nt, Human
auaaauaaauaaauaa

SEQ ID NO: 1725211 - RNA, 16 nt, Human
aauaaauaaauaaaua

SEQ ID NO: 1725212 - RNA, 19 nt, Human
cgcccacuagacccacugg

SEQ ID NO: 1725213 - RNA, 14 nt, Human
cuugagguaaaagc

SEQ ID NO: 1725214 - RNA, 17 nt, Human
agaaaugaaagcaggga

SEQ ID NO: 1725215 - RNA, 17 nt, Human
guguccccuauccuacu

SEQ ID NO: 1725216 - RNA, 20 nt, Human
acaccuuaucuauguagaau

SEQ ID NO: 1725217 - RNA, 23 nt, Human
cucagucucccucccuuggggcc

SEQ ID NO: 1725218 - RNA, 16 nt, Human
uauaucaauuuaaaaa

SEQ ID NO: 1725219 - RNA, 14 nt, Human
cucuugaggcacag

SEQ ID NO: 1725220 - RNA, 15 nt, Human
cagugucugcuggag

SEQ ID NO: 1725221 - RNA, 16 nt, Human
uaaaauccauacauuu

SEQ ID NO: 1725222 - RNA, 14 nt, Human
cagagucaagggug

SEQ ID NO: 1725223 - RNA, 20 nt, Human
agcagugagccaaauguaaa

SEQ ID NO: 1725224 - RNA, 18 nt, Human
ccaagccuggcaagggaa

SEQ ID NO: 1725225 - RNA, 15 nt, Human
uauuuauuuuaauaa

SEQ ID NO: 1725226 - RNA, 20 nt, Human
gcccauccugccccugagcc

SEQ ID NO: 1725227 - RNA, 15 nt, Human
ucaguuuuugugaaa

SEQ ID NO: 1725228 - RNA, 16 nt, Human
uaucuuccuauaauuu

SEQ ID NO: 1725229 - RNA, 16 nt, Human
ccuuccccucugcagc

SEQ ID NO: 1725230 - RNA, 14 nt, Human
ugacacuuaaaaau

SEQ ID NO: 1725231 - RNA, 22 nt, Human
auauaugcuaagucuuauauau

SEQ ID NO: 1725232 - RNA, 21 nt, Human
gggagccugaucaccugcccu

SEQ ID NO: 1725233 - RNA, 19 nt, Human
gguuuaauaauuuuuaauu

SEQ ID NO: 1725234 - RNA, 16 nt, Human
aauauaaauaaaaaua

SEQ ID NO: 1725235 - RNA, 16 nt, Human
ucuucaacucccugcc

SEQ ID NO: 1725236 - RNA, 23 nt, Human
acgaggauugggaaaaaguaauu

SEQ ID NO: 1725237 - RNA, 18 nt, Human
uuuaguuauaaaaauaua

SEQ ID NO: 1725238 - RNA, 17 nt, Human
augauuauuuuauguuu

SEQ ID NO: 1725239 - RNA, 20 nt, Human
uuucuuccuggauuccucac

SEQ ID NO: 1725240 - RNA, 13 nt, Human
cauuuguauaaaa

SEQ ID NO: 1725241 - RNA, 14 nt, Human
ccacuggacucacc

SEQ ID NO: 1725242 - RNA, 16 nt, Human
ggcuaauaucuuaucu

SEQ ID NO: 1725243 - RNA, 23 nt, Human
ucacagaaugacugacaaagaca

SEQ ID NO: 1725244 - RNA, 14 nt, Human
ccuugaugaagaag

SEQ ID NO: 1725245 - RNA, 19 nt, Human
acauauagcagcucuugaa

SEQ ID NO: 1725246 - RNA, 23 nt, Human
gccccugcacuccagccugagcg

SEQ ID NO: 1725247 - RNA, 20 nt, Human
uggaauaauccuaaacauau

SEQ ID NO: 1725248 - RNA, 15 nt, Human
ccaucucaggugugu

SEQ ID NO: 1725249 - RNA, 17 nt, Human
ucagcguuaauguaaag

SEQ ID NO: 1725250 - RNA, 16 nt, Human
ugauuuaaggccaggc

SEQ ID NO: 1725251 - RNA, 15 nt, Human
uaugcuuguaacugu

SEQ ID NO: 1725252 - RNA, 16 nt, Human
accuccuaagaaggca

SEQ ID NO: 1725253 - RNA, 22 nt, Human
ccagcuggccuugugaggagcu

SEQ ID NO: 1725254 - RNA, 15 nt, Human
ucagucucccucccu

SEQ ID NO: 1725255 - RNA, 14 nt, Human
guccauugggcagg

SEQ ID NO: 1725256 - RNA, 15 nt, Human
gugaacuugguuuua

SEQ ID NO: 1725257 - RNA, 22 nt, Human
aaccuacacgagauacagaauu

SEQ ID NO: 1725258 - RNA, 15 nt, Human
aaaugauguuucaua

SEQ ID NO: 1725259 - RNA, 15 nt, Human
ugcaauuccacuuau

SEQ ID NO: 1725260 - RNA, 14 nt, Human
auuuaaauauaugc

SEQ ID NO: 1725261 - RNA, 16 nt, Human
cuuuuaguuuuuaaag

SEQ ID NO: 1725262 - RNA, 21 nt, Human
aguuagcuuucuuccuggauu

SEQ ID NO: 1725263 - RNA, 13 nt, Human
auuuuaaaagaau

SEQ ID NO: 1725264 - RNA, 22 nt, Human
uuauaagaaauaggaaauauuu

SEQ ID NO: 1725265 - RNA, 18 nt, Human
auuuuagacauucuuuau

SEQ ID NO: 1725266 - RNA, 19 nt, Human
caagcagcccuuagcccuu

SEQ ID NO: 1725267 - RNA, 17 nt, Human
ucuauaauuuaaauaua

SEQ ID NO: 1725268 - RNA, 12 nt, Human
auuuuaaaagaa

SEQ ID NO: 1725269 - RNA, 17 nt, Human
auuuaguuauaaaaaua

SEQ ID NO: 1725270 - RNA, 11 nt, Human
gcaugguuuag

SEQ ID NO: 1725271 - RNA, 23 nt, Human
uugaaguuuuggcaauugacuau

SEQ ID NO: 1725272 - RNA, 16 nt, Human
gccaaauguaaaauag

SEQ ID NO: 1725273 - RNA, 18 nt, Human
ugagcucagcccuggugg

SEQ ID NO: 1725274 - RNA, 21 nt, Human
auccccaagccuggcaaggga

SEQ ID NO: 1725275 - RNA, 17 nt, Human
gggcaguguucccuggg

SEQ ID NO: 1725276 - RNA, 20 nt, Human
guaucaaaagaaagaaaauc

SEQ ID NO: 1725277 - RNA, 23 nt, Human
cacagauuugagcucagcccugg

SEQ ID NO: 1725278 - RNA, 14 nt, Human
ccaugggacaggga

SEQ ID NO: 1725279 - RNA, 20 nt, Human
ucacaugaacuuguaaagga

SEQ ID NO: 1725280 - RNA, 15 nt, Human
auaaaguguuugaaa

SEQ ID NO: 1725281 - RNA, 18 nt, Human
uagaauauauuuccuuau

SEQ ID NO: 1725282 - RNA, 15 nt, Human
cagucucccucccuu

SEQ ID NO: 1725283 - RNA, 18 nt, Human
gaaaugaaagcagggacu

SEQ ID NO: 1725284 - RNA, 14 nt, Human
gaaaaaauaacaau

SEQ ID NO: 1725285 - RNA, 20 nt, Human
aggagaggcaaagaaaggag

SEQ ID NO: 1725286 - RNA, 14 nt, Human
gccauuacccccag

SEQ ID NO: 1725287 - RNA, 20 nt, Human
uuuagacauucuuuaucuuu

SEQ ID NO: 1725288 - RNA, 12 nt, Human
gaaaauaacaau

SEQ ID NO: 1725289 - RNA, 15 nt, Human
guucugcagauaaac

SEQ ID NO: 1725290 - RNA, 21 nt, Human
uuccugacugcuaguuuauau

SEQ ID NO: 1725291 - RNA, 21 nt, Human
aggguuaugauuaaguaauga

SEQ ID NO: 1725292 - RNA, 20 nt, Human
agcuuauugucuagugaaac

SEQ ID NO: 1725293 - RNA, 20 nt, Human
aagacagugaaagaaaauaa

SEQ ID NO: 1725294 - RNA, 22 nt, Human
agacacugucucuaccaaaaaa

SEQ ID NO: 1725295 - RNA, 20 nt, Human
ccuccugccuaagugcagcc

SEQ ID NO: 1725296 - RNA, 15 nt, Human
uuucaaaaaaaaacc

SEQ ID NO: 1725297 - RNA, 21 nt, Human
gucucuaccaaaaaaaggaag

SEQ ID NO: 1725298 - RNA, 22 nt, Human
cuggugucuucaggggccacac

SEQ ID NO: 1725299 - RNA, 17 nt, Human
uaacugauuuguaacaa

SEQ ID NO: 1725300 - RNA, 14 nt, Human
ccucugcagcuucc

SEQ ID NO: 1725301 - RNA, 20 nt, Human
ucuucagcagagaaguuuuc

SEQ ID NO: 1725302 - RNA, 13 nt, Human
uauauuuuagaua

SEQ ID NO: 1725303 - RNA, 14 nt, Human
gggaagacaagaag

SEQ ID NO: 1725304 - RNA, 20 nt, Human
aauuuuuucucuaggaaaua

SEQ ID NO: 1725305 - RNA, 15 nt, Human
cuugugaggagcugg

SEQ ID NO: 1725306 - RNA, 22 nt, Human
uggguuccuuccucugagccuu

SEQ ID NO: 1725307 - RNA, 20 nt, Human
ccgaggugggcagaucacuu

SEQ ID NO: 1725308 - RNA, 16 nt, Human
aaagaaaggagauaca

SEQ ID NO: 1725309 - RNA, 21 nt, Human
cuggaaacacauguuccccuu

SEQ ID NO: 1725310 - RNA, 12 nt, Human
cuacaagacaca

SEQ ID NO: 1725311 - RNA, 15 nt, Human
aaagaaagaaaauca

SEQ ID NO: 1725312 - RNA, 12 nt, Human
ugacauuagaug

SEQ ID NO: 1725313 - RNA, 16 nt, Human
uuagauagaugaagaa

SEQ ID NO: 1725314 - RNA, 20 nt, Human
cugcacuccagccugagcga

SEQ ID NO: 1725315 - RNA, 14 nt, Human
aaagaaacaaaaau

SEQ ID NO: 1725316 - RNA, 19 nt, Human
cucaagcuaugugagcuca

SEQ ID NO: 1725317 - RNA, 22 nt, Human
cacuaguauuucuaugaaauau

SEQ ID NO: 1725318 - RNA, 23 nt, Human
aacuuguaaaggaauuuaaaaau

SEQ ID NO: 1725319 - RNA, 13 nt, Human
aaauccuugaaga

SEQ ID NO: 1725320 - RNA, 15 nt, Human
cuucaacucccugcc

SEQ ID NO: 1725321 - RNA, 20 nt, Human
gggcaagagagcgagacccu

SEQ ID NO: 1725322 - RNA, 17 nt, Human
ucucuggccuucggccu

SEQ ID NO: 1725323 - RNA, 13 nt, Human
acacuuaaaaaug

SEQ ID NO: 1725324 - RNA, 20 nt, Human
gccgggcgugguggugagug

SEQ ID NO: 1725325 - RNA, 12 nt, Human
ggaggcugagau

SEQ ID NO: 1725326 - RNA, 17 nt, Human
agagacagaaagcagaa

SEQ ID NO: 1725327 - RNA, 19 nt, Human
gucuuucacauuuaaauaa

SEQ ID NO: 1725328 - RNA, 13 nt, Human
aacacaacuauau

SEQ ID NO: 1725329 - RNA, 21 nt, Human
acuauuauauuuccaagaaau

SEQ ID NO: 1725330 - RNA, 14 nt, Human
cauggccacaucug

SEQ ID NO: 1725331 - RNA, 17 nt, Human
agucugacuguuuccau

SEQ ID NO: 1725332 - RNA, 23 nt, Human
aucuaugccacaagaacccccuu

SEQ ID NO: 1725333 - RNA, 22 nt, Human
uguuuuuccaguaguuagcuuu

SEQ ID NO: 1725334 - RNA, 15 nt, Human
cauuuacuuuuaaac

SEQ ID NO: 1725335 - RNA, 19 nt, Human
uacaaaaaaaaaaaaaaau

SEQ ID NO: 1725336 - RNA, 16 nt, Human
ccuccuuaucaaagga

SEQ ID NO: 1725337 - RNA, 17 nt, Human
auguuuacagaucccca

SEQ ID NO: 1725338 - RNA, 11 nt, Human
ugugugcagca

SEQ ID NO: 1725339 - RNA, 17 nt, Human
ccaaaagguauuuuaau

SEQ ID NO: 1725340 - RNA, 23 nt, Human
auguuaaaacugggacaggggag

SEQ ID NO: 1725341 - RNA, 23 nt, Human
uuuuauagcuacuaauuuuaaaa

SEQ ID NO: 1725342 - RNA, 17 nt, Human
gacagugaaagaaaaua

SEQ ID NO: 1725343 - RNA, 22 nt, Human
caugaguaacugauuuguaaca

SEQ ID NO: 1725344 - RNA, 15 nt, Human
agagacagaaagcag

SEQ ID NO: 1725345 - RNA, 18 nt, Human
cauggugaaaccuggucu

SEQ ID NO: 1725346 - RNA, 13 nt, Human
aggcuagauguau

SEQ ID NO: 1725347 - RNA, 22 nt, Human
uagaaauguauucuuuuaguuu

SEQ ID NO: 1725348 - RNA, 20 nt, Human
uggaacagauuucaaaaaaa

SEQ ID NO: 1725349 - RNA, 15 nt, Human
ugagcgcccacuaga

SEQ ID NO: 1725350 - RNA, 19 nt, Human
gaccggccuuugcaccucc

SEQ ID NO: 1725351 - RNA, 16 nt, Human
uguccccuauccuacu

SEQ ID NO: 1725352 - RNA, 17 nt, Human
gucaaaguucauagagu

SEQ ID NO: 1725353 - RNA, 16 nt, Human
guucugcacacagcac

SEQ ID NO: 1725354 - RNA, 22 nt, Human
uucauucacucaacaaacauaa

SEQ ID NO: 1725355 - RNA, 20 nt, Human
guccccuauccuacuucccc

SEQ ID NO: 1725356 - RNA, 21 nt, Human
auuauauuuccaagaaauauu

SEQ ID NO: 1725357 - RNA, 15 nt, Human
acugaagaagcacca

SEQ ID NO: 1725358 - RNA, 20 nt, Human
acuauagugugagccaggaa

SEQ ID NO: 1725359 - RNA, 19 nt, Human
gagacauugaggcaggcac

SEQ ID NO: 1725360 - RNA, 16 nt, Human
uuuuagugaaauauua

SEQ ID NO: 1725361 - RNA, 22 nt, Human
aucaucaagucuuucacauuua

SEQ ID NO: 1725362 - RNA, 18 nt, Human
ccacuuggucugugagau

SEQ ID NO: 1725363 - RNA, 22 nt, Human
acacugucucuaccaaaaaaag

SEQ ID NO: 1725364 - RNA, 18 nt, Human
acauguuacaacacggac

SEQ ID NO: 1725365 - RNA, 14 nt, Human
acacugaagaagca

SEQ ID NO: 1725366 - RNA, 12 nt, Human
guagacacacau

SEQ ID NO: 1725367 - RNA, 17 nt, Human
gacaaggaaaaaauaac

SEQ ID NO: 1725368 - RNA, 18 nt, Human
ggccacaucugagccccg

SEQ ID NO: 1725369 - RNA, 15 nt, Human
ccgucccccucuggc

SEQ ID NO: 1725370 - RNA, 18 nt, Human
cccaggcugagccucagu

SEQ ID NO: 1725371 - RNA, 22 nt, Human
uugccuaggcauagcccugccu

SEQ ID NO: 1725372 - RNA, 15 nt, Human
cagaauucauucacu

SEQ ID NO: 1725373 - RNA, 17 nt, Human
uauuuauuaaguauuuu

SEQ ID NO: 1725374 - RNA, 18 nt, Human
uauaggauguggggaagu

SEQ ID NO: 1725375 - RNA, 19 nt, Human
acuauuauauuuccaagaa

SEQ ID NO: 1725376 - RNA, 23 nt, Human
gcuggcgugcagcaucagcaucc

SEQ ID NO: 1725377 - RNA, 13 nt, Human
aaguaaaggcaaa

SEQ ID NO: 1725378 - RNA, 11 nt, Human
cuauuuaauua

SEQ ID NO: 1725379 - RNA, 18 nt, Human
aguagcugcccuuucuca

SEQ ID NO: 1725380 - RNA, 18 nt, Human
aaauauuuauuuuaauaa

SEQ ID NO: 1725381 - RNA, 13 nt, Human
aucuggcucugga

SEQ ID NO: 1725382 - RNA, 12 nt, Human
cauguuccccuu

SEQ ID NO: 1725383 - RNA, 21 nt, Human
cuccagggagucucagcuuca

SEQ ID NO: 1725384 - RNA, 16 nt, Human
cuucaacucccugccc

SEQ ID NO: 1725385 - RNA, 17 nt, Human
caggaaucacuggcugu

SEQ ID NO: 1725386 - RNA, 19 nt, Human
uaucucauuuccaagcaag

SEQ ID NO: 1725387 - RNA, 14 nt, Human
cagucucccucccu

SEQ ID NO: 1725388 - RNA, 23 nt, Human
cccacuggacucaccucccccau

SEQ ID NO: 1725389 - RNA, 23 nt, Human
ggcuaagcuucacuguaaaauaa

SEQ ID NO: 1725390 - RNA, 20 nt, Human
auaauccuaaacauaugaau

SEQ ID NO: 1725391 - RNA, 14 nt, Human
agaaacaaaaauca

SEQ ID NO: 1725392 - RNA, 15 nt, Human
caaaaaaaggaagga

SEQ ID NO: 1725393 - RNA, 16 nt, Human
aguuuauauagaaaug

SEQ ID NO: 1725394 - RNA, 22 nt, Human
ugagacucugucucaguccaug

SEQ ID NO: 1725395 - RNA, 20 nt, Human
aaaagacagugaaagaaaau

SEQ ID NO: 1725396 - RNA, 19 nt, Human
gagccucagucucccuccc

SEQ ID NO: 1725397 - RNA, 18 nt, Human
auuuaggccaugggacag

SEQ ID NO: 1725398 - RNA, 17 nt, Human
ugcacaucaaaauaugc

SEQ ID NO: 1725399 - RNA, 22 nt, Human
uugaaaaucuuauaauuuaaaa

SEQ ID NO: 1725400 - RNA, 20 nt, Human
gaaggcugaggcaggaggau

SEQ ID NO: 1725401 - RNA, 15 nt, Human
ccaaggagccaaaca

SEQ ID NO: 1725402 - RNA, 22 nt, Human
auauaaauaaaaauaauccuca

SEQ ID NO: 1725403 - RNA, 13 nt, Human
aggccuggugugu

SEQ ID NO: 1725404 - RNA, 19 nt, Human
aauguuuacagauccccaa

SEQ ID NO: 1725405 - RNA, 20 nt, Human
ucauucacucaacaaacaua

SEQ ID NO: 1725406 - RNA, 14 nt, Human
uaaauaaauaaaua

SEQ ID NO: 1725407 - RNA, 14 nt, Human
auaaauaaauaaau

SEQ ID NO: 1725408 - RNA, 17 nt, Human
auaauuuaaauauaugc

SEQ ID NO: 1725409 - RNA, 23 nt, Human
uagauaggucagugcaaauacuc

SEQ ID NO: 1725410 - RNA, 20 nt, Human
gggaggcagagguugcagug

SEQ ID NO: 1725411 - RNA, 15 nt, Human
uucaagaccagccug

SEQ ID NO: 1725412 - RNA, 20 nt, Human
agccuucucucaaggagagg

SEQ ID NO: 1725413 - RNA, 13 nt, Human
cugcacuccagcc

SEQ ID NO: 1725414 - RNA, 16 nt, Human
accucugccucagaaa

SEQ ID NO: 1725415 - RNA, 19 nt, Human
cagagucaagggugugugc

SEQ ID NO: 1725416 - RNA, 12 nt, Human
uuaauaaaccau

SEQ ID NO: 1725417 - RNA, 18 nt, Human
ccaaccuucugaggagcu

SEQ ID NO: 1725418 - RNA, 21 nt, Human
uugaggcacagaaacuccugu

SEQ ID NO: 1725419 - RNA, 19 nt, Human
auucccagccagcacagcc

SEQ ID NO: 1725420 - RNA, 19 nt, Human
gaggcagagguugcaguga

SEQ ID NO: 1725421 - RNA, 17 nt, Human
guuucuagagaugguuu

SEQ ID NO: 1725422 - RNA, 15 nt, Human
gaucuggcucuggac

SEQ ID NO: 1725423 - RNA, 19 nt, Human
agcuacuaauuuuaaaaug

SEQ ID NO: 1725424 - RNA, 21 nt, Human
aaggcaggaggaucacuugag

SEQ ID NO: 1725425 - RNA, 18 nt, Human
auuuauuacuguaagaaa

SEQ ID NO: 1725426 - RNA, 16 nt, Human
acaucaggaaagagag

SEQ ID NO: 1725427 - RNA, 14 nt, Human
aauauuauuuuaua

SEQ ID NO: 1725428 - RNA, 22 nt, Human
aagcugguggcucugugugcuc

SEQ ID NO: 1725429 - RNA, 14 nt, Human
cuaagucuuauaua

SEQ ID NO: 1725430 - RNA, 23 nt, Human
cagagguugcagugagccgagau

SEQ ID NO: 1725431 - RNA, 20 nt, Human
ggcuaauaucuuaucuuccu

SEQ ID NO: 1725432 - RNA, 18 nt, Human
gagccucagucucccucc

SEQ ID NO: 1725433 - RNA, 18 nt, Human
accaagcugguggcucug

SEQ ID NO: 1725434 - RNA, 14 nt, Human
auuuucuauaauuu

SEQ ID NO: 1725435 - RNA, 13 nt, Human
aucucaauauuuc

SEQ ID NO: 1725436 - RNA, 22 nt, Human
ugaauuguaggugacuauuaua

SEQ ID NO: 1725437 - RNA, 22 nt, Human
uuuaauaauguuucaaacauau

SEQ ID NO: 1725438 - RNA, 13 nt, Human
gaccagccugguc

SEQ ID NO: 1725439 - RNA, 21 nt, Human
aggcucuuuugggauuuuuga

SEQ ID NO: 1725440 - RNA, 22 nt, Human
agacucgggauuaguacacacu

SEQ ID NO: 1725441 - RNA, 13 nt, Human
gcagaacagugau

SEQ ID NO: 1725442 - RNA, 13 nt, Human
ccucuggcuccag

SEQ ID NO: 1725443 - RNA, 17 nt, Human
ucuuucacauuuaaaua

SEQ ID NO: 1725444 - RNA, 22 nt, Human
cuuccccucugcagcuuccagg

SEQ ID NO: 1725445 - RNA, 22 nt, Human
cauuuaguuauaaaaauauaua

SEQ ID NO: 1725446 - RNA, 23 nt, Human
uuuauauuucuguuaaaauauau

SEQ ID NO: 1725447 - RNA, 16 nt, Human
ccuaugcagaggucca

SEQ ID NO: 1725448 - RNA, 16 nt, Human
ggaguuucucuagaag

SEQ ID NO: 1725449 - RNA, 18 nt, Human
uuuuaaaaaagaaacauu

SEQ ID NO: 1725450 - RNA, 18 nt, Human
uaauuauguucuaagugc

SEQ ID NO: 1725451 - RNA, 19 nt, Human
ggacucaccucccccaucu

SEQ ID NO: 1725452 - RNA, 13 nt, Human
agacacugucucu

SEQ ID NO: 1725453 - RNA, 13 nt, Human
caagaaggaaaga

SEQ ID NO: 1725454 - RNA, 12 nt, Human
aagagcuuaaca

SEQ ID NO: 1725455 - RNA, 18 nt, Human
aaaagacaaggaaaaaau

SEQ ID NO: 1725456 - RNA, 17 nt, Human
caaauaagucaucugau

SEQ ID NO: 1725457 - RNA, 19 nt, Human
cuucacccugaggugagca

SEQ ID NO: 1725458 - RNA, 22 nt, Human
ucuuccuggauuccucacuuug

SEQ ID NO: 1725459 - RNA, 17 nt, Human
cucagucucccucccuu

SEQ ID NO: 1725460 - RNA, 21 nt, Human
agacaagaaggaaagauuuug

SEQ ID NO: 1725461 - RNA, 17 nt, Human
aacaaaauuagaaaugu

SEQ ID NO: 1725462 - RNA, 13 nt, Human
uaaaaguuuaagu

SEQ ID NO: 1725463 - RNA, 23 nt, Human
cagcaccuccuaagaaggcaccu

SEQ ID NO: 1725464 - RNA, 15 nt, Human
aauguuuguccuugg

SEQ ID NO: 1725465 - RNA, 16 nt, Human
ucaguuuuugugaaaa

SEQ ID NO: 1725466 - RNA, 22 nt, Human
cucuggccuucggccuccaucc

SEQ ID NO: 1725467 - RNA, 21 nt, Human
gugcucuauuaccauuaugga

SEQ ID NO: 1725468 - RNA, 16 nt, Human
uugauuaagaaaggaa

SEQ ID NO: 1725469 - RNA, 16 nt, Human
gucuaucuuugagcgc

SEQ ID NO: 1725470 - RNA, 19 nt, Human
ucugagcauuuaauaugga

SEQ ID NO: 1725471 - RNA, 12 nt, Human
caggacagcccu

SEQ ID NO: 1725472 - RNA, 12 nt, Human
gcuaaggcagga

SEQ ID NO: 1725473 - RNA, 15 nt, Human
aucuuuaacccacua

SEQ ID NO: 1725474 - RNA, 16 nt, Human
ggcugaggcaggagga

SEQ ID NO: 1725475 - RNA, 19 nt, Human
uccauccugaggcuccacu

SEQ ID NO: 1725476 - RNA, 12 nt, Human
gaagaccucauu

SEQ ID NO: 1725477 - RNA, 24 nt, Human
uaauuuaaaauaugcucuaaacau

SEQ ID NO: 1725478 - RNA, 17 nt, Human
gcagcaucagcaucccu

SEQ ID NO: 1725479 - RNA, 15 nt, Human
cagccagcacagccu

SEQ ID NO: 1725480 - RNA, 14 nt, Human
uccagauccuggaa

SEQ ID NO: 1725481 - RNA, 18 nt, Human
agcaaaauuuuuucucua

SEQ ID NO: 1725482 - RNA, 12 nt, Human
gacccugucuca

SEQ ID NO: 1725483 - RNA, 16 nt, Human
aaguaaaggcaaacuu

SEQ ID NO: 1725484 - RNA, 14 nt, Human
agcguugagccacc

SEQ ID NO: 1725485 - RNA, 20 nt, Human
agaggagaaacuggaacucu

SEQ ID NO: 1725486 - RNA, 19 nt, Human
auagugaggagcuuugaaa

SEQ ID NO: 1725487 - RNA, 15 nt, Human
uagagaauuuccuua

SEQ ID NO: 1725488 - RNA, 20 nt, Human
auaucauagcaaauaaguca

SEQ ID NO: 1725489 - RNA, 18 nt, Human
cuaauuagcauggccaca

SEQ ID NO: 1725490 - RNA, 18 nt, Human
ggcucuggacaggcacua

SEQ ID NO: 1725491 - RNA, 16 nt, Human
uuguaaaggaauuuaa

SEQ ID NO: 1725492 - RNA, 20 nt, Human
ggguuccuuccucugagccu

SEQ ID NO: 1725493 - RNA, 16 nt, Human
gcagugucugcuggag

SEQ ID NO: 1725494 - RNA, 22 nt, Human
cugaaauggaacagauuucaaa

SEQ ID NO: 1725495 - RNA, 16 nt, Human
uaaacuuugauuuuau

SEQ ID NO: 1725496 - RNA, 22 nt, Human
accccugagcuugcagagauga

SEQ ID NO: 1725497 - RNA, 14 nt, Human
cuaaacauaugaau

SEQ ID NO: 1725498 - RNA, 14 nt, Human
acgagaaaacaaua

SEQ ID NO: 1725499 - RNA, 12 nt, Human
auuuaucauuua

SEQ ID NO: 1725500 - RNA, 20 nt, Human
agccuuuuuuugaaaaaaag

SEQ ID NO: 1725501 - RNA, 12 nt, Human
agcuuggaaugu

SEQ ID NO: 1725502 - RNA, 18 nt, Human
gagucccaggcugagccu

SEQ ID NO: 1725503 - RNA, 13 nt, Human
agcuaaauauaua

SEQ ID NO: 1725504 - RNA, 21 nt, Human
auuccuuuuucucuccucucc

SEQ ID NO: 1725505 - RNA, 21 nt, Human
guacuccagccagggcaagag

SEQ ID NO: 1725506 - RNA, 13 nt, Human
uucuauaauuuaa

SEQ ID NO: 1725507 - RNA, 19 nt, Human
cagcuacuugggaggcuga

SEQ ID NO: 1725508 - RNA, 15 nt, Human
ucaagggugugugca

SEQ ID NO: 1725509 - RNA, 22 nt, Human
cuuguaaaggaauuuaaaaauc

SEQ ID NO: 1725510 - RNA, 20 nt, Human
cuggccuucggccuccaucc

SEQ ID NO: 1725511 - RNA, 18 nt, Human
cuuuccaugaguugcagu

SEQ ID NO: 1725512 - RNA, 19 nt, Human
agauuugagcucagcccug

SEQ ID NO: 1725513 - RNA, 14 nt, Human
auauuugaaauauu

SEQ ID NO: 1725514 - RNA, 14 nt, Human
ucaaugcagccccc

SEQ ID NO: 1725515 - RNA, 16 nt, Human
uuagagaauuuccuua

SEQ ID NO: 1725516 - RNA, 16 nt, Human
ggggcagcaccuccua

SEQ ID NO: 1725517 - RNA, 21 nt, Human
ucagggcagaugaugcuuuga

SEQ ID NO: 1725518 - RNA, 14 nt, Human
gaggcacagaaacu

SEQ ID NO: 1725519 - RNA, 19 nt, Human
aaugaauggcuaagcaaaa

SEQ ID NO: 1725520 - RNA, 20 nt, Human
agaagaacugaaaucauacu

SEQ ID NO: 1725521 - RNA, 16 nt, Human
ccagucccuccccaaa

SEQ ID NO: 1725522 - RNA, 22 nt, Human
aacaaggaaggaaagaugugaa

SEQ ID NO: 1725523 - RNA, 15 nt, Human
auuugguaaggggaa

SEQ ID NO: 1725524 - RNA, 16 nt, Human
uucucuaggaaauauu

SEQ ID NO: 1725525 - RNA, 18 nt, Human
agguccacaacacacaga

SEQ ID NO: 1725526 - RNA, 21 nt, Human
uuagaaauguaauuauguucu

SEQ ID NO: 1725527 - RNA, 19 nt, Human
ggaaaaaauaacaaugaaa

SEQ ID NO: 1725528 - RNA, 12 nt, Human
uagcauuucucc

SEQ ID NO: 1725529 - RNA, 15 nt, Human
ggacucaccuccccc

SEQ ID NO: 1725530 - RNA, 19 nt, Human
aagcauuccaacuaucuca

SEQ ID NO: 1725531 - RNA, 20 nt, Human
cacuagacccacuggacuca

SEQ ID NO: 1725532 - RNA, 23 nt, Human
aucuuccuauaauuuuagacauu

SEQ ID NO: 1725533 - RNA, 19 nt, Human
uaucacuugucaauaaaau

SEQ ID NO: 1725534 - RNA, 15 nt, Human
gcacuacuguacucc

SEQ ID NO: 1725535 - RNA, 17 nt, Human
auuagcauggccacauc

SEQ ID NO: 1725536 - RNA, 23 nt, Human
gauauuaaccaggggccaugaau

SEQ ID NO: 1725537 - RNA, 23 nt, Human
agccaccaguccauugggcaggc

SEQ ID NO: 1725538 - RNA, 14 nt, Human
cacccugagguugu

SEQ ID NO: 1725539 - RNA, 22 nt, Human
caguauggcagcuuuccucaaa

SEQ ID NO: 1725540 - RNA, 21 nt, Human
gauguggggaaguuaggaacu

SEQ ID NO: 1725541 - RNA, 22 nt, Human
caccucccccaucucuucuggg

SEQ ID NO: 1725542 - RNA, 20 nt, Human
aaaaaccugagccccaaaag

SEQ ID NO: 1725543 - RNA, 23 nt, Human
cccagcccuccuuaucaaaggac

SEQ ID NO: 1725544 - RNA, 13 nt, Human
agagauaaagcuu

SEQ ID NO: 1725545 - RNA, 16 nt, Human
gcuucuguuccgugcu

SEQ ID NO: 1725546 - RNA, 16 nt, Human
agccuacuaaaugcuc

SEQ ID NO: 1725547 - RNA, 19 nt, Human
acauuuguauaaaauaauu

SEQ ID NO: 1725548 - RNA, 18 nt, Human
auccuucagccugaaaga

SEQ ID NO: 1725549 - RNA, 12 nt, Human
caacccaaaugu

SEQ ID NO: 1725550 - RNA, 21 nt, Human
cuauuuaauuauuucacuuua

SEQ ID NO: 1725551 - RNA, 19 nt, Human
uuccucccuucucuucaca

SEQ ID NO: 1725552 - RNA, 21 nt, Human
aauuccugacugcuaguuuau

SEQ ID NO: 1725553 - RNA, 15 nt, Human
acaugugcuggccac

SEQ ID NO: 1725554 - RNA, 18 nt, Human
gaugccccgucccccucu

SEQ ID NO: 1725555 - RNA, 19 nt, Human
uauguagaauauauuuccu

SEQ ID NO: 1725556 - RNA, 22 nt, Human
aucuucacuuuuauaagaaaua

SEQ ID NO: 1725557 - RNA, 15 nt, Human
uggacgagaaaacaa

SEQ ID NO: 1725558 - RNA, 14 nt, Human
ucaauaaauaaaua

SEQ ID NO: 1725559 - RNA, 19 nt, Human
cugccaaaacaucaaccug

SEQ ID NO: 1725560 - RNA, 17 nt, Human
cagugaaagaaaauaac

SEQ ID NO: 1725561 - RNA, 15 nt, Human
cgagacccugucuca

SEQ ID NO: 1725562 - RNA, 18 nt, Human
cucuauguucuaagaagu

SEQ ID NO: 1725563 - RNA, 15 nt, Human
ccaaaauauaaucag

SEQ ID NO: 1725564 - RNA, 19 nt, Human
gucaaauugugugaaaggu

SEQ ID NO: 1725565 - RNA, 11 nt, Human
auaauuuaaau

SEQ ID NO: 1725566 - RNA, 16 nt, Human
aaaauaauccucaguu

SEQ ID NO: 1725567 - RNA, 20 nt, Human
cucuguucugcacacagcac

SEQ ID NO: 1725568 - RNA, 20 nt, Human
agcuacuaauuuuaaaaugu

SEQ ID NO: 1725569 - RNA, 18 nt, Human
aaaaucuuauaauuuaaa

SEQ ID NO: 1725570 - RNA, 21 nt, Human
ccccugcaaagcccagcuuga

SEQ ID NO: 1725571 - RNA, 19 nt, Human
guaguccuguaauggaagc

SEQ ID NO: 1725572 - RNA, 22 nt, Human
cgaggugggcagaucacuugag

SEQ ID NO: 1725573 - RNA, 21 nt, Human
cccacuggacucaccuccccc

SEQ ID NO: 1725574 - RNA, 21 nt, Human
gcacuguggguagacacacau

SEQ ID NO: 1725575 - RNA, 19 nt, Human
uauauuuccaagaaauauu

SEQ ID NO: 1725576 - RNA, 17 nt, Human
cucaugagggcuggaug

SEQ ID NO: 1725577 - RNA, 23 nt, Human
aaccugccagcuggccuugugag

SEQ ID NO: 1725578 - RNA, 15 nt, Human
aaggaaaaaauaaca

SEQ ID NO: 1725579 - RNA, 15 nt, Human
accucccccaucucu

SEQ ID NO: 1725580 - RNA, 16 nt, Human
ucucuaccaaaaaaag

SEQ ID NO: 1725581 - RNA, 20 nt, Human
gcagagaugaggccgccaug

SEQ ID NO: 1725582 - RNA, 22 nt, Human
caugucuagagaacacugugcu

SEQ ID NO: 1725583 - RNA, 23 nt, Human
ucuccauguacuggcaagaccug

SEQ ID NO: 1725584 - RNA, 12 nt, Human
auaacuggaaac

SEQ ID NO: 1725585 - RNA, 18 nt, Human
acacuguuaucuucacuu

SEQ ID NO: 1725586 - RNA, 20 nt, Human
uaaaacaagcacuaaacaaa

SEQ ID NO: 1725587 - RNA, 23 nt, Human
gaacagauuucaaaaaaaaaccc

SEQ ID NO: 1725588 - RNA, 22 nt, Human
aguauguuagugcaaauuguca

SEQ ID NO: 1725589 - RNA, 19 nt, Human
uccagaaagugacaagcuc

SEQ ID NO: 1725590 - RNA, 22 nt, Human
ugaagcaaaauuuuuucucuag

SEQ ID NO: 1725591 - RNA, 13 nt, Human
cuacauaaaauac

SEQ ID NO: 1725592 - RNA, 14 nt, Human
uacguuaggaggac

SEQ ID NO: 1725593 - RNA, 18 nt, Human
uaguaucaaaagaaagaa

SEQ ID NO: 1725594 - RNA, 22 nt, Human
guguccccuauccuacuucccc

SEQ ID NO: 1725595 - RNA, 15 nt, Human
ggaaauauuuuaaug

SEQ ID NO: 1725596 - RNA, 21 nt, Human
gcccugcugagucccaggcug

SEQ ID NO: 1725597 - RNA, 15 nt, Human
gucucuugaggcaca

SEQ ID NO: 1725598 - RNA, 17 nt, Human
acuuccagauccuggaa

SEQ ID NO: 1725599 - RNA, 20 nt, Human
uacaucccuuaccugggaaa

SEQ ID NO: 1725600 - RNA, 22 nt, Human
agacccugucucaauaaauaaa

SEQ ID NO: 1725601 - RNA, 16 nt, Human
gagcucgugggacagu

SEQ ID NO: 1725602 - RNA, 21 nt, Human
cucuucuggguuccuuccucu

SEQ ID NO: 1725603 - RNA, 21 nt, Human
gaaaacaauaacgauaaaaga

SEQ ID NO: 1725604 - RNA, 18 nt, Human
aaacaaaauuagaaaugu

SEQ ID NO: 1725605 - RNA, 21 nt, Human
uuccuaauuccacagcugcuc

SEQ ID NO: 1725606 - RNA, 20 nt, Human
caggcugagccucagucucc

SEQ ID NO: 1725607 - RNA, 18 nt, Human
cuuucacauuuaaauaaa

SEQ ID NO: 1725608 - RNA, 21 nt, Human
cuaccaaaaaucucaauauuu

SEQ ID NO: 1725609 - RNA, 23 nt, Human
ucaugcccauaccccuggccaag

SEQ ID NO: 1725610 - RNA, 18 nt, Human
aaaaguucugcagauaaa

SEQ ID NO: 1725611 - RNA, 20 nt, Human
uauuuauuacuguaagaaaa

SEQ ID NO: 1725612 - RNA, 18 nt, Human
ggcacagaaacuccuguu

SEQ ID NO: 1725613 - RNA, 21 nt, Human
cccccucuggcuccagcuggc

SEQ ID NO: 1725614 - RNA, 20 nt, Human
aaucuuucacaggggacagg

SEQ ID NO: 1725615 - RNA, 22 nt, Human
cugaggcuccacuuggucugug

SEQ ID NO: 1725616 - RNA, 19 nt, Human
aauauuauguuaaaacugg

SEQ ID NO: 1725617 - RNA, 11 nt, Human
auuuaaaaauc

SEQ ID NO: 1725618 - RNA, 19 nt, Human
uuuuaucugcuaugcuauu

SEQ ID NO: 1725619 - RNA, 19 nt, Human
cugacugcuaguuuauaua

SEQ ID NO: 1725620 - RNA, 18 nt, Human
gcagugucugcuggagac

SEQ ID NO: 1725621 - RNA, 19 nt, Human
auuuccuuauucagaauuu

SEQ ID NO: 1725622 - RNA, 19 nt, Human
uauauuuuuuguuaaauga

SEQ ID NO: 1725623 - RNA, 16 nt, Human
ugacuauuauauuucc

SEQ ID NO: 1725624 - RNA, 22 nt, Human
gugugaccacugcagaagacag

SEQ ID NO: 1725625 - RNA, 21 nt, Human
caaggagaggcaaagaaagga

SEQ ID NO: 1725626 - RNA, 23 nt, Human
auuuuauagcuacuaauuuuaaa

SEQ ID NO: 1725627 - RNA, 19 nt, Human
cagauccccaagccuggca

SEQ ID NO: 1725628 - RNA, 18 nt, Human
ucuucuggguuccuuccu

SEQ ID NO: 1725629 - RNA, 14 nt, Human
uauuugaaauauug

SEQ ID NO: 1725630 - RNA, 14 nt, Human
gaaacgaagcacca

SEQ ID NO: 1725631 - RNA, 14 nt, Human
ugagacucugucuc

SEQ ID NO: 1725632 - RNA, 15 nt, Human
agugacaagcucaca

SEQ ID NO: 1725633 - RNA, 19 nt, Human
accauuuuggcaagcucua

SEQ ID NO: 1725634 - RNA, 18 nt, Human
cuaccaaaaaaaggaagg

SEQ ID NO: 1725635 - RNA, 13 nt, Human
uuccucugagccu

SEQ ID NO: 1725636 - RNA, 17 nt, Human
ccugccccccagcccuc

SEQ ID NO: 1725637 - RNA, 17 nt, Human
caaacauauauaacaau

SEQ ID NO: 1725638 - RNA, 18 nt, Human
guuuaugguuguauuauu

SEQ ID NO: 1725639 - RNA, 22 nt, Human
aagacccaaaaggcagaagcaa

SEQ ID NO: 1725640 - RNA, 17 nt, Human
agaaacaaaaaucaaac

SEQ ID NO: 1725641 - RNA, 20 nt, Human
gacaggcacuaucuggguuu

SEQ ID NO: 1725642 - RNA, 16 nt, Human
guccauugggcaggca

SEQ ID NO: 1725643 - RNA, 19 nt, Human
acaaauuuacagagacaga

SEQ ID NO: 1725644 - RNA, 15 nt, Human
gaaaugaaagcaggg

SEQ ID NO: 1725645 - RNA, 21 nt, Human
ucacaugaacuuguaaaggaa

SEQ ID NO: 1725646 - RNA, 20 nt, Human
auaaauggcuuccuggcaau

SEQ ID NO: 1725647 - RNA, 21 nt, Human
agcccuuccccucugcagcuu

SEQ ID NO: 1725648 - RNA, 16 nt, Human
gcuucacuguaaaaua

SEQ ID NO: 1725649 - RNA, 20 nt, Human
aaagaaaggagauacagugg

SEQ ID NO: 1725650 - RNA, 13 nt, Human
aaauaaaaauaau

SEQ ID NO: 1725651 - RNA, 14 nt, Human
agggcuaauaucuu

SEQ ID NO: 1725652 - RNA, 23 nt, Human
ucaauaucuuuuuuuuaauaaac

SEQ ID NO: 1725653 - RNA, 18 nt, Human
uggagggaagccuugggg

SEQ ID NO: 1725654 - RNA, 15 nt, Human
uuaauuuguaguguu

SEQ ID NO: 1725655 - RNA, 18 nt, Human
ucucuaggaaauauuuau

SEQ ID NO: 1725656 - RNA, 20 nt, Human
ccagugagacagcucugcau

SEQ ID NO: 1725657 - RNA, 20 nt, Human
accucauggaauuggagcuc

SEQ ID NO: 1725658 - RNA, 16 nt, Human
cucagcccuggugggc

SEQ ID NO: 1725659 - RNA, 18 nt, Human
aucuuauaauuuaaaaua

SEQ ID NO: 1725660 - RNA, 14 nt, Human
agacaucaacagau

SEQ ID NO: 1725661 - RNA, 18 nt, Human
cuccccaaaugcuuucca

SEQ ID NO: 1725662 - RNA, 16 nt, Human
agagguccacaacaca

SEQ ID NO: 1725663 - RNA, 16 nt, Human
uacaaaugggaaacaa

SEQ ID NO: 1725664 - RNA, 14 nt, Human
ggcaccucucuggg

SEQ ID NO: 1725665 - RNA, 15 nt, Human
agaugggcauggugg

SEQ ID NO: 1725666 - RNA, 20 nt, Human
aguuuuuuuuuaaaaaagaa

SEQ ID NO: 1725667 - RNA, 20 nt, Human
accggccuuugcaccuccau

SEQ ID NO: 1725668 - RNA, 20 nt, Human
caucccuagaaagccaugug

SEQ ID NO: 1725669 - RNA, 17 nt, Human
aaaaauccuacuuucau

SEQ ID NO: 1725670 - RNA, 21 nt, Human
uaaaagacagugaaagaaaau

SEQ ID NO: 1725671 - RNA, 19 nt, Human
ugauggaguuucucuagaa

SEQ ID NO: 1725672 - RNA, 14 nt, Human
ugaggcaggaggau

SEQ ID NO: 1725673 - RNA, 11 nt, Human
aacauuuaugu

SEQ ID NO: 1725674 - RNA, 14 nt, Human
accacaagacugca

SEQ ID NO: 1725675 - RNA, 21 nt, Human
uguccucaugagggcuggaug

SEQ ID NO: 1725676 - RNA, 12 nt, Human
gccauaaaacuu

SEQ ID NO: 1725677 - RNA, 17 nt, Human
uacaaaugcauuucuaa

SEQ ID NO: 1725678 - RNA, 18 nt, Human
agugucaaugcagccccc

SEQ ID NO: 1725679 - RNA, 21 nt, Human
uuuauauaagcuuguauuccu

SEQ ID NO: 1725680 - RNA, 15 nt, Human
cuaagcaaaauguga

SEQ ID NO: 1725681 - RNA, 12 nt, Human
uaccuccaagga

SEQ ID NO: 1725682 - RNA, 14 nt, Human
uuauuauauuuaca

SEQ ID NO: 1725683 - RNA, 17 nt, Human
augcagagguccacaac

SEQ ID NO: 1725684 - RNA, 19 nt, Human
caaaacuuauuggaauguu

SEQ ID NO: 1725685 - RNA, 23 nt, Human
uuguaacaagccuccuuuuaaag

SEQ ID NO: 1725686 - RNA, 16 nt, Human
uaaaggaauuuaaaaa

SEQ ID NO: 1725687 - RNA, 21 nt, Human
cuccagcuggccgggagccug

SEQ ID NO: 1725688 - RNA, 14 nt, Human
aucuucagaaaacc

SEQ ID NO: 1725689 - RNA, 13 nt, Human
uuuaaaaaaaaac

SEQ ID NO: 1725690 - RNA, 16 nt, Human
ugagaugcuagaacuc

SEQ ID NO: 1725691 - RNA, 20 nt, Human
auaacaaugcuguauuuuaa

SEQ ID NO: 1725692 - RNA, 14 nt, Human
ucagucucccuccc

SEQ ID NO: 1725693 - RNA, 15 nt, Human
uuauauuucuguuaa

SEQ ID NO: 1725694 - RNA, 14 nt, Human
acuuuuauaagaaa

SEQ ID NO: 1725695 - RNA, 14 nt, Human
cacuaaacaaagag

SEQ ID NO: 1725696 - RNA, 17 nt, Human
cgauaaaagacagugaa

SEQ ID NO: 1725697 - RNA, 21 nt, Human
auguuuacagauccccaagcc

SEQ ID NO: 1725698 - RNA, 15 nt, Human
uacaaaugcauuucu

SEQ ID NO: 1725699 - RNA, 23 nt, Human
cuggccgggagccugaucaccug

SEQ ID NO: 1725700 - RNA, 16 nt, Human
ccaccugcugagcccc

SEQ ID NO: 1725701 - RNA, 23 nt, Human
uguagguagaucuggucuuuaga

SEQ ID NO: 1725702 - RNA, 21 nt, Human
ccauccugccccugagcccau

SEQ ID NO: 1725703 - RNA, 19 nt, Human
acucugcaagaagaaauca

SEQ ID NO: 1725704 - RNA, 22 nt, Human
aggauggcuaguaucaaaagaa

SEQ ID NO: 1725705 - RNA, 19 nt, Human
cuagucuguuuucccuccu

SEQ ID NO: 1725706 - RNA, 15 nt, Human
uacagaacuaaaaau

SEQ ID NO: 1725707 - RNA, 21 nt, Human
aucuuuuuuuuaauaaaccau

SEQ ID NO: 1725708 - RNA, 21 nt, Human
aggaagggacacauaucaaac

SEQ ID NO: 1725709 - RNA, 13 nt, Human
uuuagugaaauau

SEQ ID NO: 1725710 - RNA, 22 nt, Human
uguugcccacagcuguaugauu

SEQ ID NO: 1725711 - RNA, 21 nt, Human
auaugcucuaaacauguuuau

SEQ ID NO: 1725712 - RNA, 19 nt, Human
ucaccaaggcugauuaaac

SEQ ID NO: 1725713 - RNA, 21 nt, Human
uggggaauauguuagagaauu

SEQ ID NO: 1725714 - RNA, 23 nt, Human
auacaguggagacaucuggaaag

SEQ ID NO: 1725715 - RNA, 16 nt, Human
acaaauccaaugaaau

SEQ ID NO: 1725716 - RNA, 14 nt, Human
aaaaaggaaggaag

SEQ ID NO: 1725717 - RNA, 15 nt, Human
uccuacaagacacag

SEQ ID NO: 1725718 - RNA, 15 nt, Human
aauugacccacaaga

SEQ ID NO: 1725719 - RNA, 16 nt, Human
uccucacuuugaagag

SEQ ID NO: 1725720 - RNA, 16 nt, Human
gccuucucucaaggag

SEQ ID NO: 1725721 - RNA, 12 nt, Human
cagauuuuccug

SEQ ID NO: 1725722 - RNA, 17 nt, Human
caagaaaugaaagcagg

SEQ ID NO: 1725723 - RNA, 15 nt, Human
cugcuacuaucuguu

SEQ ID NO: 1725724 - RNA, 20 nt, Human
ccugccuaagugcagccccg

SEQ ID NO: 1725725 - RNA, 16 nt, Human
auauuuccaagaaaua

SEQ ID NO: 1725726 - RNA, 18 nt, Human
aacugccaucauuuacuu

SEQ ID NO: 1725727 - RNA, 15 nt, Human
ucauaagaauucugu

SEQ ID NO: 1725728 - RNA, 18 nt, Human
cauuauggauaaagauga

SEQ ID NO: 1725729 - RNA, 17 nt, Human
ucagacauagaauuaac

SEQ ID NO: 1725730 - RNA, 17 nt, Human
cccaucucagguguguu

SEQ ID NO: 1725731 - RNA, 13 nt, Human
uaaaauacaaaaa

SEQ ID NO: 1725732 - RNA, 16 nt, Human
augggaacaaggaagg

SEQ ID NO: 1725733 - RNA, 12 nt, Human
gcaacaugguga

SEQ ID NO: 1725734 - RNA, 15 nt, Human
aagccagauuuuccu

SEQ ID NO: 1725735 - RNA, 14 nt, Human
agucugacuguuuc

SEQ ID NO: 1725736 - RNA, 18 nt, Human
uucaauaucuuuuuuuua

SEQ ID NO: 1725737 - RNA, 23 nt, Human
gagaaaugagcacgcauggaaaa

SEQ ID NO: 1725738 - RNA, 21 nt, Human
aagacucgggauuaguacaca

SEQ ID NO: 1725739 - RNA, 16 nt, Human
cugagcauuuaauaug

SEQ ID NO: 1725740 - RNA, 18 nt, Human
auagucaaauugugugaa

SEQ ID NO: 1725741 - RNA, 15 nt, Human
gaagauguagaggag

SEQ ID NO: 1725742 - RNA, 14 nt, Human
agcuggaaacacau

SEQ ID NO: 1725743 - RNA, 14 nt, Human
auauuuauuuuaau

SEQ ID NO: 1725744 - RNA, 17 nt, Human
uacagaacuaaaaauua

SEQ ID NO: 1725745 - RNA, 16 nt, Human
caaaguugauuaagaa

SEQ ID NO: 1725746 - RNA, 13 nt, Human
acacacaugaagu

SEQ ID NO: 1725747 - RNA, 23 nt, Human
uggaaauguuuacagauccccaa

SEQ ID NO: 1725748 - RNA, 13 nt, Human
cccugcacuccag

SEQ ID NO: 1725749 - RNA, 14 nt, Human
gaucuaugccacaa

SEQ ID NO: 1725750 - RNA, 17 nt, Human
cuuccucugagccuugg

SEQ ID NO: 1725751 - RNA, 15 nt, Human
ugaaauuguauuaca

SEQ ID NO: 1725752 - RNA, 13 nt, Human
ccucauggaauug

SEQ ID NO: 1725753 - RNA, 19 nt, Human
gcaggcacugccaaaacau

SEQ ID NO: 1725754 - RNA, 17 nt, Human
ccuauccuacuuccccu

SEQ ID NO: 1725755 - RNA, 14 nt, Human
gagaggcaaagaaa

SEQ ID NO: 1725756 - RNA, 12 nt, Human
uaauuccacagc

SEQ ID NO: 1725757 - RNA, 11 nt, Human
aaagaaacaaa

SEQ ID NO: 1725758 - RNA, 16 nt, Human
ucugcagauaaacagu

SEQ ID NO: 1725759 - RNA, 17 nt, Human
guuagagaauuuccuua

SEQ ID NO: 1725760 - RNA, 19 nt, Human
acgaaauacguuaggagga

SEQ ID NO: 1725761 - RNA, 17 nt, Human
uuuuuaauuauauggcu

SEQ ID NO: 1725762 - RNA, 19 nt, Human
uaguuuaugauuccaccua

SEQ ID NO: 1725763 - RNA, 16 nt, Human
gccucagucucccucc

SEQ ID NO: 1725764 - RNA, 22 nt, Human
auuacuguaagaaaauaucacu

SEQ ID NO: 1725765 - RNA, 19 nt, Human
agaugcuagaacucccuuu

SEQ ID NO: 1725766 - RNA, 14 nt, Human
ggacucaccucccc

SEQ ID NO: 1725767 - RNA, 19 nt, Human
cucuguucugcacacagca

SEQ ID NO: 1725768 - RNA, 16 nt, Human
gccuaagugcagcccc

SEQ ID NO: 1725769 - RNA, 23 nt, Human
agcaugucgucaaagcugaaaug

SEQ ID NO: 1725770 - RNA, 14 nt, Human
uauaauuuaaauau

SEQ ID NO: 1725771 - RNA, 15 nt, Human
aauauauuuccuuau

SEQ ID NO: 1725772 - RNA, 15 nt, Human
uguuaaaugauuuca

SEQ ID NO: 1725773 - RNA, 15 nt, Human
aauaaauaaauaaaa

SEQ ID NO: 1725774 - RNA, 16 nt, Human
ugagccccgaaucuga

SEQ ID NO: 1725775 - RNA, 18 nt, Human
auucuugccaaauauaaa

SEQ ID NO: 1725776 - RNA, 12 nt, Human
uauuauuuuuua

SEQ ID NO: 1725777 - RNA, 14 nt, Human
gaaaacaauaacga

SEQ ID NO: 1725778 - RNA, 21 nt, Human
uuauagcuacuaauuuuaaaa

SEQ ID NO: 1725779 - RNA, 14 nt, Human
ucuaggaaauauuu

SEQ ID NO: 1725780 - RNA, 21 nt, Human
aggaagaucccuuuguccaca

SEQ ID NO: 1725781 - RNA, 23 nt, Human
cucuacuaaaaauacaaaaaaaa

SEQ ID NO: 1725782 - RNA, 14 nt, Human
auuucuaugaaaua

SEQ ID NO: 1725783 - RNA, 14 nt, Human
auuugaaauuguau

SEQ ID NO: 1725784 - RNA, 21 nt, Human
agaagcuagaaaacaggcaaa

SEQ ID NO: 1725785 - RNA, 22 nt, Human
cccccugcaaagcccagcuuga

SEQ ID NO: 1725786 - RNA, 15 nt, Human
ggccuucggccucca

SEQ ID NO: 1725787 - RNA, 22 nt, Human
uucauagaguucccaugaacua

SEQ ID NO: 1725788 - RNA, 13 nt, Human
cuagcagugagcc

SEQ ID NO: 1725789 - RNA, 19 nt, Human
cucugcaagaagaaaucau

SEQ ID NO: 1725790 - RNA, 19 nt, Human
uuggcaagcucuaucacca

SEQ ID NO: 1725791 - RNA, 17 nt, Human
cauaaaauacaaaaacu

SEQ ID NO: 1725792 - RNA, 16 nt, Human
aaaugggaaacaaaag

SEQ ID NO: 1725793 - RNA, 11 nt, Human
ggucacaggaa

SEQ ID NO: 1725794 - RNA, 15 nt, Human
cccacucugcaagaa

SEQ ID NO: 1725795 - RNA, 15 nt, Human
auuuauuaaguauuu

SEQ ID NO: 1725796 - RNA, 23 nt, Human
caaauaagucaucugaugagaac

SEQ ID NO: 1725797 - RNA, 18 nt, Human
gacauuugcucauggaau

SEQ ID NO: 1725798 - RNA, 18 nt, Human
aucuacacuccagugaga

SEQ ID NO: 1725799 - RNA, 17 nt, Human
cucacaggagcaucucc

SEQ ID NO: 1725800 - RNA, 15 nt, Human
ccuggugggcagaga

SEQ ID NO: 1725801 - RNA, 23 nt, Human
ggaugaauuaaguuuuuuuuuaa

SEQ ID NO: 1725802 - RNA, 14 nt, Human
ccaaugaaaugagu

SEQ ID NO: 1725803 - RNA, 23 nt, Human
aauuaaaaccucuuugugucccu

SEQ ID NO: 1725804 - RNA, 14 nt, Human
accauuuuuacuug

SEQ ID NO: 1725805 - RNA, 23 nt, Human
uauguuaaaacugggacagggga

SEQ ID NO: 1725806 - RNA, 18 nt, Human
gccuucggccuccauccu

SEQ ID NO: 1725807 - RNA, 12 nt, Human
aauaaaaacaaa

SEQ ID NO: 1725808 - RNA, 22 nt, Human
ggggugguuuucccaucucagg

SEQ ID NO: 1725809 - RNA, 22 nt, Human
gaugggaacaaggaaggaaaga

SEQ ID NO: 1725810 - RNA, 15 nt, Human
gaaaacaaggaugaa

SEQ ID NO: 1725811 - RNA, 16 nt, Human
aagaagcuagaaaaca

SEQ ID NO: 1725812 - RNA, 13 nt, Human
aauuauuucacuu

SEQ ID NO: 1725813 - RNA, 17 nt, Human
cccacuggacucaccuc

SEQ ID NO: 1725814 - RNA, 21 nt, Human
cacaugaacuuguaaaggaau

SEQ ID NO: 1725815 - RNA, 22 nt, Human
uaccucugcuauuugcuguuau

SEQ ID NO: 1725816 - RNA, 16 nt, Human
aauauuuuaauguuuc

SEQ ID NO: 1725817 - RNA, 21 nt, Human
agucucccucccuuggggccu

SEQ ID NO: 1725818 - RNA, 19 nt, Human
acuucagcgguuuauauaa

SEQ ID NO: 1725819 - RNA, 14 nt, Human
caguucugaagaag

SEQ ID NO: 1725820 - RNA, 16 nt, Human
ccacuuauaggaauug

SEQ ID NO: 1725821 - RNA, 18 nt, Human
uuauuacuguaagaaaau

SEQ ID NO: 1725822 - RNA, 20 nt, Human
ucaauaaaauccauacauuu

SEQ ID NO: 1725823 - RNA, 20 nt, Human
ucaaaacuucagacauagaa

SEQ ID NO: 1725824 - RNA, 15 nt, Human
uccucaacucugagu

SEQ ID NO: 1725825 - RNA, 19 nt, Human
augaaguacucauacaugu

SEQ ID NO: 1725826 - RNA, 13 nt, Human
aauaucucuucuc

SEQ ID NO: 1725827 - RNA, 18 nt, Human
agauauuaacugagaagg

SEQ ID NO: 1725828 - RNA, 14 nt, Human
aauauuuauuuuaa

SEQ ID NO: 1725829 - RNA, 15 nt, Human
uauuucacuuuagaa

SEQ ID NO: 1725830 - RNA, 10 nt, Human
aaacacaugu

SEQ ID NO: 1725831 - RNA, 17 nt, Human
accugagccccaaaagg

SEQ ID NO: 1725832 - RNA, 16 nt, Human
gagaaacuggaacucu

SEQ ID NO: 1725833 - RNA, 16 nt, Human
aagaaaggagauacag

SEQ ID NO: 1725834 - RNA, 15 nt, Human
uuacagagacagaaa

SEQ ID NO: 1725835 - RNA, 13 nt, Human
aaaguguuugaaa

SEQ ID NO: 1725836 - RNA, 16 nt, Human
uauuuuugugauuuug

SEQ ID NO: 1725837 - RNA, 19 nt, Human
cccuuccccucugcagcuu

SEQ ID NO: 1725838 - RNA, 17 nt, Human
cacaccaaccuucugag

SEQ ID NO: 1725839 - RNA, 15 nt, Human
caggaaguagaggag

SEQ ID NO: 1725840 - RNA, 21 nt, Human
guauacugugugcuaaaacaa

SEQ ID NO: 1725841 - RNA, 21 nt, Human
cugagccucagucucccuccc

SEQ ID NO: 1725842 - RNA, 15 nt, Human
uaaaagacaaggaaa

SEQ ID NO: 1725843 - RNA, 19 nt, Human
auaauuuuuauauuugaaa

SEQ ID NO: 1725844 - RNA, 21 nt, Human
gaagcuagaaaacaggcaaau

SEQ ID NO: 1725845 - RNA, 17 nt, Human
cugagaugggagaauca

SEQ ID NO: 1725846 - RNA, 18 nt, Human
acagucucuugaggcaca

SEQ ID NO: 1725847 - RNA, 16 nt, Human
augccccgucccccuc

SEQ ID NO: 1725848 - RNA, 21 nt, Human
agccucuuagaugcaguucug

SEQ ID NO: 1725849 - RNA, 18 nt, Human
ucaccagucccuccccaa

SEQ ID NO: 1725850 - RNA, 18 nt, Human
gcccuggugggcagagag

SEQ ID NO: 1725851 - RNA, 20 nt, Human
caagcucuaucaccaaggag

SEQ ID NO: 1725852 - RNA, 15 nt, Human
aaacugaaacaaaau

SEQ ID NO: 1725853 - RNA, 17 nt, Human
cuaagcuucacuguaaa

SEQ ID NO: 1725854 - RNA, 15 nt, Human
cuguauguccuuggu

SEQ ID NO: 1725855 - RNA, 22 nt, Human
cagaucuaugccacaagaaccc

SEQ ID NO: 1725856 - RNA, 20 nt, Human
uggaaacacauguuccccuu

SEQ ID NO: 1725857 - RNA, 23 nt, Human
uaaguuuuuuuuuaaaaaagaaa

SEQ ID NO: 1725858 - RNA, 17 nt, Human
gccaugggacagggagg

SEQ ID NO: 1725859 - RNA, 14 nt, Human
agaaaugaaagcag

SEQ ID NO: 1725860 - RNA, 13 nt, Human
acaauaaaagaca

SEQ ID NO: 1725861 - RNA, 22 nt, Human
ucauucccguugaacgucacau

SEQ ID NO: 1725862 - RNA, 12 nt, Human
aagaaaauaacg

SEQ ID NO: 1725863 - RNA, 17 nt, Human
agucccaggcugagccu

SEQ ID NO: 1725864 - RNA, 17 nt, Human
gccuaagugcagccccg

SEQ ID NO: 1725865 - RNA, 23 nt, Human
caauaacgauaaaagacagugaa

SEQ ID NO: 1725866 - RNA, 19 nt, Human
cuguuauuuuaucugcuau

SEQ ID NO: 1725867 - RNA, 17 nt, Human
guuccuuuuaaagaaac

SEQ ID NO: 1725868 - RNA, 21 nt, Human
cauuuucuucucacauuuaua

SEQ ID NO: 1725869 - RNA, 21 nt, Human
cucuugaaguauauauaucau

SEQ ID NO: 1725870 - RNA, 17 nt, Human
ccucuggcuccagcugg

SEQ ID NO: 1725871 - RNA, 13 nt, Human
aacaagccuccuu

SEQ ID NO: 1725872 - RNA, 18 nt, Human
cuggguuaggccuugccu

SEQ ID NO: 1725873 - RNA, 16 nt, Human
gugagacagcucugca

SEQ ID NO: 1725874 - RNA, 23 nt, Human
caacacccugagguugugugugg

SEQ ID NO: 1725875 - RNA, 11 nt, Human
aaaaaaaggaa

SEQ ID NO: 1725876 - RNA, 17 nt, Human
guuuaauucugaaagca

SEQ ID NO: 1725877 - RNA, 23 nt, Human
aauauuuauuuuaauaauguuuc

SEQ ID NO: 1725878 - RNA, 13 nt, Human
cacaacacacaga

SEQ ID NO: 1725879 - RNA, 12 nt, Human
uuauucacugua

SEQ ID NO: 1725880 - RNA, 16 nt, Human
caauaacgauaaaaga

SEQ ID NO: 1725881 - RNA, 16 nt, Human
cuaguuuauauagaaa

SEQ ID NO: 1725882 - RNA, 21 nt, Human
ucuucaacucccugcccccca

SEQ ID NO: 1725883 - RNA, 15 nt, Human
ugagacacugucucu

SEQ ID NO: 1725884 - RNA, 21 nt, Human
ucuggguugaagggcaguguu

SEQ ID NO: 1725885 - RNA, 13 nt, Human
agccucagucucc

SEQ ID NO: 1725886 - RNA, 17 nt, Human
guagaaugggggcagca

SEQ ID NO: 1725887 - RNA, 15 nt, Human
acuuuauaaaggauu

SEQ ID NO: 1725888 - RNA, 18 nt, Human
gauuucaaaaaaaaaccc

SEQ ID NO: 1725889 - RNA, 17 nt, Human
gcagcauuguuggcugu

SEQ ID NO: 1725890 - RNA, 14 nt, Human
caaggcuagaacca

SEQ ID NO: 1725891 - RNA, 17 nt, Human
auguugacaugggacau

SEQ ID NO: 1725892 - RNA, 24 nt, Human
ccccugagcuugcagagaugaggc

SEQ ID NO: 1725893 - RNA, 18 nt, Human
uaaguuuuuuuuuaaaaa

SEQ ID NO: 1725894 - RNA, 16 nt, Human
cuagaacucccuuuca

SEQ ID NO: 1725895 - RNA, 20 nt, Human
accucugccucagaaaacaa

SEQ ID NO: 1725896 - RNA, 23 nt, Human
ggaacaguuaccucugccucaga

SEQ ID NO: 1725897 - RNA, 19 nt, Human
guauucuuuuaguuuuuaa

SEQ ID NO: 1725898 - RNA, 18 nt, Human
ccugucucaauaaauaaa

SEQ ID NO: 1725899 - RNA, 18 nt, Human
aacagauuucaaaaaaaa

SEQ ID NO: 1725900 - RNA, 17 nt, Human
uauauuguagauaauac

SEQ ID NO: 1725901 - RNA, 16 nt, Human
uuauauuuccaagaaa

SEQ ID NO: 1725902 - RNA, 14 nt, Human
cugagucccaggcu

SEQ ID NO: 1725903 - RNA, 13 nt, Human
auuggacaguaaa

SEQ ID NO: 1725904 - RNA, 17 nt, Human
ucgggauuaguacacac

SEQ ID NO: 1725905 - RNA, 15 nt, Human
aaauauuuauuuuaa

SEQ ID NO: 1725906 - RNA, 21 nt, Human
uugccuaggcauagcccugcc

SEQ ID NO: 1725907 - RNA, 22 nt, Human
ucuggguuccuuccucugagcc

SEQ ID NO: 1725908 - RNA, 14 nt, Human
cugguggcucugug

SEQ ID NO: 1725909 - RNA, 19 nt, Human
auuuugugaagcaaaauuu

SEQ ID NO: 1725910 - RNA, 20 nt, Human
augguuuagaaagcuugccc

SEQ ID NO: 1725911 - RNA, 11 nt, Human
gcuacagugag

SEQ ID NO: 1725912 - RNA, 15 nt, Human
auaaauaaauaaaua

SEQ ID NO: 1725913 - RNA, 15 nt, Human
uaaauaaauaaauaa

SEQ ID NO: 1725914 - RNA, 18 nt, Human
uuggggccuaugcagagg

SEQ ID NO: 1725915 - RNA, 15 nt, Human
uugacacuuaaaaau

SEQ ID NO: 1725916 - RNA, 13 nt, Human
ggcaggcacugcc

SEQ ID NO: 1725917 - RNA, 21 nt, Human
cauuucuugagguaaaagcau

SEQ ID NO: 1725918 - RNA, 12 nt, Human
gacacugucucu

SEQ ID NO: 1725919 - RNA, 14 nt, Human
ugcagcuuccaggc

SEQ ID NO: 1725920 - RNA, 13 nt, Human
uccccaaaugcuu

SEQ ID NO: 1725921 - RNA, 17 nt, Human
gcucaccagucccuccc

SEQ ID NO: 1725922 - RNA, 16 nt, Human
auaaauaaaaacaaag

SEQ ID NO: 1725923 - RNA, 16 nt, Human
agugaaauauuauuuu

SEQ ID NO: 1725924 - RNA, 18 nt, Human
ugagaugguuucuagaga

SEQ ID NO: 1725925 - RNA, 20 nt, Human
cucuaccaaaaaaaggaagg

SEQ ID NO: 1725926 - RNA, 22 nt, Human
uuugcuguuauuuuaucugcua

SEQ ID NO: 1725927 - RNA, 14 nt, Human
ccagcuggccggga

SEQ ID NO: 1725928 - RNA, 20 nt, Human
cuuccaggcuggcgugcagc

SEQ ID NO: 1725929 - RNA, 14 nt, Human
gauaaaagacagug

SEQ ID NO: 1725930 - RNA, 16 nt, Human
auaauccuaaacauau

SEQ ID NO: 1725931 - RNA, 18 nt, Human
aaaguugauuaagaaagg

SEQ ID NO: 1725932 - RNA, 19 nt, Human
gacagucaccucauggaau

SEQ ID NO: 1725933 - RNA, 23 nt, Human
gcccuggugccucaccccuugcc

SEQ ID NO: 1725934 - RNA, 14 nt, Human
ccuuaucaaaggac

SEQ ID NO: 1725935 - RNA, 21 nt, Human
caacacaucaggaaagagagc

SEQ ID NO: 1725936 - RNA, 16 nt, Human
cugcucucaguucacu

SEQ ID NO: 1725937 - RNA, 17 nt, Human
ugaaaaucuuauaauuu

SEQ ID NO: 1725938 - RNA, 23 nt, Human
aucgcagacacaugugcuggcca

SEQ ID NO: 1725939 - RNA, 23 nt, Human
ggaggcagagguugcagugagcc

SEQ ID NO: 1725940 - RNA, 15 nt, Human
agacagcucugcaua

SEQ ID NO: 1725941 - RNA, 18 nt, Human
ccaagcugguggcucugu

SEQ ID NO: 1725942 - RNA, 18 nt, Human
cuuuccacagaagcucca

SEQ ID NO: 1725943 - RNA, 15 nt, Human
auaaauaaaaauaau

SEQ ID NO: 1725944 - RNA, 21 nt, Human
agucaagggugugugcagcau

SEQ ID NO: 1725945 - RNA, 19 nt, Human
cugagccucagucucccuc

SEQ ID NO: 1725946 - RNA, 18 nt, Human
accaccugccuauauuuu

SEQ ID NO: 1725947 - RNA, 20 nt, Human
uuucauaagaauucuguuga

SEQ ID NO: 1725948 - RNA, 18 nt, Human
cucuggccuucggccucc

SEQ ID NO: 1725949 - RNA, 21 nt, Human
cuugaggcacagaaacuccug

SEQ ID NO: 1725950 - RNA, 12 nt, Human
aagaaaauaaca

SEQ ID NO: 1725951 - RNA, 23 nt, Human
uccacaaguaaaaggaaaugcuc

SEQ ID NO: 1725952 - RNA, 17 nt, Human
uaauuuuuauauuugaa

SEQ ID NO: 1725953 - RNA, 14 nt, Human
aauauuauguuaaa

SEQ ID NO: 1725954 - RNA, 15 nt, Human
gccuugggaccccug

SEQ ID NO: 1725955 - RNA, 13 nt, Human
ggugugugcagca

SEQ ID NO: 1725956 - RNA, 16 nt, Human
augcuguauuuuaaaa

SEQ ID NO: 1725957 - RNA, 18 nt, Human
uaauuagcauggccacau

SEQ ID NO: 1725958 - RNA, 15 nt, Human
gcacagccucuuaga

SEQ ID NO: 1725959 - RNA, 18 nt, Human
uacauuuguauaaaauaa

SEQ ID NO: 1725960 - RNA, 16 nt, Human
ccuggugggcagagag

SEQ ID NO: 1725961 - RNA, 18 nt, Human
uuuauguuuaauucugaa

SEQ ID NO: 1725962 - RNA, 20 nt, Human
uaguuauaaaaauauauagc

SEQ ID NO: 1725963 - RNA, 20 nt, Human
gcuugcagagaugaggccgc

SEQ ID NO: 1725964 - RNA, 19 nt, Human
acuccuguucaugcccaua

SEQ ID NO: 1725965 - RNA, 17 nt, Human
uccucugagccuuggga

SEQ ID NO: 1725966 - RNA, 22 nt, Human
cagcccuggugggcagagaggu

SEQ ID NO: 1725967 - RNA, 21 nt, Human
accaacacccugagguugugu

SEQ ID NO: 1725968 - RNA, 20 nt, Human
aaagacaaggaaaaaauaac

SEQ ID NO: 1725969 - RNA, 20 nt, Human
uaucauuuaguuauaaaaau

SEQ ID NO: 1725970 - RNA, 18 nt, Human
cuuccucugagccuuggg

SEQ ID NO: 1725971 - RNA, 17 nt, Human
uccacaacacacagauu

SEQ ID NO: 1725972 - RNA, 15 nt, Human
ccucagucucccucc

SEQ ID NO: 1725973 - RNA, 16 nt, Human
uagaaagccaugugca

SEQ ID NO: 1725974 - RNA, 22 nt, Human
uaauaggcguaacuaauuuuaa

SEQ ID NO: 1725975 - RNA, 18 nt, Human
acuggacucaccuccccc

SEQ ID NO: 1725976 - RNA, 15 nt, Human
cuccucaacucugag

SEQ ID NO: 1725977 - RNA, 20 nt, Human
aauaagccagacaucaacag

SEQ ID NO: 1725978 - RNA, 22 nt, Human
ccauacuaauuauacccccugc

SEQ ID NO: 1725979 - RNA, 22 nt, Human
ugguagcuaaauauauauuuua

SEQ ID NO: 1725980 - RNA, 16 nt, Human
ucuuggggaauauguu

SEQ ID NO: 1725981 - RNA, 22 nt, Human
agaagcaccaaucaugaauuag

SEQ ID NO: 1725982 - RNA, 22 nt, Human
ucuacuaaaaauacaaaaaaaa

SEQ ID NO: 1725983 - RNA, 17 nt, Human
cuaucucauuuccaagc

SEQ ID NO: 1725984 - RNA, 15 nt, Human
aucuuauaauuuaaa

SEQ ID NO: 1725985 - RNA, 18 nt, Human
uauuuucaguuauuauau

SEQ ID NO: 1725986 - RNA, 15 nt, Human
uuuaauaauuuuuaa

SEQ ID NO: 1725987 - RNA, 16 nt, Human
auaaugaauacuuuau

SEQ ID NO: 1725988 - RNA, 14 nt, Human
caucucaggugugu

SEQ ID NO: 1725989 - RNA, 15 nt, Human
acucugcaagaagaa

SEQ ID NO: 1725990 - RNA, 19 nt, Human
ccuccagggagucucagcu

SEQ ID NO: 1725991 - RNA, 21 nt, Human
gagcaucuccucaacucugag

SEQ ID NO: 1725992 - RNA, 12 nt, Human
aauauauuuccu

SEQ ID NO: 1725993 - RNA, 17 nt, Human
guggcucugugugcucu

SEQ ID NO: 1725994 - RNA, 17 nt, Human
aaucuuucacaggggac

SEQ ID NO: 1725995 - RNA, 17 nt, Human
caaccuucugaggagcu

SEQ ID NO: 1725996 - RNA, 18 nt, Human
uucucuaggaaauauuua

SEQ ID NO: 1725997 - RNA, 15 nt, Human
ucaagaucagccugg

SEQ ID NO: 1725998 - RNA, 19 nt, Human
cccugccucaagcuaugug

SEQ ID NO: 1725999 - RNA, 14 nt, Human
uaugaauuacauuu

SEQ ID NO: 1726000 - RNA, 15 nt, Human
agguguguugcagug

SEQ ID NO: 1726001 - RNA, 13 nt, Human
cuuagcccuuccc

SEQ ID NO: 1726002 - RNA, 20 nt, Human
gaaaauaacgauaaaagaca

SEQ ID NO: 1726003 - RNA, 16 nt, Human
ucccugccccccagcc

SEQ ID NO: 1726004 - RNA, 12 nt, Human
gguauuuuaauc

SEQ ID NO: 1726005 - RNA, 14 nt, Human
aaauguaaaauagu

SEQ ID NO: 1726006 - RNA, 19 nt, Human
uggugagugccuguaauca

SEQ ID NO: 1726007 - RNA, 12 nt, Human
auuauauuucca

SEQ ID NO: 1726008 - RNA, 13 nt, Human
ccagcacagccuc

SEQ ID NO: 1726009 - RNA, 21 nt, Human
uaucuuccuauaauuuuagac

SEQ ID NO: 1726010 - RNA, 19 nt, Human
ggaauuucuucaacucccu

SEQ ID NO: 1726011 - RNA, 19 nt, Human
uuguacucugaaaguuuug

SEQ ID NO: 1726012 - RNA, 12 nt, Human
ggcagcaccucc

SEQ ID NO: 1726013 - RNA, 19 nt, Human
auccuacaagacacaguga

SEQ ID NO: 1726014 - RNA, 16 nt, Human
uccugcaauuccacuu

SEQ ID NO: 1726015 - RNA, 17 nt, Human
ccaccugcugagcccca

SEQ ID NO: 1726016 - RNA, 18 nt, Human
uguacuuuauuuucuaua

SEQ ID NO: 1726017 - RNA, 18 nt, Human
acauaaaauacaaaaacu

SEQ ID NO: 1726018 - RNA, 22 nt, Human
aucuauguagaauauauuuccu

SEQ ID NO: 1726019 - RNA, 18 nt, Human
uaagcuucacuguaaaau

SEQ ID NO: 1726020 - RNA, 18 nt, Human
aguuuauauagaaaugua

SEQ ID NO: 1726021 - RNA, 18 nt, Human
cuccagccugagcgacag

SEQ ID NO: 1726022 - RNA, 11 nt, Human
acugggacagg

SEQ ID NO: 1726023 - RNA, 21 nt, Human
ugcuggccaccugcugagccc

SEQ ID NO: 1726024 - RNA, 17 nt, Human
caggcuggcgugcagca

SEQ ID NO: 1726025 - RNA, 22 nt, Human
gaaaacaauaacgauaaaagac

SEQ ID NO: 1726026 - RNA, 16 nt, Human
agugaaagaaaauaac

SEQ ID NO: 1726027 - RNA, 21 nt, Human
uagggugauauuaaccagggg

SEQ ID NO: 1726028 - RNA, 14 nt, Human
gccaggcacagugg

SEQ ID NO: 1726029 - RNA, 22 nt, Human
ucucagcuucacccugagguga

SEQ ID NO: 1726030 - RNA, 16 nt, Human
agaugagagaacaggg

SEQ ID NO: 1726031 - RNA, 15 nt, Human
uccaagccucauguc

SEQ ID NO: 1726032 - RNA, 14 nt, Human
ucucuacauaaaau

SEQ ID NO: 1726033 - RNA, 12 nt, Human
cuuccucugagc

SEQ ID NO: 1726034 - RNA, 17 nt, Human
gaaguauaggccaggca

SEQ ID NO: 1726035 - RNA, 18 nt, Human
gaaaauaacaauaaaaga

SEQ ID NO: 1726036 - RNA, 16 nt, Human
ccugagcuugcagaga

SEQ ID NO: 1726037 - RNA, 16 nt, Human
agccucagucucccuc

SEQ ID NO: 1726038 - RNA, 23 nt, Human
auuucugagcauuuaauauggau

SEQ ID NO: 1726039 - RNA, 14 nt, Human
uugacccacaagaa

SEQ ID NO: 1726040 - RNA, 14 nt, Human
uuuuauaugcuauu

SEQ ID NO: 1726041 - RNA, 16 nt, Human
auaacuggaaacuuca

SEQ ID NO: 1726042 - RNA, 12 nt, Human
aauacuuuauaa

SEQ ID NO: 1726043 - RNA, 16 nt, Human
caaaaggauaaugaau

SEQ ID NO: 1726044 - RNA, 22 nt, Human
auaucuuuuuuuuaauaaacca

SEQ ID NO: 1726045 - RNA, 17 nt, Human
caucgcagacacaugug

SEQ ID NO: 1726046 - RNA, 14 nt, Human
aauauaaauaaaaa

SEQ ID NO: 1726047 - RNA, 17 nt, Human
uguaaaggaauuuaaaa

SEQ ID NO: 1726048 - RNA, 16 nt, Human
ucuugagguaaaagca

SEQ ID NO: 1726049 - RNA, 17 nt, Human
aacagauuucaaaaaaa

SEQ ID NO: 1726050 - RNA, 18 nt, Human
aguucuccacuagcuaug

SEQ ID NO: 1726051 - RNA, 23 nt, Human
ggucucagugucaaugcagcccc

SEQ ID NO: 1726052 - RNA, 18 nt, Human
cuucacuguaaaauaaua

SEQ ID NO: 1726053 - RNA, 21 nt, Human
cugguagcuaaauauauauuu

SEQ ID NO: 1726054 - RNA, 16 nt, Human
cucaauaaaguacaag

SEQ ID NO: 1726055 - RNA, 16 nt, Human
agcccugccucaagcu

SEQ ID NO: 1726056 - RNA, 12 nt, Human
ccagcuuugagg

SEQ ID NO: 1726057 - RNA, 20 nt, Human
agggcaguguucccuggggc

SEQ ID NO: 1726058 - RNA, 14 nt, Human
uucagccugaaaga

SEQ ID NO: 1726059 - RNA, 19 nt, Human
gcucauggaauuggagcuc

SEQ ID NO: 1726060 - RNA, 14 nt, Human
uuuguauaaaauaa

SEQ ID NO: 1726061 - RNA, 17 nt, Human
uguuggcuguuccugca

SEQ ID NO: 1726062 - RNA, 15 nt, Human
auauaucauagcaaa

SEQ ID NO: 1726063 - RNA, 15 nt, Human
augucuagagaacac

SEQ ID NO: 1726064 - RNA, 17 nt, Human
gcccuuccccucugcag

SEQ ID NO: 1726065 - RNA, 15 nt, Human
cucccuuggggccua

SEQ ID NO: 1726066 - RNA, 19 nt, Human
ugaaauuguauuacaaauc

SEQ ID NO: 1726067 - RNA, 17 nt, Human
cuagaaaacaggcaaau

SEQ ID NO: 1726068 - RNA, 23 nt, Human
aucaccaaggcugauuaaaccaa

SEQ ID NO: 1726069 - RNA, 22 nt, Human
ccauuucuugagguaaaagcau

SEQ ID NO: 1726070 - RNA, 19 nt, Human
ugggacaggggagaaccua

SEQ ID NO: 1726071 - RNA, 21 nt, Human
ugccagcuggccuugugagga

SEQ ID NO: 1726072 - RNA, 19 nt, Human
ugccucaagcuaugugagc

SEQ ID NO: 1726073 - RNA, 20 nt, Human
cagugaaagaaaauaacgau

SEQ ID NO: 1726074 - RNA, 14 nt, Human
aagcucuaucacca

SEQ ID NO: 1726075 - RNA, 19 nt, Human
uaggaggacaaaaggaaug

SEQ ID NO: 1726076 - RNA, 17 nt, Human
agcuucacuguaaaaua

SEQ ID NO: 1726077 - RNA, 21 nt, Human
acugaaacaaaauuagaaaug

SEQ ID NO: 1726078 - RNA, 14 nt, Human
ugcaccuccaugga

SEQ ID NO: 1726079 - RNA, 14 nt, Human
uuucuaugaaauau

SEQ ID NO: 1726080 - RNA, 19 nt, Human
uggcaagcucuaucaccaa

SEQ ID NO: 1726081 - RNA, 16 nt, Human
uaggaaauauuuuaau

SEQ ID NO: 1726082 - RNA, 15 nt, Human
cuccagggagucuca

SEQ ID NO: 1726083 - RNA, 14 nt, Human
gacaagaaggaaag

SEQ ID NO: 1726084 - RNA, 21 nt, Human
aauauauuuccuuauucagaa

SEQ ID NO: 1726085 - RNA, 13 nt, Human
ccccucugcagcu

SEQ ID NO: 1726086 - RNA, 14 nt, Human
agaugcuagaacuc

SEQ ID NO: 1726087 - RNA, 18 nt, Human
auagugagacacugucuc

SEQ ID NO: 1726088 - RNA, 15 nt, Human
gacagggaggacgcu

SEQ ID NO: 1726089 - RNA, 18 nt, Human
ugauuauuuuauguuuua

SEQ ID NO: 1726090 - RNA, 16 nt, Human
gcaucccuagaaagcc

SEQ ID NO: 1726091 - RNA, 15 nt, Human
uaaaaggaaaugcuc

SEQ ID NO: 1726092 - RNA, 13 nt, Human
gagcucaggaggu

SEQ ID NO: 1726093 - RNA, 16 nt, Human
agaugcuagaacuccc

SEQ ID NO: 1726094 - RNA, 17 nt, Human
cuccaaguucaaaacuu

SEQ ID NO: 1726095 - RNA, 13 nt, Human
ccugagcuugcag

SEQ ID NO: 1726096 - RNA, 18 nt, Human
uaauaauguuucaaacau

SEQ ID NO: 1726097 - RNA, 14 nt, Human
cuucacccugaggu

SEQ ID NO: 1726098 - RNA, 13 nt, Human
cucagaaaacaag

SEQ ID NO: 1726099 - RNA, 17 nt, Human
aguugauaaguacauga

SEQ ID NO: 1726100 - RNA, 13 nt, Human
aaaugggaaacaa

SEQ ID NO: 1726101 - RNA, 20 nt, Human
cuuccccucugcagcuucca

SEQ ID NO: 1726102 - RNA, 16 nt, Human
caaacugaaacaaaau

SEQ ID NO: 1726103 - RNA, 19 nt, Human
uaccauuauggauaaagau

SEQ ID NO: 1726104 - RNA, 22 nt, Human
caaauuuacagagacagaaagc

SEQ ID NO: 1726105 - RNA, 17 nt, Human
auaucaauuuaaaaaaa

SEQ ID NO: 1726106 - RNA, 15 nt, Human
aaauauaaauaaaaa

SEQ ID NO: 1726107 - RNA, 15 nt, Human
agcucuaucaccaag

SEQ ID NO: 1726108 - RNA, 14 nt, Human
cccugccccccagc

SEQ ID NO: 1726109 - RNA, 20 nt, Human
uccagccugagcgacaguga

SEQ ID NO: 1726110 - RNA, 16 nt, Human
cuuggagacagggccc

SEQ ID NO: 1726111 - RNA, 18 nt, Human
acucuuaagaagacugca

SEQ ID NO: 1726112 - RNA, 22 nt, Human
acagauuugagcucagcccugg

SEQ ID NO: 1726113 - RNA, 12 nt, Human
ugagagacacac

SEQ ID NO: 1726114 - RNA, 17 nt, Human
uaaaagacaaggaaaaa

SEQ ID NO: 1726115 - RNA, 14 nt, Human
cagauuugagcuca

SEQ ID NO: 1726116 - RNA, 17 nt, Human
ucuuuaucuuuuuagua

SEQ ID NO: 1726117 - RNA, 20 nt, Human
aggcugagaugggagaauca

SEQ ID NO: 1726118 - RNA, 14 nt, Human
aaaagacagugaaa

SEQ ID NO: 1726119 - RNA, 16 nt, Human
ugcuaagucuuauaua

SEQ ID NO: 1726120 - RNA, 23 nt, Human
cccgcuccugguuggucacagaa

SEQ ID NO: 1726121 - RNA, 20 nt, Human
aauaucuuuuuuuuaauaaa

SEQ ID NO: 1726122 - RNA, 13 nt, Human
acaagaaggaaag

SEQ ID NO: 1726123 - RNA, 16 nt, Human
agaauauauuuccuua

SEQ ID NO: 1726124 - RNA, 16 nt, Human
augagcacgcauggaa

SEQ ID NO: 1726125 - RNA, 16 nt, Human
gaauauaaauuuauca

SEQ ID NO: 1726126 - RNA, 18 nt, Human
acaaauccaaugaaauga

SEQ ID NO: 1726127 - RNA, 23 nt, Human
caggaaucacuggcuguuaaucu

SEQ ID NO: 1726128 - RNA, 16 nt, Human
cugagcgacagugaga

SEQ ID NO: 1726129 - RNA, 13 nt, Human
guuguguguggaa

SEQ ID NO: 1726130 - RNA, 13 nt, Human
aaagaaaggagau

SEQ ID NO: 1726131 - RNA, 14 nt, Human
uucacauuuaaaua

SEQ ID NO: 1726132 - RNA, 13 nt, Human
aagugcagccccg

SEQ ID NO: 1726133 - RNA, 15 nt, Human
aagaagugaaaaucu

SEQ ID NO: 1726134 - RNA, 21 nt, Human
acaaagacaucgauugauaug

SEQ ID NO: 1726135 - RNA, 18 nt, Human
cacaaguaaaaggaaaug

SEQ ID NO: 1726136 - RNA, 23 nt, Human
gggagccugaucaccugcccugc

SEQ ID NO: 1726137 - RNA, 13 nt, Human
cuauuauauuucc

SEQ ID NO: 1726138 - RNA, 21 nt, Human
aauuuacagagacagaaagca

SEQ ID NO: 1726139 - RNA, 12 nt, Human
uaagaagacugc

SEQ ID NO: 1726140 - RNA, 13 nt, Human
uacagagacagaa

SEQ ID NO: 1726141 - RNA, 17 nt, Human
uuaauaauuuuuaauua

SEQ ID NO: 1726142 - RNA, 17 nt, Human
cuucuagcagugagcca

SEQ ID NO: 1726143 - RNA, 23 nt, Human
uaagaaauaggaaauauuuuaau

SEQ ID NO: 1726144 - RNA, 11 nt, Human
aacaaggaagg

SEQ ID NO: 1726145 - RNA, 15 nt, Human
auagaaguaaaaaca

SEQ ID NO: 1726146 - RNA, 16 nt, Human
aggccaugggacaggg

SEQ ID NO: 1726147 - RNA, 20 nt, Human
auuuccuuauucagaauuuc

SEQ ID NO: 1726148 - RNA, 17 nt, Human
aucauuuacuuuuaaac

SEQ ID NO: 1726149 - RNA, 14 nt, Human
agagaauuuccuua

SEQ ID NO: 1726150 - RNA, 13 nt, Human
uuaaaaaagaaac

SEQ ID NO: 1726151 - RNA, 18 nt, Human
cccucuggcuccagcugg

SEQ ID NO: 1726152 - RNA, 22 nt, Human
agugagcagucaggaaagagaa

SEQ ID NO: 1726153 - RNA, 16 nt, Human
uuccuuacucuugauu

SEQ ID NO: 1726154 - RNA, 17 nt, Human
ucuggaggucucugaac

SEQ ID NO: 1726155 - RNA, 15 nt, Human
aauauaaauaaaaau

SEQ ID NO: 1726156 - RNA, 15 nt, Human
uauaaauaaaaauaa

SEQ ID NO: 1726157 - RNA, 19 nt, Human
uggaacaguuaccucugcc

SEQ ID NO: 1726158 - RNA, 19 nt, Human
agacagugaaagaaaauaa

SEQ ID NO: 1726159 - RNA, 17 nt, Human
ggcacaacacaucagga

SEQ ID NO: 1726160 - RNA, 18 nt, Human
cauagguuuaauaauuuu

SEQ ID NO: 1726161 - RNA, 16 nt, Human
agauagaugaagaagc

SEQ ID NO: 1726162 - RNA, 20 nt, Human
acaugagguacugagaguga

SEQ ID NO: 1726163 - RNA, 13 nt, Human
aacaauaaaagac

SEQ ID NO: 1726164 - RNA, 14 nt, Human
cuuucauaauaagu

SEQ ID NO: 1726165 - RNA, 17 nt, Human
agcuacuaauuuuaaaa

SEQ ID NO: 1726166 - RNA, 13 nt, Human
uuuaacuccugcu

SEQ ID NO: 1726167 - RNA, 12 nt, Human
gcaaagcccagc

SEQ ID NO: 1726168 - RNA, 12 nt, Human
caaccugccagc

SEQ ID NO: 1726169 - RNA, 16 nt, Human
acaugucuagagaaca

SEQ ID NO: 1726170 - RNA, 17 nt, Human
aaucuuauaauuuaaaa

SEQ ID NO: 1726171 - RNA, 18 nt, Human
ggaugggaacaaggaagg

SEQ ID NO: 1726172 - RNA, 16 nt, Human
acauccuacaagacac

SEQ ID NO: 1726173 - RNA, 16 nt, Human
ucuucucagaaggaaa

SEQ ID NO: 1726174 - RNA, 12 nt, Human
uaguacacacuu

SEQ ID NO: 1726175 - RNA, 14 nt, Human
uugcuggagcucug

SEQ ID NO: 1726176 - RNA, 17 nt, Human
cugagcgacagugagac

SEQ ID NO: 1726177 - RNA, 18 nt, Human
gccccugcacuccagccu

SEQ ID NO: 1726178 - RNA, 13 nt, Human
ucuacuaaaaaua

SEQ ID NO: 1726179 - RNA, 17 nt, Human
cuaaggcaggaggauca

SEQ ID NO: 1726180 - RNA, 16 nt, Human
ugagccccggaggucg

SEQ ID NO: 1726181 - RNA, 18 nt, Human
agccugaucaccugcccu

SEQ ID NO: 1726182 - RNA, 16 nt, Human
auacuauuuaauuauu

SEQ ID NO: 1726183 - RNA, 19 nt, Human
cucuugaggcacagaaacu

SEQ ID NO: 1726184 - RNA, 19 nt, Human
gcacuaguauuucuaugaa

SEQ ID NO: 1726185 - RNA, 18 nt, Human
auccccaagccuggcaag

SEQ ID NO: 1726186 - RNA, 16 nt, Human
gauuuaaggccaggca

SEQ ID NO: 1726187 - RNA, 22 nt, Human
uuugaaacgaggauugggaaaa

SEQ ID NO: 1726188 - RNA, 16 nt, Human
agugucaaugcagccc

SEQ ID NO: 1726189 - RNA, 14 nt, Human
cacaacacacagau

SEQ ID NO: 1726190 - RNA, 21 nt, Human
caagacugcacaucaaaauau

SEQ ID NO: 1726191 - RNA, 22 nt, Human
gauaagagauguugacucuaaa

SEQ ID NO: 1726192 - RNA, 17 nt, Human
caaagagaaagaggguu

SEQ ID NO: 1726193 - RNA, 14 nt, Human
aaaagaaacauuug

SEQ ID NO: 1726194 - RNA, 14 nt, Human
uaaagaaacaaaaa

SEQ ID NO: 1726195 - RNA, 14 nt, Human
uaaauuuaucauuu

SEQ ID NO: 1726196 - RNA, 11 nt, Human
auggauaaaga

SEQ ID NO: 1726197 - RNA, 15 nt, Human
aauuauuucacuuua

SEQ ID NO: 1726198 - RNA, 20 nt, Human
gagcaucaucuucuggguua

SEQ ID NO: 1726199 - RNA, 15 nt, Human
aagccuccuuuuaaa

SEQ ID NO: 1726200 - RNA, 18 nt, Human
auauuucuguuaaaauau

SEQ ID NO: 1726201 - RNA, 16 nt, Human
acaccaaccuucugag

SEQ ID NO: 1726202 - RNA, 15 nt, Human
aaaaaauaacaauga

SEQ ID NO: 1726203 - RNA, 21 nt, Human
acagcccuucuuuccacagaa

SEQ ID NO: 1726204 - RNA, 13 nt, Human
aguguuugaaagc

SEQ ID NO: 1726205 - RNA, 18 nt, Human
uuccaagaaauauuccuu

SEQ ID NO: 1726206 - RNA, 15 nt, Human
gcaacccaaauguuc

SEQ ID NO: 1726207 - RNA, 18 nt, Human
gaggcuccacuuggucug

SEQ ID NO: 1726208 - RNA, 21 nt, Human
cccuagaaagccaugugcagc

SEQ ID NO: 1726209 - RNA, 15 nt, Human
cugaggcaggaggau

SEQ ID NO: 1726210 - RNA, 22 nt, Human
uucuaugcuuguaacugucuuc

SEQ ID NO: 1726211 - RNA, 22 nt, Human
agucuuucacauuuaaauaaag

SEQ ID NO: 1726212 - RNA, 12 nt, Human
uacuauuuaauu

SEQ ID NO: 1726213 - RNA, 15 nt, Human
gauccugcaauucca

SEQ ID NO: 1726214 - RNA, 18 nt, Human
uguauuauuuuuuaaaaa

SEQ ID NO: 1726215 - RNA, 23 nt, Human
uaucuauguagaauauauuuccu

SEQ ID NO: 1726216 - RNA, 19 nt, Human
ugagcgcccacuagaccca

SEQ ID NO: 1726217 - RNA, 19 nt, Human
aaaggaaggaagggacaca

SEQ ID NO: 1726218 - RNA, 12 nt, Human
aauaauuuuuaa

SEQ ID NO: 1726219 - RNA, 14 nt, Human
agcguuaauguaaa

SEQ ID NO: 1726220 - RNA, 20 nt, Human
agaugcaguucugaagaaga

SEQ ID NO: 1726221 - RNA, 19 nt, Human
agaugagagaacagggcug

SEQ ID NO: 1726222 - RNA, 15 nt, Human
cuacaagacacagug

SEQ ID NO: 1726223 - RNA, 16 nt, Human
gauuaagaaaggaagu

SEQ ID NO: 1726224 - RNA, 23 nt, Human
caacggggugaaacccugucucu

SEQ ID NO: 1726225 - RNA, 14 nt, Human
caagaaggaaagau

SEQ ID NO: 1726226 - RNA, 22 nt, Human
ccuuccccucugcagcuuccag

SEQ ID NO: 1726227 - RNA, 21 nt, Human
cccccauuguggucacaggaa

SEQ ID NO: 1726228 - RNA, 22 nt, Human
uggaaaguuuaugguuguauua

SEQ ID NO: 1726229 - RNA, 16 nt, Human
ucaucaaugaaugaau

SEQ ID NO: 1726230 - RNA, 13 nt, Human
auagugagacacu

SEQ ID NO: 1726231 - RNA, 23 nt, Human
cacaagaaaugaaagcagggacu

SEQ ID NO: 1726232 - RNA, 13 nt, Human
cacacugaagaag

SEQ ID NO: 1726233 - RNA, 17 nt, Human
ugcauuuuggaaggcug

SEQ ID NO: 1726234 - RNA, 16 nt, Human
cugcugagccccaagu

SEQ ID NO: 1726235 - RNA, 20 nt, Human
cugagccucagucucccucc

SEQ ID NO: 1726236 - RNA, 22 nt, Human
aggcacaguggcucacaccugu

SEQ ID NO: 1726237 - RNA, 17 nt, Human
uuacagagacagaaagc

SEQ ID NO: 1726238 - RNA, 13 nt, Human
cugaagcuguguc

SEQ ID NO: 1726239 - RNA, 16 nt, Human
aacagauuucaaaaaa

SEQ ID NO: 1726240 - RNA, 22 nt, Human
gaaaaucuuauaauuuaaaaua

SEQ ID NO: 1726241 - RNA, 15 nt, Human
ggcuggcgugcagca

SEQ ID NO: 1726242 - RNA, 12 nt, Human
agggcaagagag

SEQ ID NO: 1726243 - RNA, 16 nt, Human
gacauugaggcaggca

SEQ ID NO: 1726244 - RNA, 14 nt, Human
uccacaacacacag

SEQ ID NO: 1726245 - RNA, 16 nt, Human
gagcaucaucuucugg

SEQ ID NO: 1726246 - RNA, 14 nt, Human
aagaagugaaaauc

SEQ ID NO: 1726247 - RNA, 16 nt, Human
ucagucucccucccuu

SEQ ID NO: 1726248 - RNA, 17 nt, Human
aucaaggguacacugcc

SEQ ID NO: 1726249 - RNA, 18 nt, Human
acuguuaucuucacuuuu

SEQ ID NO: 1726250 - RNA, 12 nt, Human
agacaucuggaa

SEQ ID NO: 1726251 - RNA, 16 nt, Human
gacuauuauauuucca

SEQ ID NO: 1726252 - RNA, 22 nt, Human
cugcuggagacauugaggcagg

SEQ ID NO: 1726253 - RNA, 21 nt, Human
auauuuccuuauucagaauuu

SEQ ID NO: 1726254 - RNA, 14 nt, Human
cuaagcauuccaac

SEQ ID NO: 1726255 - RNA, 18 nt, Human
cuguuuucccuccuugga

SEQ ID NO: 1726256 - RNA, 13 nt, Human
uauuuauuuuaau

SEQ ID NO: 1726257 - RNA, 13 nt, Human
uuuaaaaaagaaa

SEQ ID NO: 1726258 - RNA, 13 nt, Human
ugaaaaucuuaua

SEQ ID NO: 1726259 - RNA, 14 nt, Human
cugaggcuccacuu

SEQ ID NO: 1726260 - RNA, 16 nt, Human
ugaaauuguauuacaa

SEQ ID NO: 1726261 - RNA, 19 nt, Human
agcguugagccaccaagcu

SEQ ID NO: 1726262 - RNA, 22 nt, Human
cuuguacucugaaaguuuugga

SEQ ID NO: 1726263 - RNA, 13 nt, Human
gauuguaaaaugg

SEQ ID NO: 1726264 - RNA, 13 nt, Human
aaaggaaggaagg

SEQ ID NO: 1726265 - RNA, 17 nt, Human
agaggcaaagaaaggag

SEQ ID NO: 1726266 - RNA, 14 nt, Human
guaacugauuugua

SEQ ID NO: 1726267 - RNA, 20 nt, Human
uuucuucaacucccugcccc

SEQ ID NO: 1726268 - RNA, 15 nt, Human
gacucaccuccccca

SEQ ID NO: 1726269 - RNA, 19 nt, Human
gucaaucagccuaguugau

SEQ ID NO: 1726270 - RNA, 15 nt, Human
cuggaaacacauguu

SEQ ID NO: 1726271 - RNA, 18 nt, Human
ugaagcuguguccucaug

SEQ ID NO: 1726272 - RNA, 17 nt, Human
aacaaaaaucaaacuuu

SEQ ID NO: 1726273 - RNA, 18 nt, Human
aucuggcucuggacaggc

SEQ ID NO: 1726274 - RNA, 14 nt, Human
cucccuuggggccu

SEQ ID NO: 1726275 - RNA, 20 nt, Human
uuccacagaagcuccaggua

SEQ ID NO: 1726276 - RNA, 20 nt, Human
uagaugcaguucugaagaag

SEQ ID NO: 1726277 - RNA, 18 nt, Human
ccuucggccuccauccug

SEQ ID NO: 1726278 - RNA, 17 nt, Human
agacagugaaagaaaau

SEQ ID NO: 1726279 - RNA, 15 nt, Human
uuccaagaaauauuc

SEQ ID NO: 1726280 - RNA, 22 nt, Human
agcuuguauuccuuuuucucuc

SEQ ID NO: 1726281 - RNA, 19 nt, Human
ccccucuggcuccagcugg

SEQ ID NO: 1726282 - RNA, 18 nt, Human
uaugaggcuacagaacua

SEQ ID NO: 1726283 - RNA, 16 nt, Human
guuuuuuuuuaaaaaa

SEQ ID NO: 1726284 - RNA, 14 nt, Human
agagguccacaaca

SEQ ID NO: 1726285 - RNA, 22 nt, Human
cugcucaauaaaguacaagagc

SEQ ID NO: 1726286 - RNA, 12 nt, Human
cuuuaucuuuuu

SEQ ID NO: 1726287 - RNA, 17 nt, Human
gacucaccucccccauc

SEQ ID NO: 1726288 - RNA, 15 nt, Human
cucguggaacaguua

SEQ ID NO: 1726289 - RNA, 19 nt, Human
auuuaguuauaaaaauaua

SEQ ID NO: 1726290 - RNA, 13 nt, Human
auugaggcaggca

SEQ ID NO: 1726291 - RNA, 22 nt, Human
accaaucaugaauuaguuuuau

SEQ ID NO: 1726292 - RNA, 19 nt, Human
gccccccagcccuccuuau

SEQ ID NO: 1726293 - RNA, 11 nt, Human
uuauauuuauu

SEQ ID NO: 1726294 - RNA, 20 nt, Human
cuauguagaauauauuuccu

SEQ ID NO: 1726295 - RNA, 15 nt, Human
auaucuuaucuuccu

SEQ ID NO: 1726296 - RNA, 12 nt, Human
agugcagccccg

SEQ ID NO: 1726297 - RNA, 19 nt, Human
guccaggucuaccaaaaau

SEQ ID NO: 1726298 - RNA, 16 nt, Human
aauuucuucaacuccc

SEQ ID NO: 1726299 - RNA, 13 nt, Human
ccugccccccagc

SEQ ID NO: 1726300 - RNA, 15 nt, Human
caagcucacagaccu

SEQ ID NO: 1726301 - RNA, 14 nt, Human
caccaaccuucuga

SEQ ID NO: 1726302 - RNA, 17 nt, Human
caaaacuuauuggaaug

SEQ ID NO: 1726303 - RNA, 16 nt, Human
acuaaacaaagaguga

SEQ ID NO: 1726304 - RNA, 21 nt, Human
caaagcccagcuugaaaccuu

SEQ ID NO: 1726305 - RNA, 18 nt, Human
gcaaagcccagcuugaaa

SEQ ID NO: 1726306 - RNA, 18 nt, Human
caagccucauguccacug

SEQ ID NO: 1726307 - RNA, 16 nt, Human
ugcauagguuuaauaa

SEQ ID NO: 1726308 - RNA, 11 nt, Human
acuuugaagag

SEQ ID NO: 1726309 - RNA, 19 nt, Human
aagcuaugugagcucacca

SEQ ID NO: 1726310 - RNA, 21 nt, Human
cuaaauugacacuuaaaaaug

SEQ ID NO: 1726311 - RNA, 22 nt, Human
uuuuauagcuacuaauuuuaaa

SEQ ID NO: 1726312 - RNA, 14 nt, Human
auauauuuuagaua

SEQ ID NO: 1726313 - RNA, 17 nt, Human
gucucagcuucacccug

SEQ ID NO: 1726314 - RNA, 22 nt, Human
aauuccuaccucuucaccugac

SEQ ID NO: 1726315 - RNA, 15 nt, Human
aauuuaucauuuagu

SEQ ID NO: 1726316 - RNA, 13 nt, Human
aaggcaggaggau

SEQ ID NO: 1726317 - RNA, 24 nt, Human
cauaugaaaaggcuaagcuucacu

SEQ ID NO: 1726318 - RNA, 19 nt, Human
cucaccucccccaucucuu

SEQ ID NO: 1726319 - RNA, 18 nt, Human
agcugcucaauaaaguac

SEQ ID NO: 1726320 - RNA, 12 nt, Human
caagaaggaaag

SEQ ID NO: 1726321 - RNA, 22 nt, Human
ugaaaaaguucugcagauaaac

SEQ ID NO: 1726322 - RNA, 13 nt, Human
uuaugcuaaguga

SEQ ID NO: 1726323 - RNA, 14 nt, Human
gcaaagcccagcuu

SEQ ID NO: 1726324 - RNA, 19 nt, Human
guacugagagugaacaaau

SEQ ID NO: 1726325 - RNA, 13 nt, Human
ucucagggcagau

SEQ ID NO: 1726326 - RNA, 18 nt, Human
gaagcaccaaucaugaau

SEQ ID NO: 1726327 - RNA, 13 nt, Human
ggacaaaaggaau

SEQ ID NO: 1726328 - RNA, 15 nt, Human
ucgaggcuacaguga

SEQ ID NO: 1726329 - RNA, 15 nt, Human
cauguccacugguuc

SEQ ID NO: 1726330 - RNA, 15 nt, Human
cccaucucaggugug

SEQ ID NO: 1726331 - RNA, 17 nt, Human
ugaaauauuauuuuaua

SEQ ID NO: 1726332 - RNA, 14 nt, Human
ggagauacagugga

SEQ ID NO: 1726333 - RNA, 12 nt, Human
aguuauaaaaau

SEQ ID NO: 1726334 - RNA, 17 nt, Human
aaauaacgauaaaagac

SEQ ID NO: 1726335 - RNA, 21 nt, Human
gcuggccaccugcugagcccc

SEQ ID NO: 1726336 - RNA, 13 nt, Human
ccuuugcaccucc

SEQ ID NO: 1726337 - RNA, 11 nt, Human
accauuuuuac

SEQ ID NO: 1726338 - RNA, 15 nt, Human
aggcaccucucuggg

SEQ ID NO: 1726339 - RNA, 16 nt, Human
ccuacaugagguacug

SEQ ID NO: 1726340 - RNA, 17 nt, Human
uuauaucaauuuaaaaa

SEQ ID NO: 1726341 - RNA, 16 nt, Human
caggcugagccucagu

SEQ ID NO: 1726342 - RNA, 16 nt, Human
aauuacauuuguauaa

SEQ ID NO: 1726343 - RNA, 22 nt, Human
cacuuccaagagccuuuuuuug

SEQ ID NO: 1726344 - RNA, 22 nt, Human
gugccucaccccuugccauaau

SEQ ID NO: 1726345 - RNA, 20 nt, Human
uuacaaauccaaugaaauga

SEQ ID NO: 1726346 - RNA, 23 nt, Human
auuauauggcuugaguuuaaauu

SEQ ID NO: 1726347 - RNA, 15 nt, Human
ccacaggaaccacaa

SEQ ID NO: 1726348 - RNA, 17 nt, Human
uaaaagacagugaaaga

SEQ ID NO: 1726349 - RNA, 17 nt, Human
uaaauuuaucauuuagu

SEQ ID NO: 1726350 - RNA, 14 nt, Human
gccucagucucccu

SEQ ID NO: 1726351 - RNA, 16 nt, Human
gaauggcuaagcaaaa

SEQ ID NO: 1726352 - RNA, 21 nt, Human
cagugagacagcucugcauac

SEQ ID NO: 1726353 - RNA, 13 nt, Human
aucaaugaaugaa

SEQ ID NO: 1726354 - RNA, 19 nt, Human
ucuguuuucccuccuugga

SEQ ID NO: 1726355 - RNA, 22 nt, Human
uauccuacuuccccuuccuaau

SEQ ID NO: 1726356 - RNA, 19 nt, Human
caugaguaacugauuugua

SEQ ID NO: 1726357 - RNA, 17 nt, Human
agcgacagugagacucu

SEQ ID NO: 1726358 - RNA, 17 nt, Human
ggcucuggacaggcacu

SEQ ID NO: 1726359 - RNA, 17 nt, Human
uguucuaagaagugaaa

SEQ ID NO: 1726360 - RNA, 19 nt, Human
ucccucccaaguaaauguu

SEQ ID NO: 1726361 - RNA, 19 nt, Human
caagagagcgagacccugu

SEQ ID NO: 1726362 - RNA, 16 nt, Human
gccaaggaugccccgu

SEQ ID NO: 1726363 - RNA, 20 nt, Human
acuaaauugacacuuaaaaa

SEQ ID NO: 1726364 - RNA, 17 nt, Human
uaugcuaagugaaauaa

SEQ ID NO: 1726365 - RNA, 12 nt, Human
gucccaggcuga

SEQ ID NO: 1726366 - RNA, 14 nt, Human
acaagagcuuaaca

SEQ ID NO: 1726367 - RNA, 15 nt, Human
aaaagacaaggaaaa

SEQ ID NO: 1726368 - RNA, 21 nt, Human
aagcuccauuuuuagugaaau

SEQ ID NO: 1726369 - RNA, 13 nt, Human
ucuauaauuuaaa

SEQ ID NO: 1726370 - RNA, 15 nt, Human
aauucugaaagcaac

SEQ ID NO: 1726371 - RNA, 21 nt, Human
gccaaauauaaauaaaaauaa

SEQ ID NO: 1726372 - RNA, 15 nt, Human
uggauuccucacuuu

SEQ ID NO: 1726373 - RNA, 15 nt, Human
gcuguuaaucuuuca

SEQ ID NO: 1726374 - RNA, 11 nt, Human
ccugagcccca

SEQ ID NO: 1726375 - RNA, 14 nt, Human
aggggcagcagugc

SEQ ID NO: 1726376 - RNA, 20 nt, Human
ugguuguauuauuuuuuaaa

SEQ ID NO: 1726377 - RNA, 21 nt, Human
gcugagucccaggcugagccu

SEQ ID NO: 1726378 - RNA, 13 nt, Human
aagacagugaaag

SEQ ID NO: 1726379 - RNA, 21 nt, Human
ggagacauugaggcaggcacu

SEQ ID NO: 1726380 - RNA, 23 nt, Human
aggugaucuggcucuggacaggc

SEQ ID NO: 1726381 - RNA, 16 nt, Human
uaggauguugaaaaag

SEQ ID NO: 1726382 - RNA, 16 nt, Human
ccuccuuuuaaaguaa

SEQ ID NO: 1726383 - RNA, 17 nt, Human
aacaguuaccucugccu

SEQ ID NO: 1726384 - RNA, 14 nt, Human
cuauuauauuucca

SEQ ID NO: 1726385 - RNA, 15 nt, Human
aagaaggaaagauuu

SEQ ID NO: 1726386 - RNA, 12 nt, Human
aucauuuacuuu

SEQ ID NO: 1726387 - RNA, 12 nt, Human
gcugaugcaguu

SEQ ID NO: 1726388 - RNA, 18 nt, Human
aaaguaacccuacaaaac

SEQ ID NO: 1726389 - RNA, 19 nt, Human
ccccugagcuugcagagau

SEQ ID NO: 1726390 - RNA, 14 nt, Human
aaaaaaggaaggaa

SEQ ID NO: 1726391 - RNA, 13 nt, Human
acuguaaaauaau

SEQ ID NO: 1726392 - RNA, 15 nt, Human
uuggggaauauguua

SEQ ID NO: 1726393 - RNA, 17 nt, Human
uucugagcauuuaauau

SEQ ID NO: 1726394 - RNA, 18 nt, Human
augauguuucauaagaau

SEQ ID NO: 1726395 - RNA, 14 nt, Human
ggcaauagucaaau

SEQ ID NO: 1726396 - RNA, 19 nt, Human
agaaaauaacaauaaaaga

SEQ ID NO: 1726397 - RNA, 16 nt, Human
guugagguaccuccaa

SEQ ID NO: 1726398 - RNA, 23 nt, Human
gauagauaggucagugcaaauac

SEQ ID NO: 1726399 - RNA, 20 nt, Human
acagaacuaaaaauuaaaac

SEQ ID NO: 1726400 - RNA, 17 nt, Human
caaauccaaugaaauga

SEQ ID NO: 1726401 - RNA, 13 nt, Human
uggcuccagcugg

SEQ ID NO: 1726402 - RNA, 18 nt, Human
uacaugucuagagaacac

SEQ ID NO: 1726403 - RNA, 16 nt, Human
ucuuauaauuuaaaau

SEQ ID NO: 1726404 - RNA, 21 nt, Human
acacugucucuaccaaaaaaa

SEQ ID NO: 1726405 - RNA, 17 nt, Human
ggccaugggacagggag

SEQ ID NO: 1726406 - RNA, 18 nt, Human
uuacaaaugggaaacaaa

SEQ ID NO: 1726407 - RNA, 23 nt, Human
uuuguauaaaauaauuuuuauau

SEQ ID NO: 1726408 - RNA, 12 nt, Human
gccccugagccc

SEQ ID NO: 1726409 - RNA, 21 nt, Human
auucauagcagcuuauucaca

SEQ ID NO: 1726410 - RNA, 17 nt, Human
acaagaaaugaaagcag

SEQ ID NO: 1726411 - RNA, 21 nt, Human
acaguuaccucugccucagaa

SEQ ID NO: 1726412 - RNA, 15 nt, Human
ucugucucaguccau

SEQ ID NO: 1726413 - RNA, 17 nt, Human
uauauuuccaagaaaua

SEQ ID NO: 1726414 - RNA, 14 nt, Human
gagagugaacaaau

SEQ ID NO: 1726415 - RNA, 17 nt, Human
guggggcuaaggcagga

SEQ ID NO: 1726416 - RNA, 16 nt, Human
gucuucaggggccaca

SEQ ID NO: 1726417 - RNA, 20 nt, Human
gcuggagacauugaggcagg

SEQ ID NO: 1726418 - RNA, 23 nt, Human
agcccuccuuaucaaaggacacc

SEQ ID NO: 1726419 - RNA, 23 nt, Human
uugauuuuauaugcuauuuauua

SEQ ID NO: 1726420 - RNA, 15 nt, Human
ccucauguccacugg

SEQ ID NO: 1726421 - RNA, 23 nt, Human
auuuuagauagaugaagaagcua

SEQ ID NO: 1726422 - RNA, 15 nt, Human
aaaucaaacuuuaca

SEQ ID NO: 1726423 - RNA, 23 nt, Human
gaaaacaauaacgauaaaagaca

SEQ ID NO: 1726424 - RNA, 20 nt, Human
ucaagucuuucacauuuaaa

SEQ ID NO: 1726425 - RNA, 14 nt, Human
aguuuuuuuuuaaa

SEQ ID NO: 1726426 - RNA, 14 nt, Human
ugcuucuguuuuau

SEQ ID NO: 1726427 - RNA, 14 nt, Human
uggcucugugugcu

SEQ ID NO: 1726428 - RNA, 18 nt, Human
uauauuuccuuauucaga

SEQ ID NO: 1726429 - RNA, 15 nt, Human
ugagcucaccagucc

SEQ ID NO: 1726430 - RNA, 18 nt, Human
agaagcaacccaaauguu

SEQ ID NO: 1726431 - RNA, 13 nt, Human
augcuagaacucc

SEQ ID NO: 1726432 - RNA, 14 nt, Human
agaaaauaacaaua

SEQ ID NO: 1726433 - RNA, 17 nt, Human
agaaucacuugaacccg

SEQ ID NO: 1726434 - RNA, 18 nt, Human
auaggaaauauuuuaaug

SEQ ID NO: 1726435 - RNA, 13 nt, Human
cccuccuuaucaa

SEQ ID NO: 1726436 - RNA, 22 nt, Human
caccagucugacuguuuccauc

SEQ ID NO: 1726437 - RNA, 22 nt, Human
ccgggaggcagagguugcagug

SEQ ID NO: 1726438 - RNA, 20 nt, Human
uuaaugccacuaaauugaca

SEQ ID NO: 1726439 - RNA, 16 nt, Human
aaauaacaaugaaagu

SEQ ID NO: 1726440 - RNA, 22 nt, Human
agcacagccucuuagaugcagu

SEQ ID NO: 1726441 - RNA, 14 nt, Human
agaauucauucacu

SEQ ID NO: 1726442 - RNA, 15 nt, Human
aaggguacacugccu

SEQ ID NO: 1726443 - RNA, 14 nt, Human
ccccugagcuugca

SEQ ID NO: 1726444 - RNA, 13 nt, Human
augauuccaccua

SEQ ID NO: 1726445 - RNA, 12 nt, Human
ccagucccuccc

SEQ ID NO: 1726446 - RNA, 13 nt, Human
uuuuauaugcuau

SEQ ID NO: 1726447 - RNA, 16 nt, Human
uaaaagacaaggaaaa

SEQ ID NO: 1726448 - RNA, 24 nt, Human
ugucuugaauuguaggugacuauu

SEQ ID NO: 1726449 - RNA, 15 nt, Human
aaaacaggcaaauuc

SEQ ID NO: 1726450 - RNA, 20 nt, Human
uaacaagccuccuuuuaaag

SEQ ID NO: 1726451 - RNA, 21 nt, Human
ccagccuggucaacauaguga

SEQ ID NO: 1726452 - RNA, 14 nt, Human
gcuggagcucugcc

SEQ ID NO: 1726453 - RNA, 13 nt, Human
ugaaauuguauua

SEQ ID NO: 1726454 - RNA, 23 nt, Human
uguucccuggggcuuuaacuccu

SEQ ID NO: 1726455 - RNA, 22 nt, Human
gcagaugaugcuuugagaacau

SEQ ID NO: 1726456 - RNA, 19 nt, Human
acucugucucaguccauga

SEQ ID NO: 1726457 - RNA, 16 nt, Human
aaauauuuauuuuaau

SEQ ID NO: 1726458 - RNA, 22 nt, Human
gucaagaucagccugggcaaca

SEQ ID NO: 1726459 - RNA, 16 nt, Human
ucaaacuuuacagaaa

SEQ ID NO: 1726460 - RNA, 15 nt, Human
aauacaaaaacuuag

SEQ ID NO: 1726461 - RNA, 23 nt, Human
cugaaaucauacuucuuaggguu

SEQ ID NO: 1726462 - RNA, 14 nt, Human
cucaccagucccuc

SEQ ID NO: 1726463 - RNA, 18 nt, Human
uuguacucugaaaguuuu

SEQ ID NO: 1726464 - RNA, 12 nt, Human
aguguuugaaag

SEQ ID NO: 1726465 - RNA, 14 nt, Human
uugggaaaaaguaa

SEQ ID NO: 1726466 - RNA, 14 nt, Human
cauuuacuuuuaaa

SEQ ID NO: 1726467 - RNA, 15 nt, Human
cuccacuggaaaacu

SEQ ID NO: 1726468 - RNA, 17 nt, Human
ugucuucaggggccaca

SEQ ID NO: 1726469 - RNA, 15 nt, Human
ugggacagggaggac

SEQ ID NO: 1726470 - RNA, 21 nt, Human
auggcagcuuuccucaaaacu

SEQ ID NO: 1726471 - RNA, 22 nt, Human
aagaugagaugguuucuagaga

SEQ ID NO: 1726472 - RNA, 18 nt, Human
auucugguagcuaaauau

SEQ ID NO: 1726473 - RNA, 18 nt, Human
uaauuuuagacauucuuu

SEQ ID NO: 1726474 - RNA, 15 nt, Human
aguuuauauagaaau

SEQ ID NO: 1726475 - RNA, 14 nt, Human
ggccuucggccucc

SEQ ID NO: 1726476 - RNA, 22 nt, Human
auguccuuggugccuggagccu

SEQ ID NO: 1726477 - RNA, 15 nt, Human
agcaccaucauuccc

SEQ ID NO: 1726478 - RNA, 21 nt, Human
ccauaccccuggccaaggaag

SEQ ID NO: 1726479 - RNA, 14 nt, Human
gcuggcgugcagca

SEQ ID NO: 1726480 - RNA, 16 nt, Human
cgcauggaaaaguuuc

SEQ ID NO: 1726481 - RNA, 19 nt, Human
cugccagaaucuagagcaa

SEQ ID NO: 1726482 - RNA, 16 nt, Human
uguucuaagaagugaa

SEQ ID NO: 1726483 - RNA, 14 nt, Human
uauaauuuaaaaua

SEQ ID NO: 1726484 - RNA, 14 nt, Human
auuauuuuuuaaaa

SEQ ID NO: 1726485 - RNA, 12 nt, Human
uaaauauauauu

SEQ ID NO: 1726486 - RNA, 15 nt, Human
cucccugccccccag

SEQ ID NO: 1726487 - RNA, 21 nt, Human
ugucucuaccaaaaaaaggaa

SEQ ID NO: 1726488 - RNA, 15 nt, Human
uugcucauggaauug

SEQ ID NO: 1726489 - RNA, 12 nt, Human
ucaccccuugcc

SEQ ID NO: 1726490 - RNA, 18 nt, Human
ucuauguagaauauauuu

SEQ ID NO: 1726491 - RNA, 16 nt, Human
acuguauguccuuggu

SEQ ID NO: 1726492 - RNA, 13 nt, Human
aaaauaacgauaa

SEQ ID NO: 1726493 - RNA, 16 nt, Human
aagaaauauuccuuaa

SEQ ID NO: 1726494 - RNA, 19 nt, Human
aaagacagugaaagaaaau

SEQ ID NO: 1726495 - RNA, 13 nt, Human
gcuggagcucugc

SEQ ID NO: 1726496 - RNA, 14 nt, Human
uauauuuccuuauu

SEQ ID NO: 1726497 - RNA, 14 nt, Human
uauauauuuuagau

SEQ ID NO: 1726498 - RNA, 17 nt, Human
uuccaagccucaugucc

SEQ ID NO: 1726499 - RNA, 19 nt, Human
gcacacagcacgggggcca

SEQ ID NO: 1726500 - RNA, 22 nt, Human
cucagcuucacccugaggugag

SEQ ID NO: 1726501 - RNA, 15 nt, Human
uggcuaauuagcaug

SEQ ID NO: 1726502 - RNA, 13 nt, Human
ucucccucccuug

SEQ ID NO: 1726503 - RNA, 23 nt, Human
caucucuucuggguuccuuccuc

SEQ ID NO: 1726504 - RNA, 14 nt, Human
ugguauguuuucag

SEQ ID NO: 1726505 - RNA, 13 nt, Human
gcucucuggccuu

SEQ ID NO: 1726506 - RNA, 14 nt, Human
aggaaagaugugaa

SEQ ID NO: 1726507 - RNA, 16 nt, Human
gucuguuuucccuccu

SEQ ID NO: 1726508 - RNA, 15 nt, Human
cucaacaaacauaau

SEQ ID NO: 1726509 - RNA, 20 nt, Human
agagacacacugaagaagca

SEQ ID NO: 1726510 - RNA, 16 nt, Human
uagaaaacaggcaaau

SEQ ID NO: 1726511 - RNA, 21 nt, Human
aaaagguauuuuaaucaccaa

SEQ ID NO: 1726512 - RNA, 22 nt, Human
cugggacaggggagaaccuagg

SEQ ID NO: 1726513 - RNA, 19 nt, Human
uguuugccgcuuaagcuuu

SEQ ID NO: 1726514 - RNA, 14 nt, Human
uugauggaaauaca

SEQ ID NO: 1726515 - RNA, 14 nt, Human
acuuugauuuuaua

SEQ ID NO: 1726516 - RNA, 13 nt, Human
uacuuuauuuucu

SEQ ID NO: 1726517 - RNA, 19 nt, Human
ugcacacagcacgggggcc

SEQ ID NO: 1726518 - RNA, 11 nt, Human
ccacaucugag

SEQ ID NO: 1726519 - RNA, 23 nt, Human
ggauguggggaaguuaggaacug

SEQ ID NO: 1726520 - RNA, 19 nt, Human
aacugaaacaaaauuagaa

SEQ ID NO: 1726521 - RNA, 18 nt, Human
ccuuccuaauuccacagc

SEQ ID NO: 1726522 - RNA, 17 nt, Human
ugaugcuuugagaacau

SEQ ID NO: 1726523 - RNA, 17 nt, Human
gcaucuccucaacucug

SEQ ID NO: 1726524 - RNA, 21 nt, Human
gaaagcagggacuugaaccca

SEQ ID NO: 1726525 - RNA, 15 nt, Human
acagugaaagaaaau

SEQ ID NO: 1726526 - RNA, 14 nt, Human
uacaugucuagaga

SEQ ID NO: 1726527 - RNA, 19 nt, Human
uuauggcacuaguauuucu

SEQ ID NO: 1726528 - RNA, 19 nt, Human
augaaagcagggacuugaa

SEQ ID NO: 1726529 - RNA, 12 nt, Human
aaagaaacaaaa

SEQ ID NO: 1726530 - RNA, 12 nt, Human
agaaucuagagc

SEQ ID NO: 1726531 - RNA, 13 nt, Human
caacaucuaguga

SEQ ID NO: 1726532 - RNA, 20 nt, Human
ccagcuugaaaccuucacuu

SEQ ID NO: 1726533 - RNA, 14 nt, Human
uuuuaaaaaagaaa

SEQ ID NO: 1726534 - RNA, 15 nt, Human
guggagacaucugga

SEQ ID NO: 1726535 - RNA, 18 nt, Human
uuguaaaggaauuuaaaa

SEQ ID NO: 1726536 - RNA, 17 nt, Human
auuuuaauaauguuuca

SEQ ID NO: 1726537 - RNA, 18 nt, Human
ccacaucugagccccgaa

SEQ ID NO: 1726538 - RNA, 12 nt, Human
cucauggaauug

SEQ ID NO: 1726539 - RNA, 18 nt, Human
ugcauagguuuaauaauu

SEQ ID NO: 1726540 - RNA, 10 nt, Human
ccugagcccc

SEQ ID NO: 1726541 - RNA, 12 nt, Human
ucuauguagaau

SEQ ID NO: 1726542 - RNA, 22 nt, Human
uaauucugguagcuaaauauau

SEQ ID NO: 1726543 - RNA, 15 nt, Human
acuauuauauuucca

SEQ ID NO: 1726544 - RNA, 21 nt, Human
ugaugcuacaggauuugaaau

SEQ ID NO: 1726545 - RNA, 12 nt, Human
ggcugaugcagu

SEQ ID NO: 1726546 - RNA, 16 nt, Human
gcuguuaaucuuucaa

SEQ ID NO: 1726547 - RNA, 15 nt, Human
acaaaugggaaacaa

SEQ ID NO: 1726548 - RNA, 14 nt, Human
aaauaaauaaauaa

SEQ ID NO: 1726549 - RNA, 20 nt, Human
aucuacaugucuagagaaca

SEQ ID NO: 1726550 - RNA, 21 nt, Human
ugccuguaaucacagcuacuu

SEQ ID NO: 1726551 - RNA, 14 nt, Human
ugagguugugugug

SEQ ID NO: 1726552 - RNA, 18 nt, Human
aggaaaaaauaacaauga

SEQ ID NO: 1726553 - RNA, 16 nt, Human
acuaguuucccuugca

SEQ ID NO: 1726554 - RNA, 16 nt, Human
aaaagcaucacaugaa

SEQ ID NO: 1726555 - RNA, 13 nt, Human
uguuuucccuccu

SEQ ID NO: 1726556 - RNA, 23 nt, Human
gcauuguuggcuguuccugcagu

SEQ ID NO: 1726557 - RNA, 18 nt, Human
uccagcuggccgggagcc

SEQ ID NO: 1726558 - RNA, 15 nt, Human
ucuaugaaauauuau

SEQ ID NO: 1726559 - RNA, 23 nt, Human
cuacacgagauacagaauuuuau

SEQ ID NO: 1726560 - RNA, 14 nt, Human
caauugacuauagu

SEQ ID NO: 1726561 - RNA, 16 nt, Human
uggcaagcucuaucac

SEQ ID NO: 1726562 - RNA, 16 nt, Human
aucacuugagccccgg

SEQ ID NO: 1726563 - RNA, 21 nt, Human
agucuguuuucccuccuugga

SEQ ID NO: 1726564 - RNA, 23 nt, Human
gacacauaucaaacugaaacaaa

SEQ ID NO: 1726565 - RNA, 14 nt, Human
aaagaggaaugaag

SEQ ID NO: 1726566 - RNA, 22 nt, Human
aaauguugacaugggacauuug

SEQ ID NO: 1726567 - RNA, 13 nt, Human
acaagagcuuaac

SEQ ID NO: 1726568 - RNA, 18 nt, Human
ccucuggcuccagcuggc

SEQ ID NO: 1726569 - RNA, 18 nt, Human
uuuauggcacuaguauuu

SEQ ID NO: 1726570 - RNA, 17 nt, Human
uuagaugggcauggugg

SEQ ID NO: 1726571 - RNA, 23 nt, Human
aucacagcuacuugggaggcuga

SEQ ID NO: 1726572 - RNA, 18 nt, Human
uguucaagaccagccugg

SEQ ID NO: 1726573 - RNA, 18 nt, Human
uuuguuaaaugauuucau

SEQ ID NO: 1726574 - RNA, 20 nt, Human
auguuucuuggggaauaugu

SEQ ID NO: 1726575 - RNA, 16 nt, Human
cuaaaaauuaaaaccu

SEQ ID NO: 1726576 - RNA, 21 nt, Human
gaaaugaguuuuucuuuucau

SEQ ID NO: 1726577 - RNA, 13 nt, Human
guuuucccaucuc

SEQ ID NO: 1726578 - RNA, 13 nt, Human
ugauuauauguca

SEQ ID NO: 1726579 - RNA, 17 nt, Human
agacacacugaagaagc

SEQ ID NO: 1726580 - RNA, 20 nt, Human
aucuauguagaauauauuuc

SEQ ID NO: 1726581 - RNA, 12 nt, Human
gaugagagaaca

SEQ ID NO: 1726582 - RNA, 13 nt, Human
aaaugaaagcagg

SEQ ID NO: 1726583 - RNA, 12 nt, Human
uacuaaaugcuc

SEQ ID NO: 1726584 - RNA, 14 nt, Human
uaaaauccauacau

SEQ ID NO: 1726585 - RNA, 11 nt, Human
gaguuucucua

SEQ ID NO: 1726586 - RNA, 18 nt, Human
auguuaaaacugggacag

SEQ ID NO: 1726587 - RNA, 19 nt, Human
acuauuuaauuauuucacu

SEQ ID NO: 1726588 - RNA, 14 nt, Human
acaagcagcccuua

SEQ ID NO: 1726589 - RNA, 19 nt, Human
uuacagaaagauuugaugu

SEQ ID NO: 1726590 - RNA, 15 nt, Human
gccucuuagaugcag

SEQ ID NO: 1726591 - RNA, 23 nt, Human
uguugcccacagcuguaugauuc

SEQ ID NO: 1726592 - RNA, 17 nt, Human
aggagaggcaaagaaag

SEQ ID NO: 1726593 - RNA, 14 nt, Human
auuuaaggccaggc

SEQ ID NO: 1726594 - RNA, 16 nt, Human
uggggauagugaggca

SEQ ID NO: 1726595 - RNA, 15 nt, Human
uccacaaguaaaagg

SEQ ID NO: 1726596 - RNA, 19 nt, Human
auuaaguuuuuuuuuaaaa

SEQ ID NO: 1726597 - RNA, 14 nt, Human
cagccaccagucca

SEQ ID NO: 1726598 - RNA, 19 nt, Human
gauaaagcuuaggucaaag

SEQ ID NO: 1726599 - RNA, 14 nt, Human
ccucagucucccuc

SEQ ID NO: 1726600 - RNA, 17 nt, Human
uccucacuuugaagagu

SEQ ID NO: 1726601 - RNA, 14 nt, Human
aucaaaagaaagaa

SEQ ID NO: 1726602 - RNA, 23 nt, Human
accuccauggaaacgaagcacca

SEQ ID NO: 1726603 - RNA, 20 nt, Human
ucuaugagggcuaauaucuu

SEQ ID NO: 1726604 - RNA, 14 nt, Human
uugaaauuguauua

SEQ ID NO: 1726605 - RNA, 14 nt, Human
auguagaauauauu

SEQ ID NO: 1726606 - RNA, 15 nt, Human
acaagacccaaaagg

SEQ ID NO: 1726607 - RNA, 21 nt, Human
gccuuuucccaacuccagaaa

SEQ ID NO: 1726608 - RNA, 18 nt, Human
aggaaguauaggccaggc

SEQ ID NO: 1726609 - RNA, 16 nt, Human
aagaaaauaacaauaa

SEQ ID NO: 1726610 - RNA, 16 nt, Human
ugaaguccaagcauuu

SEQ ID NO: 1726611 - RNA, 12 nt, Human
ucuuaagaagac

SEQ ID NO: 1726612 - RNA, 14 nt, Human
uauuauauuuccaa

SEQ ID NO: 1726613 - RNA, 19 nt, Human
caaguaaaaggaaaugcuc

SEQ ID NO: 1726614 - RNA, 14 nt, Human
gcuuuaacuccugc

SEQ ID NO: 1726615 - RNA, 20 nt, Human
cuuauucacaagacccaaaa

SEQ ID NO: 1726616 - RNA, 12 nt, Human
auuucaaaaaaa

SEQ ID NO: 1726617 - RNA, 11 nt, Human
cgauaaaagac

SEQ ID NO: 1726618 - RNA, 13 nt, Human
caaaaaaaaaccc

SEQ ID NO: 1726619 - RNA, 18 nt, Human
augaugcuuugagaacau

SEQ ID NO: 1726620 - RNA, 22 nt, Human
uauuucagauaaucacaauaca

SEQ ID NO: 1726621 - RNA, 16 nt, Human
aacaauuugaauauaa

SEQ ID NO: 1726622 - RNA, 17 nt, Human
cuacaugucuagagaac

SEQ ID NO: 1726623 - RNA, 19 nt, Human
acauuuauguuccuuuuaa

SEQ ID NO: 1726624 - RNA, 15 nt, Human
ggcaagcucuaucac

SEQ ID NO: 1726625 - RNA, 22 nt, Human
gaaauaagccagacaucaacag

SEQ ID NO: 1726626 - RNA, 21 nt, Human
aaacgaggauugggaaaaagu

SEQ ID NO: 1726627 - RNA, 10 nt, Human
agcuuugagg

SEQ ID NO: 1726628 - RNA, 20 nt, Human
aguuguuucuacuacaugga

SEQ ID NO: 1726629 - RNA, 18 nt, Human
acaaaaggauaaugaaua

SEQ ID NO: 1726630 - RNA, 17 nt, Human
agugauuaccagggacu

SEQ ID NO: 1726631 - RNA, 18 nt, Human
uaauuauuucacuuuaga

SEQ ID NO: 1726632 - RNA, 20 nt, Human
acuucuuaggguuaugauua

SEQ ID NO: 1726633 - RNA, 13 nt, Human
uuuugaaucauca

SEQ ID NO: 1726634 - RNA, 20 nt, Human
uaaaagacagugaaagaaaa

SEQ ID NO: 1726635 - RNA, 12 nt, Human
agauuucaaaaa

SEQ ID NO: 1726636 - RNA, 14 nt, Human
ccugccccccagcc

SEQ ID NO: 1726637 - RNA, 21 nt, Human
uauaagaaauaggaaauauuu

SEQ ID NO: 1726638 - RNA, 12 nt, Human
gaauuggagcuc

SEQ ID NO: 1726639 - RNA, 14 nt, Human
augggccauaugaa

SEQ ID NO: 1726640 - RNA, 15 nt, Human
agucuguuuucccuc

SEQ ID NO: 1726641 - RNA, 22 nt, Human
caucucuucuggguuccuuccu

SEQ ID NO: 1726642 - RNA, 15 nt, Human
gaccacugcagaaga

SEQ ID NO: 1726643 - RNA, 17 nt, Human
caauaaauaaauaaaua

SEQ ID NO: 1726644 - RNA, 16 nt, Human
ugugagaugcuagaac

SEQ ID NO: 1726645 - RNA, 22 nt, Human
accauuucuugagguaaaagca

SEQ ID NO: 1726646 - RNA, 19 nt, Human
uaccuccaaggaccggccu

SEQ ID NO: 1726647 - RNA, 13 nt, Human
aacucuauaaugu

SEQ ID NO: 1726648 - RNA, 15 nt, Human
uucacuguaaaauaa

SEQ ID NO: 1726649 - RNA, 13 nt, Human
agaaaugaaagca

SEQ ID NO: 1726650 - RNA, 17 nt, Human
cuccuuaucaaaggaca

SEQ ID NO: 1726651 - RNA, 16 nt, Human
ugcaugguuuagaaag

SEQ ID NO: 1726652 - RNA, 17 nt, Human
uugcaguuuuuuccuag

SEQ ID NO: 1726653 - RNA, 23 nt, Human
ucuaccaaaaaucucaauauuuc

SEQ ID NO: 1726654 - RNA, 19 nt, Human
aaauaugccccauucaaca

SEQ ID NO: 1726655 - RNA, 16 nt, Human
cagcuuuccucaaaac

SEQ ID NO: 1726656 - RNA, 15 nt, Human
cuucugaggagcugu

SEQ ID NO: 1726657 - RNA, 16 nt, Human
agggaggacgcucucu

SEQ ID NO: 1726658 - RNA, 15 nt, Human
cccugcaaagcccag

SEQ ID NO: 1726659 - RNA, 16 nt, Human
cuucggccuccauccu

SEQ ID NO: 1726660 - RNA, 22 nt, Human
gaauaaccaacacccugagguu

SEQ ID NO: 1726661 - RNA, 15 nt, Human
ugcuguauuuuaaaa

SEQ ID NO: 1726662 - RNA, 21 nt, Human
uaagucaucugaugagaacaa

SEQ ID NO: 1726663 - RNA, 22 nt, Human
auauuuuagauagaugaagaag

SEQ ID NO: 1726664 - RNA, 22 nt, Human
aaauaacaaugaaaguugauaa

SEQ ID NO: 1726665 - RNA, 20 nt, Human
uguaaaggaauuuaaaaauc

SEQ ID NO: 1726666 - RNA, 16 nt, Human
aagcuucacuguaaaa

SEQ ID NO: 1726667 - RNA, 22 nt, Human
cauuuaaauaaaguguuugaaa

SEQ ID NO: 1726668 - RNA, 17 nt, Human
gaaacaaaaaucaaacu

SEQ ID NO: 1726669 - RNA, 23 nt, Human
gaucuacaugucuagagaacacu

SEQ ID NO: 1726670 - RNA, 14 nt, Human
ugcuggagcucugc

SEQ ID NO: 1726671 - RNA, 20 nt, Human
auuacauuuguauaaaauaa

SEQ ID NO: 1726672 - RNA, 20 nt, Human
augucgucaaagcugaaaug

SEQ ID NO: 1726673 - RNA, 20 nt, Human
agcagcccuuagcccuuccc

SEQ ID NO: 1726674 - RNA, 14 nt, Human
uaaauaaaaauaau

SEQ ID NO: 1726675 - RNA, 18 nt, Human
guuaguauuguccagguc

SEQ ID NO: 1726676 - RNA, 16 nt, Human
uauaugucacuuugcu

SEQ ID NO: 1726677 - RNA, 17 nt, Human
gccccccagcccuccuu

SEQ ID NO: 1726678 - RNA, 20 nt, Human
uaauucugguagcuaaauau

SEQ ID NO: 1726679 - RNA, 14 nt, Human
uuucuguuaaaaua

SEQ ID NO: 1726680 - RNA, 15 nt, Human
cugcacuccagccug

SEQ ID NO: 1726681 - RNA, 16 nt, Human
augcuaagugaaauaa

SEQ ID NO: 1726682 - RNA, 14 nt, Human
uaaggauucugaga

SEQ ID NO: 1726683 - RNA, 16 nt, Human
uuaauaauuuuuaauu

SEQ ID NO: 1726684 - RNA, 15 nt, Human
agacaaggaaaaaau

SEQ ID NO: 1726685 - RNA, 20 nt, Human
cccugcacuccagccugagc

SEQ ID NO: 1726686 - RNA, 12 nt, Human
cuugguuuuaau

SEQ ID NO: 1726687 - RNA, 14 nt, Human
guagcuaaauauau

SEQ ID NO: 1726688 - RNA, 20 nt, Human
ccauacuaauuauacccccu

SEQ ID NO: 1726689 - RNA, 15 nt, Human
auguuagagaauuuc

SEQ ID NO: 1726690 - RNA, 21 nt, Human
cuggguuuuggggggacgcua

SEQ ID NO: 1726691 - RNA, 20 nt, Human
ccaaguaaauguuuguccuu

SEQ ID NO: 1726692 - RNA, 16 nt, Human
uauaaauuuaucauuu

SEQ ID NO: 1726693 - RNA, 20 nt, Human
uuuaaggccaggcauggugg

SEQ ID NO: 1726694 - RNA, 19 nt, Human
cauggaauuggagcucgug

SEQ ID NO: 1726695 - RNA, 13 nt, Human
acaucaggaaaga

SEQ ID NO: 1726696 - RNA, 21 nt, Human
acaagaaggaaagauuuuguu

SEQ ID NO: 1726697 - RNA, 22 nt, Human
uauuccuuuuucucuccucucc

SEQ ID NO: 1726698 - RNA, 16 nt, Human
aagcauuuagauguau

SEQ ID NO: 1726699 - RNA, 23 nt, Human
aaauuuacagagacagaaagcag

SEQ ID NO: 1726700 - RNA, 15 nt, Human
gccccugcacuccag

SEQ ID NO: 1726701 - RNA, 19 nt, Human
uuugccaaguucuccacua

SEQ ID NO: 1726702 - RNA, 10 nt, Human
auguuuucag

SEQ ID NO: 1726703 - RNA, 23 nt, Human
gaaugagagacacacugaagaag

SEQ ID NO: 1726704 - RNA, 16 nt, Human
uucacauuuaaauaaa

SEQ ID NO: 1726705 - RNA, 23 nt, Human
aggaugguucccuugaugaagaa

SEQ ID NO: 1726706 - RNA, 22 nt, Human
agcuaaugaaguguuuagcaua

SEQ ID NO: 1726707 - RNA, 23 nt, Human
aguacucauacauguuacaacac

SEQ ID NO: 1726708 - RNA, 20 nt, Human
uaucuucacuuuuauaagaa

SEQ ID NO: 1726709 - RNA, 20 nt, Human
aaggaugccccgucccccuc

SEQ ID NO: 1726710 - RNA, 19 nt, Human
aaaauaacaauaaaagaca

SEQ ID NO: 1726711 - RNA, 16 nt, Human
acauuugcucauggaa

SEQ ID NO: 1726712 - RNA, 15 nt, Human
auuucauucaauauc

SEQ ID NO: 1726713 - RNA, 20 nt, Human
auaagccagacaucaacaga

SEQ ID NO: 1726714 - RNA, 21 nt, Human
uuagauaaggcuguucuuuaa

SEQ ID NO: 1726715 - RNA, 18 nt, Human
agauccccaagccuggca

SEQ ID NO: 1726716 - RNA, 16 nt, Human
aaggagaggcaaagaa

SEQ ID NO: 1726717 - RNA, 12 nt, Human
acaagacacagu

SEQ ID NO: 1726718 - RNA, 20 nt, Human
auuuugugauugauuauaug

SEQ ID NO: 1726719 - RNA, 14 nt, Human
cucaccccuugcca

SEQ ID NO: 1726720 - RNA, 16 nt, Human
caugggacagggagga

SEQ ID NO: 1726721 - RNA, 13 nt, Human
cacuguaaaauaa

SEQ ID NO: 1726722 - RNA, 17 nt, Human
augauuaaguaaugaua

SEQ ID NO: 1726723 - RNA, 19 nt, Human
gagcucaccagucccuccc

SEQ ID NO: 1726724 - RNA, 16 nt, Human
aaaaauuccaagugau

SEQ ID NO: 1726725 - RNA, 20 nt, Human
ccaacacccugagguugugu

SEQ ID NO: 1726726 - RNA, 14 nt, Human
cacaucaggaaaga

SEQ ID NO: 1726727 - RNA, 18 nt, Human
uccaggcuggcgugcagc

SEQ ID NO: 1726728 - RNA, 17 nt, Human
auauuugaaauauugac

SEQ ID NO: 1726729 - RNA, 19 nt, Human
ccccuauccuacuuccccu

SEQ ID NO: 1726730 - RNA, 23 nt, Human
caccaaggagccaaacauccuac

SEQ ID NO: 1726731 - RNA, 17 nt, Human
auuauuuuuuaaaaaaa

SEQ ID NO: 1726732 - RNA, 13 nt, Human
auuccucacuuug

SEQ ID NO: 1726733 - RNA, 20 nt, Human
aagucuuucacauuuaaaua

SEQ ID NO: 1726734 - RNA, 11 nt, Human
gccaugggaca

SEQ ID NO: 1726735 - RNA, 15 nt, Human
uagaauauauuuccu

SEQ ID NO: 1726736 - RNA, 22 nt, Human
uagacacacaugaaguccaagc

SEQ ID NO: 1726737 - RNA, 15 nt, Human
uaaauaaauaaaaac

SEQ ID NO: 1726738 - RNA, 15 nt, Human
aaaauacaaaaaaaa

SEQ ID NO: 1726739 - RNA, 20 nt, Human
cacagcacgggggccaagga

SEQ ID NO: 1726740 - RNA, 20 nt, Human
uuauucacuguauguccuug

SEQ ID NO: 1726741 - RNA, 14 nt, Human
auccaaugaaauga

SEQ ID NO: 1726742 - RNA, 19 nt, Human
agaucacuugagcucagga

SEQ ID NO: 1726743 - RNA, 22 nt, Human
cuacauaaaauacaaaaacuua

SEQ ID NO: 1726744 - RNA, 21 nt, Human
aagauauuaacugagaaggcu

SEQ ID NO: 1726745 - RNA, 16 nt, Human
agugagacagcucugc

SEQ ID NO: 1726746 - RNA, 15 nt, Human
aucaaaggacaccau

SEQ ID NO: 1726747 - RNA, 16 nt, Human
auuucaaaaaaaaacc

SEQ ID NO: 1726748 - RNA, 12 nt, Human
acugaaacaaaa

SEQ ID NO: 1726749 - RNA, 17 nt, Human
uaauuccacagcugcuc

SEQ ID NO: 1726750 - RNA, 13 nt, Human
uaugaaauauuau

SEQ ID NO: 1726751 - RNA, 14 nt, Human
gugagcuacaaaug

SEQ ID NO: 1726752 - RNA, 22 nt, Human
cauaaauguugacaugggacau

SEQ ID NO: 1726753 - RNA, 18 nt, Human
acaaggaaggaaagaugu

SEQ ID NO: 1726754 - RNA, 16 nt, Human
aaguauaggccaggca

SEQ ID NO: 1726755 - RNA, 18 nt, Human
ccugaggugagcaucauc

SEQ ID NO: 1726756 - RNA, 16 nt, Human
aauuccacagcugcuc

SEQ ID NO: 1726757 - RNA, 19 nt, Human
auuguaguccuguaaugga

SEQ ID NO: 1726758 - RNA, 14 nt, Human
caggcacaguggcu

SEQ ID NO: 1726759 - RNA, 18 nt, Human
cugcucaauaaaguacaa

SEQ ID NO: 1726760 - RNA, 18 nt, Human
uuacuguaagaaaauauc

SEQ ID NO: 1726761 - RNA, 19 nt, Human
agcucugcccauccugccc

SEQ ID NO: 1726762 - RNA, 19 nt, Human
uccuauaauuuuagacauu

SEQ ID NO: 1726763 - RNA, 21 nt, Human
ccuccccaaaugcuuuccaug

SEQ ID NO: 1726764 - RNA, 23 nt, Human
uccagguagaggguguguaagua

SEQ ID NO: 1726765 - RNA, 18 nt, Human
cuaggcauagcccugccu

SEQ ID NO: 1726766 - RNA, 12 nt, Human
cacaacacacag

SEQ ID NO: 1726767 - RNA, 16 nt, Human
ugacacuuaaaaaugg

SEQ ID NO: 1726768 - RNA, 19 nt, Human
uggugaacuugguuuuaau

SEQ ID NO: 1726769 - RNA, 18 nt, Human
auuuguauaaaauaauuu

SEQ ID NO: 1726770 - RNA, 13 nt, Human
uauuuaauuauuu

SEQ ID NO: 1726771 - RNA, 17 nt, Human
ccaaggaugccccgucc

SEQ ID NO: 1726772 - RNA, 17 nt, Human
gaaugagagacacacug

SEQ ID NO: 1726773 - RNA, 17 nt, Human
uuucccuccuuggagac

SEQ ID NO: 1726774 - RNA, 17 nt, Human
ugguucccuugaugaag

SEQ ID NO: 1726775 - RNA, 15 nt, Human
ggaacaaggaaggaa

SEQ ID NO: 1726776 - RNA, 13 nt, Human
aucaggcuggcca

SEQ ID NO: 1726777 - RNA, 15 nt, Human
cugccagcuggccuu

SEQ ID NO: 1726778 - RNA, 12 nt, Human
cccucugcagcu

SEQ ID NO: 1726779 - RNA, 22 nt, Human
agcuguguccucaugagggcug

SEQ ID NO: 1726780 - RNA, 15 nt, Human
aaaauaacaaugaaa

SEQ ID NO: 1726781 - RNA, 22 nt, Human
uggacgagaaaacaauaacgau

SEQ ID NO: 1726782 - RNA, 15 nt, Human
gcuaauaucuuaucu

SEQ ID NO: 1726783 - RNA, 18 nt, Human
cugagccuugggaccccu

SEQ ID NO: 1726784 - RNA, 17 nt, Human
gcaaauugucacaggac

SEQ ID NO: 1726785 - RNA, 18 nt, Human
uuuuauaucaauuuaaaa

SEQ ID NO: 1726786 - RNA, 16 nt, Human
uuucuauaauuuaaau

SEQ ID NO: 1726787 - RNA, 15 nt, Human
acucaccucccccau

SEQ ID NO: 1726788 - RNA, 19 nt, Human
acagugauuaccagggacu

SEQ ID NO: 1726789 - RNA, 11 nt, Human
aggcaggagga

SEQ ID NO: 1726790 - RNA, 20 nt, Human
auacugugugcuaaaacaag

SEQ ID NO: 1726791 - RNA, 18 nt, Human
gcaggaggaucacuugag

SEQ ID NO: 1726792 - RNA, 21 nt, Human
aauuuuuauauuugaaauauu

SEQ ID NO: 1726793 - RNA, 18 nt, Human
uggucaauuuuguuaugu

SEQ ID NO: 1726794 - RNA, 21 nt, Human
agcccuucuuuccacagaagc

SEQ ID NO: 1726795 - RNA, 19 nt, Human
uauauuuuugugauuuugu

SEQ ID NO: 1726796 - RNA, 19 nt, Human
cccacuugccauaaaacuu

SEQ ID NO: 1726797 - RNA, 23 nt, Human
uuuaaugccgauaucuucagaaa

SEQ ID NO: 1726798 - RNA, 15 nt, Human
uugacccacaagaaa

SEQ ID NO: 1726799 - RNA, 15 nt, Human
aagucauuauuagga

SEQ ID NO: 1726800 - RNA, 15 nt, Human
ucccccaucucuucu

SEQ ID NO: 1726801 - RNA, 18 nt, Human
uaggaaauauuuuaaugu

SEQ ID NO: 1726802 - RNA, 19 nt, Human
auugaggacacugauaugg

SEQ ID NO: 1726803 - RNA, 22 nt, Human
acuuugauuuuauaugcuauuu

SEQ ID NO: 1726804 - RNA, 14 nt, Human
ccacaaucuaggau

SEQ ID NO: 1726805 - RNA, 16 nt, Human
gucucaauaaauaaau

SEQ ID NO: 1726806 - RNA, 20 nt, Human
auaaauaaaaacaaaguuga

SEQ ID NO: 1726807 - RNA, 18 nt, Human
auuuuuagugaaauauua

SEQ ID NO: 1726808 - RNA, 19 nt, Human
agacucgggauuaguacac

SEQ ID NO: 1726809 - RNA, 21 nt, Human
ugccuaggcauagcccugccu

SEQ ID NO: 1726810 - RNA, 18 nt, Human
auaccccuggccaaggaa

SEQ ID NO: 1726811 - RNA, 13 nt, Human
aauuuuuauauuu

SEQ ID NO: 1726812 - RNA, 17 nt, Human
uaugcuauugaaguuuu

SEQ ID NO: 1726813 - RNA, 17 nt, Human
gaugggaacaaggaagg

SEQ ID NO: 1726814 - RNA, 14 nt, Human
gcugguggcucugu

SEQ ID NO: 1726815 - RNA, 13 nt, Human
gaaccuaggguga

SEQ ID NO: 1726816 - RNA, 23 nt, Human
uauuuuauuaggaguaccauaau

SEQ ID NO: 1726817 - RNA, 23 nt, Human
agcuggaaacacauguuccccuu

SEQ ID NO: 1726818 - RNA, 16 nt, Human
ggcagagagguaggga

SEQ ID NO: 1726819 - RNA, 15 nt, Human
uuuaaaugucugaaa

SEQ ID NO: 1726820 - RNA, 22 nt, Human
guacacugccuucucaacucca

SEQ ID NO: 1726821 - RNA, 16 nt, Human
aauaaaguguuugaaa

SEQ ID NO: 1726822 - RNA, 12 nt, Human
cuccauuuuuag

SEQ ID NO: 1726823 - RNA, 12 nt, Human
aaugcagccccc

SEQ ID NO: 1726824 - RNA, 16 nt, Human
ugagcucaggagguca

SEQ ID NO: 1726825 - RNA, 14 nt, Human
ccgcuuaagcuuuc

SEQ ID NO: 1726826 - RNA, 13 nt, Human
agacagcucugca

SEQ ID NO: 1726827 - RNA, 20 nt, Human
uaauaucuuaucuuccuaua

SEQ ID NO: 1726828 - RNA, 19 nt, Human
aaucuacacuccagugaga

SEQ ID NO: 1726829 - RNA, 15 nt, Human
uacuaauuuuaaaau

SEQ ID NO: 1726830 - RNA, 23 nt, Human
uuuccaucaaggguacacugccu

SEQ ID NO: 1726831 - RNA, 14 nt, Human
aauaguuuaugauu

SEQ ID NO: 1726832 - RNA, 18 nt, Human
aguccauugggcaggcag

SEQ ID NO: 1726833 - RNA, 19 nt, Human
ggagccugaucaccugccc

SEQ ID NO: 1726834 - RNA, 15 nt, Human
agggcucacagaauu

SEQ ID NO: 1726835 - RNA, 20 nt, Human
gcccacucugcaagaagaaa

SEQ ID NO: 1726836 - RNA, 21 nt, Human
gccucaagcuaugugagcuca

SEQ ID NO: 1726837 - RNA, 19 nt, Human
auaaaagacagugaaagaa

SEQ ID NO: 1726838 - RNA, 22 nt, Human
ucugcuaugcuauugaaguuuu

SEQ ID NO: 1726839 - RNA, 16 nt, Human
auugucuagugaaacu

SEQ ID NO: 1726840 - RNA, 13 nt, Human
ucccaaguaaaug

SEQ ID NO: 1726841 - RNA, 22 nt, Human
cucugagccuugggaccccuga

SEQ ID NO: 1726842 - RNA, 16 nt, Human
ccauuuuuagugaaau

SEQ ID NO: 1726843 - RNA, 19 nt, Human
uaucuauguagaauauauu

SEQ ID NO: 1726844 - RNA, 23 nt, Human
ucggccuccauccugaggcucca

SEQ ID NO: 1726845 - RNA, 20 nt, Human
cugauauuggacaguaaaau

SEQ ID NO: 1726846 - RNA, 18 nt, Human
auagaauuaacacaugau

SEQ ID NO: 1726847 - RNA, 20 nt, Human
ggcaggaggaucacuugagc

SEQ ID NO: 1726848 - RNA, 22 nt, Human
aggcugaugggcaaaaaaccaa

SEQ ID NO: 1726849 - RNA, 18 nt, Human
gaagcaaaauuuuuucuc

SEQ ID NO: 1726850 - RNA, 14 nt, Human
aauggcuaagcaaa

SEQ ID NO: 1726851 - RNA, 16 nt, Human
aaauauuccuuaagau

SEQ ID NO: 1726852 - RNA, 21 nt, Human
aaacaauaacgauaaaagaca

SEQ ID NO: 1726853 - RNA, 14 nt, Human
ugcuagaacucccu

SEQ ID NO: 1726854 - RNA, 24 nt, Human
uggccgggagccugaucaccugcc

SEQ ID NO: 1726855 - RNA, 19 nt, Human
uggccacaucugagccccg

SEQ ID NO: 1726856 - RNA, 17 nt, Human
uaacgauaaaagacagu

SEQ ID NO: 1726857 - RNA, 19 nt, Human
cuggacucaccucccccau

SEQ ID NO: 1726858 - RNA, 12 nt, Human
caaguaaauguu

SEQ ID NO: 1726859 - RNA, 20 nt, Human
ucuucuggguuccuuccucu

SEQ ID NO: 1726860 - RNA, 16 nt, Human
aaaguguuugaaagcu

SEQ ID NO: 1726861 - RNA, 16 nt, Human
ccacuuggucugugag

SEQ ID NO: 1726862 - RNA, 15 nt, Human
uuauagcuacuaauu

SEQ ID NO: 1726863 - RNA, 15 nt, Human
gccccauucaacauc

SEQ ID NO: 1726864 - RNA, 14 nt, Human
cucuggcuccagcu

SEQ ID NO: 1726865 - RNA, 20 nt, Human
uaggaauugacccacaagaa

SEQ ID NO: 1726866 - RNA, 21 nt, Human
aacuuguaaaggaauuuaaaa

SEQ ID NO: 1726867 - RNA, 15 nt, Human
ucuugaggcacagaa

SEQ ID NO: 1726868 - RNA, 19 nt, Human
gaucacuuuaggccuggug

SEQ ID NO: 1726869 - RNA, 22 nt, Human
gaugcaguuguugcccacagcu

SEQ ID NO: 1726870 - RNA, 14 nt, Human
aggacaaaaggaau

SEQ ID NO: 1726871 - RNA, 14 nt, Human
aggaaggaaagaug

SEQ ID NO: 1726872 - RNA, 15 nt, Human
aguucugaagaagau

SEQ ID NO: 1726873 - RNA, 12 nt, Human
cuggcuccagcu

SEQ ID NO: 1726874 - RNA, 19 nt, Human
auuuacagagacagaaagc

SEQ ID NO: 1726875 - RNA, 19 nt, Human
augaauuacauuuguauaa

SEQ ID NO: 1726876 - RNA, 20 nt, Human
ggaaaguuuucuccacugga

SEQ ID NO: 1726877 - RNA, 17 nt, Human
uaggaugggaacaagga

SEQ ID NO: 1726878 - RNA, 16 nt, Human
gaagauguagaggaga

SEQ ID NO: 1726879 - RNA, 19 nt, Human
caucaaggguacacugccu

SEQ ID NO: 1726880 - RNA, 18 nt, Human
aucagcaucccuagaaag

SEQ ID NO: 1726881 - RNA, 16 nt, Human
aaagacaaggaaaaaa

SEQ ID NO: 1726882 - RNA, 20 nt, Human
agcccuuccccucugcagcu

SEQ ID NO: 1726883 - RNA, 23 nt, Human
aauaggcugaugggcaaaaaacc

SEQ ID NO: 1726884 - RNA, 15 nt, Human
guuuuucuuuucauu

SEQ ID NO: 1726885 - RNA, 18 nt, Human
cuuugagcgcccacuaga

SEQ ID NO: 1726886 - RNA, 14 nt, Human
uggcuugaguuuaa

SEQ ID NO: 1726887 - RNA, 14 nt, Human
agacacugucucua

SEQ ID NO: 1726888 - RNA, 12 nt, Human
uuauuucacuuu

SEQ ID NO: 1726889 - RNA, 23 nt, Human
ugaaaaucuuauaauuuaaaaua

SEQ ID NO: 1726890 - RNA, 19 nt, Human
acaauaacgauaaaagaca

SEQ ID NO: 1726891 - RNA, 21 nt, Human
uuuucaggcuagauguaugua

SEQ ID NO: 1726892 - RNA, 15 nt, Human
agaaaacaauaacga

SEQ ID NO: 1726893 - RNA, 11 nt, Human
ugccauaaaac

SEQ ID NO: 1726894 - RNA, 15 nt, Human
cuuuucccaacucca

SEQ ID NO: 1726895 - RNA, 17 nt, Human
uuuccaugaguugcagu

SEQ ID NO: 1726896 - RNA, 18 nt, Human
caaguaaaaggaaaugcu

SEQ ID NO: 1726897 - RNA, 15 nt, Human
cacuuggucugugag

SEQ ID NO: 1726898 - RNA, 23 nt, Human
gggaaacaaaaggauaaugaaua

SEQ ID NO: 1726899 - RNA, 16 nt, Human
uucuauaauuuaaaua

SEQ ID NO: 1726900 - RNA, 13 nt, Human
uaacgauaaaaga

SEQ ID NO: 1726901 - RNA, 22 nt, Human
uguaacugucuucuagcaguga

SEQ ID NO: 1726902 - RNA, 14 nt, Human
gccagggcaagaga

SEQ ID NO: 1726903 - RNA, 18 nt, Human
ugcaagaagaaaucauga

SEQ ID NO: 1726904 - RNA, 14 nt, Human
cucaacucugagug

SEQ ID NO: 1726905 - RNA, 19 nt, Human
agugccuccaaguucaaaa

SEQ ID NO: 1726906 - RNA, 23 nt, Human
auauaacaaugcuguauuuuaaa

SEQ ID NO: 1726907 - RNA, 13 nt, Human
gaugggcaaaaaa

SEQ ID NO: 1726908 - RNA, 16 nt, Human
acauuuauauuuuugu

SEQ ID NO: 1726909 - RNA, 12 nt, Human
ugugaggagcug

SEQ ID NO: 1726910 - RNA, 16 nt, Human
ggaacaaggaaggaaa

SEQ ID NO: 1726911 - RNA, 15 nt, Human
uucacauuuaaauaa

SEQ ID NO: 1726912 - RNA, 16 nt, Human
cugcugagucccaggc

SEQ ID NO: 1726913 - RNA, 20 nt, Human
caaaguugauuaagaaagga

SEQ ID NO: 1726914 - RNA, 18 nt, Human
caugaagauguagaggag

SEQ ID NO: 1726915 - RNA, 20 nt, Human
cagucccuccccaaaugcuu

SEQ ID NO: 1726916 - RNA, 22 nt, Human
ugugagcucaccagucccuccc

SEQ ID NO: 1726917 - RNA, 17 nt, Human
agaacucccuuucaaca

SEQ ID NO: 1726918 - RNA, 16 nt, Human
auuuaguuauaaaaau

SEQ ID NO: 1726919 - RNA, 19 nt, Human
auuguaggugacuauuaua

SEQ ID NO: 1726920 - RNA, 12 nt, Human
cccccagcccuc

SEQ ID NO: 1726921 - RNA, 15 nt, Human
gaauaaccaacaccc

SEQ ID NO: 1726922 - RNA, 17 nt, Human
uaucaauuuaaaaaaaa

SEQ ID NO: 1726923 - RNA, 20 nt, Human
ugauuucugagcauuuaaua

SEQ ID NO: 1726924 - RNA, 17 nt, Human
uuccaagugauugaaac

SEQ ID NO: 1726925 - RNA, 12 nt, Human
auucugaaagca

SEQ ID NO: 1726926 - RNA, 11 nt, Human
caaaaaucaaa

SEQ ID NO: 1726927 - RNA, 14 nt, Human
cccugaggugagca

SEQ ID NO: 1726928 - RNA, 16 nt, Human
agggcaguguucccug

SEQ ID NO: 1726929 - RNA, 22 nt, Human
auguuccuuuuaaagaaacaaa

SEQ ID NO: 1726930 - RNA, 14 nt, Human
uugccaugugcuag

SEQ ID NO: 1726931 - RNA, 18 nt, Human
cuccauccugaggcucca

SEQ ID NO: 1726932 - RNA, 17 nt, Human
uccugccccugagccca

SEQ ID NO: 1726933 - RNA, 13 nt, Human
acggggugaaacc

SEQ ID NO: 1726934 - RNA, 14 nt, Human
uaauccuaaacaua

SEQ ID NO: 1726935 - RNA, 20 nt, Human
auuuucaguuauuauauuua

SEQ ID NO: 1726936 - RNA, 18 nt, Human
auggcuugaguuuaaauu

SEQ ID NO: 1726937 - RNA, 16 nt, Human
guuggcuguuccugca

SEQ ID NO: 1726938 - RNA, 22 nt, Human
cgugcuugucccuguggaagua

SEQ ID NO: 1726939 - RNA, 18 nt, Human
aaauaacgauaaaagaca

SEQ ID NO: 1726940 - RNA, 21 nt, Human
uccauccugaggcuccacuug

SEQ ID NO: 1726941 - RNA, 20 nt, Human
ugagucccaggcugagccuc

SEQ ID NO: 1726942 - RNA, 17 nt, Human
cagcagugccaaaauau

SEQ ID NO: 1726943 - RNA, 18 nt, Human
cagcuuauugucuaguga

SEQ ID NO: 1726944 - RNA, 19 nt, Human
uuuauaucaauuuaaaaaa

SEQ ID NO: 1726945 - RNA, 14 nt, Human
caaaugcauuucua

SEQ ID NO: 1726946 - RNA, 18 nt, Human
cuuuuaaagaaacaaaaa

SEQ ID NO: 1726947 - RNA, 17 nt, Human
uuauuacuguaagaaaa

SEQ ID NO: 1726948 - RNA, 21 nt, Human
ugaacaaauuuacagagacag

SEQ ID NO: 1726949 - RNA, 16 nt, Human
ugcagugucugcugga

SEQ ID NO: 1726950 - RNA, 17 nt, Human
gacgagaaaacaauaac

SEQ ID NO: 1726951 - RNA, 16 nt, Human
aguaaaggcaaacuua

SEQ ID NO: 1726952 - RNA, 19 nt, Human
auuuucaguuauuauauuu

SEQ ID NO: 1726953 - RNA, 15 nt, Human
ucacaggacagcccu

SEQ ID NO: 1726954 - RNA, 13 nt, Human
auguagaauauau

SEQ ID NO: 1726955 - RNA, 15 nt, Human
aacaaggaaggaaag

SEQ ID NO: 1726956 - RNA, 20 nt, Human
ucagaauuucuaaaaguuua

SEQ ID NO: 1726957 - RNA, 17 nt, Human
gccuccuuuuaaaguaa

SEQ ID NO: 1726958 - RNA, 17 nt, Human
gucaaagcugaaaugga

SEQ ID NO: 1726959 - RNA, 16 nt, Human
ugcacaucaaaauaug

SEQ ID NO: 1726960 - RNA, 23 nt, Human
uguggaaggugaucuggcucugg

SEQ ID NO: 1726961 - RNA, 22 nt, Human
aaacauccuacaagacacagug

SEQ ID NO: 1726962 - RNA, 14 nt, Human
uaauaucuuaucuu

SEQ ID NO: 1726963 - RNA, 11 nt, Human
aaaggaaggaa

SEQ ID NO: 1726964 - RNA, 22 nt, Human
auuuucuucucacauuuauauu

SEQ ID NO: 1726965 - RNA, 16 nt, Human
cuuuaugcuaagugaa

SEQ ID NO: 1726966 - RNA, 23 nt, Human
ugauguuucauaagaauucuguu

SEQ ID NO: 1726967 - RNA, 19 nt, Human
gccuggucaacauagugag

SEQ ID NO: 1726968 - RNA, 19 nt, Human
gcauggccacaucugagcc

SEQ ID NO: 1726969 - RNA, 22 nt, Human
caucaucuucuggguuaggccu

SEQ ID NO: 1726970 - RNA, 17 nt, Human
gggcuaaggcaggagga

SEQ ID NO: 1726971 - RNA, 17 nt, Human
ccaguaguuagcuuucu

SEQ ID NO: 1726972 - RNA, 16 nt, Human
cugucucuaccaaaaa

SEQ ID NO: 1726973 - RNA, 22 nt, Human
ugauaguuguaccgcaauguga

SEQ ID NO: 1726974 - RNA, 22 nt, Human
aucaccaaggcugauuaaacca

SEQ ID NO: 1726975 - RNA, 14 nt, Human
ugagcuugcagaga

SEQ ID NO: 1726976 - RNA, 14 nt, Human
uaguuucccuugca

SEQ ID NO: 1726977 - RNA, 18 nt, Human
acauuuauauuuuuguga

SEQ ID NO: 1726978 - RNA, 16 nt, Human
cauuuaguuauaaaaa

SEQ ID NO: 1726979 - RNA, 17 nt, Human
gauaaaagacagugaaa

SEQ ID NO: 1726980 - RNA, 12 nt, Human
uaaaaauuaaaa

SEQ ID NO: 1726981 - RNA, 23 nt, Human
guaauuccguagguuauuuucag

SEQ ID NO: 1726982 - RNA, 20 nt, Human
agaaggcuguggauuuaaug

SEQ ID NO: 1726983 - RNA, 13 nt, Human
aacgucacaucuu

SEQ ID NO: 1726984 - RNA, 16 nt, Human
agauaaggcuguucuu

SEQ ID NO: 1726985 - RNA, 18 nt, Human
acaugaacuuguaaagga

SEQ ID NO: 1726986 - RNA, 15 nt, Human
aagaaaauaacaaua

SEQ ID NO: 1726987 - RNA, 22 nt, Human
gucacaggaaguagaggaggcc

SEQ ID NO: 1726988 - RNA, 22 nt, Human
acccugaggugagcaucaucuu

SEQ ID NO: 1726989 - RNA, 22 nt, Human
acacauaucaaacugaaacaaa

SEQ ID NO: 1726990 - RNA, 17 nt, Human
aaccuucugaggagcug

SEQ ID NO: 1726991 - RNA, 21 nt, Human
cagagguccacaacacacaga

SEQ ID NO: 1726992 - RNA, 19 nt, Human
gaaagaaaauaacaauaaa

SEQ ID NO: 1726993 - RNA, 16 nt, Human
uccuguaauggaagca

SEQ ID NO: 1726994 - RNA, 13 nt, Human
cacaacuauauug

SEQ ID NO: 1726995 - RNA, 14 nt, Human
gagcucagcccugg

SEQ ID NO: 1726996 - RNA, 18 nt, Human
auuugcuggagcucugcc

SEQ ID NO: 1726997 - RNA, 23 nt, Human
gucucagcuucacccugagguga

SEQ ID NO: 1726998 - RNA, 16 nt, Human
cacgggggccaaggau

SEQ ID NO: 1726999 - RNA, 17 nt, Human
cacauguuccccuuggg

SEQ ID NO: 1727000 - RNA, 23 nt, Human
ggucuaucuuugagcgcccacua

SEQ ID NO: 1727001 - RNA, 14 nt, Human
cucaauaaauaaau

SEQ ID NO: 1727002 - RNA, 14 nt, Human
acuauuauauuucc

SEQ ID NO: 1727003 - RNA, 23 nt, Human
aaguauccuucagccugaaagag

SEQ ID NO: 1727004 - RNA, 15 nt, Human
gacaguauggcagcu

SEQ ID NO: 1727005 - RNA, 16 nt, Human
agcuugaaaccuucac

SEQ ID NO: 1727006 - RNA, 21 nt, Human
aaaauuuuuucucuaggaaau

SEQ ID NO: 1727007 - RNA, 17 nt, Human
auaucuuaucuuccuau

SEQ ID NO: 1727008 - RNA, 13 nt, Human
auaaaaauauaua

SEQ ID NO: 1727009 - RNA, 20 nt, Human
gaagggacacauaucaaacu

SEQ ID NO: 1727010 - RNA, 18 nt, Human
aucuauguagaauauauu

SEQ ID NO: 1727011 - RNA, 14 nt, Human
cugcuaguuuauau

SEQ ID NO: 1727012 - RNA, 22 nt, Human
gcacagccucuuagaugcaguu

SEQ ID NO: 1727013 - RNA, 19 nt, Human
aaaaucuuauaauuuaaaa

SEQ ID NO: 1727014 - RNA, 18 nt, Human
cuuuucccaacuccagaa

SEQ ID NO: 1727015 - RNA, 22 nt, Human
auacuuuggccauuacccccag

SEQ ID NO: 1727016 - RNA, 20 nt, Human
aacagucucuugaggcacag

SEQ ID NO: 1727017 - RNA, 13 nt, Human
aacaaaauuagaa

SEQ ID NO: 1727018 - RNA, 22 nt, Human
gucucagcuucacccugaggug

SEQ ID NO: 1727019 - RNA, 15 nt, Human
aaauauaaucagaga

SEQ ID NO: 1727020 - RNA, 21 nt, Human
aaugugacuuaaugccacuaa

SEQ ID NO: 1727021 - RNA, 17 nt, Human
ucauacuucuuaggguu

SEQ ID NO: 1727022 - RNA, 20 nt, Human
acggacgaaccuugaaaacu

SEQ ID NO: 1727023 - RNA, 16 nt, Human
cuggaugcucucguug

SEQ ID NO: 1727024 - RNA, 14 nt, Human
gcugauuaaaccaa

SEQ ID NO: 1727025 - RNA, 13 nt, Human
ucuagagcaaagc

SEQ ID NO: 1727026 - RNA, 22 nt, Human
cacagauuugagcucagcccug

SEQ ID NO: 1727027 - RNA, 11 nt, Human
cugacaaagac

SEQ ID NO: 1727028 - RNA, 15 nt, Human
agccugaaagaggaa

SEQ ID NO: 1727029 - RNA, 23 nt, Human
cagagucaagggugugugcagca

SEQ ID NO: 1727030 - RNA, 21 nt, Human
aggaugggaacaaggaaggaa

SEQ ID NO: 1727031 - RNA, 14 nt, Human
aaaacuucagacau

SEQ ID NO: 1727032 - RNA, 16 nt, Human
ugaugggcaaaaaacc

SEQ ID NO: 1727033 - RNA, 14 nt, Human
ugagaugcuagaac

SEQ ID NO: 1727034 - RNA, 22 nt, Human
uggaagccagaucuaugccaca

SEQ ID NO: 1727035 - RNA, 21 nt, Human
cuggccaccugcugagcccca

SEQ ID NO: 1727036 - RNA, 15 nt, Human
uucuguuaaaauaua

SEQ ID NO: 1727037 - RNA, 12 nt, Human
ccaggcugagcc

SEQ ID NO: 1727038 - RNA, 16 nt, Human
auccuacaagacacag

SEQ ID NO: 1727039 - RNA, 22 nt, Human
caagcacuaaacaaagagugaa

SEQ ID NO: 1727040 - RNA, 23 nt, Human
ggaugguucccuugaugaagaag

SEQ ID NO: 1727041 - RNA, 16 nt, Human
auaguaccucugcuau

SEQ ID NO: 1727042 - RNA, 14 nt, Human
agcucaccaguccc

SEQ ID NO: 1727043 - RNA, 15 nt, Human
cuaguaauuggaaag

SEQ ID NO: 1727044 - RNA, 12 nt, Human
acucccugcccc

SEQ ID NO: 1727045 - RNA, 14 nt, Human
cuuuuaguuuuuaa

SEQ ID NO: 1727046 - RNA, 23 nt, Human
agcagcccuuagcccuuccccuc

SEQ ID NO: 1727047 - RNA, 20 nt, Human
aaaacaagcacuaaacaaag

SEQ ID NO: 1727048 - RNA, 20 nt, Human
aaggagccaaacauccuaca

SEQ ID NO: 1727049 - RNA, 17 nt, Human
aaauauaaauaaaaaua

SEQ ID NO: 1727050 - RNA, 15 nt, Human
aagcacuaaacaaag

SEQ ID NO: 1727051 - RNA, 14 nt, Human
cucagucucccucc

SEQ ID NO: 1727052 - RNA, 12 nt, Human
acacuuaaaaau

SEQ ID NO: 1727053 - RNA, 21 nt, Human
cuucucacauuuauauuuuug

SEQ ID NO: 1727054 - RNA, 22 nt, Human
aaaggaauguguaagucuuuaa

SEQ ID NO: 1727055 - RNA, 12 nt, Human
ucuacacuccag

SEQ ID NO: 1727056 - RNA, 14 nt, Human
gggcuggaugcucu

SEQ ID NO: 1727057 - RNA, 16 nt, Human
aaggagauacagugga

SEQ ID NO: 1727058 - RNA, 13 nt, Human
cuaugaaauauua

SEQ ID NO: 1727059 - RNA, 18 nt, Human
aagaccucauuuugaagg

SEQ ID NO: 1727060 - RNA, 16 nt, Human
ccacaagaacccccuu

SEQ ID NO: 1727061 - RNA, 15 nt, Human
ccagauccuggaaau

SEQ ID NO: 1727062 - RNA, 21 nt, Human
augaugcuuugagaacauacu

SEQ ID NO: 1727063 - RNA, 21 nt, Human
uggggcuuuaacuccugcuag

SEQ ID NO: 1727064 - RNA, 17 nt, Human
ccuacuuccccuuccua

SEQ ID NO: 1727065 - RNA, 16 nt, Human
ggagaggcaaagaaag

SEQ ID NO: 1727066 - RNA, 20 nt, Human
ugagcgcccacuagacccac

SEQ ID NO: 1727067 - RNA, 15 nt, Human
uuagugaaauauuau

SEQ ID NO: 1727068 - RNA, 20 nt, Human
ccagcuggccgggagccuga

SEQ ID NO: 1727069 - RNA, 21 nt, Human
augcuacaggauuugaaauug

SEQ ID NO: 1727070 - RNA, 18 nt, Human
ggaaggcugaggcaggag

SEQ ID NO: 1727071 - RNA, 18 nt, Human
augucugaaauggaacag

SEQ ID NO: 1727072 - RNA, 17 nt, Human
ucuuauaauuuaaaaua

SEQ ID NO: 1727073 - RNA, 14 nt, Human
gaaugauuaugaau

SEQ ID NO: 1727074 - RNA, 23 nt, Human
cuucaacucccugccccccagcc

SEQ ID NO: 1727075 - RNA, 16 nt, Human
aaugaaagcagggacu

SEQ ID NO: 1727076 - RNA, 21 nt, Human
aaugaauggcuaagcaaaaug

SEQ ID NO: 1727077 - RNA, 18 nt, Human
gaaaauaucacuugucaa

SEQ ID NO: 1727078 - RNA, 23 nt, Human
uuucccaucucagguguguugca

SEQ ID NO: 1727079 - RNA, 14 nt, Human
aucuauguagaaua

SEQ ID NO: 1727080 - RNA, 19 nt, Human
uagugagcagucaggaaag

SEQ ID NO: 1727081 - RNA, 19 nt, Human
ucaauucuugccaaauaua

SEQ ID NO: 1727082 - RNA, 14 nt, Human
uggccaccugcuga

SEQ ID NO: 1727083 - RNA, 13 nt, Human
agcgacagugaga

SEQ ID NO: 1727084 - RNA, 18 nt, Human
augggggcagcaccuccu

SEQ ID NO: 1727085 - RNA, 16 nt, Human
agugaaggauuuaugu

SEQ ID NO: 1727086 - RNA, 13 nt, Human
ccaaggaugcccc

SEQ ID NO: 1727087 - RNA, 22 nt, Human
uguucugauauuggacaguaaa

SEQ ID NO: 1727088 - RNA, 13 nt, Human
aggaaaaaauaac

SEQ ID NO: 1727089 - RNA, 20 nt, Human
gaacguaaucguguccccua

SEQ ID NO: 1727090 - RNA, 20 nt, Human
acagaaagauuugauguaug

SEQ ID NO: 1727091 - RNA, 19 nt, Human
uuauauuucuguuaaaaua

SEQ ID NO: 1727092 - RNA, 14 nt, Human
cugccagcuggccu

SEQ ID NO: 1727093 - RNA, 21 nt, Human
caauuuuguuauguauauuuu

SEQ ID NO: 1727094 - RNA, 17 nt, Human
aaagcagggacuugaac

SEQ ID NO: 1727095 - RNA, 13 nt, Human
cacauuuaaauaa

SEQ ID NO: 1727096 - RNA, 15 nt, Human
auaucaauuuaaaaa

SEQ ID NO: 1727097 - RNA, 23 nt, Human
aggaggaucacuuuaggccuggu

SEQ ID NO: 1727098 - RNA, 14 nt, Human
ugagcucagcccug

SEQ ID NO: 1727099 - RNA, 22 nt, Human
cuucagaaaaccuaagcaaacu

SEQ ID NO: 1727100 - RNA, 21 nt, Human
cgaaguauccuucagccugaa

SEQ ID NO: 1727101 - RNA, 11 nt, Human
ucaccugcccu

SEQ ID NO: 1727102 - RNA, 22 nt, Human
aaacauguuuaucguauuugau

SEQ ID NO: 1727103 - RNA, 16 nt, Human
uauuuuaauguuucuu

SEQ ID NO: 1727104 - RNA, 12 nt, Human
cagacacaugug

SEQ ID NO: 1727105 - RNA, 17 nt, Human
ccagggaagacaagaag

SEQ ID NO: 1727106 - RNA, 19 nt, Human
auaaaagacaaggaaaaaa

SEQ ID NO: 1727107 - RNA, 16 nt, Human
aggguguguaaguaga

SEQ ID NO: 1727108 - RNA, 14 nt, Human
acguuaggaggaca

SEQ ID NO: 1727109 - RNA, 19 nt, Human
uuuccugaaaacccuugcc

SEQ ID NO: 1727110 - RNA, 15 nt, Human
gccuaagugcagccc

SEQ ID NO: 1727111 - RNA, 21 nt, Human
gaagugaaaaucuacacucca

SEQ ID NO: 1727112 - RNA, 14 nt, Human
gaaaguuuucucca

SEQ ID NO: 1727113 - RNA, 12 nt, Human
aacuuuacagaa

SEQ ID NO: 1727114 - RNA, 16 nt, Human
agacauugaggcaggc

SEQ ID NO: 1727115 - RNA, 21 nt, Human
aaaugucuugcuugauuguau

SEQ ID NO: 1727116 - RNA, 13 nt, Human
aguuaccucugcc

SEQ ID NO: 1727117 - RNA, 16 nt, Human
uagagaauuuccuuac

SEQ ID NO: 1727118 - RNA, 19 nt, Human
agagccuuuuuuugaaaaa

SEQ ID NO: 1727119 - RNA, 21 nt, Human
gcagcauuguuggcuguuccu

SEQ ID NO: 1727120 - RNA, 14 nt, Human
acagaauuuuaugc

SEQ ID NO: 1727121 - RNA, 23 nt, Human
acguaaucguguccccuauccua

SEQ ID NO: 1727122 - RNA, 13 nt, Human
uuauucacaagac

SEQ ID NO: 1727123 - RNA, 16 nt, Human
cuccauccugaggcuc

SEQ ID NO: 1727124 - RNA, 20 nt, Human
agccuuggggcugaugcagu

SEQ ID NO: 1727125 - RNA, 23 nt, Human
uuuauuaggaguaccauaauucu

SEQ ID NO: 1727126 - RNA, 15 nt, Human
uagauaggccauggg

SEQ ID NO: 1727127 - RNA, 20 nt, Human
aagggcuguuauaaucuuuc

SEQ ID NO: 1727128 - RNA, 19 nt, Human
ccaccugccuauauuuuuu

SEQ ID NO: 1727129 - RNA, 15 nt, Human
aacugaaacaaaauu

SEQ ID NO: 1727130 - RNA, 15 nt, Human
gucccaggcugagcc

SEQ ID NO: 1727131 - RNA, 17 nt, Human
aguuuauauagaaaugu

SEQ ID NO: 1727132 - RNA, 13 nt, Human
uucaaaaaaaaac

SEQ ID NO: 1727133 - RNA, 18 nt, Human
acugccuucucaacucca

SEQ ID NO: 1727134 - RNA, 13 nt, Human
ugggaggcugaga

SEQ ID NO: 1727135 - RNA, 15 nt, Human
uggagacaucuggaa

SEQ ID NO: 1727136 - RNA, 19 nt, Human
ucagguguguugcaguguc

SEQ ID NO: 1727137 - RNA, 18 nt, Human
gaauaauccuaaacauau

SEQ ID NO: 1727138 - RNA, 21 nt, Human
gucaagaucagccugggcaac

SEQ ID NO: 1727139 - RNA, 18 nt, Human
gggaacaaggaaggaaag

SEQ ID NO: 1727140 - RNA, 16 nt, Human
acugcuaguuuauaua

SEQ ID NO: 1727141 - RNA, 22 nt, Human
gaauuucuucaacucccugccc

SEQ ID NO: 1727142 - RNA, 22 nt, Human
uaaaauaauuuuuauauuugaa

SEQ ID NO: 1727143 - RNA, 20 nt, Human
aaaguugauuaagaaaggaa

SEQ ID NO: 1727144 - RNA, 22 nt, Human
ggacagcccuucuuuccacaga

SEQ ID NO: 1727145 - RNA, 23 nt, Human
uccaaacugacucuuaagaagac

SEQ ID NO: 1727146 - RNA, 20 nt, Human
ccauuguggucacaggaagu

SEQ ID NO: 1727147 - RNA, 20 nt, Human
gaaacgaggauugggaaaaa

SEQ ID NO: 1727148 - RNA, 15 nt, Human
ucaaaggacaccauu

SEQ ID NO: 1727149 - RNA, 15 nt, Human
gcuguauuuuaaaag

SEQ ID NO: 1727150 - RNA, 20 nt, Human
acaucuggaaaguuuucucc

SEQ ID NO: 1727151 - RNA, 18 nt, Human
acaaaugcauuucuaaag

SEQ ID NO: 1727152 - RNA, 18 nt, Human
acuugccauaaaacuuag

SEQ ID NO: 1727153 - RNA, 23 nt, Human
ugaaaugaguuuuucuuuucauu

SEQ ID NO: 1727154 - RNA, 11 nt, Human
gagguaaaagc

SEQ ID NO: 1727155 - RNA, 20 nt, Human
caaacugccaucauuuacuu

SEQ ID NO: 1727156 - RNA, 18 nt, Human
aaggaugccccguccccc

SEQ ID NO: 1727157 - RNA, 22 nt, Human
uuuauagcuacuaauuuuaaaa

SEQ ID NO: 1727158 - RNA, 16 nt, Human
guugauggaaauacac

SEQ ID NO: 1727159 - RNA, 19 nt, Human
cccugccccccagcccucc

SEQ ID NO: 1727160 - RNA, 14 nt, Human
ucucagaaggaaag

SEQ ID NO: 1727161 - RNA, 21 nt, Human
ucacagaaugacugacaaaga

SEQ ID NO: 1727162 - RNA, 15 nt, Human
agaggcaaagaaagg

SEQ ID NO: 1727163 - RNA, 16 nt, Human
ugagccaaauguaaaa

SEQ ID NO: 1727164 - RNA, 21 nt, Human
aauuaaguuuuuuuuuaaaaa

SEQ ID NO: 1727165 - RNA, 21 nt, Human
ccaguccauugggcaggcaga

SEQ ID NO: 1727166 - RNA, 18 nt, Human
aaggagaggcaaagaaag

SEQ ID NO: 1727167 - RNA, 22 nt, Human
ggccauuacccccagcuuugag

SEQ ID NO: 1727168 - RNA, 21 nt, Human
aacauagugagacacugucuc

SEQ ID NO: 1727169 - RNA, 16 nt, Human
uguaguccuguaaugg

SEQ ID NO: 1727170 - RNA, 18 nt, Human
uuauguuccuuuuaaaga

SEQ ID NO: 1727171 - RNA, 21 nt, Human
caggcacuaucuggguuuugg

SEQ ID NO: 1727172 - RNA, 13 nt, Human
uaagaaaggaagu

SEQ ID NO: 1727173 - RNA, 21 nt, Human
augucauuugcuggagcucug

SEQ ID NO: 1727174 - RNA, 15 nt, Human
ccuugccaugugcua

SEQ ID NO: 1727175 - RNA, 18 nt, Human
ugaggcaggcacugccaa

SEQ ID NO: 1727176 - RNA, 14 nt, Human
uaauuauuucacuu

SEQ ID NO: 1727177 - RNA, 12 nt, Human
aauuuuaaaaug

SEQ ID NO: 1727178 - RNA, 15 nt, Human
uuaaguauuuuauua

SEQ ID NO: 1727179 - RNA, 18 nt, Human
ugaaaaaguucugcagau

SEQ ID NO: 1727180 - RNA, 20 nt, Human
acuccagugagacagcucug

SEQ ID NO: 1727181 - RNA, 16 nt, Human
uuuaaggauucugaga

SEQ ID NO: 1727182 - RNA, 23 nt, Human
ucuuagaugcaguucugaagaag

SEQ ID NO: 1727183 - RNA, 19 nt, Human
gauggaguuucucuagaag

SEQ ID NO: 1727184 - RNA, 22 nt, Human
ccucccuuggggccuaugcaga

SEQ ID NO: 1727185 - RNA, 12 nt, Human
agaaaacaauaa

SEQ ID NO: 1727186 - RNA, 15 nt, Human
cauuuaguuauaaaa

SEQ ID NO: 1727187 - RNA, 16 nt, Human
ccucaaaacuucagac

SEQ ID NO: 1727188 - RNA, 23 nt, Human
cuugauaaauggcuuccuggcaa

SEQ ID NO: 1727189 - RNA, 20 nt, Human
ggccuaugcagagguccaca

SEQ ID NO: 1727190 - RNA, 15 nt, Human
ugccccgucccccuc

SEQ ID NO: 1727191 - RNA, 17 nt, Human
aauaacgauaaaagaca

SEQ ID NO: 1727192 - RNA, 15 nt, Human
cugaaagaggaauga

SEQ ID NO: 1727193 - RNA, 22 nt, Human
gcagagagguagggauggggcu

SEQ ID NO: 1727194 - RNA, 13 nt, Human
aagacaaggaaaa

SEQ ID NO: 1727195 - RNA, 17 nt, Human
cugaucaccugcccugc

SEQ ID NO: 1727196 - RNA, 16 nt, Human
cccuuuacccccauga

SEQ ID NO: 1727197 - RNA, 14 nt, Human
guaacuaauuuuaa

SEQ ID NO: 1727198 - RNA, 14 nt, Human
ggcuacagugagcc

SEQ ID NO: 1727199 - RNA, 23 nt, Human
gaggcauuuaggccaugggacag

SEQ ID NO: 1727200 - RNA, 12 nt, Human
caucaggaaaga

SEQ ID NO: 1727201 - RNA, 22 nt, Human
agaauuuuaugcggcauuuucu

SEQ ID NO: 1727202 - RNA, 21 nt, Human
cuguuaucuucacuuuuauaa

SEQ ID NO: 1727203 - RNA, 20 nt, Human
aaagacagugaaagaaaaua

SEQ ID NO: 1727204 - RNA, 23 nt, Human
caucaacagauaaauaguuuaug

SEQ ID NO: 1727205 - RNA, 20 nt, Human
ucucguugacccucacagga

SEQ ID NO: 1727206 - RNA, 14 nt, Human
ggcuccagcuggcc

SEQ ID NO: 1727207 - RNA, 19 nt, Human
auuuuagauagaugaagaa

SEQ ID NO: 1727208 - RNA, 12 nt, Human
uugggcaggcag

SEQ ID NO: 1727209 - RNA, 16 nt, Human
auuccuuaagauauua

SEQ ID NO: 1727210 - RNA, 17 nt, Human
agauagaugaagaagcu

SEQ ID NO: 1727211 - RNA, 15 nt, Human
acaucaacagauaaa

SEQ ID NO: 1727212 - RNA, 14 nt, Human
agcucguggaacag

SEQ ID NO: 1727213 - RNA, 22 nt, Human
cugccaaaacaucaaccugcca

SEQ ID NO: 1727214 - RNA, 15 nt, Human
cuaagugcagccccg

SEQ ID NO: 1727215 - RNA, 17 nt, Human
uucacuuuuauaagaaa

SEQ ID NO: 1727216 - RNA, 21 nt, Human
gacagucaccucauggaauug

SEQ ID NO: 1727217 - RNA, 19 nt, Human
augcagagguccacaacac

SEQ ID NO: 1727218 - RNA, 14 nt, Human
auauauuuccuuau

SEQ ID NO: 1727219 - RNA, 15 nt, Human
ugcuucuguuuuaua

SEQ ID NO: 1727220 - RNA, 13 nt, Human
cugagagugaaca

SEQ ID NO: 1727221 - RNA, 12 nt, Human
guaaaggcaaac

SEQ ID NO: 1727222 - RNA, 14 nt, Human
cuggagcucugccc

SEQ ID NO: 1727223 - RNA, 12 nt, Human
gguuuauauaag

SEQ ID NO: 1727224 - RNA, 13 nt, Human
ccagcccuccuua

SEQ ID NO: 1727225 - RNA, 16 nt, Human
uauccuacuuccccuu

SEQ ID NO: 1727226 - RNA, 13 nt, Human
cuacagugagcca

SEQ ID NO: 1727227 - RNA, 16 nt, Human
uuugcuguuauuuuau

SEQ ID NO: 1727228 - RNA, 12 nt, Human
augaccaacauc

SEQ ID NO: 1727229 - RNA, 16 nt, Human
cccuauccuacuuccc

SEQ ID NO: 1727230 - RNA, 11 nt, Human
ugcagugagcc

SEQ ID NO: 1727231 - RNA, 15 nt, Human
caaggaaaaaauaac

SEQ ID NO: 1727232 - RNA, 17 nt, Human
agaugggagaaucacuu

SEQ ID NO: 1727233 - RNA, 16 nt, Human
guuucacaccuuaucu

SEQ ID NO: 1727234 - RNA, 16 nt, Human
gacauagaauuaacac

SEQ ID NO: 1727235 - RNA, 19 nt, Human
caagaaggaaagauuuugu

SEQ ID NO: 1727236 - RNA, 20 nt, Human
gaccauacuaauuauacccc

SEQ ID NO: 1727237 - RNA, 21 nt, Human
gccugaucaccugcccugcug

SEQ ID NO: 1727238 - RNA, 16 nt, Human
cauagaaguaaaaaca

SEQ ID NO: 1727239 - RNA, 12 nt, Human
ucccccucuggc

SEQ ID NO: 1727240 - RNA, 13 nt, Human
ucuaagaagugaa

SEQ ID NO: 1727241 - RNA, 21 nt, Human
aauucauucacucaacaaaca

SEQ ID NO: 1727242 - RNA, 21 nt, Human
gaaaaaaagcuuuuuuugaau

SEQ ID NO: 1727243 - RNA, 14 nt, Human
aaauauaaauaaaa

SEQ ID NO: 1727244 - RNA, 14 nt, Human
auaaauaaaaauaa

SEQ ID NO: 1727245 - RNA, 17 nt, Human
cucguggaacaguuacc

SEQ ID NO: 1727246 - RNA, 14 nt, Human
cuacagaacuaaaa

SEQ ID NO: 1727247 - RNA, 17 nt, Human
gccugagcgacagugag

SEQ ID NO: 1727248 - RNA, 17 nt, Human
cauuguuggcuguuccu

SEQ ID NO: 1727249 - RNA, 13 nt, Human
aaaaaugguuuaa

SEQ ID NO: 1727250 - RNA, 20 nt, Human
uggauuuaauguggaaauga

SEQ ID NO: 1727251 - RNA, 16 nt, Human
uagcuacuaauuuuaa

SEQ ID NO: 1727252 - RNA, 21 nt, Human
ccucccuuggggccuaugcag

SEQ ID NO: 1727253 - RNA, 22 nt, Human
aaucacuggcuguuaaucuuuc

SEQ ID NO: 1727254 - RNA, 16 nt, Human
acuuuuauaagaaaua

SEQ ID NO: 1727255 - RNA, 20 nt, Human
uguaagaaaauaucacuugu

SEQ ID NO: 1727256 - RNA, 21 nt, Human
gccuauagucccacuacuugu

SEQ ID NO: 1727257 - RNA, 19 nt, Human
ccauccugccccugagccc

SEQ ID NO: 1727258 - RNA, 17 nt, Human
aaaguacaagagcuuaa

SEQ ID NO: 1727259 - RNA, 14 nt, Human
acaaauccaaugaa

SEQ ID NO: 1727260 - RNA, 13 nt, Human
cuucucaacucca

SEQ ID NO: 1727261 - RNA, 14 nt, Human
cauuuauguuccuu

SEQ ID NO: 1727262 - RNA, 13 nt, Human
cccaaaaggcaga

SEQ ID NO: 1727263 - RNA, 12 nt, Human
auaaaauacaaa

SEQ ID NO: 1727264 - RNA, 16 nt, Human
ucagcagagaaguuuu

SEQ ID NO: 1727265 - RNA, 20 nt, Human
aaauccuugaagauuuacca

SEQ ID NO: 1727266 - RNA, 12 nt, Human
cuaccaaaaaaa

SEQ ID NO: 1727267 - RNA, 21 nt, Human
uccuacaagacacagugacca

SEQ ID NO: 1727268 - RNA, 18 nt, Human
aagggaauuucuucaacu

SEQ ID NO: 1727269 - RNA, 15 nt, Human
uuuaugguuguauua

SEQ ID NO: 1727270 - RNA, 15 nt, Human
cccccagcccuccuu

SEQ ID NO: 1727271 - RNA, 21 nt, Human
gcagaucuacaugucuagaga

SEQ ID NO: 1727272 - RNA, 15 nt, Human
accaaggcugauuaa

SEQ ID NO: 1727273 - RNA, 15 nt, Human
ugcagauaaacagua

SEQ ID NO: 1727274 - RNA, 14 nt, Human
auuuauuaaguauu

SEQ ID NO: 1727275 - RNA, 12 nt, Human
cagugaaagaaa

SEQ ID NO: 1727276 - RNA, 22 nt, Human
agaaugagagacacacugaaga

SEQ ID NO: 1727277 - RNA, 13 nt, Human
auaacuggaaacu

SEQ ID NO: 1727278 - RNA, 17 nt, Human
agaaugacugacaaaga

SEQ ID NO: 1727279 - RNA, 15 nt, Human
auuauuuuuuaaaaa

SEQ ID NO: 1727280 - RNA, 15 nt, Human
uuuaaggauucugag

SEQ ID NO: 1727281 - RNA, 23 nt, Human
agcucugcccauccugccccuga

SEQ ID NO: 1727282 - RNA, 15 nt, Human
caaauccaaugaaau

SEQ ID NO: 1727283 - RNA, 22 nt, Human
uuccuagucuguuuucccuccu

SEQ ID NO: 1727284 - RNA, 22 nt, Human
aaacguauucaaacaauuugaa

SEQ ID NO: 1727285 - RNA, 19 nt, Human
cuuggggccuaugcagagg

SEQ ID NO: 1727286 - RNA, 19 nt, Human
uguucaugcccauaccccu

SEQ ID NO: 1727287 - RNA, 16 nt, Human
uaagaaauaggaaaua

SEQ ID NO: 1727288 - RNA, 20 nt, Human
aucauuuaguuauaaaaaua

SEQ ID NO: 1727289 - RNA, 23 nt, Human
gcuaugcuauugaaguuuuggca

SEQ ID NO: 1727290 - RNA, 19 nt, Human
aggucuaccaaaaaucuca

SEQ ID NO: 1727291 - RNA, 16 nt, Human
gugaaaccuggucucu

SEQ ID NO: 1727292 - RNA, 18 nt, Human
gcauggccacaucugagc

SEQ ID NO: 1727293 - RNA, 17 nt, Human
uugccaaauauaaauaa

SEQ ID NO: 1727294 - RNA, 18 nt, Human
gccugggcaacaugguga

SEQ ID NO: 1727295 - RNA, 13 nt, Human
aggauuugaaauu

SEQ ID NO: 1727296 - RNA, 15 nt, Human
auaauccuaaacaua

SEQ ID NO: 1727297 - RNA, 20 nt, Human
uggccacacaggaucuuuug

SEQ ID NO: 1727298 - RNA, 22 nt, Human
cuuccuaauuccacagcugcuc

SEQ ID NO: 1727299 - RNA, 15 nt, Human
uuauaugcuauuuau

SEQ ID NO: 1727300 - RNA, 14 nt, Human
cugaaacaaaauua

SEQ ID NO: 1727301 - RNA, 11 nt, Human
cuguuuuauaa

SEQ ID NO: 1727302 - RNA, 22 nt, Human
ggcauuuaggccaugggacagg

SEQ ID NO: 1727303 - RNA, 11 nt, Human
caauaaaagac

SEQ ID NO: 1727304 - RNA, 14 nt, Human
acccaaaaggcaga

SEQ ID NO: 1727305 - RNA, 16 nt, Human
ccugccccccagcccu

SEQ ID NO: 1727306 - RNA, 20 nt, Human
cagcuggccgggagccugau

SEQ ID NO: 1727307 - RNA, 15 nt, Human
uccauugggcaggca

SEQ ID NO: 1727308 - RNA, 18 nt, Human
acaagccuccuuuuaaag

SEQ ID NO: 1727309 - RNA, 13 nt, Human
acuuauuggaaug

SEQ ID NO: 1727310 - RNA, 19 nt, Human
aucuauguagaauauauuu

SEQ ID NO: 1727311 - RNA, 17 nt, Human
uuaaauggucaauuuug

SEQ ID NO: 1727312 - RNA, 14 nt, Human
cuucucuucacagu

SEQ ID NO: 1727313 - RNA, 20 nt, Human
ggucaacauagugagacacu

SEQ ID NO: 1727314 - RNA, 17 nt, Human
aaagaaacauuugguaa

SEQ ID NO: 1727315 - RNA, 14 nt, Human
gucucaauaaauaa

SEQ ID NO: 1727316 - RNA, 21 nt, Human
ccugaucaccugcccugcuga

SEQ ID NO: 1727317 - RNA, 18 nt, Human
auguuccuuuuaaagaaa

SEQ ID NO: 1727318 - RNA, 12 nt, Human
cuucaacucccu

SEQ ID NO: 1727319 - RNA, 15 nt, Human
auaauuuugugaagc

SEQ ID NO: 1727320 - RNA, 22 nt, Human
gacacaugugcuggccaccugc

SEQ ID NO: 1727321 - RNA, 11 nt, Human
ugggggcagca

SEQ ID NO: 1727322 - RNA, 18 nt, Human
aacaaaguugauuaagaa

SEQ ID NO: 1727323 - RNA, 15 nt, Human
auuucacuuuagaaa

SEQ ID NO: 1727324 - RNA, 14 nt, Human
cccugccucaagcu

SEQ ID NO: 1727325 - RNA, 11 nt, Human
caacucccugc

SEQ ID NO: 1727326 - RNA, 12 nt, Human
uuuuauauuuga

SEQ ID NO: 1727327 - RNA, 18 nt, Human
gaaauacguuaggaggac

SEQ ID NO: 1727328 - RNA, 20 nt, Human
ccgauaucuucagaaaaccu

SEQ ID NO: 1727329 - RNA, 17 nt, Human
aaauccuacuuucauaa

SEQ ID NO: 1727330 - RNA, 19 nt, Human
ucucaaggagaggcaaaga

SEQ ID NO: 1727331 - RNA, 16 nt, Human
ugacuuaaugccacua

SEQ ID NO: 1727332 - RNA, 18 nt, Human
uguauucuuuuaguuuuu

SEQ ID NO: 1727333 - RNA, 18 nt, Human
uagcccuuccccucugca

SEQ ID NO: 1727334 - RNA, 19 nt, Human
uguauacugugugcuaaaa

SEQ ID NO: 1727335 - RNA, 18 nt, Human
cugagucccaggcugagc

SEQ ID NO: 1727336 - RNA, 20 nt, Human
uuuuaaagaaacaaaaauca

SEQ ID NO: 1727337 - RNA, 18 nt, Human
gagcgacagugagacucu

SEQ ID NO: 1727338 - RNA, 19 nt, Human
uguggauuuaauguggaaa

SEQ ID NO: 1727339 - RNA, 22 nt, Human
uaauaucuuaucuuccuauaau

SEQ ID NO: 1727340 - RNA, 15 nt, Human
augcccauaccccug

SEQ ID NO: 1727341 - RNA, 23 nt, Human
cucagcccuggugggcagagagg

SEQ ID NO: 1727342 - RNA, 14 nt, Human
aaucucaauauuuc

SEQ ID NO: 1727343 - RNA, 21 nt, Human
ugcccauccugccccugagcc

SEQ ID NO: 1727344 - RNA, 19 nt, Human
cuggggcuuuaacuccugc

SEQ ID NO: 1727345 - RNA, 20 nt, Human
auauguuagagaauuuccuu

SEQ ID NO: 1727346 - RNA, 19 nt, Human
aaacaaaaggauaaugaau

SEQ ID NO: 1727347 - RNA, 17 nt, Human
aaacauccuacaagaca

SEQ ID NO: 1727348 - RNA, 15 nt, Human
gcagagguugcagug

SEQ ID NO: 1727349 - RNA, 12 nt, Human
cauagaaguaaa

SEQ ID NO: 1727350 - RNA, 21 nt, Human
cacuugaacccgggaggcaga

SEQ ID NO: 1727351 - RNA, 23 nt, Human
aguaauuggaaaggcagcucuaa

SEQ ID NO: 1727352 - RNA, 17 nt, Human
aaauguucaucaaugaa

SEQ ID NO: 1727353 - RNA, 14 nt, Human
aaaagaaagaaaau

SEQ ID NO: 1727354 - RNA, 19 nt, Human
uugugccccugcacuccag

SEQ ID NO: 1727355 - RNA, 14 nt, Human
aaacugaaacaaaa

SEQ ID NO: 1727356 - RNA, 20 nt, Human
cuacuuccccuuccuaauuc

SEQ ID NO: 1727357 - RNA, 20 nt, Human
uauguccuuggugccuggag

SEQ ID NO: 1727358 - RNA, 19 nt, Human
uccccuauccuacuucccc

SEQ ID NO: 1727359 - RNA, 21 nt, Human
gaaauguuuacagauccccaa

SEQ ID NO: 1727360 - RNA, 14 nt, Human
ugcucauggaauug

SEQ ID NO: 1727361 - RNA, 18 nt, Human
ugugaccacugcagaaga

SEQ ID NO: 1727362 - RNA, 15 nt, Human
caaggagaggcaaag

SEQ ID NO: 1727363 - RNA, 15 nt, Human
cacaggacagcccuu

SEQ ID NO: 1727364 - RNA, 22 nt, Human
cuaagcuucacuguaaaauaau

SEQ ID NO: 1727365 - RNA, 17 nt, Human
ccugagcuugcagagau

SEQ ID NO: 1727366 - RNA, 23 nt, Human
accucucuggguugaagggcagu

SEQ ID NO: 1727367 - RNA, 16 nt, Human
auccaaugaaaugagu

SEQ ID NO: 1727368 - RNA, 18 nt, Human
auuagaaauguaauuaug

SEQ ID NO: 1727369 - RNA, 16 nt, Human
cuuauaauuuaaaaua

SEQ ID NO: 1727370 - RNA, 22 nt, Human
uuuccuuauucagaauuucuaa

SEQ ID NO: 1727371 - RNA, 18 nt, Human
gccugagcgacagugaga

SEQ ID NO: 1727372 - RNA, 14 nt, Human
ugaagauguagagg

SEQ ID NO: 1727373 - RNA, 14 nt, Human
ggccgggagccuga

SEQ ID NO: 1727374 - RNA, 20 nt, Human
caaacauccuacaagacaca

SEQ ID NO: 1727375 - RNA, 11 nt, Human
aauaaauaaau

SEQ ID NO: 1727376 - RNA, 22 nt, Human
caagcucuaucaccaaggagcc

SEQ ID NO: 1727377 - RNA, 15 nt, Human
augguuguauuauuu

SEQ ID NO: 1727378 - RNA, 18 nt, Human
gcagcccuuagcccuucc

SEQ ID NO: 1727379 - RNA, 18 nt, Human
aauuuuagacauucuuua

SEQ ID NO: 1727380 - RNA, 15 nt, Human
cagcuggccuuguga

SEQ ID NO: 1727381 - RNA, 14 nt, Human
gaaggugaucuggc

SEQ ID NO: 1727382 - RNA, 22 nt, Human
agccaaacauccuacaagacac

SEQ ID NO: 1727383 - RNA, 17 nt, Human
aaaauuagaaauguaau

SEQ ID NO: 1727384 - RNA, 21 nt, Human
cccuauccuacuuccccuucc

SEQ ID NO: 1727385 - RNA, 16 nt, Human
aaaaugugauauguac

SEQ ID NO: 1727386 - RNA, 13 nt, Human
uuguaacugucuu

SEQ ID NO: 1727387 - RNA, 12 nt, Human
gacagugaaaga

SEQ ID NO: 1727388 - RNA, 17 nt, Human
cucugauccgagcucag

SEQ ID NO: 1727389 - RNA, 22 nt, Human
cuccagccugagcgacagugag

SEQ ID NO: 1727390 - RNA, 14 nt, Human
ugagcucaccaguc

SEQ ID NO: 1727391 - RNA, 23 nt, Human
cuaggaugggaacaaggaaggaa

SEQ ID NO: 1727392 - RNA, 20 nt, Human
caccuccuaagaaggcaccu

SEQ ID NO: 1727393 - RNA, 14 nt, Human
uauuugcuguuauu

SEQ ID NO: 1727394 - RNA, 21 nt, Human
uucagcucagcuaaugaagug

SEQ ID NO: 1727395 - RNA, 20 nt, Human
ucugaaaguuuuggaaacgu

SEQ ID NO: 1727396 - RNA, 21 nt, Human
auguuuaauucugaaagcaac

SEQ ID NO: 1727397 - RNA, 15 nt, Human
guuauaaaaauauau

SEQ ID NO: 1727398 - RNA, 17 nt, Human
uucuccacuggaaaacu

SEQ ID NO: 1727399 - RNA, 17 nt, Human
uuucauaagaauucugu

SEQ ID NO: 1727400 - RNA, 18 nt, Human
gcacuccagccugagcga

SEQ ID NO: 1727401 - RNA, 15 nt, Human
gcuguucuuuaaaug

SEQ ID NO: 1727402 - RNA, 20 nt, Human
gaauucauucacucaacaaa

SEQ ID NO: 1727403 - RNA, 13 nt, Human
cuaggcauagccc

SEQ ID NO: 1727404 - RNA, 11 nt, Human
aauuuaaauau

SEQ ID NO: 1727405 - RNA, 21 nt, Human
cgacagugagacucugucuca

SEQ ID NO: 1727406 - RNA, 18 nt, Human
cuuagaugggcauggugg

SEQ ID NO: 1727407 - RNA, 20 nt, Human
uggggcuuuaacuccugcua

SEQ ID NO: 1727408 - RNA, 13 nt, Human
cauggaaaaguuu

SEQ ID NO: 1727409 - RNA, 13 nt, Human
uagcuaaguuuug

SEQ ID NO: 1727410 - RNA, 21 nt, Human
cuagucuguuuucccuccuug

SEQ ID NO: 1727411 - RNA, 18 nt, Human
ugccauaauuacuauguc

SEQ ID NO: 1727412 - RNA, 17 nt, Human
ccucagucucccucccu

SEQ ID NO: 1727413 - RNA, 14 nt, Human
aauuagaaauguaa

SEQ ID NO: 1727414 - RNA, 23 nt, Human
aggaccggccuuugcaccuccau

SEQ ID NO: 1727415 - RNA, 19 nt, Human
uauuuaauuauuucacuuu

SEQ ID NO: 1727416 - RNA, 18 nt, Human
ugaagaagcuagaaaaca

SEQ ID NO: 1727417 - RNA, 12 nt, Human
uaaaugcucaau

SEQ ID NO: 1727418 - RNA, 21 nt, Human
caucuagcaugucgucaaagc

SEQ ID NO: 1727419 - RNA, 21 nt, Human
cucaagcuaugugagcucacc

SEQ ID NO: 1727420 - RNA, 15 nt, Human
ucaccagucccuccc

SEQ ID NO: 1727421 - RNA, 21 nt, Human
gacagugaaagaaaauaacaa

SEQ ID NO: 1727422 - RNA, 16 nt, Human
agguacuucaaauccu

SEQ ID NO: 1727423 - RNA, 18 nt, Human
acugugugcuaaaacaag

SEQ ID NO: 1727424 - RNA, 21 nt, Human
uggaaacguauucaaacaauu

SEQ ID NO: 1727425 - RNA, 14 nt, Human
ccaggcaugguggu

SEQ ID NO: 1727426 - RNA, 17 nt, Human
auggcuaguaucaaaag

SEQ ID NO: 1727427 - RNA, 15 nt, Human
ugucaauaaaaucca

SEQ ID NO: 1727428 - RNA, 16 nt, Human
uugccauaauuacuau

SEQ ID NO: 1727429 - RNA, 22 nt, Human
cuccugccuaagugcagccccg

SEQ ID NO: 1727430 - RNA, 22 nt, Human
aacaaaguugauuaagaaagga

SEQ ID NO: 1727431 - RNA, 17 nt, Human
uuucacauuuaaauaaa

SEQ ID NO: 1727432 - RNA, 19 nt, Human
uaaugaaguguuuagcaua

SEQ ID NO: 1727433 - RNA, 19 nt, Human
gagccugaucaccugcccu

SEQ ID NO: 1727434 - RNA, 13 nt, Human
uaagugcagcccc

SEQ ID NO: 1727435 - RNA, 19 nt, Human
gcccuuccccucugcagcu

SEQ ID NO: 1727436 - RNA, 15 nt, Human
gaaagaaaauaacga

SEQ ID NO: 1727437 - RNA, 14 nt, Human
ccaugaccaacauc

SEQ ID NO: 1727438 - RNA, 16 nt, Human
aucacuuuaggccugg

SEQ ID NO: 1727439 - RNA, 23 nt, Human
cucuugaggcacagaaacuccug

SEQ ID NO: 1727440 - RNA, 19 nt, Human
accccugagcuugcagaga

SEQ ID NO: 1727441 - RNA, 20 nt, Human
aaugaauacuuuauaaagga

SEQ ID NO: 1727442 - RNA, 17 nt, Human
aaaggaaggaagggaca

SEQ ID NO: 1727443 - RNA, 19 nt, Human
gaaugggggcagcaccucc

SEQ ID NO: 1727444 - RNA, 13 nt, Human
uacauaaaauaca

SEQ ID NO: 1727445 - RNA, 20 nt, Human
uugauaaguacaugauaagc

SEQ ID NO: 1727446 - RNA, 15 nt, Human
acauccuacaagaca

SEQ ID NO: 1727447 - RNA, 15 nt, Human
ugagcucagcccugg

SEQ ID NO: 1727448 - RNA, 21 nt, Human
caaggaaaaaauaacaaugaa

SEQ ID NO: 1727449 - RNA, 18 nt, Human
uguggucacaggaaguag

SEQ ID NO: 1727450 - RNA, 17 nt, Human
cucuuuugggauuuuug

SEQ ID NO: 1727451 - RNA, 17 nt, Human
gacagucaccucaugga

SEQ ID NO: 1727452 - RNA, 16 nt, Human
caugguuuagaaagcu

SEQ ID NO: 1727453 - RNA, 20 nt, Human
cagccugagcgacagugaga

SEQ ID NO: 1727454 - RNA, 23 nt, Human
auuaccauuauggauaaagauga

SEQ ID NO: 1727455 - RNA, 13 nt, Human
agacacagugacc

SEQ ID NO: 1727456 - RNA, 20 nt, Human
aagucaucugaugagaacaa

SEQ ID NO: 1727457 - RNA, 14 nt, Human
agcucuaucaccaa

SEQ ID NO: 1727458 - RNA, 17 nt, Human
uccauccugaggcucca

SEQ ID NO: 1727459 - RNA, 13 nt, Human
cuuuccaugaguu

SEQ ID NO: 1727460 - RNA, 22 nt, Human
agggagucucagcuucacccug

SEQ ID NO: 1727461 - RNA, 21 nt, Human
uauuacuguaagaaaauauca

SEQ ID NO: 1727462 - RNA, 14 nt, Human
aaauaaaaacaaag

SEQ ID NO: 1727463 - RNA, 12 nt, Human
uaguuuuuaaag

SEQ ID NO: 1727464 - RNA, 22 nt, Human
gcuugcagagaugaggccgcca

SEQ ID NO: 1727465 - RNA, 11 nt, Human
augggacaggg

SEQ ID NO: 1727466 - RNA, 22 nt, Human
gaagugaaaaucuacacuccag

SEQ ID NO: 1727467 - RNA, 20 nt, Human
uuugccgcuuaagcuuucag

SEQ ID NO: 1727468 - RNA, 21 nt, Human
uccccuugggggugguggaug

SEQ ID NO: 1727469 - RNA, 14 nt, Human
acuaauuuuaaaau

SEQ ID NO: 1727470 - RNA, 20 nt, Human
aguugauuuaaggccaggca

SEQ ID NO: 1727471 - RNA, 22 nt, Human
aacucccugccccccagcccuc

SEQ ID NO: 1727472 - RNA, 17 nt, Human
cagggcugaagcugugu

SEQ ID NO: 1727473 - RNA, 12 nt, Human
cagaacagugau

SEQ ID NO: 1727474 - RNA, 18 nt, Human
cagugaaagaaaauaaca

SEQ ID NO: 1727475 - RNA, 22 nt, Human
uugacccacaagaaaugaaagc

SEQ ID NO: 1727476 - RNA, 13 nt, Human
auccugaggcucc

SEQ ID NO: 1727477 - RNA, 20 nt, Human
cugagguuguguguggaagg

SEQ ID NO: 1727478 - RNA, 14 nt, Human
cuguaaucacagcu

SEQ ID NO: 1727479 - RNA, 19 nt, Human
cugcaaagcccagcuugaa

SEQ ID NO: 1727480 - RNA, 17 nt, Human
agggagucucagcuuca

SEQ ID NO: 1727481 - RNA, 17 nt, Human
cagacaucaacagauaa

SEQ ID NO: 1727482 - RNA, 19 nt, Human
cuaagcuucacuguaaaau

SEQ ID NO: 1727483 - RNA, 16 nt, Human
guuccuuccucugagc

SEQ ID NO: 1727484 - RNA, 17 nt, Human
aaagcuccauuuuuagu

SEQ ID NO: 1727485 - RNA, 21 nt, Human
augaauacuuuauaaaggauu

SEQ ID NO: 1727486 - RNA, 18 nt, Human
uaggugacuauuauauuu

SEQ ID NO: 1727487 - RNA, 23 nt, Human
uaaaauauaugaggcuacagaac

SEQ ID NO: 1727488 - RNA, 16 nt, Human
aauuuuuaauuauaug

SEQ ID NO: 1727489 - RNA, 13 nt, Human
agaauauauuucc

SEQ ID NO: 1727490 - RNA, 14 nt, Human
uuagagaauuuccu

SEQ ID NO: 1727491 - RNA, 19 nt, Human
uauacugugugcuaaaaca

SEQ ID NO: 1727492 - RNA, 16 nt, Human
gaugggcaaaaaacca

SEQ ID NO: 1727493 - RNA, 20 nt, Human
aaacuuuaugcuaagugaaa

SEQ ID NO: 1727494 - RNA, 21 nt, Human
aggacagcccuucuuuccaca

SEQ ID NO: 1727495 - RNA, 18 nt, Human
cagcugcucaauaaagua

SEQ ID NO: 1727496 - RNA, 13 nt, Human
cucugcagcuucc

SEQ ID NO: 1727497 - RNA, 19 nt, Human
agaaaauaacgauaaaaga

SEQ ID NO: 1727498 - RNA, 17 nt, Human
ggaaggcugaggcagga

SEQ ID NO: 1727499 - RNA, 16 nt, Human
aggaggaucacuugag

SEQ ID NO: 1727500 - RNA, 15 nt, Human
auaugcuucuuugug

SEQ ID NO: 1727501 - RNA, 20 nt, Human
accugauuucugagcauuua

SEQ ID NO: 1727502 - RNA, 14 nt, Human
uugugauugauuau

SEQ ID NO: 1727503 - RNA, 22 nt, Human
ugauugugggauacuauuuaau

SEQ ID NO: 1727504 - RNA, 18 nt, Human
ugcuauuuauuaaguauu

SEQ ID NO: 1727505 - RNA, 21 nt, Human
caccagucugacuguuuccau

SEQ ID NO: 1727506 - RNA, 18 nt, Human
ccauccugccccugagcc

SEQ ID NO: 1727507 - RNA, 15 nt, Human
acaaaguugauuaag

SEQ ID NO: 1727508 - RNA, 22 nt, Human
agaucacuugagcucaggaggu

SEQ ID NO: 1727509 - RNA, 14 nt, Human
uauaaauaaaaaua

SEQ ID NO: 1727510 - RNA, 19 nt, Human
aaguugcauagguuuaaua

SEQ ID NO: 1727511 - RNA, 21 nt, Human
ugggaggcugagaugggagaa

SEQ ID NO: 1727512 - RNA, 16 nt, Human
ugccucaccccuugcc

SEQ ID NO: 1727513 - RNA, 16 nt, Human
uagaauauauuuccuu

SEQ ID NO: 1727514 - RNA, 15 nt, Human
cuucucuucacaguc

SEQ ID NO: 1727515 - RNA, 14 nt, Human
agagacagaaagca

SEQ ID NO: 1727516 - RNA, 16 nt, Human
cccccagcccuccuua

SEQ ID NO: 1727517 - RNA, 19 nt, Human
cccccucuggcuccagcug

SEQ ID NO: 1727518 - RNA, 23 nt, Human
aucucuucuggguuccuuccucu

SEQ ID NO: 1727519 - RNA, 14 nt, Human
aggggaccagagag

SEQ ID NO: 1727520 - RNA, 11 nt, Human
uuauauuucca

SEQ ID NO: 1727521 - RNA, 14 nt, Human
gcagaucacuugag

SEQ ID NO: 1727522 - RNA, 16 nt, Human
gauguugacucuaaag

SEQ ID NO: 1727523 - RNA, 18 nt, Human
aaagaaaaucaggcuggc

SEQ ID NO: 1727524 - RNA, 21 nt, Human
aaagcugaaauggacuuuugu

SEQ ID NO: 1727525 - RNA, 13 nt, Human
uuauguuuaauuc

SEQ ID NO: 1727526 - RNA, 22 nt, Human
cagugagccaaauguaaaauag

SEQ ID NO: 1727527 - RNA, 18 nt, Human
ggaacuggugucuucagg

SEQ ID NO: 1727528 - RNA, 22 nt, Human
augcagagguccacaacacaca

SEQ ID NO: 1727529 - RNA, 21 nt, Human
uauaaaauaauuuuuauauuu

SEQ ID NO: 1727530 - RNA, 21 nt, Human
ccuuuuuuugaaaaaaagcuu

SEQ ID NO: 1727531 - RNA, 14 nt, Human
cucccucccuuggg

SEQ ID NO: 1727532 - RNA, 12 nt, Human
uucagccugaaa

SEQ ID NO: 1727533 - RNA, 15 nt, Human
uucugcacacagcac

SEQ ID NO: 1727534 - RNA, 18 nt, Human
cuacauaaaauacaaaaa

SEQ ID NO: 1727535 - RNA, 11 nt, Human
auuaaaaccuc

SEQ ID NO: 1727536 - RNA, 14 nt, Human
uggacucaccuccc

SEQ ID NO: 1727537 - RNA, 20 nt, Human
ugagagacacacugaagaag

SEQ ID NO: 1727538 - RNA, 17 nt, Human
ugaacuugguuuuaauu

SEQ ID NO: 1727539 - RNA, 22 nt, Human
cucagcccuggugggcagagag

SEQ ID NO: 1727540 - RNA, 20 nt, Human
caaauauaaauaaaaauaau

SEQ ID NO: 1727541 - RNA, 20 nt, Human
aaaaucuuauaauuuaaaau

SEQ ID NO: 1727542 - RNA, 14 nt, Human
ucuuuuuuuuaaua

SEQ ID NO: 1727543 - RNA, 17 nt, Human
uuuuauaugcuauuuau

SEQ ID NO: 1727544 - RNA, 17 nt, Human
gauaucuucagaaaacc

SEQ ID NO: 1727545 - RNA, 23 nt, Human
uugacccucacaggagcaucucc

SEQ ID NO: 1727546 - RNA, 17 nt, Human
ugcccauaccccuggcc

SEQ ID NO: 1727547 - RNA, 23 nt, Human
cacuggacucaccucccccaucu

SEQ ID NO: 1727548 - RNA, 14 nt, Human
uaaaggaauuuaaa

SEQ ID NO: 1727549 - RNA, 17 nt, Human
caucagcaucccuagaa

SEQ ID NO: 1727550 - RNA, 17 nt, Human
cucugcaagaagaaauc

SEQ ID NO: 1727551 - RNA, 22 nt, Human
auauuuccuuauucagaauuuc

SEQ ID NO: 1727552 - RNA, 15 nt, Human
agggaagacaagaag

SEQ ID NO: 1727553 - RNA, 22 nt, Human
uuuauaagaaauaggaaauauu

SEQ ID NO: 1727554 - RNA, 20 nt, Human
uauaugcuaagucuuauaua

SEQ ID NO: 1727555 - RNA, 23 nt, Human
aggcugaggcaggaggaucacuu

SEQ ID NO: 1727556 - RNA, 19 nt, Human
cucauggaauuggagcucg

SEQ ID NO: 1727557 - RNA, 19 nt, Human
uaccccuggccaaggaaga

SEQ ID NO: 1727558 - RNA, 18 nt, Human
uauguuccuuuuaaagaa

SEQ ID NO: 1727559 - RNA, 23 nt, Human
aggagcuguugagguaccuccaa

SEQ ID NO: 1727560 - RNA, 12 nt, Human
aucuucacuuuu

SEQ ID NO: 1727561 - RNA, 13 nt, Human
ccaaaagguauuu

SEQ ID NO: 1727562 - RNA, 19 nt, Human
accuccuaagaaggcaccu

SEQ ID NO: 1727563 - RNA, 16 nt, Human
aaauguaauuauguuc

SEQ ID NO: 1727564 - RNA, 22 nt, Human
aggcuccacuuggucugugaga

SEQ ID NO: 1727565 - RNA, 15 nt, Human
gauuaagaaaggaag

SEQ ID NO: 1727566 - RNA, 15 nt, Human
aagccuggcaaggga

SEQ ID NO: 1727567 - RNA, 21 nt, Human
gagauuuugcuugagcaggau

SEQ ID NO: 1727568 - RNA, 16 nt, Human
uucccaacuccagaaa

SEQ ID NO: 1727569 - RNA, 16 nt, Human
cuucuggguuccuucc

SEQ ID NO: 1727570 - RNA, 23 nt, Human
cgaaauacguuaggaggacaaaa

SEQ ID NO: 1727571 - RNA, 13 nt, Human
gugagcaucaucu

SEQ ID NO: 1727572 - RNA, 13 nt, Human
accaacacccuga

SEQ ID NO: 1727573 - RNA, 15 nt, Human
aguauaggccaggca

SEQ ID NO: 1727574 - RNA, 18 nt, Human
ggaaagaauaaccaacac

SEQ ID NO: 1727575 - RNA, 14 nt, Human
aaaggaauuuaaaa

SEQ ID NO: 1727576 - RNA, 17 nt, Human
cuacacuccagugagac

SEQ ID NO: 1727577 - RNA, 15 nt, Human
cagugaaagaaaaua

SEQ ID NO: 1727578 - RNA, 18 nt, Human
auuauuucacuuuagaaa

SEQ ID NO: 1727579 - RNA, 17 nt, Human
guugauuuaaggccagg

SEQ ID NO: 1727580 - RNA, 22 nt, Human
auaacaaugcuguauuuuaaaa

SEQ ID NO: 1727581 - RNA, 16 nt, Human
guuaucuucacuuuua

SEQ ID NO: 1727582 - RNA, 22 nt, Human
aauugacccacaagaaaugaaa

SEQ ID NO: 1727583 - RNA, 22 nt, Human
cuuuccacagaagcuccaggua

SEQ ID NO: 1727584 - RNA, 23 nt, Human
aaaaugggcuuuggaugauuauu

SEQ ID NO: 1727585 - RNA, 16 nt, Human
uugucaauaaaaucca

SEQ ID NO: 1727586 - RNA, 13 nt, Human
caacauagugaga

SEQ ID NO: 1727587 - RNA, 17 nt, Human
caagccuccuuuuaaag

SEQ ID NO: 1727588 - RNA, 12 nt, Human
uaagaaggcacc

SEQ ID NO: 1727589 - RNA, 15 nt, Human
cuaucuuugagcgcc

SEQ ID NO: 1727590 - RNA, 14 nt, Human
ugaggcuacagaac

SEQ ID NO: 1727591 - RNA, 17 nt, Human
aggcuagaaccaccugc

SEQ ID NO: 1727592 - RNA, 23 nt, Human
uguugagguaccuccaaggaccg

SEQ ID NO: 1727593 - RNA, 22 nt, Human
ucuagcaugucgucaaagcuga

SEQ ID NO: 1727594 - RNA, 16 nt, Human
uuucacauuuaaauaa

SEQ ID NO: 1727595 - RNA, 23 nt, Human
aagagccuuuuuuugaaaaaaag

SEQ ID NO: 1727596 - RNA, 20 nt, Human
guucugcagauaaacaguag

SEQ ID NO: 1727597 - RNA, 23 nt, Human
gcuggccuugugaggagcuggaa

SEQ ID NO: 1727598 - RNA, 22 nt, Human
auggaaauguuuacagaucccc

SEQ ID NO: 1727599 - RNA, 13 nt, Human
caguuauuauauu

SEQ ID NO: 1727600 - RNA, 19 nt, Human
ugaucaccugcccugcuga

SEQ ID NO: 1727601 - RNA, 17 nt, Human
cuggacucaccuccccc

SEQ ID NO: 1727602 - RNA, 20 nt, Human
ugccccccagcccuccuuau

SEQ ID NO: 1727603 - RNA, 20 nt, Human
gagccucagucucccucccu

SEQ ID NO: 1727604 - RNA, 19 nt, Human
aauuuuguuauguauauuu

SEQ ID NO: 1727605 - RNA, 18 nt, Human
uauagcuacuaauuuuaa

SEQ ID NO: 1727606 - RNA, 20 nt, Human
uuagcauaguaccucugcua

SEQ ID NO: 1727607 - RNA, 21 nt, Human
uacaugagguacugagaguga

SEQ ID NO: 1727608 - RNA, 18 nt, Human
aaacugccaucauuuacu

SEQ ID NO: 1727609 - RNA, 15 nt, Human
auccugccccugagc

SEQ ID NO: 1727610 - RNA, 14 nt, Human
aguauaggccaggc

SEQ ID NO: 1727611 - RNA, 22 nt, Human
augucuagagaacacugugcuc

SEQ ID NO: 1727612 - RNA, 12 nt, Human
uauauuuccuua

SEQ ID NO: 1727613 - RNA, 20 nt, Human
aaagagugaaggauuuaugu

SEQ ID NO: 1727614 - RNA, 19 nt, Human
cuagaguuuagcuggaaaa

SEQ ID NO: 1727615 - RNA, 14 nt, Human
ggaaguagaggagg

SEQ ID NO: 1727616 - RNA, 15 nt, Human
auuuuaaaagaauga

SEQ ID NO: 1727617 - RNA, 17 nt, Human
aauaaaguguuugaaag

SEQ ID NO: 1727618 - RNA, 16 nt, Human
cuucacuguaaaauaa

SEQ ID NO: 1727619 - RNA, 22 nt, Human
acaccuuguacuuuauuuucua

SEQ ID NO: 1727620 - RNA, 15 nt, Human
uaucuucacuuuuau

SEQ ID NO: 1727621 - RNA, 15 nt, Human
cccugagguugugug

SEQ ID NO: 1727622 - RNA, 20 nt, Human
cugcacacagcacgggggcc

SEQ ID NO: 1727623 - RNA, 23 nt, Human
gaccccugagcuugcagagauga

SEQ ID NO: 1727624 - RNA, 19 nt, Human
ucuuaucuuccuauaauuu

SEQ ID NO: 1727625 - RNA, 22 nt, Human
augguuguauuauuuuuuaaaa

SEQ ID NO: 1727626 - RNA, 22 nt, Human
aaaguugauuuaaggccaggca

SEQ ID NO: 1727627 - RNA, 17 nt, Human
acaaaaggaauguguaa

SEQ ID NO: 1727628 - RNA, 14 nt, Human
aucucuucucagaa

SEQ ID NO: 1727629 - RNA, 19 nt, Human
auguuccuuuuaaagaaac

SEQ ID NO: 1727630 - RNA, 17 nt, Human
agggcauagaaguaaaa

SEQ ID NO: 1727631 - RNA, 22 nt, Human
gacucaccucccccaucucuuc

SEQ ID NO: 1727632 - RNA, 23 nt, Human
caccucauggaauuggagcucgu

SEQ ID NO: 1727633 - RNA, 19 nt, Human
cuccagcuggccgggagcc

SEQ ID NO: 1727634 - RNA, 19 nt, Human
ucagugucaaugcagcccc

SEQ ID NO: 1727635 - RNA, 17 nt, Human
ccccaguuguuucuacu

SEQ ID NO: 1727636 - RNA, 16 nt, Human
gaaauguauucuuuua

SEQ ID NO: 1727637 - RNA, 20 nt, Human
aguugauuaagaaaggaagu

SEQ ID NO: 1727638 - RNA, 19 nt, Human
aacacaucaggaaagagag

SEQ ID NO: 1727639 - RNA, 21 nt, Human
aauaggcugaugggcaaaaaa

SEQ ID NO: 1727640 - RNA, 14 nt, Human
ggccacaucugagc

SEQ ID NO: 1727641 - RNA, 21 nt, Human
cuauguucuaagaagugaaaa

SEQ ID NO: 1727642 - RNA, 15 nt, Human
uaggaaauauuuauu

SEQ ID NO: 1727643 - RNA, 17 nt, Human
aguaaaaggaaaugcuc

SEQ ID NO: 1727644 - RNA, 19 nt, Human
cagugagccaaauguaaaa

SEQ ID NO: 1727645 - RNA, 19 nt, Human
aagccaugugcagccacca

SEQ ID NO: 1727646 - RNA, 14 nt, Human
augauguuuagaaa

SEQ ID NO: 1727647 - RNA, 21 nt, Human
uagaugagagaacagggcuga

SEQ ID NO: 1727648 - RNA, 13 nt, Human
cuuaucaaaggac

SEQ ID NO: 1727649 - RNA, 23 nt, Human
caaagcugaaauggacuuuugua

SEQ ID NO: 1727650 - RNA, 17 nt, Human
caggagcaucuccucaa

SEQ ID NO: 1727651 - RNA, 15 nt, Human
gagaugcuagaacuc

SEQ ID NO: 1727652 - RNA, 22 nt, Human
ugggcacuguggguagacacac

SEQ ID NO: 1727653 - RNA, 11 nt, Human
agaauauauuu

SEQ ID NO: 1727654 - RNA, 22 nt, Human
aauaagucaucugaugagaaca

SEQ ID NO: 1727655 - RNA, 16 nt, Human
caaaaaaaggaaggaa

SEQ ID NO: 1727656 - RNA, 13 nt, Human
aaggaaggaaaga

SEQ ID NO: 1727657 - RNA, 21 nt, Human
cuuccaggcuggcgugcagca

SEQ ID NO: 1727658 - RNA, 17 nt, Human
uucaaaacuuauuggaa

SEQ ID NO: 1727659 - RNA, 13 nt, Human
cucaccuccccca

SEQ ID NO: 1727660 - RNA, 19 nt, Human
ugagucccaggcugagccu

SEQ ID NO: 1727661 - RNA, 19 nt, Human
auuggagcucgugggacag

SEQ ID NO: 1727662 - RNA, 15 nt, Human
uucggccuccauccu

SEQ ID NO: 1727663 - RNA, 16 nt, Human
ggccuccauccugagg

SEQ ID NO: 1727664 - RNA, 12 nt, Human
agggauggggcu

SEQ ID NO: 1727665 - RNA, 22 nt, Human
caaugcuguauuuuaaaagaau

SEQ ID NO: 1727666 - RNA, 21 nt, Human
gacagaaagcagaacagugau

SEQ ID NO: 1727667 - RNA, 15 nt, Human
acgagauacagaauu

SEQ ID NO: 1727668 - RNA, 19 nt, Human
agaguuuagcuggaaaagu

SEQ ID NO: 1727669 - RNA, 13 nt, Human
agcccagcuugaa

SEQ ID NO: 1727670 - RNA, 19 nt, Human
gagguacugagagugaaca

SEQ ID NO: 1727671 - RNA, 13 nt, Human
ucuuauaauuuaa

SEQ ID NO: 1727672 - RNA, 18 nt, Human
uaaauugacacuuaaaaa

SEQ ID NO: 1727673 - RNA, 14 nt, Human
ggagcaucuccuca

SEQ ID NO: 1727674 - RNA, 17 nt, Human
ugaaauaagccagacau

SEQ ID NO: 1727675 - RNA, 18 nt, Human
cccacuagacccacugga

SEQ ID NO: 1727676 - RNA, 16 nt, Human
aaauauaaauaaaaau

SEQ ID NO: 1727677 - RNA, 18 nt, Human
auaaaguguuugaaagcu

SEQ ID NO: 1727678 - RNA, 20 nt, Human
aauucugguagcuaaauaua

SEQ ID NO: 1727679 - RNA, 17 nt, Human
gaaagccaugugcagcc

SEQ ID NO: 1727680 - RNA, 15 nt, Human
guguugcagugucug

SEQ ID NO: 1727681 - RNA, 20 nt, Human
aauuguaggugacuauuaua

SEQ ID NO: 1727682 - RNA, 21 nt, Human
ccuggugccucaccccuugcc

SEQ ID NO: 1727683 - RNA, 15 nt, Human
uguauuuuaaaagaa

SEQ ID NO: 1727684 - RNA, 22 nt, Human
agacccacuggacucaccuccc

SEQ ID NO: 1727685 - RNA, 18 nt, Human
ugggauacuauuuaauua

SEQ ID NO: 1727686 - RNA, 12 nt, Human
cuccaaggaccg

SEQ ID NO: 1727687 - RNA, 19 nt, Human
ccccugcaaagcccagcuu

SEQ ID NO: 1727688 - RNA, 15 nt, Human
uuucccagucuucag

SEQ ID NO: 1727689 - RNA, 15 nt, Human
acuuuuauaagaaau

SEQ ID NO: 1727690 - RNA, 13 nt, Human
ucugcagcuucca

SEQ ID NO: 1727691 - RNA, 14 nt, Human
cugcaaagcccagc

SEQ ID NO: 1727692 - RNA, 19 nt, Human
gaaaauaacgauaaaagac

SEQ ID NO: 1727693 - RNA, 19 nt, Human
ugaacaaauuuacagagac

SEQ ID NO: 1727694 - RNA, 18 nt, Human
uaucaaaagaaagaaaau

SEQ ID NO: 1727695 - RNA, 23 nt, Human
augaauuaaguuuuuuuuuaaaa

SEQ ID NO: 1727696 - RNA, 21 nt, Human
uuauuuucuauaauuuaaaua

SEQ ID NO: 1727697 - RNA, 16 nt, Human
caggaaguagaggagg

SEQ ID NO: 1727698 - RNA, 23 nt, Human
gggccuaugcagagguccacaac

SEQ ID NO: 1727699 - RNA, 16 nt, Human
aaauaguuuaugauuc

SEQ ID NO: 1727700 - RNA, 20 nt, Human
augcaguuguugcccacagc

SEQ ID NO: 1727701 - RNA, 19 nt, Human
uaggugacuauuauauuuc

SEQ ID NO: 1727702 - RNA, 17 nt, Human
caauaacgauaaaagac

SEQ ID NO: 1727703 - RNA, 21 nt, Human
agaauucuguugauggaaaua

SEQ ID NO: 1727704 - RNA, 23 nt, Human
aaaauaucacuugucaauaaaau

SEQ ID NO: 1727705 - RNA, 16 nt, Human
auuuuaauaauguuuc

SEQ ID NO: 1727706 - RNA, 15 nt, Human
ccacaucugagcccc

SEQ ID NO: 1727707 - RNA, 13 nt, Human
uagcauggccaca

SEQ ID NO: 1727708 - RNA, 13 nt, Human
uaauuuuuauauu

SEQ ID NO: 1727709 - RNA, 22 nt, Human
ucucucaaggagaggcaaagaa

SEQ ID NO: 1727710 - RNA, 14 nt, Human
uccacuuggucugu

SEQ ID NO: 1727711 - RNA, 16 nt, Human
cuacacuccagugaga

SEQ ID NO: 1727712 - RNA, 17 nt, Human
cuucugaggagcuguug

SEQ ID NO: 1727713 - RNA, 17 nt, Human
cuuccuaauuccacagc

SEQ ID NO: 1727714 - RNA, 18 nt, Human
uguaaaggaauuuaaaaa

SEQ ID NO: 1727715 - RNA, 17 nt, Human
gaagcaccaaucaugaa

SEQ ID NO: 1727716 - RNA, 14 nt, Human
cucccugcccccca

SEQ ID NO: 1727717 - RNA, 19 nt, Human
ggucgaggcuacagugagc

SEQ ID NO: 1727718 - RNA, 17 nt, Human
guauuauuuuuuaaaaa

SEQ ID NO: 1727719 - RNA, 14 nt, Human
agcaaguauuagaa

SEQ ID NO: 1727720 - RNA, 19 nt, Human
agucccuccccaaaugcuu

SEQ ID NO: 1727721 - RNA, 22 nt, Human
ggaaaugauguuucauaagaau

SEQ ID NO: 1727722 - RNA, 21 nt, Human
caaaguugauuaagaaaggaa

SEQ ID NO: 1727723 - RNA, 18 nt, Human
aaaaccuaagcaaacuua

SEQ ID NO: 1727724 - RNA, 14 nt, Human
ugugaaaagcucca

SEQ ID NO: 1727725 - RNA, 17 nt, Human
auaaguacaugauaagc

SEQ ID NO: 1727726 - RNA, 16 nt, Human
cauuuguauaaaauaa

SEQ ID NO: 1727727 - RNA, 15 nt, Human
cugcagauaaacagu

SEQ ID NO: 1727728 - RNA, 17 nt, Human
ggaaauauuuauuuuaa

SEQ ID NO: 1727729 - RNA, 19 nt, Human
cagaaagcagaacagugau

SEQ ID NO: 1727730 - RNA, 20 nt, Human
acaaugacuuguacucugaa

SEQ ID NO: 1727731 - RNA, 18 nt, Human
augagcacgcauggaaaa

SEQ ID NO: 1727732 - RNA, 21 nt, Human
agggugauauuaaccaggggc

SEQ ID NO: 1727733 - RNA, 21 nt, Human
ucauucacucaacaaacauaa

SEQ ID NO: 1727734 - RNA, 18 nt, Human
uggcucuggacaggcacu

SEQ ID NO: 1727735 - RNA, 19 nt, Human
cagcacgggggccaaggau

SEQ ID NO: 1727736 - RNA, 13 nt, Human
ugccagcuggccu

SEQ ID NO: 1727737 - RNA, 12 nt, Human
aaaugaaagcag

SEQ ID NO: 1727738 - RNA, 18 nt, Human
aaaucuuauaauuuaaaa

SEQ ID NO: 1727739 - RNA, 16 nt, Human
guccgaggugggcaga

SEQ ID NO: 1727740 - RNA, 18 nt, Human
ugagccaccaagcuggug

SEQ ID NO: 1727741 - RNA, 15 nt, Human
aauauauauuuuaga

SEQ ID NO: 1727742 - RNA, 15 nt, Human
ccccugagcuugcag

SEQ ID NO: 1727743 - RNA, 11 nt, Human
aaaaaggaagg

SEQ ID NO: 1727744 - RNA, 21 nt, Human
uguaaaauggugugaccacug

SEQ ID NO: 1727745 - RNA, 19 nt, Human
caacucccugccccccagc

SEQ ID NO: 1727746 - RNA, 14 nt, Human
gccaggcauggugg

SEQ ID NO: 1727747 - RNA, 22 nt, Human
ccacagcuguaugauucccagc

SEQ ID NO: 1727748 - RNA, 16 nt, Human
aucaaaagaaagaaaa

SEQ ID NO: 1727749 - RNA, 17 nt, Human
uuauuucccucccaagu

SEQ ID NO: 1727750 - RNA, 20 nt, Human
cugaggcaggaggaucacuu

SEQ ID NO: 1727751 - RNA, 16 nt, Human
auuauacccccugcaa

SEQ ID NO: 1727752 - RNA, 16 nt, Human
aaaagcuccauuuuua

SEQ ID NO: 1727753 - RNA, 17 nt, Human
acucaccucccccaucu

SEQ ID NO: 1727754 - RNA, 20 nt, Human
ucacuguauguccuuggugc

SEQ ID NO: 1727755 - RNA, 22 nt, Human
acauccuacaagacacagugac

SEQ ID NO: 1727756 - RNA, 22 nt, Human
aaaugauguuucauaagaauuc

SEQ ID NO: 1727757 - RNA, 17 nt, Human
ccaucaguuccagccuu

SEQ ID NO: 1727758 - RNA, 19 nt, Human
uggagccuacuaaaugcuc

SEQ ID NO: 1727759 - RNA, 17 nt, Human
caaauauaaauaaaaau

SEQ ID NO: 1727760 - RNA, 13 nt, Human
ucacuguaaaaua

SEQ ID NO: 1727761 - RNA, 21 nt, Human
acagugaaagaaaauaacaau

SEQ ID NO: 1727762 - RNA, 21 nt, Human
gcauggccacaucugagcccc

SEQ ID NO: 1727763 - RNA, 21 nt, Human
uauacugugugcuaaaacaag

SEQ ID NO: 1727764 - RNA, 23 nt, Human
aaugcuccuccagggagucucag

SEQ ID NO: 1727765 - RNA, 19 nt, Human
agugaggagcuuugaaacg

SEQ ID NO: 1727766 - RNA, 23 nt, Human
aaagcccagcuugaaaccuucac

SEQ ID NO: 1727767 - RNA, 19 nt, Human
ugaaauggacuuuuguaca

SEQ ID NO: 1727768 - RNA, 13 nt, Human
agcucugcccauc

SEQ ID NO: 1727769 - RNA, 14 nt, Human
auuuaauuauuuca

SEQ ID NO: 1727770 - RNA, 20 nt, Human
aaguucaaaacuuauuggaa

SEQ ID NO: 1727771 - RNA, 21 nt, Human
auaguuguaccgcaaugugac

SEQ ID NO: 1727772 - RNA, 17 nt, Human
agucuucagcagagaag

SEQ ID NO: 1727773 - RNA, 22 nt, Human
uuagauaaggcuguucuuuaaa

SEQ ID NO: 1727774 - RNA, 22 nt, Human
ugucucuacuaaaaauacaaaa

SEQ ID NO: 1727775 - RNA, 18 nt, Human
aagucuuucacauuuaaa

SEQ ID NO: 1727776 - RNA, 15 nt, Human
augggacagggagga

SEQ ID NO: 1727777 - RNA, 19 nt, Human
cuaguaucaaaagaaagaa

SEQ ID NO: 1727778 - RNA, 14 nt, Human
cgucccccucuggc

SEQ ID NO: 1727779 - RNA, 17 nt, Human
aacugccaucauuuacu

SEQ ID NO: 1727780 - RNA, 15 nt, Human
uuuagugaaauauua

SEQ ID NO: 1727781 - RNA, 16 nt, Human
gaaaaaauaacaauga

SEQ ID NO: 1727782 - RNA, 21 nt, Human
cuacauaaaauacaaaaacuu

SEQ ID NO: 1727783 - RNA, 23 nt, Human
gcugaguguuucacaccuuaucu

SEQ ID NO: 1727784 - RNA, 19 nt, Human
auuuucuauaauuuaaaua

SEQ ID NO: 1727785 - RNA, 17 nt, Human
uaucuucagaaaaccua

SEQ ID NO: 1727786 - RNA, 15 nt, Human
agccucagucucccu

SEQ ID NO: 1727787 - RNA, 16 nt, Human
acaugugcuggccacc

SEQ ID NO: 1727788 - RNA, 20 nt, Human
agggcagaugaugcuuugag

SEQ ID NO: 1727789 - RNA, 17 nt, Human
gaaaaucaggcuggcca

SEQ ID NO: 1727790 - RNA, 22 nt, Human
aaugggcacaggguuuauguuu

SEQ ID NO: 1727791 - RNA, 19 nt, Human
aagcuuguauuccuuuuuc

SEQ ID NO: 1727792 - RNA, 14 nt, Human
auccuugaagauuu

SEQ ID NO: 1727793 - RNA, 22 nt, Human
ggacaguaaaauccacagacca

SEQ ID NO: 1727794 - RNA, 22 nt, Human
gcuauuugcuguuauuuuaucu

SEQ ID NO: 1727795 - RNA, 22 nt, Human
uauuucuaugaaauauuauguu

SEQ ID NO: 1727796 - RNA, 21 nt, Human
cugauauuggacaguaaaauc

SEQ ID NO: 1727797 - RNA, 12 nt, Human
caugggaaguga

SEQ ID NO: 1727798 - RNA, 23 nt, Human
acugucuuguuggacgagaaaac

SEQ ID NO: 1727799 - RNA, 18 nt, Human
ucuaugaaauauuauguu

SEQ ID NO: 1727800 - RNA, 21 nt, Human
ugagaaggcuguggauuuaau

SEQ ID NO: 1727801 - RNA, 23 nt, Human
ugaauuauguuugcauguucacu

SEQ ID NO: 1727802 - RNA, 21 nt, Human
cacuaucuggguuuugggggg

SEQ ID NO: 1727803 - RNA, 18 nt, Human
ccuugggaccccugagcu

SEQ ID NO: 1727804 - RNA, 15 nt, Human
aaugauuaugaauua

SEQ ID NO: 1727805 - RNA, 12 nt, Human
gcucagcccugg

SEQ ID NO: 1727806 - RNA, 21 nt, Human
acuccagccagggcaagagag

SEQ ID NO: 1727807 - RNA, 23 nt, Human
uuacgaaauacguuaggaggaca

SEQ ID NO: 1727808 - RNA, 17 nt, Human
uggcuaagcaaaaugug

SEQ ID NO: 1727809 - RNA, 14 nt, Human
ccaccugcugagcc

SEQ ID NO: 1727810 - RNA, 18 nt, Human
ucugcaagaagaaaucau

SEQ ID NO: 1727811 - RNA, 19 nt, Human
cuggccuucggccuccauc

SEQ ID NO: 1727812 - RNA, 21 nt, Human
aaagaaaauaacgauaaaaga

SEQ ID NO: 1727813 - RNA, 16 nt, Human
ucuaaaaguuuaaguu

SEQ ID NO: 1727814 - RNA, 18 nt, Human
gaugcaguucugaagaag

SEQ ID NO: 1727815 - RNA, 13 nt, Human
uuucuaaaaguuu

SEQ ID NO: 1727816 - RNA, 22 nt, Human
cggaggucgaggcuacagugag

SEQ ID NO: 1727817 - RNA, 20 nt, Human
ugaaaaucuuauaauuuaaa

SEQ ID NO: 1727818 - RNA, 13 nt, Human
caucgcagacaca

SEQ ID NO: 1727819 - RNA, 23 nt, Human
auuccugacugcuaguuuauaua

SEQ ID NO: 1727820 - RNA, 16 nt, Human
uaacaauaaaagacaa

SEQ ID NO: 1727821 - RNA, 23 nt, Human
auucaauaucuuuuuuuuaauaa

SEQ ID NO: 1727822 - RNA, 14 nt, Human
acugccaucauuua

SEQ ID NO: 1727823 - RNA, 17 nt, Human
acauagugagacacugu

SEQ ID NO: 1727824 - RNA, 13 nt, Human
uaguuuuuaaagu

SEQ ID NO: 1727825 - RNA, 21 nt, Human
cagcccuuagcccuuccccuc

SEQ ID NO: 1727826 - RNA, 22 nt, Human
caucgcaauguaagacucggga

SEQ ID NO: 1727827 - RNA, 17 nt, Human
agcucugcccauccugc

SEQ ID NO: 1727828 - RNA, 11 nt, Human
agugucugcug

SEQ ID NO: 1727829 - RNA, 15 nt, Human
gcaagcucuaucacc

SEQ ID NO: 1727830 - RNA, 19 nt, Human
uuuccaagaaauauuccuu

SEQ ID NO: 1727831 - RNA, 13 nt, Human
ugggcaaaaaacc

SEQ ID NO: 1727832 - RNA, 16 nt, Human
ccugaucaccugcccu

SEQ ID NO: 1727833 - RNA, 13 nt, Human
auaauuuuagaca

SEQ ID NO: 1727834 - RNA, 17 nt, Human
auguuucauaagaauuc

SEQ ID NO: 1727835 - RNA, 17 nt, Human
aaggugaucuggcucug

SEQ ID NO: 1727836 - RNA, 13 nt, Human
caccaaggagcca

SEQ ID NO: 1727837 - RNA, 12 nt, Human
ccuucagccuga

SEQ ID NO: 1727838 - RNA, 14 nt, Human
agugucuugaauug

SEQ ID NO: 1727839 - RNA, 16 nt, Human
augaauacuuuauaaa

SEQ ID NO: 1727840 - RNA, 17 nt, Human
uaugccacaagaacccc

SEQ ID NO: 1727841 - RNA, 12 nt, Human
aggaaauauuuu

SEQ ID NO: 1727842 - RNA, 22 nt, Human
agcauuguuggcuguuccugca

SEQ ID NO: 1727843 - RNA, 17 nt, Human
ucuaccaaaaaaaggaa

SEQ ID NO: 1727844 - RNA, 23 nt, Human
gauaaggcuguucuuuaaauguc

SEQ ID NO: 1727845 - RNA, 22 nt, Human
aauuacauuuguauaaaauaau

SEQ ID NO: 1727846 - RNA, 19 nt, Human
ucaguccaugaagauguag

SEQ ID NO: 1727847 - RNA, 14 nt, Human
cccacuugccauaa

SEQ ID NO: 1727848 - RNA, 18 nt, Human
agcauuguuggcuguucc

SEQ ID NO: 1727849 - RNA, 13 nt, Human
gggcugaagcugu

SEQ ID NO: 1727850 - RNA, 17 nt, Human
gaagaccucauuuugaa

SEQ ID NO: 1727851 - RNA, 23 nt, Human
agaaugauuaugaauuacauuug

SEQ ID NO: 1727852 - RNA, 21 nt, Human
cucaguccaugaagauguaga

SEQ ID NO: 1727853 - RNA, 21 nt, Human
auggaaauacacuguuaucuu

SEQ ID NO: 1727854 - RNA, 14 nt, Human
auuuauguuuaauu

SEQ ID NO: 1727855 - RNA, 23 nt, Human
cugagaaggcuguggauuuaaug

SEQ ID NO: 1727856 - RNA, 17 nt, Human
uaccaaaaaaaggaagg

SEQ ID NO: 1727857 - RNA, 20 nt, Human
gagccugaucaccugcccug

SEQ ID NO: 1727858 - RNA, 17 nt, Human
aguauuucuaugaaaua

SEQ ID NO: 1727859 - RNA, 15 nt, Human
agauuucaaaaaaaa

SEQ ID NO: 1727860 - RNA, 22 nt, Human
gaauuaaguuuuuuuuuaaaaa

SEQ ID NO: 1727861 - RNA, 20 nt, Human
caagagccuuuuuuugaaaa

SEQ ID NO: 1727862 - RNA, 15 nt, Human
aaugucugaaaugga

SEQ ID NO: 1727863 - RNA, 17 nt, Human
gcaugguuuagaaagcu

SEQ ID NO: 1727864 - RNA, 17 nt, Human
gauggaguuucucuaga

SEQ ID NO: 1727865 - RNA, 20 nt, Human
uuaaauggucaauuuuguua

SEQ ID NO: 1727866 - RNA, 17 nt, Human
augccccgucccccucu

SEQ ID NO: 1727867 - RNA, 13 nt, Human
cacuuugaagagu

SEQ ID NO: 1727868 - RNA, 18 nt, Human
caguuguugcccacagcu

SEQ ID NO: 1727869 - RNA, 15 nt, Human
cuaaggcaggaggau

SEQ ID NO: 1727870 - RNA, 12 nt, Human
agacagugaaag

SEQ ID NO: 1727871 - RNA, 15 nt, Human
auauagaaauguauu

SEQ ID NO: 1727872 - RNA, 16 nt, Human
gacauuugcucaugga

SEQ ID NO: 1727873 - RNA, 21 nt, Human
uuacauuuguauaaaauaauu

SEQ ID NO: 1727874 - RNA, 13 nt, Human
uggacgagaaaac

SEQ ID NO: 1727875 - RNA, 13 nt, Human
cuccacuggaaaa

SEQ ID NO: 1727876 - RNA, 22 nt, Human
ggcagcuuuccucaaaacuuca

SEQ ID NO: 1727877 - RNA, 16 nt, Human
aaaauccauacauuug

SEQ ID NO: 1727878 - RNA, 23 nt, Human
ugcauagguuuaauaauuuuuaa

SEQ ID NO: 1727879 - RNA, 21 nt, Human
ggaaagaauaaccaacacccu

SEQ ID NO: 1727880 - RNA, 14 nt, Human
auuuuaucugcuau

SEQ ID NO: 1727881 - RNA, 17 nt, Human
acaaaugcauuucuaaa

SEQ ID NO: 1727882 - RNA, 20 nt, Human
gcuuccaggcuggcgugcag

SEQ ID NO: 1727883 - RNA, 16 nt, Human
auaaauaaauaaaaac

SEQ ID NO: 1727884 - RNA, 15 nt, Human
ucuuauaauuuaaaa

SEQ ID NO: 1727885 - RNA, 13 nt, Human
uauuucuaugaaa

SEQ ID NO: 1727886 - RNA, 21 nt, Human
uaggugacuauuauauuucca

SEQ ID NO: 1727887 - RNA, 14 nt, Human
agguugcagugagc

SEQ ID NO: 1727888 - RNA, 12 nt, Human
accccugagcuu

SEQ ID NO: 1727889 - RNA, 14 nt, Human
acauauauaacaau

SEQ ID NO: 1727890 - RNA, 15 nt, Human
augggaacaaggaag

SEQ ID NO: 1727891 - RNA, 14 nt, Human
uaguaucaaaagaa

SEQ ID NO: 1727892 - RNA, 19 nt, Human
agaaacaaaaaucaaacuu

SEQ ID NO: 1727893 - RNA, 17 nt, Human
uccagcuggccgggagc

SEQ ID NO: 1727894 - RNA, 18 nt, Human
aaauauaaauaaaaauaa

SEQ ID NO: 1727895 - RNA, 20 nt, Human
ugcagccaccaguccauugg

SEQ ID NO: 1727896 - RNA, 22 nt, Human
agaaaacaauaacgauaaaaga

SEQ ID NO: 1727897 - RNA, 15 nt, Human
caggcaaauuccuga

SEQ ID NO: 1727898 - RNA, 16 nt, Human
auuuguauaaaauaau

SEQ ID NO: 1727899 - RNA, 21 nt, Human
caagacccaaaaggcagaagc

SEQ ID NO: 1727900 - RNA, 20 nt, Human
uuuaaauaaaguguuugaaa

SEQ ID NO: 1727901 - RNA, 20 nt, Human
aucaaccugccagcuggccu

SEQ ID NO: 1727902 - RNA, 13 nt, Human
cguuaauguaaag

SEQ ID NO: 1727903 - RNA, 16 nt, Human
ccaugugcagccacca

SEQ ID NO: 1727904 - RNA, 14 nt, Human
uucuggaauaaucc

SEQ ID NO: 1727905 - RNA, 22 nt, Human
ccgggagccugaucaccugccc

SEQ ID NO: 1727906 - RNA, 20 nt, Human
agcuucacuguaaaauaaua

SEQ ID NO: 1727907 - RNA, 21 nt, Human
cucagugucaaugcagccccc

SEQ ID NO: 1727908 - RNA, 20 nt, Human
cucagcuucacccugaggug

SEQ ID NO: 1727909 - RNA, 12 nt, Human
gccagggcaaga

SEQ ID NO: 1727910 - RNA, 17 nt, Human
uugugaagcaaaauuuu

SEQ ID NO: 1727911 - RNA, 18 nt, Human
acuuuaugcuaagugaaa

SEQ ID NO: 1727912 - RNA, 17 nt, Human
uuagauagaugaagaag

SEQ ID NO: 1727913 - RNA, 17 nt, Human
guugcugggggggauug

SEQ ID NO: 1727914 - RNA, 20 nt, Human
aacaagccuccuuuuaaagu

SEQ ID NO: 1727915 - RNA, 18 nt, Human
gcuccauuuuuagugaaa

SEQ ID NO: 1727916 - RNA, 20 nt, Human
aaugauguuucauaagaauu

SEQ ID NO: 1727917 - RNA, 15 nt, Human
uuaguuuuuaaagua

SEQ ID NO: 1727918 - RNA, 15 nt, Human
aauacuuuauaaagg

SEQ ID NO: 1727919 - RNA, 18 nt, Human
auuauuuuuuaaaaaaau

SEQ ID NO: 1727920 - RNA, 20 nt, Human
auccucgaggcccuagcauu

SEQ ID NO: 1727921 - RNA, 12 nt, Human
cuuaucuuccua

SEQ ID NO: 1727922 - RNA, 22 nt, Human
uuguaacaagccuccuuuuaaa

SEQ ID NO: 1727923 - RNA, 15 nt, Human
gucaaugcagccccc

SEQ ID NO: 1727924 - RNA, 15 nt, Human
augauaacuggaaac

SEQ ID NO: 1727925 - RNA, 12 nt, Human
aaaauaacaaua

SEQ ID NO: 1727926 - RNA, 14 nt, Human
aucaccaaggcuga

SEQ ID NO: 1727927 - RNA, 21 nt, Human
aagucuuucacauuuaaauaa

SEQ ID NO: 1727928 - RNA, 19 nt, Human
augaguaacugauuuguaa

SEQ ID NO: 1727929 - RNA, 16 nt, Human
cagaagcaacccaaau

SEQ ID NO: 1727930 - RNA, 18 nt, Human
ucaaggguacacugccuu

SEQ ID NO: 1727931 - RNA, 22 nt, Human
uacugagagugaacaaauuuac

SEQ ID NO: 1727932 - RNA, 18 nt, Human
gccccgucccccucuggc

SEQ ID NO: 1727933 - RNA, 20 nt, Human
agaaaaccuaagcaaacuua

SEQ ID NO: 1727934 - RNA, 22 nt, Human
cugaaacaaaauuagaaaugua

SEQ ID NO: 1727935 - RNA, 22 nt, Human
cuaggaugggaacaaggaagga

SEQ ID NO: 1727936 - RNA, 20 nt, Human
ccccuauccuacuuccccuu

SEQ ID NO: 1727937 - RNA, 17 nt, Human
caccugcugagccccaa

SEQ ID NO: 1727938 - RNA, 20 nt, Human
uccucaugagggcuggaugc

SEQ ID NO: 1727939 - RNA, 14 nt, Human
uacuaauuuuaaaa

SEQ ID NO: 1727940 - RNA, 22 nt, Human
cuucaacucccugccccccagc

SEQ ID NO: 1727941 - RNA, 23 nt, Human
uaacgauaaaagacagugaaaga

SEQ ID NO: 1727942 - RNA, 17 nt, Human
auuucuaaaaguuuaag

SEQ ID NO: 1727943 - RNA, 23 nt, Human
auaucuuuuuuuuaauaaaccau

SEQ ID NO: 1727944 - RNA, 19 nt, Human
guuauuauauuuacaaaug

SEQ ID NO: 1727945 - RNA, 20 nt, Human
guuccuuccucugagccuug

SEQ ID NO: 1727946 - RNA, 22 nt, Human
uaaaacaagcacuaaacaaaga

SEQ ID NO: 1727947 - RNA, 13 nt, Human
ccaggcugagccu

SEQ ID NO: 1727948 - RNA, 13 nt, Human
aggcauagcccug

SEQ ID NO: 1727949 - RNA, 17 nt, Human
uccuacaagacacagug

SEQ ID NO: 1727950 - RNA, 14 nt, Human
ucuauaauuuaaau

SEQ ID NO: 1727951 - RNA, 13 nt, Human
guaacuaauuuua

SEQ ID NO: 1727952 - RNA, 20 nt, Human
aggacaaaaggaauguguaa

SEQ ID NO: 1727953 - RNA, 14 nt, Human
uuaaacuuugauuu

SEQ ID NO: 1727954 - RNA, 16 nt, Human
uuuucucuaggaaaua

SEQ ID NO: 1727955 - RNA, 13 nt, Human
aacucccugcccc

SEQ ID NO: 1727956 - RNA, 22 nt, Human
aaaaaaccugagccccaaaagg

SEQ ID NO: 1727957 - RNA, 23 nt, Human
uaagaauucuguugauggaaaua

SEQ ID NO: 1727958 - RNA, 17 nt, Human
cuucacuguaaaauaau

SEQ ID NO: 1727959 - RNA, 20 nt, Human
cccuuccuaauuccacagcu

SEQ ID NO: 1727960 - RNA, 14 nt, Human
caugaacuuguaaa

SEQ ID NO: 1727961 - RNA, 15 nt, Human
cugacucuuaagaag

SEQ ID NO: 1727962 - RNA, 22 nt, Human
caggggccacaccaaccuucug

SEQ ID NO: 1727963 - RNA, 15 nt, Human
auacguuaggaggac

SEQ ID NO: 1727964 - RNA, 19 nt, Human
agcagcuuauucacaagac

SEQ ID NO: 1727965 - RNA, 12 nt, Human
ccugccagcugg

SEQ ID NO: 1727966 - RNA, 17 nt, Human
cauaguaccucugcuau

SEQ ID NO: 1727967 - RNA, 16 nt, Human
ugcaaauugucacagg

SEQ ID NO: 1727968 - RNA, 19 nt, Human
aaauuaaaaccucuuugug

SEQ ID NO: 1727969 - RNA, 22 nt, Human
cccaugauguuuagaaacacaa

SEQ ID NO: 1727970 - RNA, 23 nt, Human
cauuguggucacaggaaguagag

SEQ ID NO: 1727971 - RNA, 15 nt, Human
aaacaauuugaauau

SEQ ID NO: 1727972 - RNA, 17 nt, Human
cuaauaucuuaucuucc

SEQ ID NO: 1727973 - RNA, 16 nt, Human
aucaauuuaaaaaaaa

SEQ ID NO: 1727974 - RNA, 20 nt, Human
ucagaaggaaagaauaacca

SEQ ID NO: 1727975 - RNA, 13 nt, Human
gguccacaacaca

SEQ ID NO: 1727976 - RNA, 18 nt, Human
ccaaccuggaguugaaaa

SEQ ID NO: 1727977 - RNA, 22 nt, Human
cuggguuccuuccucugagccu

SEQ ID NO: 1727978 - RNA, 15 nt, Human
auuucuaugaaauau

SEQ ID NO: 1727979 - RNA, 12 nt, Human
aaaagaaagaaa

SEQ ID NO: 1727980 - RNA, 14 nt, Human
acaugucuagagaa

SEQ ID NO: 1727981 - RNA, 16 nt, Human
uguugagguaccucca

SEQ ID NO: 1727982 - RNA, 15 nt, Human
ccagcacagccucuu

SEQ ID NO: 1727983 - RNA, 17 nt, Human
ccugggcaacaugguga

SEQ ID NO: 1727984 - RNA, 22 nt, Human
uauaagaaauaggaaauauuuu

SEQ ID NO: 1727985 - RNA, 16 nt, Human
cagggcucacagaauu

SEQ ID NO: 1727986 - RNA, 15 nt, Human
uguuaucuucacuuu

SEQ ID NO: 1727987 - RNA, 14 nt, Human
gagacacugucucu

SEQ ID NO: 1727988 - RNA, 18 nt, Human
uuuuaucugcuaugcuau

SEQ ID NO: 1727989 - RNA, 13 nt, Human
cgggaggcagagg

SEQ ID NO: 1727990 - RNA, 18 nt, Human
auguuucauaagaauucu

SEQ ID NO: 1727991 - RNA, 22 nt, Human
uccaugaguugcaguuuuuucc

SEQ ID NO: 1727992 - RNA, 23 nt, Human
gaaaaaguucugcagauaaacag

SEQ ID NO: 1727993 - RNA, 23 nt, Human
uagacacacaugaaguccaagca

SEQ ID NO: 1727994 - RNA, 21 nt, Human
cucagcuucacccugagguga

SEQ ID NO: 1727995 - RNA, 14 nt, Human
aacgauaaaagaca

SEQ ID NO: 1727996 - RNA, 20 nt, Human
agcauuguuggcuguuccug

SEQ ID NO: 1727997 - RNA, 20 nt, Human
caaauguucaucaaugaaug

SEQ ID NO: 1727998 - RNA, 21 nt, Human
aauaauguuucaaacauauau

SEQ ID NO: 1727999 - RNA, 15 nt, Human
auauuuuuuguuaaa

SEQ ID NO: 1728000 - RNA, 16 nt, Human
ccccaucucuucuggg

SEQ ID NO: 1728001 - RNA, 23 nt, Human
ucucuaccaaaaaaaggaaggaa

SEQ ID NO: 1728002 - RNA, 16 nt, Human
caugucuagagaacac

SEQ ID NO: 1728003 - RNA, 14 nt, Human
cucugccucagaaa

SEQ ID NO: 1728004 - RNA, 13 nt, Human
acaugucuagaga

SEQ ID NO: 1728005 - RNA, 21 nt, Human
ccaaggaugccccgucccccu

SEQ ID NO: 1728006 - RNA, 19 nt, Human
gccugaucaccugcccugc

SEQ ID NO: 1728007 - RNA, 21 nt, Human
uuccuagucuguuuucccucc

SEQ ID NO: 1728008 - RNA, 23 nt, Human
acucuauguucuaagaagugaaa

SEQ ID NO: 1728009 - RNA, 21 nt, Human
acacaucaggaaagagagcac

SEQ ID NO: 1728010 - RNA, 23 nt, Human
aauacacuguuaucuucacuuuu

SEQ ID NO: 1728011 - RNA, 23 nt, Human
ugaauuacauuuguauaaaauaa

SEQ ID NO: 1728012 - RNA, 17 nt, Human
auaaaguacaagagcuu

SEQ ID NO: 1728013 - RNA, 22 nt, Human
ucugguagcuaaauauauauuu

SEQ ID NO: 1728014 - RNA, 22 nt, Human
cagcacgggggccaaggaugcc

SEQ ID NO: 1728015 - RNA, 14 nt, Human
cugaacccagggaa

SEQ ID NO: 1728016 - RNA, 14 nt, Human
caucauuuacuuuu

SEQ ID NO: 1728017 - RNA, 21 nt, Human
aguuguugcccacagcuguau

SEQ ID NO: 1728018 - RNA, 14 nt, Human
auuguccaggucua

SEQ ID NO: 1728019 - RNA, 19 nt, Human
cuuccagauccuggaaauc

SEQ ID NO: 1728020 - RNA, 21 nt, Human
gaacagucucuugaggcacag

SEQ ID NO: 1728021 - RNA, 16 nt, Human
ccugagcgacagugag

SEQ ID NO: 1728022 - RNA, 20 nt, Human
aacaaugcuguauuuuaaaa

SEQ ID NO: 1728023 - RNA, 16 nt, Human
uggcaauugacuauag

SEQ ID NO: 1728024 - RNA, 14 nt, Human
aagagugaaggauu

SEQ ID NO: 1728025 - RNA, 14 nt, Human
cugucucaguccau

SEQ ID NO: 1728026 - RNA, 17 nt, Human
aaccuagggugauauua

SEQ ID NO: 1728027 - RNA, 17 nt, Human
ccugucgguuuauucac

SEQ ID NO: 1728028 - RNA, 14 nt, Human
ucuucagaaaaccu

SEQ ID NO: 1728029 - RNA, 22 nt, Human
aauuuaaaaaaaaaccugagcc

SEQ ID NO: 1728030 - RNA, 14 nt, Human
ccaaauauaaauaa

SEQ ID NO: 1728031 - RNA, 14 nt, Human
cagugaaagaaaau

SEQ ID NO: 1728032 - RNA, 14 nt, Human
augggaacaaggaa

SEQ ID NO: 1728033 - RNA, 13 nt, Human
cguugagccacca

SEQ ID NO: 1728034 - RNA, 21 nt, Human
auuuguauaaaauaauuuuua

SEQ ID NO: 1728035 - RNA, 14 nt, Human
uaaaagacaaggaa

SEQ ID NO: 1728036 - RNA, 14 nt, Human
auaaaauaauuuuu

SEQ ID NO: 1728037 - RNA, 22 nt, Human
gagucaagggugugugcagcau

SEQ ID NO: 1728038 - RNA, 17 nt, Human
cuauccuacuuccccuu

SEQ ID NO: 1728039 - RNA, 12 nt, Human
caccuccuaaga

SEQ ID NO: 1728040 - RNA, 19 nt, Human
uggcaaacugccaucauuu

SEQ ID NO: 1728041 - RNA, 18 nt, Human
gaaggugaucuggcucug

SEQ ID NO: 1728042 - RNA, 16 nt, Human
ccuaagugcagccccg

SEQ ID NO: 1728043 - RNA, 22 nt, Human
uaucuauguagaauauauuucc

SEQ ID NO: 1728044 - RNA, 17 nt, Human
aauaugcucuaaacaug

SEQ ID NO: 1728045 - RNA, 18 nt, Human
agcagugccaaaauauaa

SEQ ID NO: 1728046 - RNA, 22 nt, Human
aaugauguuucauaagaauucu

SEQ ID NO: 1728047 - RNA, 21 nt, Human
ccuuccccucugcagcuucca

SEQ ID NO: 1728048 - RNA, 21 nt, Human
cucuacauaaaauacaaaaac

SEQ ID NO: 1728049 - RNA, 16 nt, Human
aacgagacaagcagcc

SEQ ID NO: 1728050 - RNA, 22 nt, Human
uggagacauugaggcaggcacu

SEQ ID NO: 1728051 - RNA, 15 nt, Human
ucucagaaggaaaga

SEQ ID NO: 1728052 - RNA, 22 nt, Human
accuuaucuauguagaauauau

SEQ ID NO: 1728053 - RNA, 20 nt, Human
accuacacgagauacagaau

SEQ ID NO: 1728054 - RNA, 16 nt, Human
cacuaguauuucuaug

SEQ ID NO: 1728055 - RNA, 18 nt, Human
aaguugauaugccuuuuc

SEQ ID NO: 1728056 - RNA, 19 nt, Human
cccauggcacucuauguuc

SEQ ID NO: 1728057 - RNA, 23 nt, Human
ugucuucaggggccacaccaacc

SEQ ID NO: 1728058 - RNA, 14 nt, Human
cugcugagucccag

SEQ ID NO: 1728059 - RNA, 12 nt, Human
guauaggccagg

SEQ ID NO: 1728060 - RNA, 16 nt, Human
aaguugauuaagaaag

SEQ ID NO: 1728061 - RNA, 22 nt, Human
auauuuacaaaugggaaacaaa

SEQ ID NO: 1728062 - RNA, 15 nt, Human
ucuggcuccagcugg

SEQ ID NO: 1728063 - RNA, 16 nt, Human
cacuuaaaaaugguuu

SEQ ID NO: 1728064 - RNA, 21 nt, Human
gacugcuaguuuauauagaaa

SEQ ID NO: 1728065 - RNA, 19 nt, Human
ccagccagggcaagagagc

SEQ ID NO: 1728066 - RNA, 18 nt, Human
uaaaagacaaggaaaaaa

SEQ ID NO: 1728067 - RNA, 16 nt, Human
auaucauagcaaauaa

SEQ ID NO: 1728068 - RNA, 13 nt, Human
uuauaaaaauaua

SEQ ID NO: 1728069 - RNA, 17 nt, Human
agcccuuccccucugca

SEQ ID NO: 1728070 - RNA, 20 nt, Human
uguuggugaacuugguuuua

SEQ ID NO: 1728071 - RNA, 15 nt, Human
aaacauaugaauuau

SEQ ID NO: 1728072 - RNA, 21 nt, Human
acaugagguacugagagugaa

SEQ ID NO: 1728073 - RNA, 22 nt, Human
caggauuagauaaggcuguucu

SEQ ID NO: 1728074 - RNA, 17 nt, Human
gaucuacaugucuagag

SEQ ID NO: 1728075 - RNA, 12 nt, Human
aaggaugccccg

SEQ ID NO: 1728076 - RNA, 20 nt, Human
ucugguagcuaaauauauau

SEQ ID NO: 1728077 - RNA, 15 nt, Human
ucugcagauaaacag

SEQ ID NO: 1728078 - RNA, 23 nt, Human
aauguauucuuuuaguuuuuaaa

SEQ ID NO: 1728079 - RNA, 23 nt, Human
ugucaauucuugccaaauauaaa

SEQ ID NO: 1728080 - RNA, 23 nt, Human
cacagaaacuccuguucaugccc

SEQ ID NO: 1728081 - RNA, 14 nt, Human
ccugccccugagcc

SEQ ID NO: 1728082 - RNA, 12 nt, Human
ucugcacacagc

SEQ ID NO: 1728083 - RNA, 12 nt, Human
cucccugccccc

SEQ ID NO: 1728084 - RNA, 15 nt, Human
auaggaaauauuuua

SEQ ID NO: 1728085 - RNA, 19 nt, Human
cacaggaaccacaagacug

SEQ ID NO: 1728086 - RNA, 11 nt, Human
ucaccuccccc

SEQ ID NO: 1728087 - RNA, 13 nt, Human
aagcuucuguucc

SEQ ID NO: 1728088 - RNA, 23 nt, Human
ugcagagguccacaacacacaga

SEQ ID NO: 1728089 - RNA, 19 nt, Human
gcuggccuugugaggagcu

SEQ ID NO: 1728090 - RNA, 14 nt, Human
aacuuugauuuuau

SEQ ID NO: 1728091 - RNA, 18 nt, Human
ccugaaagaggaaugaag

SEQ ID NO: 1728092 - RNA, 18 nt, Human
cauggaauuggagcucgu

SEQ ID NO: 1728093 - RNA, 18 nt, Human
cauagugagacacugucu

SEQ ID NO: 1728094 - RNA, 22 nt, Human
gaggggagcaugggaagugacg

SEQ ID NO: 1728095 - RNA, 18 nt, Human
caagcuaugugagcucac

SEQ ID NO: 1728096 - RNA, 15 nt, Human
aaauguauucuuuua

SEQ ID NO: 1728097 - RNA, 23 nt, Human
cucaggggggugguuuucccauc

SEQ ID NO: 1728098 - RNA, 16 nt, Human
ccucagucucccuccc

SEQ ID NO: 1728099 - RNA, 21 nt, Human
ugaaauggacuuuuguacaua

SEQ ID NO: 1728100 - RNA, 22 nt, Human
uuaccucugccucagaaaacaa

SEQ ID NO: 1728101 - RNA, 16 nt, Human
cagggacuugaaccca

SEQ ID NO: 1728102 - RNA, 22 nt, Human
agacucugucucaguccaugaa

SEQ ID NO: 1728103 - RNA, 21 nt, Human
ugaauuguaggugacuauuau

SEQ ID NO: 1728104 - RNA, 13 nt, Human
aagcauuccaacu

SEQ ID NO: 1728105 - RNA, 15 nt, Human
augugcagccaccag

SEQ ID NO: 1728106 - RNA, 16 nt, Human
cuggccuucggccucc

SEQ ID NO: 1728107 - RNA, 13 nt, Human
uguauauuuuaua

SEQ ID NO: 1728108 - RNA, 13 nt, Human
uuuuaaaaaagaa

SEQ ID NO: 1728109 - RNA, 17 nt, Human
agugagacagcucugca

SEQ ID NO: 1728110 - RNA, 14 nt, Human
aaagagaacuucca

SEQ ID NO: 1728111 - RNA, 15 nt, Human
aggcagauguuccua

SEQ ID NO: 1728112 - RNA, 16 nt, Human
acagagacagaaagca

SEQ ID NO: 1728113 - RNA, 19 nt, Human
gugaacuugguuuuaauua

SEQ ID NO: 1728114 - RNA, 18 nt, Human
auaauccuaaacauauga

SEQ ID NO: 1728115 - RNA, 22 nt, Human
uaagaauucuguugauggaaau

SEQ ID NO: 1728116 - RNA, 19 nt, Human
ugcuugucccuguggaagu

SEQ ID NO: 1728117 - RNA, 17 nt, Human
ccacuggacucaccucc

SEQ ID NO: 1728118 - RNA, 16 nt, Human
cuagaaccaccugccu

SEQ ID NO: 1728119 - RNA, 17 nt, Human
ugacuauuauauuucca

SEQ ID NO: 1728120 - RNA, 23 nt, Human
cccuagaaagccaugugcagcca

SEQ ID NO: 1728121 - RNA, 11 nt, Human
aaauaaauaaa

SEQ ID NO: 1728122 - RNA, 20 nt, Human
gaaaauaacaauaaaagaca

SEQ ID NO: 1728123 - RNA, 23 nt, Human
uaaaagacagugaaagaaaauaa

SEQ ID NO: 1728124 - RNA, 19 nt, Human
auuagaaauguaauuaugu

SEQ ID NO: 1728125 - RNA, 15 nt, Human
aauaacgauaaaaga

SEQ ID NO: 1728126 - RNA, 18 nt, Human
gaaacaaaaggauaauga

SEQ ID NO: 1728127 - RNA, 17 nt, Human
aggcuggcgugcagcau

SEQ ID NO: 1728128 - RNA, 22 nt, Human
uuccccuuccuaauuccacagc

SEQ ID NO: 1728129 - RNA, 13 nt, Human
uuuucuuuucauu

SEQ ID NO: 1728130 - RNA, 15 nt, Human
ccugccccccagccc

SEQ ID NO: 1728131 - RNA, 15 nt, Human
gcccacuagacccac

SEQ ID NO: 1728132 - RNA, 19 nt, Human
auguuuacagauccccaag

SEQ ID NO: 1728133 - RNA, 20 nt, Human
augcuucuguuuuauaauuu

SEQ ID NO: 1728134 - RNA, 21 nt, Human
uugaggaaaaugggcuuugga

SEQ ID NO: 1728135 - RNA, 16 nt, Human
gaaucacuugaacccg

SEQ ID NO: 1728136 - RNA, 16 nt, Human
uuaaauuguaauaggc

SEQ ID NO: 1728137 - RNA, 18 nt, Human
gacccacuggacucaccu

SEQ ID NO: 1728138 - RNA, 14 nt, Human
ccugcugagcccca

SEQ ID NO: 1728139 - RNA, 20 nt, Human
ccucaagcuaugugagcuca

SEQ ID NO: 1728140 - RNA, 21 nt, Human
acaaggaaggaaagaugugaa

SEQ ID NO: 1728141 - RNA, 14 nt, Human
cuccagugagacag

SEQ ID NO: 1728142 - RNA, 20 nt, Human
uaacgauaaaagacagugaa

SEQ ID NO: 1728143 - RNA, 23 nt, Human
gcuguggauuuaauguggaaaug

SEQ ID NO: 1728144 - RNA, 14 nt, Human
cagagguugcagug

SEQ ID NO: 1728145 - RNA, 21 nt, Human
accaaggagccaaacauccua

SEQ ID NO: 1728146 - RNA, 18 nt, Human
uauguuagagaauuuccu

SEQ ID NO: 1728147 - RNA, 19 nt, Human
auuauuuuuuaaaaaaauu

SEQ ID NO: 1728148 - RNA, 17 nt, Human
ugaucaccugcccugcu

SEQ ID NO: 1728149 - RNA, 13 nt, Human
agagguccacaac

SEQ ID NO: 1728150 - RNA, 18 nt, Human
auguuccuaauaaagcuu

SEQ ID NO: 1728151 - RNA, 15 nt, Human
acucaacaaacauaa

SEQ ID NO: 1728152 - RNA, 20 nt, Human
guaaaauagugaauaaaguc

SEQ ID NO: 1728153 - RNA, 16 nt, Human
cagucucccucccuug

SEQ ID NO: 1728154 - RNA, 16 nt, Human
gagaacacugugcucu

SEQ ID NO: 1728155 - RNA, 13 nt, Human
aguguuuagcaua

SEQ ID NO: 1728156 - RNA, 18 nt, Human
uuaucauuuaguuauaaa

SEQ ID NO: 1728157 - RNA, 18 nt, Human
cuucucacauuuauauuu

SEQ ID NO: 1728158 - RNA, 18 nt, Human
uuaggaggacaaaaggaa

SEQ ID NO: 1728159 - RNA, 22 nt, Human
uuuauggcacuaguauuucuau

SEQ ID NO: 1728160 - RNA, 18 nt, Human
ucucagguguguugcagu

SEQ ID NO: 1728161 - RNA, 17 nt, Human
accugcugagccccaag

SEQ ID NO: 1728162 - RNA, 18 nt, Human
acaaaugggaaacaaaag

SEQ ID NO: 1728163 - RNA, 12 nt, Human
agggacccccaa

SEQ ID NO: 1728164 - RNA, 22 nt, Human
cuggagacauugaggcaggcac

SEQ ID NO: 1728165 - RNA, 19 nt, Human
aaucagagauaaagcuuag

SEQ ID NO: 1728166 - RNA, 18 nt, Human
caaggcuagaaccaccug

SEQ ID NO: 1728167 - RNA, 18 nt, Human
gaauuuccuuacucuuga

SEQ ID NO: 1728168 - RNA, 21 nt, Human
uccuucagccugaaagaggaa

SEQ ID NO: 1728169 - RNA, 22 nt, Human
uccagccuucucucaaggagag

SEQ ID NO: 1728170 - RNA, 21 nt, Human
cuaguaucaaaagaaagaaaa

SEQ ID NO: 1728171 - RNA, 13 nt, Human
uaaauauauauuu

SEQ ID NO: 1728172 - RNA, 13 nt, Human
cugaugggcaaaa

SEQ ID NO: 1728173 - RNA, 17 nt, Human
uaagaaauaggaaauau

SEQ ID NO: 1728174 - RNA, 17 nt, Human
uucucuaggaaauauuu

SEQ ID NO: 1728175 - RNA, 17 nt, Human
caccucccccaucucuu

SEQ ID NO: 1728176 - RNA, 14 nt, Human
acuuggucugugag

SEQ ID NO: 1728177 - RNA, 14 nt, Human
caaggaaaaaauaa

SEQ ID NO: 1728178 - RNA, 20 nt, Human
cuggcuaauuagcauggcca

SEQ ID NO: 1728179 - RNA, 20 nt, Human
aaauaauuuuuauauuugaa

SEQ ID NO: 1728180 - RNA, 20 nt, Human
cuucuuuguguuauuucccu

SEQ ID NO: 1728181 - RNA, 17 nt, Human
acacuaagagagaauga

SEQ ID NO: 1728182 - RNA, 22 nt, Human
caaaugggaaacaaaaggauaa

SEQ ID NO: 1728183 - RNA, 19 nt, Human
uucccuugaugaagaaguu

SEQ ID NO: 1728184 - RNA, 14 nt, Human
cacuuauaggaauu

SEQ ID NO: 1728185 - RNA, 17 nt, Human
cccacuagacccacugg

SEQ ID NO: 1728186 - RNA, 17 nt, Human
aauucuugccaaauaua

SEQ ID NO: 1728187 - RNA, 17 nt, Human
uuauaaucuuucacagg

SEQ ID NO: 1728188 - RNA, 22 nt, Human
auauauaacaaugcuguauuuu

SEQ ID NO: 1728189 - RNA, 23 nt, Human
ucccuagaaagccaugugcagcc

SEQ ID NO: 1728190 - RNA, 23 nt, Human
uuauagcuacuaauuuuaaaaug

SEQ ID NO: 1728191 - RNA, 22 nt, Human
cagacacaugugcuggccaccu

SEQ ID NO: 1728192 - RNA, 13 nt, Human
ugccaaaauauaa

SEQ ID NO: 1728193 - RNA, 11 nt, Human
agacacaugug

SEQ ID NO: 1728194 - RNA, 18 nt, Human
uauuucuguuaaaauaua

SEQ ID NO: 1728195 - RNA, 16 nt, Human
ucuuuuaguuuuuaaa

SEQ ID NO: 1728196 - RNA, 12 nt, Human
uauuuuaauguu

SEQ ID NO: 1728197 - RNA, 17 nt, Human
acuauuuaauuauuuca

SEQ ID NO: 1728198 - RNA, 18 nt, Human
ugcccauaccccuggcca

SEQ ID NO: 1728199 - RNA, 23 nt, Human
cuaguaauuggaaaggcagcucu

SEQ ID NO: 1728200 - RNA, 22 nt, Human
aaagagugaaggauuuauguuu

SEQ ID NO: 1728201 - RNA, 19 nt, Human
uguuaucuucacuuuuaua

SEQ ID NO: 1728202 - RNA, 16 nt, Human
aaauauuauguuaaaa

SEQ ID NO: 1728203 - RNA, 21 nt, Human
aaucaccaaggcugauuaaac

SEQ ID NO: 1728204 - RNA, 20 nt, Human
aggugacuauuauauuucca

SEQ ID NO: 1728205 - RNA, 18 nt, Human
uuccuaauaaagcuucug

SEQ ID NO: 1728206 - RNA, 14 nt, Human
uguauucuuuuagu

SEQ ID NO: 1728207 - RNA, 19 nt, Human
caaagugucuugaauugua

SEQ ID NO: 1728208 - RNA, 13 nt, Human
auugucuagugaa

SEQ ID NO: 1728209 - RNA, 20 nt, Human
aagcuucacuguaaaauaau

SEQ ID NO: 1728210 - RNA, 16 nt, Human
uucaguuauuauauuu

SEQ ID NO: 1728211 - RNA, 20 nt, Human
cauagugagacacugucucu

SEQ ID NO: 1728212 - RNA, 18 nt, Human
uucugauauuggacagua

SEQ ID NO: 1728213 - RNA, 20 nt, Human
acuagaguuuagcuggaaaa

SEQ ID NO: 1728214 - RNA, 16 nt, Human
uaucaaaagaaagaaa

SEQ ID NO: 1728215 - RNA, 19 nt, Human
ccgggcgugguggugagug

SEQ ID NO: 1728216 - RNA, 22 nt, Human
accuaacgaaguauccuucagc

SEQ ID NO: 1728217 - RNA, 12 nt, Human
acaugagguacu

SEQ ID NO: 1728218 - RNA, 16 nt, Human
ugagcucagcccuggu

SEQ ID NO: 1728219 - RNA, 11 nt, Human
aauuccacagc

SEQ ID NO: 1728220 - RNA, 20 nt, Human
uaugcuucuguuuuauaauu

SEQ ID NO: 1728221 - RNA, 13 nt, Human
caacucccugccc

SEQ ID NO: 1728222 - RNA, 21 nt, Human
auacaguggagacaucuggaa

SEQ ID NO: 1728223 - RNA, 15 nt, Human
uauaauuuaaauaua

SEQ ID NO: 1728224 - RNA, 22 nt, Human
aaacaaggaugaauuaaguuuu

SEQ ID NO: 1728225 - RNA, 19 nt, Human
agccugaucaccugcccug

SEQ ID NO: 1728226 - RNA, 14 nt, Human
auuauuucacuuua

SEQ ID NO: 1728227 - RNA, 13 nt, Human
uaguuuauauaga

SEQ ID NO: 1728228 - RNA, 17 nt, Human
gugccuguaaucacagc

SEQ ID NO: 1728229 - RNA, 22 nt, Human
ggcacaacacaucaggaaagag

SEQ ID NO: 1728230 - RNA, 20 nt, Human
uaugaaaaggcuaagcuuca

SEQ ID NO: 1728231 - RNA, 13 nt, Human
ugagcgacaguga

SEQ ID NO: 1728232 - RNA, 19 nt, Human
cucugccucagaaaacaag

SEQ ID NO: 1728233 - RNA, 15 nt, Human
guaaggggaauugag

SEQ ID NO: 1728234 - RNA, 18 nt, Human
ggaggacgcucucuggcc

SEQ ID NO: 1728235 - RNA, 14 nt, Human
ucccuugaugaaga

SEQ ID NO: 1728236 - RNA, 19 nt, Human
aguugauuuaaggccaggc

SEQ ID NO: 1728237 - RNA, 20 nt, Human
aauucuugccaaauauaaau

SEQ ID NO: 1728238 - RNA, 12 nt, Human
acaccuuaucua

SEQ ID NO: 1728239 - RNA, 20 nt, Human
ccaaauguucaucaaugaau

SEQ ID NO: 1728240 - RNA, 17 nt, Human
uccuuggugccuggagc

SEQ ID NO: 1728241 - RNA, 23 nt, Human
caggcacaguggcucacaccugu

SEQ ID NO: 1728242 - RNA, 21 nt, Human
cuuguuggacgagaaaacaau

SEQ ID NO: 1728243 - RNA, 16 nt, Human
ugacaagcucacagac

SEQ ID NO: 1728244 - RNA, 14 nt, Human
ugacuauuauauuu

SEQ ID NO: 1728245 - RNA, 18 nt, Human
gucuucuagcagugagcc

SEQ ID NO: 1728246 - RNA, 17 nt, Human
ccuuggugccuggagcc

SEQ ID NO: 1728247 - RNA, 18 nt, Human
uaggaugggaacaaggaa

SEQ ID NO: 1728248 - RNA, 16 nt, Human
gccaugugcuaguaau

SEQ ID NO: 1728249 - RNA, 18 nt, Human
uauuuucuauaauuuaaa

SEQ ID NO: 1728250 - RNA, 14 nt, Human
uauuaaguauuuua

SEQ ID NO: 1728251 - RNA, 17 nt, Human
aagacagugaaagaaaa

SEQ ID NO: 1728252 - RNA, 15 nt, Human
aaucucaauauuuca

SEQ ID NO: 1728253 - RNA, 17 nt, Human
cugccucagaaaacaag

SEQ ID NO: 1728254 - RNA, 13 nt, Human
acuaauuuuaaaa

SEQ ID NO: 1728255 - RNA, 21 nt, Human
auuauauuuauuacuguaaga

SEQ ID NO: 1728256 - RNA, 23 nt, Human
ucuagcaugucgucaaagcugaa

SEQ ID NO: 1728257 - RNA, 14 nt, Human
ugaucaccugcccu

SEQ ID NO: 1728258 - RNA, 22 nt, Human
uucaauaucuuuuuuuuaauaa

SEQ ID NO: 1728259 - RNA, 15 nt, Human
cgaagcaccaucauu

SEQ ID NO: 1728260 - RNA, 20 nt, Human
ggagccugaucaccugcccu

SEQ ID NO: 1728261 - RNA, 16 nt, Human
gaugcuuugagaacau

SEQ ID NO: 1728262 - RNA, 14 nt, Human
aucaggaaagagag

SEQ ID NO: 1728263 - RNA, 17 nt, Human
cugcacuccagccugag

SEQ ID NO: 1728264 - RNA, 16 nt, Human
cccacuggacucaccu

SEQ ID NO: 1728265 - RNA, 17 nt, Human
ucuauguagaauauauu

SEQ ID NO: 1728266 - RNA, 18 nt, Human
caaggcugauuaaaccaa

SEQ ID NO: 1728267 - RNA, 22 nt, Human
gugaacaaauuuacagagacag

SEQ ID NO: 1728268 - RNA, 17 nt, Human
agauacaguggagacau

SEQ ID NO: 1728269 - RNA, 19 nt, Human
cugccccccagcccuccuu

SEQ ID NO: 1728270 - RNA, 12 nt, Human
caauaaauaaau

SEQ ID NO: 1728271 - RNA, 21 nt, Human
uuggaaggcugaggcaggagg

SEQ ID NO: 1728272 - RNA, 24 nt, Human
cauucuggaauaauccuaaacaua

SEQ ID NO: 1728273 - RNA, 22 nt, Human
cugccagaaucuagagcaaagc

SEQ ID NO: 1728274 - RNA, 16 nt, Human
uacauuuguauaaaau

SEQ ID NO: 1728275 - RNA, 18 nt, Human
uaaaauccauacauuugu

SEQ ID NO: 1728276 - RNA, 13 nt, Human
ccacaacacacag

SEQ ID NO: 1728277 - RNA, 21 nt, Human
uuauguuuaauucugaaagca

SEQ ID NO: 1728278 - RNA, 19 nt, Human
cccugcaaagcccagcuug

SEQ ID NO: 1728279 - RNA, 15 nt, Human
ugauuucauucaaua

SEQ ID NO: 1728280 - RNA, 15 nt, Human
auauaaauaaaaaua

SEQ ID NO: 1728281 - RNA, 13 nt, Human
uaccccuggccaa

SEQ ID NO: 1728282 - RNA, 16 nt, Human
auccuugaagauuuac

SEQ ID NO: 1728283 - RNA, 21 nt, Human
acgcucucuggccuucggccu

SEQ ID NO: 1728284 - RNA, 14 nt, Human
gcguugagccacca

SEQ ID NO: 1728285 - RNA, 22 nt, Human
cuuaucuauguagaauauauuu

SEQ ID NO: 1728286 - RNA, 19 nt, Human
ccuuagcccuuccccucug

SEQ ID NO: 1728287 - RNA, 20 nt, Human
agccuaguugaucagcuuau

SEQ ID NO: 1728288 - RNA, 14 nt, Human
cagcaucagcaucc

SEQ ID NO: 1728289 - RNA, 13 nt, Human
auugggcaggcag

SEQ ID NO: 1728290 - RNA, 19 nt, Human
cggccuccauccugaggcu

SEQ ID NO: 1728291 - RNA, 11 nt, Human
auuuuugaagc

SEQ ID NO: 1728292 - RNA, 13 nt, Human
gaagaacugaaau

SEQ ID NO: 1728293 - RNA, 14 nt, Human
gagcccauggcacu

SEQ ID NO: 1728294 - RNA, 22 nt, Human
gcuccuccagggagucucagcu

SEQ ID NO: 1728295 - RNA, 14 nt, Human
uuaauuauuucacu

SEQ ID NO: 1728296 - RNA, 22 nt, Human
caaacaauuugaauauaaauuu

SEQ ID NO: 1728297 - RNA, 13 nt, Human
caugguggugugu

SEQ ID NO: 1728298 - RNA, 22 nt, Human
ugcuggagacauugaggcaggc

SEQ ID NO: 1728299 - RNA, 15 nt, Human
aggguuuggaagcca

SEQ ID NO: 1728300 - RNA, 20 nt, Human
cacuguggguagacacacau

SEQ ID NO: 1728301 - RNA, 13 nt, Human
aaaauaacaauga

SEQ ID NO: 1728302 - RNA, 16 nt, Human
uuauaauuuaaaauau

SEQ ID NO: 1728303 - RNA, 22 nt, Human
ucaacuccaaacugacucuuaa

SEQ ID NO: 1728304 - RNA, 18 nt, Human
aaagagugaaggauuuau

SEQ ID NO: 1728305 - RNA, 23 nt, Human
agccccaaguggaacgagacaag

SEQ ID NO: 1728306 - RNA, 15 nt, Human
acaggguuuauguuu

SEQ ID NO: 1728307 - RNA, 12 nt, Human
agcuuucuuccu

SEQ ID NO: 1728308 - RNA, 13 nt, Human
gccacaagaaccc

SEQ ID NO: 1728309 - RNA, 21 nt, Human
uaauaggcguaacuaauuuua

SEQ ID NO: 1728310 - RNA, 19 nt, Human
cuuuuaaagaaacaaaaau

SEQ ID NO: 1728311 - RNA, 22 nt, Human
auaucaaacugaaacaaaauua

SEQ ID NO: 1728312 - RNA, 22 nt, Human
gucucuaccaaaaaaaggaagg

SEQ ID NO: 1728313 - RNA, 18 nt, Human
caaacuuuacagaaagau

SEQ ID NO: 1728314 - RNA, 14 nt, Human
agauguagaggaga

SEQ ID NO: 1728315 - RNA, 18 nt, Human
agucuucagcagagaagu

SEQ ID NO: 1728316 - RNA, 19 nt, Human
uccacaaguaaaaggaaau

SEQ ID NO: 1728317 - RNA, 15 nt, Human
gaaaugauguuucau

SEQ ID NO: 1728318 - RNA, 23 nt, Human
caugcugucuacacuaagagaga

SEQ ID NO: 1728319 - RNA, 18 nt, Human
uccuaauuccacagcugc

SEQ ID NO: 1728320 - RNA, 19 nt, Human
uucuuuaucuuuuuaguau

SEQ ID NO: 1728321 - RNA, 18 nt, Human
ucaggaaagagagcacca

SEQ ID NO: 1728322 - RNA, 20 nt, Human
uaaaagacaaggaaaaaaua

SEQ ID NO: 1728323 - RNA, 17 nt, Human
cuccuaagaaggcaccu

SEQ ID NO: 1728324 - RNA, 16 nt, Human
aggaggacaaaaggaa

SEQ ID NO: 1728325 - RNA, 20 nt, Human
guauuauuuuuuaaaaaaau

SEQ ID NO: 1728326 - RNA, 16 nt, Human
gcagcaucagcauccc

SEQ ID NO: 1728327 - RNA, 19 nt, Human
caauucuugccaaauauaa

SEQ ID NO: 1728328 - RNA, 15 nt, Human
ccacaagaaaugaaa

SEQ ID NO: 1728329 - RNA, 18 nt, Human
ugccauguggcagaucua

SEQ ID NO: 1728330 - RNA, 15 nt, Human
cuacuaauuuuaaaa

SEQ ID NO: 1728331 - RNA, 14 nt, Human
cagauccccaagcc

SEQ ID NO: 1728332 - RNA, 14 nt, Human
cauagaaguaaaaa

SEQ ID NO: 1728333 - RNA, 12 nt, Human
acugaaaucaua

SEQ ID NO: 1728334 - RNA, 13 nt, Human
ugugcuggccacc

SEQ ID NO: 1728335 - RNA, 18 nt, Human
uagugaaauauuauuuua

SEQ ID NO: 1728336 - RNA, 15 nt, Human
cuggguuccuuccuc

SEQ ID NO: 1728337 - RNA, 16 nt, Human
ugugcagccaccaguc

SEQ ID NO: 1728338 - RNA, 23 nt, Human
uaauuuguaguguuggagaagaa

SEQ ID NO: 1728339 - RNA, 19 nt, Human
aguauuucuaugaaauauu

SEQ ID NO: 1728340 - RNA, 18 nt, Human
gaccccugagcuugcaga

SEQ ID NO: 1728341 - RNA, 19 nt, Human
aaggaaguauaggccaggc

SEQ ID NO: 1728342 - RNA, 20 nt, Human
agggaagacaagaaggaaag

SEQ ID NO: 1728343 - RNA, 24 nt, Human
uggcagaucuacaugucuagagaa

SEQ ID NO: 1728344 - RNA, 20 nt, Human
uuaacacaugauccugcaau

SEQ ID NO: 1728345 - RNA, 19 nt, Human
auagcuacuaauuuuaaaa

SEQ ID NO: 1728346 - RNA, 13 nt, Human
uccuacuuccccu

SEQ ID NO: 1728347 - RNA, 22 nt, Human
aauuuuagacauucuuuaucuu

SEQ ID NO: 1728348 - RNA, 17 nt, Human
uucacuguaaaauaaua

SEQ ID NO: 1728349 - RNA, 21 nt, Human
agggcagaugaugcuuugaga

SEQ ID NO: 1728350 - RNA, 14 nt, Human
auugaggcaggcac

SEQ ID NO: 1728351 - RNA, 15 nt, Human
aauagugaauaaagu

SEQ ID NO: 1728352 - RNA, 14 nt, Human
aucuaugccacaag

SEQ ID NO: 1728353 - RNA, 17 nt, Human
uuauauuugaaauauug

SEQ ID NO: 1728354 - RNA, 15 nt, Human
uaguauggcaaacug

SEQ ID NO: 1728355 - RNA, 21 nt, Human
aaaauaugccccauucaacau

SEQ ID NO: 1728356 - RNA, 14 nt, Human
cugccccccagccc

SEQ ID NO: 1728357 - RNA, 21 nt, Human
gcccauccugccccugagccc

SEQ ID NO: 1728358 - RNA, 17 nt, Human
cauuuguauaaaauaau

SEQ ID NO: 1728359 - RNA, 15 nt, Human
ugaugggcaaaaaac

SEQ ID NO: 1728360 - RNA, 14 nt, Human
cucaacaaacauaa

SEQ ID NO: 1728361 - RNA, 15 nt, Human
gucucuacauaaaau

SEQ ID NO: 1728362 - RNA, 18 nt, Human
uauaacaaugcuguauuu

SEQ ID NO: 1728363 - RNA, 17 nt, Human
gaucuggcucuggacag

SEQ ID NO: 1728364 - RNA, 18 nt, Human
aggaugggaacaaggaag

SEQ ID NO: 1728365 - RNA, 23 nt, Human
uggcuugaguuuaaauuguaaua

SEQ ID NO: 1728366 - RNA, 15 nt, Human
agcuaaauauauauu

SEQ ID NO: 1728367 - RNA, 14 nt, Human
cagauccuggaaau

SEQ ID NO: 1728368 - RNA, 23 nt, Human
aagccauccccgcuccugguugg

SEQ ID NO: 1728369 - RNA, 16 nt, Human
agcuaaauauauauuu

SEQ ID NO: 1728370 - RNA, 16 nt, Human
cauuauggauaaagau

SEQ ID NO: 1728371 - RNA, 16 nt, Human
aacaauaaaagacaag

SEQ ID NO: 1728372 - RNA, 21 nt, Human
gauaaaagacagugaaagaaa

SEQ ID NO: 1728373 - RNA, 18 nt, Human
cagauuugagcucagccc

SEQ ID NO: 1728374 - RNA, 22 nt, Human
cuugaauuguaggugacuauua

SEQ ID NO: 1728375 - RNA, 11 nt, Human
cauaugaaaag

SEQ ID NO: 1728376 - RNA, 20 nt, Human
cuucaacucccugcccccca

SEQ ID NO: 1728377 - RNA, 21 nt, Human
caacacacagauuugagcuca

SEQ ID NO: 1728378 - RNA, 19 nt, Human
ccugccuaagugcagcccc

SEQ ID NO: 1728379 - RNA, 19 nt, Human
ucuucacuuuuauaagaaa

SEQ ID NO: 1728380 - RNA, 12 nt, Human
cuguuaaaauau

SEQ ID NO: 1728381 - RNA, 22 nt, Human
gccugguguguucaagaccagc

SEQ ID NO: 1728382 - RNA, 16 nt, Human
aauugacccacaagaa

SEQ ID NO: 1728383 - RNA, 22 nt, Human
uccuuuuaaagaaacaaaaauc

SEQ ID NO: 1728384 - RNA, 13 nt, Human
auaucuucagaaa

SEQ ID NO: 1728385 - RNA, 20 nt, Human
ucuguuuucccuccuuggag

SEQ ID NO: 1728386 - RNA, 17 nt, Human
caugagggcuggaugcu

SEQ ID NO: 1728387 - RNA, 12 nt, Human
uauaggccaggc

SEQ ID NO: 1728388 - RNA, 19 nt, Human
gugacuuaaugccacuaaa

SEQ ID NO: 1728389 - RNA, 22 nt, Human
ccaaacauccuacaagacacag

SEQ ID NO: 1728390 - RNA, 16 nt, Human
agcuccagugauaaga

SEQ ID NO: 1728391 - RNA, 16 nt, Human
uaaauaaaaauaaucc

SEQ ID NO: 1728392 - RNA, 12 nt, Human
auagcaaauaag

SEQ ID NO: 1728393 - RNA, 23 nt, Human
ggagcaucuccucaacucugagu

SEQ ID NO: 1728394 - RNA, 21 nt, Human
cagacacaugugcuggccacc

SEQ ID NO: 1728395 - RNA, 22 nt, Human
aaacuuuacagaaagauuugau

SEQ ID NO: 1728396 - RNA, 18 nt, Human
ugaacuugguuuuaauua

SEQ ID NO: 1728397 - RNA, 19 nt, Human
aaaauaacgauaaaagaca

SEQ ID NO: 1728398 - RNA, 16 nt, Human
aacuugguuuuaauua

SEQ ID NO: 1728399 - RNA, 15 nt, Human
gaauauauuuccuua

SEQ ID NO: 1728400 - RNA, 17 nt, Human
ucccuccccaaaugcuu

SEQ ID NO: 1728401 - RNA, 20 nt, Human
uauacugugugcuaaaacaa

SEQ ID NO: 1728402 - RNA, 16 nt, Human
ugaauuaguuuuauau

SEQ ID NO: 1728403 - RNA, 18 nt, Human
cuccauuuuuagugaaau

SEQ ID NO: 1728404 - RNA, 17 nt, Human
acccacuggacucaccu

SEQ ID NO: 1728405 - RNA, 21 nt, Human
cuaggaugggaacaaggaagg

SEQ ID NO: 1728406 - RNA, 18 nt, Human
uaauuuuaacucuauaau

SEQ ID NO: 1728407 - RNA, 14 nt, Human
caaggaaggaaaga

SEQ ID NO: 1728408 - RNA, 21 nt, Human
auacuauuuaauuauuucacu

SEQ ID NO: 1728409 - RNA, 17 nt, Human
gaacagauuucaaaaaa

SEQ ID NO: 1728410 - RNA, 14 nt, Human
cuuggucugugaga

SEQ ID NO: 1728411 - RNA, 23 nt, Human
uuuauaugcuucuguuuuauaau

SEQ ID NO: 1728412 - RNA, 15 nt, Human
ggccuccauccugag

SEQ ID NO: 1728413 - RNA, 11 nt, Human
guauggcaaac

SEQ ID NO: 1728414 - RNA, 17 nt, Human
acuccugcuagaacagu

SEQ ID NO: 1728415 - RNA, 22 nt, Human
uucuacuggcugccagaaucua

SEQ ID NO: 1728416 - RNA, 20 nt, Human
gauugugccccugcacucca

SEQ ID NO: 1728417 - RNA, 18 nt, Human
gaaaauaacgauaaaaga

SEQ ID NO: 1728418 - RNA, 12 nt, Human
uauaauuuaaaa

SEQ ID NO: 1728419 - RNA, 14 nt, Human
cuuuacagaaagau

SEQ ID NO: 1728420 - RNA, 19 nt, Human
aaucaaacuuuacagaaag

SEQ ID NO: 1728421 - RNA, 14 nt, Human
cuacaagacacagu

SEQ ID NO: 1728422 - RNA, 19 nt, Human
cuggcucuggacaggcacu

SEQ ID NO: 1728423 - RNA, 12 nt, Human
acauaaaauaca

SEQ ID NO: 1728424 - RNA, 20 nt, Human
auauuuuauaucaauuuaaa

SEQ ID NO: 1728425 - RNA, 15 nt, Human
uaaaguaaaggcaaa

SEQ ID NO: 1728426 - RNA, 21 nt, Human
ccaugugcagccaccagucca

SEQ ID NO: 1728427 - RNA, 13 nt, Human
aagaaaauaacga

SEQ ID NO: 1728428 - RNA, 18 nt, Human
acagaaagcagaacagug

SEQ ID NO: 1728429 - RNA, 16 nt, Human
cugaucaccugcccug

SEQ ID NO: 1728430 - RNA, 23 nt, Human
augucaauucuugccaaauauaa

SEQ ID NO: 1728431 - RNA, 20 nt, Human
cuggccaccugcugagcccc

SEQ ID NO: 1728432 - RNA, 18 nt, Human
auuaaguuuuuuuuuaaa

SEQ ID NO: 1728433 - RNA, 17 nt, Human
aauaacaauaaaagaca

SEQ ID NO: 1728434 - RNA, 13 nt, Human
uuggacgagaaaa

SEQ ID NO: 1728435 - RNA, 16 nt, Human
ugcuauugaaguuuug

SEQ ID NO: 1728436 - RNA, 14 nt, Human
gaaagcagaacagu

SEQ ID NO: 1728437 - RNA, 12 nt, Human
acacugaagaag

SEQ ID NO: 1728438 - RNA, 13 nt, Human
aaacauccuacaa

SEQ ID NO: 1728439 - RNA, 19 nt, Human
acuaucucauuuccaagca

SEQ ID NO: 1728440 - RNA, 16 nt, Human
ccugcaaagcccagcu

SEQ ID NO: 1728441 - RNA, 15 nt, Human
uggaaacgaagcacc

SEQ ID NO: 1728442 - RNA, 21 nt, Human
cuccauggaaacgaagcacca

SEQ ID NO: 1728443 - RNA, 18 nt, Human
gcuacagugagccaagag

SEQ ID NO: 1728444 - RNA, 22 nt, Human
gaaaggaaguauaggccaggca

SEQ ID NO: 1728445 - RNA, 12 nt, Human
acagagacagaa

SEQ ID NO: 1728446 - RNA, 17 nt, Human
cccaggcugagccucag

SEQ ID NO: 1728447 - RNA, 12 nt, Human
caggcauggugg

SEQ ID NO: 1728448 - RNA, 13 nt, Human
auaaauaaaaaua

SEQ ID NO: 1728449 - RNA, 20 nt, Human
uuguaggugacuauuauauu

SEQ ID NO: 1728450 - RNA, 14 nt, Human
aaauaggaaauauu

SEQ ID NO: 1728451 - RNA, 17 nt, Human
acuugaacccauauuug

SEQ ID NO: 1728452 - RNA, 21 nt, Human
caucucagguguguugcagug

SEQ ID NO: 1728453 - RNA, 20 nt, Human
acuuuauuuucuauaauuua

SEQ ID NO: 1728454 - RNA, 13 nt, Human
uuuaaaaauccua

SEQ ID NO: 1728455 - RNA, 11 nt, Human
caucuagugag

SEQ ID NO: 1728456 - RNA, 13 nt, Human
auuuuuuaaaaaa

SEQ ID NO: 1728457 - RNA, 19 nt, Human
uguuggacgagaaaacaau

SEQ ID NO: 1728458 - RNA, 23 nt, Human
cauccucgaggcccuagcauuuc

SEQ ID NO: 1728459 - RNA, 18 nt, Human
ucaagggugugugcagca

SEQ ID NO: 1728460 - RNA, 21 nt, Human
aaaaaguucugcagauaaaca

SEQ ID NO: 1728461 - RNA, 15 nt, Human
uaacaauaaaagaca

SEQ ID NO: 1728462 - RNA, 16 nt, Human
ucucuaggaaauauuu

SEQ ID NO: 1728463 - RNA, 16 nt, Salmonella enterica enterica serovar Typhi Ty2
uuuugcagaauugaua

SEQ ID NO: 1728464 - RNA, 12 nt, Salmonella enterica enterica serovar Typhi Ty2
uuuugaugaccg

SEQ ID NO: 1728465 - RNA, 19 nt, Salmonella enterica enterica serovar Typhi Ty2
uuuugaguuugucauccag

SEQ ID NO: 1728466 - RNA, 20 nt, Salmonella enterica enterica serovar Typhi Ty2
uuuugccgcugucgccagaa

SEQ ID NO: 1728467 - RNA, 13 nt, Salmonella enterica enterica serovar Typhi Ty2
uuucgcccacauc

SEQ ID NO: 1728468 - RNA, 13 nt, Salmonella enterica enterica serovar Typhi Ty2
uuucgccagcaac

SEQ ID NO: 1728469 - RNA, 17 nt, Salmonella enterica enterica serovar Typhi Ty2
uuucguacauguccaga

SEQ ID NO: 1728470 - RNA, 19 nt, Salmonella enterica enterica serovar Typhi Ty2
uuucguacauguccagauc

SEQ ID NO: 1728471 - RNA, 12 nt, Salmonella enterica enterica serovar Typhi Ty2
uuugcagauccu

SEQ ID NO: 1728472 - RNA, 16 nt, Salmonella enterica enterica serovar Typhi Ty2
uuugccaaacugcugg

SEQ ID NO: 1728473 - RNA, 19 nt, Salmonella enterica enterica serovar Typhi Ty2
uuuguaaccaacaaacgcg

SEQ ID NO: 1728474 - RNA, 19 nt, Salmonella enterica enterica serovar Typhi Ty2
uuuuaccgcccgcgccagu

SEQ ID NO: 1728475 - RNA, 13 nt, Salmonella enterica enterica serovar Typhi Ty2
uuuuacaucagau

SEQ ID NO: 1728476 - RNA, 17 nt, Salmonella enterica enterica serovar Typhi Ty2
uuugucgucaugcgcca

SEQ ID NO: 1728477 - RNA, 17 nt, Salmonella enterica enterica serovar Typhi Ty2
uuuuaauguccagcagu

SEQ ID NO: 1728478 - RNA, 14 nt, Salmonella enterica enterica serovar Typhi Ty2
uuuguccgcugcug

SEQ ID NO: 1728479 - RNA, 15 nt, Salmonella enterica enterica serovar Typhi Ty2
uuuuaugcagccgau

SEQ ID NO: 1728480 - RNA, 21 nt, Salmonella enterica enterica serovar Typhi Ty2
uuuaaaaagcugcauaaugcg

SEQ ID NO: 1728481 - RNA, 22 nt, Salmonella enterica enterica serovar Typhi Ty2
uugugccugcugcggauaacgu

SEQ ID NO: 1728482 - RNA, 13 nt, Salmonella enterica enterica serovar Typhi Ty2
uugucuucgaugc

SEQ ID NO: 1728483 - RNA, 19 nt, Salmonella enterica enterica serovar Typhi Ty2
uugucauccugcucaucga

SEQ ID NO: 1728484 - RNA, 22 nt, Salmonella enterica enterica serovar Typhi Ty2
uugucaugcuaaaacagauaac

SEQ ID NO: 1728485 - RNA, 20 nt, Salmonella enterica enterica serovar Typhi Ty2
uuuaacaaaucgacagccag

SEQ ID NO: 1728486 - RNA, 23 nt, Salmonella enterica enterica serovar Typhi Ty2
uuuauagagcgccauauugcugu

SEQ ID NO: 1728487 - RNA, 21 nt, Salmonella enterica enterica serovar Typhi Ty2
uuucaagcaauaccggguuaa

SEQ ID NO: 1728488 - RNA, 20 nt, Salmonella enterica enterica serovar Typhi Ty2
uuucaaucgcgcccgccauc

SEQ ID NO: 1728489 - RNA, 12 nt, Salmonella enterica enterica serovar Typhi Ty2
uuucaacggauu

SEQ ID NO: 1728490 - RNA, 17 nt, Salmonella enterica enterica serovar Typhi Ty2
uuucaaccacggauaag

SEQ ID NO: 1728491 - RNA, 22 nt, Salmonella enterica enterica serovar Typhi Ty2
uuucaaccgcgccaaagauaag

SEQ ID NO: 1728492 - RNA, 12 nt, Salmonella enterica enterica serovar Typhi Ty2
uuucauaacgca

SEQ ID NO: 1728493 - RNA, 19 nt, Salmonella enterica enterica serovar Typhi Ty2
uuucaucaagccauugcgc

SEQ ID NO: 1728494 - RNA, 16 nt, Salmonella enterica enterica serovar Typhi Ty2
uuucaucuccgauaaa

SEQ ID NO: 1728495 - RNA, 21 nt, Salmonella enterica enterica serovar Typhi Ty2
uuuccugcuguugucgauauu

SEQ ID NO: 1728496 - RNA, 20 nt, Salmonella enterica enterica serovar Typhi Ty2
uuucgaagccgaccaccauc

SEQ ID NO: 1728497 - RNA, 19 nt, Salmonella enterica enterica serovar Typhi Ty2
uuucgaacgcuagcucaac

SEQ ID NO: 1728498 - RNA, 17 nt, Salmonella enterica enterica serovar Typhi Ty2
uuucauuggucaguaag

SEQ ID NO: 1728499 - RNA, 18 nt, Salmonella enterica enterica serovar Typhi Ty2
uuuccgcuagggcaucag

SEQ ID NO: 1728500 - RNA, 21 nt, Salmonella enterica enterica serovar Typhi Ty2
uugaauaaugcccguugacga

SEQ ID NO: 1728501 - RNA, 13 nt, Salmonella enterica enterica serovar Typhi Ty2
uugaauuugacga

SEQ ID NO: 1728502 - RNA, 15 nt, Salmonella enterica enterica serovar Typhi Ty2
uugacccacgccagc

SEQ ID NO: 1728503 - RNA, 14 nt, Salmonella enterica enterica serovar Typhi Ty2
uuccucagaauccg

SEQ ID NO: 1728504 - RNA, 12 nt, Salmonella enterica enterica serovar Typhi Ty2
uuccucccggug

SEQ ID NO: 1728505 - RNA, 20 nt, Salmonella enterica enterica serovar Typhi Ty2
uuccgguuaauacgccggug

SEQ ID NO: 1728506 - RNA, 14 nt, Salmonella enterica enterica serovar Typhi Ty2
uuccgguuccggcg

SEQ ID NO: 1728507 - RNA, 20 nt, Salmonella enterica enterica serovar Typhi Ty2
uugaacagcgucauccagug

SEQ ID NO: 1728508 - RNA, 15 nt, Salmonella enterica enterica serovar Typhi Ty2
uugaacauauccgcg

SEQ ID NO: 1728509 - RNA, 16 nt, Salmonella enterica enterica serovar Typhi Ty2
uugagcuggauaagcu

SEQ ID NO: 1728510 - RNA, 17 nt, Salmonella enterica enterica serovar Typhi Ty2
uugacuuuuacgccacg

SEQ ID NO: 1728511 - RNA, 16 nt, Salmonella enterica enterica serovar Typhi Ty2
uugaguuuuccgccau

SEQ ID NO: 1728512 - RNA, 16 nt, Salmonella enterica enterica serovar Typhi Ty2
uugauaacggaaucac

SEQ ID NO: 1728513 - RNA, 12 nt, Salmonella enterica enterica serovar Typhi Ty2
uugaucacggua

SEQ ID NO: 1728514 - RNA, 20 nt, Salmonella enterica enterica serovar Typhi Ty2
uugaugaaccgcuguagcgu

SEQ ID NO: 1728515 - RNA, 13 nt, Salmonella enterica enterica serovar Typhi Ty2
uugauucaccgac

SEQ ID NO: 1728516 - RNA, 22 nt, Salmonella enterica enterica serovar Typhi Ty2
uugcaugguagucguuauaauc

SEQ ID NO: 1728517 - RNA, 16 nt, Salmonella enterica enterica serovar Typhi Ty2
uugcauuucgaccgca

SEQ ID NO: 1728518 - RNA, 13 nt, Salmonella enterica enterica serovar Typhi Ty2
uugccauucgcca

SEQ ID NO: 1728519 - RNA, 15 nt, Salmonella enterica enterica serovar Typhi Ty2
uugccauauugccgc

SEQ ID NO: 1728520 - RNA, 15 nt, Salmonella enterica enterica serovar Typhi Ty2
uugccaugguucaca

SEQ ID NO: 1728521 - RNA, 17 nt, Salmonella enterica enterica serovar Typhi Ty2
uugccaugugccgcgaa

SEQ ID NO: 1728522 - RNA, 20 nt, Salmonella enterica enterica serovar Typhi Ty2
uugccagagagaugccgccg

SEQ ID NO: 1728523 - RNA, 20 nt, Salmonella enterica enterica serovar Typhi Ty2
uugccacuggcuuuccugau

SEQ ID NO: 1728524 - RNA, 13 nt, Salmonella enterica enterica serovar Typhi Ty2
uugccaaacugcu

SEQ ID NO: 1728525 - RNA, 13 nt, Salmonella enterica enterica serovar Typhi Ty2
uuggaucggcaaa

SEQ ID NO: 1728526 - RNA, 20 nt, Salmonella enterica enterica serovar Typhi Ty2
uuggcaaaaaaggccagacu

SEQ ID NO: 1728527 - RNA, 19 nt, Salmonella enterica enterica serovar Typhi Ty2
uuggcagaacgaccacauu

SEQ ID NO: 1728528 - RNA, 22 nt, Salmonella enterica enterica serovar Typhi Ty2
uugcugacagcaucgauuccgc

SEQ ID NO: 1728529 - RNA, 14 nt, Salmonella enterica enterica serovar Typhi Ty2
uugcucugccagcg

SEQ ID NO: 1728530 - RNA, 20 nt, Salmonella enterica enterica serovar Typhi Ty2
uugcuggcgugaaccgguaa

SEQ ID NO: 1728531 - RNA, 14 nt, Salmonella enterica enterica serovar Typhi Ty2
uugcuggcgugaac

SEQ ID NO: 1728532 - RNA, 18 nt, Salmonella enterica enterica serovar Typhi Ty2
uugcuuauccggccuaca

SEQ ID NO: 1728533 - RNA, 20 nt, Salmonella enterica enterica serovar Typhi Ty2
uugcuuauuagaggcguaag

SEQ ID NO: 1728534 - RNA, 16 nt, Salmonella enterica enterica serovar Typhi Ty2
uugcuuuuucggcaau

SEQ ID NO: 1728535 - RNA, 18 nt, Salmonella enterica enterica serovar Typhi Ty2
uugcuuucaauuuccgca

SEQ ID NO: 1728536 - RNA, 17 nt, Salmonella enterica enterica serovar Typhi Ty2
uugccuucgauuaacgc

SEQ ID NO: 1728537 - RNA, 16 nt, Salmonella enterica enterica serovar Typhi Ty2
uugccuuuuuccggga

SEQ ID NO: 1728538 - RNA, 23 nt, Salmonella enterica enterica serovar Typhi Ty2
uugccgucaaacgcuaucaccgc

SEQ ID NO: 1728539 - RNA, 23 nt, Salmonella enterica enterica serovar Typhi Ty2
uugccgccuugguugccgcauaa

SEQ ID NO: 1728540 - RNA, 12 nt, Salmonella enterica enterica serovar Typhi Ty2
uugccgccauca

SEQ ID NO: 1728541 - RNA, 17 nt, Salmonella enterica enterica serovar Typhi Ty2
uugccgacagaacugau

SEQ ID NO: 1728542 - RNA, 14 nt, Salmonella enterica enterica serovar Typhi Ty2
uugcgcuaaaaucc

SEQ ID NO: 1728543 - RNA, 18 nt, Salmonella enterica enterica serovar Typhi Ty2
uugcgcgacgacgccagc

SEQ ID NO: 1728544 - RNA, 14 nt, Salmonella enterica enterica serovar Typhi Ty2
uugcgccgucacac

SEQ ID NO: 1728545 - RNA, 21 nt, Salmonella enterica enterica serovar Typhi Ty2
uugcgccgugccuggcgcugg

SEQ ID NO: 1728546 - RNA, 13 nt, Salmonella enterica enterica serovar Typhi Ty2
uugcgccgcgaac

SEQ ID NO: 1728547 - RNA, 20 nt, Salmonella enterica enterica serovar Typhi Ty2
uugcgccgacggaacccagc

SEQ ID NO: 1728548 - RNA, 21 nt, Salmonella enterica enterica serovar Typhi Ty2
uugcgcagcaacgucucgaca

SEQ ID NO: 1728549 - RNA, 20 nt, Salmonella enterica enterica serovar Typhi Ty2
uucagagcguccacgccauc

SEQ ID NO: 1728550 - RNA, 21 nt, Salmonella enterica enterica serovar Typhi Ty2
uucagguuuuuaagcugccca

SEQ ID NO: 1728551 - RNA, 19 nt, Salmonella enterica enterica serovar Typhi Ty2
uucacacugcgccgccagc

SEQ ID NO: 1728552 - RNA, 16 nt, Salmonella enterica enterica serovar Typhi Ty2
uucacccacugcacau

SEQ ID NO: 1728553 - RNA, 13 nt, Salmonella enterica enterica serovar Typhi Ty2
uucaccacgcagc

SEQ ID NO: 1728554 - RNA, 16 nt, Salmonella enterica enterica serovar Typhi Ty2
uucaccccagcgguaa

SEQ ID NO: 1728555 - RNA, 20 nt, Salmonella enterica enterica serovar Typhi Ty2
uucacggucaaacgcgguaa

SEQ ID NO: 1728556 - RNA, 15 nt, Salmonella enterica enterica serovar Typhi Ty2
uucacgcucacgcag

SEQ ID NO: 1728557 - RNA, 19 nt, Salmonella enterica enterica serovar Typhi Ty2
uucacggcgguucaucgga

SEQ ID NO: 1728558 - RNA, 19 nt, Salmonella enterica enterica serovar Typhi Ty2
uuauguagccagccauggc

SEQ ID NO: 1728559 - RNA, 18 nt, Salmonella enterica enterica serovar Typhi Ty2
uuauguaggccugauaag

SEQ ID NO: 1728560 - RNA, 17 nt, Salmonella enterica enterica serovar Typhi Ty2
uuauguaccgucaucgc

SEQ ID NO: 1728561 - RNA, 22 nt, Salmonella enterica enterica serovar Typhi Ty2
uuauuacgcgcucucauaagcc

SEQ ID NO: 1728562 - RNA, 12 nt, Salmonella enterica enterica serovar Typhi Ty2
uuauuaacccuu

SEQ ID NO: 1728563 - RNA, 17 nt, Salmonella enterica enterica serovar Typhi Ty2
uuauguuugcugauaag

SEQ ID NO: 1728564 - RNA, 16 nt, Salmonella enterica enterica serovar Typhi Ty2
uuaugggaggauacug

SEQ ID NO: 1728565 - RNA, 14 nt, Salmonella enterica enterica serovar Typhi Ty2
uuaugcugccagcg

SEQ ID NO: 1728566 - RNA, 13 nt, Salmonella enterica enterica serovar Typhi Ty2
uuaugaucgccca

SEQ ID NO: 1728567 - RNA, 14 nt, Salmonella enterica enterica serovar Typhi Ty2
uucaacgcgaccgg

SEQ ID NO: 1728568 - RNA, 13 nt, Salmonella enterica enterica serovar Typhi Ty2
uucaacgucagcu

SEQ ID NO: 1728569 - RNA, 19 nt, Salmonella enterica enterica serovar Typhi Ty2
uucaacagggguuccggca

SEQ ID NO: 1728570 - RNA, 12 nt, Salmonella enterica enterica serovar Typhi Ty2
uucauccacgcc

SEQ ID NO: 1728571 - RNA, 19 nt, Salmonella enterica enterica serovar Typhi Ty2
uucauaguuugcauaaccg

SEQ ID NO: 1728572 - RNA, 14 nt, Salmonella enterica enterica serovar Typhi Ty2
uucauaacgccgau

SEQ ID NO: 1728573 - RNA, 21 nt, Salmonella enterica enterica serovar Typhi Ty2
uuccacgcugacugcauaaug

SEQ ID NO: 1728574 - RNA, 22 nt, Salmonella enterica enterica serovar Typhi Ty2
uuccacgauauuaauucccgcc

SEQ ID NO: 1728575 - RNA, 22 nt, Salmonella enterica enterica serovar Typhi Ty2
uuccacugagcuucaccgccag

SEQ ID NO: 1728576 - RNA, 16 nt, Salmonella enterica enterica serovar Typhi Ty2
uuccacugcggcauua

SEQ ID NO: 1728577 - RNA, 16 nt, Salmonella enterica enterica serovar Typhi Ty2
uuccagcagccagccg

SEQ ID NO: 1728578 - RNA, 18 nt, Salmonella enterica enterica serovar Typhi Ty2
uuccagcagcgcaucaug

SEQ ID NO: 1728579 - RNA, 14 nt, Salmonella enterica enterica serovar Typhi Ty2
uuccagcagccagc

SEQ ID NO: 1728580 - RNA, 16 nt, Salmonella enterica enterica serovar Typhi Ty2
uuccacuguuggcgaa

SEQ ID NO: 1728581 - RNA, 15 nt, Salmonella enterica enterica serovar Typhi Ty2
uuccggguccagacg

SEQ ID NO: 1728582 - RNA, 13 nt, Salmonella enterica enterica serovar Typhi Ty2
uuccgggucgcuu

SEQ ID NO: 1728583 - RNA, 17 nt, Salmonella enterica enterica serovar Typhi Ty2
uuccggcggucagccag

SEQ ID NO: 1728584 - RNA, 14 nt, Salmonella enterica enterica serovar Typhi Ty2
uuccaggccgccag

SEQ ID NO: 1728585 - RNA, 15 nt, Salmonella enterica enterica serovar Typhi Ty2
uuccccugccagacg

SEQ ID NO: 1728586 - RNA, 13 nt, Salmonella enterica enterica serovar Typhi Ty2
uucccgcuggcug

SEQ ID NO: 1728587 - RNA, 13 nt, Salmonella enterica enterica serovar Typhi Ty2
uucccgcgccagc

SEQ ID NO: 1728588 - RNA, 16 nt, Salmonella enterica enterica serovar Typhi Ty2
uucccggcuaaccugu

SEQ ID NO: 1728589 - RNA, 14 nt, Salmonella enterica enterica serovar Typhi Ty2
uucccgaugccagc

SEQ ID NO: 1728590 - RNA, 16 nt, Salmonella enterica enterica serovar Typhi Ty2
uucccgauuccguguc

SEQ ID NO: 1728591 - RNA, 19 nt, Salmonella enterica enterica serovar Typhi Ty2
uuacaagaauaugcagugc

SEQ ID NO: 1728592 - RNA, 18 nt, Salmonella enterica enterica serovar Typhi Ty2
uuacacugauaccccagc

SEQ ID NO: 1728593 - RNA, 20 nt, Salmonella enterica enterica serovar Typhi Ty2
uuaaugucaccaucaucgau

SEQ ID NO: 1728594 - RNA, 16 nt, Salmonella enterica enterica serovar Typhi Ty2
uuaaugauuugcuuua

SEQ ID NO: 1728595 - RNA, 16 nt, Salmonella enterica enterica serovar Typhi Ty2
uuaaucaccagcgcau

SEQ ID NO: 1728596 - RNA, 14 nt, Salmonella enterica enterica serovar Typhi Ty2
uuaaugaaaucguc

SEQ ID NO: 1728597 - RNA, 18 nt, Salmonella enterica enterica serovar Typhi Ty2
uuaacucuuugagcgccc

SEQ ID NO: 1728598 - RNA, 19 nt, Salmonella enterica enterica serovar Typhi Ty2
uuaacguaggccggauaag

SEQ ID NO: 1728599 - RNA, 11 nt, Salmonella enterica enterica serovar Typhi Ty2
uuaacgccagu

SEQ ID NO: 1728600 - RNA, 15 nt, Salmonella enterica enterica serovar Typhi Ty2
uuaacaaacgccagg

SEQ ID NO: 1728601 - RNA, 16 nt, Salmonella enterica enterica serovar Typhi Ty2
uuaacuucuccgccau

SEQ ID NO: 1728602 - RNA, 18 nt, Salmonella enterica enterica serovar Typhi Ty2
uuaagccagacgcgcagc

SEQ ID NO: 1728603 - RNA, 21 nt, Salmonella enterica enterica serovar Typhi Ty2
uuaagcauccaggaaguaaau

SEQ ID NO: 1728604 - RNA, 18 nt, Salmonella enterica enterica serovar Typhi Ty2
uguuggucacgauccgca

SEQ ID NO: 1728605 - RNA, 13 nt, Salmonella enterica enterica serovar Typhi Ty2
uguuuaucgggcu

SEQ ID NO: 1728606 - RNA, 21 nt, Salmonella enterica enterica serovar Typhi Ty2
uguugcgggccagcagccagg

SEQ ID NO: 1728607 - RNA, 18 nt, Salmonella enterica enterica serovar Typhi Ty2
uuaacagaauugcgccac

SEQ ID NO: 1728608 - RNA, 15 nt, Salmonella enterica enterica serovar Typhi Ty2
uguuuuccagcguaa

SEQ ID NO: 1728609 - RNA, 21 nt, Salmonella enterica enterica serovar Typhi Ty2
uguuuuauugcuucagccaga

SEQ ID NO: 1728610 - RNA, 21 nt, Salmonella enterica enterica serovar Typhi Ty2
uuaucacccacaggagccagu

SEQ ID NO: 1728611 - RNA, 13 nt, Salmonella enterica enterica serovar Typhi Ty2
uuaucaugcgcca

SEQ ID NO: 1728612 - RNA, 16 nt, Salmonella enterica enterica serovar Typhi Ty2
uuaucuuccacgguaa

SEQ ID NO: 1728613 - RNA, 21 nt, Salmonella enterica enterica serovar Typhi Ty2
uuauaugcguguagcagauag

SEQ ID NO: 1728614 - RNA, 21 nt, Salmonella enterica enterica serovar Typhi Ty2
uuauaucaggcaaaaaucguc

SEQ ID NO: 1728615 - RNA, 19 nt, Salmonella enterica enterica serovar Typhi Ty2
uuaguaccgaacagccagg

SEQ ID NO: 1728616 - RNA, 20 nt, Salmonella enterica enterica serovar Typhi Ty2
uuaguccgucggggauggcg

SEQ ID NO: 1728617 - RNA, 17 nt, Salmonella enterica enterica serovar Typhi Ty2
uuaguaauaaagcguag

SEQ ID NO: 1728618 - RNA, 15 nt, Salmonella enterica enterica serovar Typhi Ty2
uuagggcgcggcugg

SEQ ID NO: 1728619 - RNA, 19 nt, Salmonella enterica enterica serovar Typhi Ty2
uuaggccaaacuuacgcag

SEQ ID NO: 1728620 - RNA, 13 nt, Salmonella enterica enterica serovar Typhi Ty2
uuagacaagcagu

SEQ ID NO: 1728621 - RNA, 19 nt, Salmonella enterica enterica serovar Typhi Ty2
uuagagaguaaaaccggca

SEQ ID NO: 1728622 - RNA, 16 nt, Salmonella enterica enterica serovar Typhi Ty2
uuagaaaguggcauau

SEQ ID NO: 1728623 - RNA, 14 nt, Salmonella enterica enterica serovar Typhi Ty2
uuaccgcaucgccc

SEQ ID NO: 1728624 - RNA, 15 nt, Salmonella enterica enterica serovar Typhi Ty2
uuaccccaggcgaua

SEQ ID NO: 1728625 - RNA, 20 nt, Salmonella enterica enterica serovar Typhi Ty2
uuaccgccagauggcgucac

SEQ ID NO: 1728626 - RNA, 17 nt, Salmonella enterica enterica serovar Typhi Ty2
uuacugugccgccggug

SEQ ID NO: 1728627 - RNA, 20 nt, Salmonella enterica enterica serovar Typhi Ty2
uuacugcgccagccugcugg

SEQ ID NO: 1728628 - RNA, 14 nt, Salmonella enterica enterica serovar Typhi Ty2
uuacugugccgccg

SEQ ID NO: 1728629 - RNA, 18 nt, Salmonella enterica enterica serovar Typhi Ty2
uuacccuucaugcagccc

SEQ ID NO: 1728630 - RNA, 22 nt, Salmonella enterica enterica serovar Typhi Ty2
uuacccagcaauaguggacaca

SEQ ID NO: 1728631 - RNA, 13 nt, Salmonella enterica enterica serovar Typhi Ty2
uuacccacuguau

SEQ ID NO: 1728632 - RNA, 20 nt, Salmonella enterica enterica serovar Typhi Ty2
uuacccggcguauugguaca

SEQ ID NO: 1728633 - RNA, 14 nt, Salmonella enterica enterica serovar Typhi Ty2
uuacaucagauaaa

SEQ ID NO: 1728634 - RNA, 16 nt, Salmonella enterica enterica serovar Typhi Ty2
uuacagauauccaccg

SEQ ID NO: 1728635 - RNA, 18 nt, Salmonella enterica enterica serovar Typhi Ty2
ugguggauauccagcaua

SEQ ID NO: 1728636 - RNA, 19 nt, Salmonella enterica enterica serovar Typhi Ty2
ugguggggccuaaugagcc

SEQ ID NO: 1728637 - RNA, 20 nt, Salmonella enterica enterica serovar Typhi Ty2
ugguggcggucauugucgga

SEQ ID NO: 1728638 - RNA, 15 nt, Salmonella enterica enterica serovar Typhi Ty2
ugguaacugcggcua

SEQ ID NO: 1728639 - RNA, 19 nt, Salmonella enterica enterica serovar Typhi Ty2
ugguaacgccgugacggcg

SEQ ID NO: 1728640 - RNA, 14 nt, Salmonella enterica enterica serovar Typhi Ty2
uggguuuccggauc

SEQ ID NO: 1728641 - RNA, 23 nt, Salmonella enterica enterica serovar Typhi Ty2
ugguuuuagcuuaucccauugcg

SEQ ID NO: 1728642 - RNA, 23 nt, Salmonella enterica enterica serovar Typhi Ty2
ugguuugccgcauacaucgcaga

SEQ ID NO: 1728643 - RNA, 14 nt, Salmonella enterica enterica serovar Typhi Ty2
ugguucugccagaa

SEQ ID NO: 1728644 - RNA, 11 nt, Salmonella enterica enterica serovar Typhi Ty2
uguaccaggcc

SEQ ID NO: 1728645 - RNA, 17 nt, Salmonella enterica enterica serovar Typhi Ty2
uguaccagcagcgccag

SEQ ID NO: 1728646 - RNA, 23 nt, Salmonella enterica enterica serovar Typhi Ty2
uguaauaccacugcccgccgcca

SEQ ID NO: 1728647 - RNA, 17 nt, Salmonella enterica enterica serovar Typhi Ty2
uguagcgccaaccggcu

SEQ ID NO: 1728648 - RNA, 18 nt, Salmonella enterica enterica serovar Typhi Ty2
ugucaccaucaucgauau

SEQ ID NO: 1728649 - RNA, 20 nt, Salmonella enterica enterica serovar Typhi Ty2
uguaggccgggcaagcgaag

SEQ ID NO: 1728650 - RNA, 19 nt, Salmonella enterica enterica serovar Typhi Ty2
uguaggcccgguaagcgca

SEQ ID NO: 1728651 - RNA, 15 nt, Salmonella enterica enterica serovar Typhi Ty2
ugucaggaugcugau

SEQ ID NO: 1728652 - RNA, 21 nt, Salmonella enterica enterica serovar Typhi Ty2
ugucaucaaaaucaucgccac

SEQ ID NO: 1728653 - RNA, 22 nt, Salmonella enterica enterica serovar Typhi Ty2
ugucauccaccagaauaaaggc

SEQ ID NO: 1728654 - RNA, 18 nt, Salmonella enterica enterica serovar Typhi Ty2
uguccacggggcggcaau

SEQ ID NO: 1728655 - RNA, 12 nt, Salmonella enterica enterica serovar Typhi Ty2
uguccagcagug

SEQ ID NO: 1728656 - RNA, 14 nt, Salmonella enterica enterica serovar Typhi Ty2
uguugccgacagcg

SEQ ID NO: 1728657 - RNA, 14 nt, Salmonella enterica enterica serovar Typhi Ty2
uguuaaaaccggcu

SEQ ID NO: 1728658 - RNA, 15 nt, Salmonella enterica enterica serovar Typhi Ty2
uguuauggcaggcga

SEQ ID NO: 1728659 - RNA, 16 nt, Salmonella enterica enterica serovar Typhi Ty2
uguucaagcugguuaa

SEQ ID NO: 1728660 - RNA, 12 nt, Salmonella enterica enterica serovar Typhi Ty2
uguucagccagc

SEQ ID NO: 1728661 - RNA, 20 nt, Salmonella enterica enterica serovar Typhi Ty2
uguucagguacagguaauga

SEQ ID NO: 1728662 - RNA, 12 nt, Salmonella enterica enterica serovar Typhi Ty2
ugugcaggagca

SEQ ID NO: 1728663 - RNA, 15 nt, Salmonella enterica enterica serovar Typhi Ty2
ugugcacagguaaac

SEQ ID NO: 1728664 - RNA, 16 nt, Salmonella enterica enterica serovar Typhi Ty2
ugugguccaaucguau

SEQ ID NO: 1728665 - RNA, 21 nt, Salmonella enterica enterica serovar Typhi Ty2
uguguaauguuuucugccagc

SEQ ID NO: 1728666 - RNA, 13 nt, Salmonella enterica enterica serovar Typhi Ty2
ugugguucugcca

SEQ ID NO: 1728667 - RNA, 14 nt, Salmonella enterica enterica serovar Typhi Ty2
ugugauaccgccug

SEQ ID NO: 1728668 - RNA, 21 nt, Salmonella enterica enterica serovar Typhi Ty2
ugugagcacagguuucaggua

SEQ ID NO: 1728669 - RNA, 20 nt, Salmonella enterica enterica serovar Typhi Ty2
ugugagcgcccgccgcgaac

SEQ ID NO: 1728670 - RNA, 20 nt, Salmonella enterica enterica serovar Typhi Ty2
ugugacuucccauucacgua

SEQ ID NO: 1728671 - RNA, 12 nt, Salmonella enterica enterica serovar Typhi Ty2
uggccaucaggu

SEQ ID NO: 1728672 - RNA, 21 nt, Salmonella enterica enterica serovar Typhi Ty2
uggccacggagugcgcggcga

SEQ ID NO: 1728673 - RNA, 21 nt, Salmonella enterica enterica serovar Typhi Ty2
uggccaguaucgcgccgccaa

SEQ ID NO: 1728674 - RNA, 16 nt, Salmonella enterica enterica serovar Typhi Ty2
uggccaggcauugaua

SEQ ID NO: 1728675 - RNA, 15 nt, Salmonella enterica enterica serovar Typhi Ty2
uggccaccuuuacgg

SEQ ID NO: 1728676 - RNA, 12 nt, Salmonella enterica enterica serovar Typhi Ty2
uggcagggcuga

SEQ ID NO: 1728677 - RNA, 16 nt, Salmonella enterica enterica serovar Typhi Ty2
uggcaguuugcgcuga

SEQ ID NO: 1728678 - RNA, 16 nt, Salmonella enterica enterica serovar Typhi Ty2
uggcaauggcggcgga

SEQ ID NO: 1728679 - RNA, 15 nt, Salmonella enterica enterica serovar Typhi Ty2
uggcaaucauaccgu

SEQ ID NO: 1728680 - RNA, 13 nt, Salmonella enterica enterica serovar Typhi Ty2
uggcagcggcuga

SEQ ID NO: 1728681 - RNA, 14 nt, Salmonella enterica enterica serovar Typhi Ty2
uggaucgcuccauu

SEQ ID NO: 1728682 - RNA, 15 nt, Salmonella enterica enterica serovar Typhi Ty2
uggauuuauggcguc

SEQ ID NO: 1728683 - RNA, 13 nt, Salmonella enterica enterica serovar Typhi Ty2
uggauuuauggcg

SEQ ID NO: 1728684 - RNA, 15 nt, Salmonella enterica enterica serovar Typhi Ty2
uggaguuaucauuau

SEQ ID NO: 1728685 - RNA, 19 nt, Salmonella enterica enterica serovar Typhi Ty2
uggagguuucuucaucaaa

SEQ ID NO: 1728686 - RNA, 15 nt, Salmonella enterica enterica serovar Typhi Ty2
uggauaaaucgguca

SEQ ID NO: 1728687 - RNA, 13 nt, Salmonella enterica enterica serovar Typhi Ty2
uggauaaggcgug

SEQ ID NO: 1728688 - RNA, 22 nt, Salmonella enterica enterica serovar Typhi Ty2
uggaguacgggcagauggucgc

SEQ ID NO: 1728689 - RNA, 17 nt, Salmonella enterica enterica serovar Typhi Ty2
uggaguuucaucagcac

SEQ ID NO: 1728690 - RNA, 17 nt, Salmonella enterica enterica serovar Typhi Ty2
uggauagucaggcgaug

SEQ ID NO: 1728691 - RNA, 14 nt, Salmonella enterica enterica serovar Typhi Ty2
uggauaccgcacug

SEQ ID NO: 1728692 - RNA, 14 nt, Salmonella enterica enterica serovar Typhi Ty2
uggauaaccugccg

SEQ ID NO: 1728693 - RNA, 23 nt, Salmonella enterica enterica serovar Typhi Ty2
uggauauuccaguuaucacggua

SEQ ID NO: 1728694 - RNA, 22 nt, Salmonella enterica enterica serovar Typhi Ty2
uggaggccaauauugccgccau

SEQ ID NO: 1728695 - RNA, 20 nt, Salmonella enterica enterica serovar Typhi Ty2
uggaccgcagcuuauuccag

SEQ ID NO: 1728696 - RNA, 17 nt, Salmonella enterica enterica serovar Typhi Ty2
uggacaaggaucguuac

SEQ ID NO: 1728697 - RNA, 14 nt, Salmonella enterica enterica serovar Typhi Ty2
uggaauuuuuccag

SEQ ID NO: 1728698 - RNA, 14 nt, Salmonella enterica enterica serovar Typhi Ty2
uggaaccaggcgcg

SEQ ID NO: 1728699 - RNA, 21 nt, Salmonella enterica enterica serovar Typhi Ty2
uggaacuuuaucgcgcggcga

SEQ ID NO: 1728700 - RNA, 21 nt, Salmonella enterica enterica serovar Typhi Ty2
uggccgagaguccagcgccag

SEQ ID NO: 1728701 - RNA, 16 nt, Salmonella enterica enterica serovar Typhi Ty2
uggccgacggcauaac

SEQ ID NO: 1728702 - RNA, 14 nt, Salmonella enterica enterica serovar Typhi Ty2
uggcgaaacgccug

SEQ ID NO: 1728703 - RNA, 16 nt, Salmonella enterica enterica serovar Typhi Ty2
uggccuggagaucagc

SEQ ID NO: 1728704 - RNA, 16 nt, Salmonella enterica enterica serovar Typhi Ty2
uggcgcugccggaaag

SEQ ID NO: 1728705 - RNA, 17 nt, Salmonella enterica enterica serovar Typhi Ty2
uggcgcuuaauacgcga

SEQ ID NO: 1728706 - RNA, 19 nt, Salmonella enterica enterica serovar Typhi Ty2
uggcgcuuaauacgcgaug

SEQ ID NO: 1728707 - RNA, 21 nt, Salmonella enterica enterica serovar Typhi Ty2
uggcgcuguucuugcugcugc

SEQ ID NO: 1728708 - RNA, 22 nt, Salmonella enterica enterica serovar Typhi Ty2
uggcggacccaaaagaaguggc

SEQ ID NO: 1728709 - RNA, 16 nt, Salmonella enterica enterica serovar Typhi Ty2
uggcggauacgcuucc

SEQ ID NO: 1728710 - RNA, 20 nt, Salmonella enterica enterica serovar Typhi Ty2
uggcgcacauuuacgccagc

SEQ ID NO: 1728711 - RNA, 22 nt, Salmonella enterica enterica serovar Typhi Ty2
uggcgccaaaaccgcucacggu

SEQ ID NO: 1728712 - RNA, 14 nt, Salmonella enterica enterica serovar Typhi Ty2
uggcguaaacgcca

SEQ ID NO: 1728713 - RNA, 12 nt, Salmonella enterica enterica serovar Typhi Ty2
uggcguaaauca

SEQ ID NO: 1728714 - RNA, 20 nt, Salmonella enterica enterica serovar Typhi Ty2
uggcguaaugcgaugccgca

SEQ ID NO: 1728715 - RNA, 18 nt, Salmonella enterica enterica serovar Typhi Ty2
uggcgucagaccggcaau

SEQ ID NO: 1728716 - RNA, 19 nt, Salmonella enterica enterica serovar Typhi Ty2
uggcguuaccucgccgacg

SEQ ID NO: 1728717 - RNA, 20 nt, Salmonella enterica enterica serovar Typhi Ty2
uggcguguggcugucgaccg

SEQ ID NO: 1728718 - RNA, 16 nt, Salmonella enterica enterica serovar Typhi Ty2
ugggaauuagcgaauc

SEQ ID NO: 1728719 - RNA, 13 nt, Salmonella enterica enterica serovar Typhi Ty2
uggguuccaggcg

SEQ ID NO: 1728720 - RNA, 23 nt, Salmonella enterica enterica serovar Typhi Ty2
ugggcgugucgccggggcgcugg

SEQ ID NO: 1728721 - RNA, 17 nt, Salmonella enterica enterica serovar Typhi Ty2
uaaaccaccggauggcg

SEQ ID NO: 1728722 - RNA, 12 nt, Salmonella enterica enterica serovar Typhi Ty2
uaaacaggcagg

SEQ ID NO: 1728723 - RNA, 20 nt, Salmonella enterica enterica serovar Typhi Ty2
uaaacagcgugaacacgccc

SEQ ID NO: 1728724 - RNA, 18 nt, Salmonella enterica enterica serovar Typhi Ty2
uaaaccccgauaaaccag

SEQ ID NO: 1728725 - RNA, 18 nt, Salmonella enterica enterica serovar Typhi Ty2
uaaaccaggcagcguggc

SEQ ID NO: 1728726 - RNA, 19 nt, Salmonella enterica enterica serovar Typhi Ty2
guuucaagcaguuccagca

SEQ ID NO: 1728727 - RNA, 22 nt, Salmonella enterica enterica serovar Typhi Ty2
guuuauuuaacguguuacguuu

SEQ ID NO: 1728728 - RNA, 17 nt, Salmonella enterica enterica serovar Typhi Ty2
guuuaauuccaucggca

SEQ ID NO: 1728729 - RNA, 22 nt, Salmonella enterica enterica serovar Typhi Ty2
guuuauugaaauuaaucaggca

SEQ ID NO: 1728730 - RNA, 17 nt, Salmonella enterica enterica serovar Typhi Ty2
guuuaucgcgugguaug

SEQ ID NO: 1728731 - RNA, 14 nt, Salmonella enterica enterica serovar Typhi Ty2
guuucaccguuuuc

SEQ ID NO: 1728732 - RNA, 16 nt, Salmonella enterica enterica serovar Typhi Ty2
uaaaaauauccgccau

SEQ ID NO: 1728733 - RNA, 18 nt, Salmonella enterica enterica serovar Typhi Ty2
uaaaaagcgcgggcuggc

SEQ ID NO: 1728734 - RNA, 18 nt, Salmonella enterica enterica serovar Typhi Ty2
uaaaguccugcgucgcuu

SEQ ID NO: 1728735 - RNA, 19 nt, Salmonella enterica enterica serovar Typhi Ty2
uaaagugcugaacaauaac

SEQ ID NO: 1728736 - RNA, 20 nt, Salmonella enterica enterica serovar Typhi Ty2
uaaauaggagaugcacggau

SEQ ID NO: 1728737 - RNA, 21 nt, Salmonella enterica enterica serovar Typhi Ty2
uaaauacuuuuuuagcgcaca

SEQ ID NO: 1728738 - RNA, 20 nt, Salmonella enterica enterica serovar Typhi Ty2
uaaaugcugaugacguccag

SEQ ID NO: 1728739 - RNA, 14 nt, Salmonella enterica enterica serovar Typhi Ty2
uaacacaaucaggc

SEQ ID NO: 1728740 - RNA, 18 nt, Salmonella enterica enterica serovar Typhi Ty2
uaaccauucccgauaaug

SEQ ID NO: 1728741 - RNA, 22 nt, Salmonella enterica enterica serovar Typhi Ty2
uaacccacaagaaaugcaggcg

SEQ ID NO: 1728742 - RNA, 15 nt, Salmonella enterica enterica serovar Typhi Ty2
uaaccaccuguucgc

SEQ ID NO: 1728743 - RNA, 15 nt, Salmonella enterica enterica serovar Typhi Ty2
uaacgcaucgcggau

SEQ ID NO: 1728744 - RNA, 15 nt, Salmonella enterica enterica serovar Typhi Ty2
uaacgcaggcgauag

SEQ ID NO: 1728745 - RNA, 15 nt, Salmonella enterica enterica serovar Typhi Ty2
uaacgccgcauagcg

SEQ ID NO: 1728746 - RNA, 13 nt, Salmonella enterica enterica serovar Typhi Ty2
uaacgcaucgcgg

SEQ ID NO: 1728747 - RNA, 23 nt, Salmonella enterica enterica serovar Typhi Ty2
uaacgacucauaauaucucccgu

SEQ ID NO: 1728748 - RNA, 13 nt, Salmonella enterica enterica serovar Typhi Ty2
uaauuaaccgcgc

SEQ ID NO: 1728749 - RNA, 23 nt, Salmonella enterica enterica serovar Typhi Ty2
uaauguuucacguagcaaagcgu

SEQ ID NO: 1728750 - RNA, 18 nt, Salmonella enterica enterica serovar Typhi Ty2
uaaugcacaauacgccga

SEQ ID NO: 1728751 - RNA, 20 nt, Salmonella enterica enterica serovar Typhi Ty2
uaaugcccggcgcggcauca

SEQ ID NO: 1728752 - RNA, 15 nt, Salmonella enterica enterica serovar Typhi Ty2
uaauuugcgccaucg

SEQ ID NO: 1728753 - RNA, 18 nt, Salmonella enterica enterica serovar Typhi Ty2
uaauucagcucaacgccc

SEQ ID NO: 1728754 - RNA, 22 nt, Salmonella enterica enterica serovar Typhi Ty2
uacagaugccguccauccggcg

SEQ ID NO: 1728755 - RNA, 13 nt, Salmonella enterica enterica serovar Typhi Ty2
uacaccagacgau

SEQ ID NO: 1728756 - RNA, 16 nt, Salmonella enterica enterica serovar Typhi Ty2
uacaccgccauccggc

SEQ ID NO: 1728757 - RNA, 15 nt, Salmonella enterica enterica serovar Typhi Ty2
uacagcagcgacgca

SEQ ID NO: 1728758 - RNA, 14 nt, Salmonella enterica enterica serovar Typhi Ty2
uacagcacuucccg

SEQ ID NO: 1728759 - RNA, 16 nt, Salmonella enterica enterica serovar Typhi Ty2
uaauuuugccaucgcg

SEQ ID NO: 1728760 - RNA, 18 nt, Salmonella enterica enterica serovar Typhi Ty2
uacaaucgucuucagcaa

SEQ ID NO: 1728761 - RNA, 15 nt, Salmonella enterica enterica serovar Typhi Ty2
uaacugcaaacgcgg

SEQ ID NO: 1728762 - RNA, 15 nt, Salmonella enterica enterica serovar Typhi Ty2
uaacugaacaucgcc

SEQ ID NO: 1728763 - RNA, 12 nt, Salmonella enterica enterica serovar Typhi Ty2
uaacucaauagc

SEQ ID NO: 1728764 - RNA, 20 nt, Salmonella enterica enterica serovar Typhi Ty2
uaagccggcaggcagcgcca

SEQ ID NO: 1728765 - RNA, 21 nt, Salmonella enterica enterica serovar Typhi Ty2
uaagccggcaggcagcgccag

SEQ ID NO: 1728766 - RNA, 13 nt, Salmonella enterica enterica serovar Typhi Ty2
uaaguaugccgca

SEQ ID NO: 1728767 - RNA, 23 nt, Salmonella enterica enterica serovar Typhi Ty2
uaagccggcaggcagcgccagcg

SEQ ID NO: 1728768 - RNA, 22 nt, Salmonella enterica enterica serovar Typhi Ty2
uaagccggcaggcagcgccagc

SEQ ID NO: 1728769 - RNA, 22 nt, Salmonella enterica enterica serovar Typhi Ty2
uaagcgcaauauuguuaaccag

SEQ ID NO: 1728770 - RNA, 20 nt, Salmonella enterica enterica serovar Typhi Ty2
uaagcgcagcgccauccggc

SEQ ID NO: 1728771 - RNA, 16 nt, Salmonella enterica enterica serovar Typhi Ty2
uaagcgccgucauccg

SEQ ID NO: 1728772 - RNA, 15 nt, Salmonella enterica enterica serovar Typhi Ty2
uaauccggcaacugc

SEQ ID NO: 1728773 - RNA, 22 nt, Salmonella enterica enterica serovar Typhi Ty2
uaaucaugaacguuaucggcau

SEQ ID NO: 1728774 - RNA, 20 nt, Salmonella enterica enterica serovar Typhi Ty2
uaaucaugaacguuaucggc

SEQ ID NO: 1728775 - RNA, 19 nt, Salmonella enterica enterica serovar Typhi Ty2
uaaucgauaagccagcgau

SEQ ID NO: 1728776 - RNA, 22 nt, Salmonella enterica enterica serovar Typhi Ty2
uaaucgcccugcgguagcgccg

SEQ ID NO: 1728777 - RNA, 22 nt, Salmonella enterica enterica serovar Typhi Ty2
uaaucgccgugcaguucuucau

SEQ ID NO: 1728778 - RNA, 21 nt, Salmonella enterica enterica serovar Typhi Ty2
uaaugaguacggguauuccag

SEQ ID NO: 1728779 - RNA, 15 nt, Salmonella enterica enterica serovar Typhi Ty2
uaaucaggguaauaa

SEQ ID NO: 1728780 - RNA, 21 nt, Salmonella enterica enterica serovar Typhi Ty2
uagcgagucaaaccucacgua

SEQ ID NO: 1728781 - RNA, 16 nt, Salmonella enterica enterica serovar Typhi Ty2
uagccgccgagcgccg

SEQ ID NO: 1728782 - RNA, 17 nt, Salmonella enterica enterica serovar Typhi Ty2
uagcccauauuggcaau

SEQ ID NO: 1728783 - RNA, 15 nt, Salmonella enterica enterica serovar Typhi Ty2
uagcccguacgaucu

SEQ ID NO: 1728784 - RNA, 16 nt, Salmonella enterica enterica serovar Typhi Ty2
uagcccguuaugccau

SEQ ID NO: 1728785 - RNA, 12 nt, Salmonella enterica enterica serovar Typhi Ty2
uagcauccagca

SEQ ID NO: 1728786 - RNA, 16 nt, Salmonella enterica enterica serovar Typhi Ty2
uagcaucucuucgaca

SEQ ID NO: 1728787 - RNA, 17 nt, Salmonella enterica enterica serovar Typhi Ty2
uagccagcgauccugcg

SEQ ID NO: 1728788 - RNA, 22 nt, Salmonella enterica enterica serovar Typhi Ty2
uagccaguucgccuucuucauc

SEQ ID NO: 1728789 - RNA, 18 nt, Salmonella enterica enterica serovar Typhi Ty2
uagccacagcgcgcgaca

SEQ ID NO: 1728790 - RNA, 23 nt, Salmonella enterica enterica serovar Typhi Ty2
uagccagacagcccuauaacagc

SEQ ID NO: 1728791 - RNA, 14 nt, Salmonella enterica enterica serovar Typhi Ty2
uagcaaucucgcca

SEQ ID NO: 1728792 - RNA, 14 nt, Salmonella enterica enterica serovar Typhi Ty2
uagcacuacggcaa

SEQ ID NO: 1728793 - RNA, 21 nt, Salmonella enterica enterica serovar Typhi Ty2
uagcacccuucgcuauccauc

SEQ ID NO: 1728794 - RNA, 15 nt, Salmonella enterica enterica serovar Typhi Ty2
uagcagaccgguacg

SEQ ID NO: 1728795 - RNA, 19 nt, Salmonella enterica enterica serovar Typhi Ty2
uagcagcauaaacaucagc

SEQ ID NO: 1728796 - RNA, 20 nt, Salmonella enterica enterica serovar Typhi Ty2
uagacuccgucaaagaaaac

SEQ ID NO: 1728797 - RNA, 16 nt, Salmonella enterica enterica serovar Typhi Ty2
uacuuguugagugaau

SEQ ID NO: 1728798 - RNA, 16 nt, Salmonella enterica enterica serovar Typhi Ty2
uacuuuccauauacuc

SEQ ID NO: 1728799 - RNA, 19 nt, Salmonella enterica enterica serovar Typhi Ty2
uacuuuuacccuucagaua

SEQ ID NO: 1728800 - RNA, 19 nt, Salmonella enterica enterica serovar Typhi Ty2
uacgccguccggcgaacaa

SEQ ID NO: 1728801 - RNA, 22 nt, Salmonella enterica enterica serovar Typhi Ty2
uacgccggcgcguaauuccgca

SEQ ID NO: 1728802 - RNA, 17 nt, Salmonella enterica enterica serovar Typhi Ty2
uacucaauauccugcgg

SEQ ID NO: 1728803 - RNA, 17 nt, Salmonella enterica enterica serovar Typhi Ty2
uacugcaacgccagaug

SEQ ID NO: 1728804 - RNA, 16 nt, Salmonella enterica enterica serovar Typhi Ty2
uacucaucauaauccu

SEQ ID NO: 1728805 - RNA, 17 nt, Salmonella enterica enterica serovar Typhi Ty2
uacugcuuuaauaccgg

SEQ ID NO: 1728806 - RNA, 17 nt, Salmonella enterica enterica serovar Typhi Ty2
uacgauuucauuacgcc

SEQ ID NO: 1728807 - RNA, 23 nt, Salmonella enterica enterica serovar Typhi Ty2
uacgcaccagcucuacaucgccg

SEQ ID NO: 1728808 - RNA, 22 nt, Salmonella enterica enterica serovar Typhi Ty2
uacgcauaaugcgccccgcaac

SEQ ID NO: 1728809 - RNA, 17 nt, Salmonella enterica enterica serovar Typhi Ty2
uacgcagcgccuucgcu

SEQ ID NO: 1728810 - RNA, 18 nt, Salmonella enterica enterica serovar Typhi Ty2
uacgcccucaucggcaaa

SEQ ID NO: 1728811 - RNA, 18 nt, Salmonella enterica enterica serovar Typhi Ty2
uacgccccggcgcgccau

SEQ ID NO: 1728812 - RNA, 20 nt, Salmonella enterica enterica serovar Typhi Ty2
uaccgugcaaaaucacgcgg

SEQ ID NO: 1728813 - RNA, 15 nt, Salmonella enterica enterica serovar Typhi Ty2
uaccguaaccgcagc

SEQ ID NO: 1728814 - RNA, 21 nt, Salmonella enterica enterica serovar Typhi Ty2
uaccggugcgauucagcgcag

SEQ ID NO: 1728815 - RNA, 20 nt, Salmonella enterica enterica serovar Typhi Ty2
uaccgucagauucugcggua

SEQ ID NO: 1728816 - RNA, 18 nt, Salmonella enterica enterica serovar Typhi Ty2
uaccgccgcaaccggagu

SEQ ID NO: 1728817 - RNA, 13 nt, Salmonella enterica enterica serovar Typhi Ty2
uaccgccgguaau

SEQ ID NO: 1728818 - RNA, 22 nt, Salmonella enterica enterica serovar Typhi Ty2
uaccgccgguaaugaacaccag

SEQ ID NO: 1728819 - RNA, 17 nt, Salmonella enterica enterica serovar Typhi Ty2
uaccgccaucaaacgca

SEQ ID NO: 1728820 - RNA, 19 nt, Salmonella enterica enterica serovar Typhi Ty2
uaccgccaucaaacgcagc

SEQ ID NO: 1728821 - RNA, 18 nt, Salmonella enterica enterica serovar Typhi Ty2
uaccgccaaucaacgccg

SEQ ID NO: 1728822 - RNA, 19 nt, Salmonella enterica enterica serovar Typhi Ty2
uaccgccaaucaacgccgc

SEQ ID NO: 1728823 - RNA, 16 nt, Salmonella enterica enterica serovar Typhi Ty2
uaccgccauccggcau

SEQ ID NO: 1728824 - RNA, 18 nt, Salmonella enterica enterica serovar Typhi Ty2
uaccgccacuuugcuuug

SEQ ID NO: 1728825 - RNA, 19 nt, Salmonella enterica enterica serovar Typhi Ty2
uaccgacuggggcaugaug

SEQ ID NO: 1728826 - RNA, 22 nt, Salmonella enterica enterica serovar Typhi Ty2
uaccggcgacgugacgcgccag

SEQ ID NO: 1728827 - RNA, 16 nt, Salmonella enterica enterica serovar Typhi Ty2
uaccggcauuacccag

SEQ ID NO: 1728828 - RNA, 22 nt, Salmonella enterica enterica serovar Typhi Ty2
uaccggcuaucagccgccggug

SEQ ID NO: 1728829 - RNA, 12 nt, Salmonella enterica enterica serovar Typhi Ty2
uaccggcaacgc

SEQ ID NO: 1728830 - RNA, 15 nt, Salmonella enterica enterica serovar Typhi Ty2
uaccgcgcgaaccau

SEQ ID NO: 1728831 - RNA, 14 nt, Salmonella enterica enterica serovar Typhi Ty2
uaccgcguaaugac

SEQ ID NO: 1728832 - RNA, 17 nt, Salmonella enterica enterica serovar Typhi Ty2
uaccgcguuugcgcaac

SEQ ID NO: 1728833 - RNA, 17 nt, Salmonella enterica enterica serovar Typhi Ty2
uaccgcguuuaacgcag

SEQ ID NO: 1728834 - RNA, 13 nt, Salmonella enterica enterica serovar Typhi Ty2
uaccgcgccagcg

SEQ ID NO: 1728835 - RNA, 19 nt, Salmonella enterica enterica serovar Typhi Ty2
uaccgccuuguccggccua

SEQ ID NO: 1728836 - RNA, 17 nt, Salmonella enterica enterica serovar Typhi Ty2
uacaguuugucaucagu

SEQ ID NO: 1728837 - RNA, 18 nt, Salmonella enterica enterica serovar Typhi Ty2
uacaucagauaaacggga

SEQ ID NO: 1728838 - RNA, 20 nt, Salmonella enterica enterica serovar Typhi Ty2
uaccaggcggcuuuuucauc

SEQ ID NO: 1728839 - RNA, 17 nt, Salmonella enterica enterica serovar Typhi Ty2
uaccaggaauuuuaacg

SEQ ID NO: 1728840 - RNA, 16 nt, Salmonella enterica enterica serovar Typhi Ty2
uaccagcgcggcgcca

SEQ ID NO: 1728841 - RNA, 17 nt, Salmonella enterica enterica serovar Typhi Ty2
uaccagcagcgccagcg

SEQ ID NO: 1728842 - RNA, 19 nt, Salmonella enterica enterica serovar Typhi Ty2
uaccagaucgucacgacgg

SEQ ID NO: 1728843 - RNA, 16 nt, Salmonella enterica enterica serovar Typhi Ty2
uaccacgcagcggcau

SEQ ID NO: 1728844 - RNA, 19 nt, Salmonella enterica enterica serovar Typhi Ty2
uaccacgcacaugggcguc

SEQ ID NO: 1728845 - RNA, 17 nt, Salmonella enterica enterica serovar Typhi Ty2
uaccacaauaaucgcga

SEQ ID NO: 1728846 - RNA, 19 nt, Salmonella enterica enterica serovar Typhi Ty2
uaccgaaaucaucaaucgc

SEQ ID NO: 1728847 - RNA, 13 nt, Salmonella enterica enterica serovar Typhi Ty2
uacccucaacgcg

SEQ ID NO: 1728848 - RNA, 18 nt, Salmonella enterica enterica serovar Typhi Ty2
uacccaguaccauaccgg

SEQ ID NO: 1728849 - RNA, 20 nt, Salmonella enterica enterica serovar Typhi Ty2
uacccaggugugcggucgcu

SEQ ID NO: 1728850 - RNA, 14 nt, Salmonella enterica enterica serovar Typhi Ty2
uacccauaucgcgg

SEQ ID NO: 1728851 - RNA, 18 nt, Salmonella enterica enterica serovar Typhi Ty2
guguuguaaaacgcgccc

SEQ ID NO: 1728852 - RNA, 13 nt, Salmonella enterica enterica serovar Typhi Ty2
guguuucagcagc

SEQ ID NO: 1728853 - RNA, 17 nt, Salmonella enterica enterica serovar Typhi Ty2
guuaaccgucuggcugc

SEQ ID NO: 1728854 - RNA, 19 nt, Salmonella enterica enterica serovar Typhi Ty2
guuaacccacaacgcgcca

SEQ ID NO: 1728855 - RNA, 19 nt, Salmonella enterica enterica serovar Typhi Ty2
guuaacgcagcaucgccau

SEQ ID NO: 1728856 - RNA, 14 nt, Salmonella enterica enterica serovar Typhi Ty2
guuaacccggcauu

SEQ ID NO: 1728857 - RNA, 18 nt, Salmonella enterica enterica serovar Typhi Ty2
guuaacagaaugcugaac

SEQ ID NO: 1728858 - RNA, 20 nt, Salmonella enterica enterica serovar Typhi Ty2
guuaacaauccccgucacag

SEQ ID NO: 1728859 - RNA, 19 nt, Salmonella enterica enterica serovar Typhi Ty2
guuaauauccuucagcguu

SEQ ID NO: 1728860 - RNA, 17 nt, Salmonella enterica enterica serovar Typhi Ty2
guuaauccaaauccgca

SEQ ID NO: 1728861 - RNA, 17 nt, Salmonella enterica enterica serovar Typhi Ty2
guuaacuucuccgccau

SEQ ID NO: 1728862 - RNA, 20 nt, Salmonella enterica enterica serovar Typhi Ty2
guuaacuucuccgccaucag

SEQ ID NO: 1728863 - RNA, 22 nt, Salmonella enterica enterica serovar Typhi Ty2
guguuaucgcuaucaagcugau

SEQ ID NO: 1728864 - RNA, 19 nt, Salmonella enterica enterica serovar Typhi Ty2
guguguaccagcagcgcca

SEQ ID NO: 1728865 - RNA, 18 nt, Salmonella enterica enterica serovar Typhi Ty2
guguguucccgcgccagc

SEQ ID NO: 1728866 - RNA, 16 nt, Salmonella enterica enterica serovar Typhi Ty2
gugugcggaugcgcca

SEQ ID NO: 1728867 - RNA, 21 nt, Salmonella enterica enterica serovar Typhi Ty2
gugugccugcgcuuacggcca

SEQ ID NO: 1728868 - RNA, 19 nt, Salmonella enterica enterica serovar Typhi Ty2
gugucguuucauccugaca

SEQ ID NO: 1728869 - RNA, 19 nt, Salmonella enterica enterica serovar Typhi Ty2
guguccggguucagcgaca

SEQ ID NO: 1728870 - RNA, 13 nt, Salmonella enterica enterica serovar Typhi Ty2
gugucgaccggca

SEQ ID NO: 1728871 - RNA, 14 nt, Salmonella enterica enterica serovar Typhi Ty2
guguaccagcagcg

SEQ ID NO: 1728872 - RNA, 12 nt, Salmonella enterica enterica serovar Typhi Ty2
guguaauaaccg

SEQ ID NO: 1728873 - RNA, 13 nt, Salmonella enterica enterica serovar Typhi Ty2
gugguuuauccgc

SEQ ID NO: 1728874 - RNA, 18 nt, Salmonella enterica enterica serovar Typhi Ty2
gugcuaaaauuauacacu

SEQ ID NO: 1728875 - RNA, 13 nt, Salmonella enterica enterica serovar Typhi Ty2
gugcguucugccg

SEQ ID NO: 1728876 - RNA, 13 nt, Salmonella enterica enterica serovar Typhi Ty2
guggugccguuac

SEQ ID NO: 1728877 - RNA, 16 nt, Salmonella enterica enterica serovar Typhi Ty2
guucaucuaucgccag

SEQ ID NO: 1728878 - RNA, 15 nt, Salmonella enterica enterica serovar Typhi Ty2
guucaucuaucgcca

SEQ ID NO: 1728879 - RNA, 23 nt, Salmonella enterica enterica serovar Typhi Ty2
guucaucucuucccgucgcagca

SEQ ID NO: 1728880 - RNA, 24 nt, Salmonella enterica enterica serovar Typhi Ty2
guucauccaccgcccgcguauugc

SEQ ID NO: 1728881 - RNA, 21 nt, Salmonella enterica enterica serovar Typhi Ty2
guucauucccgccaauaacca

SEQ ID NO: 1728882 - RNA, 14 nt, Salmonella enterica enterica serovar Typhi Ty2
guucauaauccgga

SEQ ID NO: 1728883 - RNA, 19 nt, Salmonella enterica enterica serovar Typhi Ty2
guuccagcguggcgauugc

SEQ ID NO: 1728884 - RNA, 12 nt, Salmonella enterica enterica serovar Typhi Ty2
guuccagcuuga

SEQ ID NO: 1728885 - RNA, 14 nt, Salmonella enterica enterica serovar Typhi Ty2
guucaggcggcaaa

SEQ ID NO: 1728886 - RNA, 14 nt, Salmonella enterica enterica serovar Typhi Ty2
guucagggcgacga

SEQ ID NO: 1728887 - RNA, 16 nt, Salmonella enterica enterica serovar Typhi Ty2
guucagucagcgcgag

SEQ ID NO: 1728888 - RNA, 17 nt, Salmonella enterica enterica serovar Typhi Ty2
guucagcgcagagugac

SEQ ID NO: 1728889 - RNA, 20 nt, Salmonella enterica enterica serovar Typhi Ty2
guucacgccgccauccggca

SEQ ID NO: 1728890 - RNA, 21 nt, Salmonella enterica enterica serovar Typhi Ty2
guucacggccaaagcgcgacu

SEQ ID NO: 1728891 - RNA, 18 nt, Salmonella enterica enterica serovar Typhi Ty2
guucagauaggcgcgaaa

SEQ ID NO: 1728892 - RNA, 21 nt, Salmonella enterica enterica serovar Typhi Ty2
guucacgggaacggcguacca

SEQ ID NO: 1728893 - RNA, 19 nt, Salmonella enterica enterica serovar Typhi Ty2
guuaauccagagcggauaa

SEQ ID NO: 1728894 - RNA, 17 nt, Salmonella enterica enterica serovar Typhi Ty2
guuaaugccaucaucag

SEQ ID NO: 1728895 - RNA, 24 nt, Salmonella enterica enterica serovar Typhi Ty2
guuaccgggcaaacggcacuacag

SEQ ID NO: 1728896 - RNA, 19 nt, Salmonella enterica enterica serovar Typhi Ty2
guuacgcauuucaagcagg

SEQ ID NO: 1728897 - RNA, 19 nt, Salmonella enterica enterica serovar Typhi Ty2
guuagcgucauccggcaua

SEQ ID NO: 1728898 - RNA, 20 nt, Salmonella enterica enterica serovar Typhi Ty2
guuagccggaagauccuguu

SEQ ID NO: 1728899 - RNA, 14 nt, Salmonella enterica enterica serovar Typhi Ty2
guuaggcgcaaagg

SEQ ID NO: 1728900 - RNA, 15 nt, Salmonella enterica enterica serovar Typhi Ty2
guuacuggcgaccgg

SEQ ID NO: 1728901 - RNA, 22 nt, Salmonella enterica enterica serovar Typhi Ty2
guuagcacauuuuuaucaggcc

SEQ ID NO: 1728902 - RNA, 23 nt, Salmonella enterica enterica serovar Typhi Ty2
guuacgggaacagaauuaccugg

SEQ ID NO: 1728903 - RNA, 13 nt, Salmonella enterica enterica serovar Typhi Ty2
guuacgggaacag

SEQ ID NO: 1728904 - RNA, 17 nt, Salmonella enterica enterica serovar Typhi Ty2
guuauguguuucuacgc

SEQ ID NO: 1728905 - RNA, 20 nt, Salmonella enterica enterica serovar Typhi Ty2
guuaucucgccaggaaccgc

SEQ ID NO: 1728906 - RNA, 16 nt, Salmonella enterica enterica serovar Typhi Ty2
guuaucgccgaucaca

SEQ ID NO: 1728907 - RNA, 12 nt, Salmonella enterica enterica serovar Typhi Ty2
guuauacgguaa

SEQ ID NO: 1728908 - RNA, 23 nt, Salmonella enterica enterica serovar Typhi Ty2
guucaacggcaaaucgcgguaaa

SEQ ID NO: 1728909 - RNA, 22 nt, Salmonella enterica enterica serovar Typhi Ty2
guucaacggcaaaucgcgguaa

SEQ ID NO: 1728910 - RNA, 18 nt, Salmonella enterica enterica serovar Typhi Ty2
guuauuugugauuuucug

SEQ ID NO: 1728911 - RNA, 23 nt, Salmonella enterica enterica serovar Typhi Ty2
guucaaaaaugauguguuucagc

SEQ ID NO: 1728912 - RNA, 15 nt, Salmonella enterica enterica serovar Typhi Ty2
guucaaacaucagcg

SEQ ID NO: 1728913 - RNA, 15 nt, Salmonella enterica enterica serovar Typhi Ty2
guucaaaucgaugcc

SEQ ID NO: 1728914 - RNA, 23 nt, Salmonella enterica enterica serovar Typhi Ty2
guucaaugagcguccagucgggc

SEQ ID NO: 1728915 - RNA, 18 nt, Salmonella enterica enterica serovar Typhi Ty2
guuccggcggucagccag

SEQ ID NO: 1728916 - RNA, 19 nt, Salmonella enterica enterica serovar Typhi Ty2
guuccggcggucagccagc

SEQ ID NO: 1728917 - RNA, 15 nt, Salmonella enterica enterica serovar Typhi Ty2
guuccggcacgguaa

SEQ ID NO: 1728918 - RNA, 21 nt, Salmonella enterica enterica serovar Typhi Ty2
guuccgccccgccuuccgcgg

SEQ ID NO: 1728919 - RNA, 21 nt, Salmonella enterica enterica serovar Typhi Ty2
guuccucguccugauccggcu

SEQ ID NO: 1728920 - RNA, 14 nt, Salmonella enterica enterica serovar Typhi Ty2
guuccucuuacgcu

SEQ ID NO: 1728921 - RNA, 22 nt, Salmonella enterica enterica serovar Typhi Ty2
guuccauuccagaaucuggccg

SEQ ID NO: 1728922 - RNA, 15 nt, Salmonella enterica enterica serovar Typhi Ty2
guucccggcaacagu

SEQ ID NO: 1728923 - RNA, 14 nt, Salmonella enterica enterica serovar Typhi Ty2
guucccugcgcugg

SEQ ID NO: 1728924 - RNA, 19 nt, Salmonella enterica enterica serovar Typhi Ty2
guucgcauauucugcgaaa

SEQ ID NO: 1728925 - RNA, 22 nt, Salmonella enterica enterica serovar Typhi Ty2
guucgauuuuuucgacauuacc

SEQ ID NO: 1728926 - RNA, 18 nt, Salmonella enterica enterica serovar Typhi Ty2
guucgacaauguccgcca

SEQ ID NO: 1728927 - RNA, 16 nt, Salmonella enterica enterica serovar Typhi Ty2
guucuucgccguuauc

SEQ ID NO: 1728928 - RNA, 23 nt, Salmonella enterica enterica serovar Typhi Ty2
guugaccagccuaccugccgcca

SEQ ID NO: 1728929 - RNA, 19 nt, Salmonella enterica enterica serovar Typhi Ty2
guucgcgaauuucacgcag

SEQ ID NO: 1728930 - RNA, 17 nt, Salmonella enterica enterica serovar Typhi Ty2
guucgcggggguuauuc

SEQ ID NO: 1728931 - RNA, 13 nt, Salmonella enterica enterica serovar Typhi Ty2
guucgcguacgca

SEQ ID NO: 1728932 - RNA, 23 nt, Salmonella enterica enterica serovar Typhi Ty2
guucgcuuucauacgacgacggu

SEQ ID NO: 1728933 - RNA, 16 nt, Salmonella enterica enterica serovar Typhi Ty2
guugauuacucccguc

SEQ ID NO: 1728934 - RNA, 16 nt, Salmonella enterica enterica serovar Typhi Ty2
guugacgacauccgaa

SEQ ID NO: 1728935 - RNA, 23 nt, Salmonella enterica enterica serovar Typhi Ty2
guugaccguuaggaaagcaguaa

SEQ ID NO: 1728936 - RNA, 21 nt, Salmonella enterica enterica serovar Typhi Ty2
guugcguuggaagugcguuaa

SEQ ID NO: 1728937 - RNA, 11 nt, Salmonella enterica enterica serovar Typhi Ty2
guugccuucga

SEQ ID NO: 1728938 - RNA, 14 nt, Salmonella enterica enterica serovar Typhi Ty2
guuguuccagcagc

SEQ ID NO: 1728939 - RNA, 16 nt, Salmonella enterica enterica serovar Typhi Ty2
guuuaaguaagguaaa

SEQ ID NO: 1728940 - RNA, 21 nt, Salmonella enterica enterica serovar Typhi Ty2
guuuaacugaacuuccguaaa

SEQ ID NO: 1728941 - RNA, 15 nt, Salmonella enterica enterica serovar Typhi Ty2
guuguuuacacggca

SEQ ID NO: 1728942 - RNA, 19 nt, Salmonella enterica enterica serovar Typhi Ty2
guugucggcggucgcggca

SEQ ID NO: 1728943 - RNA, 15 nt, Salmonella enterica enterica serovar Typhi Ty2
guugggcagaaacgu

SEQ ID NO: 1728944 - RNA, 19 nt, Salmonella enterica enterica serovar Typhi Ty2
ucccgaucuucaucguuac

SEQ ID NO: 1728945 - RNA, 15 nt, Salmonella enterica enterica serovar Typhi Ty2
ucccgcugcggcgug

SEQ ID NO: 1728946 - RNA, 19 nt, Salmonella enterica enterica serovar Typhi Ty2
ucccggcaauuaccgccag

SEQ ID NO: 1728947 - RNA, 20 nt, Salmonella enterica enterica serovar Typhi Ty2
ucccggcaauuaccgccagc

SEQ ID NO: 1728948 - RNA, 17 nt, Salmonella enterica enterica serovar Typhi Ty2
uccccucuuccaucagc

SEQ ID NO: 1728949 - RNA, 12 nt, Salmonella enterica enterica serovar Typhi Ty2
ucccgaccaguu

SEQ ID NO: 1728950 - RNA, 20 nt, Salmonella enterica enterica serovar Typhi Ty2
ucccgaaucacuuacuaagg

SEQ ID NO: 1728951 - RNA, 18 nt, Salmonella enterica enterica serovar Typhi Ty2
ucccgacaccagccguuc

SEQ ID NO: 1728952 - RNA, 23 nt, Salmonella enterica enterica serovar Typhi Ty2
uccccgacggccucuucacgcag

SEQ ID NO: 1728953 - RNA, 23 nt, Salmonella enterica enterica serovar Typhi Ty2
uccccaucugaacucuuccagau

SEQ ID NO: 1728954 - RNA, 14 nt, Salmonella enterica enterica serovar Typhi Ty2
ucccccauccgcgc

SEQ ID NO: 1728955 - RNA, 22 nt, Salmonella enterica enterica serovar Typhi Ty2
uccccgcugucgggagccucuu

SEQ ID NO: 1728956 - RNA, 22 nt, Salmonella enterica enterica serovar Typhi Ty2
uccccgccgcugaggauggcgc

SEQ ID NO: 1728957 - RNA, 19 nt, Salmonella enterica enterica serovar Typhi Ty2
ucccacggagaaaagcgaa

SEQ ID NO: 1728958 - RNA, 17 nt, Salmonella enterica enterica serovar Typhi Ty2
ucccacugcacgccagg

SEQ ID NO: 1728959 - RNA, 16 nt, Salmonella enterica enterica serovar Typhi Ty2
ucccacugcacgccag

SEQ ID NO: 1728960 - RNA, 13 nt, Salmonella enterica enterica serovar Typhi Ty2
uccaucagccagg

SEQ ID NO: 1728961 - RNA, 19 nt, Salmonella enterica enterica serovar Typhi Ty2
uccaguuugcguucacagc

SEQ ID NO: 1728962 - RNA, 22 nt, Salmonella enterica enterica serovar Typhi Ty2
ucccacaccacacgcuuauccu

SEQ ID NO: 1728963 - RNA, 18 nt, Salmonella enterica enterica serovar Typhi Ty2
ucccacaguuaacgccaa

SEQ ID NO: 1728964 - RNA, 13 nt, Salmonella enterica enterica serovar Typhi Ty2
ucccaccacgcag

SEQ ID NO: 1728965 - RNA, 19 nt, Salmonella enterica enterica serovar Typhi Ty2
ucccaucaauaagcgaauu

SEQ ID NO: 1728966 - RNA, 14 nt, Salmonella enterica enterica serovar Typhi Ty2
ucccauguugcgcc

SEQ ID NO: 1728967 - RNA, 19 nt, Salmonella enterica enterica serovar Typhi Ty2
ucccauucacguagcggcg

SEQ ID NO: 1728968 - RNA, 15 nt, Salmonella enterica enterica serovar Typhi Ty2
uccccaccgcugaug

SEQ ID NO: 1728969 - RNA, 19 nt, Salmonella enterica enterica serovar Typhi Ty2
uccccagcuaaaaacgcca

SEQ ID NO: 1728970 - RNA, 12 nt, Salmonella enterica enterica serovar Typhi Ty2
uccgcgcugaug

SEQ ID NO: 1728971 - RNA, 15 nt, Salmonella enterica enterica serovar Typhi Ty2
uccgcgcucauacga

SEQ ID NO: 1728972 - RNA, 14 nt, Salmonella enterica enterica serovar Typhi Ty2
uccgcgcgacggua

SEQ ID NO: 1728973 - RNA, 18 nt, Salmonella enterica enterica serovar Typhi Ty2
uccgcguuuaucgcauac

SEQ ID NO: 1728974 - RNA, 18 nt, Salmonella enterica enterica serovar Typhi Ty2
uccgcuaucucuuccagc

SEQ ID NO: 1728975 - RNA, 15 nt, Salmonella enterica enterica serovar Typhi Ty2
uccggacgcaccagc

SEQ ID NO: 1728976 - RNA, 15 nt, Salmonella enterica enterica serovar Typhi Ty2
uccggccuacucuug

SEQ ID NO: 1728977 - RNA, 12 nt, Salmonella enterica enterica serovar Typhi Ty2
uccggccuacag

SEQ ID NO: 1728978 - RNA, 17 nt, Salmonella enterica enterica serovar Typhi Ty2
uccgcguuuaucgcaua

SEQ ID NO: 1728979 - RNA, 19 nt, Salmonella enterica enterica serovar Typhi Ty2
uccggcguuuuagcgccau

SEQ ID NO: 1728980 - RNA, 15 nt, Salmonella enterica enterica serovar Typhi Ty2
uccggcuaugccgga

SEQ ID NO: 1728981 - RNA, 14 nt, Salmonella enterica enterica serovar Typhi Ty2
uccggcgauagcgg

SEQ ID NO: 1728982 - RNA, 16 nt, Salmonella enterica enterica serovar Typhi Ty2
uccgcgcaauaugcgg

SEQ ID NO: 1728983 - RNA, 23 nt, Salmonella enterica enterica serovar Typhi Ty2
uccgcccaagaacaugacggcag

SEQ ID NO: 1728984 - RNA, 14 nt, Salmonella enterica enterica serovar Typhi Ty2
uccgcccacccagc

SEQ ID NO: 1728985 - RNA, 17 nt, Salmonella enterica enterica serovar Typhi Ty2
uccgccacuuccugagc

SEQ ID NO: 1728986 - RNA, 16 nt, Salmonella enterica enterica serovar Typhi Ty2
uccgccagccgccauu

SEQ ID NO: 1728987 - RNA, 22 nt, Salmonella enterica enterica serovar Typhi Ty2
uccgcaagacacgcuuccagau

SEQ ID NO: 1728988 - RNA, 19 nt, Salmonella enterica enterica serovar Typhi Ty2
uccgcaaagcccaucagcg

SEQ ID NO: 1728989 - RNA, 19 nt, Salmonella enterica enterica serovar Typhi Ty2
ucccggcuuaaauggcgcu

SEQ ID NO: 1728990 - RNA, 13 nt, Salmonella enterica enterica serovar Typhi Ty2
ucccggcuuaaau

SEQ ID NO: 1728991 - RNA, 15 nt, Salmonella enterica enterica serovar Typhi Ty2
ucccgggugcgcagc

SEQ ID NO: 1728992 - RNA, 18 nt, Salmonella enterica enterica serovar Typhi Ty2
ucccgguuaucgaacagc

SEQ ID NO: 1728993 - RNA, 16 nt, Salmonella enterica enterica serovar Typhi Ty2
uccgacaugacgucgc

SEQ ID NO: 1728994 - RNA, 20 nt, Salmonella enterica enterica serovar Typhi Ty2
uccaguucguucugcgucgc

SEQ ID NO: 1728995 - RNA, 15 nt, Salmonella enterica enterica serovar Typhi Ty2
uccaguagcagcgau

SEQ ID NO: 1728996 - RNA, 15 nt, Salmonella enterica enterica serovar Typhi Ty2
uccaguaauuucagc

SEQ ID NO: 1728997 - RNA, 22 nt, Salmonella enterica enterica serovar Typhi Ty2
uccagguuucuggcaacagcca

SEQ ID NO: 1728998 - RNA, 14 nt, Salmonella enterica enterica serovar Typhi Ty2
uccaguaacgcguc

SEQ ID NO: 1728999 - RNA, 17 nt, Salmonella enterica enterica serovar Typhi Ty2
uccagcgcucaaucagc

SEQ ID NO: 1729000 - RNA, 13 nt, Salmonella enterica enterica serovar Typhi Ty2
uccagcggcagga

SEQ ID NO: 1729001 - RNA, 13 nt, Salmonella enterica enterica serovar Typhi Ty2
uccagcagccagc

SEQ ID NO: 1729002 - RNA, 17 nt, Salmonella enterica enterica serovar Typhi Ty2
uccagcagcucaucaau

SEQ ID NO: 1729003 - RNA, 13 nt, Salmonella enterica enterica serovar Typhi Ty2
uccaaguauugau

SEQ ID NO: 1729004 - RNA, 15 nt, Salmonella enterica enterica serovar Typhi Ty2
uccaauaaacgccag

SEQ ID NO: 1729005 - RNA, 16 nt, Salmonella enterica enterica serovar Typhi Ty2
uccaaugcggcaucuc

SEQ ID NO: 1729006 - RNA, 13 nt, Salmonella enterica enterica serovar Typhi Ty2
uccacaaccggcu

SEQ ID NO: 1729007 - RNA, 18 nt, Salmonella enterica enterica serovar Typhi Ty2
ucauuguguacauccaga

SEQ ID NO: 1729008 - RNA, 23 nt, Salmonella enterica enterica serovar Typhi Ty2
ucauuaggcguaauuauuacaga

SEQ ID NO: 1729009 - RNA, 19 nt, Salmonella enterica enterica serovar Typhi Ty2
uccacgacaauauccucgc

SEQ ID NO: 1729010 - RNA, 21 nt, Salmonella enterica enterica serovar Typhi Ty2
uccaccuggcccugcaucagc

SEQ ID NO: 1729011 - RNA, 13 nt, Salmonella enterica enterica serovar Typhi Ty2
uccaccuuauccu

SEQ ID NO: 1729012 - RNA, 12 nt, Salmonella enterica enterica serovar Typhi Ty2
uccagacuacgg

SEQ ID NO: 1729013 - RNA, 20 nt, Salmonella enterica enterica serovar Typhi Ty2
uccagcacgcgcugcgccgc

SEQ ID NO: 1729014 - RNA, 18 nt, Salmonella enterica enterica serovar Typhi Ty2
uccagcacgagcgccagc

SEQ ID NO: 1729015 - RNA, 15 nt, Salmonella enterica enterica serovar Typhi Ty2
uccagauaauccagc

SEQ ID NO: 1729016 - RNA, 17 nt, Salmonella enterica enterica serovar Typhi Ty2
uccagauacauggcuau

SEQ ID NO: 1729017 - RNA, 20 nt, Salmonella enterica enterica serovar Typhi Ty2
uccagaauguuccugcaaua

SEQ ID NO: 1729018 - RNA, 14 nt, Salmonella enterica enterica serovar Typhi Ty2
uccagaccaagauc

SEQ ID NO: 1729019 - RNA, 21 nt, Salmonella enterica enterica serovar Typhi Ty2
uccagacccagacggcgauac

SEQ ID NO: 1729020 - RNA, 18 nt, Salmonella enterica enterica serovar Typhi Ty2
ucauccggguuaaaccag

SEQ ID NO: 1729021 - RNA, 21 nt, Salmonella enterica enterica serovar Typhi Ty2
ucauccggcguugcgccgcca

SEQ ID NO: 1729022 - RNA, 17 nt, Salmonella enterica enterica serovar Typhi Ty2
ucauccccagcaucaug

SEQ ID NO: 1729023 - RNA, 21 nt, Salmonella enterica enterica serovar Typhi Ty2
ucaucccgcgccaauaacgca

SEQ ID NO: 1729024 - RNA, 18 nt, Salmonella enterica enterica serovar Typhi Ty2
ucauaugugccgauggcg

SEQ ID NO: 1729025 - RNA, 14 nt, Salmonella enterica enterica serovar Typhi Ty2
ucauaugugccgau

SEQ ID NO: 1729026 - RNA, 17 nt, Salmonella enterica enterica serovar Typhi Ty2
ucaucgauuuccugaug

SEQ ID NO: 1729027 - RNA, 23 nt, Salmonella enterica enterica serovar Typhi Ty2
ucaucgaacgccgccugcgccag

SEQ ID NO: 1729028 - RNA, 23 nt, Salmonella enterica enterica serovar Typhi Ty2
ucauguugccggauagcucgcug

SEQ ID NO: 1729029 - RNA, 20 nt, Salmonella enterica enterica serovar Typhi Ty2
ucauuacgcuuccugccgug

SEQ ID NO: 1729030 - RNA, 20 nt, Salmonella enterica enterica serovar Typhi Ty2
ucaugcugcguacaaucgcg

SEQ ID NO: 1729031 - RNA, 16 nt, Salmonella enterica enterica serovar Typhi Ty2
ucaucugaugauuaau

SEQ ID NO: 1729032 - RNA, 18 nt, Salmonella enterica enterica serovar Typhi Ty2
ucaucuuuuaaaaucaga

SEQ ID NO: 1729033 - RNA, 18 nt, Salmonella enterica enterica serovar Typhi Ty2
ucaugcgccaggugacga

SEQ ID NO: 1729034 - RNA, 15 nt, Salmonella enterica enterica serovar Typhi Ty2
ucaugcggugcauga

SEQ ID NO: 1729035 - RNA, 22 nt, Salmonella enterica enterica serovar Typhi Ty2
ucaggcguagagaggcauccgc

SEQ ID NO: 1729036 - RNA, 16 nt, Salmonella enterica enterica serovar Typhi Ty2
ucaggcgucagcaugg

SEQ ID NO: 1729037 - RNA, 23 nt, Salmonella enterica enterica serovar Typhi Ty2
ucagccuugaccgccugaucguu

SEQ ID NO: 1729038 - RNA, 18 nt, Salmonella enterica enterica serovar Typhi Ty2
ucagccugugcaaccagc

SEQ ID NO: 1729039 - RNA, 17 nt, Salmonella enterica enterica serovar Typhi Ty2
ucagcgacgguccuggc

SEQ ID NO: 1729040 - RNA, 12 nt, Salmonella enterica enterica serovar Typhi Ty2
ucauaaugccca

SEQ ID NO: 1729041 - RNA, 21 nt, Salmonella enterica enterica serovar Typhi Ty2
ucaguacgcccgugacgccag

SEQ ID NO: 1729042 - RNA, 16 nt, Salmonella enterica enterica serovar Typhi Ty2
ucagguuuucuaucgc

SEQ ID NO: 1729043 - RNA, 20 nt, Salmonella enterica enterica serovar Typhi Ty2
ucauagacgcgguuaucucu

SEQ ID NO: 1729044 - RNA, 20 nt, Salmonella enterica enterica serovar Typhi Ty2
ucauagccgcuuuccgccgc

SEQ ID NO: 1729045 - RNA, 18 nt, Salmonella enterica enterica serovar Typhi Ty2
ucauagccgacccgcauc

SEQ ID NO: 1729046 - RNA, 22 nt, Salmonella enterica enterica serovar Typhi Ty2
ucauagccgacccgcaucgccg

SEQ ID NO: 1729047 - RNA, 22 nt, Salmonella enterica enterica serovar Typhi Ty2
ucauagacugcgcuuaacgcuu

SEQ ID NO: 1729048 - RNA, 14 nt, Salmonella enterica enterica serovar Typhi Ty2
ucauacaccgcauc

SEQ ID NO: 1729049 - RNA, 18 nt, Salmonella enterica enterica serovar Typhi Ty2
ucauacggauauuacgcu

SEQ ID NO: 1729050 - RNA, 22 nt, Salmonella enterica enterica serovar Typhi Ty2
ucauagcggcuaccgcguaaug

SEQ ID NO: 1729051 - RNA, 16 nt, Salmonella enterica enterica serovar Typhi Ty2
ucauagcggcuaccgc

SEQ ID NO: 1729052 - RNA, 19 nt, Salmonella enterica enterica serovar Typhi Ty2
ucauaucugcgccgccaaa

SEQ ID NO: 1729053 - RNA, 20 nt, Salmonella enterica enterica serovar Typhi Ty2
ucacccagacugugauggcg

SEQ ID NO: 1729054 - RNA, 16 nt, Salmonella enterica enterica serovar Typhi Ty2
ucaccauucccagcgc

SEQ ID NO: 1729055 - RNA, 14 nt, Salmonella enterica enterica serovar Typhi Ty2
ucaccaucuucaca

SEQ ID NO: 1729056 - RNA, 14 nt, Salmonella enterica enterica serovar Typhi Ty2
ucacccaucgccag

SEQ ID NO: 1729057 - RNA, 17 nt, Salmonella enterica enterica serovar Typhi Ty2
ucaccacgucauccggc

SEQ ID NO: 1729058 - RNA, 17 nt, Salmonella enterica enterica serovar Typhi Ty2
ucaaugccgucggcaau

SEQ ID NO: 1729059 - RNA, 22 nt, Salmonella enterica enterica serovar Typhi Ty2
ucaaugccgucggcaauuaaca

SEQ ID NO: 1729060 - RNA, 20 nt, Salmonella enterica enterica serovar Typhi Ty2
ucaauggcgucaaacagcuu

SEQ ID NO: 1729061 - RNA, 14 nt, Salmonella enterica enterica serovar Typhi Ty2
ucaauuccacaggc

SEQ ID NO: 1729062 - RNA, 22 nt, Salmonella enterica enterica serovar Typhi Ty2
ucacaaacaccaccaguaaccg

SEQ ID NO: 1729063 - RNA, 19 nt, Salmonella enterica enterica serovar Typhi Ty2
ucacaaaauggcugauaaa

SEQ ID NO: 1729064 - RNA, 13 nt, Salmonella enterica enterica serovar Typhi Ty2
ucacauguagcgc

SEQ ID NO: 1729065 - RNA, 22 nt, Salmonella enterica enterica serovar Typhi Ty2
ucacaucguaaaucagcgugau

SEQ ID NO: 1729066 - RNA, 21 nt, Salmonella enterica enterica serovar Typhi Ty2
ucacacugcgccgccagcgac

SEQ ID NO: 1729067 - RNA, 18 nt, Salmonella enterica enterica serovar Typhi Ty2
ucacacuacacgaauacc

SEQ ID NO: 1729068 - RNA, 18 nt, Salmonella enterica enterica serovar Typhi Ty2
ucacgccgauaaugcguu

SEQ ID NO: 1729069 - RNA, 13 nt, Salmonella enterica enterica serovar Typhi Ty2
ucaccgucggacu

SEQ ID NO: 1729070 - RNA, 18 nt, Salmonella enterica enterica serovar Typhi Ty2
ucaccguggcaaaaucca

SEQ ID NO: 1729071 - RNA, 20 nt, Salmonella enterica enterica serovar Typhi Ty2
ucagaauacagaauccggcg

SEQ ID NO: 1729072 - RNA, 16 nt, Salmonella enterica enterica serovar Typhi Ty2
ucagaaccugcgauac

SEQ ID NO: 1729073 - RNA, 15 nt, Salmonella enterica enterica serovar Typhi Ty2
ucagaacugauaguu

SEQ ID NO: 1729074 - RNA, 23 nt, Salmonella enterica enterica serovar Typhi Ty2
ucagaaacaacacaaaucgggcg

SEQ ID NO: 1729075 - RNA, 15 nt, Salmonella enterica enterica serovar Typhi Ty2
ucacuuuuaccggcg

SEQ ID NO: 1729076 - RNA, 19 nt, Salmonella enterica enterica serovar Typhi Ty2
ucagaaccucaucccggcu

SEQ ID NO: 1729077 - RNA, 22 nt, Salmonella enterica enterica serovar Typhi Ty2
ucacuaggcguuagaauaacgu

SEQ ID NO: 1729078 - RNA, 15 nt, Salmonella enterica enterica serovar Typhi Ty2
ucacuaacgcggcau

SEQ ID NO: 1729079 - RNA, 19 nt, Salmonella enterica enterica serovar Typhi Ty2
ucacguuuugcagcgccau

SEQ ID NO: 1729080 - RNA, 23 nt, Salmonella enterica enterica serovar Typhi Ty2
ucagcauuacccccgccauaaug

SEQ ID NO: 1729081 - RNA, 16 nt, Salmonella enterica enterica serovar Typhi Ty2
ucagcagcgaauagcg

SEQ ID NO: 1729082 - RNA, 15 nt, Salmonella enterica enterica serovar Typhi Ty2
ucagcaccuccagcg

SEQ ID NO: 1729083 - RNA, 14 nt, Salmonella enterica enterica serovar Typhi Ty2
ucagcaccuccagc

SEQ ID NO: 1729084 - RNA, 19 nt, Salmonella enterica enterica serovar Typhi Ty2
ucagauugaucaucaccga

SEQ ID NO: 1729085 - RNA, 15 nt, Salmonella enterica enterica serovar Typhi Ty2
ucagauauuccagcg

SEQ ID NO: 1729086 - RNA, 18 nt, Salmonella enterica enterica serovar Typhi Ty2
ucagauccaacgcggaaa

SEQ ID NO: 1729087 - RNA, 24 nt, Salmonella enterica enterica serovar Typhi Ty2
ucagacuuuggauaaagccaaugg

SEQ ID NO: 1729088 - RNA, 20 nt, Salmonella enterica enterica serovar Typhi Ty2
ucagauaaagcuucugcgcc

SEQ ID NO: 1729089 - RNA, 24 nt, Salmonella enterica enterica serovar Typhi Ty2
ucaaugcccaggcgccgcucauca

SEQ ID NO: 1729090 - RNA, 15 nt, Salmonella enterica enterica serovar Typhi Ty2
ucaaugcacgccaca

SEQ ID NO: 1729091 - RNA, 15 nt, Salmonella enterica enterica serovar Typhi Ty2
ucaaucgugguuggc

SEQ ID NO: 1729092 - RNA, 13 nt, Salmonella enterica enterica serovar Typhi Ty2
ucaauauccugcg

SEQ ID NO: 1729093 - RNA, 16 nt, Salmonella enterica enterica serovar Typhi Ty2
ucaauauuaucguaau

SEQ ID NO: 1729094 - RNA, 15 nt, Salmonella enterica enterica serovar Typhi Ty2
ucaauacgcauaaug

SEQ ID NO: 1729095 - RNA, 14 nt, Salmonella enterica enterica serovar Typhi Ty2
ucaauaaccgccag

SEQ ID NO: 1729096 - RNA, 16 nt, Salmonella enterica enterica serovar Typhi Ty2
ucaagcuuugcguaaa

SEQ ID NO: 1729097 - RNA, 23 nt, Salmonella enterica enterica serovar Typhi Ty2
ucaagcgguuugaaaauggcguu

SEQ ID NO: 1729098 - RNA, 17 nt, Salmonella enterica enterica serovar Typhi Ty2
ucaagcgauacgucagc

SEQ ID NO: 1729099 - RNA, 23 nt, Salmonella enterica enterica serovar Typhi Ty2
ucaagccguuuuggcagcgcccg

SEQ ID NO: 1729100 - RNA, 18 nt, Salmonella enterica enterica serovar Typhi Ty2
ucaacgcggcuaccgaag

SEQ ID NO: 1729101 - RNA, 21 nt, Salmonella enterica enterica serovar Typhi Ty2
ucaaacuccccugucguuaau

SEQ ID NO: 1729102 - RNA, 16 nt, Salmonella enterica enterica serovar Typhi Ty2
ucaaagaccuccgccc

SEQ ID NO: 1729103 - RNA, 18 nt, Salmonella enterica enterica serovar Typhi Ty2
ucaaagccacacugcauc

SEQ ID NO: 1729104 - RNA, 16 nt, Salmonella enterica enterica serovar Typhi Ty2
ucaaacacgaccagcg

SEQ ID NO: 1729105 - RNA, 16 nt, Salmonella enterica enterica serovar Typhi Ty2
ucaaaaucaucgccac

SEQ ID NO: 1729106 - RNA, 21 nt, Salmonella enterica enterica serovar Typhi Ty2
ucaaaaugaucagaccaucgg

SEQ ID NO: 1729107 - RNA, 13 nt, Salmonella enterica enterica serovar Typhi Ty2
ucaaaccacgcug

SEQ ID NO: 1729108 - RNA, 23 nt, Salmonella enterica enterica serovar Typhi Ty2
ucaaacaggcggcuguugguuua

SEQ ID NO: 1729109 - RNA, 17 nt, Salmonella enterica enterica serovar Typhi Ty2
ucaacaaauuccggcac

SEQ ID NO: 1729110 - RNA, 14 nt, Salmonella enterica enterica serovar Typhi Ty2
ucaacaaucguuaa

SEQ ID NO: 1729111 - RNA, 19 nt, Salmonella enterica enterica serovar Typhi Ty2
ucaaccacaaguuuaucca

SEQ ID NO: 1729112 - RNA, 22 nt, Salmonella enterica enterica serovar Typhi Ty2
ucaaccagccgaucaucacgaa

SEQ ID NO: 1729113 - RNA, 15 nt, Salmonella enterica enterica serovar Typhi Ty2
ucaacaucaucggau

SEQ ID NO: 1729114 - RNA, 23 nt, Salmonella enterica enterica serovar Typhi Ty2
ucaacauacgccgccagccacug

SEQ ID NO: 1729115 - RNA, 21 nt, Salmonella enterica enterica serovar Typhi Ty2
ucaacaucagcgcuaccagcg

SEQ ID NO: 1729116 - RNA, 18 nt, Salmonella enterica enterica serovar Typhi Ty2
ucaacacuuagaacgcgg

SEQ ID NO: 1729117 - RNA, 20 nt, Salmonella enterica enterica serovar Typhi Ty2
ucaacgcaggcuggagagcg

SEQ ID NO: 1729118 - RNA, 15 nt, Salmonella enterica enterica serovar Typhi Ty2
ucaacgcaggcugga

SEQ ID NO: 1729119 - RNA, 17 nt, Salmonella enterica enterica serovar Typhi Ty2
ucaaccugcgaaaagcg

SEQ ID NO: 1729120 - RNA, 16 nt, Salmonella enterica enterica serovar Typhi Ty2
ucaacccgcuaccgca

SEQ ID NO: 1729121 - RNA, 15 nt, Salmonella enterica enterica serovar Typhi Ty2
uauuuaccgccgcuu

SEQ ID NO: 1729122 - RNA, 21 nt, Salmonella enterica enterica serovar Typhi Ty2
uauugccgccauuauucugaa

SEQ ID NO: 1729123 - RNA, 14 nt, Salmonella enterica enterica serovar Typhi Ty2
uauuuuucaccuca

SEQ ID NO: 1729124 - RNA, 19 nt, Salmonella enterica enterica serovar Typhi Ty2
ucaaaaaaucgacucacgg

SEQ ID NO: 1729125 - RNA, 21 nt, Salmonella enterica enterica serovar Typhi Ty2
ucaaaacagaaccccaucgcc

SEQ ID NO: 1729126 - RNA, 11 nt, Salmonella enterica enterica serovar Typhi Ty2
ucaaaacaggu

SEQ ID NO: 1729127 - RNA, 16 nt, Salmonella enterica enterica serovar Typhi Ty2
uauuacaugccguuaa

SEQ ID NO: 1729128 - RNA, 16 nt, Salmonella enterica enterica serovar Typhi Ty2
uauuaccgcaucgacc

SEQ ID NO: 1729129 - RNA, 16 nt, Salmonella enterica enterica serovar Typhi Ty2
uauuacaagcaguuaa

SEQ ID NO: 1729130 - RNA, 19 nt, Salmonella enterica enterica serovar Typhi Ty2
uaugcgcaugggcauaauc

SEQ ID NO: 1729131 - RNA, 20 nt, Salmonella enterica enterica serovar Typhi Ty2
uaugccggaugacgcuaacg

SEQ ID NO: 1729132 - RNA, 12 nt, Salmonella enterica enterica serovar Typhi Ty2
uaugcgccaacu

SEQ ID NO: 1729133 - RNA, 15 nt, Salmonella enterica enterica serovar Typhi Ty2
uaugcgcauagauau

SEQ ID NO: 1729134 - RNA, 23 nt, Salmonella enterica enterica serovar Typhi Ty2
uaugcgccugguugacccgcauu

SEQ ID NO: 1729135 - RNA, 19 nt, Salmonella enterica enterica serovar Typhi Ty2
uaugcggcuaauacgccag

SEQ ID NO: 1729136 - RNA, 18 nt, Salmonella enterica enterica serovar Typhi Ty2
uauuagccaaagcgguaa

SEQ ID NO: 1729137 - RNA, 12 nt, Salmonella enterica enterica serovar Typhi Ty2
uauuagcgguac

SEQ ID NO: 1729138 - RNA, 20 nt, Salmonella enterica enterica serovar Typhi Ty2
uauuaucgccaucauagccc

SEQ ID NO: 1729139 - RNA, 14 nt, Salmonella enterica enterica serovar Typhi Ty2
uauugcauggcaau

SEQ ID NO: 1729140 - RNA, 21 nt, Salmonella enterica enterica serovar Typhi Ty2
uauugauaagcgucagcgugc

SEQ ID NO: 1729141 - RNA, 17 nt, Salmonella enterica enterica serovar Typhi Ty2
uauccuggccugauaag

SEQ ID NO: 1729142 - RNA, 17 nt, Salmonella enterica enterica serovar Typhi Ty2
uagcgccagcagcauaa

SEQ ID NO: 1729143 - RNA, 14 nt, Salmonella enterica enterica serovar Typhi Ty2
uagcgccaucaggc

SEQ ID NO: 1729144 - RNA, 22 nt, Salmonella enterica enterica serovar Typhi Ty2
uaucgauggcagucgcaucaug

SEQ ID NO: 1729145 - RNA, 17 nt, Salmonella enterica enterica serovar Typhi Ty2
uaucgcaguagccaugc

SEQ ID NO: 1729146 - RNA, 13 nt, Salmonella enterica enterica serovar Typhi Ty2
uaucgagauaaug

SEQ ID NO: 1729147 - RNA, 13 nt, Salmonella enterica enterica serovar Typhi Ty2
uaucgagcggcag

SEQ ID NO: 1729148 - RNA, 14 nt, Salmonella enterica enterica serovar Typhi Ty2
uaucgacgcagaca

SEQ ID NO: 1729149 - RNA, 15 nt, Salmonella enterica enterica serovar Typhi Ty2
uaucgccuggagcug

SEQ ID NO: 1729150 - RNA, 14 nt, Salmonella enterica enterica serovar Typhi Ty2
uaucgcggauaagc

SEQ ID NO: 1729151 - RNA, 21 nt, Salmonella enterica enterica serovar Typhi Ty2
uaucgccgcccguuuccgcua

SEQ ID NO: 1729152 - RNA, 15 nt, Salmonella enterica enterica serovar Typhi Ty2
uaucgcccagauggc

SEQ ID NO: 1729153 - RNA, 23 nt, Salmonella enterica enterica serovar Typhi Ty2
uaucgcugucggucagauucaga

SEQ ID NO: 1729154 - RNA, 17 nt, Salmonella enterica enterica serovar Typhi Ty2
uaucgcuuuaaucaguu

SEQ ID NO: 1729155 - RNA, 23 nt, Salmonella enterica enterica serovar Typhi Ty2
uaucugccgcgcccgccaucgcc

SEQ ID NO: 1729156 - RNA, 23 nt, Salmonella enterica enterica serovar Typhi Ty2
uaucuuccggugugaccagcgcg

SEQ ID NO: 1729157 - RNA, 14 nt, Salmonella enterica enterica serovar Typhi Ty2
uaucuuccagcgcg

SEQ ID NO: 1729158 - RNA, 12 nt, Salmonella enterica enterica serovar Typhi Ty2
uaucuugcuuua

SEQ ID NO: 1729159 - RNA, 20 nt, Salmonella enterica enterica serovar Typhi Ty2
uaugcacaggcggcgguuca

SEQ ID NO: 1729160 - RNA, 14 nt, Salmonella enterica enterica serovar Typhi Ty2
uaugcagcagccag

SEQ ID NO: 1729161 - RNA, 14 nt, Salmonella enterica enterica serovar Typhi Ty2
uaugcaaaacguag

SEQ ID NO: 1729162 - RNA, 22 nt, Salmonella enterica enterica serovar Typhi Ty2
uaugccugauggcgcuacgcuu

SEQ ID NO: 1729163 - RNA, 15 nt, Salmonella enterica enterica serovar Typhi Ty2
uaugcaguucaucau

SEQ ID NO: 1729164 - RNA, 18 nt, Salmonella enterica enterica serovar Typhi Ty2
ugaagaaguucuucuggc

SEQ ID NO: 1729165 - RNA, 13 nt, Salmonella enterica enterica serovar Typhi Ty2
ugaauaaauccuu

SEQ ID NO: 1729166 - RNA, 16 nt, Salmonella enterica enterica serovar Typhi Ty2
ugaauaaucucugcga

SEQ ID NO: 1729167 - RNA, 18 nt, Salmonella enterica enterica serovar Typhi Ty2
ugaauugauuagcuuuaa

SEQ ID NO: 1729168 - RNA, 20 nt, Salmonella enterica enterica serovar Typhi Ty2
ugaaugcucucauauuccag

SEQ ID NO: 1729169 - RNA, 14 nt, Salmonella enterica enterica serovar Typhi Ty2
ugacaaugacgcaa

SEQ ID NO: 1729170 - RNA, 16 nt, Salmonella enterica enterica serovar Typhi Ty2
ugaauugcaaggcgac

SEQ ID NO: 1729171 - RNA, 16 nt, Salmonella enterica enterica serovar Typhi Ty2
ugaauaccaaagcccg

SEQ ID NO: 1729172 - RNA, 15 nt, Salmonella enterica enterica serovar Typhi Ty2
ugaauccaggccaga

SEQ ID NO: 1729173 - RNA, 22 nt, Salmonella enterica enterica serovar Typhi Ty2
ugaaucccuguucaaaagccug

SEQ ID NO: 1729174 - RNA, 18 nt, Salmonella enterica enterica serovar Typhi Ty2
ugaaucguagcgugcgca

SEQ ID NO: 1729175 - RNA, 16 nt, Salmonella enterica enterica serovar Typhi Ty2
ugaaugccggauggcg

SEQ ID NO: 1729176 - RNA, 12 nt, Salmonella enterica enterica serovar Typhi Ty2
ugaaagcgcaaa

SEQ ID NO: 1729177 - RNA, 21 nt, Salmonella enterica enterica serovar Typhi Ty2
ugaaacucgccaugccaucgg

SEQ ID NO: 1729178 - RNA, 22 nt, Salmonella enterica enterica serovar Typhi Ty2
ucuuugcuuuguaaagcgccau

SEQ ID NO: 1729179 - RNA, 18 nt, Salmonella enterica enterica serovar Typhi Ty2
ugaaacgccguuuguuua

SEQ ID NO: 1729180 - RNA, 15 nt, Salmonella enterica enterica serovar Typhi Ty2
ucuccaguaucagcg

SEQ ID NO: 1729181 - RNA, 14 nt, Salmonella enterica enterica serovar Typhi Ty2
ucuccaguaucagc

SEQ ID NO: 1729182 - RNA, 17 nt, Salmonella enterica enterica serovar Typhi Ty2
ucuuucaauaauggcgc

SEQ ID NO: 1729183 - RNA, 19 nt, Salmonella enterica enterica serovar Typhi Ty2
ucucccucuaauucccagu

SEQ ID NO: 1729184 - RNA, 14 nt, Salmonella enterica enterica serovar Typhi Ty2
ugaacgaagcauuu

SEQ ID NO: 1729185 - RNA, 15 nt, Salmonella enterica enterica serovar Typhi Ty2
ugaaaucgucgccaa

SEQ ID NO: 1729186 - RNA, 14 nt, Salmonella enterica enterica serovar Typhi Ty2
ugaaaucgguaauc

SEQ ID NO: 1729187 - RNA, 15 nt, Salmonella enterica enterica serovar Typhi Ty2
ugaccacggcgucaa

SEQ ID NO: 1729188 - RNA, 16 nt, Salmonella enterica enterica serovar Typhi Ty2
ugaccagcaucgccgg

SEQ ID NO: 1729189 - RNA, 16 nt, Salmonella enterica enterica serovar Typhi Ty2
ugaccaugcauauaag

SEQ ID NO: 1729190 - RNA, 18 nt, Salmonella enterica enterica serovar Typhi Ty2
ugacagcaucgauuccgc

SEQ ID NO: 1729191 - RNA, 20 nt, Salmonella enterica enterica serovar Typhi Ty2
ugacaauaagauuugcggca

SEQ ID NO: 1729192 - RNA, 22 nt, Salmonella enterica enterica serovar Typhi Ty2
ugacacccucuuucgccauuga

SEQ ID NO: 1729193 - RNA, 20 nt, Salmonella enterica enterica serovar Typhi Ty2
ugaccaagcgucagcauggu

SEQ ID NO: 1729194 - RNA, 14 nt, Salmonella enterica enterica serovar Typhi Ty2
ugaccaccgcaucg

SEQ ID NO: 1729195 - RNA, 17 nt, Salmonella enterica enterica serovar Typhi Ty2
ugacauuacccggccag

SEQ ID NO: 1729196 - RNA, 17 nt, Salmonella enterica enterica serovar Typhi Ty2
ugacgaaaagauaacgg

SEQ ID NO: 1729197 - RNA, 18 nt, Salmonella enterica enterica serovar Typhi Ty2
ugacgacuaccgccgaua

SEQ ID NO: 1729198 - RNA, 22 nt, Salmonella enterica enterica serovar Typhi Ty2
ugaccgccccguaucauuaggc

SEQ ID NO: 1729199 - RNA, 20 nt, Salmonella enterica enterica serovar Typhi Ty2
ugaucuucauaaauagccag

SEQ ID NO: 1729200 - RNA, 20 nt, Salmonella enterica enterica serovar Typhi Ty2
ugaugcgcguuuagcgccag

SEQ ID NO: 1729201 - RNA, 13 nt, Salmonella enterica enterica serovar Typhi Ty2
ugaucugcgcaac

SEQ ID NO: 1729202 - RNA, 17 nt, Salmonella enterica enterica serovar Typhi Ty2
ugaucgccaaagcguaa

SEQ ID NO: 1729203 - RNA, 17 nt, Salmonella enterica enterica serovar Typhi Ty2
ugaucgcuggugcccgg

SEQ ID NO: 1729204 - RNA, 21 nt, Salmonella enterica enterica serovar Typhi Ty2
ugaucgaaaaugcgcaugaug

SEQ ID NO: 1729205 - RNA, 19 nt, Salmonella enterica enterica serovar Typhi Ty2
ugauccuguaacgcauaag

SEQ ID NO: 1729206 - RNA, 18 nt, Salmonella enterica enterica serovar Typhi Ty2
ugauccaccaccagcauc

SEQ ID NO: 1729207 - RNA, 22 nt, Salmonella enterica enterica serovar Typhi Ty2
ugauaaaacauuccaucgccau

SEQ ID NO: 1729208 - RNA, 18 nt, Salmonella enterica enterica serovar Typhi Ty2
ugauaaaaaacaguacgg

SEQ ID NO: 1729209 - RNA, 17 nt, Salmonella enterica enterica serovar Typhi Ty2
ugaguuugucauccaga

SEQ ID NO: 1729210 - RNA, 16 nt, Salmonella enterica enterica serovar Typhi Ty2
ugaguuuuccgccauu

SEQ ID NO: 1729211 - RNA, 22 nt, Salmonella enterica enterica serovar Typhi Ty2
ugauaaacgcaaugucaucagg

SEQ ID NO: 1729212 - RNA, 14 nt, Salmonella enterica enterica serovar Typhi Ty2
ugauaaaggccggc

SEQ ID NO: 1729213 - RNA, 20 nt, Salmonella enterica enterica serovar Typhi Ty2
ugcaauuguuccugcgucgg

SEQ ID NO: 1729214 - RNA, 17 nt, Salmonella enterica enterica serovar Typhi Ty2
ugcacaauacgccgagc

SEQ ID NO: 1729215 - RNA, 13 nt, Salmonella enterica enterica serovar Typhi Ty2
ugcaaucacacua

SEQ ID NO: 1729216 - RNA, 20 nt, Salmonella enterica enterica serovar Typhi Ty2
ugcaaguugcaagucaccau

SEQ ID NO: 1729217 - RNA, 17 nt, Salmonella enterica enterica serovar Typhi Ty2
ugcaacugcgcggcaau

SEQ ID NO: 1729218 - RNA, 14 nt, Salmonella enterica enterica serovar Typhi Ty2
ugauuacagccggu

SEQ ID NO: 1729219 - RNA, 13 nt, Salmonella enterica enterica serovar Typhi Ty2
ugauuaaagccac

SEQ ID NO: 1729220 - RNA, 20 nt, Salmonella enterica enterica serovar Typhi Ty2
ugaugcuguaggccggguaa

SEQ ID NO: 1729221 - RNA, 23 nt, Salmonella enterica enterica serovar Typhi Ty2
ugaugcugguuuuagcuuauccc

SEQ ID NO: 1729222 - RNA, 18 nt, Salmonella enterica enterica serovar Typhi Ty2
ugaugcguauccagcgcg

SEQ ID NO: 1729223 - RNA, 20 nt, Salmonella enterica enterica serovar Typhi Ty2
ugcaaaucugccgucaucga

SEQ ID NO: 1729224 - RNA, 17 nt, Salmonella enterica enterica serovar Typhi Ty2
ugacgggcgaucgacua

SEQ ID NO: 1729225 - RNA, 22 nt, Salmonella enterica enterica serovar Typhi Ty2
ugacgguggccgccagcgcggu

SEQ ID NO: 1729226 - RNA, 19 nt, Salmonella enterica enterica serovar Typhi Ty2
ugacgcuaacgcuuauccg

SEQ ID NO: 1729227 - RNA, 16 nt, Salmonella enterica enterica serovar Typhi Ty2
ugacgcugaugaaaac

SEQ ID NO: 1729228 - RNA, 23 nt, Salmonella enterica enterica serovar Typhi Ty2
ugacgaucaacagaccgacgaug

SEQ ID NO: 1729229 - RNA, 15 nt, Salmonella enterica enterica serovar Typhi Ty2
ugacgccaugcaaaa

SEQ ID NO: 1729230 - RNA, 13 nt, Salmonella enterica enterica serovar Typhi Ty2
ugacuucaucaaa

SEQ ID NO: 1729231 - RNA, 21 nt, Salmonella enterica enterica serovar Typhi Ty2
ugagcauuacgucggaacgcg

SEQ ID NO: 1729232 - RNA, 18 nt, Salmonella enterica enterica serovar Typhi Ty2
ugacucaugaaccuggcg

SEQ ID NO: 1729233 - RNA, 18 nt, Salmonella enterica enterica serovar Typhi Ty2
ugacucagcggccauuga

SEQ ID NO: 1729234 - RNA, 22 nt, Salmonella enterica enterica serovar Typhi Ty2
ugagcguuagcgccauccggca

SEQ ID NO: 1729235 - RNA, 14 nt, Salmonella enterica enterica serovar Typhi Ty2
ugagcucauccagc

SEQ ID NO: 1729236 - RNA, 16 nt, Salmonella enterica enterica serovar Typhi Ty2
ugagcgucaggccauc

SEQ ID NO: 1729237 - RNA, 13 nt, Salmonella enterica enterica serovar Typhi Ty2
ugagcgucaucgg

SEQ ID NO: 1729238 - RNA, 18 nt, Salmonella enterica enterica serovar Typhi Ty2
ugagcgcuugcugcguaa

SEQ ID NO: 1729239 - RNA, 17 nt, Salmonella enterica enterica serovar Typhi Ty2
ugagcugacugacguga

SEQ ID NO: 1729240 - RNA, 18 nt, Salmonella enterica enterica serovar Typhi Ty2
ugcgacaacaaugaaacg

SEQ ID NO: 1729241 - RNA, 13 nt, Salmonella enterica enterica serovar Typhi Ty2
ugcgaaucuucau

SEQ ID NO: 1729242 - RNA, 21 nt, Salmonella enterica enterica serovar Typhi Ty2
ugccuggcaacaugaccagcg

SEQ ID NO: 1729243 - RNA, 23 nt, Salmonella enterica enterica serovar Typhi Ty2
ugccuggauaauaagacgccagu

SEQ ID NO: 1729244 - RNA, 22 nt, Salmonella enterica enterica serovar Typhi Ty2
ugcgacgcgcucaccuccgcca

SEQ ID NO: 1729245 - RNA, 19 nt, Salmonella enterica enterica serovar Typhi Ty2
ugcgaucucauaccaggug

SEQ ID NO: 1729246 - RNA, 18 nt, Salmonella enterica enterica serovar Typhi Ty2
ugcgcauccucuuuccgu

SEQ ID NO: 1729247 - RNA, 17 nt, Salmonella enterica enterica serovar Typhi Ty2
ugcgccagccuuauccc

SEQ ID NO: 1729248 - RNA, 21 nt, Salmonella enterica enterica serovar Typhi Ty2
ugccgggcauaaacuaauccc

SEQ ID NO: 1729249 - RNA, 22 nt, Salmonella enterica enterica serovar Typhi Ty2
ugccggcuaauaguuagccuga

SEQ ID NO: 1729250 - RNA, 17 nt, Salmonella enterica enterica serovar Typhi Ty2
ugccugauuucccaguu

SEQ ID NO: 1729251 - RNA, 22 nt, Salmonella enterica enterica serovar Typhi Ty2
ugccugauggcgcuacgcuuau

SEQ ID NO: 1729252 - RNA, 14 nt, Salmonella enterica enterica serovar Typhi Ty2
ugccugaucgccac

SEQ ID NO: 1729253 - RNA, 15 nt, Salmonella enterica enterica serovar Typhi Ty2
ugccugacgccugaa

SEQ ID NO: 1729254 - RNA, 22 nt, Salmonella enterica enterica serovar Typhi Ty2
ugccucgucuugauuucaggug

SEQ ID NO: 1729255 - RNA, 19 nt, Salmonella enterica enterica serovar Typhi Ty2
ugcgcggcaauuuccgcug

SEQ ID NO: 1729256 - RNA, 16 nt, Salmonella enterica enterica serovar Typhi Ty2
ugcgccuguugacgcg

SEQ ID NO: 1729257 - RNA, 23 nt, Salmonella enterica enterica serovar Typhi Ty2
ugcgccuguuagggcgcggcugg

SEQ ID NO: 1729258 - RNA, 20 nt, Salmonella enterica enterica serovar Typhi Ty2
ugcgccuuauccggcgugua

SEQ ID NO: 1729259 - RNA, 20 nt, Salmonella enterica enterica serovar Typhi Ty2
ugcgccugaagauacgccag

SEQ ID NO: 1729260 - RNA, 16 nt, Salmonella enterica enterica serovar Typhi Ty2
ugcgccugucuccagc

SEQ ID NO: 1729261 - RNA, 23 nt, Salmonella enterica enterica serovar Typhi Ty2
ugcgccgccauccggccuguaag

SEQ ID NO: 1729262 - RNA, 18 nt, Salmonella enterica enterica serovar Typhi Ty2
ugcgccgccauccggcga

SEQ ID NO: 1729263 - RNA, 15 nt, Salmonella enterica enterica serovar Typhi Ty2
ugcggccauccugcg

SEQ ID NO: 1729264 - RNA, 21 nt, Salmonella enterica enterica serovar Typhi Ty2
ugcggccaugaucgccgccau

SEQ ID NO: 1729265 - RNA, 16 nt, Salmonella enterica enterica serovar Typhi Ty2
ugcggcaucgaacggg

SEQ ID NO: 1729266 - RNA, 16 nt, Salmonella enterica enterica serovar Typhi Ty2
ugcggauuacgaauac

SEQ ID NO: 1729267 - RNA, 17 nt, Salmonella enterica enterica serovar Typhi Ty2
ugcggauaguccugcgc

SEQ ID NO: 1729268 - RNA, 16 nt, Salmonella enterica enterica serovar Typhi Ty2
ugcccagcgcaaucac

SEQ ID NO: 1729269 - RNA, 21 nt, Salmonella enterica enterica serovar Typhi Ty2
ugcccaacaucaguucagaaa

SEQ ID NO: 1729270 - RNA, 11 nt, Salmonella enterica enterica serovar Typhi Ty2
ugcccagguua

SEQ ID NO: 1729271 - RNA, 23 nt, Salmonella enterica enterica serovar Typhi Ty2
ugcccaucgcgccaugauucauc

SEQ ID NO: 1729272 - RNA, 18 nt, Salmonella enterica enterica serovar Typhi Ty2
ugcccaucgcaacgccgg

SEQ ID NO: 1729273 - RNA, 16 nt, Salmonella enterica enterica serovar Typhi Ty2
ugcauagccccagcgc

SEQ ID NO: 1729274 - RNA, 22 nt, Salmonella enterica enterica serovar Typhi Ty2
ugcauaaugguggaaugcccca

SEQ ID NO: 1729275 - RNA, 22 nt, Salmonella enterica enterica serovar Typhi Ty2
ugcaucuccagcguggcaguga

SEQ ID NO: 1729276 - RNA, 20 nt, Salmonella enterica enterica serovar Typhi Ty2
ugcauacguuucaccagcac

SEQ ID NO: 1729277 - RNA, 15 nt, Salmonella enterica enterica serovar Typhi Ty2
ugcauaaauaucugc

SEQ ID NO: 1729278 - RNA, 15 nt, Salmonella enterica enterica serovar Typhi Ty2
ugcaugagcacgcgg

SEQ ID NO: 1729279 - RNA, 15 nt, Salmonella enterica enterica serovar Typhi Ty2
ugccgacuggcguga

SEQ ID NO: 1729280 - RNA, 13 nt, Salmonella enterica enterica serovar Typhi Ty2
ugccgacgccagc

SEQ ID NO: 1729281 - RNA, 22 nt, Salmonella enterica enterica serovar Typhi Ty2
ugccgcaaacgccgaagccagc

SEQ ID NO: 1729282 - RNA, 20 nt, Salmonella enterica enterica serovar Typhi Ty2
ugccgauuccaugcccaguu

SEQ ID NO: 1729283 - RNA, 18 nt, Salmonella enterica enterica serovar Typhi Ty2
ugccgccgacaaccagcg

SEQ ID NO: 1729284 - RNA, 22 nt, Salmonella enterica enterica serovar Typhi Ty2
ugccgccuccagcauacugaug

SEQ ID NO: 1729285 - RNA, 20 nt, Salmonella enterica enterica serovar Typhi Ty2
ugccgccguucucauugcug

SEQ ID NO: 1729286 - RNA, 20 nt, Salmonella enterica enterica serovar Typhi Ty2
ugccgccgguugggcagaaa

SEQ ID NO: 1729287 - RNA, 23 nt, Salmonella enterica enterica serovar Typhi Ty2
ugccggaaagacggcagcgccau

SEQ ID NO: 1729288 - RNA, 15 nt, Salmonella enterica enterica serovar Typhi Ty2
ugccggacugauacc

SEQ ID NO: 1729289 - RNA, 20 nt, Salmonella enterica enterica serovar Typhi Ty2
ugccggacgcggcuuauccg

SEQ ID NO: 1729290 - RNA, 24 nt, Salmonella enterica enterica serovar Typhi Ty2
ugccggauucacuuucgacgacaa

SEQ ID NO: 1729291 - RNA, 20 nt, Salmonella enterica enterica serovar Typhi Ty2
ucgcaaacccacccgguaau

SEQ ID NO: 1729292 - RNA, 18 nt, Salmonella enterica enterica serovar Typhi Ty2
ucgauuuuucaucuucag

SEQ ID NO: 1729293 - RNA, 15 nt, Salmonella enterica enterica serovar Typhi Ty2
ucgauccccaacgac

SEQ ID NO: 1729294 - RNA, 12 nt, Salmonella enterica enterica serovar Typhi Ty2
ucgaucgucggg

SEQ ID NO: 1729295 - RNA, 17 nt, Salmonella enterica enterica serovar Typhi Ty2
ucgaugauauccagcac

SEQ ID NO: 1729296 - RNA, 21 nt, Salmonella enterica enterica serovar Typhi Ty2
ucgaucucggccacguccguu

SEQ ID NO: 1729297 - RNA, 15 nt, Salmonella enterica enterica serovar Typhi Ty2
ucgaucuucuccaga

SEQ ID NO: 1729298 - RNA, 16 nt, Salmonella enterica enterica serovar Typhi Ty2
ucgauaaccaccagcg

SEQ ID NO: 1729299 - RNA, 16 nt, Salmonella enterica enterica serovar Typhi Ty2
ucgauaagccagcgau

SEQ ID NO: 1729300 - RNA, 15 nt, Salmonella enterica enterica serovar Typhi Ty2
ucgauaaucccggcg

SEQ ID NO: 1729301 - RNA, 19 nt, Salmonella enterica enterica serovar Typhi Ty2
ucgagugucaauaagccag

SEQ ID NO: 1729302 - RNA, 16 nt, Salmonella enterica enterica serovar Typhi Ty2
ucgauagcgccgcauc

SEQ ID NO: 1729303 - RNA, 13 nt, Salmonella enterica enterica serovar Typhi Ty2
ucgauagcaggca

SEQ ID NO: 1729304 - RNA, 17 nt, Salmonella enterica enterica serovar Typhi Ty2
ucgauauacuccgcgac

SEQ ID NO: 1729305 - RNA, 19 nt, Salmonella enterica enterica serovar Typhi Ty2
ucgauagcgccgcaucgau

SEQ ID NO: 1729306 - RNA, 19 nt, Salmonella enterica enterica serovar Typhi Ty2
ucgaucacccacaucagcg

SEQ ID NO: 1729307 - RNA, 21 nt, Salmonella enterica enterica serovar Typhi Ty2
ucgauaugaccaguacaggcg

SEQ ID NO: 1729308 - RNA, 13 nt, Salmonella enterica enterica serovar Typhi Ty2
ucgaucagcauau

SEQ ID NO: 1729309 - RNA, 18 nt, Salmonella enterica enterica serovar Typhi Ty2
ucgaggauaaucacggcg

SEQ ID NO: 1729310 - RNA, 22 nt, Salmonella enterica enterica serovar Typhi Ty2
ucgacgucaacgguaaaauggc

SEQ ID NO: 1729311 - RNA, 14 nt, Salmonella enterica enterica serovar Typhi Ty2
ucgacucauccagc

SEQ ID NO: 1729312 - RNA, 17 nt, Salmonella enterica enterica serovar Typhi Ty2
ucgacguuguccggcga

SEQ ID NO: 1729313 - RNA, 19 nt, Salmonella enterica enterica serovar Typhi Ty2
ucgagauuuuucugcgcca

SEQ ID NO: 1729314 - RNA, 19 nt, Salmonella enterica enterica serovar Typhi Ty2
ucgccaccgcuacaaucca

SEQ ID NO: 1729315 - RNA, 22 nt, Salmonella enterica enterica serovar Typhi Ty2
ucgccagaugucggcggcaggu

SEQ ID NO: 1729316 - RNA, 21 nt, Salmonella enterica enterica serovar Typhi Ty2
ucgccaaaacccagaaucagu

SEQ ID NO: 1729317 - RNA, 13 nt, Salmonella enterica enterica serovar Typhi Ty2
ucgccaccaggcu

SEQ ID NO: 1729318 - RNA, 14 nt, Salmonella enterica enterica serovar Typhi Ty2
ucgccaccaccagc

SEQ ID NO: 1729319 - RNA, 17 nt, Salmonella enterica enterica serovar Typhi Ty2
ucgcauuuaaucgccug

SEQ ID NO: 1729320 - RNA, 14 nt, Salmonella enterica enterica serovar Typhi Ty2
ucgccgccauccgg

SEQ ID NO: 1729321 - RNA, 15 nt, Salmonella enterica enterica serovar Typhi Ty2
ucgccgccauccggc

SEQ ID NO: 1729322 - RNA, 18 nt, Salmonella enterica enterica serovar Typhi Ty2
ucgccgccaaagcgcccg

SEQ ID NO: 1729323 - RNA, 21 nt, Salmonella enterica enterica serovar Typhi Ty2
ucgccagcgucucagcaggcg

SEQ ID NO: 1729324 - RNA, 21 nt, Salmonella enterica enterica serovar Typhi Ty2
ucgccagcaacgcccagauau

SEQ ID NO: 1729325 - RNA, 22 nt, Salmonella enterica enterica serovar Typhi Ty2
ucgccagcgcaucgauauaagc

SEQ ID NO: 1729326 - RNA, 14 nt, Salmonella enterica enterica serovar Typhi Ty2
ucgccccagcauau

SEQ ID NO: 1729327 - RNA, 22 nt, Salmonella enterica enterica serovar Typhi Ty2
ucgccguuaacuggcgcaucug

SEQ ID NO: 1729328 - RNA, 19 nt, Salmonella enterica enterica serovar Typhi Ty2
ucgccgucguucagccagc

SEQ ID NO: 1729329 - RNA, 19 nt, Salmonella enterica enterica serovar Typhi Ty2
ucgccgccgccgcgaccgc

SEQ ID NO: 1729330 - RNA, 20 nt, Salmonella enterica enterica serovar Typhi Ty2
ucgccggcagacgauagcgg

SEQ ID NO: 1729331 - RNA, 13 nt, Salmonella enterica enterica serovar Typhi Ty2
ucgcgcugcgcag

SEQ ID NO: 1729332 - RNA, 21 nt, Salmonella enterica enterica serovar Typhi Ty2
ucgcgccggucgccagcauau

SEQ ID NO: 1729333 - RNA, 16 nt, Salmonella enterica enterica serovar Typhi Ty2
ucgccugucugucgcg

SEQ ID NO: 1729334 - RNA, 21 nt, Salmonella enterica enterica serovar Typhi Ty2
ucgccuggagcugaucgaccc

SEQ ID NO: 1729335 - RNA, 23 nt, Salmonella enterica enterica serovar Typhi Ty2
ucgcgauuuucaucaagccauug

SEQ ID NO: 1729336 - RNA, 20 nt, Salmonella enterica enterica serovar Typhi Ty2
ucguggacgagcauaccgua

SEQ ID NO: 1729337 - RNA, 14 nt, Salmonella enterica enterica serovar Typhi Ty2
ucguuuccagcgaa

SEQ ID NO: 1729338 - RNA, 22 nt, Salmonella enterica enterica serovar Typhi Ty2
ucguuugcgcgcacguugggca

SEQ ID NO: 1729339 - RNA, 24 nt, Salmonella enterica enterica serovar Typhi Ty2
ucguuguccacuguucguccauaa

SEQ ID NO: 1729340 - RNA, 12 nt, Salmonella enterica enterica serovar Typhi Ty2
ucucauccagcu

SEQ ID NO: 1729341 - RNA, 20 nt, Salmonella enterica enterica serovar Typhi Ty2
ucucauaccaggugccgagg

SEQ ID NO: 1729342 - RNA, 16 nt, Salmonella enterica enterica serovar Typhi Ty2
ucucaugcaacuggca

SEQ ID NO: 1729343 - RNA, 14 nt, Salmonella enterica enterica serovar Typhi Ty2
ucuaucaccgccuc

SEQ ID NO: 1729344 - RNA, 19 nt, Salmonella enterica enterica serovar Typhi Ty2
ucuaucagguaucccgcca

SEQ ID NO: 1729345 - RNA, 22 nt, Salmonella enterica enterica serovar Typhi Ty2
ucgugaaucaucaucauccgcg

SEQ ID NO: 1729346 - RNA, 20 nt, Salmonella enterica enterica serovar Typhi Ty2
ucgucuuccggauaacgcgc

SEQ ID NO: 1729347 - RNA, 13 nt, Salmonella enterica enterica serovar Typhi Ty2
ucgucuucggcga

SEQ ID NO: 1729348 - RNA, 16 nt, Salmonella enterica enterica serovar Typhi Ty2
ucgucgggauaagcga

SEQ ID NO: 1729349 - RNA, 16 nt, Salmonella enterica enterica serovar Typhi Ty2
ucguccuguagccgug

SEQ ID NO: 1729350 - RNA, 21 nt, Salmonella enterica enterica serovar Typhi Ty2
ucggguucacuuuaccaggca

SEQ ID NO: 1729351 - RNA, 15 nt, Salmonella enterica enterica serovar Typhi Ty2
ucgguaaugggcgau

SEQ ID NO: 1729352 - RNA, 20 nt, Salmonella enterica enterica serovar Typhi Ty2
ucgguaagucugauaacggc

SEQ ID NO: 1729353 - RNA, 22 nt, Salmonella enterica enterica serovar Typhi Ty2
ucggucaucagggcguaagcgc

SEQ ID NO: 1729354 - RNA, 19 nt, Salmonella enterica enterica serovar Typhi Ty2
ucgguaguguuaucgccga

SEQ ID NO: 1729355 - RNA, 17 nt, Salmonella enterica enterica serovar Typhi Ty2
ucgguggaaaccgcaga

SEQ ID NO: 1729356 - RNA, 21 nt, Salmonella enterica enterica serovar Typhi Ty2
ucguagcgaauaaucccggcg

SEQ ID NO: 1729357 - RNA, 23 nt, Salmonella enterica enterica serovar Typhi Ty2
ucgguuucgcggcguucauggca

SEQ ID NO: 1729358 - RNA, 15 nt, Salmonella enterica enterica serovar Typhi Ty2
ucgucaggcggcugc

SEQ ID NO: 1729359 - RNA, 18 nt, Salmonella enterica enterica serovar Typhi Ty2
ucgucaggcggcugcgca

SEQ ID NO: 1729360 - RNA, 23 nt, Salmonella enterica enterica serovar Typhi Ty2
ucgucaccuguagggucgccgcg

SEQ ID NO: 1729361 - RNA, 18 nt, Salmonella enterica enterica serovar Typhi Ty2
ucguauccggucaauaca

SEQ ID NO: 1729362 - RNA, 15 nt, Salmonella enterica enterica serovar Typhi Ty2
ucggccagcgccagc

SEQ ID NO: 1729363 - RNA, 20 nt, Salmonella enterica enterica serovar Typhi Ty2
ucggccagcgaaaaccagcg

SEQ ID NO: 1729364 - RNA, 21 nt, Salmonella enterica enterica serovar Typhi Ty2
ucggcaucgggauuuacaacc

SEQ ID NO: 1729365 - RNA, 21 nt, Salmonella enterica enterica serovar Typhi Ty2
ucggcauacaccgccagcguc

SEQ ID NO: 1729366 - RNA, 21 nt, Salmonella enterica enterica serovar Typhi Ty2
ucggagguuuucucauccagc

SEQ ID NO: 1729367 - RNA, 15 nt, Salmonella enterica enterica serovar Typhi Ty2
ucgcuacugcaucug

SEQ ID NO: 1729368 - RNA, 12 nt, Salmonella enterica enterica serovar Typhi Ty2
ucgcuaccuucu

SEQ ID NO: 1729369 - RNA, 13 nt, Salmonella enterica enterica serovar Typhi Ty2
ucgcgcuuauccg

SEQ ID NO: 1729370 - RNA, 18 nt, Salmonella enterica enterica serovar Typhi Ty2
ucgcucaggagcgccuga

SEQ ID NO: 1729371 - RNA, 16 nt, Salmonella enterica enterica serovar Typhi Ty2
ucgcucaacuccugca

SEQ ID NO: 1729372 - RNA, 13 nt, Salmonella enterica enterica serovar Typhi Ty2
ucgcuauccagca

SEQ ID NO: 1729373 - RNA, 17 nt, Salmonella enterica enterica serovar Typhi Ty2
ucgcuauauugcugcgc

SEQ ID NO: 1729374 - RNA, 15 nt, Salmonella enterica enterica serovar Typhi Ty2
ucgcuauccaucgcc

SEQ ID NO: 1729375 - RNA, 14 nt, Salmonella enterica enterica serovar Typhi Ty2
ucgcucaucaggcg

SEQ ID NO: 1729376 - RNA, 20 nt, Salmonella enterica enterica serovar Typhi Ty2
ucggcgacuggaacaggcca

SEQ ID NO: 1729377 - RNA, 13 nt, Salmonella enterica enterica serovar Typhi Ty2
ucggcgauauagc

SEQ ID NO: 1729378 - RNA, 12 nt, Salmonella enterica enterica serovar Typhi Ty2
ucggcgcgcugg

SEQ ID NO: 1729379 - RNA, 22 nt, Salmonella enterica enterica serovar Typhi Ty2
ucggcgcaaccauuaccgcuaa

SEQ ID NO: 1729380 - RNA, 18 nt, Salmonella enterica enterica serovar Typhi Ty2
ucggcgucugcgcgcugg

SEQ ID NO: 1729381 - RNA, 22 nt, Salmonella enterica enterica serovar Typhi Ty2
ucggcggcccacucauccagca

SEQ ID NO: 1729382 - RNA, 19 nt, Salmonella enterica enterica serovar Typhi Ty2
ucgggagcagugauuaugc

SEQ ID NO: 1729383 - RNA, 23 nt, Salmonella enterica enterica serovar Typhi Ty2
ucgggauugccgccgcgcuggug

SEQ ID NO: 1729384 - RNA, 20 nt, Salmonella enterica enterica serovar Typhi Ty2
ucgggaugguuaaauucaua

SEQ ID NO: 1729385 - RNA, 18 nt, Salmonella enterica enterica serovar Typhi Ty2
ucgggcaaaaugcgucgg

SEQ ID NO: 1729386 - RNA, 20 nt, Salmonella enterica enterica serovar Typhi Ty2
ucgggauguggugcggcuua

SEQ ID NO: 1729387 - RNA, 14 nt, Salmonella enterica enterica serovar Typhi Ty2
ucggcuuuaucgcc

SEQ ID NO: 1729388 - RNA, 21 nt, Salmonella enterica enterica serovar Typhi Ty2
ucgggacaaucaccaucccau

SEQ ID NO: 1729389 - RNA, 19 nt, Salmonella enterica enterica serovar Typhi Ty2
gcuucccacagucggcgaa

SEQ ID NO: 1729390 - RNA, 20 nt, Salmonella enterica enterica serovar Typhi Ty2
gcuucgauuuuguuaugcgc

SEQ ID NO: 1729391 - RNA, 13 nt, Salmonella enterica enterica serovar Typhi Ty2
gcuucuauccacu

SEQ ID NO: 1729392 - RNA, 17 nt, Salmonella enterica enterica serovar Typhi Ty2
gcuucguuucagauaac

SEQ ID NO: 1729393 - RNA, 22 nt, Salmonella enterica enterica serovar Typhi Ty2
gcuucgucgagcagugauucgc

SEQ ID NO: 1729394 - RNA, 16 nt, Salmonella enterica enterica serovar Typhi Ty2
gcuucguucuguauca

SEQ ID NO: 1729395 - RNA, 20 nt, Salmonella enterica enterica serovar Typhi Ty2
gcuucugcaaaauuagcgac

SEQ ID NO: 1729396 - RNA, 21 nt, Salmonella enterica enterica serovar Typhi Ty2
gcuucguaaaacucaugaccg

SEQ ID NO: 1729397 - RNA, 21 nt, Salmonella enterica enterica serovar Typhi Ty2
gcuuccagaauucguacguuu

SEQ ID NO: 1729398 - RNA, 19 nt, Salmonella enterica enterica serovar Typhi Ty2
gcuucaauaagaaacugcu

SEQ ID NO: 1729399 - RNA, 17 nt, Salmonella enterica enterica serovar Typhi Ty2
gcuuauccggccuacgg

SEQ ID NO: 1729400 - RNA, 17 nt, Salmonella enterica enterica serovar Typhi Ty2
gcuuauccggccuacga

SEQ ID NO: 1729401 - RNA, 16 nt, Salmonella enterica enterica serovar Typhi Ty2
gcuuauccggccuacg

SEQ ID NO: 1729402 - RNA, 17 nt, Salmonella enterica enterica serovar Typhi Ty2
gcuuauccggccuacag

SEQ ID NO: 1729403 - RNA, 15 nt, Salmonella enterica enterica serovar Typhi Ty2
gcuuauccggccuac

SEQ ID NO: 1729404 - RNA, 12 nt, Salmonella enterica enterica serovar Typhi Ty2
gcuuauccggcc

SEQ ID NO: 1729405 - RNA, 15 nt, Salmonella enterica enterica serovar Typhi Ty2
gcuuaucgauaucug

SEQ ID NO: 1729406 - RNA, 20 nt, Salmonella enterica enterica serovar Typhi Ty2
gcuuaucgauaucugccugc

SEQ ID NO: 1729407 - RNA, 18 nt, Salmonella enterica enterica serovar Typhi Ty2
gcuuauccggccugcaca

SEQ ID NO: 1729408 - RNA, 14 nt, Salmonella enterica enterica serovar Typhi Ty2
gcuuaucaggccua

SEQ ID NO: 1729409 - RNA, 17 nt, Salmonella enterica enterica serovar Typhi Ty2
gcuuaucaggccuacau

SEQ ID NO: 1729410 - RNA, 23 nt, Salmonella enterica enterica serovar Typhi Ty2
gcuuaucaggccuacauccggcu

SEQ ID NO: 1729411 - RNA, 17 nt, Salmonella enterica enterica serovar Typhi Ty2
gcuuaucaggccuacgc

SEQ ID NO: 1729412 - RNA, 20 nt, Salmonella enterica enterica serovar Typhi Ty2
gcuuaucaggccuacgcucg

SEQ ID NO: 1729413 - RNA, 16 nt, Salmonella enterica enterica serovar Typhi Ty2
gcuuaaaagcggcaag

SEQ ID NO: 1729414 - RNA, 16 nt, Salmonella enterica enterica serovar Typhi Ty2
gcuguuuuucaucauc

SEQ ID NO: 1729415 - RNA, 15 nt, Salmonella enterica enterica serovar Typhi Ty2
gcuguuuuuacgcca

SEQ ID NO: 1729416 - RNA, 19 nt, Salmonella enterica enterica serovar Typhi Ty2
gcuuaaaucgcggcgcuga

SEQ ID NO: 1729417 - RNA, 18 nt, Salmonella enterica enterica serovar Typhi Ty2
gcuuaaagccaauccaga

SEQ ID NO: 1729418 - RNA, 17 nt, Salmonella enterica enterica serovar Typhi Ty2
gcuuaaagggauuauca

SEQ ID NO: 1729419 - RNA, 14 nt, Salmonella enterica enterica serovar Typhi Ty2
gcuuaaugcccggc

SEQ ID NO: 1729420 - RNA, 21 nt, Salmonella enterica enterica serovar Typhi Ty2
gcuuaauaauaagcggccuau

SEQ ID NO: 1729421 - RNA, 20 nt, Salmonella enterica enterica serovar Typhi Ty2
gcuuaauaauaagcggccua

SEQ ID NO: 1729422 - RNA, 17 nt, Salmonella enterica enterica serovar Typhi Ty2
gcuuaccgggccuacag

SEQ ID NO: 1729423 - RNA, 14 nt, Salmonella enterica enterica serovar Typhi Ty2
gcuuaccaggccua

SEQ ID NO: 1729424 - RNA, 14 nt, Salmonella enterica enterica serovar Typhi Ty2
gcuuaccagaccgg

SEQ ID NO: 1729425 - RNA, 13 nt, Salmonella enterica enterica serovar Typhi Ty2
gcuuacaggcacg

SEQ ID NO: 1729426 - RNA, 15 nt, Salmonella enterica enterica serovar Typhi Ty2
gcuggcuggcguuga

SEQ ID NO: 1729427 - RNA, 20 nt, Salmonella enterica enterica serovar Typhi Ty2
gcugggaaacuuaucaguaa

SEQ ID NO: 1729428 - RNA, 22 nt, Salmonella enterica enterica serovar Typhi Ty2
gcugguauaggccaggcuauag

SEQ ID NO: 1729429 - RNA, 15 nt, Salmonella enterica enterica serovar Typhi Ty2
gcuggucagcgcaau

SEQ ID NO: 1729430 - RNA, 17 nt, Salmonella enterica enterica serovar Typhi Ty2
gcuggguuaacgcgcca

SEQ ID NO: 1729431 - RNA, 12 nt, Salmonella enterica enterica serovar Typhi Ty2
gcuggcggcaag

SEQ ID NO: 1729432 - RNA, 19 nt, Salmonella enterica enterica serovar Typhi Ty2
gcugguuaacgccgccauc

SEQ ID NO: 1729433 - RNA, 21 nt, Salmonella enterica enterica serovar Typhi Ty2
gcugguguaauugcgccaggc

SEQ ID NO: 1729434 - RNA, 21 nt, Salmonella enterica enterica serovar Typhi Ty2
gcugguggugccgacgccagc

SEQ ID NO: 1729435 - RNA, 22 nt, Salmonella enterica enterica serovar Typhi Ty2
gcugguuccccgugcccggcau

SEQ ID NO: 1729436 - RNA, 22 nt, Salmonella enterica enterica serovar Typhi Ty2
gcugguuaauaauuuuacccgc

SEQ ID NO: 1729437 - RNA, 14 nt, Salmonella enterica enterica serovar Typhi Ty2
gcugguuauuccgc

SEQ ID NO: 1729438 - RNA, 15 nt, Salmonella enterica enterica serovar Typhi Ty2
gcugguuauuccgcu

SEQ ID NO: 1729439 - RNA, 15 nt, Salmonella enterica enterica serovar Typhi Ty2
gcugguggccuucgg

SEQ ID NO: 1729440 - RNA, 19 nt, Salmonella enterica enterica serovar Typhi Ty2
gcuguaacccgccgccauc

SEQ ID NO: 1729441 - RNA, 15 nt, Salmonella enterica enterica serovar Typhi Ty2
gcuguaaaccggccc

SEQ ID NO: 1729442 - RNA, 23 nt, Salmonella enterica enterica serovar Typhi Ty2
gcuguaauuaaggauugccgccu

SEQ ID NO: 1729443 - RNA, 21 nt, Salmonella enterica enterica serovar Typhi Ty2
gcuguuaauuugcaucaggcc

SEQ ID NO: 1729444 - RNA, 16 nt, Salmonella enterica enterica serovar Typhi Ty2
gcugugguuuauccgc

SEQ ID NO: 1729445 - RNA, 18 nt, Salmonella enterica enterica serovar Typhi Ty2
gcugugggcgugucgccg

SEQ ID NO: 1729446 - RNA, 22 nt, Salmonella enterica enterica serovar Typhi Ty2
gcugugguugcccgcaggcuuc

SEQ ID NO: 1729447 - RNA, 20 nt, Salmonella enterica enterica serovar Typhi Ty2
gcuguucaaucacugaugcc

SEQ ID NO: 1729448 - RNA, 18 nt, Salmonella enterica enterica serovar Typhi Ty2
gcuguuacugucggcgau

SEQ ID NO: 1729449 - RNA, 20 nt, Salmonella enterica enterica serovar Typhi Ty2
gcuguuccugcgggaacaga

SEQ ID NO: 1729450 - RNA, 16 nt, Salmonella enterica enterica serovar Typhi Ty2
gcuguuccuucagaaa

SEQ ID NO: 1729451 - RNA, 18 nt, Salmonella enterica enterica serovar Typhi Ty2
ggaaaauauucagcacau

SEQ ID NO: 1729452 - RNA, 18 nt, Salmonella enterica enterica serovar Typhi Ty2
gcuuuggcaaacggcgcc

SEQ ID NO: 1729453 - RNA, 17 nt, Salmonella enterica enterica serovar Typhi Ty2
gcuuugcgauagcccgg

SEQ ID NO: 1729454 - RNA, 18 nt, Salmonella enterica enterica serovar Typhi Ty2
gcuuugcuuauccggccu

SEQ ID NO: 1729455 - RNA, 11 nt, Salmonella enterica enterica serovar Typhi Ty2
gcuuugagcgu

SEQ ID NO: 1729456 - RNA, 22 nt, Salmonella enterica enterica serovar Typhi Ty2
ggaaagacggcagcgccauccg

SEQ ID NO: 1729457 - RNA, 16 nt, Salmonella enterica enterica serovar Typhi Ty2
ggaaacuccagcggca

SEQ ID NO: 1729458 - RNA, 19 nt, Salmonella enterica enterica serovar Typhi Ty2
ggaaacuauccuggccuga

SEQ ID NO: 1729459 - RNA, 14 nt, Salmonella enterica enterica serovar Typhi Ty2
ggaaagggacgaug

SEQ ID NO: 1729460 - RNA, 19 nt, Salmonella enterica enterica serovar Typhi Ty2
gcuuguucuuuucaauaaa

SEQ ID NO: 1729461 - RNA, 20 nt, Salmonella enterica enterica serovar Typhi Ty2
gcuuguuguuuauccugcaa

SEQ ID NO: 1729462 - RNA, 16 nt, Salmonella enterica enterica serovar Typhi Ty2
gcuucuuguucacgug

SEQ ID NO: 1729463 - RNA, 22 nt, Salmonella enterica enterica serovar Typhi Ty2
gcuucuucacuaauuugaugcc

SEQ ID NO: 1729464 - RNA, 13 nt, Salmonella enterica enterica serovar Typhi Ty2
gcuuuaagcgcug

SEQ ID NO: 1729465 - RNA, 23 nt, Salmonella enterica enterica serovar Typhi Ty2
gcuuuacgaccgcagaaacagau

SEQ ID NO: 1729466 - RNA, 17 nt, Salmonella enterica enterica serovar Typhi Ty2
gcuuucuucuucacgac

SEQ ID NO: 1729467 - RNA, 19 nt, Salmonella enterica enterica serovar Typhi Ty2
ggaacuggcagcagugaca

SEQ ID NO: 1729468 - RNA, 16 nt, Salmonella enterica enterica serovar Typhi Ty2
ggaacugggugccgug

SEQ ID NO: 1729469 - RNA, 20 nt, Salmonella enterica enterica serovar Typhi Ty2
ggaacaucagccagcagcuc

SEQ ID NO: 1729470 - RNA, 15 nt, Salmonella enterica enterica serovar Typhi Ty2
ggaacagggccgcau

SEQ ID NO: 1729471 - RNA, 17 nt, Salmonella enterica enterica serovar Typhi Ty2
ggaacagauacuggaag

SEQ ID NO: 1729472 - RNA, 23 nt, Salmonella enterica enterica serovar Typhi Ty2
ggaaaucaaaccaucccagguua

SEQ ID NO: 1729473 - RNA, 22 nt, Salmonella enterica enterica serovar Typhi Ty2
ggaaagucuuaccuguauuaug

SEQ ID NO: 1729474 - RNA, 14 nt, Salmonella enterica enterica serovar Typhi Ty2
ggaaauaccauccg

SEQ ID NO: 1729475 - RNA, 21 nt, Salmonella enterica enterica serovar Typhi Ty2
ggaaauggcgaacagcccgcu

SEQ ID NO: 1729476 - RNA, 18 nt, Salmonella enterica enterica serovar Typhi Ty2
ggaagauguugccguaac

SEQ ID NO: 1729477 - RNA, 18 nt, Salmonella enterica enterica serovar Typhi Ty2
ggaagcgaccggcgucau

SEQ ID NO: 1729478 - RNA, 22 nt, Salmonella enterica enterica serovar Typhi Ty2
ggaagucggaaaucuguuccag

SEQ ID NO: 1729479 - RNA, 13 nt, Salmonella enterica enterica serovar Typhi Ty2
ggaauaccgucaa

SEQ ID NO: 1729480 - RNA, 19 nt, Salmonella enterica enterica serovar Typhi Ty2
ggacgcaagagcguccagu

SEQ ID NO: 1729481 - RNA, 23 nt, Salmonella enterica enterica serovar Typhi Ty2
ggaccggcagcgucggcuucauc

SEQ ID NO: 1729482 - RNA, 13 nt, Salmonella enterica enterica serovar Typhi Ty2
ggaauauccgcgc

SEQ ID NO: 1729483 - RNA, 21 nt, Salmonella enterica enterica serovar Typhi Ty2
ggaauaagcgauacucucgca

SEQ ID NO: 1729484 - RNA, 17 nt, Salmonella enterica enterica serovar Typhi Ty2
ggaauucccacaucgcg

SEQ ID NO: 1729485 - RNA, 21 nt, Salmonella enterica enterica serovar Typhi Ty2
ggacaucggcacgcgaucgcg

SEQ ID NO: 1729486 - RNA, 19 nt, Salmonella enterica enterica serovar Typhi Ty2
ggacauaaacgccucaucc

SEQ ID NO: 1729487 - RNA, 17 nt, Salmonella enterica enterica serovar Typhi Ty2
ggacgucaugccgccac

SEQ ID NO: 1729488 - RNA, 13 nt, Salmonella enterica enterica serovar Typhi Ty2
ggacgucaugccg

SEQ ID NO: 1729489 - RNA, 22 nt, Salmonella enterica enterica serovar Typhi Ty2
ggacguagggcugccaucaggc

SEQ ID NO: 1729490 - RNA, 12 nt, Salmonella enterica enterica serovar Typhi Ty2
ggacucaggccu

SEQ ID NO: 1729491 - RNA, 13 nt, Salmonella enterica enterica serovar Typhi Ty2
ggacugauacagc

SEQ ID NO: 1729492 - RNA, 14 nt, Salmonella enterica enterica serovar Typhi Ty2
ggagaacggcacaa

SEQ ID NO: 1729493 - RNA, 21 nt, Salmonella enterica enterica serovar Typhi Ty2
ggagaaaacgcggccuggaag

SEQ ID NO: 1729494 - RNA, 20 nt, Salmonella enterica enterica serovar Typhi Ty2
ggacuuuaucuuuaccaggg

SEQ ID NO: 1729495 - RNA, 21 nt, Salmonella enterica enterica serovar Typhi Ty2
gcugcuauguaaaauccggca

SEQ ID NO: 1729496 - RNA, 14 nt, Salmonella enterica enterica serovar Typhi Ty2
gcugcgucagcgcu

SEQ ID NO: 1729497 - RNA, 19 nt, Salmonella enterica enterica serovar Typhi Ty2
gcugcgguuuacgccaugc

SEQ ID NO: 1729498 - RNA, 17 nt, Salmonella enterica enterica serovar Typhi Ty2
gcugcgcuuauccgcuc

SEQ ID NO: 1729499 - RNA, 16 nt, Salmonella enterica enterica serovar Typhi Ty2
gcugcgcuuauccggc

SEQ ID NO: 1729500 - RNA, 17 nt, Salmonella enterica enterica serovar Typhi Ty2
gcugcgcuuaucaggcc

SEQ ID NO: 1729501 - RNA, 12 nt, Salmonella enterica enterica serovar Typhi Ty2
gcugcgccagau

SEQ ID NO: 1729502 - RNA, 18 nt, Salmonella enterica enterica serovar Typhi Ty2
gcugcgccuuauccggcg

SEQ ID NO: 1729503 - RNA, 17 nt, Salmonella enterica enterica serovar Typhi Ty2
gcugcgccuuauccggc

SEQ ID NO: 1729504 - RNA, 18 nt, Salmonella enterica enterica serovar Typhi Ty2
gcugccagcugcgucagc

SEQ ID NO: 1729505 - RNA, 14 nt, Salmonella enterica enterica serovar Typhi Ty2
gcugccugccggau

SEQ ID NO: 1729506 - RNA, 20 nt, Salmonella enterica enterica serovar Typhi Ty2
gcugcgaagccaccggauug

SEQ ID NO: 1729507 - RNA, 21 nt, Salmonella enterica enterica serovar Typhi Ty2
gcugaccgcuuucccggcaug

SEQ ID NO: 1729508 - RNA, 16 nt, Salmonella enterica enterica serovar Typhi Ty2
gcugacgaucaugccg

SEQ ID NO: 1729509 - RNA, 22 nt, Salmonella enterica enterica serovar Typhi Ty2
gcugagcaaaaccagacgccga

SEQ ID NO: 1729510 - RNA, 16 nt, Salmonella enterica enterica serovar Typhi Ty2
gcugaucaaugcgcaa

SEQ ID NO: 1729511 - RNA, 17 nt, Salmonella enterica enterica serovar Typhi Ty2
gcugaucgugauaggcc

SEQ ID NO: 1729512 - RNA, 22 nt, Salmonella enterica enterica serovar Typhi Ty2
gcugauacuuauuacgguauca

SEQ ID NO: 1729513 - RNA, 14 nt, Salmonella enterica enterica serovar Typhi Ty2
gcugauacgcacca

SEQ ID NO: 1729514 - RNA, 19 nt, Salmonella enterica enterica serovar Typhi Ty2
gcugcacaaaauacuguuu

SEQ ID NO: 1729515 - RNA, 16 nt, Salmonella enterica enterica serovar Typhi Ty2
gcugcacaaaauacug

SEQ ID NO: 1729516 - RNA, 20 nt, Salmonella enterica enterica serovar Typhi Ty2
gcugcaauagcagaucgcgc

SEQ ID NO: 1729517 - RNA, 20 nt, Salmonella enterica enterica serovar Typhi Ty2
gcugaugugauuaaacgcaa

SEQ ID NO: 1729518 - RNA, 17 nt, Salmonella enterica enterica serovar Typhi Ty2
gcugaaauuuccgcuuc

SEQ ID NO: 1729519 - RNA, 19 nt, Salmonella enterica enterica serovar Typhi Ty2
gcugacaaagguugcgcca

SEQ ID NO: 1729520 - RNA, 23 nt, Salmonella enterica enterica serovar Typhi Ty2
gcugacaacacauccgcagcgaa

SEQ ID NO: 1729521 - RNA, 14 nt, Salmonella enterica enterica serovar Typhi Ty2
gcugacacucaucc

SEQ ID NO: 1729522 - RNA, 18 nt, Salmonella enterica enterica serovar Typhi Ty2
gcugacacucauccagac

SEQ ID NO: 1729523 - RNA, 16 nt, Salmonella enterica enterica serovar Typhi Ty2
gcugaccgaaccgcug

SEQ ID NO: 1729524 - RNA, 20 nt, Salmonella enterica enterica serovar Typhi Ty2
gcugaccacgccgccgcguc

SEQ ID NO: 1729525 - RNA, 14 nt, Salmonella enterica enterica serovar Typhi Ty2
gcucgucggcggaa

SEQ ID NO: 1729526 - RNA, 21 nt, Salmonella enterica enterica serovar Typhi Ty2
gcucgcuguagcgccaaccgg

SEQ ID NO: 1729527 - RNA, 22 nt, Salmonella enterica enterica serovar Typhi Ty2
gcucgcuuuuacucuuccugcu

SEQ ID NO: 1729528 - RNA, 17 nt, Salmonella enterica enterica serovar Typhi Ty2
gcucggccaucuggcgu

SEQ ID NO: 1729529 - RNA, 21 nt, Salmonella enterica enterica serovar Typhi Ty2
gcucgcgacgcagacccgcaa

SEQ ID NO: 1729530 - RNA, 23 nt, Salmonella enterica enterica serovar Typhi Ty2
gcucgcgauccucauacagcccg

SEQ ID NO: 1729531 - RNA, 21 nt, Salmonella enterica enterica serovar Typhi Ty2
gcucgcccagaauuuccuucg

SEQ ID NO: 1729532 - RNA, 16 nt, Salmonella enterica enterica serovar Typhi Ty2
gcucgcccaucacuac

SEQ ID NO: 1729533 - RNA, 15 nt, Salmonella enterica enterica serovar Typhi Ty2
gcucgcaccguaggc

SEQ ID NO: 1729534 - RNA, 13 nt, Salmonella enterica enterica serovar Typhi Ty2
gcuacacgcgaau

SEQ ID NO: 1729535 - RNA, 22 nt, Salmonella enterica enterica serovar Typhi Ty2
gcuacauccgccagccgccauu

SEQ ID NO: 1729536 - RNA, 20 nt, Salmonella enterica enterica serovar Typhi Ty2
gcuaaugcuuauccggccua

SEQ ID NO: 1729537 - RNA, 21 nt, Salmonella enterica enterica serovar Typhi Ty2
gcuaaugcccggcgcggcauc

SEQ ID NO: 1729538 - RNA, 17 nt, Salmonella enterica enterica serovar Typhi Ty2
gcuaauaguuagccuga

SEQ ID NO: 1729539 - RNA, 18 nt, Salmonella enterica enterica serovar Typhi Ty2
gcuccugcuccugcggcg

SEQ ID NO: 1729540 - RNA, 15 nt, Salmonella enterica enterica serovar Typhi Ty2
gcuccugcgccggac

SEQ ID NO: 1729541 - RNA, 17 nt, Salmonella enterica enterica serovar Typhi Ty2
gcuccgggacauccgga

SEQ ID NO: 1729542 - RNA, 13 nt, Salmonella enterica enterica serovar Typhi Ty2
gcguaauuccgca

SEQ ID NO: 1729543 - RNA, 21 nt, Salmonella enterica enterica serovar Typhi Ty2
gcguaagguauuuagccguuc

SEQ ID NO: 1729544 - RNA, 18 nt, Salmonella enterica enterica serovar Typhi Ty2
gcguaacgccuccaccgu

SEQ ID NO: 1729545 - RNA, 23 nt, Salmonella enterica enterica serovar Typhi Ty2
gcggugucgauacgauugcgcgu

SEQ ID NO: 1729546 - RNA, 19 nt, Salmonella enterica enterica serovar Typhi Ty2
gcggucaugcuggcgauga

SEQ ID NO: 1729547 - RNA, 15 nt, Salmonella enterica enterica serovar Typhi Ty2
gcggucaucgcccau

SEQ ID NO: 1729548 - RNA, 21 nt, Salmonella enterica enterica serovar Typhi Ty2
gcggucagcuuuucagcccag

SEQ ID NO: 1729549 - RNA, 19 nt, Salmonella enterica enterica serovar Typhi Ty2
gcggucgacagccacacgc

SEQ ID NO: 1729550 - RNA, 13 nt, Salmonella enterica enterica serovar Typhi Ty2
gcgucacaggcuu

SEQ ID NO: 1729551 - RNA, 16 nt, Salmonella enterica enterica serovar Typhi Ty2
gcgucaauaaucgcgc

SEQ ID NO: 1729552 - RNA, 21 nt, Salmonella enterica enterica serovar Typhi Ty2
gcgucacccgccggcagcagc

SEQ ID NO: 1729553 - RNA, 16 nt, Salmonella enterica enterica serovar Typhi Ty2
gcgucacgaccggcga

SEQ ID NO: 1729554 - RNA, 22 nt, Salmonella enterica enterica serovar Typhi Ty2
gcgucacccgccggcagcagcu

SEQ ID NO: 1729555 - RNA, 12 nt, Salmonella enterica enterica serovar Typhi Ty2
gcgucagcagag

SEQ ID NO: 1729556 - RNA, 22 nt, Salmonella enterica enterica serovar Typhi Ty2
gcgucagcccaagcugacggau

SEQ ID NO: 1729557 - RNA, 16 nt, Salmonella enterica enterica serovar Typhi Ty2
gcgucaggccaggguu

SEQ ID NO: 1729558 - RNA, 15 nt, Salmonella enterica enterica serovar Typhi Ty2
gcgucaggacggcga

SEQ ID NO: 1729559 - RNA, 17 nt, Salmonella enterica enterica serovar Typhi Ty2
gcgucaucauugcgcca

SEQ ID NO: 1729560 - RNA, 17 nt, Salmonella enterica enterica serovar Typhi Ty2
gcgucauaaccgcaguc

SEQ ID NO: 1729561 - RNA, 14 nt, Salmonella enterica enterica serovar Typhi Ty2
gcgucauaaugccc

SEQ ID NO: 1729562 - RNA, 17 nt, Salmonella enterica enterica serovar Typhi Ty2
gcgucaucggcgcgcug

SEQ ID NO: 1729563 - RNA, 14 nt, Salmonella enterica enterica serovar Typhi Ty2
gcgucauccggcau

SEQ ID NO: 1729564 - RNA, 19 nt, Salmonella enterica enterica serovar Typhi Ty2
gcguagcgucuuauccggc

SEQ ID NO: 1729565 - RNA, 22 nt, Salmonella enterica enterica serovar Typhi Ty2
gcguagcgagucaaaccucacg

SEQ ID NO: 1729566 - RNA, 16 nt, Salmonella enterica enterica serovar Typhi Ty2
gcguagcgcauccggc

SEQ ID NO: 1729567 - RNA, 19 nt, Salmonella enterica enterica serovar Typhi Ty2
gcguacuaaauaggcggca

SEQ ID NO: 1729568 - RNA, 19 nt, Salmonella enterica enterica serovar Typhi Ty2
gcguacuuucgccaguuca

SEQ ID NO: 1729569 - RNA, 18 nt, Salmonella enterica enterica serovar Typhi Ty2
gcguagagaggcauccgc

SEQ ID NO: 1729570 - RNA, 16 nt, Salmonella enterica enterica serovar Typhi Ty2
gcguacaggcggauga

SEQ ID NO: 1729571 - RNA, 14 nt, Salmonella enterica enterica serovar Typhi Ty2
gcguaccagcguca

SEQ ID NO: 1729572 - RNA, 15 nt, Salmonella enterica enterica serovar Typhi Ty2
gcguacaggcggaaa

SEQ ID NO: 1729573 - RNA, 13 nt, Salmonella enterica enterica serovar Typhi Ty2
gcguacagcgcca

SEQ ID NO: 1729574 - RNA, 18 nt, Salmonella enterica enterica serovar Typhi Ty2
gcguaccagaaacagcgc

SEQ ID NO: 1729575 - RNA, 23 nt, Salmonella enterica enterica serovar Typhi Ty2
gcguauccauucucaucagaccg

SEQ ID NO: 1729576 - RNA, 20 nt, Salmonella enterica enterica serovar Typhi Ty2
gcguaucucauugauggucg

SEQ ID NO: 1729577 - RNA, 13 nt, Salmonella enterica enterica serovar Typhi Ty2
gcgucaacgccac

SEQ ID NO: 1729578 - RNA, 20 nt, Salmonella enterica enterica serovar Typhi Ty2
gcgucaacguuuuucagccg

SEQ ID NO: 1729579 - RNA, 21 nt, Salmonella enterica enterica serovar Typhi Ty2
gcgucaacucagcaauauaug

SEQ ID NO: 1729580 - RNA, 12 nt, Salmonella enterica enterica serovar Typhi Ty2
gcguauuucacc

SEQ ID NO: 1729581 - RNA, 22 nt, Salmonella enterica enterica serovar Typhi Ty2
gcgucaaaaauaaaaaccgccu

SEQ ID NO: 1729582 - RNA, 18 nt, Salmonella enterica enterica serovar Typhi Ty2
gcgucaaaguugcaucaa

SEQ ID NO: 1729583 - RNA, 14 nt, Salmonella enterica enterica serovar Typhi Ty2
gcgucaaaacuuau

SEQ ID NO: 1729584 - RNA, 13 nt, Salmonella enterica enterica serovar Typhi Ty2
gcgugaccgguaa

SEQ ID NO: 1729585 - RNA, 17 nt, Salmonella enterica enterica serovar Typhi Ty2
gcgugcggacguagggc

SEQ ID NO: 1729586 - RNA, 14 nt, Salmonella enterica enterica serovar Typhi Ty2
gcgugcgacauggc

SEQ ID NO: 1729587 - RNA, 16 nt, Salmonella enterica enterica serovar Typhi Ty2
gcgucuuauccggccu

SEQ ID NO: 1729588 - RNA, 13 nt, Salmonella enterica enterica serovar Typhi Ty2
gcgucuuauccgg

SEQ ID NO: 1729589 - RNA, 19 nt, Salmonella enterica enterica serovar Typhi Ty2
gcgucuggguuugcagcag

SEQ ID NO: 1729590 - RNA, 15 nt, Salmonella enterica enterica serovar Typhi Ty2
gcgucucauccggca

SEQ ID NO: 1729591 - RNA, 23 nt, Salmonella enterica enterica serovar Typhi Ty2
gcgucgucauagcguugauaugc

SEQ ID NO: 1729592 - RNA, 18 nt, Salmonella enterica enterica serovar Typhi Ty2
gcgucgguuauagacgcc

SEQ ID NO: 1729593 - RNA, 15 nt, Salmonella enterica enterica serovar Typhi Ty2
gcgucggauggcgac

SEQ ID NO: 1729594 - RNA, 13 nt, Salmonella enterica enterica serovar Typhi Ty2
gcguuuagcgcca

SEQ ID NO: 1729595 - RNA, 20 nt, Salmonella enterica enterica serovar Typhi Ty2
gcguuuauguuugcugauaa

SEQ ID NO: 1729596 - RNA, 22 nt, Salmonella enterica enterica serovar Typhi Ty2
gcguuuauguuugcugauaaga

SEQ ID NO: 1729597 - RNA, 22 nt, Salmonella enterica enterica serovar Typhi Ty2
gcguuuauuauaaacacuauca

SEQ ID NO: 1729598 - RNA, 23 nt, Salmonella enterica enterica serovar Typhi Ty2
gcguuucacaucgccaguuauca

SEQ ID NO: 1729599 - RNA, 17 nt, Salmonella enterica enterica serovar Typhi Ty2
gcguuucacaucgccag

SEQ ID NO: 1729600 - RNA, 23 nt, Salmonella enterica enterica serovar Typhi Ty2
gcguuucccgcgcggaaggcgcc

SEQ ID NO: 1729601 - RNA, 20 nt, Salmonella enterica enterica serovar Typhi Ty2
gcguuucguaauggccuaca

SEQ ID NO: 1729602 - RNA, 21 nt, Salmonella enterica enterica serovar Typhi Ty2
gcguuuccagacuggucgccc

SEQ ID NO: 1729603 - RNA, 16 nt, Salmonella enterica enterica serovar Typhi Ty2
gcguugugcagaauca

SEQ ID NO: 1729604 - RNA, 23 nt, Salmonella enterica enterica serovar Typhi Ty2
gcguuguccuauugcaacgccga

SEQ ID NO: 1729605 - RNA, 17 nt, Salmonella enterica enterica serovar Typhi Ty2
gcguugcgccgccaggc

SEQ ID NO: 1729606 - RNA, 18 nt, Salmonella enterica enterica serovar Typhi Ty2
gcguugcuuaucaggccu

SEQ ID NO: 1729607 - RNA, 22 nt, Salmonella enterica enterica serovar Typhi Ty2
gcuaacgccugauccggccuac

SEQ ID NO: 1729608 - RNA, 20 nt, Salmonella enterica enterica serovar Typhi Ty2
gcuaacgcguacccggcuua

SEQ ID NO: 1729609 - RNA, 18 nt, Salmonella enterica enterica serovar Typhi Ty2
gcuaacgcuuauccggcc

SEQ ID NO: 1729610 - RNA, 15 nt, Salmonella enterica enterica serovar Typhi Ty2
gcuaagagugacggu

SEQ ID NO: 1729611 - RNA, 20 nt, Salmonella enterica enterica serovar Typhi Ty2
gcuaacgcuuauccggccua

SEQ ID NO: 1729612 - RNA, 19 nt, Salmonella enterica enterica serovar Typhi Ty2
gcuaaggccuuauugugcc

SEQ ID NO: 1729613 - RNA, 21 nt, Salmonella enterica enterica serovar Typhi Ty2
gcuaacgccugauccggccua

SEQ ID NO: 1729614 - RNA, 23 nt, Salmonella enterica enterica serovar Typhi Ty2
gcuaaagcgacuuauccggccua

SEQ ID NO: 1729615 - RNA, 12 nt, Salmonella enterica enterica serovar Typhi Ty2
gcguuucugaac

SEQ ID NO: 1729616 - RNA, 20 nt, Salmonella enterica enterica serovar Typhi Ty2
gcguuugauuugcgcgucgu

SEQ ID NO: 1729617 - RNA, 18 nt, Salmonella enterica enterica serovar Typhi Ty2
gcguuucuacgccauggc

SEQ ID NO: 1729618 - RNA, 17 nt, Salmonella enterica enterica serovar Typhi Ty2
gcguuuuaccgcccgac

SEQ ID NO: 1729619 - RNA, 16 nt, Salmonella enterica enterica serovar Typhi Ty2
gcuaaaaacagcgcaa

SEQ ID NO: 1729620 - RNA, 16 nt, Salmonella enterica enterica serovar Typhi Ty2
gcuaaaccggcggaau

SEQ ID NO: 1729621 - RNA, 13 nt, Salmonella enterica enterica serovar Typhi Ty2
gcguuuugcgcgu

SEQ ID NO: 1729622 - RNA, 23 nt, Salmonella enterica enterica serovar Typhi Ty2
gcguuuuuaucuuuuacgcuguc

SEQ ID NO: 1729623 - RNA, 17 nt, Salmonella enterica enterica serovar Typhi Ty2
gcguuuuuucaucggca

SEQ ID NO: 1729624 - RNA, 20 nt, Salmonella enterica enterica serovar Typhi Ty2
gcguggcaucuuaucaggcc

SEQ ID NO: 1729625 - RNA, 22 nt, Salmonella enterica enterica serovar Typhi Ty2
gcguuaugugaguuagcggcaa

SEQ ID NO: 1729626 - RNA, 16 nt, Salmonella enterica enterica serovar Typhi Ty2
gcguuaggaacaucga

SEQ ID NO: 1729627 - RNA, 21 nt, Salmonella enterica enterica serovar Typhi Ty2
gcguggcaucuuaucaggccu

SEQ ID NO: 1729628 - RNA, 23 nt, Salmonella enterica enterica serovar Typhi Ty2
gcguucacgccgccauccggcaa

SEQ ID NO: 1729629 - RNA, 14 nt, Salmonella enterica enterica serovar Typhi Ty2
gcguucagcgccug

SEQ ID NO: 1729630 - RNA, 23 nt, Salmonella enterica enterica serovar Typhi Ty2
gcguucaaagaucucgucaaggu

SEQ ID NO: 1729631 - RNA, 23 nt, Salmonella enterica enterica serovar Typhi Ty2
gcguuauguuguugagacgguga

SEQ ID NO: 1729632 - RNA, 21 nt, Salmonella enterica enterica serovar Typhi Ty2
gcguucuuccacuucagcagc

SEQ ID NO: 1729633 - RNA, 20 nt, Salmonella enterica enterica serovar Typhi Ty2
gcguucuagcuuaucgccaa

SEQ ID NO: 1729634 - RNA, 15 nt, Salmonella enterica enterica serovar Typhi Ty2
gcggcguccgccagc

SEQ ID NO: 1729635 - RNA, 21 nt, Salmonella enterica enterica serovar Typhi Ty2
gcggcguacacuucauccggc

SEQ ID NO: 1729636 - RNA, 21 nt, Salmonella enterica enterica serovar Typhi Ty2
gcggcgguaacgccuucgcaa

SEQ ID NO: 1729637 - RNA, 20 nt, Salmonella enterica enterica serovar Typhi Ty2
gcggcgugaugccagccaua

SEQ ID NO: 1729638 - RNA, 17 nt, Salmonella enterica enterica serovar Typhi Ty2
gcggcgugaccgccuua

SEQ ID NO: 1729639 - RNA, 16 nt, Salmonella enterica enterica serovar Typhi Ty2
gcggcgccaucaccau

SEQ ID NO: 1729640 - RNA, 23 nt, Salmonella enterica enterica serovar Typhi Ty2
gcggcgcaaaucgccaucagcgc

SEQ ID NO: 1729641 - RNA, 14 nt, Salmonella enterica enterica serovar Typhi Ty2
gcgggaaugcgcgc

SEQ ID NO: 1729642 - RNA, 21 nt, Salmonella enterica enterica serovar Typhi Ty2
gcgggcauacucuccuccaua

SEQ ID NO: 1729643 - RNA, 18 nt, Salmonella enterica enterica serovar Typhi Ty2
gcgggcguauagccaggc

SEQ ID NO: 1729644 - RNA, 19 nt, Salmonella enterica enterica serovar Typhi Ty2
gcggccuaaaucgcugcug

SEQ ID NO: 1729645 - RNA, 14 nt, Salmonella enterica enterica serovar Typhi Ty2
gcggccugcgugcg

SEQ ID NO: 1729646 - RNA, 13 nt, Salmonella enterica enterica serovar Typhi Ty2
gcggccuccggau

SEQ ID NO: 1729647 - RNA, 21 nt, Salmonella enterica enterica serovar Typhi Ty2
gcggccuaaaucgcugcugau

SEQ ID NO: 1729648 - RNA, 17 nt, Salmonella enterica enterica serovar Typhi Ty2
gcggaacaccagcgccg

SEQ ID NO: 1729649 - RNA, 15 nt, Salmonella enterica enterica serovar Typhi Ty2
gcggaaaagcgccca

SEQ ID NO: 1729650 - RNA, 20 nt, Salmonella enterica enterica serovar Typhi Ty2
gcgcuuuuuuuacgccugaa

SEQ ID NO: 1729651 - RNA, 20 nt, Salmonella enterica enterica serovar Typhi Ty2
gcggcaucauaaaucgacau

SEQ ID NO: 1729652 - RNA, 19 nt, Salmonella enterica enterica serovar Typhi Ty2
gcggcaucgaacgggcgau

SEQ ID NO: 1729653 - RNA, 21 nt, Salmonella enterica enterica serovar Typhi Ty2
gcggcaguugaacucgauaac

SEQ ID NO: 1729654 - RNA, 16 nt, Salmonella enterica enterica serovar Typhi Ty2
gcggcaguuccggcgu

SEQ ID NO: 1729655 - RNA, 19 nt, Salmonella enterica enterica serovar Typhi Ty2
gcggcaguugccggaacca

SEQ ID NO: 1729656 - RNA, 15 nt, Salmonella enterica enterica serovar Typhi Ty2
gcggcaguuccggcg

SEQ ID NO: 1729657 - RNA, 14 nt, Salmonella enterica enterica serovar Typhi Ty2
gcggcaucaggcau

SEQ ID NO: 1729658 - RNA, 13 nt, Salmonella enterica enterica serovar Typhi Ty2
gcggcaucaggca

SEQ ID NO: 1729659 - RNA, 20 nt, Salmonella enterica enterica serovar Typhi Ty2
gcggcaucagauggcgauuc

SEQ ID NO: 1729660 - RNA, 18 nt, Salmonella enterica enterica serovar Typhi Ty2
gcggcauaauaugccgga

SEQ ID NO: 1729661 - RNA, 21 nt, Salmonella enterica enterica serovar Typhi Ty2
gcggcauuggcguuaccggca

SEQ ID NO: 1729662 - RNA, 21 nt, Salmonella enterica enterica serovar Typhi Ty2
gcggccaggcaaagauccacc

SEQ ID NO: 1729663 - RNA, 16 nt, Salmonella enterica enterica serovar Typhi Ty2
gcggccccaucagcac

SEQ ID NO: 1729664 - RNA, 17 nt, Salmonella enterica enterica serovar Typhi Ty2
gcgacuucauucaggca

SEQ ID NO: 1729665 - RNA, 22 nt, Salmonella enterica enterica serovar Typhi Ty2
gcgacuuuaaacuuauccgcca

SEQ ID NO: 1729666 - RNA, 14 nt, Salmonella enterica enterica serovar Typhi Ty2
gcgacugauaagcg

SEQ ID NO: 1729667 - RNA, 16 nt, Salmonella enterica enterica serovar Typhi Ty2
gcgagcaggaauagcu

SEQ ID NO: 1729668 - RNA, 22 nt, Salmonella enterica enterica serovar Typhi Ty2
gcgagaacugcugcauccgcgc

SEQ ID NO: 1729669 - RNA, 22 nt, Salmonella enterica enterica serovar Typhi Ty2
gcgagaaggcuuugccauacgc

SEQ ID NO: 1729670 - RNA, 19 nt, Salmonella enterica enterica serovar Typhi Ty2
gcgauaaaaccaccuacgc

SEQ ID NO: 1729671 - RNA, 14 nt, Salmonella enterica enterica serovar Typhi Ty2
gcgauaagcgucuu

SEQ ID NO: 1729672 - RNA, 15 nt, Salmonella enterica enterica serovar Typhi Ty2
gcgauacgcagcacc

SEQ ID NO: 1729673 - RNA, 19 nt, Salmonella enterica enterica serovar Typhi Ty2
gcgauacucucgcagcgaa

SEQ ID NO: 1729674 - RNA, 16 nt, Salmonella enterica enterica serovar Typhi Ty2
gcgauaggccucgacc

SEQ ID NO: 1729675 - RNA, 20 nt, Salmonella enterica enterica serovar Typhi Ty2
gcgagguucccgccgccauu

SEQ ID NO: 1729676 - RNA, 11 nt, Salmonella enterica enterica serovar Typhi Ty2
gcgagcgccgu

SEQ ID NO: 1729677 - RNA, 15 nt, Salmonella enterica enterica serovar Typhi Ty2
gcgacaccagcgucg

SEQ ID NO: 1729678 - RNA, 21 nt, Salmonella enterica enterica serovar Typhi Ty2
gcgacaggcgcuuaucgccgu

SEQ ID NO: 1729679 - RNA, 19 nt, Salmonella enterica enterica serovar Typhi Ty2
gcgaagcgccgucggcauc

SEQ ID NO: 1729680 - RNA, 19 nt, Salmonella enterica enterica serovar Typhi Ty2
gcgaagcgcgcagcgcuga

SEQ ID NO: 1729681 - RNA, 18 nt, Salmonella enterica enterica serovar Typhi Ty2
gcgacacaacggcacaac

SEQ ID NO: 1729682 - RNA, 17 nt, Salmonella enterica enterica serovar Typhi Ty2
gcgaagcgucauccggc

SEQ ID NO: 1729683 - RNA, 15 nt, Salmonella enterica enterica serovar Typhi Ty2
gcgaagcggcgcuau

SEQ ID NO: 1729684 - RNA, 21 nt, Salmonella enterica enterica serovar Typhi Ty2
gcgaagcggcgcuauccggca

SEQ ID NO: 1729685 - RNA, 15 nt, Salmonella enterica enterica serovar Typhi Ty2
gcgacaguaguauca

SEQ ID NO: 1729686 - RNA, 13 nt, Salmonella enterica enterica serovar Typhi Ty2
gcgacccagcgca

SEQ ID NO: 1729687 - RNA, 16 nt, Salmonella enterica enterica serovar Typhi Ty2
gcgaccacgacgccgg

SEQ ID NO: 1729688 - RNA, 16 nt, Salmonella enterica enterica serovar Typhi Ty2
gcgacgacacggcgca

SEQ ID NO: 1729689 - RNA, 15 nt, Salmonella enterica enterica serovar Typhi Ty2
gcgacgaaucagcga

SEQ ID NO: 1729690 - RNA, 15 nt, Salmonella enterica enterica serovar Typhi Ty2
gcgacgaucagcgcc

SEQ ID NO: 1729691 - RNA, 16 nt, Salmonella enterica enterica serovar Typhi Ty2
gcgacgaucagcgcca

SEQ ID NO: 1729692 - RNA, 14 nt, Salmonella enterica enterica serovar Typhi Ty2
gcgacgaucagcgc

SEQ ID NO: 1729693 - RNA, 14 nt, Salmonella enterica enterica serovar Typhi Ty2
gcgacgccgccauc

SEQ ID NO: 1729694 - RNA, 12 nt, Salmonella enterica enterica serovar Typhi Ty2
gcgacgaugcgc

SEQ ID NO: 1729695 - RNA, 21 nt, Salmonella enterica enterica serovar Typhi Ty2
gcgacgaugugcauaaccgcg

SEQ ID NO: 1729696 - RNA, 17 nt, Salmonella enterica enterica serovar Typhi Ty2
gcgaaauuuaauauaug

SEQ ID NO: 1729697 - RNA, 13 nt, Salmonella enterica enterica serovar Typhi Ty2
gcgaacagcgcac

SEQ ID NO: 1729698 - RNA, 17 nt, Salmonella enterica enterica serovar Typhi Ty2
gcgaaacuccagcgaua

SEQ ID NO: 1729699 - RNA, 18 nt, Salmonella enterica enterica serovar Typhi Ty2
gccuuuuuucaccugcaa

SEQ ID NO: 1729700 - RNA, 23 nt, Salmonella enterica enterica serovar Typhi Ty2
gccuuuuuuauacuccagcagac

SEQ ID NO: 1729701 - RNA, 23 nt, Salmonella enterica enterica serovar Typhi Ty2
gcgaaaaauaggauggcgcagca

SEQ ID NO: 1729702 - RNA, 15 nt, Salmonella enterica enterica serovar Typhi Ty2
gcgaaaaaaagcccg

SEQ ID NO: 1729703 - RNA, 12 nt, Salmonella enterica enterica serovar Typhi Ty2
gccuuuggccug

SEQ ID NO: 1729704 - RNA, 15 nt, Salmonella enterica enterica serovar Typhi Ty2
gcgaaaacggcguag

SEQ ID NO: 1729705 - RNA, 22 nt, Salmonella enterica enterica serovar Typhi Ty2
gccuuucuuauuuuuuucaacg

SEQ ID NO: 1729706 - RNA, 14 nt, Salmonella enterica enterica serovar Typhi Ty2
gccuuugccuucgc

SEQ ID NO: 1729707 - RNA, 17 nt, Salmonella enterica enterica serovar Typhi Ty2
gccuuucagaucggcaa

SEQ ID NO: 1729708 - RNA, 18 nt, Salmonella enterica enterica serovar Typhi Ty2
gcgaaccuuccaucgcau

SEQ ID NO: 1729709 - RNA, 14 nt, Salmonella enterica enterica serovar Typhi Ty2
gcgaacgcgauugc

SEQ ID NO: 1729710 - RNA, 14 nt, Salmonella enterica enterica serovar Typhi Ty2
gcgaacaggcguaa

SEQ ID NO: 1729711 - RNA, 23 nt, Salmonella enterica enterica serovar Typhi Ty2
gcgaacagcccgcuauuucucgc

SEQ ID NO: 1729712 - RNA, 22 nt, Salmonella enterica enterica serovar Typhi Ty2
gcgaacaggcucagcgccacgc

SEQ ID NO: 1729713 - RNA, 22 nt, Salmonella enterica enterica serovar Typhi Ty2
gcgaaccaccguuuaaucgccc

SEQ ID NO: 1729714 - RNA, 11 nt, Salmonella enterica enterica serovar Typhi Ty2
gcgaacauugg

SEQ ID NO: 1729715 - RNA, 19 nt, Salmonella enterica enterica serovar Typhi Ty2
gcgaagaucguuauccagc

SEQ ID NO: 1729716 - RNA, 18 nt, Salmonella enterica enterica serovar Typhi Ty2
gcgaagauuaacccgguc

SEQ ID NO: 1729717 - RNA, 23 nt, Salmonella enterica enterica serovar Typhi Ty2
gcgaacguuacccggccagccgu

SEQ ID NO: 1729718 - RNA, 23 nt, Salmonella enterica enterica serovar Typhi Ty2
gcgaacugcacucggauguacug

SEQ ID NO: 1729719 - RNA, 21 nt, Salmonella enterica enterica serovar Typhi Ty2
gccuggcgguaugaaagccau

SEQ ID NO: 1729720 - RNA, 15 nt, Salmonella enterica enterica serovar Typhi Ty2
gccuggcgcagcgcu

SEQ ID NO: 1729721 - RNA, 22 nt, Salmonella enterica enterica serovar Typhi Ty2
gccuggcgauguucuugccgcc

SEQ ID NO: 1729722 - RNA, 13 nt, Salmonella enterica enterica serovar Typhi Ty2
gccuguccggccu

SEQ ID NO: 1729723 - RNA, 13 nt, Salmonella enterica enterica serovar Typhi Ty2
gccugucggucuu

SEQ ID NO: 1729724 - RNA, 20 nt, Salmonella enterica enterica serovar Typhi Ty2
gccuugauccuguaacgcau

SEQ ID NO: 1729725 - RNA, 14 nt, Salmonella enterica enterica serovar Typhi Ty2
gccuucuuccguca

SEQ ID NO: 1729726 - RNA, 21 nt, Salmonella enterica enterica serovar Typhi Ty2
gccuucuuucucgaauccacu

SEQ ID NO: 1729727 - RNA, 18 nt, Salmonella enterica enterica serovar Typhi Ty2
gccuuauccggccuacgu

SEQ ID NO: 1729728 - RNA, 24 nt, Salmonella enterica enterica serovar Typhi Ty2
gccuucauaaugaauacgcuccag

SEQ ID NO: 1729729 - RNA, 14 nt, Salmonella enterica enterica serovar Typhi Ty2
gccuucaaucagca

SEQ ID NO: 1729730 - RNA, 19 nt, Salmonella enterica enterica serovar Typhi Ty2
gccuuauuuuucagcgcca

SEQ ID NO: 1729731 - RNA, 16 nt, Salmonella enterica enterica serovar Typhi Ty2
gccugcgccagcgccg

SEQ ID NO: 1729732 - RNA, 17 nt, Salmonella enterica enterica serovar Typhi Ty2
gccugcgccagcgccgg

SEQ ID NO: 1729733 - RNA, 21 nt, Salmonella enterica enterica serovar Typhi Ty2
gccugcgcuuacggccaugga

SEQ ID NO: 1729734 - RNA, 14 nt, Salmonella enterica enterica serovar Typhi Ty2
gccuccggcgguga

SEQ ID NO: 1729735 - RNA, 21 nt, Salmonella enterica enterica serovar Typhi Ty2
gccucacccugaaauccggcu

SEQ ID NO: 1729736 - RNA, 15 nt, Salmonella enterica enterica serovar Typhi Ty2
gccucgcgauccgcc

SEQ ID NO: 1729737 - RNA, 24 nt, Salmonella enterica enterica serovar Typhi Ty2
gccguuggcuuuggcucacugcua

SEQ ID NO: 1729738 - RNA, 20 nt, Salmonella enterica enterica serovar Typhi Ty2
gccuaucgccauauacgcca

SEQ ID NO: 1729739 - RNA, 14 nt, Salmonella enterica enterica serovar Typhi Ty2
gccuaucgccauau

SEQ ID NO: 1729740 - RNA, 23 nt, Salmonella enterica enterica serovar Typhi Ty2
gccuaucaccgcgaugaccauca

SEQ ID NO: 1729741 - RNA, 13 nt, Salmonella enterica enterica serovar Typhi Ty2
gccguuucaaccc

SEQ ID NO: 1729742 - RNA, 13 nt, Salmonella enterica enterica serovar Typhi Ty2
gccgucgcuauca

SEQ ID NO: 1729743 - RNA, 13 nt, Salmonella enterica enterica serovar Typhi Ty2
gccgucgccacac

SEQ ID NO: 1729744 - RNA, 18 nt, Salmonella enterica enterica serovar Typhi Ty2
gccgugauagcaggcacu

SEQ ID NO: 1729745 - RNA, 16 nt, Salmonella enterica enterica serovar Typhi Ty2
gccgucgaugauggcg

SEQ ID NO: 1729746 - RNA, 20 nt, Salmonella enterica enterica serovar Typhi Ty2
gccgucgacaaagccgacgc

SEQ ID NO: 1729747 - RNA, 17 nt, Salmonella enterica enterica serovar Typhi Ty2
gccgucaaacaucgcgc

SEQ ID NO: 1729748 - RNA, 23 nt, Salmonella enterica enterica serovar Typhi Ty2
gccgucaaacaagccgccaacgc

SEQ ID NO: 1729749 - RNA, 16 nt, Salmonella enterica enterica serovar Typhi Ty2
gccguauucuuaccca

SEQ ID NO: 1729750 - RNA, 15 nt, Salmonella enterica enterica serovar Typhi Ty2
gccgucacagagagc

SEQ ID NO: 1729751 - RNA, 20 nt, Salmonella enterica enterica serovar Typhi Ty2
gccgucaauuuuaagaauau

SEQ ID NO: 1729752 - RNA, 19 nt, Salmonella enterica enterica serovar Typhi Ty2
gccguaucagcaagcgcca

SEQ ID NO: 1729753 - RNA, 13 nt, Salmonella enterica enterica serovar Typhi Ty2
gccguauccaggg

SEQ ID NO: 1729754 - RNA, 19 nt, Salmonella enterica enterica serovar Typhi Ty2
gccggucguaaugagcacu

SEQ ID NO: 1729755 - RNA, 13 nt, Salmonella enterica enterica serovar Typhi Ty2
gccggucgccagc

SEQ ID NO: 1729756 - RNA, 19 nt, Salmonella enterica enterica serovar Typhi Ty2
gccggucaugccaucccgc

SEQ ID NO: 1729757 - RNA, 22 nt, Salmonella enterica enterica serovar Typhi Ty2
gccggucaggauacagccgacu

SEQ ID NO: 1729758 - RNA, 13 nt, Salmonella enterica enterica serovar Typhi Ty2
gccggucaugcca

SEQ ID NO: 1729759 - RNA, 22 nt, Salmonella enterica enterica serovar Typhi Ty2
gccgguacgggaaauagcggaa

SEQ ID NO: 1729760 - RNA, 17 nt, Salmonella enterica enterica serovar Typhi Ty2
gccgguagcuucagcgg

SEQ ID NO: 1729761 - RNA, 18 nt, Salmonella enterica enterica serovar Typhi Ty2
gccgggugacgcuuacgc

SEQ ID NO: 1729762 - RNA, 14 nt, Salmonella enterica enterica serovar Typhi Ty2
gccgggccugccag

SEQ ID NO: 1729763 - RNA, 14 nt, Salmonella enterica enterica serovar Typhi Ty2
gcgccggacagcag

SEQ ID NO: 1729764 - RNA, 13 nt, Salmonella enterica enterica serovar Typhi Ty2
gcgccuaccgcca

SEQ ID NO: 1729765 - RNA, 23 nt, Salmonella enterica enterica serovar Typhi Ty2
gcgccuaccagcgcuauccaggc

SEQ ID NO: 1729766 - RNA, 22 nt, Salmonella enterica enterica serovar Typhi Ty2
gcgcgagaacugcugcauccgc

SEQ ID NO: 1729767 - RNA, 23 nt, Salmonella enterica enterica serovar Typhi Ty2
gcgcgagccacgcggcaucaggc

SEQ ID NO: 1729768 - RNA, 13 nt, Salmonella enterica enterica serovar Typhi Ty2
gcgccuuccggga

SEQ ID NO: 1729769 - RNA, 13 nt, Salmonella enterica enterica serovar Typhi Ty2
gcgcgccgacagg

SEQ ID NO: 1729770 - RNA, 13 nt, Salmonella enterica enterica serovar Typhi Ty2
gcgcgccggugau

SEQ ID NO: 1729771 - RNA, 16 nt, Salmonella enterica enterica serovar Typhi Ty2
gcgcgccuaccgccau

SEQ ID NO: 1729772 - RNA, 23 nt, Salmonella enterica enterica serovar Typhi Ty2
gcgcgcuuuccacaaucccggca

SEQ ID NO: 1729773 - RNA, 22 nt, Salmonella enterica enterica serovar Typhi Ty2
gcgcgcuuuccacaaucccggc

SEQ ID NO: 1729774 - RNA, 14 nt, Salmonella enterica enterica serovar Typhi Ty2
gcgcugaucgccac

SEQ ID NO: 1729775 - RNA, 19 nt, Salmonella enterica enterica serovar Typhi Ty2
gcgcugauauuuuuacuga

SEQ ID NO: 1729776 - RNA, 16 nt, Salmonella enterica enterica serovar Typhi Ty2
gcgcugagaugaccau

SEQ ID NO: 1729777 - RNA, 22 nt, Salmonella enterica enterica serovar Typhi Ty2
gcgcuccgacugaaccuucacg

SEQ ID NO: 1729778 - RNA, 21 nt, Salmonella enterica enterica serovar Typhi Ty2
gcgcugccgcuuauccggccu

SEQ ID NO: 1729779 - RNA, 18 nt, Salmonella enterica enterica serovar Typhi Ty2
gcgcugcgcggcgugcag

SEQ ID NO: 1729780 - RNA, 21 nt, Salmonella enterica enterica serovar Typhi Ty2
gcgcugcgccagaucaggcgu

SEQ ID NO: 1729781 - RNA, 18 nt, Salmonella enterica enterica serovar Typhi Ty2
gcgcuggcaguuugcgcu

SEQ ID NO: 1729782 - RNA, 19 nt, Salmonella enterica enterica serovar Typhi Ty2
gcgcuuaucaggccuacaa

SEQ ID NO: 1729783 - RNA, 22 nt, Salmonella enterica enterica serovar Typhi Ty2
gcgcuuagccugaucgaucagc

SEQ ID NO: 1729784 - RNA, 19 nt, Salmonella enterica enterica serovar Typhi Ty2
gcgcuuaccgggccuacag

SEQ ID NO: 1729785 - RNA, 19 nt, Salmonella enterica enterica serovar Typhi Ty2
gcgcuuaccgggccuacaa

SEQ ID NO: 1729786 - RNA, 22 nt, Salmonella enterica enterica serovar Typhi Ty2
gcgcuuaucgccguaaccgccu

SEQ ID NO: 1729787 - RNA, 19 nt, Salmonella enterica enterica serovar Typhi Ty2
gcgcuguguccgccugcug

SEQ ID NO: 1729788 - RNA, 19 nt, Salmonella enterica enterica serovar Typhi Ty2
gcgcugugcuaucaggccu

SEQ ID NO: 1729789 - RNA, 14 nt, Salmonella enterica enterica serovar Typhi Ty2
gcgcugugacggca

SEQ ID NO: 1729790 - RNA, 21 nt, Salmonella enterica enterica serovar Typhi Ty2
gcgcuguuguuccagauaauc

SEQ ID NO: 1729791 - RNA, 20 nt, Salmonella enterica enterica serovar Typhi Ty2
gcgcuguuuuuacgccauaa

SEQ ID NO: 1729792 - RNA, 23 nt, Salmonella enterica enterica serovar Typhi Ty2
gcgcuguacgccucuuucagccg

SEQ ID NO: 1729793 - RNA, 13 nt, Salmonella enterica enterica serovar Typhi Ty2
gcgcugucugccg

SEQ ID NO: 1729794 - RNA, 16 nt, Salmonella enterica enterica serovar Typhi Ty2
gcgcuuuacaugacgc

SEQ ID NO: 1729795 - RNA, 17 nt, Salmonella enterica enterica serovar Typhi Ty2
gcgcuucugauuauuga

SEQ ID NO: 1729796 - RNA, 20 nt, Salmonella enterica enterica serovar Typhi Ty2
gcgcuucgcuuaucaggccu

SEQ ID NO: 1729797 - RNA, 17 nt, Salmonella enterica enterica serovar Typhi Ty2
gcgcuucguuuuccgca

SEQ ID NO: 1729798 - RNA, 15 nt, Salmonella enterica enterica serovar Typhi Ty2
gcgcuucggcgauag

SEQ ID NO: 1729799 - RNA, 13 nt, Salmonella enterica enterica serovar Typhi Ty2
gcgcuuccugcag

SEQ ID NO: 1729800 - RNA, 18 nt, Salmonella enterica enterica serovar Typhi Ty2
gcgcgucgcauccggcaa

SEQ ID NO: 1729801 - RNA, 23 nt, Salmonella enterica enterica serovar Typhi Ty2
gcgcguuguccaacugucgccau

SEQ ID NO: 1729802 - RNA, 17 nt, Salmonella enterica enterica serovar Typhi Ty2
gcgcuauugaucgccau

SEQ ID NO: 1729803 - RNA, 19 nt, Salmonella enterica enterica serovar Typhi Ty2
gcgcuauugaucgccauag

SEQ ID NO: 1729804 - RNA, 18 nt, Salmonella enterica enterica serovar Typhi Ty2
gcgcucaacacauaacgc

SEQ ID NO: 1729805 - RNA, 20 nt, Salmonella enterica enterica serovar Typhi Ty2
gcgcucaacacauaacgccc

SEQ ID NO: 1729806 - RNA, 18 nt, Salmonella enterica enterica serovar Typhi Ty2
gcgcguuuuccaucauca

SEQ ID NO: 1729807 - RNA, 22 nt, Salmonella enterica enterica serovar Typhi Ty2
gcgcguuuuccaucaucaggac

SEQ ID NO: 1729808 - RNA, 13 nt, Salmonella enterica enterica serovar Typhi Ty2
gcgcuaaccagcg

SEQ ID NO: 1729809 - RNA, 17 nt, Salmonella enterica enterica serovar Typhi Ty2
gcgcuaaaauccacguc

SEQ ID NO: 1729810 - RNA, 12 nt, Salmonella enterica enterica serovar Typhi Ty2
gcgcggguugcc

SEQ ID NO: 1729811 - RNA, 15 nt, Salmonella enterica enterica serovar Typhi Ty2
gcgcguaauuccgca

SEQ ID NO: 1729812 - RNA, 22 nt, Salmonella enterica enterica serovar Typhi Ty2
gcgcguaaauaccuucuggcgu

SEQ ID NO: 1729813 - RNA, 20 nt, Salmonella enterica enterica serovar Typhi Ty2
gcgcggcaggccuuucggca

SEQ ID NO: 1729814 - RNA, 13 nt, Salmonella enterica enterica serovar Typhi Ty2
gcgcggcagaccg

SEQ ID NO: 1729815 - RNA, 21 nt, Salmonella enterica enterica serovar Typhi Ty2
gcgcauaagccacuucaacca

SEQ ID NO: 1729816 - RNA, 18 nt, Salmonella enterica enterica serovar Typhi Ty2
gcgcauacucuuccguca

SEQ ID NO: 1729817 - RNA, 17 nt, Salmonella enterica enterica serovar Typhi Ty2
gcgcauacgucaugccu

SEQ ID NO: 1729818 - RNA, 13 nt, Salmonella enterica enterica serovar Typhi Ty2
gcgcauacucuuc

SEQ ID NO: 1729819 - RNA, 16 nt, Salmonella enterica enterica serovar Typhi Ty2
gcgcauauuccggcga

SEQ ID NO: 1729820 - RNA, 17 nt, Salmonella enterica enterica serovar Typhi Ty2
gcgcauauuccggcgac

SEQ ID NO: 1729821 - RNA, 17 nt, Salmonella enterica enterica serovar Typhi Ty2
gcgcauccgucaggccc

SEQ ID NO: 1729822 - RNA, 18 nt, Salmonella enterica enterica serovar Typhi Ty2
gcgcaucgauauaagcgc

SEQ ID NO: 1729823 - RNA, 17 nt, Salmonella enterica enterica serovar Typhi Ty2
gcgcaucgcaucagggc

SEQ ID NO: 1729824 - RNA, 21 nt, Salmonella enterica enterica serovar Typhi Ty2
gcgcagugaccagcaucagcg

SEQ ID NO: 1729825 - RNA, 19 nt, Salmonella enterica enterica serovar Typhi Ty2
gcgcagcgccaucaggccc

SEQ ID NO: 1729826 - RNA, 20 nt, Salmonella enterica enterica serovar Typhi Ty2
gcgcagcgccaucaggcacg

SEQ ID NO: 1729827 - RNA, 17 nt, Salmonella enterica enterica serovar Typhi Ty2
gcgcagcgccaucaggc

SEQ ID NO: 1729828 - RNA, 16 nt, Salmonella enterica enterica serovar Typhi Ty2
gcgcagcgcaucaggc

SEQ ID NO: 1729829 - RNA, 17 nt, Salmonella enterica enterica serovar Typhi Ty2
gcgcagcgauauagcgc

SEQ ID NO: 1729830 - RNA, 15 nt, Salmonella enterica enterica serovar Typhi Ty2
gcgcagccagcgccc

SEQ ID NO: 1729831 - RNA, 16 nt, Salmonella enterica enterica serovar Typhi Ty2
gcgcagcacuucagaa

SEQ ID NO: 1729832 - RNA, 23 nt, Salmonella enterica enterica serovar Typhi Ty2
gcgcacuuccucucccacugcga

SEQ ID NO: 1729833 - RNA, 20 nt, Salmonella enterica enterica serovar Typhi Ty2
gcgcagaaucacuucauccg

SEQ ID NO: 1729834 - RNA, 20 nt, Salmonella enterica enterica serovar Typhi Ty2
gcgcagaccuacgcuauccg

SEQ ID NO: 1729835 - RNA, 24 nt, Salmonella enterica enterica serovar Typhi Ty2
gcgauauccaccgguacgcuccag

SEQ ID NO: 1729836 - RNA, 14 nt, Salmonella enterica enterica serovar Typhi Ty2
gcgauaucaaucac

SEQ ID NO: 1729837 - RNA, 17 nt, Salmonella enterica enterica serovar Typhi Ty2
gcgauauccgugccgcc

SEQ ID NO: 1729838 - RNA, 13 nt, Salmonella enterica enterica serovar Typhi Ty2
gcgauaucugccg

SEQ ID NO: 1729839 - RNA, 19 nt, Salmonella enterica enterica serovar Typhi Ty2
gcgaucaccacgcgaauac

SEQ ID NO: 1729840 - RNA, 17 nt, Salmonella enterica enterica serovar Typhi Ty2
gcgccacuuuuccggca

SEQ ID NO: 1729841 - RNA, 18 nt, Salmonella enterica enterica serovar Typhi Ty2
gcgccagagaucgcacua

SEQ ID NO: 1729842 - RNA, 21 nt, Salmonella enterica enterica serovar Typhi Ty2
gcgccagcaacagcguaccuu

SEQ ID NO: 1729843 - RNA, 23 nt, Salmonella enterica enterica serovar Typhi Ty2
gcgccagcggauugccauacacg

SEQ ID NO: 1729844 - RNA, 12 nt, Salmonella enterica enterica serovar Typhi Ty2
gcgccagcagca

SEQ ID NO: 1729845 - RNA, 16 nt, Salmonella enterica enterica serovar Typhi Ty2
gcgccagcagcagcgc

SEQ ID NO: 1729846 - RNA, 19 nt, Salmonella enterica enterica serovar Typhi Ty2
gcgcccaguccuuccggcg

SEQ ID NO: 1729847 - RNA, 24 nt, Salmonella enterica enterica serovar Typhi Ty2
gcgcccccagcaaaccggcaugaa

SEQ ID NO: 1729848 - RNA, 15 nt, Salmonella enterica enterica serovar Typhi Ty2
gcgccccaguaacgu

SEQ ID NO: 1729849 - RNA, 21 nt, Salmonella enterica enterica serovar Typhi Ty2
gcgccccagcacaaucccggc

SEQ ID NO: 1729850 - RNA, 16 nt, Salmonella enterica enterica serovar Typhi Ty2
gcgcccagcagcagaa

SEQ ID NO: 1729851 - RNA, 13 nt, Salmonella enterica enterica serovar Typhi Ty2
gcgcccagcagca

SEQ ID NO: 1729852 - RNA, 22 nt, Salmonella enterica enterica serovar Typhi Ty2
gcgcccaaugcuuagucagccu

SEQ ID NO: 1729853 - RNA, 15 nt, Salmonella enterica enterica serovar Typhi Ty2
gcgccgcgauacgga

SEQ ID NO: 1729854 - RNA, 15 nt, Salmonella enterica enterica serovar Typhi Ty2
gcgccgcgauaaaga

SEQ ID NO: 1729855 - RNA, 19 nt, Salmonella enterica enterica serovar Typhi Ty2
gcgccgcgacaacgccauc

SEQ ID NO: 1729856 - RNA, 16 nt, Salmonella enterica enterica serovar Typhi Ty2
gcgccgcgccgccgua

SEQ ID NO: 1729857 - RNA, 21 nt, Salmonella enterica enterica serovar Typhi Ty2
gcgccgccaacgauacagcac

SEQ ID NO: 1729858 - RNA, 19 nt, Salmonella enterica enterica serovar Typhi Ty2
gcgccgccaacgauacagc

SEQ ID NO: 1729859 - RNA, 15 nt, Salmonella enterica enterica serovar Typhi Ty2
gcgccgcucaucacc

SEQ ID NO: 1729860 - RNA, 22 nt, Salmonella enterica enterica serovar Typhi Ty2
gcgccgcaaaggaucaucggcc

SEQ ID NO: 1729861 - RNA, 21 nt, Salmonella enterica enterica serovar Typhi Ty2
gcgccgaaugcguuuuuucac

SEQ ID NO: 1729862 - RNA, 23 nt, Salmonella enterica enterica serovar Typhi Ty2
gucgagaauguggguauccacgc

SEQ ID NO: 1729863 - RNA, 13 nt, Salmonella enterica enterica serovar Typhi Ty2
gucgcauccgcgu

SEQ ID NO: 1729864 - RNA, 12 nt, Salmonella enterica enterica serovar Typhi Ty2
gucgccagcaua

SEQ ID NO: 1729865 - RNA, 18 nt, Salmonella enterica enterica serovar Typhi Ty2
gucgccagacccagcgcu

SEQ ID NO: 1729866 - RNA, 12 nt, Salmonella enterica enterica serovar Typhi Ty2
gucgccggccug

SEQ ID NO: 1729867 - RNA, 22 nt, Salmonella enterica enterica serovar Typhi Ty2
gucgccgccgggcaguacgcac

SEQ ID NO: 1729868 - RNA, 14 nt, Salmonella enterica enterica serovar Typhi Ty2
gucgccuuccagcg

SEQ ID NO: 1729869 - RNA, 21 nt, Salmonella enterica enterica serovar Typhi Ty2
gucgcgaaugcgcaaucccgg

SEQ ID NO: 1729870 - RNA, 19 nt, Salmonella enterica enterica serovar Typhi Ty2
gucgcggcucaccagcuga

SEQ ID NO: 1729871 - RNA, 14 nt, Salmonella enterica enterica serovar Typhi Ty2
gucgcuccggaacg

SEQ ID NO: 1729872 - RNA, 17 nt, Salmonella enterica enterica serovar Typhi Ty2
gucgcuauccagcagua

SEQ ID NO: 1729873 - RNA, 19 nt, Salmonella enterica enterica serovar Typhi Ty2
gucgcuaacccaggccgga

SEQ ID NO: 1729874 - RNA, 15 nt, Salmonella enterica enterica serovar Typhi Ty2
gucgcuggcggaauc

SEQ ID NO: 1729875 - RNA, 20 nt, Salmonella enterica enterica serovar Typhi Ty2
gucgcugcgcucaucaggcc

SEQ ID NO: 1729876 - RNA, 22 nt, Salmonella enterica enterica serovar Typhi Ty2
gucgcucuuuuuuuugcuuaaa

SEQ ID NO: 1729877 - RNA, 17 nt, Salmonella enterica enterica serovar Typhi Ty2
gucagauccuucauuca

SEQ ID NO: 1729878 - RNA, 20 nt, Salmonella enterica enterica serovar Typhi Ty2
gucccgccuuguucaauaga

SEQ ID NO: 1729879 - RNA, 16 nt, Salmonella enterica enterica serovar Typhi Ty2
guccgccuuugacgcc

SEQ ID NO: 1729880 - RNA, 17 nt, Salmonella enterica enterica serovar Typhi Ty2
guccggcccgcuaucac

SEQ ID NO: 1729881 - RNA, 18 nt, Salmonella enterica enterica serovar Typhi Ty2
guccgcuggcguccagcc

SEQ ID NO: 1729882 - RNA, 15 nt, Salmonella enterica enterica serovar Typhi Ty2
guccggaucucgcca

SEQ ID NO: 1729883 - RNA, 19 nt, Salmonella enterica enterica serovar Typhi Ty2
guccugcaaggcaucgucg

SEQ ID NO: 1729884 - RNA, 16 nt, Salmonella enterica enterica serovar Typhi Ty2
guccuccggcugaagc

SEQ ID NO: 1729885 - RNA, 16 nt, Salmonella enterica enterica serovar Typhi Ty2
guccugucccugccag

SEQ ID NO: 1729886 - RNA, 17 nt, Salmonella enterica enterica serovar Typhi Ty2
guccuugcgaagaccgc

SEQ ID NO: 1729887 - RNA, 21 nt, Salmonella enterica enterica serovar Typhi Ty2
guccugcggacgcagcucaua

SEQ ID NO: 1729888 - RNA, 23 nt, Salmonella enterica enterica serovar Typhi Ty2
gucgucugaaagcgacucaucca

SEQ ID NO: 1729889 - RNA, 14 nt, Salmonella enterica enterica serovar Typhi Ty2
gucguggcgaucag

SEQ ID NO: 1729890 - RNA, 21 nt, Salmonella enterica enterica serovar Typhi Ty2
gucguuccacacguccauccg

SEQ ID NO: 1729891 - RNA, 16 nt, Salmonella enterica enterica serovar Typhi Ty2
gucguuagccagaugg

SEQ ID NO: 1729892 - RNA, 17 nt, Salmonella enterica enterica serovar Typhi Ty2
gucuggauaccccgcac

SEQ ID NO: 1729893 - RNA, 15 nt, Salmonella enterica enterica serovar Typhi Ty2
gucucuacuacauau

SEQ ID NO: 1729894 - RNA, 21 nt, Salmonella enterica enterica serovar Typhi Ty2
gucuugccaugugccgcgaaa

SEQ ID NO: 1729895 - RNA, 15 nt, Salmonella enterica enterica serovar Typhi Ty2
gugacaucgccggag

SEQ ID NO: 1729896 - RNA, 14 nt, Salmonella enterica enterica serovar Typhi Ty2
gugaccccggccuc

SEQ ID NO: 1729897 - RNA, 19 nt, Salmonella enterica enterica serovar Typhi Ty2
gugaccacgguuaucuggc

SEQ ID NO: 1729898 - RNA, 15 nt, Salmonella enterica enterica serovar Typhi Ty2
gugacccgccgccag

SEQ ID NO: 1729899 - RNA, 17 nt, Salmonella enterica enterica serovar Typhi Ty2
gugaauaugacgggcaa

SEQ ID NO: 1729900 - RNA, 12 nt, Salmonella enterica enterica serovar Typhi Ty2
gucggcagcgag

SEQ ID NO: 1729901 - RNA, 21 nt, Salmonella enterica enterica serovar Typhi Ty2
gucgucauuugaaucugcggu

SEQ ID NO: 1729902 - RNA, 14 nt, Salmonella enterica enterica serovar Typhi Ty2
gucgucauggcgua

SEQ ID NO: 1729903 - RNA, 14 nt, Salmonella enterica enterica serovar Typhi Ty2
gucgucgaucgcgc

SEQ ID NO: 1729904 - RNA, 16 nt, Salmonella enterica enterica serovar Typhi Ty2
gucguaaauuccugca

SEQ ID NO: 1729905 - RNA, 19 nt, Salmonella enterica enterica serovar Typhi Ty2
gucguacucaccaguccgg

SEQ ID NO: 1729906 - RNA, 17 nt, Salmonella enterica enterica serovar Typhi Ty2
gucguacucuaggcgcu

SEQ ID NO: 1729907 - RNA, 20 nt, Salmonella enterica enterica serovar Typhi Ty2
gugcaauaucgcggcaaaga

SEQ ID NO: 1729908 - RNA, 13 nt, Salmonella enterica enterica serovar Typhi Ty2
gugcaaucagcga

SEQ ID NO: 1729909 - RNA, 21 nt, Salmonella enterica enterica serovar Typhi Ty2
gugacgaagaucgcguacagc

SEQ ID NO: 1729910 - RNA, 15 nt, Salmonella enterica enterica serovar Typhi Ty2
gugagaaacgcgcca

SEQ ID NO: 1729911 - RNA, 20 nt, Salmonella enterica enterica serovar Typhi Ty2
gugaggagcuuuagcuccga

SEQ ID NO: 1729912 - RNA, 16 nt, Salmonella enterica enterica serovar Typhi Ty2
gugacuaaaagacgcc

SEQ ID NO: 1729913 - RNA, 22 nt, Salmonella enterica enterica serovar Typhi Ty2
gugacgguaucgugacgcgaau

SEQ ID NO: 1729914 - RNA, 16 nt, Salmonella enterica enterica serovar Typhi Ty2
gugacgggcuggcgcu

SEQ ID NO: 1729915 - RNA, 13 nt, Salmonella enterica enterica serovar Typhi Ty2
gugccgucaucca

SEQ ID NO: 1729916 - RNA, 21 nt, Salmonella enterica enterica serovar Typhi Ty2
gugcgaguucaagucucgccu

SEQ ID NO: 1729917 - RNA, 23 nt, Salmonella enterica enterica serovar Typhi Ty2
gugccgaccagcgguugcauaaa

SEQ ID NO: 1729918 - RNA, 17 nt, Salmonella enterica enterica serovar Typhi Ty2
gugccgacaaccugccc

SEQ ID NO: 1729919 - RNA, 14 nt, Salmonella enterica enterica serovar Typhi Ty2
gugccaauggcgau

SEQ ID NO: 1729920 - RNA, 13 nt, Salmonella enterica enterica serovar Typhi Ty2
guaccacguuauc

SEQ ID NO: 1729921 - RNA, 16 nt, Salmonella enterica enterica serovar Typhi Ty2
guacauuauugcacau

SEQ ID NO: 1729922 - RNA, 23 nt, Salmonella enterica enterica serovar Typhi Ty2
guacacuucauccggcguugcgc

SEQ ID NO: 1729923 - RNA, 17 nt, Salmonella enterica enterica serovar Typhi Ty2
guacacuucauccggcg

SEQ ID NO: 1729924 - RNA, 14 nt, Salmonella enterica enterica serovar Typhi Ty2
guacacgcagucca

SEQ ID NO: 1729925 - RNA, 14 nt, Salmonella enterica enterica serovar Typhi Ty2
guacacuucagcca

SEQ ID NO: 1729926 - RNA, 15 nt, Salmonella enterica enterica serovar Typhi Ty2
guacacgaaauagcg

SEQ ID NO: 1729927 - RNA, 12 nt, Salmonella enterica enterica serovar Typhi Ty2
guaauugacgcg

SEQ ID NO: 1729928 - RNA, 18 nt, Salmonella enterica enterica serovar Typhi Ty2
guaaugucuggugcagca

SEQ ID NO: 1729929 - RNA, 14 nt, Salmonella enterica enterica serovar Typhi Ty2
guaaugacgcggaa

SEQ ID NO: 1729930 - RNA, 19 nt, Salmonella enterica enterica serovar Typhi Ty2
guaaugaccacaccgucaa

SEQ ID NO: 1729931 - RNA, 21 nt, Salmonella enterica enterica serovar Typhi Ty2
guaagaagaaccagcgcgaca

SEQ ID NO: 1729932 - RNA, 19 nt, Salmonella enterica enterica serovar Typhi Ty2
guaacucggcagcgcgaca

SEQ ID NO: 1729933 - RNA, 20 nt, Salmonella enterica enterica serovar Typhi Ty2
gguuguaucauguuccggca

SEQ ID NO: 1729934 - RNA, 16 nt, Salmonella enterica enterica serovar Typhi Ty2
guaaaggucgccgcau

SEQ ID NO: 1729935 - RNA, 20 nt, Salmonella enterica enterica serovar Typhi Ty2
guaaauaaaucagcgcggca

SEQ ID NO: 1729936 - RNA, 16 nt, Salmonella enterica enterica serovar Typhi Ty2
guaaaugacgccagac

SEQ ID NO: 1729937 - RNA, 16 nt, Salmonella enterica enterica serovar Typhi Ty2
guaaccuuuuuauggc

SEQ ID NO: 1729938 - RNA, 23 nt, Salmonella enterica enterica serovar Typhi Ty2
guaaauugaguggacaucgccau

SEQ ID NO: 1729939 - RNA, 20 nt, Salmonella enterica enterica serovar Typhi Ty2
guaacgccgugacggcguaa

SEQ ID NO: 1729940 - RNA, 17 nt, Salmonella enterica enterica serovar Typhi Ty2
gguuugagcaccacgcg

SEQ ID NO: 1729941 - RNA, 19 nt, Salmonella enterica enterica serovar Typhi Ty2
guaaaggcguagaucucua

SEQ ID NO: 1729942 - RNA, 16 nt, Salmonella enterica enterica serovar Typhi Ty2
gguuuuuaagcugccc

SEQ ID NO: 1729943 - RNA, 21 nt, Salmonella enterica enterica serovar Typhi Ty2
gguuuuccugaaucaguaucc

SEQ ID NO: 1729944 - RNA, 23 nt, Salmonella enterica enterica serovar Typhi Ty2
gguuaauaauuuuacccgcgcau

SEQ ID NO: 1729945 - RNA, 16 nt, Salmonella enterica enterica serovar Typhi Ty2
gguguuugcggcacac

SEQ ID NO: 1729946 - RNA, 14 nt, Salmonella enterica enterica serovar Typhi Ty2
gguuacucuuccac

SEQ ID NO: 1729947 - RNA, 20 nt, Salmonella enterica enterica serovar Typhi Ty2
gguuacgcagcuuaaagcca

SEQ ID NO: 1729948 - RNA, 14 nt, Salmonella enterica enterica serovar Typhi Ty2
ggugcguucugccg

SEQ ID NO: 1729949 - RNA, 18 nt, Salmonella enterica enterica serovar Typhi Ty2
ggugcugaauauuaucgg

SEQ ID NO: 1729950 - RNA, 21 nt, Salmonella enterica enterica serovar Typhi Ty2
ggugcucucccagcugagcua

SEQ ID NO: 1729951 - RNA, 17 nt, Salmonella enterica enterica serovar Typhi Ty2
gucacagauccagacau

SEQ ID NO: 1729952 - RNA, 13 nt, Salmonella enterica enterica serovar Typhi Ty2
gucacaauaacgc

SEQ ID NO: 1729953 - RNA, 19 nt, Salmonella enterica enterica serovar Typhi Ty2
gucacaauaucgagaugac

SEQ ID NO: 1729954 - RNA, 14 nt, Salmonella enterica enterica serovar Typhi Ty2
guaugcgauacccc

SEQ ID NO: 1729955 - RNA, 16 nt, Salmonella enterica enterica serovar Typhi Ty2
guaugcagugggccgg

SEQ ID NO: 1729956 - RNA, 16 nt, Salmonella enterica enterica serovar Typhi Ty2
gucaacacgcagaccc

SEQ ID NO: 1729957 - RNA, 16 nt, Salmonella enterica enterica serovar Typhi Ty2
gucaaauuaagaaagu

SEQ ID NO: 1729958 - RNA, 16 nt, Salmonella enterica enterica serovar Typhi Ty2
guaucacaaucagcca

SEQ ID NO: 1729959 - RNA, 10 nt, Salmonella enterica enterica serovar Typhi Ty2
guauaaagcu

SEQ ID NO: 1729960 - RNA, 13 nt, Salmonella enterica enterica serovar Typhi Ty2
guauaacucagcg

SEQ ID NO: 1729961 - RNA, 21 nt, Salmonella enterica enterica serovar Typhi Ty2
guauaaauuuccgcagccaga

SEQ ID NO: 1729962 - RNA, 12 nt, Salmonella enterica enterica serovar Typhi Ty2
guauaaaucacg

SEQ ID NO: 1729963 - RNA, 19 nt, Salmonella enterica enterica serovar Typhi Ty2
guauaauccaacauuauca

SEQ ID NO: 1729964 - RNA, 12 nt, Salmonella enterica enterica serovar Typhi Ty2
guauccgccaua

SEQ ID NO: 1729965 - RNA, 17 nt, Salmonella enterica enterica serovar Typhi Ty2
guaugacguggccagca

SEQ ID NO: 1729966 - RNA, 17 nt, Salmonella enterica enterica serovar Typhi Ty2
guaguggaucagcagau

SEQ ID NO: 1729967 - RNA, 22 nt, Salmonella enterica enterica serovar Typhi Ty2
guagugccggauggcggcgaaa

SEQ ID NO: 1729968 - RNA, 14 nt, Salmonella enterica enterica serovar Typhi Ty2
guaguaaaccgguu

SEQ ID NO: 1729969 - RNA, 16 nt, Salmonella enterica enterica serovar Typhi Ty2
guagcugcgccugaaa

SEQ ID NO: 1729970 - RNA, 16 nt, Salmonella enterica enterica serovar Typhi Ty2
guagcuugaaagcgca

SEQ ID NO: 1729971 - RNA, 14 nt, Salmonella enterica enterica serovar Typhi Ty2
guagcgcguucagg

SEQ ID NO: 1729972 - RNA, 14 nt, Salmonella enterica enterica serovar Typhi Ty2
guagcgccauccgg

SEQ ID NO: 1729973 - RNA, 19 nt, Salmonella enterica enterica serovar Typhi Ty2
guagcgccaucaggcauaa

SEQ ID NO: 1729974 - RNA, 16 nt, Salmonella enterica enterica serovar Typhi Ty2
guagcgagaaggcuuu

SEQ ID NO: 1729975 - RNA, 19 nt, Salmonella enterica enterica serovar Typhi Ty2
guagcagacagccgaucag

SEQ ID NO: 1729976 - RNA, 17 nt, Salmonella enterica enterica serovar Typhi Ty2
guacguccauccgccgg

SEQ ID NO: 1729977 - RNA, 17 nt, Salmonella enterica enterica serovar Typhi Ty2
guacgcgcgcggcguca

SEQ ID NO: 1729978 - RNA, 14 nt, Salmonella enterica enterica serovar Typhi Ty2
guacgcaagcguaa

SEQ ID NO: 1729979 - RNA, 22 nt, Salmonella enterica enterica serovar Typhi Ty2
guacgaucugacugaucgaucc

SEQ ID NO: 1729980 - RNA, 22 nt, Salmonella enterica enterica serovar Typhi Ty2
guacgcaggcgacuggcguccg

SEQ ID NO: 1729981 - RNA, 18 nt, Salmonella enterica enterica serovar Typhi Ty2
guaccgcuacgcaggcca

SEQ ID NO: 1729982 - RNA, 20 nt, Salmonella enterica enterica serovar Typhi Ty2
guaccgccuuguccggccua

SEQ ID NO: 1729983 - RNA, 17 nt, Salmonella enterica enterica serovar Typhi Ty2
guaccggcgcucagcca

SEQ ID NO: 1729984 - RNA, 14 nt, Salmonella enterica enterica serovar Typhi Ty2
guaccgaacagcca

SEQ ID NO: 1729985 - RNA, 15 nt, Salmonella enterica enterica serovar Typhi Ty2
ggguggcgcuagcgc

SEQ ID NO: 1729986 - RNA, 20 nt, Salmonella enterica enterica serovar Typhi Ty2
gggugaugacgcgcaggccg

SEQ ID NO: 1729987 - RNA, 22 nt, Salmonella enterica enterica serovar Typhi Ty2
gggugcaaauccaucucaggcc

SEQ ID NO: 1729988 - RNA, 17 nt, Salmonella enterica enterica serovar Typhi Ty2
gguaauagcccucgccg

SEQ ID NO: 1729989 - RNA, 19 nt, Salmonella enterica enterica serovar Typhi Ty2
gguaaggcguagccgccac

SEQ ID NO: 1729990 - RNA, 17 nt, Salmonella enterica enterica serovar Typhi Ty2
gguaacgccuucgcaaa

SEQ ID NO: 1729991 - RNA, 17 nt, Salmonella enterica enterica serovar Typhi Ty2
gguacaggccgccgccu

SEQ ID NO: 1729992 - RNA, 20 nt, Salmonella enterica enterica serovar Typhi Ty2
gguaauuuugccaucgcgca

SEQ ID NO: 1729993 - RNA, 18 nt, Salmonella enterica enterica serovar Typhi Ty2
gguaauuuugccaucgcg

SEQ ID NO: 1729994 - RNA, 12 nt, Salmonella enterica enterica serovar Typhi Ty2
ggguuuuccggu

SEQ ID NO: 1729995 - RNA, 18 nt, Salmonella enterica enterica serovar Typhi Ty2
gguaaaaagcuccggacg

SEQ ID NO: 1729996 - RNA, 13 nt, Salmonella enterica enterica serovar Typhi Ty2
ggguuauuuccgc

SEQ ID NO: 1729997 - RNA, 20 nt, Salmonella enterica enterica serovar Typhi Ty2
ggucagauccuuuuucugcg

SEQ ID NO: 1729998 - RNA, 15 nt, Salmonella enterica enterica serovar Typhi Ty2
ggucagaaauccgcg

SEQ ID NO: 1729999 - RNA, 14 nt, Salmonella enterica enterica serovar Typhi Ty2
gguauuacaugccg

SEQ ID NO: 1730000 - RNA, 23 nt, Salmonella enterica enterica serovar Typhi Ty2
gguauugaauccggguuccugca

SEQ ID NO: 1730001 - RNA, 17 nt, Salmonella enterica enterica serovar Typhi Ty2
ggucaacgcgccgccaa

SEQ ID NO: 1730002 - RNA, 19 nt, Salmonella enterica enterica serovar Typhi Ty2
gguaccgggcugucaucga

SEQ ID NO: 1730003 - RNA, 22 nt, Salmonella enterica enterica serovar Typhi Ty2
gguacguuaaccggaucggcca

SEQ ID NO: 1730004 - RNA, 14 nt, Salmonella enterica enterica serovar Typhi Ty2
gguagccaggcgcg

SEQ ID NO: 1730005 - RNA, 12 nt, Salmonella enterica enterica serovar Typhi Ty2
gguagucaucgc

SEQ ID NO: 1730006 - RNA, 15 nt, Salmonella enterica enterica serovar Typhi Ty2
ggucgucuucuugcg

SEQ ID NO: 1730007 - RNA, 22 nt, Salmonella enterica enterica serovar Typhi Ty2
ggugacgaagaucgcguacagc

SEQ ID NO: 1730008 - RNA, 19 nt, Salmonella enterica enterica serovar Typhi Ty2
ggucauacugugcgugaug

SEQ ID NO: 1730009 - RNA, 15 nt, Salmonella enterica enterica serovar Typhi Ty2
ggucgcucuggucga

SEQ ID NO: 1730010 - RNA, 14 nt, Salmonella enterica enterica serovar Typhi Ty2
ggucgcuauccagc

SEQ ID NO: 1730011 - RNA, 21 nt, Salmonella enterica enterica serovar Typhi Ty2
ggucgagcuuuugcugcgcca

SEQ ID NO: 1730012 - RNA, 18 nt, Salmonella enterica enterica serovar Typhi Ty2
ggucgagcuuuugcugcg

SEQ ID NO: 1730013 - RNA, 19 nt, Salmonella enterica enterica serovar Typhi Ty2
ggucgacagccacacgcca

SEQ ID NO: 1730014 - RNA, 21 nt, Salmonella enterica enterica serovar Typhi Ty2
ggccugcauuugcuggcguga

SEQ ID NO: 1730015 - RNA, 14 nt, Salmonella enterica enterica serovar Typhi Ty2
ggccugcagagcgg

SEQ ID NO: 1730016 - RNA, 15 nt, Salmonella enterica enterica serovar Typhi Ty2
ggccugcgcuggaac

SEQ ID NO: 1730017 - RNA, 12 nt, Salmonella enterica enterica serovar Typhi Ty2
ggccucaucggg

SEQ ID NO: 1730018 - RNA, 21 nt, Salmonella enterica enterica serovar Typhi Ty2
ggcgaaagcacuucucgcgca

SEQ ID NO: 1730019 - RNA, 22 nt, Salmonella enterica enterica serovar Typhi Ty2
ggcgaaagaaaauuguccacgg

SEQ ID NO: 1730020 - RNA, 17 nt, Salmonella enterica enterica serovar Typhi Ty2
ggccuuuuuccgucagc

SEQ ID NO: 1730021 - RNA, 13 nt, Salmonella enterica enterica serovar Typhi Ty2
ggcgaaauagcgu

SEQ ID NO: 1730022 - RNA, 18 nt, Salmonella enterica enterica serovar Typhi Ty2
ggcgaaccggcaucggca

SEQ ID NO: 1730023 - RNA, 13 nt, Salmonella enterica enterica serovar Typhi Ty2
ggccugucaggcc

SEQ ID NO: 1730024 - RNA, 20 nt, Salmonella enterica enterica serovar Typhi Ty2
ggcgaaaaccgagcauccgc

SEQ ID NO: 1730025 - RNA, 18 nt, Salmonella enterica enterica serovar Typhi Ty2
ggcgaacuucauccacgc

SEQ ID NO: 1730026 - RNA, 21 nt, Salmonella enterica enterica serovar Typhi Ty2
ggccgcuuugcgaacagcgca

SEQ ID NO: 1730027 - RNA, 23 nt, Salmonella enterica enterica serovar Typhi Ty2
ggccggaaaggauauaagcgcca

SEQ ID NO: 1730028 - RNA, 15 nt, Salmonella enterica enterica serovar Typhi Ty2
ggccggaugagcguu

SEQ ID NO: 1730029 - RNA, 22 nt, Salmonella enterica enterica serovar Typhi Ty2
ggccggaugagcguuagcgcca

SEQ ID NO: 1730030 - RNA, 15 nt, Salmonella enterica enterica serovar Typhi Ty2
ggccaggcgaccguc

SEQ ID NO: 1730031 - RNA, 16 nt, Salmonella enterica enterica serovar Typhi Ty2
ggcccaggcaucgacg

SEQ ID NO: 1730032 - RNA, 15 nt, Salmonella enterica enterica serovar Typhi Ty2
ggcccggguaaugcu

SEQ ID NO: 1730033 - RNA, 13 nt, Salmonella enterica enterica serovar Typhi Ty2
ggccgcagcgcca

SEQ ID NO: 1730034 - RNA, 12 nt, Salmonella enterica enterica serovar Typhi Ty2
ggccgcaucggg

SEQ ID NO: 1730035 - RNA, 20 nt, Salmonella enterica enterica serovar Typhi Ty2
ggauguuaauuucaucgccg

SEQ ID NO: 1730036 - RNA, 22 nt, Salmonella enterica enterica serovar Typhi Ty2
ggauuaucaggaugaauaugaa

SEQ ID NO: 1730037 - RNA, 17 nt, Salmonella enterica enterica serovar Typhi Ty2
ggcaaaccccggacaca

SEQ ID NO: 1730038 - RNA, 18 nt, Salmonella enterica enterica serovar Typhi Ty2
ggauuuccuggcaguuca

SEQ ID NO: 1730039 - RNA, 19 nt, Salmonella enterica enterica serovar Typhi Ty2
ggcaacccuuuggccacca

SEQ ID NO: 1730040 - RNA, 19 nt, Salmonella enterica enterica serovar Typhi Ty2
ggcaaguuuaauuccgaau

SEQ ID NO: 1730041 - RNA, 14 nt, Salmonella enterica enterica serovar Typhi Ty2
ggcaagcgccagca

SEQ ID NO: 1730042 - RNA, 12 nt, Salmonella enterica enterica serovar Typhi Ty2
ggcaagcucagc

SEQ ID NO: 1730043 - RNA, 16 nt, Salmonella enterica enterica serovar Typhi Ty2
ggcaagcucagcggca

SEQ ID NO: 1730044 - RNA, 18 nt, Salmonella enterica enterica serovar Typhi Ty2
ggcaagacccgaaccugc

SEQ ID NO: 1730045 - RNA, 12 nt, Salmonella enterica enterica serovar Typhi Ty2
ggcaauuuccgc

SEQ ID NO: 1730046 - RNA, 19 nt, Salmonella enterica enterica serovar Typhi Ty2
ggcaauuugauagcgccac

SEQ ID NO: 1730047 - RNA, 13 nt, Salmonella enterica enterica serovar Typhi Ty2
ggcacacagcacu

SEQ ID NO: 1730048 - RNA, 23 nt, Salmonella enterica enterica serovar Typhi Ty2
ggcaauuaacauuucacgauacu

SEQ ID NO: 1730049 - RNA, 20 nt, Salmonella enterica enterica serovar Typhi Ty2
ggcaaucgcuuccagcgccg

SEQ ID NO: 1730050 - RNA, 22 nt, Salmonella enterica enterica serovar Typhi Ty2
ggcaaugauuagauagauauuu

SEQ ID NO: 1730051 - RNA, 15 nt, Salmonella enterica enterica serovar Typhi Ty2
ggcacgauaaauugc

SEQ ID NO: 1730052 - RNA, 17 nt, Salmonella enterica enterica serovar Typhi Ty2
ggcacgauaaccagauc

SEQ ID NO: 1730053 - RNA, 14 nt, Salmonella enterica enterica serovar Typhi Ty2
ggcacgccaucgcc

SEQ ID NO: 1730054 - RNA, 15 nt, Salmonella enterica enterica serovar Typhi Ty2
ggcagacaugaccgc

SEQ ID NO: 1730055 - RNA, 21 nt, Salmonella enterica enterica serovar Typhi Ty2
ggcagcgcgccgcccuguaac

SEQ ID NO: 1730056 - RNA, 22 nt, Salmonella enterica enterica serovar Typhi Ty2
ggcagaauuaacucaucacagc

SEQ ID NO: 1730057 - RNA, 12 nt, Salmonella enterica enterica serovar Typhi Ty2
ggcagcgucagg

SEQ ID NO: 1730058 - RNA, 16 nt, Salmonella enterica enterica serovar Typhi Ty2
ggcaggcuuccacgca

SEQ ID NO: 1730059 - RNA, 17 nt, Salmonella enterica enterica serovar Typhi Ty2
ggcauuggcguuaccgg

SEQ ID NO: 1730060 - RNA, 24 nt, Salmonella enterica enterica serovar Typhi Ty2
ggcaugcgccccguuuccgcgacg

SEQ ID NO: 1730061 - RNA, 13 nt, Salmonella enterica enterica serovar Typhi Ty2
ggcaugaugccac

SEQ ID NO: 1730062 - RNA, 23 nt, Salmonella enterica enterica serovar Typhi Ty2
ggcaucugaacacgccgacucac

SEQ ID NO: 1730063 - RNA, 17 nt, Salmonella enterica enterica serovar Typhi Ty2
ggcaucuucagacaguu

SEQ ID NO: 1730064 - RNA, 16 nt, Salmonella enterica enterica serovar Typhi Ty2
ggcaguacgcacguuu

SEQ ID NO: 1730065 - RNA, 20 nt, Salmonella enterica enterica serovar Typhi Ty2
ggcauccgugaccugcugac

SEQ ID NO: 1730066 - RNA, 11 nt, Salmonella enterica enterica serovar Typhi Ty2
ggccagcacaa

SEQ ID NO: 1730067 - RNA, 18 nt, Salmonella enterica enterica serovar Typhi Ty2
ggcauuuaugccgccauc

SEQ ID NO: 1730068 - RNA, 14 nt, Salmonella enterica enterica serovar Typhi Ty2
ggcauuucaaucgc

SEQ ID NO: 1730069 - RNA, 21 nt, Salmonella enterica enterica serovar Typhi Ty2
ggcauuuuuauuuaacgccag

SEQ ID NO: 1730070 - RNA, 12 nt, Salmonella enterica enterica serovar Typhi Ty2
ggcgcguccagc

SEQ ID NO: 1730071 - RNA, 13 nt, Salmonella enterica enterica serovar Typhi Ty2
ggcgccuuguccg

SEQ ID NO: 1730072 - RNA, 20 nt, Salmonella enterica enterica serovar Typhi Ty2
ggcgcgacgcuuaucagccc

SEQ ID NO: 1730073 - RNA, 13 nt, Salmonella enterica enterica serovar Typhi Ty2
ggcgcuuuaccgg

SEQ ID NO: 1730074 - RNA, 14 nt, Salmonella enterica enterica serovar Typhi Ty2
ggcgcuuccugcag

SEQ ID NO: 1730075 - RNA, 18 nt, Salmonella enterica enterica serovar Typhi Ty2
ggcgcuguuuuuacgcca

SEQ ID NO: 1730076 - RNA, 16 nt, Salmonella enterica enterica serovar Typhi Ty2
ggcgcuucgcuuacca

SEQ ID NO: 1730077 - RNA, 13 nt, Salmonella enterica enterica serovar Typhi Ty2
ggcgcuccugaau

SEQ ID NO: 1730078 - RNA, 18 nt, Salmonella enterica enterica serovar Typhi Ty2
ggcgcugcgcuuaucagg

SEQ ID NO: 1730079 - RNA, 19 nt, Salmonella enterica enterica serovar Typhi Ty2
ggcgcugcgcuuaucaggc

SEQ ID NO: 1730080 - RNA, 19 nt, Salmonella enterica enterica serovar Typhi Ty2
ggcgcugcguuuaucaggc

SEQ ID NO: 1730081 - RNA, 18 nt, Salmonella enterica enterica serovar Typhi Ty2
ggcgcucacgcugacagg

SEQ ID NO: 1730082 - RNA, 15 nt, Salmonella enterica enterica serovar Typhi Ty2
ggcgguauuauccgc

SEQ ID NO: 1730083 - RNA, 14 nt, Salmonella enterica enterica serovar Typhi Ty2
ggcgguauuauccg

SEQ ID NO: 1730084 - RNA, 18 nt, Salmonella enterica enterica serovar Typhi Ty2
ggcgggugcgcagcccca

SEQ ID NO: 1730085 - RNA, 20 nt, Salmonella enterica enterica serovar Typhi Ty2
ggcggcugcgccuuauccgg

SEQ ID NO: 1730086 - RNA, 20 nt, Salmonella enterica enterica serovar Typhi Ty2
ggcggcuggcgccuuaccgg

SEQ ID NO: 1730087 - RNA, 21 nt, Salmonella enterica enterica serovar Typhi Ty2
ggcgccauuggcucggcguca

SEQ ID NO: 1730088 - RNA, 14 nt, Salmonella enterica enterica serovar Typhi Ty2
ggcgccaucaccau

SEQ ID NO: 1730089 - RNA, 14 nt, Salmonella enterica enterica serovar Typhi Ty2
ggcgccaucgccuc

SEQ ID NO: 1730090 - RNA, 17 nt, Salmonella enterica enterica serovar Typhi Ty2
ggcgccagcucaucggg

SEQ ID NO: 1730091 - RNA, 23 nt, Salmonella enterica enterica serovar Typhi Ty2
ggcgccagagagcguuucuacgc

SEQ ID NO: 1730092 - RNA, 14 nt, Salmonella enterica enterica serovar Typhi Ty2
ggcgcauaucgccc

SEQ ID NO: 1730093 - RNA, 21 nt, Salmonella enterica enterica serovar Typhi Ty2
ggcgcaguuuacgcagcgccu

SEQ ID NO: 1730094 - RNA, 18 nt, Salmonella enterica enterica serovar Typhi Ty2
ggcgcaguucgccgccag

SEQ ID NO: 1730095 - RNA, 22 nt, Salmonella enterica enterica serovar Typhi Ty2
ggcgcaguccagaugcgccaga

SEQ ID NO: 1730096 - RNA, 17 nt, Salmonella enterica enterica serovar Typhi Ty2
ggcgacaaacagcgccc

SEQ ID NO: 1730097 - RNA, 19 nt, Salmonella enterica enterica serovar Typhi Ty2
ggcgaauuguggucgaucc

SEQ ID NO: 1730098 - RNA, 17 nt, Salmonella enterica enterica serovar Typhi Ty2
ggcgaauuuaugccggu

SEQ ID NO: 1730099 - RNA, 16 nt, Salmonella enterica enterica serovar Typhi Ty2
ggcgauguucuugccg

SEQ ID NO: 1730100 - RNA, 21 nt, Salmonella enterica enterica serovar Typhi Ty2
ggcgauuacaacgcgaugguc

SEQ ID NO: 1730101 - RNA, 15 nt, Salmonella enterica enterica serovar Typhi Ty2
ggcgcaaaucgccau

SEQ ID NO: 1730102 - RNA, 12 nt, Salmonella enterica enterica serovar Typhi Ty2
ggcgcaaccggc

SEQ ID NO: 1730103 - RNA, 18 nt, Salmonella enterica enterica serovar Typhi Ty2
ggcuggagagcaacgcca

SEQ ID NO: 1730104 - RNA, 22 nt, Salmonella enterica enterica serovar Typhi Ty2
ggcugcugauggucuuaaugcu

SEQ ID NO: 1730105 - RNA, 18 nt, Salmonella enterica enterica serovar Typhi Ty2
ggcuggcgucgccaaagc

SEQ ID NO: 1730106 - RNA, 14 nt, Salmonella enterica enterica serovar Typhi Ty2
ggcuggcugcugau

SEQ ID NO: 1730107 - RNA, 20 nt, Salmonella enterica enterica serovar Typhi Ty2
ggcugcgccuuaucaagccu

SEQ ID NO: 1730108 - RNA, 11 nt, Salmonella enterica enterica serovar Typhi Ty2
ggcugcguaac

SEQ ID NO: 1730109 - RNA, 23 nt, Salmonella enterica enterica serovar Typhi Ty2
ggcugcgugauuuuggccucauc

SEQ ID NO: 1730110 - RNA, 22 nt, Salmonella enterica enterica serovar Typhi Ty2
ggcugcgauaaugaagcauaaa

SEQ ID NO: 1730111 - RNA, 14 nt, Salmonella enterica enterica serovar Typhi Ty2
ggcugccaucaggc

SEQ ID NO: 1730112 - RNA, 15 nt, Salmonella enterica enterica serovar Typhi Ty2
ggcugccacacguca

SEQ ID NO: 1730113 - RNA, 18 nt, Salmonella enterica enterica serovar Typhi Ty2
ggcugccauuaucaccau

SEQ ID NO: 1730114 - RNA, 19 nt, Salmonella enterica enterica serovar Typhi Ty2
ggcugcacgccaucggcua

SEQ ID NO: 1730115 - RNA, 15 nt, Salmonella enterica enterica serovar Typhi Ty2
ggcugagaaucaccu

SEQ ID NO: 1730116 - RNA, 22 nt, Salmonella enterica enterica serovar Typhi Ty2
ggcugacugaauuuucagccau

SEQ ID NO: 1730117 - RNA, 17 nt, Salmonella enterica enterica serovar Typhi Ty2
ggcucccacucuuccag

SEQ ID NO: 1730118 - RNA, 16 nt, Salmonella enterica enterica serovar Typhi Ty2
ggcugaaaucacgcca

SEQ ID NO: 1730119 - RNA, 13 nt, Salmonella enterica enterica serovar Typhi Ty2
ggcugaacgccag

SEQ ID NO: 1730120 - RNA, 18 nt, Salmonella enterica enterica serovar Typhi Ty2
ggcugaccgcuuucccgg

SEQ ID NO: 1730121 - RNA, 15 nt, Salmonella enterica enterica serovar Typhi Ty2
ggcggucgggaacgc

SEQ ID NO: 1730122 - RNA, 22 nt, Salmonella enterica enterica serovar Typhi Ty2
ggcgucuaccuggguagcgcca

SEQ ID NO: 1730123 - RNA, 15 nt, Salmonella enterica enterica serovar Typhi Ty2
ggcgucgcggcaaua

SEQ ID NO: 1730124 - RNA, 17 nt, Salmonella enterica enterica serovar Typhi Ty2
ggcguuccuuaucagca

SEQ ID NO: 1730125 - RNA, 14 nt, Salmonella enterica enterica serovar Typhi Ty2
ggcguuccuuauca

SEQ ID NO: 1730126 - RNA, 12 nt, Salmonella enterica enterica serovar Typhi Ty2
ggcguucucccg

SEQ ID NO: 1730127 - RNA, 18 nt, Salmonella enterica enterica serovar Typhi Ty2
ggcucaaaguuaccggca

SEQ ID NO: 1730128 - RNA, 20 nt, Salmonella enterica enterica serovar Typhi Ty2
ggcuauuuuuugcuggcggc

SEQ ID NO: 1730129 - RNA, 20 nt, Salmonella enterica enterica serovar Typhi Ty2
ggcguuuucauuagccgcca

SEQ ID NO: 1730130 - RNA, 18 nt, Salmonella enterica enterica serovar Typhi Ty2
ggcuagcgccuuauccgg

SEQ ID NO: 1730131 - RNA, 18 nt, Salmonella enterica enterica serovar Typhi Ty2
gggcgacaccgcaaaccg

SEQ ID NO: 1730132 - RNA, 12 nt, Salmonella enterica enterica serovar Typhi Ty2
gggcgcuggcgu

SEQ ID NO: 1730133 - RNA, 16 nt, Salmonella enterica enterica serovar Typhi Ty2
ggcuguaccuuaaccg

SEQ ID NO: 1730134 - RNA, 17 nt, Salmonella enterica enterica serovar Typhi Ty2
ggcuguaccuuaaccgg

SEQ ID NO: 1730135 - RNA, 22 nt, Salmonella enterica enterica serovar Typhi Ty2
ggcuugguugacgugaaccguc

SEQ ID NO: 1730136 - RNA, 13 nt, Salmonella enterica enterica serovar Typhi Ty2
ggcuugaucaacg

SEQ ID NO: 1730137 - RNA, 20 nt, Salmonella enterica enterica serovar Typhi Ty2
ggcuugaucgcgcagcaaau

SEQ ID NO: 1730138 - RNA, 17 nt, Salmonella enterica enterica serovar Typhi Ty2
gggaaaccauguugauc

SEQ ID NO: 1730139 - RNA, 18 nt, Salmonella enterica enterica serovar Typhi Ty2
ggcuuuuuucuccaguug

SEQ ID NO: 1730140 - RNA, 16 nt, Salmonella enterica enterica serovar Typhi Ty2
ggcuuuuuuucaacug

SEQ ID NO: 1730141 - RNA, 22 nt, Salmonella enterica enterica serovar Typhi Ty2
gggaaacgcuauuuaacccugg

SEQ ID NO: 1730142 - RNA, 14 nt, Salmonella enterica enterica serovar Typhi Ty2
gggaaucgcgauuc

SEQ ID NO: 1730143 - RNA, 19 nt, Salmonella enterica enterica serovar Typhi Ty2
ggcuuuacgaccgcagaaa

SEQ ID NO: 1730144 - RNA, 12 nt, Salmonella enterica enterica serovar Typhi Ty2
ggcuuuaaagca

SEQ ID NO: 1730145 - RNA, 21 nt, Salmonella enterica enterica serovar Typhi Ty2
ggcuuguuaugcggaucggcg

SEQ ID NO: 1730146 - RNA, 14 nt, Salmonella enterica enterica serovar Typhi Ty2
ggcuuuguaucagc

SEQ ID NO: 1730147 - RNA, 21 nt, Salmonella enterica enterica serovar Typhi Ty2
gggauuucuucccuugccgcc

SEQ ID NO: 1730148 - RNA, 19 nt, Salmonella enterica enterica serovar Typhi Ty2
gggauuuccuggcaguuca

SEQ ID NO: 1730149 - RNA, 13 nt, Salmonella enterica enterica serovar Typhi Ty2
gggcaaaaaacgg

SEQ ID NO: 1730150 - RNA, 22 nt, Salmonella enterica enterica serovar Typhi Ty2
cucucauagccgacccgcaucg

SEQ ID NO: 1730151 - RNA, 14 nt, Salmonella enterica enterica serovar Typhi Ty2
cucguucaacggca

SEQ ID NO: 1730152 - RNA, 19 nt, Salmonella enterica enterica serovar Typhi Ty2
cucuccgguugcugauaac

SEQ ID NO: 1730153 - RNA, 14 nt, Salmonella enterica enterica serovar Typhi Ty2
cucuucaguaacca

SEQ ID NO: 1730154 - RNA, 14 nt, Salmonella enterica enterica serovar Typhi Ty2
cucuucaguaagcg

SEQ ID NO: 1730155 - RNA, 18 nt, Salmonella enterica enterica serovar Typhi Ty2
cucugucgaccaucgcau

SEQ ID NO: 1730156 - RNA, 16 nt, Salmonella enterica enterica serovar Typhi Ty2
cucuucgugacccgcc

SEQ ID NO: 1730157 - RNA, 15 nt, Salmonella enterica enterica serovar Typhi Ty2
cucuucguucauccg

SEQ ID NO: 1730158 - RNA, 14 nt, Salmonella enterica enterica serovar Typhi Ty2
cucuucuuugcgcg

SEQ ID NO: 1730159 - RNA, 12 nt, Salmonella enterica enterica serovar Typhi Ty2
cugaaacgggaa

SEQ ID NO: 1730160 - RNA, 22 nt, Salmonella enterica enterica serovar Typhi Ty2
cugaaaacggcaucaagcccau

SEQ ID NO: 1730161 - RNA, 22 nt, Salmonella enterica enterica serovar Typhi Ty2
cucuucuuccggcgauagcggc

SEQ ID NO: 1730162 - RNA, 21 nt, Salmonella enterica enterica serovar Typhi Ty2
cucgucauagugagcgacuuc

SEQ ID NO: 1730163 - RNA, 13 nt, Salmonella enterica enterica serovar Typhi Ty2
cucgggcgucgcg

SEQ ID NO: 1730164 - RNA, 17 nt, Salmonella enterica enterica serovar Typhi Ty2
cugauaacgugcgcgug

SEQ ID NO: 1730165 - RNA, 23 nt, Salmonella enterica enterica serovar Typhi Ty2
cugauacuuauuacgguaucagc

SEQ ID NO: 1730166 - RNA, 16 nt, Salmonella enterica enterica serovar Typhi Ty2
cugauacugcuccggc

SEQ ID NO: 1730167 - RNA, 17 nt, Salmonella enterica enterica serovar Typhi Ty2
cugaugcguauccagcg

SEQ ID NO: 1730168 - RNA, 17 nt, Salmonella enterica enterica serovar Typhi Ty2
cugauaagcauagcgcc

SEQ ID NO: 1730169 - RNA, 19 nt, Salmonella enterica enterica serovar Typhi Ty2
cugauaaaagagagcgcca

SEQ ID NO: 1730170 - RNA, 13 nt, Salmonella enterica enterica serovar Typhi Ty2
cugaguauagagc

SEQ ID NO: 1730171 - RNA, 21 nt, Salmonella enterica enterica serovar Typhi Ty2
cugaguaaugaucauaccggc

SEQ ID NO: 1730172 - RNA, 15 nt, Salmonella enterica enterica serovar Typhi Ty2
cugcacaagaaacau

SEQ ID NO: 1730173 - RNA, 20 nt, Salmonella enterica enterica serovar Typhi Ty2
cugcaauauaugcgccguug

SEQ ID NO: 1730174 - RNA, 19 nt, Salmonella enterica enterica serovar Typhi Ty2
cugauuaauaugaaccaau

SEQ ID NO: 1730175 - RNA, 23 nt, Salmonella enterica enterica serovar Typhi Ty2
cugauggcgcugcgcuuaucagg

SEQ ID NO: 1730176 - RNA, 17 nt, Salmonella enterica enterica serovar Typhi Ty2
cugauguaccugcguua

SEQ ID NO: 1730177 - RNA, 17 nt, Salmonella enterica enterica serovar Typhi Ty2
cugacgcagcuucugau

SEQ ID NO: 1730178 - RNA, 20 nt, Salmonella enterica enterica serovar Typhi Ty2
cugacgcgcagcgauauagc

SEQ ID NO: 1730179 - RNA, 17 nt, Salmonella enterica enterica serovar Typhi Ty2
cugacgcccaucagcau

SEQ ID NO: 1730180 - RNA, 19 nt, Salmonella enterica enterica serovar Typhi Ty2
cugaagcgcaguguuaauc

SEQ ID NO: 1730181 - RNA, 20 nt, Salmonella enterica enterica serovar Typhi Ty2
cugaagcguaacagcgcuau

SEQ ID NO: 1730182 - RNA, 15 nt, Salmonella enterica enterica serovar Typhi Ty2
cugacuaucuggaua

SEQ ID NO: 1730183 - RNA, 22 nt, Salmonella enterica enterica serovar Typhi Ty2
cugacugccguauaauccagcu

SEQ ID NO: 1730184 - RNA, 17 nt, Salmonella enterica enterica serovar Typhi Ty2
cugacgcggacgccacc

SEQ ID NO: 1730185 - RNA, 22 nt, Salmonella enterica enterica serovar Typhi Ty2
cugagaugaaaucuacaggucg

SEQ ID NO: 1730186 - RNA, 19 nt, Salmonella enterica enterica serovar Typhi Ty2
cugagacucagcagcgcau

SEQ ID NO: 1730187 - RNA, 13 nt, Salmonella enterica enterica serovar Typhi Ty2
cugagaaggucag

SEQ ID NO: 1730188 - RNA, 20 nt, Salmonella enterica enterica serovar Typhi Ty2
cugagaaaaauacgccagau

SEQ ID NO: 1730189 - RNA, 23 nt, Salmonella enterica enterica serovar Typhi Ty2
cuccgguaaucaccagaucggca

SEQ ID NO: 1730190 - RNA, 14 nt, Salmonella enterica enterica serovar Typhi Ty2
cuccgguugcugau

SEQ ID NO: 1730191 - RNA, 18 nt, Salmonella enterica enterica serovar Typhi Ty2
cuccucagcgcuuaccac

SEQ ID NO: 1730192 - RNA, 14 nt, Salmonella enterica enterica serovar Typhi Ty2
cuccucuuccgaca

SEQ ID NO: 1730193 - RNA, 18 nt, Salmonella enterica enterica serovar Typhi Ty2
cuccugccgaugccgccg

SEQ ID NO: 1730194 - RNA, 15 nt, Salmonella enterica enterica serovar Typhi Ty2
cuccugcgauagcug

SEQ ID NO: 1730195 - RNA, 16 nt, Salmonella enterica enterica serovar Typhi Ty2
cucgauaacuuucggg

SEQ ID NO: 1730196 - RNA, 22 nt, Salmonella enterica enterica serovar Typhi Ty2
cucgauaauauccgacgccugu

SEQ ID NO: 1730197 - RNA, 15 nt, Salmonella enterica enterica serovar Typhi Ty2
cucgccgucggcaga

SEQ ID NO: 1730198 - RNA, 20 nt, Salmonella enterica enterica serovar Typhi Ty2
cucgcggcagauaucgcuga

SEQ ID NO: 1730199 - RNA, 16 nt, Salmonella enterica enterica serovar Typhi Ty2
cucgcuguucgccaga

SEQ ID NO: 1730200 - RNA, 20 nt, Salmonella enterica enterica serovar Typhi Ty2
cuccaguuguuccagcagcu

SEQ ID NO: 1730201 - RNA, 16 nt, Salmonella enterica enterica serovar Typhi Ty2
cucccaggcgcgcagc

SEQ ID NO: 1730202 - RNA, 18 nt, Salmonella enterica enterica serovar Typhi Ty2
cucauaacggcuacgcag

SEQ ID NO: 1730203 - RNA, 13 nt, Salmonella enterica enterica serovar Typhi Ty2
cucaucagaccgu

SEQ ID NO: 1730204 - RNA, 17 nt, Salmonella enterica enterica serovar Typhi Ty2
cucaucaaacagggcgu

SEQ ID NO: 1730205 - RNA, 14 nt, Salmonella enterica enterica serovar Typhi Ty2
cucaucagcgccau

SEQ ID NO: 1730206 - RNA, 18 nt, Salmonella enterica enterica serovar Typhi Ty2
cucauuugcggcgucgcc

SEQ ID NO: 1730207 - RNA, 21 nt, Salmonella enterica enterica serovar Typhi Ty2
cuccaccauaucgcagaccau

SEQ ID NO: 1730208 - RNA, 22 nt, Salmonella enterica enterica serovar Typhi Ty2
cucagccaggucugcaccacgg

SEQ ID NO: 1730209 - RNA, 18 nt, Salmonella enterica enterica serovar Typhi Ty2
cucaggccggauaaggcg

SEQ ID NO: 1730210 - RNA, 18 nt, Salmonella enterica enterica serovar Typhi Ty2
cucauaaauugcagcgac

SEQ ID NO: 1730211 - RNA, 17 nt, Salmonella enterica enterica serovar Typhi Ty2
cucaccgagacugcccg

SEQ ID NO: 1730212 - RNA, 11 nt, Salmonella enterica enterica serovar Typhi Ty2
cucacccugaa

SEQ ID NO: 1730213 - RNA, 15 nt, Salmonella enterica enterica serovar Typhi Ty2
cucaaaccccagauu

SEQ ID NO: 1730214 - RNA, 16 nt, Salmonella enterica enterica serovar Typhi Ty2
cuauuucuuagcgcca

SEQ ID NO: 1730215 - RNA, 11 nt, Salmonella enterica enterica serovar Typhi Ty2
cuauuuaaccc

SEQ ID NO: 1730216 - RNA, 19 nt, Salmonella enterica enterica serovar Typhi Ty2
cuacgccuuauccggccua

SEQ ID NO: 1730217 - RNA, 23 nt, Salmonella enterica enterica serovar Typhi Ty2
cuacgccugugcuggcgaauccg

SEQ ID NO: 1730218 - RNA, 15 nt, Salmonella enterica enterica serovar Typhi Ty2
cuacgcuuaucaggc

SEQ ID NO: 1730219 - RNA, 16 nt, Salmonella enterica enterica serovar Typhi Ty2
cuacgcugcgcguucu

SEQ ID NO: 1730220 - RNA, 18 nt, Salmonella enterica enterica serovar Typhi Ty2
cuacgcuuauccggcuua

SEQ ID NO: 1730221 - RNA, 13 nt, Salmonella enterica enterica serovar Typhi Ty2
cuagggcaucaga

SEQ ID NO: 1730222 - RNA, 23 nt, Salmonella enterica enterica serovar Typhi Ty2
cuaggcgcugcuggcagcgcuga

SEQ ID NO: 1730223 - RNA, 22 nt, Salmonella enterica enterica serovar Typhi Ty2
cuauuagcgcgggauaucgcug

SEQ ID NO: 1730224 - RNA, 22 nt, Salmonella enterica enterica serovar Typhi Ty2
cuaucgggucugcgcgccggaa

SEQ ID NO: 1730225 - RNA, 15 nt, Salmonella enterica enterica serovar Typhi Ty2
cuauaacagcgcugg

SEQ ID NO: 1730226 - RNA, 16 nt, Salmonella enterica enterica serovar Typhi Ty2
cuaucgccagcgcguu

SEQ ID NO: 1730227 - RNA, 17 nt, Salmonella enterica enterica serovar Typhi Ty2
cuaucgcuccucccuga

SEQ ID NO: 1730228 - RNA, 14 nt, Salmonella enterica enterica serovar Typhi Ty2
cuaucgcggauaag

SEQ ID NO: 1730229 - RNA, 20 nt, Salmonella enterica enterica serovar Typhi Ty2
cuaucgcugcugauuggcga

SEQ ID NO: 1730230 - RNA, 23 nt, Salmonella enterica enterica serovar Typhi Ty2
cuauccucuuuuaucacccggau

SEQ ID NO: 1730231 - RNA, 15 nt, Salmonella enterica enterica serovar Typhi Ty2
cuaaugagccagaug

SEQ ID NO: 1730232 - RNA, 15 nt, Salmonella enterica enterica serovar Typhi Ty2
cuaaugaagcgcguu

SEQ ID NO: 1730233 - RNA, 20 nt, Salmonella enterica enterica serovar Typhi Ty2
cuaccacgccgcuacugccg

SEQ ID NO: 1730234 - RNA, 23 nt, Salmonella enterica enterica serovar Typhi Ty2
cuaccacagaaaucgccgggcua

SEQ ID NO: 1730235 - RNA, 20 nt, Salmonella enterica enterica serovar Typhi Ty2
cuaccggggcgcucgccuga

SEQ ID NO: 1730236 - RNA, 20 nt, Salmonella enterica enterica serovar Typhi Ty2
cuaacgucuuauccggccua

SEQ ID NO: 1730237 - RNA, 18 nt, Salmonella enterica enterica serovar Typhi Ty2
cuaacccgcugcgccguu

SEQ ID NO: 1730238 - RNA, 23 nt, Salmonella enterica enterica serovar Typhi Ty2
cuaaaugcauagccccagcgcaa

SEQ ID NO: 1730239 - RNA, 19 nt, Salmonella enterica enterica serovar Typhi Ty2
cuaacgcguacccggcuua

SEQ ID NO: 1730240 - RNA, 14 nt, Salmonella enterica enterica serovar Typhi Ty2
cuaaguacggcguc

SEQ ID NO: 1730241 - RNA, 18 nt, Salmonella enterica enterica serovar Typhi Ty2
cuaaucccccggaucacc

SEQ ID NO: 1730242 - RNA, 19 nt, Salmonella enterica enterica serovar Typhi Ty2
cguugcgcccaucaucauc

SEQ ID NO: 1730243 - RNA, 13 nt, Salmonella enterica enterica serovar Typhi Ty2
cguugcgccgcca

SEQ ID NO: 1730244 - RNA, 22 nt, Salmonella enterica enterica serovar Typhi Ty2
cguugcugucgcgcaauaccug

SEQ ID NO: 1730245 - RNA, 16 nt, Salmonella enterica enterica serovar Typhi Ty2
cguugcgacuaucggc

SEQ ID NO: 1730246 - RNA, 13 nt, Salmonella enterica enterica serovar Typhi Ty2
cguugccagcggc

SEQ ID NO: 1730247 - RNA, 15 nt, Salmonella enterica enterica serovar Typhi Ty2
cguugcccaucgcaa

SEQ ID NO: 1730248 - RNA, 15 nt, Salmonella enterica enterica serovar Typhi Ty2
cguugaccagcgacg

SEQ ID NO: 1730249 - RNA, 12 nt, Salmonella enterica enterica serovar Typhi Ty2
cguugaccagcg

SEQ ID NO: 1730250 - RNA, 21 nt, Salmonella enterica enterica serovar Typhi Ty2
cguucgugaauaugacgggca

SEQ ID NO: 1730251 - RNA, 23 nt, Salmonella enterica enterica serovar Typhi Ty2
cguugauccugaccgggcucacg

SEQ ID NO: 1730252 - RNA, 18 nt, Salmonella enterica enterica serovar Typhi Ty2
cguucgacaacggaucgc

SEQ ID NO: 1730253 - RNA, 18 nt, Salmonella enterica enterica serovar Typhi Ty2
cguucguugauagcgacg

SEQ ID NO: 1730254 - RNA, 13 nt, Salmonella enterica enterica serovar Typhi Ty2
cgugcuucaacgg

SEQ ID NO: 1730255 - RNA, 15 nt, Salmonella enterica enterica serovar Typhi Ty2
cguuuuagcgccauu

SEQ ID NO: 1730256 - RNA, 20 nt, Salmonella enterica enterica serovar Typhi Ty2
cguuuugauguccagaugcu

SEQ ID NO: 1730257 - RNA, 20 nt, Salmonella enterica enterica serovar Typhi Ty2
cguuuucggcgacugccgca

SEQ ID NO: 1730258 - RNA, 16 nt, Salmonella enterica enterica serovar Typhi Ty2
cguuuuucucaucaag

SEQ ID NO: 1730259 - RNA, 17 nt, Salmonella enterica enterica serovar Typhi Ty2
cuaaaaaggaaagggac

SEQ ID NO: 1730260 - RNA, 16 nt, Salmonella enterica enterica serovar Typhi Ty2
cuaaaaacagcgcaau

SEQ ID NO: 1730261 - RNA, 13 nt, Salmonella enterica enterica serovar Typhi Ty2
cguuuuuagcucg

SEQ ID NO: 1730262 - RNA, 20 nt, Salmonella enterica enterica serovar Typhi Ty2
cguuucuauuauugaucggc

SEQ ID NO: 1730263 - RNA, 16 nt, Salmonella enterica enterica serovar Typhi Ty2
cguuucugaacgcggu

SEQ ID NO: 1730264 - RNA, 20 nt, Salmonella enterica enterica serovar Typhi Ty2
cguuugcgucaaucaggaaa

SEQ ID NO: 1730265 - RNA, 16 nt, Salmonella enterica enterica serovar Typhi Ty2
cguuugcgcuacgcug

SEQ ID NO: 1730266 - RNA, 17 nt, Salmonella enterica enterica serovar Typhi Ty2
cguuugcgcuacgcugc

SEQ ID NO: 1730267 - RNA, 12 nt, Salmonella enterica enterica serovar Typhi Ty2
cguuucgccgua

SEQ ID NO: 1730268 - RNA, 17 nt, Salmonella enterica enterica serovar Typhi Ty2
cguuucgcuaucgccca

SEQ ID NO: 1730269 - RNA, 22 nt, Salmonella enterica enterica serovar Typhi Ty2
cguuuccugucucuauuaaccg

SEQ ID NO: 1730270 - RNA, 22 nt, Salmonella enterica enterica serovar Typhi Ty2
cuaacagcagcagcaaaccgau

SEQ ID NO: 1730271 - RNA, 18 nt, Salmonella enterica enterica serovar Typhi Ty2
cuaaagacgguaaucaga

SEQ ID NO: 1730272 - RNA, 15 nt, Salmonella enterica enterica serovar Typhi Ty2
cuaaagcgcuggcgg

SEQ ID NO: 1730273 - RNA, 22 nt, Salmonella enterica enterica serovar Typhi Ty2
cuaaagcgacuuauccggccua

SEQ ID NO: 1730274 - RNA, 16 nt, Salmonella enterica enterica serovar Typhi Ty2
cuaaaacuuuaacacu

SEQ ID NO: 1730275 - RNA, 18 nt, Salmonella enterica enterica serovar Typhi Ty2
cguuggcgucaucgacau

SEQ ID NO: 1730276 - RNA, 19 nt, Salmonella enterica enterica serovar Typhi Ty2
cguuguaguuaucgccgaa

SEQ ID NO: 1730277 - RNA, 18 nt, Salmonella enterica enterica serovar Typhi Ty2
cguuguaguuaucgccga

SEQ ID NO: 1730278 - RNA, 16 nt, Salmonella enterica enterica serovar Typhi Ty2
cguugucauggcgcca

SEQ ID NO: 1730279 - RNA, 21 nt, Salmonella enterica enterica serovar Typhi Ty2
cguuuacaccgccauccggca

SEQ ID NO: 1730280 - RNA, 12 nt, Salmonella enterica enterica serovar Typhi Ty2
cguuuaaagcgc

SEQ ID NO: 1730281 - RNA, 18 nt, Salmonella enterica enterica serovar Typhi Ty2
cguuuaaaagcggauaag

SEQ ID NO: 1730282 - RNA, 16 nt, Salmonella enterica enterica serovar Typhi Ty2
cguuuaugccgccauc

SEQ ID NO: 1730283 - RNA, 17 nt, Salmonella enterica enterica serovar Typhi Ty2
cguuucaaaaugcccca

SEQ ID NO: 1730284 - RNA, 21 nt, Salmonella enterica enterica serovar Typhi Ty2
cguuucauguaaaugacgcca

SEQ ID NO: 1730285 - RNA, 23 nt, Salmonella enterica enterica serovar Typhi Ty2
cguuguggacgaacucagagucg

SEQ ID NO: 1730286 - RNA, 19 nt, Salmonella enterica enterica serovar Typhi Ty2
cgucguuaacugcauuaca

SEQ ID NO: 1730287 - RNA, 23 nt, Salmonella enterica enterica serovar Typhi Ty2
cgucguuaacaucaucaggccug

SEQ ID NO: 1730288 - RNA, 22 nt, Salmonella enterica enterica serovar Typhi Ty2
cgucguuacccuccugcaaucc

SEQ ID NO: 1730289 - RNA, 19 nt, Salmonella enterica enterica serovar Typhi Ty2
cgucuccagacaauccgcg

SEQ ID NO: 1730290 - RNA, 15 nt, Salmonella enterica enterica serovar Typhi Ty2
cgucgucccaggcca

SEQ ID NO: 1730291 - RNA, 16 nt, Salmonella enterica enterica serovar Typhi Ty2
cgucugguaauaggcc

SEQ ID NO: 1730292 - RNA, 17 nt, Salmonella enterica enterica serovar Typhi Ty2
cgucuggaguacgggca

SEQ ID NO: 1730293 - RNA, 22 nt, Salmonella enterica enterica serovar Typhi Ty2
cgucugcaaugguaaaacgcug

SEQ ID NO: 1730294 - RNA, 16 nt, Salmonella enterica enterica serovar Typhi Ty2
cgucugacgcuugcau

SEQ ID NO: 1730295 - RNA, 17 nt, Salmonella enterica enterica serovar Typhi Ty2
cgucugccccaaacgcu

SEQ ID NO: 1730296 - RNA, 18 nt, Salmonella enterica enterica serovar Typhi Ty2
cgucugcgcgcugguguc

SEQ ID NO: 1730297 - RNA, 15 nt, Salmonella enterica enterica serovar Typhi Ty2
cgucggcgccggcgu

SEQ ID NO: 1730298 - RNA, 16 nt, Salmonella enterica enterica serovar Typhi Ty2
cgucggcgacgacgau

SEQ ID NO: 1730299 - RNA, 19 nt, Salmonella enterica enterica serovar Typhi Ty2
cgucggcgauugucaucau

SEQ ID NO: 1730300 - RNA, 21 nt, Salmonella enterica enterica serovar Typhi Ty2
cgucgggauaagcgaugcgcg

SEQ ID NO: 1730301 - RNA, 17 nt, Salmonella enterica enterica serovar Typhi Ty2
cgucgguuauagacgcc

SEQ ID NO: 1730302 - RNA, 23 nt, Salmonella enterica enterica serovar Typhi Ty2
cgugcaguuuugcuucaugcaca

SEQ ID NO: 1730303 - RNA, 18 nt, Salmonella enterica enterica serovar Typhi Ty2
cgugccgccgcgaaaacg

SEQ ID NO: 1730304 - RNA, 20 nt, Salmonella enterica enterica serovar Typhi Ty2
cgugcaguucuguaggccgg

SEQ ID NO: 1730305 - RNA, 18 nt, Salmonella enterica enterica serovar Typhi Ty2
cgugcaggccggauaagc

SEQ ID NO: 1730306 - RNA, 23 nt, Salmonella enterica enterica serovar Typhi Ty2
cgugcaggccggauaagccggau

SEQ ID NO: 1730307 - RNA, 22 nt, Salmonella enterica enterica serovar Typhi Ty2
cgugccguagaaaaugcgcugg

SEQ ID NO: 1730308 - RNA, 17 nt, Salmonella enterica enterica serovar Typhi Ty2
cgugcgaucucauacca

SEQ ID NO: 1730309 - RNA, 18 nt, Salmonella enterica enterica serovar Typhi Ty2
cgugaagaaacggaaauc

SEQ ID NO: 1730310 - RNA, 14 nt, Salmonella enterica enterica serovar Typhi Ty2
cgugaaagcauacc

SEQ ID NO: 1730311 - RNA, 17 nt, Salmonella enterica enterica serovar Typhi Ty2
cgugacgcgccagcgga

SEQ ID NO: 1730312 - RNA, 23 nt, Salmonella enterica enterica serovar Typhi Ty2
cgugauaauaguggugcgcaucc

SEQ ID NO: 1730313 - RNA, 21 nt, Salmonella enterica enterica serovar Typhi Ty2
cgugauaaaacauuccaucgc

SEQ ID NO: 1730314 - RNA, 17 nt, Salmonella enterica enterica serovar Typhi Ty2
cgugaguuucaguauca

SEQ ID NO: 1730315 - RNA, 16 nt, Salmonella enterica enterica serovar Typhi Ty2
cgucaguaccagcgag

SEQ ID NO: 1730316 - RNA, 15 nt, Salmonella enterica enterica serovar Typhi Ty2
cgucagucgccagaa

SEQ ID NO: 1730317 - RNA, 17 nt, Salmonella enterica enterica serovar Typhi Ty2
cgucauaucauccagcc

SEQ ID NO: 1730318 - RNA, 15 nt, Salmonella enterica enterica serovar Typhi Ty2
cgucauaacgcgcau

SEQ ID NO: 1730319 - RNA, 13 nt, Salmonella enterica enterica serovar Typhi Ty2
cgucccagcgcac

SEQ ID NO: 1730320 - RNA, 21 nt, Salmonella enterica enterica serovar Typhi Ty2
cguccugacggugcgcgacgc

SEQ ID NO: 1730321 - RNA, 22 nt, Salmonella enterica enterica serovar Typhi Ty2
cguccugacggugcgcgacgcc

SEQ ID NO: 1730322 - RNA, 16 nt, Salmonella enterica enterica serovar Typhi Ty2
cguccuccaacgugca

SEQ ID NO: 1730323 - RNA, 15 nt, Salmonella enterica enterica serovar Typhi Ty2
cgucccugccacagu

SEQ ID NO: 1730324 - RNA, 15 nt, Salmonella enterica enterica serovar Typhi Ty2
cgucccuuccgccac

SEQ ID NO: 1730325 - RNA, 19 nt, Salmonella enterica enterica serovar Typhi Ty2
cguccggcaucgugauaaa

SEQ ID NO: 1730326 - RNA, 18 nt, Salmonella enterica enterica serovar Typhi Ty2
cgucgagaaaccgcucgc

SEQ ID NO: 1730327 - RNA, 14 nt, Salmonella enterica enterica serovar Typhi Ty2
cgucgagacggugu

SEQ ID NO: 1730328 - RNA, 13 nt, Salmonella enterica enterica serovar Typhi Ty2
cgucgcacgaauc

SEQ ID NO: 1730329 - RNA, 15 nt, Salmonella enterica enterica serovar Typhi Ty2
cgucgccaaucagca

SEQ ID NO: 1730330 - RNA, 13 nt, Salmonella enterica enterica serovar Typhi Ty2
cgucgcgaaucgu

SEQ ID NO: 1730331 - RNA, 21 nt, Salmonella enterica enterica serovar Typhi Ty2
cgucgcgcgccgccugcgcca

SEQ ID NO: 1730332 - RNA, 17 nt, Salmonella enterica enterica serovar Typhi Ty2
cgucgcgacguccgcca

SEQ ID NO: 1730333 - RNA, 14 nt, Salmonella enterica enterica serovar Typhi Ty2
cgucgccagggcgg

SEQ ID NO: 1730334 - RNA, 17 nt, Salmonella enterica enterica serovar Typhi Ty2
cgucgccgaucggcguu

SEQ ID NO: 1730335 - RNA, 16 nt, Salmonella enterica enterica serovar Typhi Ty2
cgucggcaauuaacau

SEQ ID NO: 1730336 - RNA, 18 nt, Salmonella enterica enterica serovar Typhi Ty2
cgucagcgcccgauaaau

SEQ ID NO: 1730337 - RNA, 12 nt, Salmonella enterica enterica serovar Typhi Ty2
cguauccagcgc

SEQ ID NO: 1730338 - RNA, 11 nt, Salmonella enterica enterica serovar Typhi Ty2
cguauccagca

SEQ ID NO: 1730339 - RNA, 19 nt, Salmonella enterica enterica serovar Typhi Ty2
cguauauucgcgaugcuca

SEQ ID NO: 1730340 - RNA, 14 nt, Salmonella enterica enterica serovar Typhi Ty2
cguaucacuguaaa

SEQ ID NO: 1730341 - RNA, 20 nt, Salmonella enterica enterica serovar Typhi Ty2
cgucaagaucgcgcagcagg

SEQ ID NO: 1730342 - RNA, 23 nt, Salmonella enterica enterica serovar Typhi Ty2
cguaucuuccggugugaccagcg

SEQ ID NO: 1730343 - RNA, 13 nt, Salmonella enterica enterica serovar Typhi Ty2
cgucaaucaggaa

SEQ ID NO: 1730344 - RNA, 18 nt, Salmonella enterica enterica serovar Typhi Ty2
cguaggccugauaagcgc

SEQ ID NO: 1730345 - RNA, 15 nt, Salmonella enterica enterica serovar Typhi Ty2
cguaggccugauaag

SEQ ID NO: 1730346 - RNA, 19 nt, Salmonella enterica enterica serovar Typhi Ty2
cguaggccggauaagacgc

SEQ ID NO: 1730347 - RNA, 17 nt, Salmonella enterica enterica serovar Typhi Ty2
cguaggccggaagacgu

SEQ ID NO: 1730348 - RNA, 21 nt, Salmonella enterica enterica serovar Typhi Ty2
cguagcccagcgccgcaucgc

SEQ ID NO: 1730349 - RNA, 16 nt, Salmonella enterica enterica serovar Typhi Ty2
cguacauugccggaug

SEQ ID NO: 1730350 - RNA, 14 nt, Salmonella enterica enterica serovar Typhi Ty2
cgguguacagcgcg

SEQ ID NO: 1730351 - RNA, 23 nt, Salmonella enterica enterica serovar Typhi Ty2
cgguuaaugaaaucgucgccaac

SEQ ID NO: 1730352 - RNA, 21 nt, Salmonella enterica enterica serovar Typhi Ty2
cgguuagcgaacguccagcgg

SEQ ID NO: 1730353 - RNA, 14 nt, Salmonella enterica enterica serovar Typhi Ty2
cgguuauaaccgga

SEQ ID NO: 1730354 - RNA, 19 nt, Salmonella enterica enterica serovar Typhi Ty2
cgguuagcucaacgcaucg

SEQ ID NO: 1730355 - RNA, 12 nt, Salmonella enterica enterica serovar Typhi Ty2
cgguuaugcgau

SEQ ID NO: 1730356 - RNA, 20 nt, Salmonella enterica enterica serovar Typhi Ty2
cgguuaugccugccagcauu

SEQ ID NO: 1730357 - RNA, 19 nt, Salmonella enterica enterica serovar Typhi Ty2
cgguuaaaaacagccagca

SEQ ID NO: 1730358 - RNA, 21 nt, Salmonella enterica enterica serovar Typhi Ty2
cgguuucaccauuaagcaauc

SEQ ID NO: 1730359 - RNA, 17 nt, Salmonella enterica enterica serovar Typhi Ty2
cgguuugagcaccacgc

SEQ ID NO: 1730360 - RNA, 17 nt, Salmonella enterica enterica serovar Typhi Ty2
cguaauuccgcauugag

SEQ ID NO: 1730361 - RNA, 16 nt, Salmonella enterica enterica serovar Typhi Ty2
cguaaugagcgucgcc

SEQ ID NO: 1730362 - RNA, 23 nt, Salmonella enterica enterica serovar Typhi Ty2
cguaauuuuuccaguugcgcuac

SEQ ID NO: 1730363 - RNA, 14 nt, Salmonella enterica enterica serovar Typhi Ty2
cguaaaaccgcgcu

SEQ ID NO: 1730364 - RNA, 22 nt, Salmonella enterica enterica serovar Typhi Ty2
cguaaucgcuuucauuacgcuu

SEQ ID NO: 1730365 - RNA, 22 nt, Salmonella enterica enterica serovar Typhi Ty2
cguaaugacuggcuuugcgcca

SEQ ID NO: 1730366 - RNA, 12 nt, Salmonella enterica enterica serovar Typhi Ty2
cguaaaacugca

SEQ ID NO: 1730367 - RNA, 15 nt, Salmonella enterica enterica serovar Typhi Ty2
cguaaaacaacagcg

SEQ ID NO: 1730368 - RNA, 13 nt, Salmonella enterica enterica serovar Typhi Ty2
cgguuuuuccgcu

SEQ ID NO: 1730369 - RNA, 21 nt, Salmonella enterica enterica serovar Typhi Ty2
cgguuuuacuauugccgauaa

SEQ ID NO: 1730370 - RNA, 21 nt, Salmonella enterica enterica serovar Typhi Ty2
cggugaccugccuuucccauc

SEQ ID NO: 1730371 - RNA, 23 nt, Salmonella enterica enterica serovar Typhi Ty2
cggugaugaucaauaacgccggu

SEQ ID NO: 1730372 - RNA, 17 nt, Salmonella enterica enterica serovar Typhi Ty2
cgguggaaaccgcagaa

SEQ ID NO: 1730373 - RNA, 15 nt, Salmonella enterica enterica serovar Typhi Ty2
cgguggcgcuuuacc

SEQ ID NO: 1730374 - RNA, 22 nt, Salmonella enterica enterica serovar Typhi Ty2
cggugcugaauauuaucggcgu

SEQ ID NO: 1730375 - RNA, 18 nt, Salmonella enterica enterica serovar Typhi Ty2
cggugcgccccagcauga

SEQ ID NO: 1730376 - RNA, 21 nt, Salmonella enterica enterica serovar Typhi Ty2
cugucgauaacagcauaaacg

SEQ ID NO: 1730377 - RNA, 19 nt, Salmonella enterica enterica serovar Typhi Ty2
cuguccggaauaacuccag

SEQ ID NO: 1730378 - RNA, 16 nt, Salmonella enterica enterica serovar Typhi Ty2
cugucgaaaccagcau

SEQ ID NO: 1730379 - RNA, 21 nt, Salmonella enterica enterica serovar Typhi Ty2
cugucaucaucaaguaccgug

SEQ ID NO: 1730380 - RNA, 17 nt, Salmonella enterica enterica serovar Typhi Ty2
cugucaggacuagcgcg

SEQ ID NO: 1730381 - RNA, 20 nt, Salmonella enterica enterica serovar Typhi Ty2
cuguauucguccauaagcgc

SEQ ID NO: 1730382 - RNA, 17 nt, Salmonella enterica enterica serovar Typhi Ty2
cugucaccgacacgcau

SEQ ID NO: 1730383 - RNA, 14 nt, Salmonella enterica enterica serovar Typhi Ty2
cuguuaauaccgug

SEQ ID NO: 1730384 - RNA, 21 nt, Salmonella enterica enterica serovar Typhi Ty2
cuguuaauaaguccgcgggca

SEQ ID NO: 1730385 - RNA, 23 nt, Salmonella enterica enterica serovar Typhi Ty2
cuguuaaccuguaacacacuggu

SEQ ID NO: 1730386 - RNA, 19 nt, Salmonella enterica enterica serovar Typhi Ty2
cuguguuuucagccaggug

SEQ ID NO: 1730387 - RNA, 21 nt, Salmonella enterica enterica serovar Typhi Ty2
cugugcaacaucuuaccggug

SEQ ID NO: 1730388 - RNA, 15 nt, Salmonella enterica enterica serovar Typhi Ty2
cugugcgugaugggc

SEQ ID NO: 1730389 - RNA, 19 nt, Salmonella enterica enterica serovar Typhi Ty2
cugugacgcaggccgggua

SEQ ID NO: 1730390 - RNA, 19 nt, Salmonella enterica enterica serovar Typhi Ty2
cuucaacagcggcggcagu

SEQ ID NO: 1730391 - RNA, 18 nt, Salmonella enterica enterica serovar Typhi Ty2
cuucaacagcucgccaug

SEQ ID NO: 1730392 - RNA, 22 nt, Salmonella enterica enterica serovar Typhi Ty2
cuuauuuuauuuuuauauuccg

SEQ ID NO: 1730393 - RNA, 19 nt, Salmonella enterica enterica serovar Typhi Ty2
cuucaaaacagaaccccau

SEQ ID NO: 1730394 - RNA, 23 nt, Salmonella enterica enterica serovar Typhi Ty2
cuucaaauauauugaaaagggac

SEQ ID NO: 1730395 - RNA, 15 nt, Salmonella enterica enterica serovar Typhi Ty2
cuuauugaguuaccg

SEQ ID NO: 1730396 - RNA, 16 nt, Salmonella enterica enterica serovar Typhi Ty2
cuuaugcaagauugcg

SEQ ID NO: 1730397 - RNA, 20 nt, Salmonella enterica enterica serovar Typhi Ty2
cuuaucggcguguuucaucu

SEQ ID NO: 1730398 - RNA, 16 nt, Salmonella enterica enterica serovar Typhi Ty2
cuuacgcuugggcuga

SEQ ID NO: 1730399 - RNA, 13 nt, Salmonella enterica enterica serovar Typhi Ty2
cuguuuaucugau

SEQ ID NO: 1730400 - RNA, 20 nt, Salmonella enterica enterica serovar Typhi Ty2
cuguuucgcaggccggauaa

SEQ ID NO: 1730401 - RNA, 22 nt, Salmonella enterica enterica serovar Typhi Ty2
cuguuuauucuucgucagaugc

SEQ ID NO: 1730402 - RNA, 16 nt, Salmonella enterica enterica serovar Typhi Ty2
cuuaacgcccgcgucu

SEQ ID NO: 1730403 - RNA, 20 nt, Salmonella enterica enterica serovar Typhi Ty2
cuguuucgcccgcucgcgau

SEQ ID NO: 1730404 - RNA, 17 nt, Salmonella enterica enterica serovar Typhi Ty2
cuuaccuugaguaacug

SEQ ID NO: 1730405 - RNA, 15 nt, Salmonella enterica enterica serovar Typhi Ty2
cuuaccgcggucacc

SEQ ID NO: 1730406 - RNA, 18 nt, Salmonella enterica enterica serovar Typhi Ty2
cuuaaugcauggcagaua

SEQ ID NO: 1730407 - RNA, 18 nt, Salmonella enterica enterica serovar Typhi Ty2
cuucgaaugucucaauau

SEQ ID NO: 1730408 - RNA, 14 nt, Salmonella enterica enterica serovar Typhi Ty2
cuucgcccggcgua

SEQ ID NO: 1730409 - RNA, 18 nt, Salmonella enterica enterica serovar Typhi Ty2
cuucgccaaaauggcgaa

SEQ ID NO: 1730410 - RNA, 19 nt, Salmonella enterica enterica serovar Typhi Ty2
cuuccgacacugaaacucc

SEQ ID NO: 1730411 - RNA, 17 nt, Salmonella enterica enterica serovar Typhi Ty2
cuucccugacgcgcagc

SEQ ID NO: 1730412 - RNA, 15 nt, Salmonella enterica enterica serovar Typhi Ty2
cuuccgccagcgcgu

SEQ ID NO: 1730413 - RNA, 14 nt, Salmonella enterica enterica serovar Typhi Ty2
cuuccgccugauaa

SEQ ID NO: 1730414 - RNA, 14 nt, Salmonella enterica enterica serovar Typhi Ty2
cuucacaaucagcg

SEQ ID NO: 1730415 - RNA, 16 nt, Salmonella enterica enterica serovar Typhi Ty2
cuucaauuugccggaa

SEQ ID NO: 1730416 - RNA, 20 nt, Salmonella enterica enterica serovar Typhi Ty2
cuucaaucgucguuccgcca

SEQ ID NO: 1730417 - RNA, 22 nt, Salmonella enterica enterica serovar Typhi Ty2
cuucacccagacugugauggcg

SEQ ID NO: 1730418 - RNA, 18 nt, Salmonella enterica enterica serovar Typhi Ty2
cuucacccaucgccagau

SEQ ID NO: 1730419 - RNA, 19 nt, Salmonella enterica enterica serovar Typhi Ty2
cuucauggucggacgggcc

SEQ ID NO: 1730420 - RNA, 22 nt, Salmonella enterica enterica serovar Typhi Ty2
cuucccauauuuuuucugccag

SEQ ID NO: 1730421 - RNA, 14 nt, Salmonella enterica enterica serovar Typhi Ty2
cuucccgcgauaaa

SEQ ID NO: 1730422 - RNA, 21 nt, Salmonella enterica enterica serovar Typhi Ty2
cuucuguacgcugaauaaccc

SEQ ID NO: 1730423 - RNA, 12 nt, Salmonella enterica enterica serovar Typhi Ty2
cuucuuaccgug

SEQ ID NO: 1730424 - RNA, 18 nt, Salmonella enterica enterica serovar Typhi Ty2
cuucucuuuaugcgucaa

SEQ ID NO: 1730425 - RNA, 13 nt, Salmonella enterica enterica serovar Typhi Ty2
cuucuuugcgcgu

SEQ ID NO: 1730426 - RNA, 17 nt, Salmonella enterica enterica serovar Typhi Ty2
cuucuuuauagauauca

SEQ ID NO: 1730427 - RNA, 16 nt, Salmonella enterica enterica serovar Typhi Ty2
cuucuccgccugcggu

SEQ ID NO: 1730428 - RNA, 21 nt, Salmonella enterica enterica serovar Typhi Ty2
cuucuccccuucaucaguaac

SEQ ID NO: 1730429 - RNA, 13 nt, Salmonella enterica enterica serovar Typhi Ty2
cuucuccgccauc

SEQ ID NO: 1730430 - RNA, 14 nt, Salmonella enterica enterica serovar Typhi Ty2
cuucucgcgcauca

SEQ ID NO: 1730431 - RNA, 16 nt, Salmonella enterica enterica serovar Typhi Ty2
cuucuccuucgccaaa

SEQ ID NO: 1730432 - RNA, 23 nt, Salmonella enterica enterica serovar Typhi Ty2
cuucgggcgauuuuugcagcaac

SEQ ID NO: 1730433 - RNA, 18 nt, Salmonella enterica enterica serovar Typhi Ty2
cuucgccaucuccaucau

SEQ ID NO: 1730434 - RNA, 21 nt, Salmonella enterica enterica serovar Typhi Ty2
gaaaaagaccgacaucgccag

SEQ ID NO: 1730435 - RNA, 13 nt, Salmonella enterica enterica serovar Typhi Ty2
gaaaaaucauuau

SEQ ID NO: 1730436 - RNA, 20 nt, Salmonella enterica enterica serovar Typhi Ty2
gaaaaccccaucccggcaac

SEQ ID NO: 1730437 - RNA, 13 nt, Salmonella enterica enterica serovar Typhi Ty2
gaaaaccagcgcc

SEQ ID NO: 1730438 - RNA, 13 nt, Salmonella enterica enterica serovar Typhi Ty2
gaaaaauguucag

SEQ ID NO: 1730439 - RNA, 16 nt, Salmonella enterica enterica serovar Typhi Ty2
gaaaaaucuguaggcc

SEQ ID NO: 1730440 - RNA, 22 nt, Salmonella enterica enterica serovar Typhi Ty2
gaaaaaugagacgccgaugagc

SEQ ID NO: 1730441 - RNA, 23 nt, Salmonella enterica enterica serovar Typhi Ty2
gaaaaaagugaucccccagaauc

SEQ ID NO: 1730442 - RNA, 18 nt, Salmonella enterica enterica serovar Typhi Ty2
gaaaaaaaagcgccgcag

SEQ ID NO: 1730443 - RNA, 15 nt, Salmonella enterica enterica serovar Typhi Ty2
gaaaaacaucauggc

SEQ ID NO: 1730444 - RNA, 20 nt, Salmonella enterica enterica serovar Typhi Ty2
cuuuguacagcuugccguca

SEQ ID NO: 1730445 - RNA, 21 nt, Salmonella enterica enterica serovar Typhi Ty2
cuuuuuuguauuaacggcgcu

SEQ ID NO: 1730446 - RNA, 20 nt, Salmonella enterica enterica serovar Typhi Ty2
gaaaaucagugaacacccug

SEQ ID NO: 1730447 - RNA, 23 nt, Salmonella enterica enterica serovar Typhi Ty2
gaaacaguuggcggacucgcugg

SEQ ID NO: 1730448 - RNA, 15 nt, Salmonella enterica enterica serovar Typhi Ty2
gaaacaucaucguuu

SEQ ID NO: 1730449 - RNA, 20 nt, Salmonella enterica enterica serovar Typhi Ty2
gaaaaucugcgccaaucgcg

SEQ ID NO: 1730450 - RNA, 22 nt, Salmonella enterica enterica serovar Typhi Ty2
gaaaagggaugcugaagccgcu

SEQ ID NO: 1730451 - RNA, 23 nt, Salmonella enterica enterica serovar Typhi Ty2
gaaaauaccccagcgcgccgcag

SEQ ID NO: 1730452 - RNA, 16 nt, Salmonella enterica enterica serovar Typhi Ty2
gaaaccggccgccauc

SEQ ID NO: 1730453 - RNA, 20 nt, Salmonella enterica enterica serovar Typhi Ty2
gaaaccgcuacccggcacaa

SEQ ID NO: 1730454 - RNA, 13 nt, Salmonella enterica enterica serovar Typhi Ty2
cuuucagaucggc

SEQ ID NO: 1730455 - RNA, 16 nt, Salmonella enterica enterica serovar Typhi Ty2
cuuucaauuuccgcac

SEQ ID NO: 1730456 - RNA, 23 nt, Salmonella enterica enterica serovar Typhi Ty2
cuuguccggcguuuuagcgccau

SEQ ID NO: 1730457 - RNA, 13 nt, Salmonella enterica enterica serovar Typhi Ty2
cuuucaucagccg

SEQ ID NO: 1730458 - RNA, 18 nt, Salmonella enterica enterica serovar Typhi Ty2
cuuucagcguugcagcca

SEQ ID NO: 1730459 - RNA, 15 nt, Salmonella enterica enterica serovar Typhi Ty2
cuuucagaucggcaa

SEQ ID NO: 1730460 - RNA, 16 nt, Salmonella enterica enterica serovar Typhi Ty2
cuuuccggaacgcguu

SEQ ID NO: 1730461 - RNA, 23 nt, Salmonella enterica enterica serovar Typhi Ty2
cuuugcaccgcuaaaaaacaggc

SEQ ID NO: 1730462 - RNA, 16 nt, Salmonella enterica enterica serovar Typhi Ty2
cuuugcugacgccaua

SEQ ID NO: 1730463 - RNA, 15 nt, Salmonella enterica enterica serovar Typhi Ty2
cuuucugcugccgca

SEQ ID NO: 1730464 - RNA, 14 nt, Salmonella enterica enterica serovar Typhi Ty2
cuuucugccagguu

SEQ ID NO: 1730465 - RNA, 22 nt, Salmonella enterica enterica serovar Typhi Ty2
cuuucugauaacgcaggcgaua

SEQ ID NO: 1730466 - RNA, 17 nt, Salmonella enterica enterica serovar Typhi Ty2
cuugccagagccccaau

SEQ ID NO: 1730467 - RNA, 14 nt, Salmonella enterica enterica serovar Typhi Ty2
cuugcaugaccauc

SEQ ID NO: 1730468 - RNA, 24 nt, Salmonella enterica enterica serovar Typhi Ty2
cuugcaucucauaaaacauuccug

SEQ ID NO: 1730469 - RNA, 15 nt, Salmonella enterica enterica serovar Typhi Ty2
cuugcaucucauaaa

SEQ ID NO: 1730470 - RNA, 12 nt, Salmonella enterica enterica serovar Typhi Ty2
cuugaucgcgca

SEQ ID NO: 1730471 - RNA, 19 nt, Salmonella enterica enterica serovar Typhi Ty2
cuugaucgugccguccggc

SEQ ID NO: 1730472 - RNA, 13 nt, Salmonella enterica enterica serovar Typhi Ty2
cuugauacgccau

SEQ ID NO: 1730473 - RNA, 17 nt, Salmonella enterica enterica serovar Typhi Ty2
cuugaguuuuccgccau

SEQ ID NO: 1730474 - RNA, 16 nt, Salmonella enterica enterica serovar Typhi Ty2
cuugacgucgccauau

SEQ ID NO: 1730475 - RNA, 20 nt, Salmonella enterica enterica serovar Typhi Ty2
cuugaauccuuuaaucgccg

SEQ ID NO: 1730476 - RNA, 17 nt, Salmonella enterica enterica serovar Typhi Ty2
cuugccgggccuggcau

SEQ ID NO: 1730477 - RNA, 20 nt, Salmonella enterica enterica serovar Typhi Ty2
cuugccgcgccagacgccau

SEQ ID NO: 1730478 - RNA, 19 nt, Salmonella enterica enterica serovar Typhi Ty2
cuuggaaaguugcgccgug

SEQ ID NO: 1730479 - RNA, 18 nt, Salmonella enterica enterica serovar Typhi Ty2
cugcggcugacgcgauga

SEQ ID NO: 1730480 - RNA, 15 nt, Salmonella enterica enterica serovar Typhi Ty2
cugcgguaucggaga

SEQ ID NO: 1730481 - RNA, 22 nt, Salmonella enterica enterica serovar Typhi Ty2
cugcguuugcggaucgaucucg

SEQ ID NO: 1730482 - RNA, 21 nt, Salmonella enterica enterica serovar Typhi Ty2
cugcucccccaguugcugcau

SEQ ID NO: 1730483 - RNA, 19 nt, Salmonella enterica enterica serovar Typhi Ty2
cugcugacguagauucuga

SEQ ID NO: 1730484 - RNA, 22 nt, Salmonella enterica enterica serovar Typhi Ty2
cugcugaccuuaauccagcagu

SEQ ID NO: 1730485 - RNA, 20 nt, Salmonella enterica enterica serovar Typhi Ty2
cugcgaguuuaugguugucu

SEQ ID NO: 1730486 - RNA, 19 nt, Salmonella enterica enterica serovar Typhi Ty2
cugcacgagagaccaugcu

SEQ ID NO: 1730487 - RNA, 13 nt, Salmonella enterica enterica serovar Typhi Ty2
cugcgccacauca

SEQ ID NO: 1730488 - RNA, 15 nt, Salmonella enterica enterica serovar Typhi Ty2
cugcgccagccugcu

SEQ ID NO: 1730489 - RNA, 14 nt, Salmonella enterica enterica serovar Typhi Ty2
cugcgccgggcaga

SEQ ID NO: 1730490 - RNA, 18 nt, Salmonella enterica enterica serovar Typhi Ty2
cugcgccugcucagcauu

SEQ ID NO: 1730491 - RNA, 13 nt, Salmonella enterica enterica serovar Typhi Ty2
cugcgcgccaaac

SEQ ID NO: 1730492 - RNA, 20 nt, Salmonella enterica enterica serovar Typhi Ty2
cugcgcgccgcccugcauca

SEQ ID NO: 1730493 - RNA, 15 nt, Salmonella enterica enterica serovar Typhi Ty2
cugcgcggcaaugag

SEQ ID NO: 1730494 - RNA, 14 nt, Salmonella enterica enterica serovar Typhi Ty2
cugcgcgucggcau

SEQ ID NO: 1730495 - RNA, 16 nt, Salmonella enterica enterica serovar Typhi Ty2
cugcggccucgccucu

SEQ ID NO: 1730496 - RNA, 13 nt, Salmonella enterica enterica serovar Typhi Ty2
cugcggccaugau

SEQ ID NO: 1730497 - RNA, 17 nt, Salmonella enterica enterica serovar Typhi Ty2
cugcgcugcggucaggg

SEQ ID NO: 1730498 - RNA, 15 nt, Salmonella enterica enterica serovar Typhi Ty2
cuggcugucgauaac

SEQ ID NO: 1730499 - RNA, 13 nt, Salmonella enterica enterica serovar Typhi Ty2
cugggcgcaugag

SEQ ID NO: 1730500 - RNA, 17 nt, Salmonella enterica enterica serovar Typhi Ty2
cuggggucgucagcgga

SEQ ID NO: 1730501 - RNA, 15 nt, Salmonella enterica enterica serovar Typhi Ty2
cuggguaugcagugg

SEQ ID NO: 1730502 - RNA, 21 nt, Salmonella enterica enterica serovar Typhi Ty2
cuggucauggcuuagcgccag

SEQ ID NO: 1730503 - RNA, 20 nt, Salmonella enterica enterica serovar Typhi Ty2
cuggucaacacgcggucguc

SEQ ID NO: 1730504 - RNA, 23 nt, Salmonella enterica enterica serovar Typhi Ty2
cuggcgcugaccgccccguauca

SEQ ID NO: 1730505 - RNA, 20 nt, Salmonella enterica enterica serovar Typhi Ty2
cuggcgcuguuuuuacgcca

SEQ ID NO: 1730506 - RNA, 13 nt, Salmonella enterica enterica serovar Typhi Ty2
cuggccuccggcg

SEQ ID NO: 1730507 - RNA, 18 nt, Salmonella enterica enterica serovar Typhi Ty2
cuggccguuuucccggca

SEQ ID NO: 1730508 - RNA, 16 nt, Salmonella enterica enterica serovar Typhi Ty2
cugcugggcgauuuca

SEQ ID NO: 1730509 - RNA, 18 nt, Salmonella enterica enterica serovar Typhi Ty2
cugcugcggcguucccca

SEQ ID NO: 1730510 - RNA, 16 nt, Salmonella enterica enterica serovar Typhi Ty2
cugcuggcagcgcuga

SEQ ID NO: 1730511 - RNA, 17 nt, Salmonella enterica enterica serovar Typhi Ty2
cugcuguccgccagcaa

SEQ ID NO: 1730512 - RNA, 20 nt, Salmonella enterica enterica serovar Typhi Ty2
cugcugguaccuuuguggca

SEQ ID NO: 1730513 - RNA, 17 nt, Salmonella enterica enterica serovar Typhi Ty2
cuggaacagauguuuac

SEQ ID NO: 1730514 - RNA, 15 nt, Salmonella enterica enterica serovar Typhi Ty2
cuggaaccaggcgcg

SEQ ID NO: 1730515 - RNA, 19 nt, Salmonella enterica enterica serovar Typhi Ty2
cugcuugucgaucaucaga

SEQ ID NO: 1730516 - RNA, 17 nt, Salmonella enterica enterica serovar Typhi Ty2
cugcuuugucgcgguua

SEQ ID NO: 1730517 - RNA, 23 nt, Salmonella enterica enterica serovar Typhi Ty2
cuggccggaaaggauauaagcgc

SEQ ID NO: 1730518 - RNA, 21 nt, Salmonella enterica enterica serovar Typhi Ty2
cuggcagugauccaucgguuc

SEQ ID NO: 1730519 - RNA, 20 nt, Salmonella enterica enterica serovar Typhi Ty2
cuggcauaaccgcagcgcgg

SEQ ID NO: 1730520 - RNA, 23 nt, Salmonella enterica enterica serovar Typhi Ty2
cuggccaggcauugauaaagcgc

SEQ ID NO: 1730521 - RNA, 17 nt, Salmonella enterica enterica serovar Typhi Ty2
cuggcauuuuacuucug

SEQ ID NO: 1730522 - RNA, 18 nt, Salmonella enterica enterica serovar Typhi Ty2
cuggcaacaugaccagcg

SEQ ID NO: 1730523 - RNA, 14 nt, Salmonella enterica enterica serovar Typhi Ty2
cuggcaagcgccag

SEQ ID NO: 1730524 - RNA, 15 nt, Salmonella enterica enterica serovar Typhi Ty2
gaauuaucaggguua

SEQ ID NO: 1730525 - RNA, 18 nt, Salmonella enterica enterica serovar Typhi Ty2
gaauuaugcagacgcucg

SEQ ID NO: 1730526 - RNA, 17 nt, Salmonella enterica enterica serovar Typhi Ty2
gaauuaugggccgacgu

SEQ ID NO: 1730527 - RNA, 20 nt, Salmonella enterica enterica serovar Typhi Ty2
gaauuauuaccaaugagcug

SEQ ID NO: 1730528 - RNA, 17 nt, Salmonella enterica enterica serovar Typhi Ty2
gaauugccauuguucgc

SEQ ID NO: 1730529 - RNA, 17 nt, Salmonella enterica enterica serovar Typhi Ty2
gaaugccuuuuacaaua

SEQ ID NO: 1730530 - RNA, 12 nt, Salmonella enterica enterica serovar Typhi Ty2
gaauuacgggcg

SEQ ID NO: 1730531 - RNA, 17 nt, Salmonella enterica enterica serovar Typhi Ty2
gaaugugcuuaucacgu

SEQ ID NO: 1730532 - RNA, 16 nt, Salmonella enterica enterica serovar Typhi Ty2
gaauaacaucuuccau

SEQ ID NO: 1730533 - RNA, 16 nt, Salmonella enterica enterica serovar Typhi Ty2
gaauaaaaccggcaua

SEQ ID NO: 1730534 - RNA, 20 nt, Salmonella enterica enterica serovar Typhi Ty2
gaauaaccacugauggcugg

SEQ ID NO: 1730535 - RNA, 22 nt, Salmonella enterica enterica serovar Typhi Ty2
gaauaacccccgcgaacgcgau

SEQ ID NO: 1730536 - RNA, 22 nt, Salmonella enterica enterica serovar Typhi Ty2
gaauaugcagugcugcugccau

SEQ ID NO: 1730537 - RNA, 22 nt, Salmonella enterica enterica serovar Typhi Ty2
gaauagcggcaguacgagcauc

SEQ ID NO: 1730538 - RNA, 15 nt, Salmonella enterica enterica serovar Typhi Ty2
gaauagugcaggaag

SEQ ID NO: 1730539 - RNA, 18 nt, Salmonella enterica enterica serovar Typhi Ty2
gaaucgccagucgcagca

SEQ ID NO: 1730540 - RNA, 14 nt, Salmonella enterica enterica serovar Typhi Ty2
gaaucgccugcguc

SEQ ID NO: 1730541 - RNA, 15 nt, Salmonella enterica enterica serovar Typhi Ty2
gaaggucugacaacu

SEQ ID NO: 1730542 - RNA, 20 nt, Salmonella enterica enterica serovar Typhi Ty2
gaaggucuugauggcgauca

SEQ ID NO: 1730543 - RNA, 13 nt, Salmonella enterica enterica serovar Typhi Ty2
gaaguggcaaucg

SEQ ID NO: 1730544 - RNA, 18 nt, Salmonella enterica enterica serovar Typhi Ty2
gaccaaagucaaacugau

SEQ ID NO: 1730545 - RNA, 21 nt, Salmonella enterica enterica serovar Typhi Ty2
gaccaacaccuacgauaucau

SEQ ID NO: 1730546 - RNA, 21 nt, Salmonella enterica enterica serovar Typhi Ty2
gacauguccgauagcauuauu

SEQ ID NO: 1730547 - RNA, 14 nt, Salmonella enterica enterica serovar Typhi Ty2
gacauguuccgccc

SEQ ID NO: 1730548 - RNA, 21 nt, Salmonella enterica enterica serovar Typhi Ty2
gacauguuccgccccgccuuc

SEQ ID NO: 1730549 - RNA, 23 nt, Salmonella enterica enterica serovar Typhi Ty2
gacauguuuauguagccagccau

SEQ ID NO: 1730550 - RNA, 16 nt, Salmonella enterica enterica serovar Typhi Ty2
gacagccgacggcaaa

SEQ ID NO: 1730551 - RNA, 18 nt, Salmonella enterica enterica serovar Typhi Ty2
gacagcuuagauucaacc

SEQ ID NO: 1730552 - RNA, 20 nt, Salmonella enterica enterica serovar Typhi Ty2
gacauagagcgggucaacgc

SEQ ID NO: 1730553 - RNA, 11 nt, Salmonella enterica enterica serovar Typhi Ty2
gacaucagcca

SEQ ID NO: 1730554 - RNA, 22 nt, Salmonella enterica enterica serovar Typhi Ty2
gacagugacggcaauagaacgu

SEQ ID NO: 1730555 - RNA, 18 nt, Salmonella enterica enterica serovar Typhi Ty2
gacacuggaaacagccaa

SEQ ID NO: 1730556 - RNA, 17 nt, Salmonella enterica enterica serovar Typhi Ty2
gacagauuaucagcgag

SEQ ID NO: 1730557 - RNA, 15 nt, Salmonella enterica enterica serovar Typhi Ty2
gacagagcucgucaa

SEQ ID NO: 1730558 - RNA, 17 nt, Salmonella enterica enterica serovar Typhi Ty2
gaagcgaauagcguauu

SEQ ID NO: 1730559 - RNA, 20 nt, Salmonella enterica enterica serovar Typhi Ty2
gaagcgaccggcgucaucau

SEQ ID NO: 1730560 - RNA, 22 nt, Salmonella enterica enterica serovar Typhi Ty2
gaagcgcaaacggaucuuccac

SEQ ID NO: 1730561 - RNA, 21 nt, Salmonella enterica enterica serovar Typhi Ty2
gaagcgccuguuaucaggacg

SEQ ID NO: 1730562 - RNA, 16 nt, Salmonella enterica enterica serovar Typhi Ty2
gaaggcaacugauccu

SEQ ID NO: 1730563 - RNA, 14 nt, Salmonella enterica enterica serovar Typhi Ty2
gaagcgcguguauu

SEQ ID NO: 1730564 - RNA, 14 nt, Salmonella enterica enterica serovar Typhi Ty2
gaagcggacgggcg

SEQ ID NO: 1730565 - RNA, 13 nt, Salmonella enterica enterica serovar Typhi Ty2
gaagcgucaucaa

SEQ ID NO: 1730566 - RNA, 23 nt, Salmonella enterica enterica serovar Typhi Ty2
gaacggcuuuccagcagccagaa

SEQ ID NO: 1730567 - RNA, 23 nt, Salmonella enterica enterica serovar Typhi Ty2
gaacgcguccaugaccaccagcg

SEQ ID NO: 1730568 - RNA, 15 nt, Salmonella enterica enterica serovar Typhi Ty2
gaaacggcggaacca

SEQ ID NO: 1730569 - RNA, 20 nt, Salmonella enterica enterica serovar Typhi Ty2
gaaaccuccgcagugcggag

SEQ ID NO: 1730570 - RNA, 15 nt, Salmonella enterica enterica serovar Typhi Ty2
gaaacgacugguaau

SEQ ID NO: 1730571 - RNA, 24 nt, Salmonella enterica enterica serovar Typhi Ty2
gaaacgacugguaaugucauccag

SEQ ID NO: 1730572 - RNA, 19 nt, Salmonella enterica enterica serovar Typhi Ty2
gaagacguuuacaccgcca

SEQ ID NO: 1730573 - RNA, 19 nt, Salmonella enterica enterica serovar Typhi Ty2
gaagaucgcguacagcgcc

SEQ ID NO: 1730574 - RNA, 20 nt, Salmonella enterica enterica serovar Typhi Ty2
gaagaucgcguacagcgcca

SEQ ID NO: 1730575 - RNA, 20 nt, Salmonella enterica enterica serovar Typhi Ty2
gaagaucguuauccagcagc

SEQ ID NO: 1730576 - RNA, 21 nt, Salmonella enterica enterica serovar Typhi Ty2
gaagacgaugauguagccgcg

SEQ ID NO: 1730577 - RNA, 15 nt, Salmonella enterica enterica serovar Typhi Ty2
gaagaauuauuauca

SEQ ID NO: 1730578 - RNA, 14 nt, Salmonella enterica enterica serovar Typhi Ty2
gaagaacagcgucg

SEQ ID NO: 1730579 - RNA, 15 nt, Salmonella enterica enterica serovar Typhi Ty2
gaacguuggcgauaa

SEQ ID NO: 1730580 - RNA, 15 nt, Salmonella enterica enterica serovar Typhi Ty2
gacgaucagcgccac

SEQ ID NO: 1730581 - RNA, 19 nt, Salmonella enterica enterica serovar Typhi Ty2
gacgcauugagacaugccg

SEQ ID NO: 1730582 - RNA, 16 nt, Salmonella enterica enterica serovar Typhi Ty2
gacgaugauaauacau

SEQ ID NO: 1730583 - RNA, 23 nt, Salmonella enterica enterica serovar Typhi Ty2
gacgccaccggguuaaagcccug

SEQ ID NO: 1730584 - RNA, 19 nt, Salmonella enterica enterica serovar Typhi Ty2
gacgcgaaugucauccgga

SEQ ID NO: 1730585 - RNA, 17 nt, Salmonella enterica enterica serovar Typhi Ty2
gacgccguccaggcucg

SEQ ID NO: 1730586 - RNA, 15 nt, Salmonella enterica enterica serovar Typhi Ty2
gacgcgccagcggau

SEQ ID NO: 1730587 - RNA, 20 nt, Salmonella enterica enterica serovar Typhi Ty2
gacggcccguaucgcucagg

SEQ ID NO: 1730588 - RNA, 18 nt, Salmonella enterica enterica serovar Typhi Ty2
gacggcagcgccauccgg

SEQ ID NO: 1730589 - RNA, 13 nt, Salmonella enterica enterica serovar Typhi Ty2
gacggcaucagga

SEQ ID NO: 1730590 - RNA, 15 nt, Salmonella enterica enterica serovar Typhi Ty2
gacgcuacgcgucgc

SEQ ID NO: 1730591 - RNA, 18 nt, Salmonella enterica enterica serovar Typhi Ty2
gacggccugucuccucag

SEQ ID NO: 1730592 - RNA, 23 nt, Salmonella enterica enterica serovar Typhi Ty2
gacggcgcgacauccgcuuuugg

SEQ ID NO: 1730593 - RNA, 23 nt, Salmonella enterica enterica serovar Typhi Ty2
gacgucaagaucgcgcagcaggc

SEQ ID NO: 1730594 - RNA, 12 nt, Salmonella enterica enterica serovar Typhi Ty2
gacguagcgcca

SEQ ID NO: 1730595 - RNA, 22 nt, Salmonella enterica enterica serovar Typhi Ty2
gacgggccgccaucuccggcag

SEQ ID NO: 1730596 - RNA, 12 nt, Salmonella enterica enterica serovar Typhi Ty2
gacgggccaggc

SEQ ID NO: 1730597 - RNA, 19 nt, Salmonella enterica enterica serovar Typhi Ty2
gacgagcagguuacucuuc

SEQ ID NO: 1730598 - RNA, 18 nt, Salmonella enterica enterica serovar Typhi Ty2
gacgaaccggcgccguuu

SEQ ID NO: 1730599 - RNA, 22 nt, Salmonella enterica enterica serovar Typhi Ty2
gaccuucaacccagcagcagau

SEQ ID NO: 1730600 - RNA, 19 nt, Salmonella enterica enterica serovar Typhi Ty2
gacgaagaucgcguacagc

SEQ ID NO: 1730601 - RNA, 14 nt, Salmonella enterica enterica serovar Typhi Ty2
gaccgcuucgcugg

SEQ ID NO: 1730602 - RNA, 21 nt, Salmonella enterica enterica serovar Typhi Ty2
gaccgucgcgcccuccuccag

SEQ ID NO: 1730603 - RNA, 14 nt, Salmonella enterica enterica serovar Typhi Ty2
gaccgucagcagca

SEQ ID NO: 1730604 - RNA, 13 nt, Salmonella enterica enterica serovar Typhi Ty2
gaccuccgcguac

SEQ ID NO: 1730605 - RNA, 13 nt, Salmonella enterica enterica serovar Typhi Ty2
gaccuccgccauc

SEQ ID NO: 1730606 - RNA, 14 nt, Salmonella enterica enterica serovar Typhi Ty2
gaccucaucaaaca

SEQ ID NO: 1730607 - RNA, 16 nt, Salmonella enterica enterica serovar Typhi Ty2
gaccauugauuuccgc

SEQ ID NO: 1730608 - RNA, 14 nt, Salmonella enterica enterica serovar Typhi Ty2
gaccaccgccauau

SEQ ID NO: 1730609 - RNA, 14 nt, Salmonella enterica enterica serovar Typhi Ty2
gaccgccagcagag

SEQ ID NO: 1730610 - RNA, 11 nt, Salmonella enterica enterica serovar Typhi Ty2
gaccgccauaa

SEQ ID NO: 1730611 - RNA, 10 nt, Salmonella enterica enterica serovar Typhi Ty2
gaccgccaug

SEQ ID NO: 1730612 - RNA, 22 nt, Salmonella enterica enterica serovar Typhi Ty2
gaccgccgaugcugaauagcca

SEQ ID NO: 1730613 - RNA, 18 nt, Salmonella enterica enterica serovar Typhi Ty2
gaccgccuaacagcgccg

SEQ ID NO: 1730614 - RNA, 19 nt, Salmonella enterica enterica serovar Typhi Ty2
gccaccaucgucgccagac

SEQ ID NO: 1730615 - RNA, 14 nt, Salmonella enterica enterica serovar Typhi Ty2
gccaccaucacuac

SEQ ID NO: 1730616 - RNA, 13 nt, Salmonella enterica enterica serovar Typhi Ty2
gccaccagcgcca

SEQ ID NO: 1730617 - RNA, 19 nt, Salmonella enterica enterica serovar Typhi Ty2
gccaccacgccgagaaaca

SEQ ID NO: 1730618 - RNA, 22 nt, Salmonella enterica enterica serovar Typhi Ty2
gccaccacucggcgagcaguac

SEQ ID NO: 1730619 - RNA, 16 nt, Salmonella enterica enterica serovar Typhi Ty2
gccaccgccgccacca

SEQ ID NO: 1730620 - RNA, 18 nt, Salmonella enterica enterica serovar Typhi Ty2
gccaaucgccgccgccag

SEQ ID NO: 1730621 - RNA, 16 nt, Salmonella enterica enterica serovar Typhi Ty2
gccaaucaccgccagc

SEQ ID NO: 1730622 - RNA, 23 nt, Salmonella enterica enterica serovar Typhi Ty2
gccaauccagaauaccagaauca

SEQ ID NO: 1730623 - RNA, 24 nt, Salmonella enterica enterica serovar Typhi Ty2
gccaagcgccuguucaacaugcug

SEQ ID NO: 1730624 - RNA, 16 nt, Salmonella enterica enterica serovar Typhi Ty2
gccaagcggcaacucu

SEQ ID NO: 1730625 - RNA, 22 nt, Salmonella enterica enterica serovar Typhi Ty2
gccaagcggcaucucgccaaac

SEQ ID NO: 1730626 - RNA, 14 nt, Salmonella enterica enterica serovar Typhi Ty2
gccaagaucgccaa

SEQ ID NO: 1730627 - RNA, 18 nt, Salmonella enterica enterica serovar Typhi Ty2
gccaacuuuuugcgcaau

SEQ ID NO: 1730628 - RNA, 21 nt, Salmonella enterica enterica serovar Typhi Ty2
gcauccauauaagcgguauuc

SEQ ID NO: 1730629 - RNA, 20 nt, Salmonella enterica enterica serovar Typhi Ty2
gcauccugcggguucaucgc

SEQ ID NO: 1730630 - RNA, 17 nt, Salmonella enterica enterica serovar Typhi Ty2
gcauccuccauccaggu

SEQ ID NO: 1730631 - RNA, 18 nt, Salmonella enterica enterica serovar Typhi Ty2
gccacagccauccgacgc

SEQ ID NO: 1730632 - RNA, 21 nt, Salmonella enterica enterica serovar Typhi Ty2
gccacaggaaccgguagccag

SEQ ID NO: 1730633 - RNA, 15 nt, Salmonella enterica enterica serovar Typhi Ty2
gccacagcgccagac

SEQ ID NO: 1730634 - RNA, 15 nt, Salmonella enterica enterica serovar Typhi Ty2
gccaccacauaccgu

SEQ ID NO: 1730635 - RNA, 13 nt, Salmonella enterica enterica serovar Typhi Ty2
gccacaucguuac

SEQ ID NO: 1730636 - RNA, 19 nt, Salmonella enterica enterica serovar Typhi Ty2
gccaaugaacucgccucgc

SEQ ID NO: 1730637 - RNA, 15 nt, Salmonella enterica enterica serovar Typhi Ty2
gccaauuccgccaua

SEQ ID NO: 1730638 - RNA, 15 nt, Salmonella enterica enterica serovar Typhi Ty2
gccacaacguugacc

SEQ ID NO: 1730639 - RNA, 13 nt, Salmonella enterica enterica serovar Typhi Ty2
gccacaaacugcg

SEQ ID NO: 1730640 - RNA, 13 nt, Salmonella enterica enterica serovar Typhi Ty2
gccagcagcgcac

SEQ ID NO: 1730641 - RNA, 13 nt, Salmonella enterica enterica serovar Typhi Ty2
gccagcaggcgca

SEQ ID NO: 1730642 - RNA, 17 nt, Salmonella enterica enterica serovar Typhi Ty2
gccagcgccaccaaagc

SEQ ID NO: 1730643 - RNA, 14 nt, Salmonella enterica enterica serovar Typhi Ty2
gccagcgaucaggc

SEQ ID NO: 1730644 - RNA, 16 nt, Salmonella enterica enterica serovar Typhi Ty2
gccagccuaucgccau

SEQ ID NO: 1730645 - RNA, 21 nt, Salmonella enterica enterica serovar Typhi Ty2
gccagccgauuuuucggcacg

SEQ ID NO: 1730646 - RNA, 15 nt, Salmonella enterica enterica serovar Typhi Ty2
gccaggaaccgccga

SEQ ID NO: 1730647 - RNA, 15 nt, Salmonella enterica enterica serovar Typhi Ty2
gccagcgggcgucga

SEQ ID NO: 1730648 - RNA, 15 nt, Salmonella enterica enterica serovar Typhi Ty2
gccagcgccagcguu

SEQ ID NO: 1730649 - RNA, 23 nt, Salmonella enterica enterica serovar Typhi Ty2
gccacuuccagcgcgccgucauc

SEQ ID NO: 1730650 - RNA, 19 nt, Salmonella enterica enterica serovar Typhi Ty2
gccagauaaagcagcgaca

SEQ ID NO: 1730651 - RNA, 15 nt, Salmonella enterica enterica serovar Typhi Ty2
gccagauagcgucuu

SEQ ID NO: 1730652 - RNA, 21 nt, Salmonella enterica enterica serovar Typhi Ty2
gccagaugucgcggauaugca

SEQ ID NO: 1730653 - RNA, 22 nt, Salmonella enterica enterica serovar Typhi Ty2
gccagauggaaaccggcgucuu

SEQ ID NO: 1730654 - RNA, 19 nt, Salmonella enterica enterica serovar Typhi Ty2
gccagcaacguuaaggccg

SEQ ID NO: 1730655 - RNA, 15 nt, Salmonella enterica enterica serovar Typhi Ty2
gccagcaacgcccag

SEQ ID NO: 1730656 - RNA, 21 nt, Salmonella enterica enterica serovar Typhi Ty2
gccagcacgaggguaauggcu

SEQ ID NO: 1730657 - RNA, 21 nt, Salmonella enterica enterica serovar Typhi Ty2
gccacuuaccaaucgcggcga

SEQ ID NO: 1730658 - RNA, 23 nt, Salmonella enterica enterica serovar Typhi Ty2
gccacgccccuaaggcagcaagg

SEQ ID NO: 1730659 - RNA, 14 nt, Salmonella enterica enterica serovar Typhi Ty2
gccacgcuguucgc

SEQ ID NO: 1730660 - RNA, 14 nt, Salmonella enterica enterica serovar Typhi Ty2
gcccagaucaggcc

SEQ ID NO: 1730661 - RNA, 15 nt, Salmonella enterica enterica serovar Typhi Ty2
gcccagcagcugcug

SEQ ID NO: 1730662 - RNA, 18 nt, Salmonella enterica enterica serovar Typhi Ty2
gcccagcacuaacagcag

SEQ ID NO: 1730663 - RNA, 12 nt, Salmonella enterica enterica serovar Typhi Ty2
gcccaccgcaua

SEQ ID NO: 1730664 - RNA, 17 nt, Salmonella enterica enterica serovar Typhi Ty2
gccaugcuauucagcag

SEQ ID NO: 1730665 - RNA, 14 nt, Salmonella enterica enterica serovar Typhi Ty2
gccaugcggcgcca

SEQ ID NO: 1730666 - RNA, 18 nt, Salmonella enterica enterica serovar Typhi Ty2
gccaguuagcgaucgcgc

SEQ ID NO: 1730667 - RNA, 22 nt, Salmonella enterica enterica serovar Typhi Ty2
gccaguucacgccgccgccgac

SEQ ID NO: 1730668 - RNA, 19 nt, Salmonella enterica enterica serovar Typhi Ty2
gccaguuuacgcguacucg

SEQ ID NO: 1730669 - RNA, 15 nt, Salmonella enterica enterica serovar Typhi Ty2
gccaguuuuccgccu

SEQ ID NO: 1730670 - RNA, 18 nt, Salmonella enterica enterica serovar Typhi Ty2
gccaguagauggcgcuaa

SEQ ID NO: 1730671 - RNA, 18 nt, Salmonella enterica enterica serovar Typhi Ty2
gccaguacagcagcgacg

SEQ ID NO: 1730672 - RNA, 14 nt, Salmonella enterica enterica serovar Typhi Ty2
gccagucgcagaug

SEQ ID NO: 1730673 - RNA, 16 nt, Salmonella enterica enterica serovar Typhi Ty2
gccaugaugagcgcca

SEQ ID NO: 1730674 - RNA, 16 nt, Salmonella enterica enterica serovar Typhi Ty2
gccaucgacagcgcca

SEQ ID NO: 1730675 - RNA, 14 nt, Salmonella enterica enterica serovar Typhi Ty2
gccaucguccagcc

SEQ ID NO: 1730676 - RNA, 17 nt, Salmonella enterica enterica serovar Typhi Ty2
gccaucuccaucauuuc

SEQ ID NO: 1730677 - RNA, 16 nt, Salmonella enterica enterica serovar Typhi Ty2
gccaucgucgccacca

SEQ ID NO: 1730678 - RNA, 18 nt, Salmonella enterica enterica serovar Typhi Ty2
gccaugaucgccgccauc

SEQ ID NO: 1730679 - RNA, 22 nt, Salmonella enterica enterica serovar Typhi Ty2
gccaucuccaucauuuccggcg

SEQ ID NO: 1730680 - RNA, 16 nt, Salmonella enterica enterica serovar Typhi Ty2
gccauccugcgugccg

SEQ ID NO: 1730681 - RNA, 17 nt, Salmonella enterica enterica serovar Typhi Ty2
gccauccugccgcacca

SEQ ID NO: 1730682 - RNA, 13 nt, Salmonella enterica enterica serovar Typhi Ty2
gccauccggcauu

SEQ ID NO: 1730683 - RNA, 18 nt, Salmonella enterica enterica serovar Typhi Ty2
gccauccggcaucucuuc

SEQ ID NO: 1730684 - RNA, 15 nt, Salmonella enterica enterica serovar Typhi Ty2
gccauccggcgcuga

SEQ ID NO: 1730685 - RNA, 23 nt, Salmonella enterica enterica serovar Typhi Ty2
gccauaaugcacaauacgccgag

SEQ ID NO: 1730686 - RNA, 13 nt, Salmonella enterica enterica serovar Typhi Ty2
gccauccggcaca

SEQ ID NO: 1730687 - RNA, 22 nt, Salmonella enterica enterica serovar Typhi Ty2
gccauacagguuuuaaucguuu

SEQ ID NO: 1730688 - RNA, 16 nt, Salmonella enterica enterica serovar Typhi Ty2
gccccucuugcagcaa

SEQ ID NO: 1730689 - RNA, 23 nt, Salmonella enterica enterica serovar Typhi Ty2
gccccgguggcgguaccggcauu

SEQ ID NO: 1730690 - RNA, 19 nt, Salmonella enterica enterica serovar Typhi Ty2
gcccgauaagcaagcgcca

SEQ ID NO: 1730691 - RNA, 17 nt, Salmonella enterica enterica serovar Typhi Ty2
gccccugcaggcgaucc

SEQ ID NO: 1730692 - RNA, 21 nt, Salmonella enterica enterica serovar Typhi Ty2
gcccgauaagcaagcgccauc

SEQ ID NO: 1730693 - RNA, 23 nt, Salmonella enterica enterica serovar Typhi Ty2
gcccgauggcgcugcguuuauca

SEQ ID NO: 1730694 - RNA, 21 nt, Salmonella enterica enterica serovar Typhi Ty2
gcccgauggcgcugcgcgcau

SEQ ID NO: 1730695 - RNA, 14 nt, Salmonella enterica enterica serovar Typhi Ty2
gcccaucagcgcca

SEQ ID NO: 1730696 - RNA, 20 nt, Salmonella enterica enterica serovar Typhi Ty2
gcccauauccaucuggcggu

SEQ ID NO: 1730697 - RNA, 18 nt, Salmonella enterica enterica serovar Typhi Ty2
gcccaucaucaucggcac

SEQ ID NO: 1730698 - RNA, 19 nt, Salmonella enterica enterica serovar Typhi Ty2
gcccauaccccacgccaua

SEQ ID NO: 1730699 - RNA, 18 nt, Salmonella enterica enterica serovar Typhi Ty2
gcccaggcgccgcucauc

SEQ ID NO: 1730700 - RNA, 17 nt, Salmonella enterica enterica serovar Typhi Ty2
gcccccgaucacggcga

SEQ ID NO: 1730701 - RNA, 14 nt, Salmonella enterica enterica serovar Typhi Ty2
gccccaucacggga

SEQ ID NO: 1730702 - RNA, 17 nt, Salmonella enterica enterica serovar Typhi Ty2
gccccccuaccggaauc

SEQ ID NO: 1730703 - RNA, 19 nt, Salmonella enterica enterica serovar Typhi Ty2
gcccuuuuuuguugugaua

SEQ ID NO: 1730704 - RNA, 17 nt, Salmonella enterica enterica serovar Typhi Ty2
gccgaacaguuucucgc

SEQ ID NO: 1730705 - RNA, 20 nt, Salmonella enterica enterica serovar Typhi Ty2
gcccuucgaccgucagcagc

SEQ ID NO: 1730706 - RNA, 23 nt, Salmonella enterica enterica serovar Typhi Ty2
gcccuggaggaacagcgccguca

SEQ ID NO: 1730707 - RNA, 14 nt, Salmonella enterica enterica serovar Typhi Ty2
gcccuguuauucag

SEQ ID NO: 1730708 - RNA, 20 nt, Salmonella enterica enterica serovar Typhi Ty2
gcccuggcuguccuugcgcc

SEQ ID NO: 1730709 - RNA, 18 nt, Salmonella enterica enterica serovar Typhi Ty2
gcccguagauaagcgcca

SEQ ID NO: 1730710 - RNA, 15 nt, Salmonella enterica enterica serovar Typhi Ty2
gcccgguuacgcuuc

SEQ ID NO: 1730711 - RNA, 16 nt, Salmonella enterica enterica serovar Typhi Ty2
gcccgccucgcugaua

SEQ ID NO: 1730712 - RNA, 19 nt, Salmonella enterica enterica serovar Typhi Ty2
gcccgguggcgccacgcca

SEQ ID NO: 1730713 - RNA, 22 nt, Salmonella enterica enterica serovar Typhi Ty2
gcccugcgguagcuccagacag

SEQ ID NO: 1730714 - RNA, 22 nt, Salmonella enterica enterica serovar Typhi Ty2
gcccugaaagccgacccgcauc

SEQ ID NO: 1730715 - RNA, 19 nt, Salmonella enterica enterica serovar Typhi Ty2
gcccucuaagcgcucaaau

SEQ ID NO: 1730716 - RNA, 14 nt, Salmonella enterica enterica serovar Typhi Ty2
gccgaucaucccgc

SEQ ID NO: 1730717 - RNA, 16 nt, Salmonella enterica enterica serovar Typhi Ty2
gccgaucaccagcgca

SEQ ID NO: 1730718 - RNA, 19 nt, Salmonella enterica enterica serovar Typhi Ty2
gccgauauugcggccuucc

SEQ ID NO: 1730719 - RNA, 12 nt, Salmonella enterica enterica serovar Typhi Ty2
gccgaucaggcc

SEQ ID NO: 1730720 - RNA, 23 nt, Salmonella enterica enterica serovar Typhi Ty2
gccgaguccgaggcgaaacggcg

SEQ ID NO: 1730721 - RNA, 17 nt, Salmonella enterica enterica serovar Typhi Ty2
gccgcacaccagcgcau

SEQ ID NO: 1730722 - RNA, 21 nt, Salmonella enterica enterica serovar Typhi Ty2
gccgcaauuccugacugcgcg

SEQ ID NO: 1730723 - RNA, 21 nt, Salmonella enterica enterica serovar Typhi Ty2
gccgaugagaugucaucggcu

SEQ ID NO: 1730724 - RNA, 12 nt, Salmonella enterica enterica serovar Typhi Ty2
gccgaugaccag

SEQ ID NO: 1730725 - RNA, 15 nt, Salmonella enterica enterica serovar Typhi Ty2
gccgacgcauccgcc

SEQ ID NO: 1730726 - RNA, 21 nt, Salmonella enterica enterica serovar Typhi Ty2
gccgacgccacccagcgaacu

SEQ ID NO: 1730727 - RNA, 14 nt, Salmonella enterica enterica serovar Typhi Ty2
gccgacgcauccgc

SEQ ID NO: 1730728 - RNA, 15 nt, Salmonella enterica enterica serovar Typhi Ty2
gccgacucgcgcaau

SEQ ID NO: 1730729 - RNA, 12 nt, Salmonella enterica enterica serovar Typhi Ty2
gccgacucacgc

SEQ ID NO: 1730730 - RNA, 18 nt, Salmonella enterica enterica serovar Typhi Ty2
gccgacucacgcagcgcu

SEQ ID NO: 1730731 - RNA, 23 nt, Salmonella enterica enterica serovar Typhi Ty2
gccgacuggcaccacgaccagac

SEQ ID NO: 1730732 - RNA, 16 nt, Salmonella enterica enterica serovar Typhi Ty2
gccgacgaccggcagc

SEQ ID NO: 1730733 - RNA, 23 nt, Salmonella enterica enterica serovar Typhi Ty2
gccgaccccaugacggccugcgc

SEQ ID NO: 1730734 - RNA, 20 nt, Salmonella enterica enterica serovar Typhi Ty2
gccgacaucgcucccggcac

SEQ ID NO: 1730735 - RNA, 13 nt, Salmonella enterica enterica serovar Typhi Ty2
gccgacaucacgc

SEQ ID NO: 1730736 - RNA, 19 nt, Salmonella enterica enterica serovar Typhi Ty2
gccggauaagacgcuacgc

SEQ ID NO: 1730737 - RNA, 15 nt, Salmonella enterica enterica serovar Typhi Ty2
gccgcuuuaccgccu

SEQ ID NO: 1730738 - RNA, 17 nt, Salmonella enterica enterica serovar Typhi Ty2
gccggacaggcgacgcc

SEQ ID NO: 1730739 - RNA, 21 nt, Salmonella enterica enterica serovar Typhi Ty2
gccggacgcggcuuauccggc

SEQ ID NO: 1730740 - RNA, 14 nt, Salmonella enterica enterica serovar Typhi Ty2
gccggacgccacca

SEQ ID NO: 1730741 - RNA, 17 nt, Salmonella enterica enterica serovar Typhi Ty2
gccggacuguugaugau

SEQ ID NO: 1730742 - RNA, 21 nt, Salmonella enterica enterica serovar Typhi Ty2
gccgcuuuaaucaccauggcg

SEQ ID NO: 1730743 - RNA, 18 nt, Salmonella enterica enterica serovar Typhi Ty2
gccgcugggauucggcaa

SEQ ID NO: 1730744 - RNA, 14 nt, Salmonella enterica enterica serovar Typhi Ty2
gccgcuggcgucuu

SEQ ID NO: 1730745 - RNA, 21 nt, Salmonella enterica enterica serovar Typhi Ty2
gccgcuggugcuacgggcgcu

SEQ ID NO: 1730746 - RNA, 16 nt, Salmonella enterica enterica serovar Typhi Ty2
gccgccaucuccggca

SEQ ID NO: 1730747 - RNA, 22 nt, Salmonella enterica enterica serovar Typhi Ty2
gccgcccaggccugauaagcgc

SEQ ID NO: 1730748 - RNA, 16 nt, Salmonella enterica enterica serovar Typhi Ty2
gccgccauccggccug

SEQ ID NO: 1730749 - RNA, 16 nt, Salmonella enterica enterica serovar Typhi Ty2
gccgccauccggcauu

SEQ ID NO: 1730750 - RNA, 16 nt, Salmonella enterica enterica serovar Typhi Ty2
gccgccauccggcaac

SEQ ID NO: 1730751 - RNA, 16 nt, Salmonella enterica enterica serovar Typhi Ty2
gccgccauccggcaaa

SEQ ID NO: 1730752 - RNA, 14 nt, Salmonella enterica enterica serovar Typhi Ty2
gccgccauccggca

SEQ ID NO: 1730753 - RNA, 13 nt, Salmonella enterica enterica serovar Typhi Ty2
gccgccauccggc

SEQ ID NO: 1730754 - RNA, 12 nt, Salmonella enterica enterica serovar Typhi Ty2
gccgccauccgg

SEQ ID NO: 1730755 - RNA, 14 nt, Salmonella enterica enterica serovar Typhi Ty2
gccgccaucggcgc

SEQ ID NO: 1730756 - RNA, 19 nt, Salmonella enterica enterica serovar Typhi Ty2
gccgccagcucaugcgcgg

SEQ ID NO: 1730757 - RNA, 16 nt, Salmonella enterica enterica serovar Typhi Ty2
gccgccgccaucgucg

SEQ ID NO: 1730758 - RNA, 16 nt, Salmonella enterica enterica serovar Typhi Ty2
gccgcgcccagcgccg

SEQ ID NO: 1730759 - RNA, 22 nt, Salmonella enterica enterica serovar Typhi Ty2
gccgcgccgacauagcugaaca

SEQ ID NO: 1730760 - RNA, 18 nt, Salmonella enterica enterica serovar Typhi Ty2
gccgcgcccuaacaggcg

SEQ ID NO: 1730761 - RNA, 16 nt, Salmonella enterica enterica serovar Typhi Ty2
gcaccgaaacagcacg

SEQ ID NO: 1730762 - RNA, 13 nt, Salmonella enterica enterica serovar Typhi Ty2
gcaccgccgcauc

SEQ ID NO: 1730763 - RNA, 19 nt, Salmonella enterica enterica serovar Typhi Ty2
gcaccgucgagaaaccgcu

SEQ ID NO: 1730764 - RNA, 21 nt, Salmonella enterica enterica serovar Typhi Ty2
gcaccucgguauguccugccg

SEQ ID NO: 1730765 - RNA, 21 nt, Salmonella enterica enterica serovar Typhi Ty2
gcacgcuaaagcgcuggcggc

SEQ ID NO: 1730766 - RNA, 17 nt, Salmonella enterica enterica serovar Typhi Ty2
gcacgcuuuauccgguc

SEQ ID NO: 1730767 - RNA, 21 nt, Salmonella enterica enterica serovar Typhi Ty2
gcacgcuuuuuugcuggcugg

SEQ ID NO: 1730768 - RNA, 16 nt, Salmonella enterica enterica serovar Typhi Ty2
gcacguccagauacgc

SEQ ID NO: 1730769 - RNA, 14 nt, Salmonella enterica enterica serovar Typhi Ty2
gcacgccgcguuuu

SEQ ID NO: 1730770 - RNA, 14 nt, Salmonella enterica enterica serovar Typhi Ty2
gcaccuuauccggc

SEQ ID NO: 1730771 - RNA, 19 nt, Salmonella enterica enterica serovar Typhi Ty2
gcaaucacuuccgccucgc

SEQ ID NO: 1730772 - RNA, 16 nt, Salmonella enterica enterica serovar Typhi Ty2
gcaaucacuuccgccu

SEQ ID NO: 1730773 - RNA, 22 nt, Salmonella enterica enterica serovar Typhi Ty2
gcaaucacguuuugcagcgcca

SEQ ID NO: 1730774 - RNA, 16 nt, Salmonella enterica enterica serovar Typhi Ty2
gcaaugccgccgccag

SEQ ID NO: 1730775 - RNA, 13 nt, Salmonella enterica enterica serovar Typhi Ty2
gcaaugcccacgc

SEQ ID NO: 1730776 - RNA, 16 nt, Salmonella enterica enterica serovar Typhi Ty2
gcaaugcccacgccgu

SEQ ID NO: 1730777 - RNA, 20 nt, Salmonella enterica enterica serovar Typhi Ty2
gcaaucgcuuccagcgccgg

SEQ ID NO: 1730778 - RNA, 23 nt, Salmonella enterica enterica serovar Typhi Ty2
gcacaacacgcuuuucagcgcca

SEQ ID NO: 1730779 - RNA, 16 nt, Salmonella enterica enterica serovar Typhi Ty2
gcaauguggacaauca

SEQ ID NO: 1730780 - RNA, 24 nt, Salmonella enterica enterica serovar Typhi Ty2
gcaaugucaucguuugcgcuacgc

SEQ ID NO: 1730781 - RNA, 17 nt, Salmonella enterica enterica serovar Typhi Ty2
gcaaugccgccugcggu

SEQ ID NO: 1730782 - RNA, 14 nt, Salmonella enterica enterica serovar Typhi Ty2
gcaaugccgcgcuu

SEQ ID NO: 1730783 - RNA, 15 nt, Salmonella enterica enterica serovar Typhi Ty2
gcaaacggcuggaua

SEQ ID NO: 1730784 - RNA, 13 nt, Salmonella enterica enterica serovar Typhi Ty2
gcaaacgcgauac

SEQ ID NO: 1730785 - RNA, 15 nt, Salmonella enterica enterica serovar Typhi Ty2
gcaaacgacgcugac

SEQ ID NO: 1730786 - RNA, 17 nt, Salmonella enterica enterica serovar Typhi Ty2
gcaaaccuaccggcaua

SEQ ID NO: 1730787 - RNA, 21 nt, Salmonella enterica enterica serovar Typhi Ty2
gcaaacgccgaagccagcgca

SEQ ID NO: 1730788 - RNA, 15 nt, Salmonella enterica enterica serovar Typhi Ty2
gcaaaccuuccgcca

SEQ ID NO: 1730789 - RNA, 23 nt, Salmonella enterica enterica serovar Typhi Ty2
gcaauaccacgcccgccgccagc

SEQ ID NO: 1730790 - RNA, 18 nt, Salmonella enterica enterica serovar Typhi Ty2
gcaauacagcccgccagc

SEQ ID NO: 1730791 - RNA, 13 nt, Salmonella enterica enterica serovar Typhi Ty2
gcaaacgguuaau

SEQ ID NO: 1730792 - RNA, 13 nt, Salmonella enterica enterica serovar Typhi Ty2
gcaauaauccgcu

SEQ ID NO: 1730793 - RNA, 18 nt, Salmonella enterica enterica serovar Typhi Ty2
gcaauaugcggcgccauc

SEQ ID NO: 1730794 - RNA, 20 nt, Salmonella enterica enterica serovar Typhi Ty2
gcaauauuaaugucaugcgc

SEQ ID NO: 1730795 - RNA, 15 nt, Salmonella enterica enterica serovar Typhi Ty2
gcaaucacgcguuau

SEQ ID NO: 1730796 - RNA, 15 nt, Salmonella enterica enterica serovar Typhi Ty2
gcaaucaccugcauc

SEQ ID NO: 1730797 - RNA, 19 nt, Salmonella enterica enterica serovar Typhi Ty2
gcaauacuguaagccucgc

SEQ ID NO: 1730798 - RNA, 17 nt, Salmonella enterica enterica serovar Typhi Ty2
gcaauacuggaccccag

SEQ ID NO: 1730799 - RNA, 16 nt, Salmonella enterica enterica serovar Typhi Ty2
gcaauauaaauaucau

SEQ ID NO: 1730800 - RNA, 15 nt, Salmonella enterica enterica serovar Typhi Ty2
gcaauagcgcgucgu

SEQ ID NO: 1730801 - RNA, 16 nt, Salmonella enterica enterica serovar Typhi Ty2
gcacagccccagcacc

SEQ ID NO: 1730802 - RNA, 17 nt, Salmonella enterica enterica serovar Typhi Ty2
gcacagccccagcacca

SEQ ID NO: 1730803 - RNA, 17 nt, Salmonella enterica enterica serovar Typhi Ty2
gcacagcacuaacgagg

SEQ ID NO: 1730804 - RNA, 17 nt, Salmonella enterica enterica serovar Typhi Ty2
gcacacuuucaucagcc

SEQ ID NO: 1730805 - RNA, 16 nt, Salmonella enterica enterica serovar Typhi Ty2
gcacacgcagcugaug

SEQ ID NO: 1730806 - RNA, 13 nt, Salmonella enterica enterica serovar Typhi Ty2
gcacaacggccag

SEQ ID NO: 1730807 - RNA, 12 nt, Salmonella enterica enterica serovar Typhi Ty2
gcacaucagccg

SEQ ID NO: 1730808 - RNA, 22 nt, Salmonella enterica enterica serovar Typhi Ty2
gcacaucgucuuuuaccgcguc

SEQ ID NO: 1730809 - RNA, 20 nt, Salmonella enterica enterica serovar Typhi Ty2
gcacaucaauaaauccgcgc

SEQ ID NO: 1730810 - RNA, 21 nt, Salmonella enterica enterica serovar Typhi Ty2
gcacaggcgcggagacgugac

SEQ ID NO: 1730811 - RNA, 18 nt, Salmonella enterica enterica serovar Typhi Ty2
gcaccaucuuuuccggca

SEQ ID NO: 1730812 - RNA, 13 nt, Salmonella enterica enterica serovar Typhi Ty2
gcaccauuaucgc

SEQ ID NO: 1730813 - RNA, 16 nt, Salmonella enterica enterica serovar Typhi Ty2
gcaccaguuccccaua

SEQ ID NO: 1730814 - RNA, 15 nt, Salmonella enterica enterica serovar Typhi Ty2
gcaccagcauuagcg

SEQ ID NO: 1730815 - RNA, 18 nt, Salmonella enterica enterica serovar Typhi Ty2
gcacauguuucagcaccu

SEQ ID NO: 1730816 - RNA, 13 nt, Salmonella enterica enterica serovar Typhi Ty2
gcacauuagcaau

SEQ ID NO: 1730817 - RNA, 15 nt, Salmonella enterica enterica serovar Typhi Ty2
gcacaucccgaauac

SEQ ID NO: 1730818 - RNA, 13 nt, Salmonella enterica enterica serovar Typhi Ty2
gcacauucagcag

SEQ ID NO: 1730819 - RNA, 18 nt, Salmonella enterica enterica serovar Typhi Ty2
gcacauucagcagcgccc

SEQ ID NO: 1730820 - RNA, 22 nt, Salmonella enterica enterica serovar Typhi Ty2
gcacauucgauaaccgccgaca

SEQ ID NO: 1730821 - RNA, 12 nt, Salmonella enterica enterica serovar Typhi Ty2
gcaccagaccga

SEQ ID NO: 1730822 - RNA, 17 nt, Salmonella enterica enterica serovar Typhi Ty2
gcaguccuugcagccag

SEQ ID NO: 1730823 - RNA, 17 nt, Salmonella enterica enterica serovar Typhi Ty2
gcagucgcaucauggcg

SEQ ID NO: 1730824 - RNA, 18 nt, Salmonella enterica enterica serovar Typhi Ty2
gcagucguuuacgcgcuu

SEQ ID NO: 1730825 - RNA, 17 nt, Salmonella enterica enterica serovar Typhi Ty2
gcagugaagaauggcgc

SEQ ID NO: 1730826 - RNA, 18 nt, Salmonella enterica enterica serovar Typhi Ty2
gcaguguaucguugucgc

SEQ ID NO: 1730827 - RNA, 21 nt, Salmonella enterica enterica serovar Typhi Ty2
gcaguucaucuucccgcagau

SEQ ID NO: 1730828 - RNA, 14 nt, Salmonella enterica enterica serovar Typhi Ty2
gcauacguuucacc

SEQ ID NO: 1730829 - RNA, 16 nt, Salmonella enterica enterica serovar Typhi Ty2
gcauacgacaucgcca

SEQ ID NO: 1730830 - RNA, 16 nt, Salmonella enterica enterica serovar Typhi Ty2
gcauacugcgaugcgc

SEQ ID NO: 1730831 - RNA, 22 nt, Salmonella enterica enterica serovar Typhi Ty2
gcauaguccugccgacaggcag

SEQ ID NO: 1730832 - RNA, 15 nt, Salmonella enterica enterica serovar Typhi Ty2
gcauacuaccgcugc

SEQ ID NO: 1730833 - RNA, 22 nt, Salmonella enterica enterica serovar Typhi Ty2
gcauacucuuggagagcaucau

SEQ ID NO: 1730834 - RNA, 14 nt, Salmonella enterica enterica serovar Typhi Ty2
gcauauuuagccca

SEQ ID NO: 1730835 - RNA, 22 nt, Salmonella enterica enterica serovar Typhi Ty2
gcauauugcguaucguaagcca

SEQ ID NO: 1730836 - RNA, 21 nt, Salmonella enterica enterica serovar Typhi Ty2
gcaucaaacuuuuaaauugaa

SEQ ID NO: 1730837 - RNA, 22 nt, Salmonella enterica enterica serovar Typhi Ty2
gcaucaacguuguccagcggcc

SEQ ID NO: 1730838 - RNA, 16 nt, Salmonella enterica enterica serovar Typhi Ty2
gcaucagacuguuacg

SEQ ID NO: 1730839 - RNA, 20 nt, Salmonella enterica enterica serovar Typhi Ty2
gcaucagcaauuucucgccc

SEQ ID NO: 1730840 - RNA, 17 nt, Salmonella enterica enterica serovar Typhi Ty2
gcauccagcacgagcgc

SEQ ID NO: 1730841 - RNA, 19 nt, Salmonella enterica enterica serovar Typhi Ty2
gcaucaugcuaaaagcgac

SEQ ID NO: 1730842 - RNA, 13 nt, Salmonella enterica enterica serovar Typhi Ty2
gcaucaugucccc

SEQ ID NO: 1730843 - RNA, 15 nt, Salmonella enterica enterica serovar Typhi Ty2
gcaucauauucgcag

SEQ ID NO: 1730844 - RNA, 11 nt, Salmonella enterica enterica serovar Typhi Ty2
gcaucaucaaa

SEQ ID NO: 1730845 - RNA, 21 nt, Salmonella enterica enterica serovar Typhi Ty2
gcaucaucucccaggccgcca

SEQ ID NO: 1730846 - RNA, 21 nt, Salmonella enterica enterica serovar Typhi Ty2
gcaucauccccaccgcugaug

SEQ ID NO: 1730847 - RNA, 18 nt, Salmonella enterica enterica serovar Typhi Ty2
gcaggccuuucggcagcg

SEQ ID NO: 1730848 - RNA, 21 nt, Salmonella enterica enterica serovar Typhi Ty2
gcaggcgaccucgcagguacg

SEQ ID NO: 1730849 - RNA, 14 nt, Salmonella enterica enterica serovar Typhi Ty2
gcaggccuggcugg

SEQ ID NO: 1730850 - RNA, 17 nt, Salmonella enterica enterica serovar Typhi Ty2
gcaggcuuccacgcacg

SEQ ID NO: 1730851 - RNA, 16 nt, Salmonella enterica enterica serovar Typhi Ty2
gcaggcuggcgguaac

SEQ ID NO: 1730852 - RNA, 15 nt, Salmonella enterica enterica serovar Typhi Ty2
gcagcuuaaagccaa

SEQ ID NO: 1730853 - RNA, 16 nt, Salmonella enterica enterica serovar Typhi Ty2
gcagcuucagccaguc

SEQ ID NO: 1730854 - RNA, 14 nt, Salmonella enterica enterica serovar Typhi Ty2
gcaggauccccauc

SEQ ID NO: 1730855 - RNA, 20 nt, Salmonella enterica enterica serovar Typhi Ty2
gcaggauaaagaccggcaca

SEQ ID NO: 1730856 - RNA, 13 nt, Salmonella enterica enterica serovar Typhi Ty2
gcagcaccggcau

SEQ ID NO: 1730857 - RNA, 22 nt, Salmonella enterica enterica serovar Typhi Ty2
gcagaucuuuuugcuccugcgc

SEQ ID NO: 1730858 - RNA, 15 nt, Salmonella enterica enterica serovar Typhi Ty2
gcagcaauacgcccg

SEQ ID NO: 1730859 - RNA, 16 nt, Salmonella enterica enterica serovar Typhi Ty2
gcagcacaaucagcgc

SEQ ID NO: 1730860 - RNA, 15 nt, Salmonella enterica enterica serovar Typhi Ty2
gcagauaacuuccuu

SEQ ID NO: 1730861 - RNA, 19 nt, Salmonella enterica enterica serovar Typhi Ty2
gcagauaccgaccgugaga

SEQ ID NO: 1730862 - RNA, 19 nt, Salmonella enterica enterica serovar Typhi Ty2
gcagaguacgucgccuucc

SEQ ID NO: 1730863 - RNA, 23 nt, Salmonella enterica enterica serovar Typhi Ty2
gcagaguacgucgccuuccugca

SEQ ID NO: 1730864 - RNA, 16 nt, Salmonella enterica enterica serovar Typhi Ty2
gcagagcccagcgcga

SEQ ID NO: 1730865 - RNA, 18 nt, Salmonella enterica enterica serovar Typhi Ty2
gcagccaacaacaggccg

SEQ ID NO: 1730866 - RNA, 20 nt, Salmonella enterica enterica serovar Typhi Ty2
gcagcauacgcaguaacguc

SEQ ID NO: 1730867 - RNA, 14 nt, Salmonella enterica enterica serovar Typhi Ty2
gcagcaucgccauc

SEQ ID NO: 1730868 - RNA, 18 nt, Salmonella enterica enterica serovar Typhi Ty2
gcagcagaaucaggcaca

SEQ ID NO: 1730869 - RNA, 14 nt, Salmonella enterica enterica serovar Typhi Ty2
gcagcacguccaga

SEQ ID NO: 1730870 - RNA, 14 nt, Salmonella enterica enterica serovar Typhi Ty2
gcagcucaucaaua

SEQ ID NO: 1730871 - RNA, 20 nt, Salmonella enterica enterica serovar Typhi Ty2
gcagcucaucaauaaggguc

SEQ ID NO: 1730872 - RNA, 20 nt, Salmonella enterica enterica serovar Typhi Ty2
gcagcucaagcgccgcgaua

SEQ ID NO: 1730873 - RNA, 14 nt, Salmonella enterica enterica serovar Typhi Ty2
gcagcggucaucaa

SEQ ID NO: 1730874 - RNA, 15 nt, Salmonella enterica enterica serovar Typhi Ty2
gcagcguccgccauc

SEQ ID NO: 1730875 - RNA, 15 nt, Salmonella enterica enterica serovar Typhi Ty2
gcagcgccauccggc

SEQ ID NO: 1730876 - RNA, 14 nt, Salmonella enterica enterica serovar Typhi Ty2
gcagcgccaucagg

SEQ ID NO: 1730877 - RNA, 18 nt, Salmonella enterica enterica serovar Typhi Ty2
gcagcgcccagccaaagc

SEQ ID NO: 1730878 - RNA, 17 nt, Salmonella enterica enterica serovar Typhi Ty2
gcagcgcugaaucgcaa

SEQ ID NO: 1730879 - RNA, 17 nt, Salmonella enterica enterica serovar Typhi Ty2
gcagccucguccugcaa

SEQ ID NO: 1730880 - RNA, 21 nt, Salmonella enterica enterica serovar Typhi Ty2
gcagccaguuguucgauaacc

SEQ ID NO: 1730881 - RNA, 16 nt, Salmonella enterica enterica serovar Typhi Ty2
gaugguguuaccgcca

SEQ ID NO: 1730882 - RNA, 20 nt, Salmonella enterica enterica serovar Typhi Ty2
gauguccgccuugaggcguu

SEQ ID NO: 1730883 - RNA, 18 nt, Salmonella enterica enterica serovar Typhi Ty2
gaugucaauuacgcacca

SEQ ID NO: 1730884 - RNA, 11 nt, Salmonella enterica enterica serovar Typhi Ty2
gaugucauccg

SEQ ID NO: 1730885 - RNA, 14 nt, Salmonella enterica enterica serovar Typhi Ty2
gaugucggucauca

SEQ ID NO: 1730886 - RNA, 20 nt, Salmonella enterica enterica serovar Typhi Ty2
gaugucgcuucgcuuaucug

SEQ ID NO: 1730887 - RNA, 17 nt, Salmonella enterica enterica serovar Typhi Ty2
gauuaagggacgguaaa

SEQ ID NO: 1730888 - RNA, 15 nt, Salmonella enterica enterica serovar Typhi Ty2
gaugugauuaaacgc

SEQ ID NO: 1730889 - RNA, 18 nt, Salmonella enterica enterica serovar Typhi Ty2
gauucagcgcaggcaguu

SEQ ID NO: 1730890 - RNA, 15 nt, Salmonella enterica enterica serovar Typhi Ty2
gauuacccguuguua

SEQ ID NO: 1730891 - RNA, 21 nt, Salmonella enterica enterica serovar Typhi Ty2
gauugagggggaggcggcgag

SEQ ID NO: 1730892 - RNA, 13 nt, Salmonella enterica enterica serovar Typhi Ty2
gauuuuguuaugc

SEQ ID NO: 1730893 - RNA, 19 nt, Salmonella enterica enterica serovar Typhi Ty2
gauuuuaucaagucgcguu

SEQ ID NO: 1730894 - RNA, 21 nt, Salmonella enterica enterica serovar Typhi Ty2
gauuuggucagucggauaaac

SEQ ID NO: 1730895 - RNA, 18 nt, Salmonella enterica enterica serovar Typhi Ty2
gcaaaaccagacgccgau

SEQ ID NO: 1730896 - RNA, 14 nt, Salmonella enterica enterica serovar Typhi Ty2
gauuuuuuugcugg

SEQ ID NO: 1730897 - RNA, 22 nt, Salmonella enterica enterica serovar Typhi Ty2
gaugcugguuuuagcuuauccc

SEQ ID NO: 1730898 - RNA, 17 nt, Salmonella enterica enterica serovar Typhi Ty2
gaugcguaauccggccu

SEQ ID NO: 1730899 - RNA, 17 nt, Salmonella enterica enterica serovar Typhi Ty2
gaugcugcgcauccgcg

SEQ ID NO: 1730900 - RNA, 18 nt, Salmonella enterica enterica serovar Typhi Ty2
gaugcgcguuuagcgcca

SEQ ID NO: 1730901 - RNA, 20 nt, Salmonella enterica enterica serovar Typhi Ty2
gaugcgcucacgcuuauccg

SEQ ID NO: 1730902 - RNA, 18 nt, Salmonella enterica enterica serovar Typhi Ty2
gauggcgcuagcuuaucg

SEQ ID NO: 1730903 - RNA, 20 nt, Salmonella enterica enterica serovar Typhi Ty2
gauggcgcuacgcuuauccg

SEQ ID NO: 1730904 - RNA, 20 nt, Salmonella enterica enterica serovar Typhi Ty2
gauggcgcuacgcuuaucag

SEQ ID NO: 1730905 - RNA, 19 nt, Salmonella enterica enterica serovar Typhi Ty2
gauggcgcuucgcuuauca

SEQ ID NO: 1730906 - RNA, 19 nt, Salmonella enterica enterica serovar Typhi Ty2
gauggcgcugcgcuuauca

SEQ ID NO: 1730907 - RNA, 20 nt, Salmonella enterica enterica serovar Typhi Ty2
gauggcgcuuugcuuauccg

SEQ ID NO: 1730908 - RNA, 19 nt, Salmonella enterica enterica serovar Typhi Ty2
gauggcgcuacgcuuaucg

SEQ ID NO: 1730909 - RNA, 23 nt, Salmonella enterica enterica serovar Typhi Ty2
gauggcgcugcgcuuaucaggcc

SEQ ID NO: 1730910 - RNA, 14 nt, Salmonella enterica enterica serovar Typhi Ty2
gauggcggcguaaa

SEQ ID NO: 1730911 - RNA, 21 nt, Salmonella enterica enterica serovar Typhi Ty2
gauggcggcugcgccuuauca

SEQ ID NO: 1730912 - RNA, 23 nt, Salmonella enterica enterica serovar Typhi Ty2
gauggcggcuaacgccugauccg

SEQ ID NO: 1730913 - RNA, 22 nt, Salmonella enterica enterica serovar Typhi Ty2
gauggcggcuucgccuuauccg

SEQ ID NO: 1730914 - RNA, 19 nt, Salmonella enterica enterica serovar Typhi Ty2
gauggcgcuacgcuuauca

SEQ ID NO: 1730915 - RNA, 13 nt, Salmonella enterica enterica serovar Typhi Ty2
gaugcccauacgg

SEQ ID NO: 1730916 - RNA, 11 nt, Salmonella enterica enterica serovar Typhi Ty2
gaugccagaug

SEQ ID NO: 1730917 - RNA, 17 nt, Salmonella enterica enterica serovar Typhi Ty2
gaucccaggccggcaua

SEQ ID NO: 1730918 - RNA, 22 nt, Salmonella enterica enterica serovar Typhi Ty2
gauccccaucccaaucaggcuu

SEQ ID NO: 1730919 - RNA, 21 nt, Salmonella enterica enterica serovar Typhi Ty2
gauccccucuuccaucagcca

SEQ ID NO: 1730920 - RNA, 14 nt, Salmonella enterica enterica serovar Typhi Ty2
gaucgaggucagca

SEQ ID NO: 1730921 - RNA, 13 nt, Salmonella enterica enterica serovar Typhi Ty2
gaucgacuggcgg

SEQ ID NO: 1730922 - RNA, 19 nt, Salmonella enterica enterica serovar Typhi Ty2
gaucgcgcugcgcaggcgu

SEQ ID NO: 1730923 - RNA, 13 nt, Salmonella enterica enterica serovar Typhi Ty2
gaucgcgcagcag

SEQ ID NO: 1730924 - RNA, 13 nt, Salmonella enterica enterica serovar Typhi Ty2
gaucgcgugucgg

SEQ ID NO: 1730925 - RNA, 17 nt, Salmonella enterica enterica serovar Typhi Ty2
gaucgcuaaucaggaca

SEQ ID NO: 1730926 - RNA, 14 nt, Salmonella enterica enterica serovar Typhi Ty2
gaucguuuccagca

SEQ ID NO: 1730927 - RNA, 12 nt, Salmonella enterica enterica serovar Typhi Ty2
gaucucauacca

SEQ ID NO: 1730928 - RNA, 18 nt, Salmonella enterica enterica serovar Typhi Ty2
gaucugcuugagcaggca

SEQ ID NO: 1730929 - RNA, 23 nt, Salmonella enterica enterica serovar Typhi Ty2
gaugauguuugugaccccggccu

SEQ ID NO: 1730930 - RNA, 15 nt, Salmonella enterica enterica serovar Typhi Ty2
gaugauguucaucgc

SEQ ID NO: 1730931 - RNA, 14 nt, Salmonella enterica enterica serovar Typhi Ty2
gaugauuuucaagc

SEQ ID NO: 1730932 - RNA, 19 nt, Salmonella enterica enterica serovar Typhi Ty2
gaugcacggaugcaucaug

SEQ ID NO: 1730933 - RNA, 18 nt, Salmonella enterica enterica serovar Typhi Ty2
gaugcagacgggcgucca

SEQ ID NO: 1730934 - RNA, 21 nt, Salmonella enterica enterica serovar Typhi Ty2
gaugacgcuaacgcuuauccg

SEQ ID NO: 1730935 - RNA, 20 nt, Salmonella enterica enterica serovar Typhi Ty2
gaugacgcugcgcuuauccg

SEQ ID NO: 1730936 - RNA, 17 nt, Salmonella enterica enterica serovar Typhi Ty2
gaugacggcgcguuauc

SEQ ID NO: 1730937 - RNA, 20 nt, Salmonella enterica enterica serovar Typhi Ty2
gaugacgcuucgcuuauccg

SEQ ID NO: 1730938 - RNA, 17 nt, Salmonella enterica enterica serovar Typhi Ty2
gaugacggcagcgcguu

SEQ ID NO: 1730939 - RNA, 22 nt, Salmonella enterica enterica serovar Typhi Ty2
gaugaaaggucgaaaacggcca

SEQ ID NO: 1730940 - RNA, 17 nt, Salmonella enterica enterica serovar Typhi Ty2
gaugacucucggccuau

SEQ ID NO: 1730941 - RNA, 16 nt, Salmonella enterica enterica serovar Typhi Ty2
gaugacuaaaucagca

SEQ ID NO: 1730942 - RNA, 22 nt, Salmonella enterica enterica serovar Typhi Ty2
gagccuuacaggcgcaucagaa

SEQ ID NO: 1730943 - RNA, 19 nt, Salmonella enterica enterica serovar Typhi Ty2
gagcgaauccccgggaaca

SEQ ID NO: 1730944 - RNA, 17 nt, Salmonella enterica enterica serovar Typhi Ty2
gagcgacgucccgucag

SEQ ID NO: 1730945 - RNA, 16 nt, Salmonella enterica enterica serovar Typhi Ty2
gagcgccguaccgcgu

SEQ ID NO: 1730946 - RNA, 23 nt, Salmonella enterica enterica serovar Typhi Ty2
gagcgggucaacgccaagcgcgg

SEQ ID NO: 1730947 - RNA, 21 nt, Salmonella enterica enterica serovar Typhi Ty2
gagcguuacccagacagcaaa

SEQ ID NO: 1730948 - RNA, 23 nt, Salmonella enterica enterica serovar Typhi Ty2
gagccggacacugcgagggauuu

SEQ ID NO: 1730949 - RNA, 19 nt, Salmonella enterica enterica serovar Typhi Ty2
gagccguaaacggaaccaa

SEQ ID NO: 1730950 - RNA, 14 nt, Salmonella enterica enterica serovar Typhi Ty2
gagccgccauccgg

SEQ ID NO: 1730951 - RNA, 13 nt, Salmonella enterica enterica serovar Typhi Ty2
gacgucgucacca

SEQ ID NO: 1730952 - RNA, 22 nt, Salmonella enterica enterica serovar Typhi Ty2
gagccacuauccagucagcguu

SEQ ID NO: 1730953 - RNA, 14 nt, Salmonella enterica enterica serovar Typhi Ty2
gagccaaugaccau

SEQ ID NO: 1730954 - RNA, 22 nt, Salmonella enterica enterica serovar Typhi Ty2
gagcaugguccggugcguucug

SEQ ID NO: 1730955 - RNA, 16 nt, Salmonella enterica enterica serovar Typhi Ty2
gaucaaacuccgcgcu

SEQ ID NO: 1730956 - RNA, 18 nt, Salmonella enterica enterica serovar Typhi Ty2
gaucaacgccgcgccauc

SEQ ID NO: 1730957 - RNA, 21 nt, Salmonella enterica enterica serovar Typhi Ty2
gauaucuucauagcuuagcug

SEQ ID NO: 1730958 - RNA, 20 nt, Salmonella enterica enterica serovar Typhi Ty2
gaucaacgggguuagcguuu

SEQ ID NO: 1730959 - RNA, 18 nt, Salmonella enterica enterica serovar Typhi Ty2
gauaauuuauccaguaac

SEQ ID NO: 1730960 - RNA, 13 nt, Salmonella enterica enterica serovar Typhi Ty2
gauaauuuaucca

SEQ ID NO: 1730961 - RNA, 20 nt, Salmonella enterica enterica serovar Typhi Ty2
gauacgcugcgucaggcgau

SEQ ID NO: 1730962 - RNA, 20 nt, Salmonella enterica enterica serovar Typhi Ty2
gauacgcuguaguuccugua

SEQ ID NO: 1730963 - RNA, 15 nt, Salmonella enterica enterica serovar Typhi Ty2
gauacggcuccagca

SEQ ID NO: 1730964 - RNA, 14 nt, Salmonella enterica enterica serovar Typhi Ty2
gauacguuccagca

SEQ ID NO: 1730965 - RNA, 17 nt, Salmonella enterica enterica serovar Typhi Ty2
gauacggguaaucagac

SEQ ID NO: 1730966 - RNA, 18 nt, Salmonella enterica enterica serovar Typhi Ty2
gauacgucauaucaucca

SEQ ID NO: 1730967 - RNA, 15 nt, Salmonella enterica enterica serovar Typhi Ty2
gauagcguagcgcca

SEQ ID NO: 1730968 - RNA, 19 nt, Salmonella enterica enterica serovar Typhi Ty2
gauauccagcaccucauca

SEQ ID NO: 1730969 - RNA, 23 nt, Salmonella enterica enterica serovar Typhi Ty2
gauaagcgcagcgccaucaggca

SEQ ID NO: 1730970 - RNA, 23 nt, Salmonella enterica enterica serovar Typhi Ty2
gauaagcgcagcgccaucaggcc

SEQ ID NO: 1730971 - RNA, 17 nt, Salmonella enterica enterica serovar Typhi Ty2
gauaagcgcagcgccau

SEQ ID NO: 1730972 - RNA, 16 nt, Salmonella enterica enterica serovar Typhi Ty2
gauaagcgcagcgcca

SEQ ID NO: 1730973 - RNA, 20 nt, Salmonella enterica enterica serovar Typhi Ty2
gauaagcguagcgccaucag

SEQ ID NO: 1730974 - RNA, 23 nt, Salmonella enterica enterica serovar Typhi Ty2
gauaagcguagcgccauccggca

SEQ ID NO: 1730975 - RNA, 20 nt, Salmonella enterica enterica serovar Typhi Ty2
gauaagcuuucuguuaucag

SEQ ID NO: 1730976 - RNA, 23 nt, Salmonella enterica enterica serovar Typhi Ty2
gauaagcuuucuguuaucaggcg

SEQ ID NO: 1730977 - RNA, 21 nt, Salmonella enterica enterica serovar Typhi Ty2
gauaagcguuagcgucauccg

SEQ ID NO: 1730978 - RNA, 21 nt, Salmonella enterica enterica serovar Typhi Ty2
gauaaggcguucacgccgcca

SEQ ID NO: 1730979 - RNA, 14 nt, Salmonella enterica enterica serovar Typhi Ty2
gauaacuuucgggu

SEQ ID NO: 1730980 - RNA, 16 nt, Salmonella enterica enterica serovar Typhi Ty2
gauaagcaacgcgcca

SEQ ID NO: 1730981 - RNA, 16 nt, Salmonella enterica enterica serovar Typhi Ty2
gauaagcauagcgcca

SEQ ID NO: 1730982 - RNA, 23 nt, Salmonella enterica enterica serovar Typhi Ty2
gauaagcauagcgccaucaggca

SEQ ID NO: 1730983 - RNA, 20 nt, Salmonella enterica enterica serovar Typhi Ty2
gauaagcgaagcgucauccg

SEQ ID NO: 1730984 - RNA, 23 nt, Salmonella enterica enterica serovar Typhi Ty2
gauaagcgaagcgucauccggca

SEQ ID NO: 1730985 - RNA, 22 nt, Salmonella enterica enterica serovar Typhi Ty2
gauaagcgcagcgcaucaggca

SEQ ID NO: 1730986 - RNA, 19 nt, Salmonella enterica enterica serovar Typhi Ty2
gauaagguaaagccgccau

SEQ ID NO: 1730987 - RNA, 23 nt, Salmonella enterica enterica serovar Typhi Ty2
gauaagguguuuacgccgccauc

SEQ ID NO: 1730988 - RNA, 23 nt, Salmonella enterica enterica serovar Typhi Ty2
gauaauacgcgcgauuacgcgac

SEQ ID NO: 1730989 - RNA, 17 nt, Salmonella enterica enterica serovar Typhi Ty2
gauaauaucgucaccag

SEQ ID NO: 1730990 - RNA, 20 nt, Salmonella enterica enterica serovar Typhi Ty2
gauaaucaacaaugucgccu

SEQ ID NO: 1730991 - RNA, 23 nt, Salmonella enterica enterica serovar Typhi Ty2
gauaauguauuaucgaugcgcca

SEQ ID NO: 1730992 - RNA, 18 nt, Salmonella enterica enterica serovar Typhi Ty2
gauaaugccgcuggcgua

SEQ ID NO: 1730993 - RNA, 14 nt, Salmonella enterica enterica serovar Typhi Ty2
gauaaucagcagcg

SEQ ID NO: 1730994 - RNA, 20 nt, Salmonella enterica enterica serovar Typhi Ty2
gauaaucgcgucuacgucag

SEQ ID NO: 1730995 - RNA, 20 nt, Salmonella enterica enterica serovar Typhi Ty2
gauaaccagcgcgccgccaa

SEQ ID NO: 1730996 - RNA, 22 nt, Salmonella enterica enterica serovar Typhi Ty2
gauaaccacguucauuucguac

SEQ ID NO: 1730997 - RNA, 19 nt, Salmonella enterica enterica serovar Typhi Ty2
gauaacgaauuaagcggau

SEQ ID NO: 1730998 - RNA, 16 nt, Salmonella enterica enterica serovar Typhi Ty2
gauaaccugcugugac

SEQ ID NO: 1730999 - RNA, 16 nt, Salmonella enterica enterica serovar Typhi Ty2
gauaaccuuccggcac

SEQ ID NO: 1731000 - RNA, 14 nt, Salmonella enterica enterica serovar Typhi Ty2
gauaaccugcugug

SEQ ID NO: 1731001 - RNA, 23 nt, Salmonella enterica enterica serovar Typhi Ty2
gaguaaaguuauucacguagggu

SEQ ID NO: 1731002 - RNA, 15 nt, Salmonella enterica enterica serovar Typhi Ty2
gagucaaggcaucca

SEQ ID NO: 1731003 - RNA, 14 nt, Salmonella enterica enterica serovar Typhi Ty2
gagcugcgcuucga

SEQ ID NO: 1731004 - RNA, 17 nt, Salmonella enterica enterica serovar Typhi Ty2
gagcugcgauaauccgg

SEQ ID NO: 1731005 - RNA, 18 nt, Salmonella enterica enterica serovar Typhi Ty2
gagcuuugacgacccgcu

SEQ ID NO: 1731006 - RNA, 14 nt, Salmonella enterica enterica serovar Typhi Ty2
gaggaacaucagcc

SEQ ID NO: 1731007 - RNA, 17 nt, Salmonella enterica enterica serovar Typhi Ty2
cgggcgcguuaaugcau

SEQ ID NO: 1731008 - RNA, 17 nt, Salmonella enterica enterica serovar Typhi Ty2
cgggcguggagaacgcc

SEQ ID NO: 1731009 - RNA, 13 nt, Salmonella enterica enterica serovar Typhi Ty2
cgggcucacgcug

SEQ ID NO: 1731010 - RNA, 13 nt, Salmonella enterica enterica serovar Typhi Ty2
cgggcgucgaaau

SEQ ID NO: 1731011 - RNA, 14 nt, Salmonella enterica enterica serovar Typhi Ty2
cgggcgaggccucg

SEQ ID NO: 1731012 - RNA, 14 nt, Salmonella enterica enterica serovar Typhi Ty2
cgggccgcacacca

SEQ ID NO: 1731013 - RNA, 15 nt, Salmonella enterica enterica serovar Typhi Ty2
cgggcauuguuaauc

SEQ ID NO: 1731014 - RNA, 15 nt, Salmonella enterica enterica serovar Typhi Ty2
cgggcaucgccgcaa

SEQ ID NO: 1731015 - RNA, 15 nt, Salmonella enterica enterica serovar Typhi Ty2
cgggcaggauacggc

SEQ ID NO: 1731016 - RNA, 22 nt, Salmonella enterica enterica serovar Typhi Ty2
cgggcaaugccaccagcgccau

SEQ ID NO: 1731017 - RNA, 21 nt, Salmonella enterica enterica serovar Typhi Ty2
cgggcaaugccaccagcgcca

SEQ ID NO: 1731018 - RNA, 15 nt, Salmonella enterica enterica serovar Typhi Ty2
cgggcaaugccacca

SEQ ID NO: 1731019 - RNA, 21 nt, Salmonella enterica enterica serovar Typhi Ty2
cggucaaaagcugcauccggg

SEQ ID NO: 1731020 - RNA, 22 nt, Salmonella enterica enterica serovar Typhi Ty2
cgguauugugccgcgccugcca

SEQ ID NO: 1731021 - RNA, 15 nt, Salmonella enterica enterica serovar Typhi Ty2
cggucaaucaucaga

SEQ ID NO: 1731022 - RNA, 22 nt, Salmonella enterica enterica serovar Typhi Ty2
cggucaauacaucacgcaacgg

SEQ ID NO: 1731023 - RNA, 18 nt, Salmonella enterica enterica serovar Typhi Ty2
cgguaucacgcgugcgcg

SEQ ID NO: 1731024 - RNA, 22 nt, Salmonella enterica enterica serovar Typhi Ty2
cgguaguccgccagcaccugau

SEQ ID NO: 1731025 - RNA, 17 nt, Salmonella enterica enterica serovar Typhi Ty2
cgguacuggugcccgca

SEQ ID NO: 1731026 - RNA, 16 nt, Salmonella enterica enterica serovar Typhi Ty2
cgguacuggagaccgg

SEQ ID NO: 1731027 - RNA, 22 nt, Salmonella enterica enterica serovar Typhi Ty2
cggguugcacauuguugcaggg

SEQ ID NO: 1731028 - RNA, 23 nt, Salmonella enterica enterica serovar Typhi Ty2
cgguacccgccgcuggcuguucc

SEQ ID NO: 1731029 - RNA, 13 nt, Salmonella enterica enterica serovar Typhi Ty2
cggguuccugcau

SEQ ID NO: 1731030 - RNA, 17 nt, Salmonella enterica enterica serovar Typhi Ty2
cggggucuuccagcaga

SEQ ID NO: 1731031 - RNA, 13 nt, Salmonella enterica enterica serovar Typhi Ty2
cgggucaacgcca

SEQ ID NO: 1731032 - RNA, 22 nt, Salmonella enterica enterica serovar Typhi Ty2
cggguaaacucacccaggcgau

SEQ ID NO: 1731033 - RNA, 14 nt, Salmonella enterica enterica serovar Typhi Ty2
cggguaaggcaucg

SEQ ID NO: 1731034 - RNA, 16 nt, Salmonella enterica enterica serovar Typhi Ty2
cggcgcguucgccaaa

SEQ ID NO: 1731035 - RNA, 18 nt, Salmonella enterica enterica serovar Typhi Ty2
cggcgcguugccgccgag

SEQ ID NO: 1731036 - RNA, 16 nt, Salmonella enterica enterica serovar Typhi Ty2
cggcgcuaaccagcgc

SEQ ID NO: 1731037 - RNA, 19 nt, Salmonella enterica enterica serovar Typhi Ty2
cggcgcuucgcagcgauau

SEQ ID NO: 1731038 - RNA, 19 nt, Salmonella enterica enterica serovar Typhi Ty2
cggcggauuguucagguac

SEQ ID NO: 1731039 - RNA, 11 nt, Salmonella enterica enterica serovar Typhi Ty2
cggcggcguuu

SEQ ID NO: 1731040 - RNA, 13 nt, Salmonella enterica enterica serovar Typhi Ty2
cggcggcgcgaug

SEQ ID NO: 1731041 - RNA, 20 nt, Salmonella enterica enterica serovar Typhi Ty2
cggcggccaaccccggcaaa

SEQ ID NO: 1731042 - RNA, 22 nt, Salmonella enterica enterica serovar Typhi Ty2
cggcggcagucccaaugcggaa

SEQ ID NO: 1731043 - RNA, 23 nt, Salmonella enterica enterica serovar Typhi Ty2
cggcgucaucauugcgccaagac

SEQ ID NO: 1731044 - RNA, 15 nt, Salmonella enterica enterica serovar Typhi Ty2
cggcgucaucggcgc

SEQ ID NO: 1731045 - RNA, 13 nt, Salmonella enterica enterica serovar Typhi Ty2
cggcgucgccaga

SEQ ID NO: 1731046 - RNA, 16 nt, Salmonella enterica enterica serovar Typhi Ty2
cggcgugucagggcgg

SEQ ID NO: 1731047 - RNA, 20 nt, Salmonella enterica enterica serovar Typhi Ty2
cggcuauuccucgaucgccu

SEQ ID NO: 1731048 - RNA, 19 nt, Salmonella enterica enterica serovar Typhi Ty2
cggcuauuccucgaucgcc

SEQ ID NO: 1731049 - RNA, 22 nt, Salmonella enterica enterica serovar Typhi Ty2
cggcucaaacggccugcgcugg

SEQ ID NO: 1731050 - RNA, 21 nt, Salmonella enterica enterica serovar Typhi Ty2
cggcuaaaugacgcgcgagaa

SEQ ID NO: 1731051 - RNA, 19 nt, Salmonella enterica enterica serovar Typhi Ty2
cggcuaaacugcgaugcgc

SEQ ID NO: 1731052 - RNA, 19 nt, Salmonella enterica enterica serovar Typhi Ty2
cggcuaucagccgccggug

SEQ ID NO: 1731053 - RNA, 17 nt, Salmonella enterica enterica serovar Typhi Ty2
cggcuuugcgccggcag

SEQ ID NO: 1731054 - RNA, 15 nt, Salmonella enterica enterica serovar Typhi Ty2
cgggaaaucacguuu

SEQ ID NO: 1731055 - RNA, 22 nt, Salmonella enterica enterica serovar Typhi Ty2
cgggaaagauaauaccucaaau

SEQ ID NO: 1731056 - RNA, 15 nt, Salmonella enterica enterica serovar Typhi Ty2
cggcuuuuaucgaca

SEQ ID NO: 1731057 - RNA, 16 nt, Salmonella enterica enterica serovar Typhi Ty2
cggcuugugagcgucg

SEQ ID NO: 1731058 - RNA, 22 nt, Salmonella enterica enterica serovar Typhi Ty2
cggcuuucacaccguuauccgg

SEQ ID NO: 1731059 - RNA, 20 nt, Salmonella enterica enterica serovar Typhi Ty2
cggcugggcgaggccacgca

SEQ ID NO: 1731060 - RNA, 15 nt, Salmonella enterica enterica serovar Typhi Ty2
cggcuguguccgcca

SEQ ID NO: 1731061 - RNA, 21 nt, Salmonella enterica enterica serovar Typhi Ty2
cggcuguauguaggguacagc

SEQ ID NO: 1731062 - RNA, 18 nt, Salmonella enterica enterica serovar Typhi Ty2
cggcucccauuugcgggu

SEQ ID NO: 1731063 - RNA, 19 nt, Salmonella enterica enterica serovar Typhi Ty2
cggcuccagguugcucagg

SEQ ID NO: 1731064 - RNA, 17 nt, Salmonella enterica enterica serovar Typhi Ty2
cggcugcaccagcguua

SEQ ID NO: 1731065 - RNA, 19 nt, Salmonella enterica enterica serovar Typhi Ty2
cggcugccauuaucaccau

SEQ ID NO: 1731066 - RNA, 15 nt, Salmonella enterica enterica serovar Typhi Ty2
cggcugaagcugccg

SEQ ID NO: 1731067 - RNA, 23 nt, Salmonella enterica enterica serovar Typhi Ty2
cggcugcgcugccagcugcguca

SEQ ID NO: 1731068 - RNA, 12 nt, Salmonella enterica enterica serovar Typhi Ty2
cggaccggcgac

SEQ ID NO: 1731069 - RNA, 14 nt, Salmonella enterica enterica serovar Typhi Ty2
cggacgcagcucau

SEQ ID NO: 1731070 - RNA, 18 nt, Salmonella enterica enterica serovar Typhi Ty2
cggacgauaaccaugcuc

SEQ ID NO: 1731071 - RNA, 21 nt, Salmonella enterica enterica serovar Typhi Ty2
cggacgauaaccaugcucagc

SEQ ID NO: 1731072 - RNA, 19 nt, Salmonella enterica enterica serovar Typhi Ty2
cggacgaacgcuaugcgcc

SEQ ID NO: 1731073 - RNA, 12 nt, Salmonella enterica enterica serovar Typhi Ty2
cggacgaacgcu

SEQ ID NO: 1731074 - RNA, 17 nt, Salmonella enterica enterica serovar Typhi Ty2
cggacacccgcagccag

SEQ ID NO: 1731075 - RNA, 15 nt, Salmonella enterica enterica serovar Typhi Ty2
cggaauucccacauc

SEQ ID NO: 1731076 - RNA, 16 nt, Salmonella enterica enterica serovar Typhi Ty2
cgcuggugugcagcca

SEQ ID NO: 1731077 - RNA, 20 nt, Salmonella enterica enterica serovar Typhi Ty2
cggauaaggcgcagccgcca

SEQ ID NO: 1731078 - RNA, 18 nt, Salmonella enterica enterica serovar Typhi Ty2
cggauaagcguagcgcca

SEQ ID NO: 1731079 - RNA, 20 nt, Salmonella enterica enterica serovar Typhi Ty2
cggauaaggcguuuacgccg

SEQ ID NO: 1731080 - RNA, 20 nt, Salmonella enterica enterica serovar Typhi Ty2
cggauaaggcguuuacgcug

SEQ ID NO: 1731081 - RNA, 21 nt, Salmonella enterica enterica serovar Typhi Ty2
cggauacaagguauccgccau

SEQ ID NO: 1731082 - RNA, 19 nt, Salmonella enterica enterica serovar Typhi Ty2
cggauaaggcgcuugcgcc

SEQ ID NO: 1731083 - RNA, 21 nt, Salmonella enterica enterica serovar Typhi Ty2
cggauaauccgccacuuccug

SEQ ID NO: 1731084 - RNA, 17 nt, Salmonella enterica enterica serovar Typhi Ty2
cggauaagcgcagcgcc

SEQ ID NO: 1731085 - RNA, 15 nt, Salmonella enterica enterica serovar Typhi Ty2
cggauaaccgacgcc

SEQ ID NO: 1731086 - RNA, 17 nt, Salmonella enterica enterica serovar Typhi Ty2
cggaucggucuggcgca

SEQ ID NO: 1731087 - RNA, 20 nt, Salmonella enterica enterica serovar Typhi Ty2
cggaucgaucucgauauuca

SEQ ID NO: 1731088 - RNA, 21 nt, Salmonella enterica enterica serovar Typhi Ty2
cggagagagcaacuggcaaua

SEQ ID NO: 1731089 - RNA, 20 nt, Salmonella enterica enterica serovar Typhi Ty2
cggagaagacgccgccgcau

SEQ ID NO: 1731090 - RNA, 14 nt, Salmonella enterica enterica serovar Typhi Ty2
cggacucaggccuu

SEQ ID NO: 1731091 - RNA, 17 nt, Salmonella enterica enterica serovar Typhi Ty2
cggacuccaggcaacgu

SEQ ID NO: 1731092 - RNA, 17 nt, Salmonella enterica enterica serovar Typhi Ty2
cggagcggcguccgcca

SEQ ID NO: 1731093 - RNA, 18 nt, Salmonella enterica enterica serovar Typhi Ty2
cggagagcggauaauccg

SEQ ID NO: 1731094 - RNA, 17 nt, Salmonella enterica enterica serovar Typhi Ty2
cggcaagccgaucagcg

SEQ ID NO: 1731095 - RNA, 16 nt, Salmonella enterica enterica serovar Typhi Ty2
cggcaacugcgccaaa

SEQ ID NO: 1731096 - RNA, 17 nt, Salmonella enterica enterica serovar Typhi Ty2
cggaugcggcuagcgcc

SEQ ID NO: 1731097 - RNA, 11 nt, Salmonella enterica enterica serovar Typhi Ty2
cggaugcgcgg

SEQ ID NO: 1731098 - RNA, 19 nt, Salmonella enterica enterica serovar Typhi Ty2
cggcaauaugcuguuuaug

SEQ ID NO: 1731099 - RNA, 22 nt, Salmonella enterica enterica serovar Typhi Ty2
cggcaauagaacgucgcgcgcu

SEQ ID NO: 1731100 - RNA, 16 nt, Salmonella enterica enterica serovar Typhi Ty2
cggcaaugauaucggc

SEQ ID NO: 1731101 - RNA, 21 nt, Salmonella enterica enterica serovar Typhi Ty2
cggcaauggccagaugaaacu

SEQ ID NO: 1731102 - RNA, 18 nt, Salmonella enterica enterica serovar Typhi Ty2
cggcaccggaaccggcau

SEQ ID NO: 1731103 - RNA, 20 nt, Salmonella enterica enterica serovar Typhi Ty2
cggcacgccaucgccugaug

SEQ ID NO: 1731104 - RNA, 21 nt, Salmonella enterica enterica serovar Typhi Ty2
cggcacucaccucuuccgcca

SEQ ID NO: 1731105 - RNA, 13 nt, Salmonella enterica enterica serovar Typhi Ty2
cggcagcagugag

SEQ ID NO: 1731106 - RNA, 18 nt, Salmonella enterica enterica serovar Typhi Ty2
cggcagccgacagcguaa

SEQ ID NO: 1731107 - RNA, 15 nt, Salmonella enterica enterica serovar Typhi Ty2
cggcaguacacgcau

SEQ ID NO: 1731108 - RNA, 21 nt, Salmonella enterica enterica serovar Typhi Ty2
cggcaguaaagaucuggccgu

SEQ ID NO: 1731109 - RNA, 16 nt, Salmonella enterica enterica serovar Typhi Ty2
cggcauaaacacagca

SEQ ID NO: 1731110 - RNA, 22 nt, Salmonella enterica enterica serovar Typhi Ty2
cggcaucacaggcuuauaccga

SEQ ID NO: 1731111 - RNA, 19 nt, Salmonella enterica enterica serovar Typhi Ty2
cggcaucaagcccauguuc

SEQ ID NO: 1731112 - RNA, 20 nt, Salmonella enterica enterica serovar Typhi Ty2
cggcauauucaggagcaugg

SEQ ID NO: 1731113 - RNA, 12 nt, Salmonella enterica enterica serovar Typhi Ty2
cggcauacagcg

SEQ ID NO: 1731114 - RNA, 16 nt, Salmonella enterica enterica serovar Typhi Ty2
cggcagcguccgccau

SEQ ID NO: 1731115 - RNA, 21 nt, Salmonella enterica enterica serovar Typhi Ty2
cggcagcguauacgccggaug

SEQ ID NO: 1731116 - RNA, 17 nt, Salmonella enterica enterica serovar Typhi Ty2
cggcaucccaggcgucc

SEQ ID NO: 1731117 - RNA, 23 nt, Salmonella enterica enterica serovar Typhi Ty2
cggcaucagcaggauagcgacca

SEQ ID NO: 1731118 - RNA, 20 nt, Salmonella enterica enterica serovar Typhi Ty2
cggcccgaugccuggauaau

SEQ ID NO: 1731119 - RNA, 22 nt, Salmonella enterica enterica serovar Typhi Ty2
cggccccucgucuucgaccgcc

SEQ ID NO: 1731120 - RNA, 18 nt, Salmonella enterica enterica serovar Typhi Ty2
cggcccauaaacagguca

SEQ ID NO: 1731121 - RNA, 19 nt, Salmonella enterica enterica serovar Typhi Ty2
cggccauagcgugagguca

SEQ ID NO: 1731122 - RNA, 20 nt, Salmonella enterica enterica serovar Typhi Ty2
cggccugcacaagaaacaug

SEQ ID NO: 1731123 - RNA, 23 nt, Salmonella enterica enterica serovar Typhi Ty2
cggccugauaagcauagcgccau

SEQ ID NO: 1731124 - RNA, 22 nt, Salmonella enterica enterica serovar Typhi Ty2
cggccugacgaccguugccgau

SEQ ID NO: 1731125 - RNA, 12 nt, Salmonella enterica enterica serovar Typhi Ty2
cggccuauagcu

SEQ ID NO: 1731126 - RNA, 18 nt, Salmonella enterica enterica serovar Typhi Ty2
cggcgaagauccgcucac

SEQ ID NO: 1731127 - RNA, 16 nt, Salmonella enterica enterica serovar Typhi Ty2
cggccuuuauccagcg

SEQ ID NO: 1731128 - RNA, 13 nt, Salmonella enterica enterica serovar Typhi Ty2
cggcgagcaguac

SEQ ID NO: 1731129 - RNA, 22 nt, Salmonella enterica enterica serovar Typhi Ty2
cggcgcagguccauuuuuuauc

SEQ ID NO: 1731130 - RNA, 17 nt, Salmonella enterica enterica serovar Typhi Ty2
cggcgauauagcgcuga

SEQ ID NO: 1731131 - RNA, 21 nt, Salmonella enterica enterica serovar Typhi Ty2
cgccggguaaacgcagcguca

SEQ ID NO: 1731132 - RNA, 18 nt, Salmonella enterica enterica serovar Typhi Ty2
cgccggucaggauacagc

SEQ ID NO: 1731133 - RNA, 17 nt, Salmonella enterica enterica serovar Typhi Ty2
cgccgcguuucucgccg

SEQ ID NO: 1731134 - RNA, 18 nt, Salmonella enterica enterica serovar Typhi Ty2
cgccggacuguugaugau

SEQ ID NO: 1731135 - RNA, 20 nt, Salmonella enterica enterica serovar Typhi Ty2
cgccgcuuuuuucagcggca

SEQ ID NO: 1731136 - RNA, 17 nt, Salmonella enterica enterica serovar Typhi Ty2
cgccgcuuuuuccgccg

SEQ ID NO: 1731137 - RNA, 15 nt, Salmonella enterica enterica serovar Typhi Ty2
cgccgcuuuuuccgc

SEQ ID NO: 1731138 - RNA, 15 nt, Salmonella enterica enterica serovar Typhi Ty2
cgccggagaucagca

SEQ ID NO: 1731139 - RNA, 20 nt, Salmonella enterica enterica serovar Typhi Ty2
cgccgcuuuaaucaccaugg

SEQ ID NO: 1731140 - RNA, 14 nt, Salmonella enterica enterica serovar Typhi Ty2
cgccgcuuccggca

SEQ ID NO: 1731141 - RNA, 18 nt, Salmonella enterica enterica serovar Typhi Ty2
cgccggccugacgaccgu

SEQ ID NO: 1731142 - RNA, 17 nt, Salmonella enterica enterica serovar Typhi Ty2
cgccgucguucagccag

SEQ ID NO: 1731143 - RNA, 18 nt, Salmonella enterica enterica serovar Typhi Ty2
cgccgucgcggcuacgga

SEQ ID NO: 1731144 - RNA, 21 nt, Salmonella enterica enterica serovar Typhi Ty2
cgccgucgaugauggcggcua

SEQ ID NO: 1731145 - RNA, 18 nt, Salmonella enterica enterica serovar Typhi Ty2
cgccuccaggccggauaa

SEQ ID NO: 1731146 - RNA, 14 nt, Salmonella enterica enterica serovar Typhi Ty2
cgccguuggcguaa

SEQ ID NO: 1731147 - RNA, 14 nt, Salmonella enterica enterica serovar Typhi Ty2
cgccugauggcgac

SEQ ID NO: 1731148 - RNA, 19 nt, Salmonella enterica enterica serovar Typhi Ty2
cgccuuauccggccuacag

SEQ ID NO: 1731149 - RNA, 15 nt, Salmonella enterica enterica serovar Typhi Ty2
cgccuuccuccagca

SEQ ID NO: 1731150 - RNA, 17 nt, Salmonella enterica enterica serovar Typhi Ty2
cgccuucgacuuccgca

SEQ ID NO: 1731151 - RNA, 21 nt, Salmonella enterica enterica serovar Typhi Ty2
cgccuucggccugaaucagca

SEQ ID NO: 1731152 - RNA, 15 nt, Salmonella enterica enterica serovar Typhi Ty2
cgccuuaccgcggua

SEQ ID NO: 1731153 - RNA, 15 nt, Salmonella enterica enterica serovar Typhi Ty2
cgccuuaaaccgucg

SEQ ID NO: 1731154 - RNA, 23 nt, Salmonella enterica enterica serovar Typhi Ty2
cgccuguuagggcgcggcuggua

SEQ ID NO: 1731155 - RNA, 22 nt, Salmonella enterica enterica serovar Typhi Ty2
cgccugcgguaaucgccgcgac

SEQ ID NO: 1731156 - RNA, 16 nt, Salmonella enterica enterica serovar Typhi Ty2
cgccuggcgguaugaa

SEQ ID NO: 1731157 - RNA, 18 nt, Salmonella enterica enterica serovar Typhi Ty2
cgccuucguuauaaggcc

SEQ ID NO: 1731158 - RNA, 18 nt, Salmonella enterica enterica serovar Typhi Ty2
cgccuugcggcggcguuu

SEQ ID NO: 1731159 - RNA, 18 nt, Salmonella enterica enterica serovar Typhi Ty2
cgcgaaaugucccgauau

SEQ ID NO: 1731160 - RNA, 22 nt, Salmonella enterica enterica serovar Typhi Ty2
cgcgaauuccuuuuuccgccac

SEQ ID NO: 1731161 - RNA, 16 nt, Salmonella enterica enterica serovar Typhi Ty2
cgcgacaaggccgaua

SEQ ID NO: 1731162 - RNA, 18 nt, Salmonella enterica enterica serovar Typhi Ty2
cgcgaccagcgcgccaaa

SEQ ID NO: 1731163 - RNA, 17 nt, Salmonella enterica enterica serovar Typhi Ty2
cgcgaccagcagcauca

SEQ ID NO: 1731164 - RNA, 13 nt, Salmonella enterica enterica serovar Typhi Ty2
cgcgaccagcgcg

SEQ ID NO: 1731165 - RNA, 14 nt, Salmonella enterica enterica serovar Typhi Ty2
cgccgccagccaua

SEQ ID NO: 1731166 - RNA, 13 nt, Salmonella enterica enterica serovar Typhi Ty2
cgccgccagcuca

SEQ ID NO: 1731167 - RNA, 23 nt, Salmonella enterica enterica serovar Typhi Ty2
cgccgcccagauguugauacaga

SEQ ID NO: 1731168 - RNA, 17 nt, Salmonella enterica enterica serovar Typhi Ty2
cgccgcacuucacgcuc

SEQ ID NO: 1731169 - RNA, 14 nt, Salmonella enterica enterica serovar Typhi Ty2
cgccgaugccgccg

SEQ ID NO: 1731170 - RNA, 21 nt, Salmonella enterica enterica serovar Typhi Ty2
cgccgaagccagcgcagucaa

SEQ ID NO: 1731171 - RNA, 15 nt, Salmonella enterica enterica serovar Typhi Ty2
cgccgaagcaggcgg

SEQ ID NO: 1731172 - RNA, 15 nt, Salmonella enterica enterica serovar Typhi Ty2
cgcccugcccgccag

SEQ ID NO: 1731173 - RNA, 16 nt, Salmonella enterica enterica serovar Typhi Ty2
cgccgagaauuucagc

SEQ ID NO: 1731174 - RNA, 14 nt, Salmonella enterica enterica serovar Typhi Ty2
cgccgagcauuucc

SEQ ID NO: 1731175 - RNA, 16 nt, Salmonella enterica enterica serovar Typhi Ty2
cgccauuugccagaua

SEQ ID NO: 1731176 - RNA, 18 nt, Salmonella enterica enterica serovar Typhi Ty2
cgcccaacggaugcgcca

SEQ ID NO: 1731177 - RNA, 21 nt, Salmonella enterica enterica serovar Typhi Ty2
cgccauuggcaaucaguacgc

SEQ ID NO: 1731178 - RNA, 23 nt, Salmonella enterica enterica serovar Typhi Ty2
cgccauuggcuauuuuuugcugg

SEQ ID NO: 1731179 - RNA, 15 nt, Salmonella enterica enterica serovar Typhi Ty2
cgccauuccgcagaa

SEQ ID NO: 1731180 - RNA, 20 nt, Salmonella enterica enterica serovar Typhi Ty2
cgccauuccugccgccgcac

SEQ ID NO: 1731181 - RNA, 15 nt, Salmonella enterica enterica serovar Typhi Ty2
cgccaggcaaucagc

SEQ ID NO: 1731182 - RNA, 14 nt, Salmonella enterica enterica serovar Typhi Ty2
cgcccaggccaugc

SEQ ID NO: 1731183 - RNA, 18 nt, Salmonella enterica enterica serovar Typhi Ty2
cgcccagaaagaucagca

SEQ ID NO: 1731184 - RNA, 15 nt, Salmonella enterica enterica serovar Typhi Ty2
cgcccacaucuguuu

SEQ ID NO: 1731185 - RNA, 20 nt, Salmonella enterica enterica serovar Typhi Ty2
cgcccgcuucaucugaggau

SEQ ID NO: 1731186 - RNA, 12 nt, Salmonella enterica enterica serovar Typhi Ty2
cgcccaucgcca

SEQ ID NO: 1731187 - RNA, 14 nt, Salmonella enterica enterica serovar Typhi Ty2
cgcccauuccgccu

SEQ ID NO: 1731188 - RNA, 16 nt, Salmonella enterica enterica serovar Typhi Ty2
cgcccauuaugccgca

SEQ ID NO: 1731189 - RNA, 15 nt, Salmonella enterica enterica serovar Typhi Ty2
cgccccaaagcgcau

SEQ ID NO: 1731190 - RNA, 14 nt, Salmonella enterica enterica serovar Typhi Ty2
cgccccaaucgcca

SEQ ID NO: 1731191 - RNA, 20 nt, Salmonella enterica enterica serovar Typhi Ty2
cgcuaaacagcaaaucggga

SEQ ID NO: 1731192 - RNA, 23 nt, Salmonella enterica enterica serovar Typhi Ty2
cgcguuuuccagcauccugacau

SEQ ID NO: 1731193 - RNA, 14 nt, Salmonella enterica enterica serovar Typhi Ty2
cgcguuuuccacca

SEQ ID NO: 1731194 - RNA, 21 nt, Salmonella enterica enterica serovar Typhi Ty2
cgcucaugcgccuggcgguaa

SEQ ID NO: 1731195 - RNA, 17 nt, Salmonella enterica enterica serovar Typhi Ty2
cgcucauuuuauugaua

SEQ ID NO: 1731196 - RNA, 19 nt, Salmonella enterica enterica serovar Typhi Ty2
cgcuccaucauaucgcgca

SEQ ID NO: 1731197 - RNA, 22 nt, Salmonella enterica enterica serovar Typhi Ty2
cgcugacguucgacccgcaaug

SEQ ID NO: 1731198 - RNA, 23 nt, Salmonella enterica enterica serovar Typhi Ty2
cgcugaguuucucccgccagaug

SEQ ID NO: 1731199 - RNA, 21 nt, Salmonella enterica enterica serovar Typhi Ty2
cgcugaccuuuuucauccuca

SEQ ID NO: 1731200 - RNA, 13 nt, Salmonella enterica enterica serovar Typhi Ty2
cgcugacgccagg

SEQ ID NO: 1731201 - RNA, 14 nt, Salmonella enterica enterica serovar Typhi Ty2
cgcugacggcggca

SEQ ID NO: 1731202 - RNA, 15 nt, Salmonella enterica enterica serovar Typhi Ty2
cgcucugcuguuccu

SEQ ID NO: 1731203 - RNA, 14 nt, Salmonella enterica enterica serovar Typhi Ty2
cgcucgccagcccg

SEQ ID NO: 1731204 - RNA, 20 nt, Salmonella enterica enterica serovar Typhi Ty2
cgcucgccagcauacgucug

SEQ ID NO: 1731205 - RNA, 16 nt, Salmonella enterica enterica serovar Typhi Ty2
cgcugaucgccacgcc

SEQ ID NO: 1731206 - RNA, 19 nt, Salmonella enterica enterica serovar Typhi Ty2
cgcugcgcuuauccggccu

SEQ ID NO: 1731207 - RNA, 16 nt, Salmonella enterica enterica serovar Typhi Ty2
cgcugcgcuuauccgg

SEQ ID NO: 1731208 - RNA, 19 nt, Salmonella enterica enterica serovar Typhi Ty2
cgcugcggaacaccagcgc

SEQ ID NO: 1731209 - RNA, 20 nt, Salmonella enterica enterica serovar Typhi Ty2
cgcugcugaccuuaauccag

SEQ ID NO: 1731210 - RNA, 16 nt, Salmonella enterica enterica serovar Typhi Ty2
cgcugcgucaggcgau

SEQ ID NO: 1731211 - RNA, 14 nt, Salmonella enterica enterica serovar Typhi Ty2
cgcugcuucacgga

SEQ ID NO: 1731212 - RNA, 22 nt, Salmonella enterica enterica serovar Typhi Ty2
cgcuggcaauaaagcagggcgg

SEQ ID NO: 1731213 - RNA, 21 nt, Salmonella enterica enterica serovar Typhi Ty2
cgcuggacgucgucaccacgg

SEQ ID NO: 1731214 - RNA, 23 nt, Salmonella enterica enterica serovar Typhi Ty2
cgcguuaauauccuucagcguuu

SEQ ID NO: 1731215 - RNA, 15 nt, Salmonella enterica enterica serovar Typhi Ty2
cgcgugguaucgcga

SEQ ID NO: 1731216 - RNA, 17 nt, Salmonella enterica enterica serovar Typhi Ty2
cgcguucagcaucggga

SEQ ID NO: 1731217 - RNA, 14 nt, Salmonella enterica enterica serovar Typhi Ty2
cgcguuuagcgcca

SEQ ID NO: 1731218 - RNA, 15 nt, Salmonella enterica enterica serovar Typhi Ty2
cgcguuggcggcuuu

SEQ ID NO: 1731219 - RNA, 21 nt, Salmonella enterica enterica serovar Typhi Ty2
cgcgucggccggcaccagcca

SEQ ID NO: 1731220 - RNA, 22 nt, Salmonella enterica enterica serovar Typhi Ty2
cgcgugaauugcgguuuauccc

SEQ ID NO: 1731221 - RNA, 21 nt, Salmonella enterica enterica serovar Typhi Ty2
cgcgucuucaucagccagcau

SEQ ID NO: 1731222 - RNA, 12 nt, Salmonella enterica enterica serovar Typhi Ty2
cgcgucgccauc

SEQ ID NO: 1731223 - RNA, 14 nt, Salmonella enterica enterica serovar Typhi Ty2
cgcgucagggcgau

SEQ ID NO: 1731224 - RNA, 17 nt, Salmonella enterica enterica serovar Typhi Ty2
cgcgucagggcgauaau

SEQ ID NO: 1731225 - RNA, 19 nt, Salmonella enterica enterica serovar Typhi Ty2
cgcgucagguuuaaucggc

SEQ ID NO: 1731226 - RNA, 22 nt, Salmonella enterica enterica serovar Typhi Ty2
cgcgucagugaauauccccuga

SEQ ID NO: 1731227 - RNA, 22 nt, Salmonella enterica enterica serovar Typhi Ty2
cgcggcgcgucuucccggcgcu

SEQ ID NO: 1731228 - RNA, 16 nt, Salmonella enterica enterica serovar Typhi Ty2
cgcggucggcaggcgg

SEQ ID NO: 1731229 - RNA, 16 nt, Salmonella enterica enterica serovar Typhi Ty2
cgcggguggccugcag

SEQ ID NO: 1731230 - RNA, 16 nt, Salmonella enterica enterica serovar Typhi Ty2
cgcgguuuacuucuuc

SEQ ID NO: 1731231 - RNA, 22 nt, Salmonella enterica enterica serovar Typhi Ty2
cgcggugaucccaggccggcau

SEQ ID NO: 1731232 - RNA, 17 nt, Salmonella enterica enterica serovar Typhi Ty2
cgcguacagcgccauga

SEQ ID NO: 1731233 - RNA, 21 nt, Salmonella enterica enterica serovar Typhi Ty2
cgcguaaccccugcccgcgau

SEQ ID NO: 1731234 - RNA, 14 nt, Salmonella enterica enterica serovar Typhi Ty2
cgcguaaauccaca

SEQ ID NO: 1731235 - RNA, 17 nt, Salmonella enterica enterica serovar Typhi Ty2
cgcguacccggcuuaca

SEQ ID NO: 1731236 - RNA, 17 nt, Salmonella enterica enterica serovar Typhi Ty2
cgcguaccucagcaugu

SEQ ID NO: 1731237 - RNA, 12 nt, Salmonella enterica enterica serovar Typhi Ty2
cgcguagcagca

SEQ ID NO: 1731238 - RNA, 23 nt, Salmonella enterica enterica serovar Typhi Ty2
cgcgccggaugacggcagcgcgu

SEQ ID NO: 1731239 - RNA, 18 nt, Salmonella enterica enterica serovar Typhi Ty2
cgcgccggacagcagcau

SEQ ID NO: 1731240 - RNA, 20 nt, Salmonella enterica enterica serovar Typhi Ty2
cgcgcccacgcgcggcauca

SEQ ID NO: 1731241 - RNA, 14 nt, Salmonella enterica enterica serovar Typhi Ty2
cgcgccauuuagcg

SEQ ID NO: 1731242 - RNA, 18 nt, Salmonella enterica enterica serovar Typhi Ty2
cgcgccauuugccagaua

SEQ ID NO: 1731243 - RNA, 21 nt, Salmonella enterica enterica serovar Typhi Ty2
cgcgccaucuuucacccauug

SEQ ID NO: 1731244 - RNA, 13 nt, Salmonella enterica enterica serovar Typhi Ty2
cgcgccagcggau

SEQ ID NO: 1731245 - RNA, 12 nt, Salmonella enterica enterica serovar Typhi Ty2
cgcgccagcgau

SEQ ID NO: 1731246 - RNA, 13 nt, Salmonella enterica enterica serovar Typhi Ty2
cgcgccagcgucg

SEQ ID NO: 1731247 - RNA, 21 nt, Salmonella enterica enterica serovar Typhi Ty2
cgcgccagcggauugccauac

SEQ ID NO: 1731248 - RNA, 15 nt, Salmonella enterica enterica serovar Typhi Ty2
cgcgccagcaggucg

SEQ ID NO: 1731249 - RNA, 12 nt, Salmonella enterica enterica serovar Typhi Ty2
cgcgccagcgac

SEQ ID NO: 1731250 - RNA, 12 nt, Salmonella enterica enterica serovar Typhi Ty2
cgcgccagccaa

SEQ ID NO: 1731251 - RNA, 21 nt, Salmonella enterica enterica serovar Typhi Ty2
cgcgccauccggcauuaccgc

SEQ ID NO: 1731252 - RNA, 20 nt, Salmonella enterica enterica serovar Typhi Ty2
cgcgccagguauacagacaa

SEQ ID NO: 1731253 - RNA, 13 nt, Salmonella enterica enterica serovar Typhi Ty2
cgcgccagggcgc

SEQ ID NO: 1731254 - RNA, 22 nt, Salmonella enterica enterica serovar Typhi Ty2
cgcgccaccaucgucgccagac

SEQ ID NO: 1731255 - RNA, 17 nt, Salmonella enterica enterica serovar Typhi Ty2
cgcgccacgucggauaa

SEQ ID NO: 1731256 - RNA, 12 nt, Salmonella enterica enterica serovar Typhi Ty2
cgcgccacgcau

SEQ ID NO: 1731257 - RNA, 18 nt, Salmonella enterica enterica serovar Typhi Ty2
cgcgcauggcagggcgau

SEQ ID NO: 1731258 - RNA, 13 nt, Salmonella enterica enterica serovar Typhi Ty2
cgcgcauggcgaa

SEQ ID NO: 1731259 - RNA, 19 nt, Salmonella enterica enterica serovar Typhi Ty2
cgcgccaaaagaggcagca

SEQ ID NO: 1731260 - RNA, 18 nt, Salmonella enterica enterica serovar Typhi Ty2
cgcgccaaaguuaaucag

SEQ ID NO: 1731261 - RNA, 19 nt, Salmonella enterica enterica serovar Typhi Ty2
cgcgcacagggugaaauca

SEQ ID NO: 1731262 - RNA, 21 nt, Salmonella enterica enterica serovar Typhi Ty2
cgcgcagagauagccagcgau

SEQ ID NO: 1731263 - RNA, 21 nt, Salmonella enterica enterica serovar Typhi Ty2
cgcgcagaaucacuucauccg

SEQ ID NO: 1731264 - RNA, 20 nt, Salmonella enterica enterica serovar Typhi Ty2
cgcgcagcgauauagcgcau

SEQ ID NO: 1731265 - RNA, 20 nt, Salmonella enterica enterica serovar Typhi Ty2
cgcgcagcaucugauagccc

SEQ ID NO: 1731266 - RNA, 19 nt, Salmonella enterica enterica serovar Typhi Ty2
cgcgcauagcuggcguagc

SEQ ID NO: 1731267 - RNA, 15 nt, Salmonella enterica enterica serovar Typhi Ty2
cgcgcaguuuuuauc

SEQ ID NO: 1731268 - RNA, 13 nt, Salmonella enterica enterica serovar Typhi Ty2
cgcgcaggcggaa

SEQ ID NO: 1731269 - RNA, 23 nt, Salmonella enterica enterica serovar Typhi Ty2
cgcgcaggucuucgucagcgcau

SEQ ID NO: 1731270 - RNA, 21 nt, Salmonella enterica enterica serovar Typhi Ty2
cgcggccagcaucguaccgug

SEQ ID NO: 1731271 - RNA, 16 nt, Salmonella enterica enterica serovar Typhi Ty2
cgcggcgaaccggcau

SEQ ID NO: 1731272 - RNA, 21 nt, Salmonella enterica enterica serovar Typhi Ty2
cgcggcgaaauaggccgcgau

SEQ ID NO: 1731273 - RNA, 23 nt, Salmonella enterica enterica serovar Typhi Ty2
cgcggaccguguucaugcagcca

SEQ ID NO: 1731274 - RNA, 17 nt, Salmonella enterica enterica serovar Typhi Ty2
cgcggcaauuuccgcug

SEQ ID NO: 1731275 - RNA, 16 nt, Salmonella enterica enterica serovar Typhi Ty2
cgcgcucgccagcgcu

SEQ ID NO: 1731276 - RNA, 14 nt, Salmonella enterica enterica serovar Typhi Ty2
cgcgcgucagcgug

SEQ ID NO: 1731277 - RNA, 13 nt, Salmonella enterica enterica serovar Typhi Ty2
cgcgcugccgccc

SEQ ID NO: 1731278 - RNA, 19 nt, Salmonella enterica enterica serovar Typhi Ty2
cgcgcuuuucgccagcgca

SEQ ID NO: 1731279 - RNA, 14 nt, Salmonella enterica enterica serovar Typhi Ty2
cgcgcuuaaucgag

SEQ ID NO: 1731280 - RNA, 12 nt, Salmonella enterica enterica serovar Typhi Ty2
cgcgcggcguuc

SEQ ID NO: 1731281 - RNA, 14 nt, Salmonella enterica enterica serovar Typhi Ty2
cgcgccuaccgcca

SEQ ID NO: 1731282 - RNA, 16 nt, Salmonella enterica enterica serovar Typhi Ty2
cgcgccuaccagcgcu

SEQ ID NO: 1731283 - RNA, 13 nt, Salmonella enterica enterica serovar Typhi Ty2
ccggaauacacaa

SEQ ID NO: 1731284 - RNA, 15 nt, Salmonella enterica enterica serovar Typhi Ty2
ccggaagagcgcaga

SEQ ID NO: 1731285 - RNA, 16 nt, Salmonella enterica enterica serovar Typhi Ty2
ccggccacagcgccag

SEQ ID NO: 1731286 - RNA, 19 nt, Salmonella enterica enterica serovar Typhi Ty2
ccggcauuucaccgucaau

SEQ ID NO: 1731287 - RNA, 22 nt, Salmonella enterica enterica serovar Typhi Ty2
ccggccauagcgugaggucauu

SEQ ID NO: 1731288 - RNA, 15 nt, Salmonella enterica enterica serovar Typhi Ty2
ccggcccccggccau

SEQ ID NO: 1731289 - RNA, 18 nt, Salmonella enterica enterica serovar Typhi Ty2
ccggcgaggacuguacaa

SEQ ID NO: 1731290 - RNA, 17 nt, Salmonella enterica enterica serovar Typhi Ty2
ccggcgagcgcgauaac

SEQ ID NO: 1731291 - RNA, 11 nt, Salmonella enterica enterica serovar Typhi Ty2
ccggccuacgu

SEQ ID NO: 1731292 - RNA, 21 nt, Salmonella enterica enterica serovar Typhi Ty2
ccggccuacacguaacccugu

SEQ ID NO: 1731293 - RNA, 12 nt, Salmonella enterica enterica serovar Typhi Ty2
ccggcgugcgcu

SEQ ID NO: 1731294 - RNA, 14 nt, Salmonella enterica enterica serovar Typhi Ty2
ccggcggccuacca

SEQ ID NO: 1731295 - RNA, 17 nt, Salmonella enterica enterica serovar Typhi Ty2
ccggcuucuccaccaua

SEQ ID NO: 1731296 - RNA, 12 nt, Salmonella enterica enterica serovar Typhi Ty2
ccggcuucagca

SEQ ID NO: 1731297 - RNA, 18 nt, Salmonella enterica enterica serovar Typhi Ty2
ccggcuuaggcaggggau

SEQ ID NO: 1731298 - RNA, 15 nt, Salmonella enterica enterica serovar Typhi Ty2
ccggcuucguuaagc

SEQ ID NO: 1731299 - RNA, 22 nt, Salmonella enterica enterica serovar Typhi Ty2
ccggcguuccgcacauaaucac

SEQ ID NO: 1731300 - RNA, 13 nt, Salmonella enterica enterica serovar Typhi Ty2
ccggguaggacau

SEQ ID NO: 1731301 - RNA, 18 nt, Salmonella enterica enterica serovar Typhi Ty2
ccgggucagcccccaguu

SEQ ID NO: 1731302 - RNA, 12 nt, Salmonella enterica enterica serovar Typhi Ty2
ccgggcggcgca

SEQ ID NO: 1731303 - RNA, 18 nt, Salmonella enterica enterica serovar Typhi Ty2
ccgggcuggcaaacaggc

SEQ ID NO: 1731304 - RNA, 12 nt, Salmonella enterica enterica serovar Typhi Ty2
ccgggcgaaagc

SEQ ID NO: 1731305 - RNA, 12 nt, Salmonella enterica enterica serovar Typhi Ty2
ccgggagguacg

SEQ ID NO: 1731306 - RNA, 22 nt, Salmonella enterica enterica serovar Typhi Ty2
ccgguugcugauaacgugcgcg

SEQ ID NO: 1731307 - RNA, 13 nt, Salmonella enterica enterica serovar Typhi Ty2
ccgucauggugau

SEQ ID NO: 1731308 - RNA, 14 nt, Salmonella enterica enterica serovar Typhi Ty2
ccgucaucgacuuc

SEQ ID NO: 1731309 - RNA, 19 nt, Salmonella enterica enterica serovar Typhi Ty2
ccgucauucgagucaugaa

SEQ ID NO: 1731310 - RNA, 17 nt, Salmonella enterica enterica serovar Typhi Ty2
ccgucagcgaaucgauc

SEQ ID NO: 1731311 - RNA, 15 nt, Salmonella enterica enterica serovar Typhi Ty2
ccguauucaggcgau

SEQ ID NO: 1731312 - RNA, 24 nt, Salmonella enterica enterica serovar Typhi Ty2
ccguaugaccgccgcgcgucagca

SEQ ID NO: 1731313 - RNA, 21 nt, Salmonella enterica enterica serovar Typhi Ty2
ccguaccagccguagcugcug

SEQ ID NO: 1731314 - RNA, 18 nt, Salmonella enterica enterica serovar Typhi Ty2
ccguacguauuaucccgc

SEQ ID NO: 1731315 - RNA, 20 nt, Salmonella enterica enterica serovar Typhi Ty2
ccguacgaucugacugaucg

SEQ ID NO: 1731316 - RNA, 15 nt, Salmonella enterica enterica serovar Typhi Ty2
ccguaccuccagcga

SEQ ID NO: 1731317 - RNA, 14 nt, Salmonella enterica enterica serovar Typhi Ty2
ccgguuuauccccg

SEQ ID NO: 1731318 - RNA, 16 nt, Salmonella enterica enterica serovar Typhi Ty2
ccgugaccgcguuauc

SEQ ID NO: 1731319 - RNA, 18 nt, Salmonella enterica enterica serovar Typhi Ty2
ccgugaauguccugcggc

SEQ ID NO: 1731320 - RNA, 13 nt, Salmonella enterica enterica serovar Typhi Ty2
ccgugaauagagc

SEQ ID NO: 1731321 - RNA, 14 nt, Salmonella enterica enterica serovar Typhi Ty2
ccguucacggcgau

SEQ ID NO: 1731322 - RNA, 21 nt, Salmonella enterica enterica serovar Typhi Ty2
ccguuaugaaucgcgugcgcu

SEQ ID NO: 1731323 - RNA, 18 nt, Salmonella enterica enterica serovar Typhi Ty2
ccguuaaucuggccuacg

SEQ ID NO: 1731324 - RNA, 19 nt, Salmonella enterica enterica serovar Typhi Ty2
ccguccgcgcucauacgau

SEQ ID NO: 1731325 - RNA, 15 nt, Salmonella enterica enterica serovar Typhi Ty2
ccuccuggcguuauc

SEQ ID NO: 1731326 - RNA, 22 nt, Salmonella enterica enterica serovar Typhi Ty2
ccuccuggcguuaucaucguaa

SEQ ID NO: 1731327 - RNA, 22 nt, Salmonella enterica enterica serovar Typhi Ty2
ccucgacguuuuccaucaccau

SEQ ID NO: 1731328 - RNA, 23 nt, Salmonella enterica enterica serovar Typhi Ty2
ccucaucgcuaccuucuucccau

SEQ ID NO: 1731329 - RNA, 14 nt, Salmonella enterica enterica serovar Typhi Ty2
ccuauaaugcgcca

SEQ ID NO: 1731330 - RNA, 14 nt, Salmonella enterica enterica serovar Typhi Ty2
ccguuccgccagau

SEQ ID NO: 1731331 - RNA, 17 nt, Salmonella enterica enterica serovar Typhi Ty2
ccguucaucggcauaca

SEQ ID NO: 1731332 - RNA, 13 nt, Salmonella enterica enterica serovar Typhi Ty2
ccguucgcgguaa

SEQ ID NO: 1731333 - RNA, 14 nt, Salmonella enterica enterica serovar Typhi Ty2
ccuaccaucgcgcg

SEQ ID NO: 1731334 - RNA, 16 nt, Salmonella enterica enterica serovar Typhi Ty2
ccuaccagucgacuca

SEQ ID NO: 1731335 - RNA, 13 nt, Salmonella enterica enterica serovar Typhi Ty2
ccuacgcgcaugu

SEQ ID NO: 1731336 - RNA, 22 nt, Salmonella enterica enterica serovar Typhi Ty2
ccugcacuuccagccacggcgu

SEQ ID NO: 1731337 - RNA, 14 nt, Salmonella enterica enterica serovar Typhi Ty2
ccugcauuauccac

SEQ ID NO: 1731338 - RNA, 18 nt, Salmonella enterica enterica serovar Typhi Ty2
ccugccagcauuaacccg

SEQ ID NO: 1731339 - RNA, 21 nt, Salmonella enterica enterica serovar Typhi Ty2
ccugccccgcucgaaaccauc

SEQ ID NO: 1731340 - RNA, 22 nt, Salmonella enterica enterica serovar Typhi Ty2
ccugaugcgcguuuagcgccag

SEQ ID NO: 1731341 - RNA, 20 nt, Salmonella enterica enterica serovar Typhi Ty2
ccugaugauggaaaacgcgc

SEQ ID NO: 1731342 - RNA, 17 nt, Salmonella enterica enterica serovar Typhi Ty2
ccugaugauagcgccau

SEQ ID NO: 1731343 - RNA, 19 nt, Salmonella enterica enterica serovar Typhi Ty2
ccugauggcgcuacgccau

SEQ ID NO: 1731344 - RNA, 16 nt, Salmonella enterica enterica serovar Typhi Ty2
ccugaugauagcgcca

SEQ ID NO: 1731345 - RNA, 12 nt, Salmonella enterica enterica serovar Typhi Ty2
ccugaucgccaa

SEQ ID NO: 1731346 - RNA, 15 nt, Salmonella enterica enterica serovar Typhi Ty2
ccugauagcgcugug

SEQ ID NO: 1731347 - RNA, 19 nt, Salmonella enterica enterica serovar Typhi Ty2
ccugauagcacagcgcuau

SEQ ID NO: 1731348 - RNA, 19 nt, Salmonella enterica enterica serovar Typhi Ty2
ccugaucaucggcgcgucg

SEQ ID NO: 1731349 - RNA, 15 nt, Salmonella enterica enterica serovar Typhi Ty2
ccugaucaaggcgca

SEQ ID NO: 1731350 - RNA, 19 nt, Salmonella enterica enterica serovar Typhi Ty2
ccugauaagcgcagcgcca

SEQ ID NO: 1731351 - RNA, 20 nt, Salmonella enterica enterica serovar Typhi Ty2
ccugauaagcauagcgccau

SEQ ID NO: 1731352 - RNA, 20 nt, Salmonella enterica enterica serovar Typhi Ty2
ccugauaagcgaagcgccau

SEQ ID NO: 1731353 - RNA, 22 nt, Salmonella enterica enterica serovar Typhi Ty2
ccugauaagguaaagccgccau

SEQ ID NO: 1731354 - RNA, 20 nt, Salmonella enterica enterica serovar Typhi Ty2
ccugauaagcguagcgccau

SEQ ID NO: 1731355 - RNA, 19 nt, Salmonella enterica enterica serovar Typhi Ty2
ccugauaagcguagcgcca

SEQ ID NO: 1731356 - RNA, 20 nt, Salmonella enterica enterica serovar Typhi Ty2
ccugaccgauauagccacuc

SEQ ID NO: 1731357 - RNA, 12 nt, Salmonella enterica enterica serovar Typhi Ty2
ccugacagcgcg

SEQ ID NO: 1731358 - RNA, 18 nt, Salmonella enterica enterica serovar Typhi Ty2
ccugaauauuagaguggc

SEQ ID NO: 1731359 - RNA, 17 nt, Salmonella enterica enterica serovar Typhi Ty2
ccugaaugcucucauau

SEQ ID NO: 1731360 - RNA, 17 nt, Salmonella enterica enterica serovar Typhi Ty2
ccugaauugcaaggcga

SEQ ID NO: 1731361 - RNA, 22 nt, Salmonella enterica enterica serovar Typhi Ty2
ccugacacuguagcaacugcca

SEQ ID NO: 1731362 - RNA, 16 nt, Salmonella enterica enterica serovar Typhi Ty2
ccucgcgcggcgguuc

SEQ ID NO: 1731363 - RNA, 20 nt, Salmonella enterica enterica serovar Typhi Ty2
ccucuuauccggcugccguu

SEQ ID NO: 1731364 - RNA, 14 nt, Salmonella enterica enterica serovar Typhi Ty2
ccucuuucgccauu

SEQ ID NO: 1731365 - RNA, 20 nt, Salmonella enterica enterica serovar Typhi Ty2
ccugaaaggucgcgauccgc

SEQ ID NO: 1731366 - RNA, 12 nt, Salmonella enterica enterica serovar Typhi Ty2
ccugaaacgcgg

SEQ ID NO: 1731367 - RNA, 21 nt, Salmonella enterica enterica serovar Typhi Ty2
ccgauauauugccggccugau

SEQ ID NO: 1731368 - RNA, 21 nt, Salmonella enterica enterica serovar Typhi Ty2
ccgauaguguaaacgcgccau

SEQ ID NO: 1731369 - RNA, 20 nt, Salmonella enterica enterica serovar Typhi Ty2
ccgauagugcaagcucaucg

SEQ ID NO: 1731370 - RNA, 17 nt, Salmonella enterica enterica serovar Typhi Ty2
ccgauagcggcgcagac

SEQ ID NO: 1731371 - RNA, 22 nt, Salmonella enterica enterica serovar Typhi Ty2
ccgauagcugaagugcggauag

SEQ ID NO: 1731372 - RNA, 19 nt, Salmonella enterica enterica serovar Typhi Ty2
ccgauagcgccgcgcuauc

SEQ ID NO: 1731373 - RNA, 22 nt, Salmonella enterica enterica serovar Typhi Ty2
ccgaucacggcgaaucgccugu

SEQ ID NO: 1731374 - RNA, 17 nt, Salmonella enterica enterica serovar Typhi Ty2
ccgaucaggccgcagac

SEQ ID NO: 1731375 - RNA, 23 nt, Salmonella enterica enterica serovar Typhi Ty2
ccgaucaucguaccaauacccag

SEQ ID NO: 1731376 - RNA, 13 nt, Salmonella enterica enterica serovar Typhi Ty2
ccgcacagcacau

SEQ ID NO: 1731377 - RNA, 23 nt, Salmonella enterica enterica serovar Typhi Ty2
ccgcacagcagacaaccgacgca

SEQ ID NO: 1731378 - RNA, 17 nt, Salmonella enterica enterica serovar Typhi Ty2
ccgcaacgccgauaagg

SEQ ID NO: 1731379 - RNA, 16 nt, Salmonella enterica enterica serovar Typhi Ty2
ccgcaacccgauaagc

SEQ ID NO: 1731380 - RNA, 16 nt, Salmonella enterica enterica serovar Typhi Ty2
ccgcauucuugccgca

SEQ ID NO: 1731381 - RNA, 19 nt, Salmonella enterica enterica serovar Typhi Ty2
ccgcauggccgcuauccuc

SEQ ID NO: 1731382 - RNA, 18 nt, Salmonella enterica enterica serovar Typhi Ty2
ccgcauugguuucgccua

SEQ ID NO: 1731383 - RNA, 13 nt, Salmonella enterica enterica serovar Typhi Ty2
ccgcauuuucagc

SEQ ID NO: 1731384 - RNA, 22 nt, Salmonella enterica enterica serovar Typhi Ty2
ccgcauuucgcccucgccacgg

SEQ ID NO: 1731385 - RNA, 17 nt, Salmonella enterica enterica serovar Typhi Ty2
ccgccaucaacgaccau

SEQ ID NO: 1731386 - RNA, 21 nt, Salmonella enterica enterica serovar Typhi Ty2
ccgccaucacaccaacgcugg

SEQ ID NO: 1731387 - RNA, 15 nt, Salmonella enterica enterica serovar Typhi Ty2
ccgccagcgagauga

SEQ ID NO: 1731388 - RNA, 14 nt, Salmonella enterica enterica serovar Typhi Ty2
ccgcaucgaccaua

SEQ ID NO: 1731389 - RNA, 13 nt, Salmonella enterica enterica serovar Typhi Ty2
ccgcaucgccaua

SEQ ID NO: 1731390 - RNA, 18 nt, Salmonella enterica enterica serovar Typhi Ty2
ccgcauauauugcgcuuc

SEQ ID NO: 1731391 - RNA, 13 nt, Salmonella enterica enterica serovar Typhi Ty2
ccgcauccccaua

SEQ ID NO: 1731392 - RNA, 17 nt, Salmonella enterica enterica serovar Typhi Ty2
ccgcaggacagcgacau

SEQ ID NO: 1731393 - RNA, 22 nt, Salmonella enterica enterica serovar Typhi Ty2
ccgcaggguauaugagcgcagg

SEQ ID NO: 1731394 - RNA, 21 nt, Salmonella enterica enterica serovar Typhi Ty2
ccgcaccauucaccgauaagc

SEQ ID NO: 1731395 - RNA, 14 nt, Salmonella enterica enterica serovar Typhi Ty2
ccgagcauccgcgc

SEQ ID NO: 1731396 - RNA, 11 nt, Salmonella enterica enterica serovar Typhi Ty2
ccgagcgcugg

SEQ ID NO: 1731397 - RNA, 19 nt, Salmonella enterica enterica serovar Typhi Ty2
ccgaggcuuaauacggcaa

SEQ ID NO: 1731398 - RNA, 19 nt, Salmonella enterica enterica serovar Typhi Ty2
ccgagucgaucgucgggau

SEQ ID NO: 1731399 - RNA, 15 nt, Salmonella enterica enterica serovar Typhi Ty2
ccgauaagcgcugua

SEQ ID NO: 1731400 - RNA, 17 nt, Salmonella enterica enterica serovar Typhi Ty2
ccgacucacgcagcgcu

SEQ ID NO: 1731401 - RNA, 14 nt, Salmonella enterica enterica serovar Typhi Ty2
ccgacugcgauaac

SEQ ID NO: 1731402 - RNA, 14 nt, Salmonella enterica enterica serovar Typhi Ty2
ccgacgcacgugua

SEQ ID NO: 1731403 - RNA, 14 nt, Salmonella enterica enterica serovar Typhi Ty2
ccgacgcucaaccg

SEQ ID NO: 1731404 - RNA, 20 nt, Salmonella enterica enterica serovar Typhi Ty2
ccgcgcucauacgaucgcgc

SEQ ID NO: 1731405 - RNA, 21 nt, Salmonella enterica enterica serovar Typhi Ty2
ccgcgcuccuggaaccaguga

SEQ ID NO: 1731406 - RNA, 16 nt, Salmonella enterica enterica serovar Typhi Ty2
ccgcgcgcgcggcauc

SEQ ID NO: 1731407 - RNA, 19 nt, Salmonella enterica enterica serovar Typhi Ty2
ccgcgccuucgcggugauc

SEQ ID NO: 1731408 - RNA, 15 nt, Salmonella enterica enterica serovar Typhi Ty2
ccgcucgaaaccauc

SEQ ID NO: 1731409 - RNA, 13 nt, Salmonella enterica enterica serovar Typhi Ty2
ccgcguuuaucgc

SEQ ID NO: 1731410 - RNA, 13 nt, Salmonella enterica enterica serovar Typhi Ty2
ccgcguuucgcga

SEQ ID NO: 1731411 - RNA, 23 nt, Salmonella enterica enterica serovar Typhi Ty2
ccgcugaaccugauuauucagua

SEQ ID NO: 1731412 - RNA, 15 nt, Salmonella enterica enterica serovar Typhi Ty2
ccgcucucuucguga

SEQ ID NO: 1731413 - RNA, 16 nt, Salmonella enterica enterica serovar Typhi Ty2
ccgcugcuucacggaa

SEQ ID NO: 1731414 - RNA, 15 nt, Salmonella enterica enterica serovar Typhi Ty2
ccgcguagcguuauc

SEQ ID NO: 1731415 - RNA, 19 nt, Salmonella enterica enterica serovar Typhi Ty2
ccgcguucugucgauaaac

SEQ ID NO: 1731416 - RNA, 17 nt, Salmonella enterica enterica serovar Typhi Ty2
ccgcguuaacgccguug

SEQ ID NO: 1731417 - RNA, 12 nt, Salmonella enterica enterica serovar Typhi Ty2
ccgccggcagca

SEQ ID NO: 1731418 - RNA, 14 nt, Salmonella enterica enterica serovar Typhi Ty2
ccgccggcagcagc

SEQ ID NO: 1731419 - RNA, 13 nt, Salmonella enterica enterica serovar Typhi Ty2
ccgccgcaaaagc

SEQ ID NO: 1731420 - RNA, 22 nt, Salmonella enterica enterica serovar Typhi Ty2
ccgccgcaacgcgcacggcguu

SEQ ID NO: 1731421 - RNA, 14 nt, Salmonella enterica enterica serovar Typhi Ty2
ccgccgcagcagau

SEQ ID NO: 1731422 - RNA, 18 nt, Salmonella enterica enterica serovar Typhi Ty2
ccgccgagggcauugaug

SEQ ID NO: 1731423 - RNA, 16 nt, Salmonella enterica enterica serovar Typhi Ty2
ccgccgauaagcgcug

SEQ ID NO: 1731424 - RNA, 12 nt, Salmonella enterica enterica serovar Typhi Ty2
ccgccauccggc

SEQ ID NO: 1731425 - RNA, 21 nt, Salmonella enterica enterica serovar Typhi Ty2
ccgccgguuuauccccgcugg

SEQ ID NO: 1731426 - RNA, 14 nt, Salmonella enterica enterica serovar Typhi Ty2
ccgcgcauguaacc

SEQ ID NO: 1731427 - RNA, 15 nt, Salmonella enterica enterica serovar Typhi Ty2
ccgcgcauggccaua

SEQ ID NO: 1731428 - RNA, 23 nt, Salmonella enterica enterica serovar Typhi Ty2
ccgcgacaucguuuccagcgaau

SEQ ID NO: 1731429 - RNA, 19 nt, Salmonella enterica enterica serovar Typhi Ty2
ccgcgauagaccacgccau

SEQ ID NO: 1731430 - RNA, 23 nt, Salmonella enterica enterica serovar Typhi Ty2
cgaagcccaugauggugaacaga

SEQ ID NO: 1731431 - RNA, 22 nt, Salmonella enterica enterica serovar Typhi Ty2
cgaagaccgcaucacggcagca

SEQ ID NO: 1731432 - RNA, 13 nt, Salmonella enterica enterica serovar Typhi Ty2
cgaacugaauagu

SEQ ID NO: 1731433 - RNA, 21 nt, Salmonella enterica enterica serovar Typhi Ty2
cgaagaacauaaacagcguga

SEQ ID NO: 1731434 - RNA, 13 nt, Salmonella enterica enterica serovar Typhi Ty2
cgaacugauggcg

SEQ ID NO: 1731435 - RNA, 19 nt, Salmonella enterica enterica serovar Typhi Ty2
cgaagcggcaguugaacuc

SEQ ID NO: 1731436 - RNA, 20 nt, Salmonella enterica enterica serovar Typhi Ty2
cgaaggauaauccgguguuu

SEQ ID NO: 1731437 - RNA, 16 nt, Salmonella enterica enterica serovar Typhi Ty2
cgaacucaugccguag

SEQ ID NO: 1731438 - RNA, 14 nt, Salmonella enterica enterica serovar Typhi Ty2
cgaaaucguccguu

SEQ ID NO: 1731439 - RNA, 15 nt, Salmonella enterica enterica serovar Typhi Ty2
cgaaugucauccgga

SEQ ID NO: 1731440 - RNA, 12 nt, Salmonella enterica enterica serovar Typhi Ty2
cgaauuccgccu

SEQ ID NO: 1731441 - RNA, 16 nt, Salmonella enterica enterica serovar Typhi Ty2
cgaauuucacgcagca

SEQ ID NO: 1731442 - RNA, 18 nt, Salmonella enterica enterica serovar Typhi Ty2
cgacaaaugacgucagca

SEQ ID NO: 1731443 - RNA, 19 nt, Salmonella enterica enterica serovar Typhi Ty2
cgacaaaaagcgcgccgaa

SEQ ID NO: 1731444 - RNA, 17 nt, Salmonella enterica enterica serovar Typhi Ty2
cgaauuugccccagaua

SEQ ID NO: 1731445 - RNA, 14 nt, Salmonella enterica enterica serovar Typhi Ty2
cgaauaaaacugcc

SEQ ID NO: 1731446 - RNA, 15 nt, Salmonella enterica enterica serovar Typhi Ty2
cgaauaaaauucagc

SEQ ID NO: 1731447 - RNA, 22 nt, Salmonella enterica enterica serovar Typhi Ty2
cgaaggcuuuugcuacgucgcc

SEQ ID NO: 1731448 - RNA, 19 nt, Salmonella enterica enterica serovar Typhi Ty2
cgaauaccgugcacgcugc

SEQ ID NO: 1731449 - RNA, 13 nt, Salmonella enterica enterica serovar Typhi Ty2
cgaauagcgccag

SEQ ID NO: 1731450 - RNA, 22 nt, Salmonella enterica enterica serovar Typhi Ty2
cgaauagcgcgcuaaacgugac

SEQ ID NO: 1731451 - RNA, 18 nt, Salmonella enterica enterica serovar Typhi Ty2
cgaauagugauaccaguc

SEQ ID NO: 1731452 - RNA, 16 nt, Salmonella enterica enterica serovar Typhi Ty2
cgaaucacauccgcca

SEQ ID NO: 1731453 - RNA, 19 nt, Salmonella enterica enterica serovar Typhi Ty2
cgacaucagccagccgcca

SEQ ID NO: 1731454 - RNA, 13 nt, Salmonella enterica enterica serovar Typhi Ty2
cgacaucacgcaa

SEQ ID NO: 1731455 - RNA, 16 nt, Salmonella enterica enterica serovar Typhi Ty2
cgacaggcugccgaca

SEQ ID NO: 1731456 - RNA, 22 nt, Salmonella enterica enterica serovar Typhi Ty2
cgacaggggggaacagcaaugc

SEQ ID NO: 1731457 - RNA, 15 nt, Salmonella enterica enterica serovar Typhi Ty2
cgacaaugaucagac

SEQ ID NO: 1731458 - RNA, 16 nt, Salmonella enterica enterica serovar Typhi Ty2
cgacaaucucaccggc

SEQ ID NO: 1731459 - RNA, 15 nt, Salmonella enterica enterica serovar Typhi Ty2
cgacaauguccgcca

SEQ ID NO: 1731460 - RNA, 17 nt, Salmonella enterica enterica serovar Typhi Ty2
cgacaauuucaccuuug

SEQ ID NO: 1731461 - RNA, 12 nt, Salmonella enterica enterica serovar Typhi Ty2
cgacaaucgcaa

SEQ ID NO: 1731462 - RNA, 18 nt, Salmonella enterica enterica serovar Typhi Ty2
cgacacauuucagcgcag

SEQ ID NO: 1731463 - RNA, 21 nt, Salmonella enterica enterica serovar Typhi Ty2
cgacacauccugcgggaugcg

SEQ ID NO: 1731464 - RNA, 22 nt, Salmonella enterica enterica serovar Typhi Ty2
cgacacagcguuuaacugaaca

SEQ ID NO: 1731465 - RNA, 13 nt, Salmonella enterica enterica serovar Typhi Ty2
cgacacuugcgca

SEQ ID NO: 1731466 - RNA, 19 nt, Salmonella enterica enterica serovar Typhi Ty2
ccuugaaguuauccagcgc

SEQ ID NO: 1731467 - RNA, 15 nt, Salmonella enterica enterica serovar Typhi Ty2
ccuugcggcggcguu

SEQ ID NO: 1731468 - RNA, 17 nt, Salmonella enterica enterica serovar Typhi Ty2
ccuucgaugagcgcgaa

SEQ ID NO: 1731469 - RNA, 17 nt, Salmonella enterica enterica serovar Typhi Ty2
ccuucgcauagccggau

SEQ ID NO: 1731470 - RNA, 16 nt, Salmonella enterica enterica serovar Typhi Ty2
ccuucacgaucgagcc

SEQ ID NO: 1731471 - RNA, 18 nt, Salmonella enterica enterica serovar Typhi Ty2
ccugucaggcgagcgccu

SEQ ID NO: 1731472 - RNA, 17 nt, Salmonella enterica enterica serovar Typhi Ty2
ccugucaguacgucgca

SEQ ID NO: 1731473 - RNA, 13 nt, Salmonella enterica enterica serovar Typhi Ty2
ccuuuaucgcgca

SEQ ID NO: 1731474 - RNA, 16 nt, Salmonella enterica enterica serovar Typhi Ty2
ccuugcugaaucagau

SEQ ID NO: 1731475 - RNA, 13 nt, Salmonella enterica enterica serovar Typhi Ty2
cgaaacggcagcg

SEQ ID NO: 1731476 - RNA, 19 nt, Salmonella enterica enterica serovar Typhi Ty2
cgaaacaggucggcaugca

SEQ ID NO: 1731477 - RNA, 18 nt, Salmonella enterica enterica serovar Typhi Ty2
cgaaacaaucaccugaug

SEQ ID NO: 1731478 - RNA, 16 nt, Salmonella enterica enterica serovar Typhi Ty2
cgaaagucaucugcca

SEQ ID NO: 1731479 - RNA, 23 nt, Salmonella enterica enterica serovar Typhi Ty2
cgaaaggaagcgggccaguauua

SEQ ID NO: 1731480 - RNA, 14 nt, Salmonella enterica enterica serovar Typhi Ty2
cgaaagcgaucaca

SEQ ID NO: 1731481 - RNA, 15 nt, Salmonella enterica enterica serovar Typhi Ty2
ccugggaaucgugca

SEQ ID NO: 1731482 - RNA, 20 nt, Salmonella enterica enterica serovar Typhi Ty2
ccugggauagugcugcgcaa

SEQ ID NO: 1731483 - RNA, 15 nt, Salmonella enterica enterica serovar Typhi Ty2
ccugguaagcgcaau

SEQ ID NO: 1731484 - RNA, 22 nt, Salmonella enterica enterica serovar Typhi Ty2
ccuggguauuuuuuagcgccaa

SEQ ID NO: 1731485 - RNA, 13 nt, Salmonella enterica enterica serovar Typhi Ty2
ccuggucgauaau

SEQ ID NO: 1731486 - RNA, 15 nt, Salmonella enterica enterica serovar Typhi Ty2
ccugguccggcaggu

SEQ ID NO: 1731487 - RNA, 12 nt, Salmonella enterica enterica serovar Typhi Ty2
ccugguuaccgc

SEQ ID NO: 1731488 - RNA, 18 nt, Salmonella enterica enterica serovar Typhi Ty2
ccuguaaaaaauccagcg

SEQ ID NO: 1731489 - RNA, 16 nt, Salmonella enterica enterica serovar Typhi Ty2
ccuguagcagcgccag

SEQ ID NO: 1731490 - RNA, 20 nt, Salmonella enterica enterica serovar Typhi Ty2
ccuguagcagcgccagcgug

SEQ ID NO: 1731491 - RNA, 14 nt, Salmonella enterica enterica serovar Typhi Ty2
ccuggcuucaaccu

SEQ ID NO: 1731492 - RNA, 14 nt, Salmonella enterica enterica serovar Typhi Ty2
ccuggcgcagcgcg

SEQ ID NO: 1731493 - RNA, 22 nt, Salmonella enterica enterica serovar Typhi Ty2
cgacguaacugucuuauccggc

SEQ ID NO: 1731494 - RNA, 21 nt, Salmonella enterica enterica serovar Typhi Ty2
cgacguugaucgccaucgcga

SEQ ID NO: 1731495 - RNA, 14 nt, Salmonella enterica enterica serovar Typhi Ty2
cgacucauucagca

SEQ ID NO: 1731496 - RNA, 14 nt, Salmonella enterica enterica serovar Typhi Ty2
cgacuacgguaaac

SEQ ID NO: 1731497 - RNA, 18 nt, Salmonella enterica enterica serovar Typhi Ty2
cgacuaccgccgauaaac

SEQ ID NO: 1731498 - RNA, 21 nt, Salmonella enterica enterica serovar Typhi Ty2
cgacuauuccgcaaacgccgu

SEQ ID NO: 1731499 - RNA, 17 nt, Salmonella enterica enterica serovar Typhi Ty2
cgacguugucuucaucu

SEQ ID NO: 1731500 - RNA, 15 nt, Salmonella enterica enterica serovar Typhi Ty2
cgagaaacaccagaa

SEQ ID NO: 1731501 - RNA, 16 nt, Salmonella enterica enterica serovar Typhi Ty2
cgagaagcccagcuca

SEQ ID NO: 1731502 - RNA, 14 nt, Salmonella enterica enterica serovar Typhi Ty2
cgagaaagcguugc

SEQ ID NO: 1731503 - RNA, 18 nt, Salmonella enterica enterica serovar Typhi Ty2
cgacuuucuucggauuau

SEQ ID NO: 1731504 - RNA, 14 nt, Salmonella enterica enterica serovar Typhi Ty2
cgacuuuucgcccc

SEQ ID NO: 1731505 - RNA, 24 nt, Salmonella enterica enterica serovar Typhi Ty2
cgacuuuccgccaccagauaguca

SEQ ID NO: 1731506 - RNA, 12 nt, Salmonella enterica enterica serovar Typhi Ty2
cgagcgccugau

SEQ ID NO: 1731507 - RNA, 18 nt, Salmonella enterica enterica serovar Typhi Ty2
cgagccauuaaugcaggc

SEQ ID NO: 1731508 - RNA, 20 nt, Salmonella enterica enterica serovar Typhi Ty2
cgagcccagacuuuccagca

SEQ ID NO: 1731509 - RNA, 11 nt, Salmonella enterica enterica serovar Typhi Ty2
cgagcagccaa

SEQ ID NO: 1731510 - RNA, 13 nt, Salmonella enterica enterica serovar Typhi Ty2
cgagauaaccggg

SEQ ID NO: 1731511 - RNA, 13 nt, Salmonella enterica enterica serovar Typhi Ty2
cgagaucaggccg

SEQ ID NO: 1731512 - RNA, 14 nt, Salmonella enterica enterica serovar Typhi Ty2
cgaccgacgcguuu

SEQ ID NO: 1731513 - RNA, 14 nt, Salmonella enterica enterica serovar Typhi Ty2
cgaccgaucaucau

SEQ ID NO: 1731514 - RNA, 21 nt, Salmonella enterica enterica serovar Typhi Ty2
cgacaugcagaucgcgggcaa

SEQ ID NO: 1731515 - RNA, 18 nt, Salmonella enterica enterica serovar Typhi Ty2
cgacaucuuuuccugaag

SEQ ID NO: 1731516 - RNA, 21 nt, Salmonella enterica enterica serovar Typhi Ty2
cgacccgcaaugugcagcagg

SEQ ID NO: 1731517 - RNA, 13 nt, Salmonella enterica enterica serovar Typhi Ty2
cgaccgccagcag

SEQ ID NO: 1731518 - RNA, 17 nt, Salmonella enterica enterica serovar Typhi Ty2
cgaccgccugcaucacc

SEQ ID NO: 1731519 - RNA, 13 nt, Salmonella enterica enterica serovar Typhi Ty2
cgacgccaggcgg

SEQ ID NO: 1731520 - RNA, 19 nt, Salmonella enterica enterica serovar Typhi Ty2
cgacgcgcacccggcaacg

SEQ ID NO: 1731521 - RNA, 12 nt, Salmonella enterica enterica serovar Typhi Ty2
cgacgcucaacc

SEQ ID NO: 1731522 - RNA, 19 nt, Salmonella enterica enterica serovar Typhi Ty2
cgaccuggcggucggcuuu

SEQ ID NO: 1731523 - RNA, 15 nt, Salmonella enterica enterica serovar Typhi Ty2
cgacgaaucagcgau

SEQ ID NO: 1731524 - RNA, 18 nt, Salmonella enterica enterica serovar Typhi Ty2
cgacgaauggcggcguuu

SEQ ID NO: 1731525 - RNA, 10 nt, Salmonella enterica enterica serovar Typhi Ty2
cgaucgccac

SEQ ID NO: 1731526 - RNA, 13 nt, Salmonella enterica enterica serovar Typhi Ty2
cgaugaccaucaa

SEQ ID NO: 1731527 - RNA, 13 nt, Salmonella enterica enterica serovar Typhi Ty2
cgaucuucaucgu

SEQ ID NO: 1731528 - RNA, 16 nt, Salmonella enterica enterica serovar Typhi Ty2
cgaugccgccgcaacg

SEQ ID NO: 1731529 - RNA, 17 nt, Salmonella enterica enterica serovar Typhi Ty2
cgaugccgccgacaacc

SEQ ID NO: 1731530 - RNA, 13 nt, Salmonella enterica enterica serovar Typhi Ty2
cgaugcagccugg

SEQ ID NO: 1731531 - RNA, 23 nt, Salmonella enterica enterica serovar Typhi Ty2
cgaugcacaacacgcuuuucagc

SEQ ID NO: 1731532 - RNA, 19 nt, Salmonella enterica enterica serovar Typhi Ty2
cgaugcgcgagccguaaac

SEQ ID NO: 1731533 - RNA, 17 nt, Salmonella enterica enterica serovar Typhi Ty2
cgauguaguugccgccc

SEQ ID NO: 1731534 - RNA, 20 nt, Salmonella enterica enterica serovar Typhi Ty2
cgaugugcguauugagcgca

SEQ ID NO: 1731535 - RNA, 21 nt, Salmonella enterica enterica serovar Typhi Ty2
cgaugguguuggcaaucagcg

SEQ ID NO: 1731536 - RNA, 13 nt, Salmonella enterica enterica serovar Typhi Ty2
cgauggcgcuacg

SEQ ID NO: 1731537 - RNA, 22 nt, Salmonella enterica enterica serovar Typhi Ty2
cgauggcaaauaauaccacgau

SEQ ID NO: 1731538 - RNA, 23 nt, Salmonella enterica enterica serovar Typhi Ty2
cgauggaaccacauagagugauc

SEQ ID NO: 1731539 - RNA, 14 nt, Salmonella enterica enterica serovar Typhi Ty2
cgauuuccagcgaa

SEQ ID NO: 1731540 - RNA, 12 nt, Salmonella enterica enterica serovar Typhi Ty2
cgauugaucgga

SEQ ID NO: 1731541 - RNA, 22 nt, Salmonella enterica enterica serovar Typhi Ty2
cgauuagcuggcugcgcgggag

SEQ ID NO: 1731542 - RNA, 21 nt, Salmonella enterica enterica serovar Typhi Ty2
cgauguucgucccugcaacgc

SEQ ID NO: 1731543 - RNA, 21 nt, Salmonella enterica enterica serovar Typhi Ty2
cgauguuacgacccagcggca

SEQ ID NO: 1731544 - RNA, 15 nt, Salmonella enterica enterica serovar Typhi Ty2
cgauguuugccacgc

SEQ ID NO: 1731545 - RNA, 14 nt, Salmonella enterica enterica serovar Typhi Ty2
cgcaacgcgcauca

SEQ ID NO: 1731546 - RNA, 17 nt, Salmonella enterica enterica serovar Typhi Ty2
cgcaaaugaccagauca

SEQ ID NO: 1731547 - RNA, 16 nt, Salmonella enterica enterica serovar Typhi Ty2
cgcaaaucaccgucga

SEQ ID NO: 1731548 - RNA, 19 nt, Salmonella enterica enterica serovar Typhi Ty2
cgcaaauucgucgccgcca

SEQ ID NO: 1731549 - RNA, 15 nt, Salmonella enterica enterica serovar Typhi Ty2
cgauuugcgcucgcg

SEQ ID NO: 1731550 - RNA, 17 nt, Salmonella enterica enterica serovar Typhi Ty2
cgaguagcugagcguca

SEQ ID NO: 1731551 - RNA, 20 nt, Salmonella enterica enterica serovar Typhi Ty2
cgagucgaucgucgggauaa

SEQ ID NO: 1731552 - RNA, 15 nt, Salmonella enterica enterica serovar Typhi Ty2
cgaguggaaucagcc

SEQ ID NO: 1731553 - RNA, 16 nt, Salmonella enterica enterica serovar Typhi Ty2
cgaucagauugaucau

SEQ ID NO: 1731554 - RNA, 23 nt, Salmonella enterica enterica serovar Typhi Ty2
cgaucccggcaaaaaucagcccg

SEQ ID NO: 1731555 - RNA, 20 nt, Salmonella enterica enterica serovar Typhi Ty2
cgauaugugucaugcgguua

SEQ ID NO: 1731556 - RNA, 18 nt, Salmonella enterica enterica serovar Typhi Ty2
cgauagagacugccgccg

SEQ ID NO: 1731557 - RNA, 18 nt, Salmonella enterica enterica serovar Typhi Ty2
cgauacuccauugucggc

SEQ ID NO: 1731558 - RNA, 21 nt, Salmonella enterica enterica serovar Typhi Ty2
cgaucacccacaucagcggca

SEQ ID NO: 1731559 - RNA, 16 nt, Salmonella enterica enterica serovar Typhi Ty2
cgaucaccagcgcauc

SEQ ID NO: 1731560 - RNA, 21 nt, Salmonella enterica enterica serovar Typhi Ty2
cgauacgacugacuucaucaa

SEQ ID NO: 1731561 - RNA, 21 nt, Salmonella enterica enterica serovar Typhi Ty2
cgauacagcacggcaguacac

SEQ ID NO: 1731562 - RNA, 17 nt, Salmonella enterica enterica serovar Typhi Ty2
cgauaccaguaauacgc

SEQ ID NO: 1731563 - RNA, 20 nt, Salmonella enterica enterica serovar Typhi Ty2
cgauaaaaaacgcccagauc

SEQ ID NO: 1731564 - RNA, 21 nt, Salmonella enterica enterica serovar Typhi Ty2
cgauaaaaacccaccagcgcc

SEQ ID NO: 1731565 - RNA, 16 nt, Salmonella enterica enterica serovar Typhi Ty2
cgaguugcggcaacgu

SEQ ID NO: 1731566 - RNA, 16 nt, Salmonella enterica enterica serovar Typhi Ty2
cgccaccgccagccau

SEQ ID NO: 1731567 - RNA, 16 nt, Salmonella enterica enterica serovar Typhi Ty2
cgccagauaaaucagc

SEQ ID NO: 1731568 - RNA, 16 nt, Salmonella enterica enterica serovar Typhi Ty2
cgccacuuuuccggca

SEQ ID NO: 1731569 - RNA, 17 nt, Salmonella enterica enterica serovar Typhi Ty2
cgccagauaaaucagcc

SEQ ID NO: 1731570 - RNA, 18 nt, Salmonella enterica enterica serovar Typhi Ty2
cgccacggccagcagcca

SEQ ID NO: 1731571 - RNA, 17 nt, Salmonella enterica enterica serovar Typhi Ty2
cgccagcagcagcgcaa

SEQ ID NO: 1731572 - RNA, 23 nt, Salmonella enterica enterica serovar Typhi Ty2
cgccagauuaucggccagcgcca

SEQ ID NO: 1731573 - RNA, 22 nt, Salmonella enterica enterica serovar Typhi Ty2
cgccagauccggcagcgggcaa

SEQ ID NO: 1731574 - RNA, 13 nt, Salmonella enterica enterica serovar Typhi Ty2
cgccagcagcgcg

SEQ ID NO: 1731575 - RNA, 18 nt, Salmonella enterica enterica serovar Typhi Ty2
cgccagccgaucaucgua

SEQ ID NO: 1731576 - RNA, 12 nt, Salmonella enterica enterica serovar Typhi Ty2
cgccagcgcauc

SEQ ID NO: 1731577 - RNA, 14 nt, Salmonella enterica enterica serovar Typhi Ty2
cgccagcgcaacgc

SEQ ID NO: 1731578 - RNA, 17 nt, Salmonella enterica enterica serovar Typhi Ty2
cgccagcggccagcgua

SEQ ID NO: 1731579 - RNA, 20 nt, Salmonella enterica enterica serovar Typhi Ty2
cgccagcggcgccaucacca

SEQ ID NO: 1731580 - RNA, 14 nt, Salmonella enterica enterica serovar Typhi Ty2
cgccagcggcguuu

SEQ ID NO: 1731581 - RNA, 20 nt, Salmonella enterica enterica serovar Typhi Ty2
cgcauccggccagcgacugg

SEQ ID NO: 1731582 - RNA, 19 nt, Salmonella enterica enterica serovar Typhi Ty2
cgcaugacuacgaaucgcg

SEQ ID NO: 1731583 - RNA, 16 nt, Salmonella enterica enterica serovar Typhi Ty2
cgcaucugacaucaga

SEQ ID NO: 1731584 - RNA, 15 nt, Salmonella enterica enterica serovar Typhi Ty2
cgcauggcguugcug

SEQ ID NO: 1731585 - RNA, 15 nt, Salmonella enterica enterica serovar Typhi Ty2
cgcauggcagggcga

SEQ ID NO: 1731586 - RNA, 21 nt, Salmonella enterica enterica serovar Typhi Ty2
cgcauggacaaggaucguuac

SEQ ID NO: 1731587 - RNA, 18 nt, Salmonella enterica enterica serovar Typhi Ty2
cgcauucuugccgcaucu

SEQ ID NO: 1731588 - RNA, 16 nt, Salmonella enterica enterica serovar Typhi Ty2
cgccaccacucggcga

SEQ ID NO: 1731589 - RNA, 19 nt, Salmonella enterica enterica serovar Typhi Ty2
cgccacaguauuccggcau

SEQ ID NO: 1731590 - RNA, 15 nt, Salmonella enterica enterica serovar Typhi Ty2
cgccacagcauaccg

SEQ ID NO: 1731591 - RNA, 22 nt, Salmonella enterica enterica serovar Typhi Ty2
cgccaccaucgucgccagaccc

SEQ ID NO: 1731592 - RNA, 17 nt, Salmonella enterica enterica serovar Typhi Ty2
cgccaccauguugcgca

SEQ ID NO: 1731593 - RNA, 21 nt, Salmonella enterica enterica serovar Typhi Ty2
cgccaagaaggguauccagcg

SEQ ID NO: 1731594 - RNA, 18 nt, Salmonella enterica enterica serovar Typhi Ty2
cgcauugcgccccagcac

SEQ ID NO: 1731595 - RNA, 17 nt, Salmonella enterica enterica serovar Typhi Ty2
cgcauuucaagcaggcg

SEQ ID NO: 1731596 - RNA, 19 nt, Salmonella enterica enterica serovar Typhi Ty2
cgcauuucaagcaggcgau

SEQ ID NO: 1731597 - RNA, 13 nt, Salmonella enterica enterica serovar Typhi Ty2
cgcauuuaaucgc

SEQ ID NO: 1731598 - RNA, 11 nt, Salmonella enterica enterica serovar Typhi Ty2
cgccaaugaac

SEQ ID NO: 1731599 - RNA, 19 nt, Salmonella enterica enterica serovar Typhi Ty2
cgccaaugguuaacgccgu

SEQ ID NO: 1731600 - RNA, 13 nt, Salmonella enterica enterica serovar Typhi Ty2
cgccaagcggcaa

SEQ ID NO: 1731601 - RNA, 20 nt, Salmonella enterica enterica serovar Typhi Ty2
cgcagcgccgacguuaucgc

SEQ ID NO: 1731602 - RNA, 13 nt, Salmonella enterica enterica serovar Typhi Ty2
cgcagcgccauaa

SEQ ID NO: 1731603 - RNA, 17 nt, Salmonella enterica enterica serovar Typhi Ty2
cgcagcgcccagcagcu

SEQ ID NO: 1731604 - RNA, 19 nt, Salmonella enterica enterica serovar Typhi Ty2
cgcaggaugcgcugcgcgc

SEQ ID NO: 1731605 - RNA, 13 nt, Salmonella enterica enterica serovar Typhi Ty2
cgcaggagagcca

SEQ ID NO: 1731606 - RNA, 16 nt, Salmonella enterica enterica serovar Typhi Ty2
cgcaggcuaacgcgcc

SEQ ID NO: 1731607 - RNA, 14 nt, Salmonella enterica enterica serovar Typhi Ty2
cgcaggccaucaua

SEQ ID NO: 1731608 - RNA, 13 nt, Salmonella enterica enterica serovar Typhi Ty2
cgcaggccggaua

SEQ ID NO: 1731609 - RNA, 16 nt, Salmonella enterica enterica serovar Typhi Ty2
cgcagcgaaaauccag

SEQ ID NO: 1731610 - RNA, 16 nt, Salmonella enterica enterica serovar Typhi Ty2
cgcagaagcagaccga

SEQ ID NO: 1731611 - RNA, 21 nt, Salmonella enterica enterica serovar Typhi Ty2
cgcacuacggcaaacgcuggu

SEQ ID NO: 1731612 - RNA, 18 nt, Salmonella enterica enterica serovar Typhi Ty2
cgcacugauagccgccag

SEQ ID NO: 1731613 - RNA, 12 nt, Salmonella enterica enterica serovar Typhi Ty2
cgcacgccagau

SEQ ID NO: 1731614 - RNA, 21 nt, Salmonella enterica enterica serovar Typhi Ty2
cgcacgccagauaaaucagcc

SEQ ID NO: 1731615 - RNA, 17 nt, Salmonella enterica enterica serovar Typhi Ty2
cgcacgccugggcgaua

SEQ ID NO: 1731616 - RNA, 22 nt, Salmonella enterica enterica serovar Typhi Ty2
cgcaagcacugaaugcugacgc

SEQ ID NO: 1731617 - RNA, 20 nt, Salmonella enterica enterica serovar Typhi Ty2
cgcaagcggcaaucgccuca

SEQ ID NO: 1731618 - RNA, 21 nt, Salmonella enterica enterica serovar Typhi Ty2
cgcaccguugccauacgccca

SEQ ID NO: 1731619 - RNA, 22 nt, Salmonella enterica enterica serovar Typhi Ty2
cagcgacucauucagcaacugc

SEQ ID NO: 1731620 - RNA, 16 nt, Salmonella enterica enterica serovar Typhi Ty2
cagcgaccuccgcgca

SEQ ID NO: 1731621 - RNA, 16 nt, Salmonella enterica enterica serovar Typhi Ty2
cagcgaacuggcggca

SEQ ID NO: 1731622 - RNA, 14 nt, Salmonella enterica enterica serovar Typhi Ty2
cagcgaauuccggc

SEQ ID NO: 1731623 - RNA, 16 nt, Salmonella enterica enterica serovar Typhi Ty2
cagccucguccugcaa

SEQ ID NO: 1731624 - RNA, 18 nt, Salmonella enterica enterica serovar Typhi Ty2
cagccggauagacaugac

SEQ ID NO: 1731625 - RNA, 22 nt, Salmonella enterica enterica serovar Typhi Ty2
cagcccucaacauugccggcau

SEQ ID NO: 1731626 - RNA, 23 nt, Salmonella enterica enterica serovar Typhi Ty2
cagcccuaucgcugcgcugcggu

SEQ ID NO: 1731627 - RNA, 20 nt, Salmonella enterica enterica serovar Typhi Ty2
cagcccucgguacugcgggu

SEQ ID NO: 1731628 - RNA, 19 nt, Salmonella enterica enterica serovar Typhi Ty2
cagcccguagauaagcgcc

SEQ ID NO: 1731629 - RNA, 15 nt, Salmonella enterica enterica serovar Typhi Ty2
cagccccagcgccag

SEQ ID NO: 1731630 - RNA, 16 nt, Salmonella enterica enterica serovar Typhi Ty2
cagccaggccagcgcu

SEQ ID NO: 1731631 - RNA, 15 nt, Salmonella enterica enterica serovar Typhi Ty2
cagccauucaccacu

SEQ ID NO: 1731632 - RNA, 22 nt, Salmonella enterica enterica serovar Typhi Ty2
cagcccagguagaaucccacca

SEQ ID NO: 1731633 - RNA, 15 nt, Salmonella enterica enterica serovar Typhi Ty2
cagcaucccggcaaa

SEQ ID NO: 1731634 - RNA, 18 nt, Salmonella enterica enterica serovar Typhi Ty2
cagcaucccacgaaugcc

SEQ ID NO: 1731635 - RNA, 17 nt, Salmonella enterica enterica serovar Typhi Ty2
cagcauacgucugcgcu

SEQ ID NO: 1731636 - RNA, 15 nt, Salmonella enterica enterica serovar Typhi Ty2
cagcauauccagcgc

SEQ ID NO: 1731637 - RNA, 22 nt, Salmonella enterica enterica serovar Typhi Ty2
cagcaggacaaccccuacgcag

SEQ ID NO: 1731638 - RNA, 19 nt, Salmonella enterica enterica serovar Typhi Ty2
cagccaaauagcgccagac

SEQ ID NO: 1731639 - RNA, 22 nt, Salmonella enterica enterica serovar Typhi Ty2
cagccaaagucuggccaccgau

SEQ ID NO: 1731640 - RNA, 13 nt, Salmonella enterica enterica serovar Typhi Ty2
cagccaaacugcu

SEQ ID NO: 1731641 - RNA, 15 nt, Salmonella enterica enterica serovar Typhi Ty2
cagccaaacugcugu

SEQ ID NO: 1731642 - RNA, 16 nt, Salmonella enterica enterica serovar Typhi Ty2
cagcaugcccgccagc

SEQ ID NO: 1731643 - RNA, 17 nt, Salmonella enterica enterica serovar Typhi Ty2
cagccaacccacgcgcc

SEQ ID NO: 1731644 - RNA, 16 nt, Salmonella enterica enterica serovar Typhi Ty2
cagcagcagaaucagg

SEQ ID NO: 1731645 - RNA, 15 nt, Salmonella enterica enterica serovar Typhi Ty2
cagcagcgcaucaug

SEQ ID NO: 1731646 - RNA, 14 nt, Salmonella enterica enterica serovar Typhi Ty2
cagcagcgcauagg

SEQ ID NO: 1731647 - RNA, 14 nt, Salmonella enterica enterica serovar Typhi Ty2
cagcagcgagguga

SEQ ID NO: 1731648 - RNA, 13 nt, Salmonella enterica enterica serovar Typhi Ty2
cagcagcugcugu

SEQ ID NO: 1731649 - RNA, 15 nt, Salmonella enterica enterica serovar Typhi Ty2
cagcacgacagagau

SEQ ID NO: 1731650 - RNA, 19 nt, Salmonella enterica enterica serovar Typhi Ty2
cagcacgacagagaucagg

SEQ ID NO: 1731651 - RNA, 16 nt, Salmonella enterica enterica serovar Typhi Ty2
cagcaccuccagcgcc

SEQ ID NO: 1731652 - RNA, 15 nt, Salmonella enterica enterica serovar Typhi Ty2
cagcaccgccgcgau

SEQ ID NO: 1731653 - RNA, 12 nt, Salmonella enterica enterica serovar Typhi Ty2
cagcaccagcau

SEQ ID NO: 1731654 - RNA, 18 nt, Salmonella enterica enterica serovar Typhi Ty2
cagcaccagcauuagcgc

SEQ ID NO: 1731655 - RNA, 14 nt, Salmonella enterica enterica serovar Typhi Ty2
cagcacaaucagcg

SEQ ID NO: 1731656 - RNA, 16 nt, Salmonella enterica enterica serovar Typhi Ty2
cagcacauucagcagc

SEQ ID NO: 1731657 - RNA, 15 nt, Salmonella enterica enterica serovar Typhi Ty2
cagaaucgccagcau

SEQ ID NO: 1731658 - RNA, 18 nt, Salmonella enterica enterica serovar Typhi Ty2
cagaaucaucaugucguc

SEQ ID NO: 1731659 - RNA, 17 nt, Salmonella enterica enterica serovar Typhi Ty2
cagaauagcgucaauaa

SEQ ID NO: 1731660 - RNA, 12 nt, Salmonella enterica enterica serovar Typhi Ty2
cagaauacggcc

SEQ ID NO: 1731661 - RNA, 17 nt, Salmonella enterica enterica serovar Typhi Ty2
cagauagcguaaccggu

SEQ ID NO: 1731662 - RNA, 21 nt, Salmonella enterica enterica serovar Typhi Ty2
cagauacgccuuuacgucgcc

SEQ ID NO: 1731663 - RNA, 18 nt, Salmonella enterica enterica serovar Typhi Ty2
cagauaauagcugcggcu

SEQ ID NO: 1731664 - RNA, 15 nt, Salmonella enterica enterica serovar Typhi Ty2
cagauaauccagcgu

SEQ ID NO: 1731665 - RNA, 17 nt, Salmonella enterica enterica serovar Typhi Ty2
cagauaauagcugcggc

SEQ ID NO: 1731666 - RNA, 15 nt, Salmonella enterica enterica serovar Typhi Ty2
cagaauuuguuuaug

SEQ ID NO: 1731667 - RNA, 19 nt, Salmonella enterica enterica serovar Typhi Ty2
cagauggugauagcgcgcc

SEQ ID NO: 1731668 - RNA, 18 nt, Salmonella enterica enterica serovar Typhi Ty2
cagauguccaccgauuuc

SEQ ID NO: 1731669 - RNA, 16 nt, Salmonella enterica enterica serovar Typhi Ty2
cagauguccaccgauu

SEQ ID NO: 1731670 - RNA, 18 nt, Salmonella enterica enterica serovar Typhi Ty2
cagauauuccagcgacau

SEQ ID NO: 1731671 - RNA, 21 nt, Salmonella enterica enterica serovar Typhi Ty2
cagauaguuagcuaucgcgcc

SEQ ID NO: 1731672 - RNA, 20 nt, Salmonella enterica enterica serovar Typhi Ty2
cagaugcgaaucuucaucgu

SEQ ID NO: 1731673 - RNA, 13 nt, Salmonella enterica enterica serovar Typhi Ty2
cacgcaaaccgcu

SEQ ID NO: 1731674 - RNA, 14 nt, Salmonella enterica enterica serovar Typhi Ty2
cacgcaacaggccg

SEQ ID NO: 1731675 - RNA, 22 nt, Salmonella enterica enterica serovar Typhi Ty2
cacgcaaucucuuccgcccaga

SEQ ID NO: 1731676 - RNA, 22 nt, Salmonella enterica enterica serovar Typhi Ty2
cacgcaaugcguccgucggcga

SEQ ID NO: 1731677 - RNA, 15 nt, Salmonella enterica enterica serovar Typhi Ty2
cacgcaaaugcagcg

SEQ ID NO: 1731678 - RNA, 23 nt, Salmonella enterica enterica serovar Typhi Ty2
cacgauugaucucaucgaucacc

SEQ ID NO: 1731679 - RNA, 14 nt, Salmonella enterica enterica serovar Typhi Ty2
cacgaucgccuaau

SEQ ID NO: 1731680 - RNA, 18 nt, Salmonella enterica enterica serovar Typhi Ty2
cacgauaaauugccugau

SEQ ID NO: 1731681 - RNA, 17 nt, Salmonella enterica enterica serovar Typhi Ty2
cacgauagacagcacca

SEQ ID NO: 1731682 - RNA, 17 nt, Salmonella enterica enterica serovar Typhi Ty2
cacgcagugcgaugcga

SEQ ID NO: 1731683 - RNA, 12 nt, Salmonella enterica enterica serovar Typhi Ty2
cacgcagacgcc

SEQ ID NO: 1731684 - RNA, 21 nt, Salmonella enterica enterica serovar Typhi Ty2
cacgccacaguauuccggcau

SEQ ID NO: 1731685 - RNA, 16 nt, Salmonella enterica enterica serovar Typhi Ty2
cacgcaggucauuggg

SEQ ID NO: 1731686 - RNA, 16 nt, Salmonella enterica enterica serovar Typhi Ty2
cacgccaucagggacg

SEQ ID NO: 1731687 - RNA, 19 nt, Salmonella enterica enterica serovar Typhi Ty2
cacgccagggagggccaac

SEQ ID NO: 1731688 - RNA, 17 nt, Salmonella enterica enterica serovar Typhi Ty2
cacgccgaacaacacgg

SEQ ID NO: 1731689 - RNA, 23 nt, Salmonella enterica enterica serovar Typhi Ty2
caccugguaagcgccaagcggca

SEQ ID NO: 1731690 - RNA, 14 nt, Salmonella enterica enterica serovar Typhi Ty2
caccuuaaccgucu

SEQ ID NO: 1731691 - RNA, 22 nt, Salmonella enterica enterica serovar Typhi Ty2
caccuguccgguguccaucagg

SEQ ID NO: 1731692 - RNA, 21 nt, Salmonella enterica enterica serovar Typhi Ty2
cacgaauaagaaucagaugcu

SEQ ID NO: 1731693 - RNA, 14 nt, Salmonella enterica enterica serovar Typhi Ty2
cacgaagcggguuu

SEQ ID NO: 1731694 - RNA, 20 nt, Salmonella enterica enterica serovar Typhi Ty2
cacugaauuacugcguaaac

SEQ ID NO: 1731695 - RNA, 13 nt, Salmonella enterica enterica serovar Typhi Ty2
cacucgcggauaa

SEQ ID NO: 1731696 - RNA, 15 nt, Salmonella enterica enterica serovar Typhi Ty2
cacugauagccgcca

SEQ ID NO: 1731697 - RNA, 20 nt, Salmonella enterica enterica serovar Typhi Ty2
cacugauaaaauucccgcgc

SEQ ID NO: 1731698 - RNA, 19 nt, Salmonella enterica enterica serovar Typhi Ty2
cacugcaccaguccagugc

SEQ ID NO: 1731699 - RNA, 16 nt, Salmonella enterica enterica serovar Typhi Ty2
cacugcaccuggucga

SEQ ID NO: 1731700 - RNA, 15 nt, Salmonella enterica enterica serovar Typhi Ty2
cagaaggcuaacagc

SEQ ID NO: 1731701 - RNA, 18 nt, Salmonella enterica enterica serovar Typhi Ty2
cagaagguuauucgccuu

SEQ ID NO: 1731702 - RNA, 14 nt, Salmonella enterica enterica serovar Typhi Ty2
cagaacaacgggaa

SEQ ID NO: 1731703 - RNA, 21 nt, Salmonella enterica enterica serovar Typhi Ty2
cagaacaucaagcgguagcgu

SEQ ID NO: 1731704 - RNA, 13 nt, Salmonella enterica enterica serovar Typhi Ty2
cacuuuuaccggc

SEQ ID NO: 1731705 - RNA, 14 nt, Salmonella enterica enterica serovar Typhi Ty2
cacuuuccgacguu

SEQ ID NO: 1731706 - RNA, 21 nt, Salmonella enterica enterica serovar Typhi Ty2
cacuggaauaguuacggacau

SEQ ID NO: 1731707 - RNA, 17 nt, Salmonella enterica enterica serovar Typhi Ty2
cacuucauccggauaaa

SEQ ID NO: 1731708 - RNA, 20 nt, Salmonella enterica enterica serovar Typhi Ty2
cacgcgcgcugcgccuggaa

SEQ ID NO: 1731709 - RNA, 22 nt, Salmonella enterica enterica serovar Typhi Ty2
cacgcgcgcuuuucgccagcgc

SEQ ID NO: 1731710 - RNA, 19 nt, Salmonella enterica enterica serovar Typhi Ty2
cacgcgaugcaaccccuga

SEQ ID NO: 1731711 - RNA, 15 nt, Salmonella enterica enterica serovar Typhi Ty2
cacggaugaucuuca

SEQ ID NO: 1731712 - RNA, 14 nt, Salmonella enterica enterica serovar Typhi Ty2
cacgcgcgucagga

SEQ ID NO: 1731713 - RNA, 22 nt, Salmonella enterica enterica serovar Typhi Ty2
cacggcgcucaggaucgccgga

SEQ ID NO: 1731714 - RNA, 15 nt, Salmonella enterica enterica serovar Typhi Ty2
cacggcggccauuac

SEQ ID NO: 1731715 - RNA, 13 nt, Salmonella enterica enterica serovar Typhi Ty2
cacggcgauaaau

SEQ ID NO: 1731716 - RNA, 14 nt, Salmonella enterica enterica serovar Typhi Ty2
cacggcgcagauau

SEQ ID NO: 1731717 - RNA, 14 nt, Salmonella enterica enterica serovar Typhi Ty2
cacgguucacauuc

SEQ ID NO: 1731718 - RNA, 20 nt, Salmonella enterica enterica serovar Typhi Ty2
cacggcguguugaaauccuc

SEQ ID NO: 1731719 - RNA, 16 nt, Salmonella enterica enterica serovar Typhi Ty2
caguugcggcaucaga

SEQ ID NO: 1731720 - RNA, 12 nt, Salmonella enterica enterica serovar Typhi Ty2
caguugcgcuac

SEQ ID NO: 1731721 - RNA, 15 nt, Salmonella enterica enterica serovar Typhi Ty2
caguugcgucagcgc

SEQ ID NO: 1731722 - RNA, 19 nt, Salmonella enterica enterica serovar Typhi Ty2
caguuggcguaccaucagc

SEQ ID NO: 1731723 - RNA, 23 nt, Salmonella enterica enterica serovar Typhi Ty2
caguuccaccguaugugcgccgu

SEQ ID NO: 1731724 - RNA, 15 nt, Salmonella enterica enterica serovar Typhi Ty2
caguguaaacgccag

SEQ ID NO: 1731725 - RNA, 13 nt, Salmonella enterica enterica serovar Typhi Ty2
cagucgcagccac

SEQ ID NO: 1731726 - RNA, 18 nt, Salmonella enterica enterica serovar Typhi Ty2
caguggccagaaugaucg

SEQ ID NO: 1731727 - RNA, 17 nt, Salmonella enterica enterica serovar Typhi Ty2
cagugccugguggcgac

SEQ ID NO: 1731728 - RNA, 22 nt, Salmonella enterica enterica serovar Typhi Ty2
cauaguauugacgguuacgcaa

SEQ ID NO: 1731729 - RNA, 15 nt, Salmonella enterica enterica serovar Typhi Ty2
cauaggugaacauga

SEQ ID NO: 1731730 - RNA, 15 nt, Salmonella enterica enterica serovar Typhi Ty2
cauagaaaauauaug

SEQ ID NO: 1731731 - RNA, 21 nt, Salmonella enterica enterica serovar Typhi Ty2
cauaccgcuuaacagcguaca

SEQ ID NO: 1731732 - RNA, 18 nt, Salmonella enterica enterica serovar Typhi Ty2
cauacuguuuaucagacc

SEQ ID NO: 1731733 - RNA, 18 nt, Salmonella enterica enterica serovar Typhi Ty2
cauacugcccagccgcca

SEQ ID NO: 1731734 - RNA, 16 nt, Salmonella enterica enterica serovar Typhi Ty2
cauacuaccgcugcga

SEQ ID NO: 1731735 - RNA, 22 nt, Salmonella enterica enterica serovar Typhi Ty2
cauacucauuaccggcugccga

SEQ ID NO: 1731736 - RNA, 16 nt, Salmonella enterica enterica serovar Typhi Ty2
caguuggcgaccgcug

SEQ ID NO: 1731737 - RNA, 17 nt, Salmonella enterica enterica serovar Typhi Ty2
caguuguccgcugguca

SEQ ID NO: 1731738 - RNA, 15 nt, Salmonella enterica enterica serovar Typhi Ty2
cauaaauugcagcga

SEQ ID NO: 1731739 - RNA, 17 nt, Salmonella enterica enterica serovar Typhi Ty2
cauaaauugcagcgacc

SEQ ID NO: 1731740 - RNA, 18 nt, Salmonella enterica enterica serovar Typhi Ty2
cauaaccacaacgugaua

SEQ ID NO: 1731741 - RNA, 12 nt, Salmonella enterica enterica serovar Typhi Ty2
cauaccagcgaa

SEQ ID NO: 1731742 - RNA, 17 nt, Salmonella enterica enterica serovar Typhi Ty2
cauaccacgcagcggca

SEQ ID NO: 1731743 - RNA, 20 nt, Salmonella enterica enterica serovar Typhi Ty2
cauaccacaacagaaucgcg

SEQ ID NO: 1731744 - RNA, 18 nt, Salmonella enterica enterica serovar Typhi Ty2
cauaagcacaccauuuca

SEQ ID NO: 1731745 - RNA, 15 nt, Salmonella enterica enterica serovar Typhi Ty2
caucccgucccacca

SEQ ID NO: 1731746 - RNA, 13 nt, Salmonella enterica enterica serovar Typhi Ty2
cauccacagcgcc

SEQ ID NO: 1731747 - RNA, 14 nt, Salmonella enterica enterica serovar Typhi Ty2
caucauuuccggcg

SEQ ID NO: 1731748 - RNA, 22 nt, Salmonella enterica enterica serovar Typhi Ty2
cauccaccccgguuguggcgua

SEQ ID NO: 1731749 - RNA, 19 nt, Salmonella enterica enterica serovar Typhi Ty2
caucaugcugcaccgcauc

SEQ ID NO: 1731750 - RNA, 16 nt, Salmonella enterica enterica serovar Typhi Ty2
caucauuaaagcgcuc

SEQ ID NO: 1731751 - RNA, 19 nt, Salmonella enterica enterica serovar Typhi Ty2
caucagauaaacagguaaa

SEQ ID NO: 1731752 - RNA, 16 nt, Salmonella enterica enterica serovar Typhi Ty2
caucaggcuggcguua

SEQ ID NO: 1731753 - RNA, 16 nt, Salmonella enterica enterica serovar Typhi Ty2
caucagaccgauaaau

SEQ ID NO: 1731754 - RNA, 15 nt, Salmonella enterica enterica serovar Typhi Ty2
caucagaagugccag

SEQ ID NO: 1731755 - RNA, 17 nt, Salmonella enterica enterica serovar Typhi Ty2
caucacuucgcgcauug

SEQ ID NO: 1731756 - RNA, 16 nt, Salmonella enterica enterica serovar Typhi Ty2
caucacuggcguauug

SEQ ID NO: 1731757 - RNA, 22 nt, Salmonella enterica enterica serovar Typhi Ty2
caucaugaugaucuucagcccg

SEQ ID NO: 1731758 - RNA, 23 nt, Salmonella enterica enterica serovar Typhi Ty2
caucaucgcuggugugcagccag

SEQ ID NO: 1731759 - RNA, 22 nt, Salmonella enterica enterica serovar Typhi Ty2
caucauccccggcaggcucacc

SEQ ID NO: 1731760 - RNA, 16 nt, Salmonella enterica enterica serovar Typhi Ty2
caucauagugcgcgcg

SEQ ID NO: 1731761 - RNA, 14 nt, Salmonella enterica enterica serovar Typhi Ty2
caucacucauaaug

SEQ ID NO: 1731762 - RNA, 20 nt, Salmonella enterica enterica serovar Typhi Ty2
caucacaucguaaaucagcg

SEQ ID NO: 1731763 - RNA, 13 nt, Salmonella enterica enterica serovar Typhi Ty2
cauauugcgcuuc

SEQ ID NO: 1731764 - RNA, 16 nt, Salmonella enterica enterica serovar Typhi Ty2
cauauuaaauuccggc

SEQ ID NO: 1731765 - RNA, 14 nt, Salmonella enterica enterica serovar Typhi Ty2
cauaucaaucaacg

SEQ ID NO: 1731766 - RNA, 16 nt, Salmonella enterica enterica serovar Typhi Ty2
cauaucaaacugaaaa

SEQ ID NO: 1731767 - RNA, 22 nt, Salmonella enterica enterica serovar Typhi Ty2
cauaucuauauuuuuauaucug

SEQ ID NO: 1731768 - RNA, 15 nt, Salmonella enterica enterica serovar Typhi Ty2
cauaucgcggguaaa

SEQ ID NO: 1731769 - RNA, 17 nt, Salmonella enterica enterica serovar Typhi Ty2
caggguaucaucgcuua

SEQ ID NO: 1731770 - RNA, 13 nt, Salmonella enterica enterica serovar Typhi Ty2
cagguaaaccggu

SEQ ID NO: 1731771 - RNA, 15 nt, Salmonella enterica enterica serovar Typhi Ty2
cagguaaaaccagau

SEQ ID NO: 1731772 - RNA, 23 nt, Salmonella enterica enterica serovar Typhi Ty2
cagguaaaaccagauacgcaucg

SEQ ID NO: 1731773 - RNA, 18 nt, Salmonella enterica enterica serovar Typhi Ty2
caggggucaucggcacgu

SEQ ID NO: 1731774 - RNA, 20 nt, Salmonella enterica enterica serovar Typhi Ty2
cagggcuuuuuucucgcgcu

SEQ ID NO: 1731775 - RNA, 21 nt, Salmonella enterica enterica serovar Typhi Ty2
caggucaaaauuaaucgccag

SEQ ID NO: 1731776 - RNA, 19 nt, Salmonella enterica enterica serovar Typhi Ty2
cagguaucccgccagcggc

SEQ ID NO: 1731777 - RNA, 22 nt, Salmonella enterica enterica serovar Typhi Ty2
cagguauuuagccacgccgucc

SEQ ID NO: 1731778 - RNA, 14 nt, Salmonella enterica enterica serovar Typhi Ty2
cagucaugaaaucg

SEQ ID NO: 1731779 - RNA, 13 nt, Salmonella enterica enterica serovar Typhi Ty2
cagucaucgcgcc

SEQ ID NO: 1731780 - RNA, 20 nt, Salmonella enterica enterica serovar Typhi Ty2
caguagaucgacauaagagu

SEQ ID NO: 1731781 - RNA, 19 nt, Salmonella enterica enterica serovar Typhi Ty2
caguagaucgacauaagag

SEQ ID NO: 1731782 - RNA, 22 nt, Salmonella enterica enterica serovar Typhi Ty2
caguacggucaggcucaggaaa

SEQ ID NO: 1731783 - RNA, 13 nt, Salmonella enterica enterica serovar Typhi Ty2
caguacggcgcac

SEQ ID NO: 1731784 - RNA, 17 nt, Salmonella enterica enterica serovar Typhi Ty2
caguacgcgcgcggcgu

SEQ ID NO: 1731785 - RNA, 12 nt, Salmonella enterica enterica serovar Typhi Ty2
caguacggauga

SEQ ID NO: 1731786 - RNA, 21 nt, Salmonella enterica enterica serovar Typhi Ty2
caguacgcguucuacgguauc

SEQ ID NO: 1731787 - RNA, 19 nt, Salmonella enterica enterica serovar Typhi Ty2
caguacgaucaugagucgc

SEQ ID NO: 1731788 - RNA, 20 nt, Salmonella enterica enterica serovar Typhi Ty2
caguaccgucauuuccggcg

SEQ ID NO: 1731789 - RNA, 13 nt, Salmonella enterica enterica serovar Typhi Ty2
caguacagcagcg

SEQ ID NO: 1731790 - RNA, 15 nt, Salmonella enterica enterica serovar Typhi Ty2
caggccaucauaccg

SEQ ID NO: 1731791 - RNA, 16 nt, Salmonella enterica enterica serovar Typhi Ty2
caggccaauuccgcca

SEQ ID NO: 1731792 - RNA, 13 nt, Salmonella enterica enterica serovar Typhi Ty2
caggcauucagcg

SEQ ID NO: 1731793 - RNA, 22 nt, Salmonella enterica enterica serovar Typhi Ty2
caggccaaacccugcgccgcaa

SEQ ID NO: 1731794 - RNA, 13 nt, Salmonella enterica enterica serovar Typhi Ty2
caggcagggcgau

SEQ ID NO: 1731795 - RNA, 19 nt, Salmonella enterica enterica serovar Typhi Ty2
caggcaguuugcgaaaagc

SEQ ID NO: 1731796 - RNA, 14 nt, Salmonella enterica enterica serovar Typhi Ty2
caggcgcggcgcgu

SEQ ID NO: 1731797 - RNA, 16 nt, Salmonella enterica enterica serovar Typhi Ty2
caggccuacauccggc

SEQ ID NO: 1731798 - RNA, 21 nt, Salmonella enterica enterica serovar Typhi Ty2
caggccugcauuugcuggcgu

SEQ ID NO: 1731799 - RNA, 16 nt, Salmonella enterica enterica serovar Typhi Ty2
caggaugauguucauc

SEQ ID NO: 1731800 - RNA, 21 nt, Salmonella enterica enterica serovar Typhi Ty2
caggaugccaaccaccgcgga

SEQ ID NO: 1731801 - RNA, 13 nt, Salmonella enterica enterica serovar Typhi Ty2
caggcagaacgcu

SEQ ID NO: 1731802 - RNA, 16 nt, Salmonella enterica enterica serovar Typhi Ty2
caggacugacugcugu

SEQ ID NO: 1731803 - RNA, 22 nt, Salmonella enterica enterica serovar Typhi Ty2
caggacgguggucaucugguca

SEQ ID NO: 1731804 - RNA, 19 nt, Salmonella enterica enterica serovar Typhi Ty2
caggagcauuggaaauuca

SEQ ID NO: 1731805 - RNA, 21 nt, Salmonella enterica enterica serovar Typhi Ty2
caggagccaguuuucgacaua

SEQ ID NO: 1731806 - RNA, 21 nt, Salmonella enterica enterica serovar Typhi Ty2
caggagcauuggaaauucagg

SEQ ID NO: 1731807 - RNA, 21 nt, Salmonella enterica enterica serovar Typhi Ty2
caggaucagauauuccagcga

SEQ ID NO: 1731808 - RNA, 20 nt, Salmonella enterica enterica serovar Typhi Ty2
caggacgcacccuguucauc

SEQ ID NO: 1731809 - RNA, 17 nt, Salmonella enterica enterica serovar Typhi Ty2
caggacuaacgccgguc

SEQ ID NO: 1731810 - RNA, 11 nt, Salmonella enterica enterica serovar Typhi Ty2
cagcuggugcg

SEQ ID NO: 1731811 - RNA, 15 nt, Salmonella enterica enterica serovar Typhi Ty2
cagcugcgucagcgc

SEQ ID NO: 1731812 - RNA, 13 nt, Salmonella enterica enterica serovar Typhi Ty2
cagcuuaucugac

SEQ ID NO: 1731813 - RNA, 13 nt, Salmonella enterica enterica serovar Typhi Ty2
cagcuuugcggcc

SEQ ID NO: 1731814 - RNA, 18 nt, Salmonella enterica enterica serovar Typhi Ty2
cagcgcgccgccaacgcc

SEQ ID NO: 1731815 - RNA, 19 nt, Salmonella enterica enterica serovar Typhi Ty2
cagcgcggaagccacguuc

SEQ ID NO: 1731816 - RNA, 21 nt, Salmonella enterica enterica serovar Typhi Ty2
cagcgcgcgcgacggcagccu

SEQ ID NO: 1731817 - RNA, 16 nt, Salmonella enterica enterica serovar Typhi Ty2
cagcgcgucgaccaua

SEQ ID NO: 1731818 - RNA, 15 nt, Salmonella enterica enterica serovar Typhi Ty2
cagcgcuauccggcc

SEQ ID NO: 1731819 - RNA, 16 nt, Salmonella enterica enterica serovar Typhi Ty2
cagcgcuacccgcuga

SEQ ID NO: 1731820 - RNA, 14 nt, Salmonella enterica enterica serovar Typhi Ty2
cagcgcuaucaggc

SEQ ID NO: 1731821 - RNA, 15 nt, Salmonella enterica enterica serovar Typhi Ty2
cagcgcuccgacaaa

SEQ ID NO: 1731822 - RNA, 16 nt, Salmonella enterica enterica serovar Typhi Ty2
cagcgcuccacgcguc

SEQ ID NO: 1731823 - RNA, 22 nt, Salmonella enterica enterica serovar Typhi Ty2
cagcgcugcuguaacagacgca

SEQ ID NO: 1731824 - RNA, 22 nt, Salmonella enterica enterica serovar Typhi Ty2
cagcggacacccgcagccagaa

SEQ ID NO: 1731825 - RNA, 15 nt, Salmonella enterica enterica serovar Typhi Ty2
cagcgcuuugccgcu

SEQ ID NO: 1731826 - RNA, 13 nt, Salmonella enterica enterica serovar Typhi Ty2
cagcggccaugac

SEQ ID NO: 1731827 - RNA, 19 nt, Salmonella enterica enterica serovar Typhi Ty2
cagcggcgccaucaccauc

SEQ ID NO: 1731828 - RNA, 13 nt, Salmonella enterica enterica serovar Typhi Ty2
cagcggcggaaug

SEQ ID NO: 1731829 - RNA, 23 nt, Salmonella enterica enterica serovar Typhi Ty2
cagcguuaacgacgcuccagaau

SEQ ID NO: 1731830 - RNA, 22 nt, Salmonella enterica enterica serovar Typhi Ty2
cagcucaaccgcgcggcguucu

SEQ ID NO: 1731831 - RNA, 18 nt, Salmonella enterica enterica serovar Typhi Ty2
cagcgucuguuucaacgc

SEQ ID NO: 1731832 - RNA, 21 nt, Salmonella enterica enterica serovar Typhi Ty2
ccaaccggccccaucgccgua

SEQ ID NO: 1731833 - RNA, 13 nt, Salmonella enterica enterica serovar Typhi Ty2
ccaaauagcgcca

SEQ ID NO: 1731834 - RNA, 23 nt, Salmonella enterica enterica serovar Typhi Ty2
ccaaauagcacgugcaugggaua

SEQ ID NO: 1731835 - RNA, 17 nt, Salmonella enterica enterica serovar Typhi Ty2
ccaaaguuaaucagcgc

SEQ ID NO: 1731836 - RNA, 23 nt, Salmonella enterica enterica serovar Typhi Ty2
cauuguacuuuuaaaucaucagg

SEQ ID NO: 1731837 - RNA, 21 nt, Salmonella enterica enterica serovar Typhi Ty2
cauugucaucaguaugagcga

SEQ ID NO: 1731838 - RNA, 16 nt, Salmonella enterica enterica serovar Typhi Ty2
ccaaaccugccacagg

SEQ ID NO: 1731839 - RNA, 18 nt, Salmonella enterica enterica serovar Typhi Ty2
ccaaacaucgcucgcgcc

SEQ ID NO: 1731840 - RNA, 17 nt, Salmonella enterica enterica serovar Typhi Ty2
cauuggcaaaccccugc

SEQ ID NO: 1731841 - RNA, 20 nt, Salmonella enterica enterica serovar Typhi Ty2
cauugcugccuuauccggcc

SEQ ID NO: 1731842 - RNA, 23 nt, Salmonella enterica enterica serovar Typhi Ty2
cauucuuuugcccgguggcgcug

SEQ ID NO: 1731843 - RNA, 23 nt, Salmonella enterica enterica serovar Typhi Ty2
cauugccaugaugagcgccauau

SEQ ID NO: 1731844 - RNA, 17 nt, Salmonella enterica enterica serovar Typhi Ty2
cauucagggaaucagcg

SEQ ID NO: 1731845 - RNA, 18 nt, Salmonella enterica enterica serovar Typhi Ty2
cauuccauuuuucgaucu

SEQ ID NO: 1731846 - RNA, 17 nt, Salmonella enterica enterica serovar Typhi Ty2
cauuccccacgcugacg

SEQ ID NO: 1731847 - RNA, 19 nt, Salmonella enterica enterica serovar Typhi Ty2
cauucauuuuaucgauaau

SEQ ID NO: 1731848 - RNA, 20 nt, Salmonella enterica enterica serovar Typhi Ty2
cauuccagcguaugauagcg

SEQ ID NO: 1731849 - RNA, 18 nt, Salmonella enterica enterica serovar Typhi Ty2
cauucugcugaugcuggu

SEQ ID NO: 1731850 - RNA, 18 nt, Salmonella enterica enterica serovar Typhi Ty2
ccaccaauuucaccggau

SEQ ID NO: 1731851 - RNA, 20 nt, Salmonella enterica enterica serovar Typhi Ty2
ccaccaaagccaggccgcca

SEQ ID NO: 1731852 - RNA, 14 nt, Salmonella enterica enterica serovar Typhi Ty2
ccacaucagaccgc

SEQ ID NO: 1731853 - RNA, 12 nt, Salmonella enterica enterica serovar Typhi Ty2
ccacaucagcgg

SEQ ID NO: 1731854 - RNA, 17 nt, Salmonella enterica enterica serovar Typhi Ty2
ccacauacugaaauuuc

SEQ ID NO: 1731855 - RNA, 16 nt, Salmonella enterica enterica serovar Typhi Ty2
ccacauagcauccaga

SEQ ID NO: 1731856 - RNA, 14 nt, Salmonella enterica enterica serovar Typhi Ty2
ccacaccggcgcau

SEQ ID NO: 1731857 - RNA, 23 nt, Salmonella enterica enterica serovar Typhi Ty2
ccaauacgccagccuaucgccau

SEQ ID NO: 1731858 - RNA, 18 nt, Salmonella enterica enterica serovar Typhi Ty2
ccaauaaaaacugcuaaa

SEQ ID NO: 1731859 - RNA, 15 nt, Salmonella enterica enterica serovar Typhi Ty2
ccaacgccggcaaca

SEQ ID NO: 1731860 - RNA, 23 nt, Salmonella enterica enterica serovar Typhi Ty2
ccaauacccagcgccaacgccac

SEQ ID NO: 1731861 - RNA, 14 nt, Salmonella enterica enterica serovar Typhi Ty2
ccaauaaacgccag

SEQ ID NO: 1731862 - RNA, 22 nt, Salmonella enterica enterica serovar Typhi Ty2
ccaagcggcaacucugugcguu

SEQ ID NO: 1731863 - RNA, 18 nt, Salmonella enterica enterica serovar Typhi Ty2
ccaagaccgccuaacagc

SEQ ID NO: 1731864 - RNA, 15 nt, Salmonella enterica enterica serovar Typhi Ty2
caugguacucaacau

SEQ ID NO: 1731865 - RNA, 17 nt, Salmonella enterica enterica serovar Typhi Ty2
cauggcccuuuugcccg

SEQ ID NO: 1731866 - RNA, 16 nt, Salmonella enterica enterica serovar Typhi Ty2
cauggcggcgacaaug

SEQ ID NO: 1731867 - RNA, 21 nt, Salmonella enterica enterica serovar Typhi Ty2
caugcgcggcggguugaugau

SEQ ID NO: 1731868 - RNA, 23 nt, Salmonella enterica enterica serovar Typhi Ty2
caugccaucauuaauuuacugau

SEQ ID NO: 1731869 - RNA, 16 nt, Salmonella enterica enterica serovar Typhi Ty2
caugcagcucaagcgc

SEQ ID NO: 1731870 - RNA, 15 nt, Salmonella enterica enterica serovar Typhi Ty2
caugccguaccguug

SEQ ID NO: 1731871 - RNA, 19 nt, Salmonella enterica enterica serovar Typhi Ty2
caugacgucguuguccggc

SEQ ID NO: 1731872 - RNA, 17 nt, Salmonella enterica enterica serovar Typhi Ty2
caugaccugggcgccag

SEQ ID NO: 1731873 - RNA, 12 nt, Salmonella enterica enterica serovar Typhi Ty2
caugaucgucag

SEQ ID NO: 1731874 - RNA, 19 nt, Salmonella enterica enterica serovar Typhi Ty2
caugaugccacgagaaauc

SEQ ID NO: 1731875 - RNA, 22 nt, Salmonella enterica enterica serovar Typhi Ty2
caugaucuuaccucuccugaau

SEQ ID NO: 1731876 - RNA, 15 nt, Salmonella enterica enterica serovar Typhi Ty2
caucuuuuacaggcc

SEQ ID NO: 1731877 - RNA, 14 nt, Salmonella enterica enterica serovar Typhi Ty2
caucuuuuccggca

SEQ ID NO: 1731878 - RNA, 13 nt, Salmonella enterica enterica serovar Typhi Ty2
caucuugcguuau

SEQ ID NO: 1731879 - RNA, 22 nt, Salmonella enterica enterica serovar Typhi Ty2
caucuuucacccauugaacccg

SEQ ID NO: 1731880 - RNA, 15 nt, Salmonella enterica enterica serovar Typhi Ty2
caucuguucaacuuu

SEQ ID NO: 1731881 - RNA, 23 nt, Salmonella enterica enterica serovar Typhi Ty2
caucuuccucacagccuugccag

SEQ ID NO: 1731882 - RNA, 22 nt, Salmonella enterica enterica serovar Typhi Ty2
caucugguuguuucuuaacccc

SEQ ID NO: 1731883 - RNA, 14 nt, Salmonella enterica enterica serovar Typhi Ty2
caucucuuugcccg

SEQ ID NO: 1731884 - RNA, 16 nt, Salmonella enterica enterica serovar Typhi Ty2
caucugcaugcgcugg

SEQ ID NO: 1731885 - RNA, 21 nt, Salmonella enterica enterica serovar Typhi Ty2
caucucaauaucguugccgcc

SEQ ID NO: 1731886 - RNA, 12 nt, Salmonella enterica enterica serovar Typhi Ty2
caucucgccaaa

SEQ ID NO: 1731887 - RNA, 15 nt, Salmonella enterica enterica serovar Typhi Ty2
caucgguaagcgcaa

SEQ ID NO: 1731888 - RNA, 13 nt, Salmonella enterica enterica serovar Typhi Ty2
caucgugauaaac

SEQ ID NO: 1731889 - RNA, 19 nt, Salmonella enterica enterica serovar Typhi Ty2
caucguugccagcggccag

SEQ ID NO: 1731890 - RNA, 12 nt, Salmonella enterica enterica serovar Typhi Ty2
caucguuaucau

SEQ ID NO: 1731891 - RNA, 14 nt, Salmonella enterica enterica serovar Typhi Ty2
caucguuugcgcua

SEQ ID NO: 1731892 - RNA, 18 nt, Salmonella enterica enterica serovar Typhi Ty2
caucgucccaucgucguu

SEQ ID NO: 1731893 - RNA, 22 nt, Salmonella enterica enterica serovar Typhi Ty2
caucgucgcgccaauggcgauc

SEQ ID NO: 1731894 - RNA, 13 nt, Salmonella enterica enterica serovar Typhi Ty2
ccagcgcccuauc

SEQ ID NO: 1731895 - RNA, 18 nt, Salmonella enterica enterica serovar Typhi Ty2
ccagcgcccuauccagcg

SEQ ID NO: 1731896 - RNA, 20 nt, Salmonella enterica enterica serovar Typhi Ty2
ccagcgccgcggccuccgga

SEQ ID NO: 1731897 - RNA, 14 nt, Salmonella enterica enterica serovar Typhi Ty2
ccagcgccgcgcga

SEQ ID NO: 1731898 - RNA, 12 nt, Salmonella enterica enterica serovar Typhi Ty2
ccagcgccggau

SEQ ID NO: 1731899 - RNA, 21 nt, Salmonella enterica enterica serovar Typhi Ty2
ccagccgauuucauaccacug

SEQ ID NO: 1731900 - RNA, 19 nt, Salmonella enterica enterica serovar Typhi Ty2
ccagcgguguuugccagac

SEQ ID NO: 1731901 - RNA, 20 nt, Salmonella enterica enterica serovar Typhi Ty2
ccagcgggugaugcgccagc

SEQ ID NO: 1731902 - RNA, 17 nt, Salmonella enterica enterica serovar Typhi Ty2
ccagcguaccacgccgc

SEQ ID NO: 1731903 - RNA, 23 nt, Salmonella enterica enterica serovar Typhi Ty2
ccagcgucuccagacaauccgcg

SEQ ID NO: 1731904 - RNA, 16 nt, Salmonella enterica enterica serovar Typhi Ty2
ccagcgucagccagaa

SEQ ID NO: 1731905 - RNA, 14 nt, Salmonella enterica enterica serovar Typhi Ty2
ccagcgcgccgcca

SEQ ID NO: 1731906 - RNA, 23 nt, Salmonella enterica enterica serovar Typhi Ty2
ccagcgggccgacgauaaacaga

SEQ ID NO: 1731907 - RNA, 16 nt, Salmonella enterica enterica serovar Typhi Ty2
ccagaugucgcggaua

SEQ ID NO: 1731908 - RNA, 12 nt, Salmonella enterica enterica serovar Typhi Ty2
ccagaugguaag

SEQ ID NO: 1731909 - RNA, 14 nt, Salmonella enterica enterica serovar Typhi Ty2
ccagcacuaacagc

SEQ ID NO: 1731910 - RNA, 20 nt, Salmonella enterica enterica serovar Typhi Ty2
ccagcacuaacagcagcagc

SEQ ID NO: 1731911 - RNA, 19 nt, Salmonella enterica enterica serovar Typhi Ty2
ccagcagacucauggacaa

SEQ ID NO: 1731912 - RNA, 13 nt, Salmonella enterica enterica serovar Typhi Ty2
ccagcagcgccag

SEQ ID NO: 1731913 - RNA, 12 nt, Salmonella enterica enterica serovar Typhi Ty2
ccagcagcgcca

SEQ ID NO: 1731914 - RNA, 15 nt, Salmonella enterica enterica serovar Typhi Ty2
ccagcaguugccaua

SEQ ID NO: 1731915 - RNA, 14 nt, Salmonella enterica enterica serovar Typhi Ty2
ccagcauacgucug

SEQ ID NO: 1731916 - RNA, 14 nt, Salmonella enterica enterica serovar Typhi Ty2
ccagcauaaugagc

SEQ ID NO: 1731917 - RNA, 19 nt, Salmonella enterica enterica serovar Typhi Ty2
ccagcaucagaauaaugcu

SEQ ID NO: 1731918 - RNA, 13 nt, Salmonella enterica enterica serovar Typhi Ty2
ccagcaucacgug

SEQ ID NO: 1731919 - RNA, 18 nt, Salmonella enterica enterica serovar Typhi Ty2
ccagcaguugcagcguac

SEQ ID NO: 1731920 - RNA, 18 nt, Salmonella enterica enterica serovar Typhi Ty2
ccagcagcgcgaucgccc

SEQ ID NO: 1731921 - RNA, 17 nt, Salmonella enterica enterica serovar Typhi Ty2
ccagcagcgccagcgaa

SEQ ID NO: 1731922 - RNA, 15 nt, Salmonella enterica enterica serovar Typhi Ty2
ccagccacacgacgg

SEQ ID NO: 1731923 - RNA, 20 nt, Salmonella enterica enterica serovar Typhi Ty2
ccagccauggcccaaaaggu

SEQ ID NO: 1731924 - RNA, 22 nt, Salmonella enterica enterica serovar Typhi Ty2
ccagccauaaugcaaucaguuc

SEQ ID NO: 1731925 - RNA, 16 nt, Salmonella enterica enterica serovar Typhi Ty2
ccagccagacgccagc

SEQ ID NO: 1731926 - RNA, 17 nt, Salmonella enterica enterica serovar Typhi Ty2
ccagccgaucagcgcca

SEQ ID NO: 1731927 - RNA, 21 nt, Salmonella enterica enterica serovar Typhi Ty2
ccagccgagcgguaagagcca

SEQ ID NO: 1731928 - RNA, 23 nt, Salmonella enterica enterica serovar Typhi Ty2
ccagcccggaaauaaacgccagu

SEQ ID NO: 1731929 - RNA, 22 nt, Salmonella enterica enterica serovar Typhi Ty2
ccacgaacgauauaaaaaccga

SEQ ID NO: 1731930 - RNA, 16 nt, Salmonella enterica enterica serovar Typhi Ty2
ccacgaaucaggauau

SEQ ID NO: 1731931 - RNA, 15 nt, Salmonella enterica enterica serovar Typhi Ty2
ccaccucaaacgaug

SEQ ID NO: 1731932 - RNA, 18 nt, Salmonella enterica enterica serovar Typhi Ty2
ccaccucaagguagcgug

SEQ ID NO: 1731933 - RNA, 17 nt, Salmonella enterica enterica serovar Typhi Ty2
ccaccguuuaaucgccc

SEQ ID NO: 1731934 - RNA, 17 nt, Salmonella enterica enterica serovar Typhi Ty2
ccaccucaaucaccguu

SEQ ID NO: 1731935 - RNA, 20 nt, Salmonella enterica enterica serovar Typhi Ty2
ccaccaucacuuccauccau

SEQ ID NO: 1731936 - RNA, 19 nt, Salmonella enterica enterica serovar Typhi Ty2
ccacgcccuucacgccgaa

SEQ ID NO: 1731937 - RNA, 15 nt, Salmonella enterica enterica serovar Typhi Ty2
ccacgccguccggag

SEQ ID NO: 1731938 - RNA, 23 nt, Salmonella enterica enterica serovar Typhi Ty2
ccacgccggaaucgcgauccagc

SEQ ID NO: 1731939 - RNA, 23 nt, Salmonella enterica enterica serovar Typhi Ty2
ccacgcgggcgguauuauccgcc

SEQ ID NO: 1731940 - RNA, 15 nt, Salmonella enterica enterica serovar Typhi Ty2
ccacgcgacgccagc

SEQ ID NO: 1731941 - RNA, 14 nt, Salmonella enterica enterica serovar Typhi Ty2
ccacguuaccgcgc

SEQ ID NO: 1731942 - RNA, 12 nt, Salmonella enterica enterica serovar Typhi Ty2
ccagaugcgcca

SEQ ID NO: 1731943 - RNA, 13 nt, Salmonella enterica enterica serovar Typhi Ty2
ccagaucggcaua

SEQ ID NO: 1731944 - RNA, 17 nt, Salmonella enterica enterica serovar Typhi Ty2
ccagaucgauauccgug

SEQ ID NO: 1731945 - RNA, 18 nt, Salmonella enterica enterica serovar Typhi Ty2
ccagauagcgcugcgcca

SEQ ID NO: 1731946 - RNA, 14 nt, Salmonella enterica enterica serovar Typhi Ty2
ccagauagcgcugc

SEQ ID NO: 1731947 - RNA, 13 nt, Salmonella enterica enterica serovar Typhi Ty2
ccagauagcgcug

SEQ ID NO: 1731948 - RNA, 15 nt, Salmonella enterica enterica serovar Typhi Ty2
ccagauaucccgcca

SEQ ID NO: 1731949 - RNA, 19 nt, Salmonella enterica enterica serovar Typhi Ty2
ccagauagggccaggcgcg

SEQ ID NO: 1731950 - RNA, 14 nt, Salmonella enterica enterica serovar Typhi Ty2
ccagauaaaucagc

SEQ ID NO: 1731951 - RNA, 19 nt, Salmonella enterica enterica serovar Typhi Ty2
ccagauacccuuuaucgcg

SEQ ID NO: 1731952 - RNA, 15 nt, Salmonella enterica enterica serovar Typhi Ty2
ccagacaugcgccgg

SEQ ID NO: 1731953 - RNA, 18 nt, Salmonella enterica enterica serovar Typhi Ty2
ccacuggguuucccauug

SEQ ID NO: 1731954 - RNA, 13 nt, Salmonella enterica enterica serovar Typhi Ty2
ccagaccggcgac

SEQ ID NO: 1731955 - RNA, 18 nt, Salmonella enterica enterica serovar Typhi Ty2
ccagacgaccguaauagc

SEQ ID NO: 1731956 - RNA, 14 nt, Salmonella enterica enterica serovar Typhi Ty2
ccagacgcgcagca

SEQ ID NO: 1731957 - RNA, 18 nt, Salmonella enterica enterica serovar Typhi Ty2
ccaggcaucgacgccagc

SEQ ID NO: 1731958 - RNA, 16 nt, Salmonella enterica enterica serovar Typhi Ty2
ccaggcaccauccggu

SEQ ID NO: 1731959 - RNA, 13 nt, Salmonella enterica enterica serovar Typhi Ty2
ccaggcaaucagc

SEQ ID NO: 1731960 - RNA, 14 nt, Salmonella enterica enterica serovar Typhi Ty2
ccaggcaaaacagu

SEQ ID NO: 1731961 - RNA, 23 nt, Salmonella enterica enterica serovar Typhi Ty2
ccaggccaugcgccgcgucagca

SEQ ID NO: 1731962 - RNA, 17 nt, Salmonella enterica enterica serovar Typhi Ty2
ccaggcguuuaugagau

SEQ ID NO: 1731963 - RNA, 17 nt, Salmonella enterica enterica serovar Typhi Ty2
ccaggcuauccaacaga

SEQ ID NO: 1731964 - RNA, 18 nt, Salmonella enterica enterica serovar Typhi Ty2
ccaggcgcgaaucgacaa

SEQ ID NO: 1731965 - RNA, 13 nt, Salmonella enterica enterica serovar Typhi Ty2
ccagucauccggu

SEQ ID NO: 1731966 - RNA, 17 nt, Salmonella enterica enterica serovar Typhi Ty2
ccaguaucgcgccgcca

SEQ ID NO: 1731967 - RNA, 21 nt, Salmonella enterica enterica serovar Typhi Ty2
ccagucaaaaugucaguaucg

SEQ ID NO: 1731968 - RNA, 20 nt, Salmonella enterica enterica serovar Typhi Ty2
ccauauucuuugcgccuuau

SEQ ID NO: 1731969 - RNA, 19 nt, Salmonella enterica enterica serovar Typhi Ty2
ccaucaauaagcgaauugc

SEQ ID NO: 1731970 - RNA, 13 nt, Salmonella enterica enterica serovar Typhi Ty2
ccauaucaaucaa

SEQ ID NO: 1731971 - RNA, 19 nt, Salmonella enterica enterica serovar Typhi Ty2
ccaguuugguuaauuccgc

SEQ ID NO: 1731972 - RNA, 18 nt, Salmonella enterica enterica serovar Typhi Ty2
ccaguuuuccgccugaau

SEQ ID NO: 1731973 - RNA, 14 nt, Salmonella enterica enterica serovar Typhi Ty2
ccaguuuacgcgua

SEQ ID NO: 1731974 - RNA, 17 nt, Salmonella enterica enterica serovar Typhi Ty2
ccaguucgucuuccgga

SEQ ID NO: 1731975 - RNA, 13 nt, Salmonella enterica enterica serovar Typhi Ty2
ccaguagcagcga

SEQ ID NO: 1731976 - RNA, 17 nt, Salmonella enterica enterica serovar Typhi Ty2
ccaguacggcgcgaauc

SEQ ID NO: 1731977 - RNA, 13 nt, Salmonella enterica enterica serovar Typhi Ty2
ccaguagcagaca

SEQ ID NO: 1731978 - RNA, 21 nt, Salmonella enterica enterica serovar Typhi Ty2
ccaggugcguggcccgcacug

SEQ ID NO: 1731979 - RNA, 15 nt, Salmonella enterica enterica serovar Typhi Ty2
ccauguacuccugau

SEQ ID NO: 1731980 - RNA, 15 nt, Salmonella enterica enterica serovar Typhi Ty2
ccauuugcauccgua

SEQ ID NO: 1731981 - RNA, 22 nt, Salmonella enterica enterica serovar Typhi Ty2
ccauugcuaggaacagugacaa

SEQ ID NO: 1731982 - RNA, 15 nt, Salmonella enterica enterica serovar Typhi Ty2
cccacaaccgacgca

SEQ ID NO: 1731983 - RNA, 16 nt, Salmonella enterica enterica serovar Typhi Ty2
cccaaccgagcagcuu

SEQ ID NO: 1731984 - RNA, 20 nt, Salmonella enterica enterica serovar Typhi Ty2
cccaauagcgaucgagauaa

SEQ ID NO: 1731985 - RNA, 18 nt, Salmonella enterica enterica serovar Typhi Ty2
ccaucucacgcauggcgu

SEQ ID NO: 1731986 - RNA, 18 nt, Salmonella enterica enterica serovar Typhi Ty2
ccaucacuuccauccaug

SEQ ID NO: 1731987 - RNA, 19 nt, Salmonella enterica enterica serovar Typhi Ty2
ccaucagcaucccaccgga

SEQ ID NO: 1731988 - RNA, 18 nt, Salmonella enterica enterica serovar Typhi Ty2
ccaucacgaucgcgguuc

SEQ ID NO: 1731989 - RNA, 17 nt, Salmonella enterica enterica serovar Typhi Ty2
ccaucacauguagcgcg

SEQ ID NO: 1731990 - RNA, 17 nt, Salmonella enterica enterica serovar Typhi Ty2
ccaucggcgggcguauc

SEQ ID NO: 1731991 - RNA, 13 nt, Salmonella enterica enterica serovar Typhi Ty2
cccaggccggcau

SEQ ID NO: 1731992 - RNA, 21 nt, Salmonella enterica enterica serovar Typhi Ty2
cccagcgccggauaauccaga

SEQ ID NO: 1731993 - RNA, 20 nt, Salmonella enterica enterica serovar Typhi Ty2
cccaggguuuagccccagac

SEQ ID NO: 1731994 - RNA, 23 nt, Salmonella enterica enterica serovar Typhi Ty2
cccauagcagcuccgaaacaauc

SEQ ID NO: 1731995 - RNA, 17 nt, Salmonella enterica enterica serovar Typhi Ty2
cccauaguagcuaauga

SEQ ID NO: 1731996 - RNA, 21 nt, Salmonella enterica enterica serovar Typhi Ty2
cccaguuucaucaucgccgau

SEQ ID NO: 1731997 - RNA, 20 nt, Salmonella enterica enterica serovar Typhi Ty2
cccaucuaaccgggccugau

SEQ ID NO: 1731998 - RNA, 14 nt, Salmonella enterica enterica serovar Typhi Ty2
cccaucguaacgcc

SEQ ID NO: 1731999 - RNA, 13 nt, Salmonella enterica enterica serovar Typhi Ty2
cccaucugauaau

SEQ ID NO: 1732000 - RNA, 15 nt, Salmonella enterica enterica serovar Typhi Ty2
cccagaauccgcgca

SEQ ID NO: 1732001 - RNA, 21 nt, Salmonella enterica enterica serovar Typhi Ty2
cccagccagagauccacauug

SEQ ID NO: 1732002 - RNA, 17 nt, Salmonella enterica enterica serovar Typhi Ty2
cccagcgaacugauaaa

SEQ ID NO: 1732003 - RNA, 13 nt, Salmonella enterica enterica serovar Typhi Ty2
cccagaaucaccc

SEQ ID NO: 1732004 - RNA, 15 nt, Salmonella enterica enterica serovar Typhi Ty2
cccagaaagaucagc

SEQ ID NO: 1732005 - RNA, 16 nt, Salmonella enterica enterica serovar Typhi Ty2
cccacuucgccgguuc

SEQ ID NO: 1732006 - RNA, 21 nt, Salmonella enterica enterica serovar Typhi Ty2
cccacuccggcgugaacgccu

SEQ ID NO: 1732007 - RNA, 12 nt, Salmonella enterica enterica serovar Typhi Ty2
cccgaaccugcg

SEQ ID NO: 1732008 - RNA, 17 nt, Salmonella enterica enterica serovar Typhi Ty2
cccauuaauaucagccc

SEQ ID NO: 1732009 - RNA, 15 nt, Salmonella enterica enterica serovar Typhi Ty2
cccaugucagcgcaa

SEQ ID NO: 1732010 - RNA, 18 nt, Salmonella enterica enterica serovar Typhi Ty2
ccccguugcucauguuau

SEQ ID NO: 1732011 - RNA, 16 nt, Salmonella enterica enterica serovar Typhi Ty2
ccccguuuuccacgcg

SEQ ID NO: 1732012 - RNA, 21 nt, Salmonella enterica enterica serovar Typhi Ty2
ccccugcuggcgaaccaccag

SEQ ID NO: 1732013 - RNA, 21 nt, Salmonella enterica enterica serovar Typhi Ty2
ccccuuacuaagccaguucuc

SEQ ID NO: 1732014 - RNA, 13 nt, Salmonella enterica enterica serovar Typhi Ty2
cccgccagaugca

SEQ ID NO: 1732015 - RNA, 13 nt, Salmonella enterica enterica serovar Typhi Ty2
cccgccagcauac

SEQ ID NO: 1732016 - RNA, 23 nt, Salmonella enterica enterica serovar Typhi Ty2
cccgccagcaccaggcucgcaga

SEQ ID NO: 1732017 - RNA, 17 nt, Salmonella enterica enterica serovar Typhi Ty2
cccgccaucguccagcc

SEQ ID NO: 1732018 - RNA, 13 nt, Salmonella enterica enterica serovar Typhi Ty2
cccgcccagauca

SEQ ID NO: 1732019 - RNA, 12 nt, Salmonella enterica enterica serovar Typhi Ty2
cccgauacgcgg

SEQ ID NO: 1732020 - RNA, 18 nt, Salmonella enterica enterica serovar Typhi Ty2
cccgaucuucaucguuac

SEQ ID NO: 1732021 - RNA, 23 nt, Salmonella enterica enterica serovar Typhi Ty2
cccgauaaaaucaucgcgcugau

SEQ ID NO: 1732022 - RNA, 19 nt, Salmonella enterica enterica serovar Typhi Ty2
cccgauaagcaagcgccau

SEQ ID NO: 1732023 - RNA, 11 nt, Salmonella enterica enterica serovar Typhi Ty2
cccgauacccu

SEQ ID NO: 1732024 - RNA, 13 nt, Salmonella enterica enterica serovar Typhi Ty2
cccgauaaccgcg

SEQ ID NO: 1732025 - RNA, 21 nt, Salmonella enterica enterica serovar Typhi Ty2
cccgcaaacuaauggcgcagc

SEQ ID NO: 1732026 - RNA, 12 nt, Salmonella enterica enterica serovar Typhi Ty2
ccgaaucaggcg

SEQ ID NO: 1732027 - RNA, 21 nt, Salmonella enterica enterica serovar Typhi Ty2
ccgaaaugaccaccgcaucgg

SEQ ID NO: 1732028 - RNA, 15 nt, Salmonella enterica enterica serovar Typhi Ty2
ccgaacaacacggcg

SEQ ID NO: 1732029 - RNA, 23 nt, Salmonella enterica enterica serovar Typhi Ty2
cccugaaauaacagacuccgucu

SEQ ID NO: 1732030 - RNA, 16 nt, Salmonella enterica enterica serovar Typhi Ty2
cccucuuuuagcaaua

SEQ ID NO: 1732031 - RNA, 13 nt, Salmonella enterica enterica serovar Typhi Ty2
cccugccagcgua

SEQ ID NO: 1732032 - RNA, 22 nt, Salmonella enterica enterica serovar Typhi Ty2
cccugccguuugcgccagcccg

SEQ ID NO: 1732033 - RNA, 19 nt, Salmonella enterica enterica serovar Typhi Ty2
cccgugcgcgucgccugaa

SEQ ID NO: 1732034 - RNA, 12 nt, Salmonella enterica enterica serovar Typhi Ty2
cccguuauucau

SEQ ID NO: 1732035 - RNA, 22 nt, Salmonella enterica enterica serovar Typhi Ty2
cccguuaaauaccagcaccuga

SEQ ID NO: 1732036 - RNA, 18 nt, Salmonella enterica enterica serovar Typhi Ty2
cccguuccucguccugau

SEQ ID NO: 1732037 - RNA, 20 nt, Salmonella enterica enterica serovar Typhi Ty2
cccuccaguagcagcgauga

SEQ ID NO: 1732038 - RNA, 19 nt, Salmonella enterica enterica serovar Typhi Ty2
cccggcuuuaugaugguga

SEQ ID NO: 1732039 - RNA, 15 nt, Salmonella enterica enterica serovar Typhi Ty2
cccggcuuccagcgg

SEQ ID NO: 1732040 - RNA, 15 nt, Salmonella enterica enterica serovar Typhi Ty2
cccguacaaggucgg

SEQ ID NO: 1732041 - RNA, 18 nt, Salmonella enterica enterica serovar Typhi Ty2
cccguaaugcccaggcgg

SEQ ID NO: 1732042 - RNA, 23 nt, Salmonella enterica enterica serovar Typhi Ty2
cccguagauaagcgccacgucgg

SEQ ID NO: 1732043 - RNA, 17 nt, Salmonella enterica enterica serovar Typhi Ty2
cccggguaaugcugcag

SEQ ID NO: 1732044 - RNA, 16 nt, Salmonella enterica enterica serovar Typhi Ty2
cccguaucacugauau

SEQ ID NO: 1732045 - RNA, 23 nt, Salmonella enterica enterica serovar Typhi Ty2
cccgucaugcuucaccucagcaa

SEQ ID NO: 1732046 - RNA, 19 nt, Salmonella enterica enterica serovar Typhi Ty2
augccguccauccggcgua

SEQ ID NO: 1732047 - RNA, 16 nt, Salmonella enterica enterica serovar Typhi Ty2
augccguagcggccau

SEQ ID NO: 1732048 - RNA, 13 nt, Salmonella enterica enterica serovar Typhi Ty2
augccgccgccag

SEQ ID NO: 1732049 - RNA, 21 nt, Salmonella enterica enterica serovar Typhi Ty2
augccgcgucaggagcgggua

SEQ ID NO: 1732050 - RNA, 15 nt, Salmonella enterica enterica serovar Typhi Ty2
augccgaccagcguc

SEQ ID NO: 1732051 - RNA, 19 nt, Salmonella enterica enterica serovar Typhi Ty2
augcgaucguaaucacccg

SEQ ID NO: 1732052 - RNA, 13 nt, Salmonella enterica enterica serovar Typhi Ty2
augccuucgccgc

SEQ ID NO: 1732053 - RNA, 13 nt, Salmonella enterica enterica serovar Typhi Ty2
augccugcgcuuu

SEQ ID NO: 1732054 - RNA, 18 nt, Salmonella enterica enterica serovar Typhi Ty2
augcgcguagcccacagg

SEQ ID NO: 1732055 - RNA, 16 nt, Salmonella enterica enterica serovar Typhi Ty2
augcgcguaauuugcg

SEQ ID NO: 1732056 - RNA, 22 nt, Salmonella enterica enterica serovar Typhi Ty2
augcgcguuuagcgccagcagc

SEQ ID NO: 1732057 - RNA, 17 nt, Salmonella enterica enterica serovar Typhi Ty2
augcgcguuuagcgcca

SEQ ID NO: 1732058 - RNA, 16 nt, Salmonella enterica enterica serovar Typhi Ty2
augcgcguugccgcca

SEQ ID NO: 1732059 - RNA, 15 nt, Salmonella enterica enterica serovar Typhi Ty2
augcgcguugccgcc

SEQ ID NO: 1732060 - RNA, 21 nt, Salmonella enterica enterica serovar Typhi Ty2
augcggaaaccaguucacgcg

SEQ ID NO: 1732061 - RNA, 22 nt, Salmonella enterica enterica serovar Typhi Ty2
augcguuguccuauugcaacgc

SEQ ID NO: 1732062 - RNA, 17 nt, Salmonella enterica enterica serovar Typhi Ty2
augcguugucgcugauu

SEQ ID NO: 1732063 - RNA, 17 nt, Salmonella enterica enterica serovar Typhi Ty2
augcuauccgccgccag

SEQ ID NO: 1732064 - RNA, 16 nt, Salmonella enterica enterica serovar Typhi Ty2
augcuauaugcaggca

SEQ ID NO: 1732065 - RNA, 14 nt, Salmonella enterica enterica serovar Typhi Ty2
augcuaucgcggau

SEQ ID NO: 1732066 - RNA, 21 nt, Salmonella enterica enterica serovar Typhi Ty2
augcuauaccgcccgcgcuuu

SEQ ID NO: 1732067 - RNA, 20 nt, Salmonella enterica enterica serovar Typhi Ty2
augaggcgcagccgccaucc

SEQ ID NO: 1732068 - RNA, 16 nt, Salmonella enterica enterica serovar Typhi Ty2
augagaagggcaauau

SEQ ID NO: 1732069 - RNA, 16 nt, Salmonella enterica enterica serovar Typhi Ty2
augagauacgucauca

SEQ ID NO: 1732070 - RNA, 19 nt, Salmonella enterica enterica serovar Typhi Ty2
augaugcauuugauuuguu

SEQ ID NO: 1732071 - RNA, 19 nt, Salmonella enterica enterica serovar Typhi Ty2
augauuuaaaaaaggccgc

SEQ ID NO: 1732072 - RNA, 18 nt, Salmonella enterica enterica serovar Typhi Ty2
augaucguuuccagcauc

SEQ ID NO: 1732073 - RNA, 15 nt, Salmonella enterica enterica serovar Typhi Ty2
augaugagcgccaua

SEQ ID NO: 1732074 - RNA, 13 nt, Salmonella enterica enterica serovar Typhi Ty2
augaugagcgcca

SEQ ID NO: 1732075 - RNA, 14 nt, Salmonella enterica enterica serovar Typhi Ty2
aucugaugccugaa

SEQ ID NO: 1732076 - RNA, 20 nt, Salmonella enterica enterica serovar Typhi Ty2
aucugaugccugaaggcgcu

SEQ ID NO: 1732077 - RNA, 15 nt, Salmonella enterica enterica serovar Typhi Ty2
aucugccgucaucga

SEQ ID NO: 1732078 - RNA, 20 nt, Salmonella enterica enterica serovar Typhi Ty2
aucugccgcgcccgccaucg

SEQ ID NO: 1732079 - RNA, 15 nt, Salmonella enterica enterica serovar Typhi Ty2
augacggcaggggcg

SEQ ID NO: 1732080 - RNA, 16 nt, Salmonella enterica enterica serovar Typhi Ty2
aucugcgcauuaacgc

SEQ ID NO: 1732081 - RNA, 15 nt, Salmonella enterica enterica serovar Typhi Ty2
aucugcgcauuaacg

SEQ ID NO: 1732082 - RNA, 19 nt, Salmonella enterica enterica serovar Typhi Ty2
augcccggcauacgccggg

SEQ ID NO: 1732083 - RNA, 23 nt, Salmonella enterica enterica serovar Typhi Ty2
augcccagcgccgucauaccgcc

SEQ ID NO: 1732084 - RNA, 22 nt, Salmonella enterica enterica serovar Typhi Ty2
augcccaccgcgcgcgcggcau

SEQ ID NO: 1732085 - RNA, 20 nt, Salmonella enterica enterica serovar Typhi Ty2
augcccacaggcagggcgau

SEQ ID NO: 1732086 - RNA, 14 nt, Salmonella enterica enterica serovar Typhi Ty2
augccauuauugca

SEQ ID NO: 1732087 - RNA, 16 nt, Salmonella enterica enterica serovar Typhi Ty2
augcacaggcggcggu

SEQ ID NO: 1732088 - RNA, 20 nt, Salmonella enterica enterica serovar Typhi Ty2
augcaaaaaagcccauccgu

SEQ ID NO: 1732089 - RNA, 20 nt, Salmonella enterica enterica serovar Typhi Ty2
augcacgcuuuuuugcuggc

SEQ ID NO: 1732090 - RNA, 13 nt, Salmonella enterica enterica serovar Typhi Ty2
augcacgccacau

SEQ ID NO: 1732091 - RNA, 18 nt, Salmonella enterica enterica serovar Typhi Ty2
augcacgcgauuugcagc

SEQ ID NO: 1732092 - RNA, 18 nt, Salmonella enterica enterica serovar Typhi Ty2
auuaaucugucgaugcgg

SEQ ID NO: 1732093 - RNA, 14 nt, Salmonella enterica enterica serovar Typhi Ty2
auuaaucgccagca

SEQ ID NO: 1732094 - RNA, 23 nt, Salmonella enterica enterica serovar Typhi Ty2
auuaauaaccccagcugcggcau

SEQ ID NO: 1732095 - RNA, 16 nt, Salmonella enterica enterica serovar Typhi Ty2
auuaauuuacugauaa

SEQ ID NO: 1732096 - RNA, 12 nt, Salmonella enterica enterica serovar Typhi Ty2
auuaauggcgau

SEQ ID NO: 1732097 - RNA, 20 nt, Salmonella enterica enterica serovar Typhi Ty2
auuacgcccauuaugccgca

SEQ ID NO: 1732098 - RNA, 16 nt, Salmonella enterica enterica serovar Typhi Ty2
auuaccaguacggaaa

SEQ ID NO: 1732099 - RNA, 14 nt, Salmonella enterica enterica serovar Typhi Ty2
auguuuuaccagua

SEQ ID NO: 1732100 - RNA, 14 nt, Salmonella enterica enterica serovar Typhi Ty2
auguuuaccaucgc

SEQ ID NO: 1732101 - RNA, 17 nt, Salmonella enterica enterica serovar Typhi Ty2
auuaagccauauggcau

SEQ ID NO: 1732102 - RNA, 20 nt, Salmonella enterica enterica serovar Typhi Ty2
auuaaggaugaacucuaugc

SEQ ID NO: 1732103 - RNA, 23 nt, Salmonella enterica enterica serovar Typhi Ty2
auuaacgcggugacuuuggccgg

SEQ ID NO: 1732104 - RNA, 12 nt, Salmonella enterica enterica serovar Typhi Ty2
auuaacgcgaaa

SEQ ID NO: 1732105 - RNA, 19 nt, Salmonella enterica enterica serovar Typhi Ty2
auuaacgucacgauggcga

SEQ ID NO: 1732106 - RNA, 18 nt, Salmonella enterica enterica serovar Typhi Ty2
auuaacccacaugccggu

SEQ ID NO: 1732107 - RNA, 20 nt, Salmonella enterica enterica serovar Typhi Ty2
auuagcgaggaacgcgcaga

SEQ ID NO: 1732108 - RNA, 20 nt, Salmonella enterica enterica serovar Typhi Ty2
auuagcguuuuuaccggcuc

SEQ ID NO: 1732109 - RNA, 19 nt, Salmonella enterica enterica serovar Typhi Ty2
auuacggcgaaugcgguaa

SEQ ID NO: 1732110 - RNA, 11 nt, Salmonella enterica enterica serovar Typhi Ty2
auuacgcgccu

SEQ ID NO: 1732111 - RNA, 21 nt, Salmonella enterica enterica serovar Typhi Ty2
auuccaguccuuucgacgcau

SEQ ID NO: 1732112 - RNA, 15 nt, Salmonella enterica enterica serovar Typhi Ty2
auuccaucggcaucg

SEQ ID NO: 1732113 - RNA, 19 nt, Salmonella enterica enterica serovar Typhi Ty2
auuccaguagcgcgcccau

SEQ ID NO: 1732114 - RNA, 14 nt, Salmonella enterica enterica serovar Typhi Ty2
auuaucgcuccgga

SEQ ID NO: 1732115 - RNA, 18 nt, Salmonella enterica enterica serovar Typhi Ty2
auucaaccaaugcaacgc

SEQ ID NO: 1732116 - RNA, 21 nt, Salmonella enterica enterica serovar Typhi Ty2
auggcggcgucgccuguccgg

SEQ ID NO: 1732117 - RNA, 19 nt, Salmonella enterica enterica serovar Typhi Ty2
auggcggauuccaguagcg

SEQ ID NO: 1732118 - RNA, 16 nt, Salmonella enterica enterica serovar Typhi Ty2
auggcgcuuaauacgc

SEQ ID NO: 1732119 - RNA, 21 nt, Salmonella enterica enterica serovar Typhi Ty2
auggcgcgaagugccagguuu

SEQ ID NO: 1732120 - RNA, 19 nt, Salmonella enterica enterica serovar Typhi Ty2
auggcggcuaacgccugau

SEQ ID NO: 1732121 - RNA, 23 nt, Salmonella enterica enterica serovar Typhi Ty2
auggcggcgaaaugccuuauccg

SEQ ID NO: 1732122 - RNA, 19 nt, Salmonella enterica enterica serovar Typhi Ty2
auggcggucaacgcggcua

SEQ ID NO: 1732123 - RNA, 24 nt, Salmonella enterica enterica serovar Typhi Ty2
auggcggcgaaaugccuuauccgg

SEQ ID NO: 1732124 - RNA, 14 nt, Salmonella enterica enterica serovar Typhi Ty2
auggcguagcgcca

SEQ ID NO: 1732125 - RNA, 17 nt, Salmonella enterica enterica serovar Typhi Ty2
auggcgucggcgacuuu

SEQ ID NO: 1732126 - RNA, 14 nt, Salmonella enterica enterica serovar Typhi Ty2
auggcgauuaacgc

SEQ ID NO: 1732127 - RNA, 18 nt, Salmonella enterica enterica serovar Typhi Ty2
auggcgcagcauacgcug

SEQ ID NO: 1732128 - RNA, 18 nt, Salmonella enterica enterica serovar Typhi Ty2
auguccauccauugcgcc

SEQ ID NO: 1732129 - RNA, 17 nt, Salmonella enterica enterica serovar Typhi Ty2
auggucucaaucgcaaa

SEQ ID NO: 1732130 - RNA, 15 nt, Salmonella enterica enterica serovar Typhi Ty2
aucgcgucgccauca

SEQ ID NO: 1732131 - RNA, 14 nt, Salmonella enterica enterica serovar Typhi Ty2
aucgcuuccagcgc

SEQ ID NO: 1732132 - RNA, 16 nt, Salmonella enterica enterica serovar Typhi Ty2
aucgcuugguauggcg

SEQ ID NO: 1732133 - RNA, 21 nt, Salmonella enterica enterica serovar Typhi Ty2
aucgcgauaucaacccaguuu

SEQ ID NO: 1732134 - RNA, 15 nt, Salmonella enterica enterica serovar Typhi Ty2
aucgcgguaacgccu

SEQ ID NO: 1732135 - RNA, 16 nt, Salmonella enterica enterica serovar Typhi Ty2
aucgccugauggcgac

SEQ ID NO: 1732136 - RNA, 17 nt, Salmonella enterica enterica serovar Typhi Ty2
aucgccgaaagcgauca

SEQ ID NO: 1732137 - RNA, 20 nt, Salmonella enterica enterica serovar Typhi Ty2
aucgcagagcguaauuccgc

SEQ ID NO: 1732138 - RNA, 17 nt, Salmonella enterica enterica serovar Typhi Ty2
aucgcagacauggcaau

SEQ ID NO: 1732139 - RNA, 14 nt, Salmonella enterica enterica serovar Typhi Ty2
aucgccauccugca

SEQ ID NO: 1732140 - RNA, 18 nt, Salmonella enterica enterica serovar Typhi Ty2
aucgccaucauagcccau

SEQ ID NO: 1732141 - RNA, 19 nt, Salmonella enterica enterica serovar Typhi Ty2
aucgauauaucgcgucauc

SEQ ID NO: 1732142 - RNA, 14 nt, Salmonella enterica enterica serovar Typhi Ty2
aucgauauaucgcg

SEQ ID NO: 1732143 - RNA, 16 nt, Salmonella enterica enterica serovar Typhi Ty2
aucgauaguggcgauc

SEQ ID NO: 1732144 - RNA, 21 nt, Salmonella enterica enterica serovar Typhi Ty2
aucgauggcagucgcaucaug

SEQ ID NO: 1732145 - RNA, 14 nt, Salmonella enterica enterica serovar Typhi Ty2
aucgcaaacgccag

SEQ ID NO: 1732146 - RNA, 20 nt, Salmonella enterica enterica serovar Typhi Ty2
aucgguaaaggucgccgcau

SEQ ID NO: 1732147 - RNA, 18 nt, Salmonella enterica enterica serovar Typhi Ty2
aucgguaagccgaaacca

SEQ ID NO: 1732148 - RNA, 17 nt, Salmonella enterica enterica serovar Typhi Ty2
aucgggcuuccagcguu

SEQ ID NO: 1732149 - RNA, 14 nt, Salmonella enterica enterica serovar Typhi Ty2
aucgguuucgcggc

SEQ ID NO: 1732150 - RNA, 20 nt, Salmonella enterica enterica serovar Typhi Ty2
aucgguuugagcaccacgcg

SEQ ID NO: 1732151 - RNA, 14 nt, Salmonella enterica enterica serovar Typhi Ty2
aucguaagccaccg

SEQ ID NO: 1732152 - RNA, 16 nt, Salmonella enterica enterica serovar Typhi Ty2
aucgggaaucaucgag

SEQ ID NO: 1732153 - RNA, 18 nt, Salmonella enterica enterica serovar Typhi Ty2
aucggccagcgaaaacca

SEQ ID NO: 1732154 - RNA, 20 nt, Salmonella enterica enterica serovar Typhi Ty2
aucgggcgggcauuauacgc

SEQ ID NO: 1732155 - RNA, 22 nt, Salmonella enterica enterica serovar Typhi Ty2
aucggacgguuuugcgccaucc

SEQ ID NO: 1732156 - RNA, 17 nt, Salmonella enterica enterica serovar Typhi Ty2
aucggcaugauggcgaa

SEQ ID NO: 1732157 - RNA, 14 nt, Salmonella enterica enterica serovar Typhi Ty2
aucucuuuauugcu

SEQ ID NO: 1732158 - RNA, 14 nt, Salmonella enterica enterica serovar Typhi Ty2
aucucuuccagcgu

SEQ ID NO: 1732159 - RNA, 13 nt, Salmonella enterica enterica serovar Typhi Ty2
aucucuucaaaca

SEQ ID NO: 1732160 - RNA, 22 nt, Salmonella enterica enterica serovar Typhi Ty2
aucucguuuuacgccuucggcg

SEQ ID NO: 1732161 - RNA, 18 nt, Salmonella enterica enterica serovar Typhi Ty2
aucguuauccagcagcca

SEQ ID NO: 1732162 - RNA, 21 nt, Salmonella enterica enterica serovar Typhi Ty2
aucguuaucauuaucgccaaa

SEQ ID NO: 1732163 - RNA, 16 nt, Salmonella enterica enterica serovar Typhi Ty2
aucucacgcauggcgu

SEQ ID NO: 1732164 - RNA, 19 nt, Salmonella enterica enterica serovar Typhi Ty2
aucgucgcgguugccguca

SEQ ID NO: 1732165 - RNA, 20 nt, Salmonella enterica enterica serovar Typhi Ty2
aucgucgcgguugccgucaa

SEQ ID NO: 1732166 - RNA, 22 nt, Salmonella enterica enterica serovar Typhi Ty2
aucgucggacaacguaccggca

SEQ ID NO: 1732167 - RNA, 15 nt, Salmonella enterica enterica serovar Typhi Ty2
aucgucgggauaagc

SEQ ID NO: 1732168 - RNA, 13 nt, Salmonella enterica enterica serovar Typhi Ty2
aucguaugcgccu

SEQ ID NO: 1732169 - RNA, 16 nt, Salmonella enterica enterica serovar Typhi Ty2
aucguccggcaucgug

SEQ ID NO: 1732170 - RNA, 19 nt, Salmonella enterica enterica serovar Typhi Ty2
aucaucaucggcacagcca

SEQ ID NO: 1732171 - RNA, 14 nt, Salmonella enterica enterica serovar Typhi Ty2
aucauccccggcag

SEQ ID NO: 1732172 - RNA, 13 nt, Salmonella enterica enterica serovar Typhi Ty2
aucaucgcuauca

SEQ ID NO: 1732173 - RNA, 16 nt, Salmonella enterica enterica serovar Typhi Ty2
aucaucggcacagcca

SEQ ID NO: 1732174 - RNA, 19 nt, Salmonella enterica enterica serovar Typhi Ty2
aucaucucccaggccgcca

SEQ ID NO: 1732175 - RNA, 12 nt, Salmonella enterica enterica serovar Typhi Ty2
aucaucuauaga

SEQ ID NO: 1732176 - RNA, 12 nt, Salmonella enterica enterica serovar Typhi Ty2
aucaucuauagu

SEQ ID NO: 1732177 - RNA, 20 nt, Salmonella enterica enterica serovar Typhi Ty2
aucaucgucauuaaugccua

SEQ ID NO: 1732178 - RNA, 20 nt, Salmonella enterica enterica serovar Typhi Ty2
aucaugaacguuaucggcau

SEQ ID NO: 1732179 - RNA, 18 nt, Salmonella enterica enterica serovar Typhi Ty2
aucaugauguucauccau

SEQ ID NO: 1732180 - RNA, 13 nt, Salmonella enterica enterica serovar Typhi Ty2
aucaugcccggca

SEQ ID NO: 1732181 - RNA, 21 nt, Salmonella enterica enterica serovar Typhi Ty2
aucaugcguccgcccagaaag

SEQ ID NO: 1732182 - RNA, 18 nt, Salmonella enterica enterica serovar Typhi Ty2
aucaugcccacaggcagg

SEQ ID NO: 1732183 - RNA, 14 nt, Salmonella enterica enterica serovar Typhi Ty2
aucauugcgccaag

SEQ ID NO: 1732184 - RNA, 15 nt, Salmonella enterica enterica serovar Typhi Ty2
aucauugcgccaaga

SEQ ID NO: 1732185 - RNA, 19 nt, Salmonella enterica enterica serovar Typhi Ty2
aucauugcguucaggcggc

SEQ ID NO: 1732186 - RNA, 21 nt, Salmonella enterica enterica serovar Typhi Ty2
aucauuuggaggccggauaag

SEQ ID NO: 1732187 - RNA, 14 nt, Salmonella enterica enterica serovar Typhi Ty2
aucauucgcgucau

SEQ ID NO: 1732188 - RNA, 16 nt, Salmonella enterica enterica serovar Typhi Ty2
aucauucuaaggccgc

SEQ ID NO: 1732189 - RNA, 22 nt, Salmonella enterica enterica serovar Typhi Ty2
aucauggcucagauugaacgcu

SEQ ID NO: 1732190 - RNA, 17 nt, Salmonella enterica enterica serovar Typhi Ty2
auccacagguuaucgcc

SEQ ID NO: 1732191 - RNA, 18 nt, Salmonella enterica enterica serovar Typhi Ty2
auccacagguuaucgccg

SEQ ID NO: 1732192 - RNA, 13 nt, Salmonella enterica enterica serovar Typhi Ty2
auccacagcgcca

SEQ ID NO: 1732193 - RNA, 15 nt, Salmonella enterica enterica serovar Typhi Ty2
auccacgccuggcag

SEQ ID NO: 1732194 - RNA, 14 nt, Salmonella enterica enterica serovar Typhi Ty2
auccaccuuauccu

SEQ ID NO: 1732195 - RNA, 18 nt, Salmonella enterica enterica serovar Typhi Ty2
auccacccgguuuaccau

SEQ ID NO: 1732196 - RNA, 16 nt, Salmonella enterica enterica serovar Typhi Ty2
aucaguuuaaccguuc

SEQ ID NO: 1732197 - RNA, 12 nt, Salmonella enterica enterica serovar Typhi Ty2
aucauaccgcgu

SEQ ID NO: 1732198 - RNA, 22 nt, Salmonella enterica enterica serovar Typhi Ty2
aucauaagggagcugacugcaa

SEQ ID NO: 1732199 - RNA, 20 nt, Salmonella enterica enterica serovar Typhi Ty2
aucauaguuuuuccccauca

SEQ ID NO: 1732200 - RNA, 21 nt, Salmonella enterica enterica serovar Typhi Ty2
aucaggggcgaacccaucagg

SEQ ID NO: 1732201 - RNA, 14 nt, Salmonella enterica enterica serovar Typhi Ty2
aucagucgcagcgg

SEQ ID NO: 1732202 - RNA, 14 nt, Salmonella enterica enterica serovar Typhi Ty2
aucaguaacacaau

SEQ ID NO: 1732203 - RNA, 21 nt, Salmonella enterica enterica serovar Typhi Ty2
aucaggccugugguaugugcc

SEQ ID NO: 1732204 - RNA, 13 nt, Salmonella enterica enterica serovar Typhi Ty2
aucaggccugcaa

SEQ ID NO: 1732205 - RNA, 12 nt, Salmonella enterica enterica serovar Typhi Ty2
aucaggcguaga

SEQ ID NO: 1732206 - RNA, 16 nt, Salmonella enterica enterica serovar Typhi Ty2
aucaggccugccugau

SEQ ID NO: 1732207 - RNA, 17 nt, Salmonella enterica enterica serovar Typhi Ty2
aucaggcguugaccgcu

SEQ ID NO: 1732208 - RNA, 19 nt, Salmonella enterica enterica serovar Typhi Ty2
aucaggcuuugcgccaucg

SEQ ID NO: 1732209 - RNA, 21 nt, Salmonella enterica enterica serovar Typhi Ty2
aucaggcaaaaaucgucauca

SEQ ID NO: 1732210 - RNA, 19 nt, Salmonella enterica enterica serovar Typhi Ty2
aucaggcaucugaaaugcu

SEQ ID NO: 1732211 - RNA, 20 nt, Salmonella enterica enterica serovar Typhi Ty2
aucaggccgacaaaugacgu

SEQ ID NO: 1732212 - RNA, 19 nt, Salmonella enterica enterica serovar Typhi Ty2
aucaggccauuaacgccgc

SEQ ID NO: 1732213 - RNA, 16 nt, Salmonella enterica enterica serovar Typhi Ty2
aucagcuuugcggcca

SEQ ID NO: 1732214 - RNA, 21 nt, Salmonella enterica enterica serovar Typhi Ty2
aucaggaaagagccgcgcagc

SEQ ID NO: 1732215 - RNA, 21 nt, Salmonella enterica enterica serovar Typhi Ty2
auauugcccaucgcgccauga

SEQ ID NO: 1732216 - RNA, 15 nt, Salmonella enterica enterica serovar Typhi Ty2
auauugccgccauua

SEQ ID NO: 1732217 - RNA, 18 nt, Salmonella enterica enterica serovar Typhi Ty2
aucccgccgcauccuuau

SEQ ID NO: 1732218 - RNA, 20 nt, Salmonella enterica enterica serovar Typhi Ty2
aucccgacucugacgccggu

SEQ ID NO: 1732219 - RNA, 18 nt, Salmonella enterica enterica serovar Typhi Ty2
aucccgaacaugccgccg

SEQ ID NO: 1732220 - RNA, 17 nt, Salmonella enterica enterica serovar Typhi Ty2
auccccguuuucgccgg

SEQ ID NO: 1732221 - RNA, 22 nt, Salmonella enterica enterica serovar Typhi Ty2
auccccgccgagaaaauaccgc

SEQ ID NO: 1732222 - RNA, 12 nt, Salmonella enterica enterica serovar Typhi Ty2
aucccguagcgu

SEQ ID NO: 1732223 - RNA, 19 nt, Salmonella enterica enterica serovar Typhi Ty2
auccgcgccggguuuggcg

SEQ ID NO: 1732224 - RNA, 23 nt, Salmonella enterica enterica serovar Typhi Ty2
auccguacauaacagcagcagac

SEQ ID NO: 1732225 - RNA, 17 nt, Salmonella enterica enterica serovar Typhi Ty2
auccggccugcggugua

SEQ ID NO: 1732226 - RNA, 11 nt, Salmonella enterica enterica serovar Typhi Ty2
auccggcauuu

SEQ ID NO: 1732227 - RNA, 19 nt, Salmonella enterica enterica serovar Typhi Ty2
auccagcgcucaaucagcg

SEQ ID NO: 1732228 - RNA, 17 nt, Salmonella enterica enterica serovar Typhi Ty2
auccagcgauugacggu

SEQ ID NO: 1732229 - RNA, 18 nt, Salmonella enterica enterica serovar Typhi Ty2
auccagcguagcggugua

SEQ ID NO: 1732230 - RNA, 17 nt, Salmonella enterica enterica serovar Typhi Ty2
auccagcgucgccagca

SEQ ID NO: 1732231 - RNA, 23 nt, Salmonella enterica enterica serovar Typhi Ty2
auccagaaccguugcgcccauca

SEQ ID NO: 1732232 - RNA, 18 nt, Salmonella enterica enterica serovar Typhi Ty2
auccacugagcgcgccau

SEQ ID NO: 1732233 - RNA, 19 nt, Salmonella enterica enterica serovar Typhi Ty2
auccacuccguguugcugc

SEQ ID NO: 1732234 - RNA, 23 nt, Salmonella enterica enterica serovar Typhi Ty2
auccagaucggcaugauggcgaa

SEQ ID NO: 1732235 - RNA, 20 nt, Salmonella enterica enterica serovar Typhi Ty2
auccaugccggcuuuccgca

SEQ ID NO: 1732236 - RNA, 18 nt, Salmonella enterica enterica serovar Typhi Ty2
auccaguauuuuuaucgu

SEQ ID NO: 1732237 - RNA, 16 nt, Salmonella enterica enterica serovar Typhi Ty2
auccccaccgcugaug

SEQ ID NO: 1732238 - RNA, 17 nt, Salmonella enterica enterica serovar Typhi Ty2
auccccagucuuccugc

SEQ ID NO: 1732239 - RNA, 20 nt, Salmonella enterica enterica serovar Typhi Ty2
auccccccuuuuuugcuggc

SEQ ID NO: 1732240 - RNA, 19 nt, Salmonella enterica enterica serovar Typhi Ty2
auccccccuuuuuugcugg

SEQ ID NO: 1732241 - RNA, 18 nt, Salmonella enterica enterica serovar Typhi Ty2
auccccgaaagccgguaa

SEQ ID NO: 1732242 - RNA, 15 nt, Salmonella enterica enterica serovar Typhi Ty2
aucccaccggaaaug

SEQ ID NO: 1732243 - RNA, 16 nt, Salmonella enterica enterica serovar Typhi Ty2
aucccagggcggcguc

SEQ ID NO: 1732244 - RNA, 14 nt, Salmonella enterica enterica serovar Typhi Ty2
aucccaauaccggc

SEQ ID NO: 1732245 - RNA, 19 nt, Salmonella enterica enterica serovar Typhi Ty2
auuuauccacgccgcuauc

SEQ ID NO: 1732246 - RNA, 13 nt, Salmonella enterica enterica serovar Typhi Ty2
auucccagcgccc

SEQ ID NO: 1732247 - RNA, 21 nt, Salmonella enterica enterica serovar Typhi Ty2
auucccccauccgcgccggac

SEQ ID NO: 1732248 - RNA, 14 nt, Salmonella enterica enterica serovar Typhi Ty2
auucccgccgcaau

SEQ ID NO: 1732249 - RNA, 14 nt, Salmonella enterica enterica serovar Typhi Ty2
auuucauucagacc

SEQ ID NO: 1732250 - RNA, 21 nt, Salmonella enterica enterica serovar Typhi Ty2
auuucagugaaucgacggcaa

SEQ ID NO: 1732251 - RNA, 23 nt, Salmonella enterica enterica serovar Typhi Ty2
auuucacuggccguuuucccggc

SEQ ID NO: 1732252 - RNA, 18 nt, Salmonella enterica enterica serovar Typhi Ty2
auuucacgucacguucau

SEQ ID NO: 1732253 - RNA, 22 nt, Salmonella enterica enterica serovar Typhi Ty2
auuucacuggccguuuucccgg

SEQ ID NO: 1732254 - RNA, 16 nt, Salmonella enterica enterica serovar Typhi Ty2
auuuccgcuucgcggg

SEQ ID NO: 1732255 - RNA, 17 nt, Salmonella enterica enterica serovar Typhi Ty2
auuuccgcgcaaucgcc

SEQ ID NO: 1732256 - RNA, 14 nt, Salmonella enterica enterica serovar Typhi Ty2
auuuccgccgccag

SEQ ID NO: 1732257 - RNA, 16 nt, Salmonella enterica enterica serovar Typhi Ty2
auuuccgcgcaaucgc

SEQ ID NO: 1732258 - RNA, 18 nt, Salmonella enterica enterica serovar Typhi Ty2
auuuccgcagccagaauc

SEQ ID NO: 1732259 - RNA, 16 nt, Salmonella enterica enterica serovar Typhi Ty2
auuuaugccgccaucc

SEQ ID NO: 1732260 - RNA, 13 nt, Salmonella enterica enterica serovar Typhi Ty2
auuuaugccgcca

SEQ ID NO: 1732261 - RNA, 13 nt, Salmonella enterica enterica serovar Typhi Ty2
auuuauuaacccu

SEQ ID NO: 1732262 - RNA, 21 nt, Salmonella enterica enterica serovar Typhi Ty2
auuucaccgggccaaugccgc

SEQ ID NO: 1732263 - RNA, 21 nt, Salmonella enterica enterica serovar Typhi Ty2
auuuauuuucugaacgcugcu

SEQ ID NO: 1732264 - RNA, 13 nt, Salmonella enterica enterica serovar Typhi Ty2
auuucggcaauga

SEQ ID NO: 1732265 - RNA, 14 nt, Salmonella enterica enterica serovar Typhi Ty2
auuucgucaucgcu

SEQ ID NO: 1732266 - RNA, 17 nt, Salmonella enterica enterica serovar Typhi Ty2
auuucgaugaugaccga

SEQ ID NO: 1732267 - RNA, 22 nt, Salmonella enterica enterica serovar Typhi Ty2
auuucgaucuguuuaaguacgc

SEQ ID NO: 1732268 - RNA, 13 nt, Salmonella enterica enterica serovar Typhi Ty2
auuucgaucggcc

SEQ ID NO: 1732269 - RNA, 23 nt, Salmonella enterica enterica serovar Typhi Ty2
auuucgcgucagggcaaggcggc

SEQ ID NO: 1732270 - RNA, 20 nt, Salmonella enterica enterica serovar Typhi Ty2
auuuccuguguuacgccaau

SEQ ID NO: 1732271 - RNA, 19 nt, Salmonella enterica enterica serovar Typhi Ty2
auuucuuugguuucgcggu

SEQ ID NO: 1732272 - RNA, 17 nt, Salmonella enterica enterica serovar Typhi Ty2
auuucuugcaauagcgc

SEQ ID NO: 1732273 - RNA, 14 nt, Salmonella enterica enterica serovar Typhi Ty2
auuucuuccagcac

SEQ ID NO: 1732274 - RNA, 13 nt, Salmonella enterica enterica serovar Typhi Ty2
auuucugcugcca

SEQ ID NO: 1732275 - RNA, 15 nt, Salmonella enterica enterica serovar Typhi Ty2
auuucuccugcgcca

SEQ ID NO: 1732276 - RNA, 22 nt, Salmonella enterica enterica serovar Typhi Ty2
auuucuccugcgccagccggau

SEQ ID NO: 1732277 - RNA, 15 nt, Salmonella enterica enterica serovar Typhi Ty2
auuuguuucaucgcc

SEQ ID NO: 1732278 - RNA, 18 nt, Salmonella enterica enterica serovar Typhi Ty2
auuugugcugguggugcc

SEQ ID NO: 1732279 - RNA, 19 nt, Salmonella enterica enterica serovar Typhi Ty2
auuuguagcugcgccugaa

SEQ ID NO: 1732280 - RNA, 17 nt, Salmonella enterica enterica serovar Typhi Ty2
auuugcgucguuaacug

SEQ ID NO: 1732281 - RNA, 16 nt, Salmonella enterica enterica serovar Typhi Ty2
auuugcgugucaucaa

SEQ ID NO: 1732282 - RNA, 17 nt, Salmonella enterica enterica serovar Typhi Ty2
auuugcgcauccaccgc

SEQ ID NO: 1732283 - RNA, 14 nt, Salmonella enterica enterica serovar Typhi Ty2
auuuucaguuuuac

SEQ ID NO: 1732284 - RNA, 16 nt, Salmonella enterica enterica serovar Typhi Ty2
auuuuccaggccgcca

SEQ ID NO: 1732285 - RNA, 15 nt, Salmonella enterica enterica serovar Typhi Ty2
auuuuccccagaauc

SEQ ID NO: 1732286 - RNA, 13 nt, Salmonella enterica enterica serovar Typhi Ty2
auuuuagcgcauc

SEQ ID NO: 1732287 - RNA, 16 nt, Salmonella enterica enterica serovar Typhi Ty2
auuuuuauauuccgca

SEQ ID NO: 1732288 - RNA, 21 nt, Salmonella enterica enterica serovar Typhi Ty2
auuuuggggaaaauaccggua

SEQ ID NO: 1732289 - RNA, 15 nt, Salmonella enterica enterica serovar Typhi Ty2
caaaaauuugcgcga

SEQ ID NO: 1732290 - RNA, 12 nt, Salmonella enterica enterica serovar Typhi Ty2
auuuuucacaug

SEQ ID NO: 1732291 - RNA, 18 nt, Salmonella enterica enterica serovar Typhi Ty2
auuuuucccuggccggaa

SEQ ID NO: 1732292 - RNA, 22 nt, Salmonella enterica enterica serovar Typhi Ty2
caaaaaaaaucccgccagcggc

SEQ ID NO: 1732293 - RNA, 14 nt, Salmonella enterica enterica serovar Typhi Ty2
caaacgcgacaacg

SEQ ID NO: 1732294 - RNA, 11 nt, Salmonella enterica enterica serovar Typhi Ty2
caaacgcuggc

SEQ ID NO: 1732295 - RNA, 14 nt, Salmonella enterica enterica serovar Typhi Ty2
caaaccaaacugau

SEQ ID NO: 1732296 - RNA, 22 nt, Salmonella enterica enterica serovar Typhi Ty2
caaacauccccgcuugcagcgu

SEQ ID NO: 1732297 - RNA, 15 nt, Salmonella enterica enterica serovar Typhi Ty2
caaagcagcugcugg

SEQ ID NO: 1732298 - RNA, 13 nt, Salmonella enterica enterica serovar Typhi Ty2
caaagccaggccg

SEQ ID NO: 1732299 - RNA, 17 nt, Salmonella enterica enterica serovar Typhi Ty2
caaagcccaucagcgcc

SEQ ID NO: 1732300 - RNA, 16 nt, Salmonella enterica enterica serovar Typhi Ty2
caaacggaauagcgcc

SEQ ID NO: 1732301 - RNA, 19 nt, Salmonella enterica enterica serovar Typhi Ty2
caaagcaauaccacgcccg

SEQ ID NO: 1732302 - RNA, 17 nt, Salmonella enterica enterica serovar Typhi Ty2
caaaaggauacagcgcc

SEQ ID NO: 1732303 - RNA, 19 nt, Salmonella enterica enterica serovar Typhi Ty2
caaaaucgcccaggccuga

SEQ ID NO: 1732304 - RNA, 16 nt, Salmonella enterica enterica serovar Typhi Ty2
caaaauccuuguugau

SEQ ID NO: 1732305 - RNA, 21 nt, Salmonella enterica enterica serovar Typhi Ty2
caaacacuaccgggcagcauc

SEQ ID NO: 1732306 - RNA, 21 nt, Salmonella enterica enterica serovar Typhi Ty2
caagcauaaaccggcggccua

SEQ ID NO: 1732307 - RNA, 22 nt, Salmonella enterica enterica serovar Typhi Ty2
caagcauaaaaaacaucaugcc

SEQ ID NO: 1732308 - RNA, 15 nt, Salmonella enterica enterica serovar Typhi Ty2
caagccauugcgcgc

SEQ ID NO: 1732309 - RNA, 16 nt, Salmonella enterica enterica serovar Typhi Ty2
caagccagcauacagc

SEQ ID NO: 1732310 - RNA, 18 nt, Salmonella enterica enterica serovar Typhi Ty2
caagcaccuuauccggcc

SEQ ID NO: 1732311 - RNA, 20 nt, Salmonella enterica enterica serovar Typhi Ty2
caagcaccuuauccggccua

SEQ ID NO: 1732312 - RNA, 18 nt, Salmonella enterica enterica serovar Typhi Ty2
caaggcaucgucggcgau

SEQ ID NO: 1732313 - RNA, 20 nt, Salmonella enterica enterica serovar Typhi Ty2
caagcgcggcgaaauaggcc

SEQ ID NO: 1732314 - RNA, 18 nt, Salmonella enterica enterica serovar Typhi Ty2
caagcggcaucucgccaa

SEQ ID NO: 1732315 - RNA, 22 nt, Salmonella enterica enterica serovar Typhi Ty2
caagccgaacucuuccaccacg

SEQ ID NO: 1732316 - RNA, 21 nt, Salmonella enterica enterica serovar Typhi Ty2
caacucuuuacccagcgggug

SEQ ID NO: 1732317 - RNA, 20 nt, Salmonella enterica enterica serovar Typhi Ty2
caacucugugcguucgcgaa

SEQ ID NO: 1732318 - RNA, 19 nt, Salmonella enterica enterica serovar Typhi Ty2
caacucugugcguucgcga

SEQ ID NO: 1732319 - RNA, 19 nt, Salmonella enterica enterica serovar Typhi Ty2
caacguaaucaucaugcug

SEQ ID NO: 1732320 - RNA, 15 nt, Salmonella enterica enterica serovar Typhi Ty2
caacuggcgccggag

SEQ ID NO: 1732321 - RNA, 12 nt, Salmonella enterica enterica serovar Typhi Ty2
caacuuccacca

SEQ ID NO: 1732322 - RNA, 19 nt, Salmonella enterica enterica serovar Typhi Ty2
caacuuguuuccuguucgg

SEQ ID NO: 1732323 - RNA, 20 nt, Salmonella enterica enterica serovar Typhi Ty2
caagacacagcgucgcgcga

SEQ ID NO: 1732324 - RNA, 22 nt, Salmonella enterica enterica serovar Typhi Ty2
caagagaugcagacaauuuccg

SEQ ID NO: 1732325 - RNA, 13 nt, Salmonella enterica enterica serovar Typhi Ty2
caagaaguuccgc

SEQ ID NO: 1732326 - RNA, 23 nt, Salmonella enterica enterica serovar Typhi Ty2
caacuuguuuccuguucggggaa

SEQ ID NO: 1732327 - RNA, 21 nt, Salmonella enterica enterica serovar Typhi Ty2
caacaucagcgcuaccagcgc

SEQ ID NO: 1732328 - RNA, 14 nt, Salmonella enterica enterica serovar Typhi Ty2
caaccacggauaag

SEQ ID NO: 1732329 - RNA, 18 nt, Salmonella enterica enterica serovar Typhi Ty2
caaccacggauaagccag

SEQ ID NO: 1732330 - RNA, 16 nt, Salmonella enterica enterica serovar Typhi Ty2
caacaggaggaucgcc

SEQ ID NO: 1732331 - RNA, 17 nt, Salmonella enterica enterica serovar Typhi Ty2
caacauacgccgccagc

SEQ ID NO: 1732332 - RNA, 21 nt, Salmonella enterica enterica serovar Typhi Ty2
caaauaagguggcuaacccgc

SEQ ID NO: 1732333 - RNA, 22 nt, Salmonella enterica enterica serovar Typhi Ty2
caaaguggguauauuugccgaa

SEQ ID NO: 1732334 - RNA, 21 nt, Salmonella enterica enterica serovar Typhi Ty2
caacagcgaccacgccaccgc

SEQ ID NO: 1732335 - RNA, 16 nt, Salmonella enterica enterica serovar Typhi Ty2
caacagcucgccaugc

SEQ ID NO: 1732336 - RNA, 15 nt, Salmonella enterica enterica serovar Typhi Ty2
caacagcucgccaug

SEQ ID NO: 1732337 - RNA, 17 nt, Salmonella enterica enterica serovar Typhi Ty2
caacgaccagugaacgu

SEQ ID NO: 1732338 - RNA, 18 nt, Salmonella enterica enterica serovar Typhi Ty2
caacgccgcuuuaccgcc

SEQ ID NO: 1732339 - RNA, 11 nt, Salmonella enterica enterica serovar Typhi Ty2
caacgccgcac

SEQ ID NO: 1732340 - RNA, 14 nt, Salmonella enterica enterica serovar Typhi Ty2
caacgccuccaggc

SEQ ID NO: 1732341 - RNA, 18 nt, Salmonella enterica enterica serovar Typhi Ty2
caacgccguacuccagcc

SEQ ID NO: 1732342 - RNA, 17 nt, Salmonella enterica enterica serovar Typhi Ty2
caacgcgcaucaacgcc

SEQ ID NO: 1732343 - RNA, 21 nt, Salmonella enterica enterica serovar Typhi Ty2
caccgccgcgagagucgccag

SEQ ID NO: 1732344 - RNA, 20 nt, Salmonella enterica enterica serovar Typhi Ty2
cacccgaacaacaauacgcg

SEQ ID NO: 1732345 - RNA, 15 nt, Salmonella enterica enterica serovar Typhi Ty2
caccauguugcgcag

SEQ ID NO: 1732346 - RNA, 23 nt, Salmonella enterica enterica serovar Typhi Ty2
caccaucacuaccauuuccggcg

SEQ ID NO: 1732347 - RNA, 14 nt, Salmonella enterica enterica serovar Typhi Ty2
caccaucgccggag

SEQ ID NO: 1732348 - RNA, 18 nt, Salmonella enterica enterica serovar Typhi Ty2
caccagucgaccgcagac

SEQ ID NO: 1732349 - RNA, 19 nt, Salmonella enterica enterica serovar Typhi Ty2
caauggccgcagcgccaua

SEQ ID NO: 1732350 - RNA, 17 nt, Salmonella enterica enterica serovar Typhi Ty2
caauuccuaucaguacg

SEQ ID NO: 1732351 - RNA, 21 nt, Salmonella enterica enterica serovar Typhi Ty2
caaugacgcuucguuccgcga

SEQ ID NO: 1732352 - RNA, 16 nt, Salmonella enterica enterica serovar Typhi Ty2
cacagacagaugcagg

SEQ ID NO: 1732353 - RNA, 20 nt, Salmonella enterica enterica serovar Typhi Ty2
cacagagaucgugcauccgg

SEQ ID NO: 1732354 - RNA, 15 nt, Salmonella enterica enterica serovar Typhi Ty2
cacagaaucgcugug

SEQ ID NO: 1732355 - RNA, 20 nt, Salmonella enterica enterica serovar Typhi Ty2
cacagccaucuucugcguca

SEQ ID NO: 1732356 - RNA, 16 nt, Salmonella enterica enterica serovar Typhi Ty2
cacaccauuucacaaa

SEQ ID NO: 1732357 - RNA, 18 nt, Salmonella enterica enterica serovar Typhi Ty2
cacaccacgugcggacgu

SEQ ID NO: 1732358 - RNA, 22 nt, Salmonella enterica enterica serovar Typhi Ty2
cacaaacgccgucacaaagccc

SEQ ID NO: 1732359 - RNA, 16 nt, Salmonella enterica enterica serovar Typhi Ty2
cacaacacggcggcua

SEQ ID NO: 1732360 - RNA, 14 nt, Salmonella enterica enterica serovar Typhi Ty2
cacaaaucgggcgg

SEQ ID NO: 1732361 - RNA, 23 nt, Salmonella enterica enterica serovar Typhi Ty2
caccaacggcgacgcccgccauc

SEQ ID NO: 1732362 - RNA, 15 nt, Salmonella enterica enterica serovar Typhi Ty2
cacauuucaaacguu

SEQ ID NO: 1732363 - RNA, 14 nt, Salmonella enterica enterica serovar Typhi Ty2
cacauuuucaaugc

SEQ ID NO: 1732364 - RNA, 15 nt, Salmonella enterica enterica serovar Typhi Ty2
cacaucuacucauau

SEQ ID NO: 1732365 - RNA, 20 nt, Salmonella enterica enterica serovar Typhi Ty2
cacaucguaaaucagcguga

SEQ ID NO: 1732366 - RNA, 14 nt, Salmonella enterica enterica serovar Typhi Ty2
cacaugaccagcgc

SEQ ID NO: 1732367 - RNA, 16 nt, Salmonella enterica enterica serovar Typhi Ty2
cacaguugccuucgau

SEQ ID NO: 1732368 - RNA, 13 nt, Salmonella enterica enterica serovar Typhi Ty2
cacauagagugau

SEQ ID NO: 1732369 - RNA, 21 nt, Salmonella enterica enterica serovar Typhi Ty2
cacaucaaagccccauaaccg

SEQ ID NO: 1732370 - RNA, 17 nt, Salmonella enterica enterica serovar Typhi Ty2
cacaggagccaguuuuc

SEQ ID NO: 1732371 - RNA, 23 nt, Salmonella enterica enterica serovar Typhi Ty2
cacagcguaggccaggcauccgg

SEQ ID NO: 1732372 - RNA, 18 nt, Salmonella enterica enterica serovar Typhi Ty2
cacagguaaacgcauagg

SEQ ID NO: 1732373 - RNA, 16 nt, Salmonella enterica enterica serovar Typhi Ty2
cacaggcugcggcacg

SEQ ID NO: 1732374 - RNA, 13 nt, Salmonella enterica enterica serovar Typhi Ty2
cacaggcugcggc

SEQ ID NO: 1732375 - RNA, 12 nt, Salmonella enterica enterica serovar Typhi Ty2
cacaguacgccc

SEQ ID NO: 1732376 - RNA, 19 nt, Salmonella enterica enterica serovar Typhi Ty2
cacaguauuccggcaucgu

SEQ ID NO: 1732377 - RNA, 20 nt, Salmonella enterica enterica serovar Typhi Ty2
aggccugauaagcgcagcgc

SEQ ID NO: 1732378 - RNA, 17 nt, Salmonella enterica enterica serovar Typhi Ty2
aggcgacucauuacgcc

SEQ ID NO: 1732379 - RNA, 23 nt, Salmonella enterica enterica serovar Typhi Ty2
aggcgacuaccguucacggcgau

SEQ ID NO: 1732380 - RNA, 17 nt, Salmonella enterica enterica serovar Typhi Ty2
aggcgacgcgauagcgc

SEQ ID NO: 1732381 - RNA, 13 nt, Salmonella enterica enterica serovar Typhi Ty2
aggcgaaccccau

SEQ ID NO: 1732382 - RNA, 16 nt, Salmonella enterica enterica serovar Typhi Ty2
aggcgacccauaacgg

SEQ ID NO: 1732383 - RNA, 16 nt, Salmonella enterica enterica serovar Typhi Ty2
aggcucaucagcgcca

SEQ ID NO: 1732384 - RNA, 16 nt, Salmonella enterica enterica serovar Typhi Ty2
aggcguaaaaaggcgc

SEQ ID NO: 1732385 - RNA, 13 nt, Salmonella enterica enterica serovar Typhi Ty2
aggcggcggugau

SEQ ID NO: 1732386 - RNA, 15 nt, Salmonella enterica enterica serovar Typhi Ty2
aggggcauuuuccgg

SEQ ID NO: 1732387 - RNA, 23 nt, Salmonella enterica enterica serovar Typhi Ty2
agggugauuucgcccgcauucgc

SEQ ID NO: 1732388 - RNA, 21 nt, Salmonella enterica enterica serovar Typhi Ty2
aggguuauuuccgcuggccgg

SEQ ID NO: 1732389 - RNA, 20 nt, Salmonella enterica enterica serovar Typhi Ty2
agguccagggaaaaauagcg

SEQ ID NO: 1732390 - RNA, 14 nt, Salmonella enterica enterica serovar Typhi Ty2
agguauccagcaga

SEQ ID NO: 1732391 - RNA, 23 nt, Salmonella enterica enterica serovar Typhi Ty2
agguaucgauacagacgccaacg

SEQ ID NO: 1732392 - RNA, 20 nt, Salmonella enterica enterica serovar Typhi Ty2
agguauccugaaccagcggc

SEQ ID NO: 1732393 - RNA, 14 nt, Salmonella enterica enterica serovar Typhi Ty2
agguaugcuucagc

SEQ ID NO: 1732394 - RNA, 16 nt, Salmonella enterica enterica serovar Typhi Ty2
agggcgugaaccagca

SEQ ID NO: 1732395 - RNA, 18 nt, Salmonella enterica enterica serovar Typhi Ty2
agggcgauucccgaucuu

SEQ ID NO: 1732396 - RNA, 16 nt, Salmonella enterica enterica serovar Typhi Ty2
agggcgagcguagcga

SEQ ID NO: 1732397 - RNA, 15 nt, Salmonella enterica enterica serovar Typhi Ty2
agggcgaacuggcgg

SEQ ID NO: 1732398 - RNA, 21 nt, Salmonella enterica enterica serovar Typhi Ty2
agggccgcaaacgguucgcgg

SEQ ID NO: 1732399 - RNA, 22 nt, Salmonella enterica enterica serovar Typhi Ty2
aggcuucgcgcagccagcgccc

SEQ ID NO: 1732400 - RNA, 23 nt, Salmonella enterica enterica serovar Typhi Ty2
aggauaauaguguuagcgucagu

SEQ ID NO: 1732401 - RNA, 23 nt, Salmonella enterica enterica serovar Typhi Ty2
aggauaauucccccaguaguuga

SEQ ID NO: 1732402 - RNA, 19 nt, Salmonella enterica enterica serovar Typhi Ty2
aggauagugauauagcgcc

SEQ ID NO: 1732403 - RNA, 21 nt, Salmonella enterica enterica serovar Typhi Ty2
aggauagcgaccagcgucagc

SEQ ID NO: 1732404 - RNA, 17 nt, Salmonella enterica enterica serovar Typhi Ty2
aggauaaaauccugcac

SEQ ID NO: 1732405 - RNA, 21 nt, Salmonella enterica enterica serovar Typhi Ty2
aggaggcgcguuuacuggcga

SEQ ID NO: 1732406 - RNA, 16 nt, Salmonella enterica enterica serovar Typhi Ty2
aggcagcaaugugcgc

SEQ ID NO: 1732407 - RNA, 14 nt, Salmonella enterica enterica serovar Typhi Ty2
aggcaggaaaucca

SEQ ID NO: 1732408 - RNA, 22 nt, Salmonella enterica enterica serovar Typhi Ty2
aggcaaucuuuaacgcuggcag

SEQ ID NO: 1732409 - RNA, 16 nt, Salmonella enterica enterica serovar Typhi Ty2
aggcaaucgcuuccag

SEQ ID NO: 1732410 - RNA, 20 nt, Salmonella enterica enterica serovar Typhi Ty2
aggcaaaaaucgucaucaga

SEQ ID NO: 1732411 - RNA, 19 nt, Salmonella enterica enterica serovar Typhi Ty2
aggauuugucucaucugau

SEQ ID NO: 1732412 - RNA, 23 nt, Salmonella enterica enterica serovar Typhi Ty2
aggccagaugguaagcauagcgc

SEQ ID NO: 1732413 - RNA, 13 nt, Salmonella enterica enterica serovar Typhi Ty2
agcuucaugcugg

SEQ ID NO: 1732414 - RNA, 23 nt, Salmonella enterica enterica serovar Typhi Ty2
agcuuccagcaaaccuuccgcca

SEQ ID NO: 1732415 - RNA, 18 nt, Salmonella enterica enterica serovar Typhi Ty2
agcuuaucgccaaagaua

SEQ ID NO: 1732416 - RNA, 17 nt, Salmonella enterica enterica serovar Typhi Ty2
agcuuauuccagucauu

SEQ ID NO: 1732417 - RNA, 12 nt, Salmonella enterica enterica serovar Typhi Ty2
agcuggcgauau

SEQ ID NO: 1732418 - RNA, 13 nt, Salmonella enterica enterica serovar Typhi Ty2
agcugguauugaa

SEQ ID NO: 1732419 - RNA, 15 nt, Salmonella enterica enterica serovar Typhi Ty2
agcuggccaaucagc

SEQ ID NO: 1732420 - RNA, 12 nt, Salmonella enterica enterica serovar Typhi Ty2
agcugcgucagc

SEQ ID NO: 1732421 - RNA, 18 nt, Salmonella enterica enterica serovar Typhi Ty2
agcgucucagcaggcggc

SEQ ID NO: 1732422 - RNA, 21 nt, Salmonella enterica enterica serovar Typhi Ty2
aggaaccgguagccaggcgcg

SEQ ID NO: 1732423 - RNA, 12 nt, Salmonella enterica enterica serovar Typhi Ty2
aggaaauucaga

SEQ ID NO: 1732424 - RNA, 17 nt, Salmonella enterica enterica serovar Typhi Ty2
aggaaaugccgggcaaa

SEQ ID NO: 1732425 - RNA, 21 nt, Salmonella enterica enterica serovar Typhi Ty2
aggaacaucagccagcagcuc

SEQ ID NO: 1732426 - RNA, 20 nt, Salmonella enterica enterica serovar Typhi Ty2
aggaauacaaaaaagccgau

SEQ ID NO: 1732427 - RNA, 15 nt, Salmonella enterica enterica serovar Typhi Ty2
aggaaggcgugcagc

SEQ ID NO: 1732428 - RNA, 18 nt, Salmonella enterica enterica serovar Typhi Ty2
aggacaaccccuacgcag

SEQ ID NO: 1732429 - RNA, 17 nt, Salmonella enterica enterica serovar Typhi Ty2
aggaaaacgcuuuccag

SEQ ID NO: 1732430 - RNA, 21 nt, Salmonella enterica enterica serovar Typhi Ty2
agcuuuuuacucagggcaaaa

SEQ ID NO: 1732431 - RNA, 15 nt, Salmonella enterica enterica serovar Typhi Ty2
agcuuuucgccggaa

SEQ ID NO: 1732432 - RNA, 15 nt, Salmonella enterica enterica serovar Typhi Ty2
agcuugcaggcaaaa

SEQ ID NO: 1732433 - RNA, 15 nt, Salmonella enterica enterica serovar Typhi Ty2
auauccguagcggau

SEQ ID NO: 1732434 - RNA, 22 nt, Salmonella enterica enterica serovar Typhi Ty2
auaucaacccaguuuuuauccu

SEQ ID NO: 1732435 - RNA, 21 nt, Salmonella enterica enterica serovar Typhi Ty2
auauauccgcuauuaccagua

SEQ ID NO: 1732436 - RNA, 18 nt, Salmonella enterica enterica serovar Typhi Ty2
auaucgcuaaaccaaacu

SEQ ID NO: 1732437 - RNA, 13 nt, Salmonella enterica enterica serovar Typhi Ty2
auaucgaugccag

SEQ ID NO: 1732438 - RNA, 23 nt, Salmonella enterica enterica serovar Typhi Ty2
auauaaacgggcccggcuuucug

SEQ ID NO: 1732439 - RNA, 24 nt, Salmonella enterica enterica serovar Typhi Ty2
auauacgccacggccagcagccau

SEQ ID NO: 1732440 - RNA, 14 nt, Salmonella enterica enterica serovar Typhi Ty2
auauucgcggcuuu

SEQ ID NO: 1732441 - RNA, 18 nt, Salmonella enterica enterica serovar Typhi Ty2
auauuccguuugcgccgg

SEQ ID NO: 1732442 - RNA, 19 nt, Salmonella enterica enterica serovar Typhi Ty2
auauucaucaguuuaaccg

SEQ ID NO: 1732443 - RNA, 19 nt, Salmonella enterica enterica serovar Typhi Ty2
auauucauucugucagaaa

SEQ ID NO: 1732444 - RNA, 19 nt, Salmonella enterica enterica serovar Typhi Ty2
auaucuuucaguucgccgg

SEQ ID NO: 1732445 - RNA, 15 nt, Salmonella enterica enterica serovar Typhi Ty2
auaucuuuauucgcu

SEQ ID NO: 1732446 - RNA, 15 nt, Salmonella enterica enterica serovar Typhi Ty2
auaucguugccgccg

SEQ ID NO: 1732447 - RNA, 15 nt, Salmonella enterica enterica serovar Typhi Ty2
auaucugcgccgcca

SEQ ID NO: 1732448 - RNA, 17 nt, Salmonella enterica enterica serovar Typhi Ty2
auaguggcgucgccaua

SEQ ID NO: 1732449 - RNA, 19 nt, Salmonella enterica enterica serovar Typhi Ty2
auauaaaaauagcuggcug

SEQ ID NO: 1732450 - RNA, 15 nt, Salmonella enterica enterica serovar Typhi Ty2
auaguaacguaugcu

SEQ ID NO: 1732451 - RNA, 16 nt, Salmonella enterica enterica serovar Typhi Ty2
auaguaaauugacgcu

SEQ ID NO: 1732452 - RNA, 22 nt, Salmonella enterica enterica serovar Typhi Ty2
auaggauaggcucuaaauuagc

SEQ ID NO: 1732453 - RNA, 15 nt, Salmonella enterica enterica serovar Typhi Ty2
auagcuauggucacu

SEQ ID NO: 1732454 - RNA, 12 nt, Salmonella enterica enterica serovar Typhi Ty2
auagcuggcugu

SEQ ID NO: 1732455 - RNA, 23 nt, Salmonella enterica enterica serovar Typhi Ty2
auagcgcugcgccagaucaggcg

SEQ ID NO: 1732456 - RNA, 16 nt, Salmonella enterica enterica serovar Typhi Ty2
auagcuauccacgcag

SEQ ID NO: 1732457 - RNA, 11 nt, Salmonella enterica enterica serovar Typhi Ty2
auagcguauuu

SEQ ID NO: 1732458 - RNA, 16 nt, Salmonella enterica enterica serovar Typhi Ty2
auagcgccgcaucgau

SEQ ID NO: 1732459 - RNA, 14 nt, Salmonella enterica enterica serovar Typhi Ty2
auagcgccgcaucg

SEQ ID NO: 1732460 - RNA, 16 nt, Salmonella enterica enterica serovar Typhi Ty2
auagaccacgccauca

SEQ ID NO: 1732461 - RNA, 18 nt, Salmonella enterica enterica serovar Typhi Ty2
auagaacuuccgguaggu

SEQ ID NO: 1732462 - RNA, 19 nt, Salmonella enterica enterica serovar Typhi Ty2
auaacgaacugauggcgcu

SEQ ID NO: 1732463 - RNA, 20 nt, Salmonella enterica enterica serovar Typhi Ty2
auaacgaccaaacaagaucg

SEQ ID NO: 1732464 - RNA, 18 nt, Salmonella enterica enterica serovar Typhi Ty2
auaacgcaacgucagcga

SEQ ID NO: 1732465 - RNA, 14 nt, Salmonella enterica enterica serovar Typhi Ty2
auaaccaucggacg

SEQ ID NO: 1732466 - RNA, 23 nt, Salmonella enterica enterica serovar Typhi Ty2
auaacagacgaaaaaaaagacgc

SEQ ID NO: 1732467 - RNA, 19 nt, Salmonella enterica enterica serovar Typhi Ty2
aguuugcgauaagcgcguu

SEQ ID NO: 1732468 - RNA, 20 nt, Salmonella enterica enterica serovar Typhi Ty2
auaagguaaagccgccaucc

SEQ ID NO: 1732469 - RNA, 14 nt, Salmonella enterica enterica serovar Typhi Ty2
auaauaaacgcgcc

SEQ ID NO: 1732470 - RNA, 12 nt, Salmonella enterica enterica serovar Typhi Ty2
auaauaagcggc

SEQ ID NO: 1732471 - RNA, 23 nt, Salmonella enterica enterica serovar Typhi Ty2
auaauacgccgguaucaucagau

SEQ ID NO: 1732472 - RNA, 13 nt, Salmonella enterica enterica serovar Typhi Ty2
auaauacgcgcga

SEQ ID NO: 1732473 - RNA, 21 nt, Salmonella enterica enterica serovar Typhi Ty2
auaauacgcgcgauuacgcga

SEQ ID NO: 1732474 - RNA, 18 nt, Salmonella enterica enterica serovar Typhi Ty2
auaagagaaaauaccgcu

SEQ ID NO: 1732475 - RNA, 19 nt, Salmonella enterica enterica serovar Typhi Ty2
auaagaaaaaacuggugca

SEQ ID NO: 1732476 - RNA, 15 nt, Salmonella enterica enterica serovar Typhi Ty2
auaagaucuuccggc

SEQ ID NO: 1732477 - RNA, 23 nt, Salmonella enterica enterica serovar Typhi Ty2
auaagguguuuacgccgccaucc

SEQ ID NO: 1732478 - RNA, 20 nt, Salmonella enterica enterica serovar Typhi Ty2
auaagauuuacaacagaucg

SEQ ID NO: 1732479 - RNA, 17 nt, Salmonella enterica enterica serovar Typhi Ty2
auaauauguuuauuugc

SEQ ID NO: 1732480 - RNA, 23 nt, Salmonella enterica enterica serovar Typhi Ty2
auaauaucaaucagcaaggcggc

SEQ ID NO: 1732481 - RNA, 14 nt, Salmonella enterica enterica serovar Typhi Ty2
auacaccgccagcg

SEQ ID NO: 1732482 - RNA, 20 nt, Salmonella enterica enterica serovar Typhi Ty2
auaccaacaccugcugguca

SEQ ID NO: 1732483 - RNA, 13 nt, Salmonella enterica enterica serovar Typhi Ty2
auacauuaacgcu

SEQ ID NO: 1732484 - RNA, 15 nt, Salmonella enterica enterica serovar Typhi Ty2
auacacgcgacaaug

SEQ ID NO: 1732485 - RNA, 12 nt, Salmonella enterica enterica serovar Typhi Ty2
auaccaggcacu

SEQ ID NO: 1732486 - RNA, 15 nt, Salmonella enterica enterica serovar Typhi Ty2
auaccugucggcaaa

SEQ ID NO: 1732487 - RNA, 15 nt, Salmonella enterica enterica serovar Typhi Ty2
auacgacgcguguug

SEQ ID NO: 1732488 - RNA, 20 nt, Salmonella enterica enterica serovar Typhi Ty2
auaccuaacucuuccgcaau

SEQ ID NO: 1732489 - RNA, 20 nt, Salmonella enterica enterica serovar Typhi Ty2
auacggcggcaaugccgccg

SEQ ID NO: 1732490 - RNA, 16 nt, Salmonella enterica enterica serovar Typhi Ty2
auacggaugccgauuu

SEQ ID NO: 1732491 - RNA, 17 nt, Salmonella enterica enterica serovar Typhi Ty2
aguacuauuuucgccga

SEQ ID NO: 1732492 - RNA, 11 nt, Salmonella enterica enterica serovar Typhi Ty2
aguaccugaug

SEQ ID NO: 1732493 - RNA, 16 nt, Salmonella enterica enterica serovar Typhi Ty2
agucacuccaggcguu

SEQ ID NO: 1732494 - RNA, 15 nt, Salmonella enterica enterica serovar Typhi Ty2
agucaaagguaauau

SEQ ID NO: 1732495 - RNA, 16 nt, Salmonella enterica enterica serovar Typhi Ty2
aguccaugaugaagau

SEQ ID NO: 1732496 - RNA, 12 nt, Salmonella enterica enterica serovar Typhi Ty2
agucccagcguu

SEQ ID NO: 1732497 - RNA, 14 nt, Salmonella enterica enterica serovar Typhi Ty2
aguccggauggcag

SEQ ID NO: 1732498 - RNA, 17 nt, Salmonella enterica enterica serovar Typhi Ty2
agucagcguuacuggcg

SEQ ID NO: 1732499 - RNA, 19 nt, Salmonella enterica enterica serovar Typhi Ty2
aguccagcagccaugccag

SEQ ID NO: 1732500 - RNA, 13 nt, Salmonella enterica enterica serovar Typhi Ty2
aguccauauccgu

SEQ ID NO: 1732501 - RNA, 17 nt, Salmonella enterica enterica serovar Typhi Ty2
agucgccagaugucggc

SEQ ID NO: 1732502 - RNA, 19 nt, Salmonella enterica enterica serovar Typhi Ty2
aguccgggccgugacacau

SEQ ID NO: 1732503 - RNA, 19 nt, Salmonella enterica enterica serovar Typhi Ty2
agucggcgaacuucgcggu

SEQ ID NO: 1732504 - RNA, 18 nt, Salmonella enterica enterica serovar Typhi Ty2
agucggcgaacuucgcgg

SEQ ID NO: 1732505 - RNA, 21 nt, Salmonella enterica enterica serovar Typhi Ty2
agucgcgccgugcccagcauc

SEQ ID NO: 1732506 - RNA, 16 nt, Salmonella enterica enterica serovar Typhi Ty2
agucgcucuaucgccu

SEQ ID NO: 1732507 - RNA, 22 nt, Salmonella enterica enterica serovar Typhi Ty2
agucgugucauagucggcgcca

SEQ ID NO: 1732508 - RNA, 12 nt, Salmonella enterica enterica serovar Typhi Ty2
agucgucuggcg

SEQ ID NO: 1732509 - RNA, 13 nt, Salmonella enterica enterica serovar Typhi Ty2
agucgucauggcg

SEQ ID NO: 1732510 - RNA, 19 nt, Salmonella enterica enterica serovar Typhi Ty2
agucguagaacaccacgcg

SEQ ID NO: 1732511 - RNA, 17 nt, Salmonella enterica enterica serovar Typhi Ty2
agugaaaguuuucgcca

SEQ ID NO: 1732512 - RNA, 23 nt, Salmonella enterica enterica serovar Typhi Ty2
agugcccguuugcgagacggcga

SEQ ID NO: 1732513 - RNA, 20 nt, Salmonella enterica enterica serovar Typhi Ty2
agugccaagcaacacggcga

SEQ ID NO: 1732514 - RNA, 12 nt, Salmonella enterica enterica serovar Typhi Ty2
agugcaacggcu

SEQ ID NO: 1732515 - RNA, 15 nt, Salmonella enterica enterica serovar Typhi Ty2
agugaguaacguuaa

SEQ ID NO: 1732516 - RNA, 13 nt, Salmonella enterica enterica serovar Typhi Ty2
agugaccagcauc

SEQ ID NO: 1732517 - RNA, 15 nt, Salmonella enterica enterica serovar Typhi Ty2
agugacggcaauaga

SEQ ID NO: 1732518 - RNA, 22 nt, Salmonella enterica enterica serovar Typhi Ty2
agugcuguuccacgggaucguu

SEQ ID NO: 1732519 - RNA, 13 nt, Salmonella enterica enterica serovar Typhi Ty2
aguggaaucagcc

SEQ ID NO: 1732520 - RNA, 22 nt, Salmonella enterica enterica serovar Typhi Ty2
aguggagaggccaccagcgcca

SEQ ID NO: 1732521 - RNA, 17 nt, Salmonella enterica enterica serovar Typhi Ty2
agugcgcauacuaccgc

SEQ ID NO: 1732522 - RNA, 14 nt, Salmonella enterica enterica serovar Typhi Ty2
agugcgauuugaca

SEQ ID NO: 1732523 - RNA, 21 nt, Salmonella enterica enterica serovar Typhi Ty2
aguucacgcgugguaucgcga

SEQ ID NO: 1732524 - RNA, 12 nt, Salmonella enterica enterica serovar Typhi Ty2
aguuaucacguu

SEQ ID NO: 1732525 - RNA, 16 nt, Salmonella enterica enterica serovar Typhi Ty2
aguuacguugcggcgu

SEQ ID NO: 1732526 - RNA, 16 nt, Salmonella enterica enterica serovar Typhi Ty2
aguuagcuaucgcgcc

SEQ ID NO: 1732527 - RNA, 15 nt, Salmonella enterica enterica serovar Typhi Ty2
aguuacgcacgccag

SEQ ID NO: 1732528 - RNA, 20 nt, Salmonella enterica enterica serovar Typhi Ty2
aguguguaccagcagcgcca

SEQ ID NO: 1732529 - RNA, 19 nt, Salmonella enterica enterica serovar Typhi Ty2
aguguuaaucucacgcuca

SEQ ID NO: 1732530 - RNA, 22 nt, Salmonella enterica enterica serovar Typhi Ty2
agugggcgucaaaaucccggcu

SEQ ID NO: 1732531 - RNA, 17 nt, Salmonella enterica enterica serovar Typhi Ty2
aguggcuuuaacgucag

SEQ ID NO: 1732532 - RNA, 23 nt, Salmonella enterica enterica serovar Typhi Ty2
aguggcggcaaaaaauauagcca

SEQ ID NO: 1732533 - RNA, 14 nt, Salmonella enterica enterica serovar Typhi Ty2
agaaauccgcgaau

SEQ ID NO: 1732534 - RNA, 22 nt, Salmonella enterica enterica serovar Typhi Ty2
agaacaugacggcagucgcuac

SEQ ID NO: 1732535 - RNA, 14 nt, Salmonella enterica enterica serovar Typhi Ty2
agaacagcuggugc

SEQ ID NO: 1732536 - RNA, 14 nt, Salmonella enterica enterica serovar Typhi Ty2
agaacuuccgccac

SEQ ID NO: 1732537 - RNA, 20 nt, Salmonella enterica enterica serovar Typhi Ty2
agaagcgauuagcuggcugc

SEQ ID NO: 1732538 - RNA, 21 nt, Salmonella enterica enterica serovar Typhi Ty2
agaaucagccgacggcgauca

SEQ ID NO: 1732539 - RNA, 23 nt, Salmonella enterica enterica serovar Typhi Ty2
agaauauuuuucucagccagauc

SEQ ID NO: 1732540 - RNA, 15 nt, Salmonella enterica enterica serovar Typhi Ty2
agaauacuuccugcu

SEQ ID NO: 1732541 - RNA, 23 nt, Salmonella enterica enterica serovar Typhi Ty2
agacaucgauuagaccguaaauc

SEQ ID NO: 1732542 - RNA, 14 nt, Salmonella enterica enterica serovar Typhi Ty2
agacauccagcauu

SEQ ID NO: 1732543 - RNA, 17 nt, Salmonella enterica enterica serovar Typhi Ty2
agacagccucucccgaa

SEQ ID NO: 1732544 - RNA, 16 nt, Salmonella enterica enterica serovar Typhi Ty2
agacagccgacggcaa

SEQ ID NO: 1732545 - RNA, 14 nt, Salmonella enterica enterica serovar Typhi Ty2
agacaggacgccag

SEQ ID NO: 1732546 - RNA, 24 nt, Salmonella enterica enterica serovar Typhi Ty2
agacagaaucaggccauuaccgcc

SEQ ID NO: 1732547 - RNA, 12 nt, Salmonella enterica enterica serovar Typhi Ty2
agaauuuaucgc

SEQ ID NO: 1732548 - RNA, 23 nt, Salmonella enterica enterica serovar Typhi Ty2
agaauuuccuucgcuuccuggau

SEQ ID NO: 1732549 - RNA, 14 nt, Salmonella enterica enterica serovar Typhi Ty2
agaaugucgccaua

SEQ ID NO: 1732550 - RNA, 13 nt, Salmonella enterica enterica serovar Typhi Ty2
agaauuaucugaa

SEQ ID NO: 1732551 - RNA, 20 nt, Salmonella enterica enterica serovar Typhi Ty2
agacgcugaaaagcgucuuu

SEQ ID NO: 1732552 - RNA, 14 nt, Salmonella enterica enterica serovar Typhi Ty2
agacugcccggcau

SEQ ID NO: 1732553 - RNA, 21 nt, Salmonella enterica enterica serovar Typhi Ty2
agacuuuggauaaagccaaug

SEQ ID NO: 1732554 - RNA, 16 nt, Salmonella enterica enterica serovar Typhi Ty2
agauaacaccgcaugg

SEQ ID NO: 1732555 - RNA, 22 nt, Salmonella enterica enterica serovar Typhi Ty2
agauaaaacugcugacaaucag

SEQ ID NO: 1732556 - RNA, 15 nt, Salmonella enterica enterica serovar Typhi Ty2
agaguugaugccgga

SEQ ID NO: 1732557 - RNA, 23 nt, Salmonella enterica enterica serovar Typhi Ty2
agagcggauaagcgcagcgccau

SEQ ID NO: 1732558 - RNA, 16 nt, Salmonella enterica enterica serovar Typhi Ty2
agagcguccacgccau

SEQ ID NO: 1732559 - RNA, 16 nt, Salmonella enterica enterica serovar Typhi Ty2
agaccgugaauaagau

SEQ ID NO: 1732560 - RNA, 23 nt, Salmonella enterica enterica serovar Typhi Ty2
agaccguggaucucgucgccggu

SEQ ID NO: 1732561 - RNA, 23 nt, Salmonella enterica enterica serovar Typhi Ty2
agaccggagcgugcuucaacggu

SEQ ID NO: 1732562 - RNA, 20 nt, Salmonella enterica enterica serovar Typhi Ty2
agaccggcgaaaucgugcgc

SEQ ID NO: 1732563 - RNA, 18 nt, Salmonella enterica enterica serovar Typhi Ty2
agacgauaaccggacgau

SEQ ID NO: 1732564 - RNA, 17 nt, Salmonella enterica enterica serovar Typhi Ty2
agacgaagcgcaaacgg

SEQ ID NO: 1732565 - RNA, 18 nt, Salmonella enterica enterica serovar Typhi Ty2
agcagcguuuugcgcgua

SEQ ID NO: 1732566 - RNA, 16 nt, Salmonella enterica enterica serovar Typhi Ty2
agcagaugaacggcaa

SEQ ID NO: 1732567 - RNA, 20 nt, Salmonella enterica enterica serovar Typhi Ty2
agcaucgccgguagcuucag

SEQ ID NO: 1732568 - RNA, 13 nt, Salmonella enterica enterica serovar Typhi Ty2
agcaucgccauca

SEQ ID NO: 1732569 - RNA, 15 nt, Salmonella enterica enterica serovar Typhi Ty2
agcaucgcauuaacg

SEQ ID NO: 1732570 - RNA, 16 nt, Salmonella enterica enterica serovar Typhi Ty2
agcaucuuaugcgcaa

SEQ ID NO: 1732571 - RNA, 12 nt, Salmonella enterica enterica serovar Typhi Ty2
agcaucucaucc

SEQ ID NO: 1732572 - RNA, 15 nt, Salmonella enterica enterica serovar Typhi Ty2
agcaucuccuggcgc

SEQ ID NO: 1732573 - RNA, 15 nt, Salmonella enterica enterica serovar Typhi Ty2
agcauugggccgaua

SEQ ID NO: 1732574 - RNA, 23 nt, Salmonella enterica enterica serovar Typhi Ty2
agcauuucggcguguaacugcaa

SEQ ID NO: 1732575 - RNA, 23 nt, Salmonella enterica enterica serovar Typhi Ty2
agccacagcgguuagcggcaugu

SEQ ID NO: 1732576 - RNA, 22 nt, Salmonella enterica enterica serovar Typhi Ty2
agccacaugccuucuuuggugc

SEQ ID NO: 1732577 - RNA, 18 nt, Salmonella enterica enterica serovar Typhi Ty2
agcaccucaauaugaaau

SEQ ID NO: 1732578 - RNA, 10 nt, Salmonella enterica enterica serovar Typhi Ty2
agcaccacgc

SEQ ID NO: 1732579 - RNA, 15 nt, Salmonella enterica enterica serovar Typhi Ty2
agcacgaggguaaug

SEQ ID NO: 1732580 - RNA, 16 nt, Salmonella enterica enterica serovar Typhi Ty2
agcagaagacggaaac

SEQ ID NO: 1732581 - RNA, 22 nt, Salmonella enterica enterica serovar Typhi Ty2
agcagaauauugcugauaauca

SEQ ID NO: 1732582 - RNA, 22 nt, Salmonella enterica enterica serovar Typhi Ty2
agcacuuccggaucgcuaucuu

SEQ ID NO: 1732583 - RNA, 15 nt, Salmonella enterica enterica serovar Typhi Ty2
agaucaggcgucagc

SEQ ID NO: 1732584 - RNA, 19 nt, Salmonella enterica enterica serovar Typhi Ty2
agaucaggcgucagcaugg

SEQ ID NO: 1732585 - RNA, 20 nt, Salmonella enterica enterica serovar Typhi Ty2
agauuguggaacuuuaucgc

SEQ ID NO: 1732586 - RNA, 15 nt, Salmonella enterica enterica serovar Typhi Ty2
agauuucgcgucagg

SEQ ID NO: 1732587 - RNA, 16 nt, Salmonella enterica enterica serovar Typhi Ty2
agauuggcaucugcaa

SEQ ID NO: 1732588 - RNA, 19 nt, Salmonella enterica enterica serovar Typhi Ty2
agcacauucgauaaccgcc

SEQ ID NO: 1732589 - RNA, 18 nt, Salmonella enterica enterica serovar Typhi Ty2
agcacauagaagcucaug

SEQ ID NO: 1732590 - RNA, 17 nt, Salmonella enterica enterica serovar Typhi Ty2
agcaaacuggcgcguac

SEQ ID NO: 1732591 - RNA, 13 nt, Salmonella enterica enterica serovar Typhi Ty2
agcaaacuggcgc

SEQ ID NO: 1732592 - RNA, 17 nt, Salmonella enterica enterica serovar Typhi Ty2
agcaauacaauuauugc

SEQ ID NO: 1732593 - RNA, 21 nt, Salmonella enterica enterica serovar Typhi Ty2
agcaauaaaaauaucauuaaa

SEQ ID NO: 1732594 - RNA, 21 nt, Salmonella enterica enterica serovar Typhi Ty2
agcaaggcauuggacggaauc

SEQ ID NO: 1732595 - RNA, 17 nt, Salmonella enterica enterica serovar Typhi Ty2
agcaaggagacgcccgu

SEQ ID NO: 1732596 - RNA, 23 nt, Salmonella enterica enterica serovar Typhi Ty2
agcggacgggcggugccgguaau

SEQ ID NO: 1732597 - RNA, 21 nt, Salmonella enterica enterica serovar Typhi Ty2
agcggacggcuaauaugccag

SEQ ID NO: 1732598 - RNA, 21 nt, Salmonella enterica enterica serovar Typhi Ty2
agcggauaagauagcaggcga

SEQ ID NO: 1732599 - RNA, 15 nt, Salmonella enterica enterica serovar Typhi Ty2
agcggacacccgcag

SEQ ID NO: 1732600 - RNA, 21 nt, Salmonella enterica enterica serovar Typhi Ty2
agcgcugcuguaacagacgca

SEQ ID NO: 1732601 - RNA, 19 nt, Salmonella enterica enterica serovar Typhi Ty2
agcggcgcgcgguuaugcg

SEQ ID NO: 1732602 - RNA, 20 nt, Salmonella enterica enterica serovar Typhi Ty2
agcggccagauggcaaacgg

SEQ ID NO: 1732603 - RNA, 18 nt, Salmonella enterica enterica serovar Typhi Ty2
agcgguaguuaagcguca

SEQ ID NO: 1732604 - RNA, 23 nt, Salmonella enterica enterica serovar Typhi Ty2
agcgguacucuuuuuccgcgaga

SEQ ID NO: 1732605 - RNA, 23 nt, Salmonella enterica enterica serovar Typhi Ty2
agcgguacccggucccuggcugg

SEQ ID NO: 1732606 - RNA, 12 nt, Salmonella enterica enterica serovar Typhi Ty2
agcgucagccca

SEQ ID NO: 1732607 - RNA, 20 nt, Salmonella enterica enterica serovar Typhi Ty2
agcgucauccggcaaucaga

SEQ ID NO: 1732608 - RNA, 15 nt, Salmonella enterica enterica serovar Typhi Ty2
agcgucauccggcaa

SEQ ID NO: 1732609 - RNA, 13 nt, Salmonella enterica enterica serovar Typhi Ty2
agcguccacgcca

SEQ ID NO: 1732610 - RNA, 16 nt, Salmonella enterica enterica serovar Typhi Ty2
agcgucauuaaaaugc

SEQ ID NO: 1732611 - RNA, 12 nt, Salmonella enterica enterica serovar Typhi Ty2
agcguaccagcg

SEQ ID NO: 1732612 - RNA, 21 nt, Salmonella enterica enterica serovar Typhi Ty2
agcguaauccucgacgcauca

SEQ ID NO: 1732613 - RNA, 15 nt, Salmonella enterica enterica serovar Typhi Ty2
agcguaccagcguca

SEQ ID NO: 1732614 - RNA, 17 nt, Salmonella enterica enterica serovar Typhi Ty2
agcgcgggccugccugu

SEQ ID NO: 1732615 - RNA, 15 nt, Salmonella enterica enterica serovar Typhi Ty2
agcgcugcggcuaca

SEQ ID NO: 1732616 - RNA, 17 nt, Salmonella enterica enterica serovar Typhi Ty2
agcgcugcauuugcugc

SEQ ID NO: 1732617 - RNA, 20 nt, Salmonella enterica enterica serovar Typhi Ty2
agcgcgcccgccaccagcac

SEQ ID NO: 1732618 - RNA, 15 nt, Salmonella enterica enterica serovar Typhi Ty2
agcgccuuugcgaau

SEQ ID NO: 1732619 - RNA, 19 nt, Salmonella enterica enterica serovar Typhi Ty2
agcgcgccgccaacgccaa

SEQ ID NO: 1732620 - RNA, 17 nt, Salmonella enterica enterica serovar Typhi Ty2
agcgcgccgcagcgccg

SEQ ID NO: 1732621 - RNA, 19 nt, Salmonella enterica enterica serovar Typhi Ty2
agcgccuucaggcaucaga

SEQ ID NO: 1732622 - RNA, 18 nt, Salmonella enterica enterica serovar Typhi Ty2
agcgccguagcggcaggg

SEQ ID NO: 1732623 - RNA, 14 nt, Salmonella enterica enterica serovar Typhi Ty2
agcgccaugaagau

SEQ ID NO: 1732624 - RNA, 15 nt, Salmonella enterica enterica serovar Typhi Ty2
agcgccauccggcaa

SEQ ID NO: 1732625 - RNA, 13 nt, Salmonella enterica enterica serovar Typhi Ty2
agcgccauccggc

SEQ ID NO: 1732626 - RNA, 13 nt, Salmonella enterica enterica serovar Typhi Ty2
agcgcccggugau

SEQ ID NO: 1732627 - RNA, 15 nt, Salmonella enterica enterica serovar Typhi Ty2
agcgccagcuccaua

SEQ ID NO: 1732628 - RNA, 20 nt, Salmonella enterica enterica serovar Typhi Ty2
agcgccagcguugaccagcc

SEQ ID NO: 1732629 - RNA, 17 nt, Salmonella enterica enterica serovar Typhi Ty2
agccgccacccggcuuu

SEQ ID NO: 1732630 - RNA, 19 nt, Salmonella enterica enterica serovar Typhi Ty2
agccgcgggcgguauuaca

SEQ ID NO: 1732631 - RNA, 14 nt, Salmonella enterica enterica serovar Typhi Ty2
agccggacgcccgu

SEQ ID NO: 1732632 - RNA, 11 nt, Salmonella enterica enterica serovar Typhi Ty2
agccggauaaa

SEQ ID NO: 1732633 - RNA, 14 nt, Salmonella enterica enterica serovar Typhi Ty2
agccgagcgguaag

SEQ ID NO: 1732634 - RNA, 23 nt, Salmonella enterica enterica serovar Typhi Ty2
agccgcaaucagcguuucgccgu

SEQ ID NO: 1732635 - RNA, 15 nt, Salmonella enterica enterica serovar Typhi Ty2
agccgacuauuccgc

SEQ ID NO: 1732636 - RNA, 21 nt, Salmonella enterica enterica serovar Typhi Ty2
agccgaaacuuauacugauaa

SEQ ID NO: 1732637 - RNA, 20 nt, Salmonella enterica enterica serovar Typhi Ty2
agccgguaaucacugccgcc

SEQ ID NO: 1732638 - RNA, 22 nt, Salmonella enterica enterica serovar Typhi Ty2
agccggugaugaucaauaacgc

SEQ ID NO: 1732639 - RNA, 21 nt, Salmonella enterica enterica serovar Typhi Ty2
agcgacgucccgucagggcga

SEQ ID NO: 1732640 - RNA, 11 nt, Salmonella enterica enterica serovar Typhi Ty2
agcgacgcccu

SEQ ID NO: 1732641 - RNA, 18 nt, Salmonella enterica enterica serovar Typhi Ty2
agcgacgcugucaaucga

SEQ ID NO: 1732642 - RNA, 18 nt, Salmonella enterica enterica serovar Typhi Ty2
agcgacuuauccggccua

SEQ ID NO: 1732643 - RNA, 17 nt, Salmonella enterica enterica serovar Typhi Ty2
agcgacuugucggcaau

SEQ ID NO: 1732644 - RNA, 17 nt, Salmonella enterica enterica serovar Typhi Ty2
agcgaacguccagcggc

SEQ ID NO: 1732645 - RNA, 21 nt, Salmonella enterica enterica serovar Typhi Ty2
agcgaacaguguaaacgccag

SEQ ID NO: 1732646 - RNA, 17 nt, Salmonella enterica enterica serovar Typhi Ty2
agcgaccuuaccggcga

SEQ ID NO: 1732647 - RNA, 13 nt, Salmonella enterica enterica serovar Typhi Ty2
agcgaacugauaa

SEQ ID NO: 1732648 - RNA, 17 nt, Salmonella enterica enterica serovar Typhi Ty2
agccgucaaacaucgcg

SEQ ID NO: 1732649 - RNA, 19 nt, Salmonella enterica enterica serovar Typhi Ty2
agccugaacgggugguuuc

SEQ ID NO: 1732650 - RNA, 22 nt, Salmonella enterica enterica serovar Typhi Ty2
agccucugauuucgacgauaaa

SEQ ID NO: 1732651 - RNA, 16 nt, Salmonella enterica enterica serovar Typhi Ty2
uaaaagagagcgccaa

SEQ ID NO: 1732652 - RNA, 17 nt, Salmonella enterica enterica serovar Typhi Ty2
uaaaauugcucagccaa

SEQ ID NO: 1732653 - RNA, 20 nt, Salmonella enterica enterica serovar Typhi Ty2
uaaaacggcuuuucuucauc

SEQ ID NO: 1732654 - RNA, 14 nt, Salmonella enterica enterica serovar Typhi Ty2
guuuccagccaguc

SEQ ID NO: 1732655 - RNA, 18 nt, Salmonella enterica enterica serovar Typhi Ty2
guuucaguaaaucccgca

SEQ ID NO: 1732656 - RNA, 16 nt, Salmonella enterica enterica serovar Typhi Ty2
uaaagcguaucgccca

SEQ ID NO: 1732657 - RNA, 16 nt, Salmonella enterica enterica serovar Typhi Ty2
uaaagcgccacaacgu

SEQ ID NO: 1732658 - RNA, 13 nt, Salmonella enterica enterica serovar Typhi Ty2
uaaagcgaauacu

SEQ ID NO: 1732659 - RNA, 15 nt, Salmonella enterica enterica serovar Typhi Ty2
uaaagcgcauccagc

SEQ ID NO: 1732660 - RNA, 17 nt, Salmonella enterica enterica serovar Typhi Ty2
uaaagccgccauccggc

SEQ ID NO: 1732661 - RNA, 18 nt, Salmonella enterica enterica serovar Typhi Ty2
uaaacugcgcgauaucug

SEQ ID NO: 1732662 - RNA, 15 nt, Salmonella enterica enterica serovar Typhi Ty2
uaaacucaaucaggc

SEQ ID NO: 1732663 - RNA, 23 nt, Salmonella enterica enterica serovar Typhi Ty2
uaaacacgccgcgcuggauagcg

SEQ ID NO: 1732664 - RNA, 17 nt, Salmonella enterica enterica serovar Typhi Ty2
uaaacagcguuuucaua

SEQ ID NO: 1732665 - RNA, 18 nt, Salmonella enterica enterica serovar Typhi Ty2
uaaagaaaguagaucacc

SEQ ID NO: 1732666 - RNA, 20 nt, Salmonella enterica enterica serovar Typhi Ty2
uaaagacuuuaccgccguua

SEQ ID NO: 1732667 - RNA, 13 nt, Salmonella enterica enterica serovar Typhi Ty2
uaaauaauucacg

SEQ ID NO: 1732668 - RNA, 18 nt, Salmonella enterica enterica serovar Typhi Ty2
uaaauacaauucaacuca

SEQ ID NO: 1732669 - RNA, 16 nt, Salmonella enterica enterica serovar Typhi Ty2
uaaaucagcgcggcaa

SEQ ID NO: 1732670 - RNA, 14 nt, Salmonella enterica enterica serovar Typhi Ty2
uaaauccggcgcuu

SEQ ID NO: 1732671 - RNA, 15 nt, Salmonella enterica enterica serovar Typhi Ty2
uaaaugggcaggaga

SEQ ID NO: 1732672 - RNA, 21 nt, Salmonella enterica enterica serovar Typhi Ty2
uaaccguucaucuaucgccag

SEQ ID NO: 1732673 - RNA, 16 nt, Salmonella enterica enterica serovar Typhi Ty2
uaaccgggcgcuuaau

SEQ ID NO: 1732674 - RNA, 16 nt, Salmonella enterica enterica serovar Typhi Ty2
uaacacggcuggcaau

SEQ ID NO: 1732675 - RNA, 17 nt, Salmonella enterica enterica serovar Typhi Ty2
uaaucggcaggccaacg

SEQ ID NO: 1732676 - RNA, 13 nt, Salmonella enterica enterica serovar Typhi Ty2
uaaucgcgcgcuu

SEQ ID NO: 1732677 - RNA, 21 nt, Salmonella enterica enterica serovar Typhi Ty2
uaaucggccaggauggcccgg

SEQ ID NO: 1732678 - RNA, 22 nt, Salmonella enterica enterica serovar Typhi Ty2
uaaucugaauaccuugauaacu

SEQ ID NO: 1732679 - RNA, 22 nt, Salmonella enterica enterica serovar Typhi Ty2
uaaucguauucauugccguaaa

SEQ ID NO: 1732680 - RNA, 11 nt, Salmonella enterica enterica serovar Typhi Ty2
uaaucuuccac

SEQ ID NO: 1732681 - RNA, 15 nt, Salmonella enterica enterica serovar Typhi Ty2
uaaucguaucaaagc

SEQ ID NO: 1732682 - RNA, 13 nt, Salmonella enterica enterica serovar Typhi Ty2
uaaugacauccag

SEQ ID NO: 1732683 - RNA, 19 nt, Salmonella enterica enterica serovar Typhi Ty2
uaaugaaagaaaucaccgu

SEQ ID NO: 1732684 - RNA, 15 nt, Salmonella enterica enterica serovar Typhi Ty2
uaauccccgauaucg

SEQ ID NO: 1732685 - RNA, 12 nt, Salmonella enterica enterica serovar Typhi Ty2
uaauacucgccc

SEQ ID NO: 1732686 - RNA, 15 nt, Salmonella enterica enterica serovar Typhi Ty2
uaaucgauaagccag

SEQ ID NO: 1732687 - RNA, 13 nt, Salmonella enterica enterica serovar Typhi Ty2
uaaucgagcccag

SEQ ID NO: 1732688 - RNA, 16 nt, Salmonella enterica enterica serovar Typhi Ty2
uaaucgaaucgccuca

SEQ ID NO: 1732689 - RNA, 21 nt, Salmonella enterica enterica serovar Typhi Ty2
uaaucgccauugcaauaccgg

SEQ ID NO: 1732690 - RNA, 13 nt, Salmonella enterica enterica serovar Typhi Ty2
uaauccggcaacu

SEQ ID NO: 1732691 - RNA, 19 nt, Salmonella enterica enterica serovar Typhi Ty2
uaauccgacgcuucaaagc

SEQ ID NO: 1732692 - RNA, 16 nt, Salmonella enterica enterica serovar Typhi Ty2
uaaugauuguccagcc

SEQ ID NO: 1732693 - RNA, 21 nt, Salmonella enterica enterica serovar Typhi Ty2
uaaugcaauauuacaaagcag

SEQ ID NO: 1732694 - RNA, 21 nt, Salmonella enterica enterica serovar Typhi Ty2
uaaugcaauaaacuaaguaag

SEQ ID NO: 1732695 - RNA, 14 nt, Salmonella enterica enterica serovar Typhi Ty2
uaaugauaucgccc

SEQ ID NO: 1732696 - RNA, 20 nt, Salmonella enterica enterica serovar Typhi Ty2
uaaugaucguaugcagccag

SEQ ID NO: 1732697 - RNA, 20 nt, Salmonella enterica enterica serovar Typhi Ty2
uaaugcucuuaaaaugaucg

SEQ ID NO: 1732698 - RNA, 22 nt, Salmonella enterica enterica serovar Typhi Ty2
uaaugcgccccggcggcguaca

SEQ ID NO: 1732699 - RNA, 15 nt, Salmonella enterica enterica serovar Typhi Ty2
uaaugcccgauggcg

SEQ ID NO: 1732700 - RNA, 12 nt, Salmonella enterica enterica serovar Typhi Ty2
uaauggcgucaa

SEQ ID NO: 1732701 - RNA, 18 nt, Salmonella enterica enterica serovar Typhi Ty2
uaaugguggcaaccugac

SEQ ID NO: 1732702 - RNA, 14 nt, Salmonella enterica enterica serovar Typhi Ty2
uaauuugaaucgcc

SEQ ID NO: 1732703 - RNA, 22 nt, Salmonella enterica enterica serovar Typhi Ty2
uaagcggguauacuuaacccug

SEQ ID NO: 1732704 - RNA, 13 nt, Salmonella enterica enterica serovar Typhi Ty2
uaagcggccuaua

SEQ ID NO: 1732705 - RNA, 14 nt, Salmonella enterica enterica serovar Typhi Ty2
uaagcgugcgccau

SEQ ID NO: 1732706 - RNA, 19 nt, Salmonella enterica enterica serovar Typhi Ty2
uaagcguagcgcauccggc

SEQ ID NO: 1732707 - RNA, 18 nt, Salmonella enterica enterica serovar Typhi Ty2
uaagcguggcgcaaccga

SEQ ID NO: 1732708 - RNA, 20 nt, Salmonella enterica enterica serovar Typhi Ty2
uaaggcauuuaugccgccau

SEQ ID NO: 1732709 - RNA, 15 nt, Salmonella enterica enterica serovar Typhi Ty2
uaauaaaaaucgggu

SEQ ID NO: 1732710 - RNA, 23 nt, Salmonella enterica enterica serovar Typhi Ty2
uaauacgaucuucuccauugauc

SEQ ID NO: 1732711 - RNA, 13 nt, Salmonella enterica enterica serovar Typhi Ty2
uaauaaggcuggc

SEQ ID NO: 1732712 - RNA, 14 nt, Salmonella enterica enterica serovar Typhi Ty2
uaauacaucaugcu

SEQ ID NO: 1732713 - RNA, 19 nt, Salmonella enterica enterica serovar Typhi Ty2
uaauaacgaacugauggcg

SEQ ID NO: 1732714 - RNA, 17 nt, Salmonella enterica enterica serovar Typhi Ty2
uaacgaauuaagcggau

SEQ ID NO: 1732715 - RNA, 18 nt, Salmonella enterica enterica serovar Typhi Ty2
uaaccugguaugauaucg

SEQ ID NO: 1732716 - RNA, 19 nt, Salmonella enterica enterica serovar Typhi Ty2
uaagaccgguacgcaacgc

SEQ ID NO: 1732717 - RNA, 18 nt, Salmonella enterica enterica serovar Typhi Ty2
uaagcaacguuuccgcua

SEQ ID NO: 1732718 - RNA, 18 nt, Salmonella enterica enterica serovar Typhi Ty2
uaagaucggguggccuaa

SEQ ID NO: 1732719 - RNA, 16 nt, Salmonella enterica enterica serovar Typhi Ty2
uaagauagcaggcgau

SEQ ID NO: 1732720 - RNA, 23 nt, Salmonella enterica enterica serovar Typhi Ty2
uaagagacugacaaugacgcaau

SEQ ID NO: 1732721 - RNA, 19 nt, Salmonella enterica enterica serovar Typhi Ty2
uaagacgcuuacaucgcca

SEQ ID NO: 1732722 - RNA, 18 nt, Salmonella enterica enterica serovar Typhi Ty2
uaagacguuuaugccgcc

SEQ ID NO: 1732723 - RNA, 19 nt, Salmonella enterica enterica serovar Typhi Ty2
uaagcggcaagccgaucag

SEQ ID NO: 1732724 - RNA, 16 nt, Salmonella enterica enterica serovar Typhi Ty2
uaagcggcagcgccau

SEQ ID NO: 1732725 - RNA, 18 nt, Salmonella enterica enterica serovar Typhi Ty2
uaagcaacugauuaaucu

SEQ ID NO: 1732726 - RNA, 19 nt, Salmonella enterica enterica serovar Typhi Ty2
guuuacgagugcguucuuc

SEQ ID NO: 1732727 - RNA, 16 nt, Salmonella enterica enterica serovar Typhi Ty2
guuuacgcugcuaucc

SEQ ID NO: 1732728 - RNA, 14 nt, Salmonella enterica enterica serovar Typhi Ty2
guuuagcgccagca

SEQ ID NO: 1732729 - RNA, 21 nt, Salmonella enterica enterica serovar Typhi Ty2
guuuacacagaggaugccugc

SEQ ID NO: 1732730 - RNA, 14 nt, Salmonella enterica enterica serovar Typhi Ty2
guuuauccacaggc

SEQ ID NO: 1732731 - RNA, 17 nt, Salmonella enterica enterica serovar Typhi Ty2
guuuagcuguucaauca

SEQ ID NO: 1732732 - RNA, 14 nt, Salmonella enterica enterica serovar Typhi Ty2
guuuauguuugcug

SEQ ID NO: 1732733 - RNA, 22 nt, Salmonella enterica enterica serovar Typhi Ty2
guuuauggccgcguuucgcgau

SEQ ID NO: 1732734 - RNA, 18 nt, Salmonella enterica enterica serovar Typhi Ty2
guuguuucugccuuuaac

SEQ ID NO: 1732735 - RNA, 15 nt, Salmonella enterica enterica serovar Typhi Ty2
guuguuccagcagcu

SEQ ID NO: 1732736 - RNA, 17 nt, Salmonella enterica enterica serovar Typhi Ty2
guuguuccgcgcugaug

SEQ ID NO: 1732737 - RNA, 17 nt, Salmonella enterica enterica serovar Typhi Ty2
guuggcuauacgcggcg

SEQ ID NO: 1732738 - RNA, 15 nt, Salmonella enterica enterica serovar Typhi Ty2
guugucaaaaucgcg

SEQ ID NO: 1732739 - RNA, 21 nt, Salmonella enterica enterica serovar Typhi Ty2
guugagcgcuugcugcguaaa

SEQ ID NO: 1732740 - RNA, 14 nt, Salmonella enterica enterica serovar Typhi Ty2
guugagcuuauccg

SEQ ID NO: 1732741 - RNA, 19 nt, Salmonella enterica enterica serovar Typhi Ty2
guugccguguccuuguccg

SEQ ID NO: 1732742 - RNA, 21 nt, Salmonella enterica enterica serovar Typhi Ty2
guugcgcaagcacugaaugcu

SEQ ID NO: 1732743 - RNA, 15 nt, Salmonella enterica enterica serovar Typhi Ty2
guucgccgcgcgcau

SEQ ID NO: 1732744 - RNA, 22 nt, Salmonella enterica enterica serovar Typhi Ty2
guucgcguauuggcgcgaucag

SEQ ID NO: 1732745 - RNA, 17 nt, Salmonella enterica enterica serovar Typhi Ty2
guucgcuuauuccuccg

SEQ ID NO: 1732746 - RNA, 17 nt, Salmonella enterica enterica serovar Typhi Ty2
guucgcuucugccgcca

SEQ ID NO: 1732747 - RNA, 21 nt, Salmonella enterica enterica serovar Typhi Ty2
guucuaucagguaucccgcca

SEQ ID NO: 1732748 - RNA, 18 nt, Salmonella enterica enterica serovar Typhi Ty2
guucugaggcuauuguca

SEQ ID NO: 1732749 - RNA, 23 nt, Salmonella enterica enterica serovar Typhi Ty2
guuaacagacccgcuuucgcgua

SEQ ID NO: 1732750 - RNA, 21 nt, Salmonella enterica enterica serovar Typhi Ty2
guuaaauccucccaucgagcc

SEQ ID NO: 1732751 - RNA, 19 nt, Salmonella enterica enterica serovar Typhi Ty2
guuaacaucaucaggccug

SEQ ID NO: 1732752 - RNA, 13 nt, Salmonella enterica enterica serovar Typhi Ty2
guguucuuaccca

SEQ ID NO: 1732753 - RNA, 12 nt, Salmonella enterica enterica serovar Typhi Ty2
guuaauacgccg

SEQ ID NO: 1732754 - RNA, 19 nt, Salmonella enterica enterica serovar Typhi Ty2
guuaaggggcaggcgucaa

SEQ ID NO: 1732755 - RNA, 19 nt, Salmonella enterica enterica serovar Typhi Ty2
guuaagaggauugcguaau

SEQ ID NO: 1732756 - RNA, 14 nt, Salmonella enterica enterica serovar Typhi Ty2
guuaaucaucgcuu

SEQ ID NO: 1732757 - RNA, 23 nt, Salmonella enterica enterica serovar Typhi Ty2
aaguuauuuuuucuuuggcgcug

SEQ ID NO: 1732758 - RNA, 16 nt, Salmonella enterica enterica serovar Typhi Ty2
guuaccggcuccggca

SEQ ID NO: 1732759 - RNA, 19 nt, Salmonella enterica enterica serovar Typhi Ty2
guuacccuccugcaauccg

SEQ ID NO: 1732760 - RNA, 16 nt, Salmonella enterica enterica serovar Typhi Ty2
guuaccccgcagcgaa

SEQ ID NO: 1732761 - RNA, 19 nt, Salmonella enterica enterica serovar Typhi Ty2
guuacccagccugauggcg

SEQ ID NO: 1732762 - RNA, 17 nt, Salmonella enterica enterica serovar Typhi Ty2
guuacucacugccgccc

SEQ ID NO: 1732763 - RNA, 24 nt, Salmonella enterica enterica serovar Typhi Ty2
guuacgcgcugcaaauacugcuuu

SEQ ID NO: 1732764 - RNA, 20 nt, Salmonella enterica enterica serovar Typhi Ty2
aagugguugaaugaagccuu

SEQ ID NO: 1732765 - RNA, 16 nt, Salmonella enterica enterica serovar Typhi Ty2
guggugagcucaucca

SEQ ID NO: 1732766 - RNA, 18 nt, Salmonella enterica enterica serovar Typhi Ty2
gugggguucccgagcgau

SEQ ID NO: 1732767 - RNA, 17 nt, Salmonella enterica enterica serovar Typhi Ty2
guguaaggcuuccggca

SEQ ID NO: 1732768 - RNA, 22 nt, Salmonella enterica enterica serovar Typhi Ty2
gugucuucccugaccagcgacg

SEQ ID NO: 1732769 - RNA, 23 nt, Salmonella enterica enterica serovar Typhi Ty2
guguauuucauuucgaucuguuu

SEQ ID NO: 1732770 - RNA, 21 nt, Salmonella enterica enterica serovar Typhi Ty2
guggccagcaugcccgccagc

SEQ ID NO: 1732771 - RNA, 15 nt, Salmonella enterica enterica serovar Typhi Ty2
guggccgcgcaaggc

SEQ ID NO: 1732772 - RNA, 21 nt, Salmonella enterica enterica serovar Typhi Ty2
guggcgaaauugguagacgca

SEQ ID NO: 1732773 - RNA, 22 nt, Salmonella enterica enterica serovar Typhi Ty2
guggcgaaauugguagacgcac

SEQ ID NO: 1732774 - RNA, 20 nt, Salmonella enterica enterica serovar Typhi Ty2
guggcgaaacuccuccggga

SEQ ID NO: 1732775 - RNA, 21 nt, Salmonella enterica enterica serovar Typhi Ty2
guggcggcuacgccuuacccg

SEQ ID NO: 1732776 - RNA, 23 nt, Salmonella enterica enterica serovar Typhi Ty2
gugggauugcaguagaucgacau

SEQ ID NO: 1732777 - RNA, 21 nt, Salmonella enterica enterica serovar Typhi Ty2
guggcugaggccgcucgccau

SEQ ID NO: 1732778 - RNA, 16 nt, Salmonella enterica enterica serovar Typhi Ty2
guggcuaucggccuga

SEQ ID NO: 1732779 - RNA, 20 nt, Salmonella enterica enterica serovar Typhi Ty2
guggcgcuggccgaauagcu

SEQ ID NO: 1732780 - RNA, 17 nt, Salmonella enterica enterica serovar Typhi Ty2
guggcggaaaugcgcgg

SEQ ID NO: 1732781 - RNA, 23 nt, Salmonella enterica enterica serovar Typhi Ty2
guggcgcaguuuacgcagcgccu

SEQ ID NO: 1732782 - RNA, 14 nt, Salmonella enterica enterica serovar Typhi Ty2
gugcguucauggcg

SEQ ID NO: 1732783 - RNA, 18 nt, Salmonella enterica enterica serovar Typhi Ty2
gugcuaucaggccuacaa

SEQ ID NO: 1732784 - RNA, 22 nt, Salmonella enterica enterica serovar Typhi Ty2
gugcuaaguucucguucaacgg

SEQ ID NO: 1732785 - RNA, 19 nt, Salmonella enterica enterica serovar Typhi Ty2
gugcgguauaucacgccau

SEQ ID NO: 1732786 - RNA, 13 nt, Salmonella enterica enterica serovar Typhi Ty2
gugcgcauccgga

SEQ ID NO: 1732787 - RNA, 23 nt, Salmonella enterica enterica serovar Typhi Ty2
gugccgaaaucaucaauggcgau

SEQ ID NO: 1732788 - RNA, 17 nt, Salmonella enterica enterica serovar Typhi Ty2
gugccgcggcuucauca

SEQ ID NO: 1732789 - RNA, 17 nt, Salmonella enterica enterica serovar Typhi Ty2
gugccugacagcaauga

SEQ ID NO: 1732790 - RNA, 17 nt, Salmonella enterica enterica serovar Typhi Ty2
gugccguccggcaucac

SEQ ID NO: 1732791 - RNA, 22 nt, Salmonella enterica enterica serovar Typhi Ty2
aagugccagggcggaagcagau

SEQ ID NO: 1732792 - RNA, 21 nt, Salmonella enterica enterica serovar Typhi Ty2
aagucuuuuguauugcgcguc

SEQ ID NO: 1732793 - RNA, 20 nt, Salmonella enterica enterica serovar Typhi Ty2
gugcaguucuguaggccgga

SEQ ID NO: 1732794 - RNA, 16 nt, Salmonella enterica enterica serovar Typhi Ty2
gugauuaacagcgcca

SEQ ID NO: 1732795 - RNA, 14 nt, Salmonella enterica enterica serovar Typhi Ty2
gugauggcggucaa

SEQ ID NO: 1732796 - RNA, 13 nt, Salmonella enterica enterica serovar Typhi Ty2
gugauccguaauc

SEQ ID NO: 1732797 - RNA, 23 nt, Salmonella enterica enterica serovar Typhi Ty2
gugauccaccaccagcaucacgu

SEQ ID NO: 1732798 - RNA, 23 nt, Salmonella enterica enterica serovar Typhi Ty2
ucacgcgcgcgaaacgcacccgc

SEQ ID NO: 1732799 - RNA, 18 nt, Salmonella enterica enterica serovar Typhi Ty2
ucacgcggauugccgccc

SEQ ID NO: 1732800 - RNA, 21 nt, Salmonella enterica enterica serovar Typhi Ty2
ucagcaauuucucgcccgcca

SEQ ID NO: 1732801 - RNA, 22 nt, Salmonella enterica enterica serovar Typhi Ty2
ucagcacaucagccguaucuuc

SEQ ID NO: 1732802 - RNA, 22 nt, Salmonella enterica enterica serovar Typhi Ty2
ucagcaaaauaccggcagcggu

SEQ ID NO: 1732803 - RNA, 19 nt, Salmonella enterica enterica serovar Typhi Ty2
ucagcaagaaguuccgcuu

SEQ ID NO: 1732804 - RNA, 18 nt, Salmonella enterica enterica serovar Typhi Ty2
ucagaccgagacccagcg

SEQ ID NO: 1732805 - RNA, 21 nt, Salmonella enterica enterica serovar Typhi Ty2
ucagaccgugcuuuugcagau

SEQ ID NO: 1732806 - RNA, 16 nt, Salmonella enterica enterica serovar Typhi Ty2
ucagaccuccgccauc

SEQ ID NO: 1732807 - RNA, 20 nt, Salmonella enterica enterica serovar Typhi Ty2
ucagaccggcaaucaauaca

SEQ ID NO: 1732808 - RNA, 21 nt, Salmonella enterica enterica serovar Typhi Ty2
ucagacauauacucuucgcca

SEQ ID NO: 1732809 - RNA, 12 nt, Salmonella enterica enterica serovar Typhi Ty2
ucacugccgccc

SEQ ID NO: 1732810 - RNA, 21 nt, Salmonella enterica enterica serovar Typhi Ty2
ucagcgaucugucgccgcgua

SEQ ID NO: 1732811 - RNA, 22 nt, Salmonella enterica enterica serovar Typhi Ty2
ucagcgaucugucgccgcguaa

SEQ ID NO: 1732812 - RNA, 16 nt, Salmonella enterica enterica serovar Typhi Ty2
ucagcgauugcgccag

SEQ ID NO: 1732813 - RNA, 19 nt, Salmonella enterica enterica serovar Typhi Ty2
ucagcagccgggccagacg

SEQ ID NO: 1732814 - RNA, 23 nt, Salmonella enterica enterica serovar Typhi Ty2
ucagcagcgaggugauaaucagc

SEQ ID NO: 1732815 - RNA, 19 nt, Salmonella enterica enterica serovar Typhi Ty2
ucagcaggauagcgaccag

SEQ ID NO: 1732816 - RNA, 16 nt, Salmonella enterica enterica serovar Typhi Ty2
ucacccggauacgcgg

SEQ ID NO: 1732817 - RNA, 19 nt, Salmonella enterica enterica serovar Typhi Ty2
ucacccaggcgaugcgcgg

SEQ ID NO: 1732818 - RNA, 13 nt, Salmonella enterica enterica serovar Typhi Ty2
ucacccgcgccag

SEQ ID NO: 1732819 - RNA, 12 nt, Salmonella enterica enterica serovar Typhi Ty2
ucaccuccgcca

SEQ ID NO: 1732820 - RNA, 17 nt, Salmonella enterica enterica serovar Typhi Ty2
ucaccucaucaacgcca

SEQ ID NO: 1732821 - RNA, 13 nt, Salmonella enterica enterica serovar Typhi Ty2
ucaccuccgccac

SEQ ID NO: 1732822 - RNA, 17 nt, Salmonella enterica enterica serovar Typhi Ty2
ucaccaccgcaggcagc

SEQ ID NO: 1732823 - RNA, 13 nt, Salmonella enterica enterica serovar Typhi Ty2
ucaccaucuucac

SEQ ID NO: 1732824 - RNA, 13 nt, Salmonella enterica enterica serovar Typhi Ty2
ucaccaugacgca

SEQ ID NO: 1732825 - RNA, 14 nt, Salmonella enterica enterica serovar Typhi Ty2
ucacccacaucagc

SEQ ID NO: 1732826 - RNA, 17 nt, Salmonella enterica enterica serovar Typhi Ty2
ucaacgcgcugcagcuu

SEQ ID NO: 1732827 - RNA, 14 nt, Salmonella enterica enterica serovar Typhi Ty2
ucaacggcaucaau

SEQ ID NO: 1732828 - RNA, 19 nt, Salmonella enterica enterica serovar Typhi Ty2
ucacauaggcguagcuggu

SEQ ID NO: 1732829 - RNA, 14 nt, Salmonella enterica enterica serovar Typhi Ty2
ucacaucaucgcca

SEQ ID NO: 1732830 - RNA, 19 nt, Salmonella enterica enterica serovar Typhi Ty2
uccacggaucgacauuaug

SEQ ID NO: 1732831 - RNA, 19 nt, Salmonella enterica enterica serovar Typhi Ty2
uccacgucgcacgccauca

SEQ ID NO: 1732832 - RNA, 10 nt, Salmonella enterica enterica serovar Typhi Ty2
uccacgguuc

SEQ ID NO: 1732833 - RNA, 21 nt, Salmonella enterica enterica serovar Typhi Ty2
uccacgucauaacgcgcauuc

SEQ ID NO: 1732834 - RNA, 11 nt, Salmonella enterica enterica serovar Typhi Ty2
uccacggcgug

SEQ ID NO: 1732835 - RNA, 17 nt, Salmonella enterica enterica serovar Typhi Ty2
uccagcgcgacgccuuc

SEQ ID NO: 1732836 - RNA, 20 nt, Salmonella enterica enterica serovar Typhi Ty2
uccaggccgucggcgccagc

SEQ ID NO: 1732837 - RNA, 14 nt, Salmonella enterica enterica serovar Typhi Ty2
uccagcgcgccguc

SEQ ID NO: 1732838 - RNA, 15 nt, Salmonella enterica enterica serovar Typhi Ty2
uccagcgcguccagc

SEQ ID NO: 1732839 - RNA, 20 nt, Salmonella enterica enterica serovar Typhi Ty2
uccagcuguuuaagcgccuc

SEQ ID NO: 1732840 - RNA, 20 nt, Salmonella enterica enterica serovar Typhi Ty2
uccaccuuaucaagcgauac

SEQ ID NO: 1732841 - RNA, 15 nt, Salmonella enterica enterica serovar Typhi Ty2
ucaugcccggcaaac

SEQ ID NO: 1732842 - RNA, 18 nt, Salmonella enterica enterica serovar Typhi Ty2
ucaugaucgauccgcauc

SEQ ID NO: 1732843 - RNA, 12 nt, Salmonella enterica enterica serovar Typhi Ty2
ucauggcguaaa

SEQ ID NO: 1732844 - RNA, 21 nt, Salmonella enterica enterica serovar Typhi Ty2
uccaaacuggcugugccaaua

SEQ ID NO: 1732845 - RNA, 17 nt, Salmonella enterica enterica serovar Typhi Ty2
ucauggcuuagcgccag

SEQ ID NO: 1732846 - RNA, 23 nt, Salmonella enterica enterica serovar Typhi Ty2
uccaacagaaggcuucacgccac

SEQ ID NO: 1732847 - RNA, 16 nt, Salmonella enterica enterica serovar Typhi Ty2
uccaacuguacgccac

SEQ ID NO: 1732848 - RNA, 17 nt, Salmonella enterica enterica serovar Typhi Ty2
ucaucgcuugcccagca

SEQ ID NO: 1732849 - RNA, 22 nt, Salmonella enterica enterica serovar Typhi Ty2
ucaucgcggaaagcaaugucgc

SEQ ID NO: 1732850 - RNA, 18 nt, Salmonella enterica enterica serovar Typhi Ty2
ucaucgcggccagcaugg

SEQ ID NO: 1732851 - RNA, 15 nt, Salmonella enterica enterica serovar Typhi Ty2
ucauccggcaagcgc

SEQ ID NO: 1732852 - RNA, 22 nt, Salmonella enterica enterica serovar Typhi Ty2
ucauccgcugugggucaauggc

SEQ ID NO: 1732853 - RNA, 19 nt, Salmonella enterica enterica serovar Typhi Ty2
ucauccgcccggcaucaag

SEQ ID NO: 1732854 - RNA, 18 nt, Salmonella enterica enterica serovar Typhi Ty2
ucauccgccaaaacaucu

SEQ ID NO: 1732855 - RNA, 18 nt, Salmonella enterica enterica serovar Typhi Ty2
ucaucacgaucgagucag

SEQ ID NO: 1732856 - RNA, 23 nt, Salmonella enterica enterica serovar Typhi Ty2
ucaucaccagcagcagaaucagg

SEQ ID NO: 1732857 - RNA, 13 nt, Salmonella enterica enterica serovar Typhi Ty2
ucaucaaguaccg

SEQ ID NO: 1732858 - RNA, 17 nt, Salmonella enterica enterica serovar Typhi Ty2
ucauauugcccaucgcg

SEQ ID NO: 1732859 - RNA, 22 nt, Salmonella enterica enterica serovar Typhi Ty2
ucaguucgccacgaucggcaau

SEQ ID NO: 1732860 - RNA, 17 nt, Salmonella enterica enterica serovar Typhi Ty2
ucaguucauagccgugg

SEQ ID NO: 1732861 - RNA, 15 nt, Salmonella enterica enterica serovar Typhi Ty2
ucaguucagaaacgg

SEQ ID NO: 1732862 - RNA, 21 nt, Salmonella enterica enterica serovar Typhi Ty2
ucaguggaaaacagcauaaua

SEQ ID NO: 1732863 - RNA, 13 nt, Salmonella enterica enterica serovar Typhi Ty2
ucaguaagcguac

SEQ ID NO: 1732864 - RNA, 19 nt, Salmonella enterica enterica serovar Typhi Ty2
ucaguccccacauuacgcc

SEQ ID NO: 1732865 - RNA, 16 nt, Salmonella enterica enterica serovar Typhi Ty2
ucaggcgcgcgcugug

SEQ ID NO: 1732866 - RNA, 12 nt, Salmonella enterica enterica serovar Typhi Ty2
ucaggcgugaug

SEQ ID NO: 1732867 - RNA, 14 nt, Salmonella enterica enterica serovar Typhi Ty2
ucaggcucaucagc

SEQ ID NO: 1732868 - RNA, 18 nt, Salmonella enterica enterica serovar Typhi Ty2
ucaggcguuagccgccau

SEQ ID NO: 1732869 - RNA, 17 nt, Salmonella enterica enterica serovar Typhi Ty2
ucaggccuaccaucgcg

SEQ ID NO: 1732870 - RNA, 21 nt, Salmonella enterica enterica serovar Typhi Ty2
ucaggccgccgcaaaagccgg

SEQ ID NO: 1732871 - RNA, 20 nt, Salmonella enterica enterica serovar Typhi Ty2
ucaggccgacaaaugacguc

SEQ ID NO: 1732872 - RNA, 23 nt, Salmonella enterica enterica serovar Typhi Ty2
ucagcggcugacacucauccaga

SEQ ID NO: 1732873 - RNA, 17 nt, Salmonella enterica enterica serovar Typhi Ty2
ucagggcggaacagcgg

SEQ ID NO: 1732874 - RNA, 22 nt, Salmonella enterica enterica serovar Typhi Ty2
ucaggguuuucuaccgcagccu

SEQ ID NO: 1732875 - RNA, 14 nt, Salmonella enterica enterica serovar Typhi Ty2
ucagggaaagccag

SEQ ID NO: 1732876 - RNA, 16 nt, Salmonella enterica enterica serovar Typhi Ty2
ucaggcuuugcgccau

SEQ ID NO: 1732877 - RNA, 14 nt, Salmonella enterica enterica serovar Typhi Ty2
uaccgauagcgcgg

SEQ ID NO: 1732878 - RNA, 15 nt, Salmonella enterica enterica serovar Typhi Ty2
uaccgaugacggcaa

SEQ ID NO: 1732879 - RNA, 23 nt, Salmonella enterica enterica serovar Typhi Ty2
uaccgcaauacgcuucauauccg

SEQ ID NO: 1732880 - RNA, 22 nt, Salmonella enterica enterica serovar Typhi Ty2
uaccgaaggcgcuuuuggcguc

SEQ ID NO: 1732881 - RNA, 13 nt, Salmonella enterica enterica serovar Typhi Ty2
uacccgguaauac

SEQ ID NO: 1732882 - RNA, 12 nt, Salmonella enterica enterica serovar Typhi Ty2
uacccuuccagu

SEQ ID NO: 1732883 - RNA, 17 nt, Salmonella enterica enterica serovar Typhi Ty2
uacccgcccagaucagg

SEQ ID NO: 1732884 - RNA, 16 nt, Salmonella enterica enterica serovar Typhi Ty2
uacccgauaccgccag

SEQ ID NO: 1732885 - RNA, 22 nt, Salmonella enterica enterica serovar Typhi Ty2
uacccccaaccguuucgccagu

SEQ ID NO: 1732886 - RNA, 22 nt, Salmonella enterica enterica serovar Typhi Ty2
uacccaguagcagacagccgau

SEQ ID NO: 1732887 - RNA, 16 nt, Salmonella enterica enterica serovar Typhi Ty2
uacccaguuuuaagcg

SEQ ID NO: 1732888 - RNA, 17 nt, Salmonella enterica enterica serovar Typhi Ty2
uaauuuugccaucgcgc

SEQ ID NO: 1732889 - RNA, 17 nt, Salmonella enterica enterica serovar Typhi Ty2
uaccgucgccgacaacg

SEQ ID NO: 1732890 - RNA, 14 nt, Salmonella enterica enterica serovar Typhi Ty2
uaccguaaaaugcu

SEQ ID NO: 1732891 - RNA, 13 nt, Salmonella enterica enterica serovar Typhi Ty2
uaccgggcagcau

SEQ ID NO: 1732892 - RNA, 13 nt, Salmonella enterica enterica serovar Typhi Ty2
uaccgccaaucaa

SEQ ID NO: 1732893 - RNA, 19 nt, Salmonella enterica enterica serovar Typhi Ty2
uaccgcccagaacggcagc

SEQ ID NO: 1732894 - RNA, 14 nt, Salmonella enterica enterica serovar Typhi Ty2
uaccgcuuuaucau

SEQ ID NO: 1732895 - RNA, 18 nt, Salmonella enterica enterica serovar Typhi Ty2
uaccgcuacgcaggccau

SEQ ID NO: 1732896 - RNA, 13 nt, Salmonella enterica enterica serovar Typhi Ty2
uaccggcaaccgg

SEQ ID NO: 1732897 - RNA, 18 nt, Salmonella enterica enterica serovar Typhi Ty2
uaccgcuucgcgcgccag

SEQ ID NO: 1732898 - RNA, 22 nt, Salmonella enterica enterica serovar Typhi Ty2
uacgccaugcaucaauggcguc

SEQ ID NO: 1732899 - RNA, 22 nt, Salmonella enterica enterica serovar Typhi Ty2
uacgcccaggucgcccagccau

SEQ ID NO: 1732900 - RNA, 18 nt, Salmonella enterica enterica serovar Typhi Ty2
uacgcccgugacgccagg

SEQ ID NO: 1732901 - RNA, 15 nt, Salmonella enterica enterica serovar Typhi Ty2
uacgcccucaucggc

SEQ ID NO: 1732902 - RNA, 16 nt, Salmonella enterica enterica serovar Typhi Ty2
uacgccgccauccggc

SEQ ID NO: 1732903 - RNA, 13 nt, Salmonella enterica enterica serovar Typhi Ty2
uacgccugucgcg

SEQ ID NO: 1732904 - RNA, 23 nt, Salmonella enterica enterica serovar Typhi Ty2
uacgcuuauagguguaaaccguu

SEQ ID NO: 1732905 - RNA, 14 nt, Salmonella enterica enterica serovar Typhi Ty2
uacgcuuaucaggc

SEQ ID NO: 1732906 - RNA, 19 nt, Salmonella enterica enterica serovar Typhi Ty2
uacgcugcuauccggcaac

SEQ ID NO: 1732907 - RNA, 18 nt, Salmonella enterica enterica serovar Typhi Ty2
uaccuacaccaacggcga

SEQ ID NO: 1732908 - RNA, 13 nt, Salmonella enterica enterica serovar Typhi Ty2
uaccucgccgacg

SEQ ID NO: 1732909 - RNA, 13 nt, Salmonella enterica enterica serovar Typhi Ty2
uaccuggaaccag

SEQ ID NO: 1732910 - RNA, 19 nt, Salmonella enterica enterica serovar Typhi Ty2
uaccugcaaaaacgccaga

SEQ ID NO: 1732911 - RNA, 12 nt, Salmonella enterica enterica serovar Typhi Ty2
uagaugcgucgc

SEQ ID NO: 1732912 - RNA, 14 nt, Salmonella enterica enterica serovar Typhi Ty2
uagcauaaaugcga

SEQ ID NO: 1732913 - RNA, 20 nt, Salmonella enterica enterica serovar Typhi Ty2
uagcaucccgcaggcggcga

SEQ ID NO: 1732914 - RNA, 17 nt, Salmonella enterica enterica serovar Typhi Ty2
uagcccggcaggcuggu

SEQ ID NO: 1732915 - RNA, 13 nt, Salmonella enterica enterica serovar Typhi Ty2
uagcccacaggua

SEQ ID NO: 1732916 - RNA, 15 nt, Salmonella enterica enterica serovar Typhi Ty2
uagccacagcgguua

SEQ ID NO: 1732917 - RNA, 16 nt, Salmonella enterica enterica serovar Typhi Ty2
uagccacucacggcaa

SEQ ID NO: 1732918 - RNA, 12 nt, Salmonella enterica enterica serovar Typhi Ty2
uagccagaacgu

SEQ ID NO: 1732919 - RNA, 18 nt, Salmonella enterica enterica serovar Typhi Ty2
uagcgcgcccaugccgcc

SEQ ID NO: 1732920 - RNA, 22 nt, Salmonella enterica enterica serovar Typhi Ty2
uagcgcgaaugauuuuacgguc

SEQ ID NO: 1732921 - RNA, 13 nt, Salmonella enterica enterica serovar Typhi Ty2
uagcgucaacgcu

SEQ ID NO: 1732922 - RNA, 13 nt, Salmonella enterica enterica serovar Typhi Ty2
uagcgucccggca

SEQ ID NO: 1732923 - RNA, 21 nt, Salmonella enterica enterica serovar Typhi Ty2
uagcgaggcagcaggaucucc

SEQ ID NO: 1732924 - RNA, 13 nt, Salmonella enterica enterica serovar Typhi Ty2
uagccggcgauag

SEQ ID NO: 1732925 - RNA, 15 nt, Salmonella enterica enterica serovar Typhi Ty2
uagagcaucgcggca

SEQ ID NO: 1732926 - RNA, 18 nt, Salmonella enterica enterica serovar Typhi Ty2
uagaaugcuucuucgcca

SEQ ID NO: 1732927 - RNA, 24 nt, Salmonella enterica enterica serovar Typhi Ty2
uagacggccugcaaacgaaucacc

SEQ ID NO: 1732928 - RNA, 15 nt, Salmonella enterica enterica serovar Typhi Ty2
uagacucgcggguuu

SEQ ID NO: 1732929 - RNA, 17 nt, Salmonella enterica enterica serovar Typhi Ty2
uacgcuucguugccccg

SEQ ID NO: 1732930 - RNA, 15 nt, Salmonella enterica enterica serovar Typhi Ty2
uacgcuucucuccau

SEQ ID NO: 1732931 - RNA, 19 nt, Salmonella enterica enterica serovar Typhi Ty2
uacgcuuuauucugucgcc

SEQ ID NO: 1732932 - RNA, 19 nt, Salmonella enterica enterica serovar Typhi Ty2
uacgcuuaucaggccuaca

SEQ ID NO: 1732933 - RNA, 18 nt, Salmonella enterica enterica serovar Typhi Ty2
uacgcuuauucggucuga

SEQ ID NO: 1732934 - RNA, 23 nt, Salmonella enterica enterica serovar Typhi Ty2
uacggacguggggguucaagucc

SEQ ID NO: 1732935 - RNA, 17 nt, Salmonella enterica enterica serovar Typhi Ty2
uacuauuuuucacccua

SEQ ID NO: 1732936 - RNA, 11 nt, Salmonella enterica enterica serovar Typhi Ty2
uacuuaucggc

SEQ ID NO: 1732937 - RNA, 22 nt, Salmonella enterica enterica serovar Typhi Ty2
uacuucgcucucuuuuggcgac

SEQ ID NO: 1732938 - RNA, 17 nt, Salmonella enterica enterica serovar Typhi Ty2
uacuggagcucgcgaug

SEQ ID NO: 1732939 - RNA, 21 nt, Salmonella enterica enterica serovar Typhi Ty2
uauauaacauauagcagcagu

SEQ ID NO: 1732940 - RNA, 20 nt, Salmonella enterica enterica serovar Typhi Ty2
uauaggccugauaaacguag

SEQ ID NO: 1732941 - RNA, 11 nt, Salmonella enterica enterica serovar Typhi Ty2
uauagcgccau

SEQ ID NO: 1732942 - RNA, 15 nt, Salmonella enterica enterica serovar Typhi Ty2
uauaggcauguuccu

SEQ ID NO: 1732943 - RNA, 14 nt, Salmonella enterica enterica serovar Typhi Ty2
uauaaguacgccug

SEQ ID NO: 1732944 - RNA, 16 nt, Salmonella enterica enterica serovar Typhi Ty2
uauaaggucgauaucg

SEQ ID NO: 1732945 - RNA, 19 nt, Salmonella enterica enterica serovar Typhi Ty2
uaucaauguauuguucaug

SEQ ID NO: 1732946 - RNA, 23 nt, Salmonella enterica enterica serovar Typhi Ty2
uaucaaacugaaaaucaaauaag

SEQ ID NO: 1732947 - RNA, 18 nt, Salmonella enterica enterica serovar Typhi Ty2
uaucaaaaaaaaccagau

SEQ ID NO: 1732948 - RNA, 13 nt, Salmonella enterica enterica serovar Typhi Ty2
uauccagauagcg

SEQ ID NO: 1732949 - RNA, 15 nt, Salmonella enterica enterica serovar Typhi Ty2
uauccuggcagucca

SEQ ID NO: 1732950 - RNA, 13 nt, Salmonella enterica enterica serovar Typhi Ty2
uauccuggcgaga

SEQ ID NO: 1732951 - RNA, 13 nt, Salmonella enterica enterica serovar Typhi Ty2
uaucgaagcccag

SEQ ID NO: 1732952 - RNA, 20 nt, Salmonella enterica enterica serovar Typhi Ty2
uaucaugaaugccccagcgc

SEQ ID NO: 1732953 - RNA, 14 nt, Salmonella enterica enterica serovar Typhi Ty2
uauccacagcgaau

SEQ ID NO: 1732954 - RNA, 21 nt, Salmonella enterica enterica serovar Typhi Ty2
uaguaaccccaguagcccuga

SEQ ID NO: 1732955 - RNA, 18 nt, Salmonella enterica enterica serovar Typhi Ty2
uagcuuaucgggccuacc

SEQ ID NO: 1732956 - RNA, 15 nt, Salmonella enterica enterica serovar Typhi Ty2
uagcuuagcugcgca

SEQ ID NO: 1732957 - RNA, 15 nt, Salmonella enterica enterica serovar Typhi Ty2
uagcuggcaagaccg

SEQ ID NO: 1732958 - RNA, 22 nt, Salmonella enterica enterica serovar Typhi Ty2
uaguugucggcggucgcggcaa

SEQ ID NO: 1732959 - RNA, 13 nt, Salmonella enterica enterica serovar Typhi Ty2
uagucguugcgcc

SEQ ID NO: 1732960 - RNA, 20 nt, Salmonella enterica enterica serovar Typhi Ty2
uagucugauugccggaugac

SEQ ID NO: 1732961 - RNA, 21 nt, Salmonella enterica enterica serovar Typhi Ty2
uagucgucaugauuaugcgaa

SEQ ID NO: 1732962 - RNA, 22 nt, Salmonella enterica enterica serovar Typhi Ty2
uaguccuuaccccugcggcuga

SEQ ID NO: 1732963 - RNA, 16 nt, Salmonella enterica enterica serovar Typhi Ty2
uagucgauccccaacg

SEQ ID NO: 1732964 - RNA, 15 nt, Salmonella enterica enterica serovar Typhi Ty2
uaguccagcagccau

SEQ ID NO: 1732965 - RNA, 22 nt, Salmonella enterica enterica serovar Typhi Ty2
ucaacaucagcgcuaccagcgc

SEQ ID NO: 1732966 - RNA, 21 nt, Salmonella enterica enterica serovar Typhi Ty2
ucaacauacgccgccagccac

SEQ ID NO: 1732967 - RNA, 19 nt, Salmonella enterica enterica serovar Typhi Ty2
ucaacagggguuccggcaa

SEQ ID NO: 1732968 - RNA, 19 nt, Salmonella enterica enterica serovar Typhi Ty2
ucaaccaccaaaaagccac

SEQ ID NO: 1732969 - RNA, 16 nt, Salmonella enterica enterica serovar Typhi Ty2
ucaaccaaugcaacgc

SEQ ID NO: 1732970 - RNA, 21 nt, Salmonella enterica enterica serovar Typhi Ty2
ucaaccacaaguuuauccagc

SEQ ID NO: 1732971 - RNA, 21 nt, Salmonella enterica enterica serovar Typhi Ty2
ucaacagcgugagcugucgcu

SEQ ID NO: 1732972 - RNA, 16 nt, Salmonella enterica enterica serovar Typhi Ty2
uauuuauaucaggcaa

SEQ ID NO: 1732973 - RNA, 21 nt, Salmonella enterica enterica serovar Typhi Ty2
uauugauaccuuuaaccucuu

SEQ ID NO: 1732974 - RNA, 14 nt, Salmonella enterica enterica serovar Typhi Ty2
uauuucgccuauca

SEQ ID NO: 1732975 - RNA, 14 nt, Salmonella enterica enterica serovar Typhi Ty2
uauuuuccaucacg

SEQ ID NO: 1732976 - RNA, 13 nt, Salmonella enterica enterica serovar Typhi Ty2
uauuuuucacaca

SEQ ID NO: 1732977 - RNA, 21 nt, Salmonella enterica enterica serovar Typhi Ty2
uaugugccgaugaacgacgcu

SEQ ID NO: 1732978 - RNA, 19 nt, Salmonella enterica enterica serovar Typhi Ty2
uauucacuuuccgaaucag

SEQ ID NO: 1732979 - RNA, 14 nt, Salmonella enterica enterica serovar Typhi Ty2
uaugggauaacgca

SEQ ID NO: 1732980 - RNA, 15 nt, Salmonella enterica enterica serovar Typhi Ty2
uauggcacaucaggc

SEQ ID NO: 1732981 - RNA, 16 nt, Salmonella enterica enterica serovar Typhi Ty2
uauuccggcgacgcuu

SEQ ID NO: 1732982 - RNA, 13 nt, Salmonella enterica enterica serovar Typhi Ty2
uauuccgcaaacg

SEQ ID NO: 1732983 - RNA, 11 nt, Salmonella enterica enterica serovar Typhi Ty2
uauucccggcc

SEQ ID NO: 1732984 - RNA, 16 nt, Salmonella enterica enterica serovar Typhi Ty2
uauucauuucaaugua

SEQ ID NO: 1732985 - RNA, 12 nt, Salmonella enterica enterica serovar Typhi Ty2
uauucaucgccg

SEQ ID NO: 1732986 - RNA, 15 nt, Salmonella enterica enterica serovar Typhi Ty2
uauucaccgcucacc

SEQ ID NO: 1732987 - RNA, 14 nt, Salmonella enterica enterica serovar Typhi Ty2
uauucaucgauacg

SEQ ID NO: 1732988 - RNA, 20 nt, Salmonella enterica enterica serovar Typhi Ty2
uauuccuuguccgaugcaga

SEQ ID NO: 1732989 - RNA, 22 nt, Salmonella enterica enterica serovar Typhi Ty2
uauucgguagcuguaccagauc

SEQ ID NO: 1732990 - RNA, 13 nt, Salmonella enterica enterica serovar Typhi Ty2
uauucucgccgua

SEQ ID NO: 1732991 - RNA, 19 nt, Salmonella enterica enterica serovar Typhi Ty2
uaucgccguucaaacggua

SEQ ID NO: 1732992 - RNA, 17 nt, Salmonella enterica enterica serovar Typhi Ty2
uaucgcugucggucaga

SEQ ID NO: 1732993 - RNA, 17 nt, Salmonella enterica enterica serovar Typhi Ty2
uaucgccaagcgguaag

SEQ ID NO: 1732994 - RNA, 14 nt, Salmonella enterica enterica serovar Typhi Ty2
uaucgccauuauuc

SEQ ID NO: 1732995 - RNA, 23 nt, Salmonella enterica enterica serovar Typhi Ty2
uaucgauaaucaacaaugucgcc

SEQ ID NO: 1732996 - RNA, 23 nt, Salmonella enterica enterica serovar Typhi Ty2
uaucgaguggagcggucgacagc

SEQ ID NO: 1732997 - RNA, 21 nt, Salmonella enterica enterica serovar Typhi Ty2
uaucgacucucccggcgccca

SEQ ID NO: 1732998 - RNA, 16 nt, Salmonella enterica enterica serovar Typhi Ty2
uaugcggcgcuuccag

SEQ ID NO: 1732999 - RNA, 18 nt, Salmonella enterica enterica serovar Typhi Ty2
uaugcgauuucgucaaac

SEQ ID NO: 1733000 - RNA, 19 nt, Salmonella enterica enterica serovar Typhi Ty2
uaugcgccuucuucgcaau

SEQ ID NO: 1733001 - RNA, 20 nt, Salmonella enterica enterica serovar Typhi Ty2
uaugccgccauccggcaaac

SEQ ID NO: 1733002 - RNA, 17 nt, Salmonella enterica enterica serovar Typhi Ty2
uaucggaaguauacauc

SEQ ID NO: 1733003 - RNA, 16 nt, Salmonella enterica enterica serovar Typhi Ty2
uaucgcuuggcguuaa

SEQ ID NO: 1733004 - RNA, 13 nt, Salmonella enterica enterica serovar Typhi Ty2
uaucggagauaac

SEQ ID NO: 1733005 - RNA, 22 nt, Salmonella enterica enterica serovar Typhi Ty2
ugauaauaugcucaacuuccag

SEQ ID NO: 1733006 - RNA, 15 nt, Salmonella enterica enterica serovar Typhi Ty2
ugauaaucaauggcc

SEQ ID NO: 1733007 - RNA, 14 nt, Salmonella enterica enterica serovar Typhi Ty2
ugauaauaugcuca

SEQ ID NO: 1733008 - RNA, 21 nt, Salmonella enterica enterica serovar Typhi Ty2
ugauaacgauaagugaagcgu

SEQ ID NO: 1733009 - RNA, 15 nt, Salmonella enterica enterica serovar Typhi Ty2
ugauaccccagcgau

SEQ ID NO: 1733010 - RNA, 19 nt, Salmonella enterica enterica serovar Typhi Ty2
ugauacaugcuacaggcaa

SEQ ID NO: 1733011 - RNA, 14 nt, Salmonella enterica enterica serovar Typhi Ty2
ugauacagcagcac

SEQ ID NO: 1733012 - RNA, 18 nt, Salmonella enterica enterica serovar Typhi Ty2
ugauaaaacgcaggcagu

SEQ ID NO: 1733013 - RNA, 16 nt, Salmonella enterica enterica serovar Typhi Ty2
ugauaaagcuuucauc

SEQ ID NO: 1733014 - RNA, 17 nt, Salmonella enterica enterica serovar Typhi Ty2
ugaggccguuauuguca

SEQ ID NO: 1733015 - RNA, 21 nt, Salmonella enterica enterica serovar Typhi Ty2
ugacucacauaacaaaaccag

SEQ ID NO: 1733016 - RNA, 16 nt, Salmonella enterica enterica serovar Typhi Ty2
ugacguugcgaaucag

SEQ ID NO: 1733017 - RNA, 23 nt, Salmonella enterica enterica serovar Typhi Ty2
ugagcgcgccaugagacgcguaa

SEQ ID NO: 1733018 - RNA, 13 nt, Salmonella enterica enterica serovar Typhi Ty2
ugaucgcgcagac

SEQ ID NO: 1733019 - RNA, 14 nt, Salmonella enterica enterica serovar Typhi Ty2
ugaucgccgccauc

SEQ ID NO: 1733020 - RNA, 23 nt, Salmonella enterica enterica serovar Typhi Ty2
ugaucagacgcacaaucgccgug

SEQ ID NO: 1733021 - RNA, 18 nt, Salmonella enterica enterica serovar Typhi Ty2
ugaugacuaaaucagcau

SEQ ID NO: 1733022 - RNA, 13 nt, Salmonella enterica enterica serovar Typhi Ty2
ugaugagcgccau

SEQ ID NO: 1733023 - RNA, 19 nt, Salmonella enterica enterica serovar Typhi Ty2
ugaugaacaugcccggaug

SEQ ID NO: 1733024 - RNA, 17 nt, Salmonella enterica enterica serovar Typhi Ty2
ugaucguaggcggcgga

SEQ ID NO: 1733025 - RNA, 13 nt, Salmonella enterica enterica serovar Typhi Ty2
ugaucggcuggcg

SEQ ID NO: 1733026 - RNA, 23 nt, Salmonella enterica enterica serovar Typhi Ty2
ugaucggcuggcgcaacuggcgc

SEQ ID NO: 1733027 - RNA, 17 nt, Salmonella enterica enterica serovar Typhi Ty2
ugaucgucgcgaucgcg

SEQ ID NO: 1733028 - RNA, 12 nt, Salmonella enterica enterica serovar Typhi Ty2
ugaucugcacaa

SEQ ID NO: 1733029 - RNA, 15 nt, Salmonella enterica enterica serovar Typhi Ty2
ugaccgaagcaggcg

SEQ ID NO: 1733030 - RNA, 22 nt, Salmonella enterica enterica serovar Typhi Ty2
ugaccgauauagccacucacgg

SEQ ID NO: 1733031 - RNA, 12 nt, Salmonella enterica enterica serovar Typhi Ty2
ugacgaaaagau

SEQ ID NO: 1733032 - RNA, 17 nt, Salmonella enterica enterica serovar Typhi Ty2
ugaccgugccggauggc

SEQ ID NO: 1733033 - RNA, 14 nt, Salmonella enterica enterica serovar Typhi Ty2
ugacgccaggcaga

SEQ ID NO: 1733034 - RNA, 14 nt, Salmonella enterica enterica serovar Typhi Ty2
ugacgcccaucagc

SEQ ID NO: 1733035 - RNA, 18 nt, Salmonella enterica enterica serovar Typhi Ty2
ugacgccaagcugcagaa

SEQ ID NO: 1733036 - RNA, 16 nt, Salmonella enterica enterica serovar Typhi Ty2
ugacgaggccuguccc

SEQ ID NO: 1733037 - RNA, 17 nt, Salmonella enterica enterica serovar Typhi Ty2
ugacgagguuaucaggc

SEQ ID NO: 1733038 - RNA, 12 nt, Salmonella enterica enterica serovar Typhi Ty2
ugacgcgcauac

SEQ ID NO: 1733039 - RNA, 15 nt, Salmonella enterica enterica serovar Typhi Ty2
ugacggccaccagcg

SEQ ID NO: 1733040 - RNA, 21 nt, Salmonella enterica enterica serovar Typhi Ty2
ugacgggcauuguuaauccag

SEQ ID NO: 1733041 - RNA, 13 nt, Salmonella enterica enterica serovar Typhi Ty2
ugcaggaagggca

SEQ ID NO: 1733042 - RNA, 18 nt, Salmonella enterica enterica serovar Typhi Ty2
ugcagcgugaaaagcuua

SEQ ID NO: 1733043 - RNA, 22 nt, Salmonella enterica enterica serovar Typhi Ty2
ugcaggagcucggccaucuggc

SEQ ID NO: 1733044 - RNA, 22 nt, Salmonella enterica enterica serovar Typhi Ty2
ugcaggaggcgcguuuacuggc

SEQ ID NO: 1733045 - RNA, 22 nt, Salmonella enterica enterica serovar Typhi Ty2
ugcagcgcguccaauagccccu

SEQ ID NO: 1733046 - RNA, 16 nt, Salmonella enterica enterica serovar Typhi Ty2
ugcagcggcagugaug

SEQ ID NO: 1733047 - RNA, 14 nt, Salmonella enterica enterica serovar Typhi Ty2
ugcagauaccagcg

SEQ ID NO: 1733048 - RNA, 20 nt, Salmonella enterica enterica serovar Typhi Ty2
ugcagagcggcaaauucagc

SEQ ID NO: 1733049 - RNA, 15 nt, Salmonella enterica enterica serovar Typhi Ty2
ugcagauauugcgga

SEQ ID NO: 1733050 - RNA, 20 nt, Salmonella enterica enterica serovar Typhi Ty2
ugcagauccgcgauaucaau

SEQ ID NO: 1733051 - RNA, 18 nt, Salmonella enterica enterica serovar Typhi Ty2
ugcagcaaauaaucguag

SEQ ID NO: 1733052 - RNA, 17 nt, Salmonella enterica enterica serovar Typhi Ty2
ugcacgguugaagcgac

SEQ ID NO: 1733053 - RNA, 23 nt, Salmonella enterica enterica serovar Typhi Ty2
ugcacuggucaucgaaggcaucu

SEQ ID NO: 1733054 - RNA, 18 nt, Salmonella enterica enterica serovar Typhi Ty2
ugcacgcuguuucucgau

SEQ ID NO: 1733055 - RNA, 19 nt, Salmonella enterica enterica serovar Typhi Ty2
ugcacauucagguggcuga

SEQ ID NO: 1733056 - RNA, 19 nt, Salmonella enterica enterica serovar Typhi Ty2
ugcaccagaacucccuguu

SEQ ID NO: 1733057 - RNA, 13 nt, Salmonella enterica enterica serovar Typhi Ty2
ugauggcgcgcca

SEQ ID NO: 1733058 - RNA, 17 nt, Salmonella enterica enterica serovar Typhi Ty2
ugauggcguagcgccau

SEQ ID NO: 1733059 - RNA, 21 nt, Salmonella enterica enterica serovar Typhi Ty2
ugauggcuggcgucgccaaag

SEQ ID NO: 1733060 - RNA, 19 nt, Salmonella enterica enterica serovar Typhi Ty2
ugauggcguagcgccauca

SEQ ID NO: 1733061 - RNA, 14 nt, Salmonella enterica enterica serovar Typhi Ty2
ugaugggcaaugcc

SEQ ID NO: 1733062 - RNA, 15 nt, Salmonella enterica enterica serovar Typhi Ty2
ugauggcgaacagcc

SEQ ID NO: 1733063 - RNA, 22 nt, Salmonella enterica enterica serovar Typhi Ty2
ugcccaucugacgugcgauagc

SEQ ID NO: 1733064 - RNA, 18 nt, Salmonella enterica enterica serovar Typhi Ty2
ugcccaucauucaacgca

SEQ ID NO: 1733065 - RNA, 16 nt, Salmonella enterica enterica serovar Typhi Ty2
ugcccgauggcgcugc

SEQ ID NO: 1733066 - RNA, 16 nt, Salmonella enterica enterica serovar Typhi Ty2
ugcccgguggcgcugc

SEQ ID NO: 1733067 - RNA, 15 nt, Salmonella enterica enterica serovar Typhi Ty2
ugccaucuccugcga

SEQ ID NO: 1733068 - RNA, 17 nt, Salmonella enterica enterica serovar Typhi Ty2
ugccaucuccugcgaua

SEQ ID NO: 1733069 - RNA, 16 nt, Salmonella enterica enterica serovar Typhi Ty2
ugccaugaguaaugac

SEQ ID NO: 1733070 - RNA, 22 nt, Salmonella enterica enterica serovar Typhi Ty2
ugcccagcgcgaccugcauccc

SEQ ID NO: 1733071 - RNA, 20 nt, Salmonella enterica enterica serovar Typhi Ty2
ugcauaaagauuggcaucug

SEQ ID NO: 1733072 - RNA, 22 nt, Salmonella enterica enterica serovar Typhi Ty2
ugcauaaaauccugguaacggc

SEQ ID NO: 1733073 - RNA, 18 nt, Salmonella enterica enterica serovar Typhi Ty2
ugcauaaaggaguaacag

SEQ ID NO: 1733074 - RNA, 14 nt, Salmonella enterica enterica serovar Typhi Ty2
ugcaguuccgcaau

SEQ ID NO: 1733075 - RNA, 21 nt, Salmonella enterica enterica serovar Typhi Ty2
ucugcgcaggaggcuuccgcg

SEQ ID NO: 1733076 - RNA, 21 nt, Salmonella enterica enterica serovar Typhi Ty2
ucuuaccggugcgauucagcg

SEQ ID NO: 1733077 - RNA, 22 nt, Salmonella enterica enterica serovar Typhi Ty2
ucuucaacgugcaucuccucgc

SEQ ID NO: 1733078 - RNA, 17 nt, Salmonella enterica enterica serovar Typhi Ty2
ucuucaauggcgccgug

SEQ ID NO: 1733079 - RNA, 21 nt, Salmonella enterica enterica serovar Typhi Ty2
ucuuauccgcuuuuaaacggc

SEQ ID NO: 1733080 - RNA, 15 nt, Salmonella enterica enterica serovar Typhi Ty2
ucuucguguaacgca

SEQ ID NO: 1733081 - RNA, 19 nt, Salmonella enterica enterica serovar Typhi Ty2
ucuucuccagaucgcauaa

SEQ ID NO: 1733082 - RNA, 11 nt, Salmonella enterica enterica serovar Typhi Ty2
ucuugcgcagc

SEQ ID NO: 1733083 - RNA, 14 nt, Salmonella enterica enterica serovar Typhi Ty2
ucuucacgacgcuc

SEQ ID NO: 1733084 - RNA, 21 nt, Salmonella enterica enterica serovar Typhi Ty2
ucuucauaaauagccagcauc

SEQ ID NO: 1733085 - RNA, 14 nt, Salmonella enterica enterica serovar Typhi Ty2
ucuuccagcaucag

SEQ ID NO: 1733086 - RNA, 14 nt, Salmonella enterica enterica serovar Typhi Ty2
ucuuucaacuuccg

SEQ ID NO: 1733087 - RNA, 17 nt, Salmonella enterica enterica serovar Typhi Ty2
ucuugguaccaaacagc

SEQ ID NO: 1733088 - RNA, 22 nt, Salmonella enterica enterica serovar Typhi Ty2
ucuuucccggcaauuaccgcca

SEQ ID NO: 1733089 - RNA, 15 nt, Salmonella enterica enterica serovar Typhi Ty2
ucuuugaccagcgac

SEQ ID NO: 1733090 - RNA, 12 nt, Salmonella enterica enterica serovar Typhi Ty2
ugaaacucgcca

SEQ ID NO: 1733091 - RNA, 18 nt, Salmonella enterica enterica serovar Typhi Ty2
ugaaauacagccagguug

SEQ ID NO: 1733092 - RNA, 14 nt, Salmonella enterica enterica serovar Typhi Ty2
ugaaagccaucgcu

SEQ ID NO: 1733093 - RNA, 18 nt, Salmonella enterica enterica serovar Typhi Ty2
ugaaaggcuugcaggaug

SEQ ID NO: 1733094 - RNA, 20 nt, Salmonella enterica enterica serovar Typhi Ty2
ugaacgagucuuaccagguc

SEQ ID NO: 1733095 - RNA, 21 nt, Salmonella enterica enterica serovar Typhi Ty2
ugaacgauguaucgcgcggau

SEQ ID NO: 1733096 - RNA, 14 nt, Salmonella enterica enterica serovar Typhi Ty2
ugaacaucuuccag

SEQ ID NO: 1733097 - RNA, 15 nt, Salmonella enterica enterica serovar Typhi Ty2
ugaacauaaagucag

SEQ ID NO: 1733098 - RNA, 12 nt, Salmonella enterica enterica serovar Typhi Ty2
ugaacaggcagc

SEQ ID NO: 1733099 - RNA, 16 nt, Salmonella enterica enterica serovar Typhi Ty2
ugaaauccggcuuuga

SEQ ID NO: 1733100 - RNA, 16 nt, Salmonella enterica enterica serovar Typhi Ty2
ugaaauucgacgggac

SEQ ID NO: 1733101 - RNA, 12 nt, Salmonella enterica enterica serovar Typhi Ty2
ucucgcaggcca

SEQ ID NO: 1733102 - RNA, 22 nt, Salmonella enterica enterica serovar Typhi Ty2
ucucgccauaauuguucagcua

SEQ ID NO: 1733103 - RNA, 12 nt, Salmonella enterica enterica serovar Typhi Ty2
ucucccagcaug

SEQ ID NO: 1733104 - RNA, 18 nt, Salmonella enterica enterica serovar Typhi Ty2
ucucauuuucuuuacgcu

SEQ ID NO: 1733105 - RNA, 19 nt, Salmonella enterica enterica serovar Typhi Ty2
ucucuguccggaauaacuc

SEQ ID NO: 1733106 - RNA, 15 nt, Salmonella enterica enterica serovar Typhi Ty2
ucucugacaggaaug

SEQ ID NO: 1733107 - RNA, 14 nt, Salmonella enterica enterica serovar Typhi Ty2
ucucucauccgcca

SEQ ID NO: 1733108 - RNA, 15 nt, Salmonella enterica enterica serovar Typhi Ty2
ucugaaucuugcgca

SEQ ID NO: 1733109 - RNA, 21 nt, Salmonella enterica enterica serovar Typhi Ty2
ucucuucaugcauaaccgcgc

SEQ ID NO: 1733110 - RNA, 14 nt, Salmonella enterica enterica serovar Typhi Ty2
ucucuugccagcgc

SEQ ID NO: 1733111 - RNA, 14 nt, Salmonella enterica enterica serovar Typhi Ty2
ucucuuccgcgguc

SEQ ID NO: 1733112 - RNA, 14 nt, Salmonella enterica enterica serovar Typhi Ty2
ucugcaggucacga

SEQ ID NO: 1733113 - RNA, 22 nt, Salmonella enterica enterica serovar Typhi Ty2
ucugcagcgagcgcauacgcug

SEQ ID NO: 1733114 - RNA, 19 nt, Salmonella enterica enterica serovar Typhi Ty2
ucugccaguuaucgguaau

SEQ ID NO: 1733115 - RNA, 22 nt, Salmonella enterica enterica serovar Typhi Ty2
ucugccgcgcccgccaucgccc

SEQ ID NO: 1733116 - RNA, 15 nt, Salmonella enterica enterica serovar Typhi Ty2
ucgucgggauaagcg

SEQ ID NO: 1733117 - RNA, 14 nt, Salmonella enterica enterica serovar Typhi Ty2
ucgugauagacggc

SEQ ID NO: 1733118 - RNA, 13 nt, Salmonella enterica enterica serovar Typhi Ty2
ucgugauaacgcg

SEQ ID NO: 1733119 - RNA, 17 nt, Salmonella enterica enterica serovar Typhi Ty2
ucgugauaaagcugacg

SEQ ID NO: 1733120 - RNA, 23 nt, Salmonella enterica enterica serovar Typhi Ty2
ucgguugauguaugaacugcauc

SEQ ID NO: 1733121 - RNA, 21 nt, Salmonella enterica enterica serovar Typhi Ty2
ucgucaaaaccaaacagcgac

SEQ ID NO: 1733122 - RNA, 19 nt, Salmonella enterica enterica serovar Typhi Ty2
ucguauuggggaucgggca

SEQ ID NO: 1733123 - RNA, 12 nt, Salmonella enterica enterica serovar Typhi Ty2
ucgucccagcgc

SEQ ID NO: 1733124 - RNA, 21 nt, Salmonella enterica enterica serovar Typhi Ty2
ucggguacggaauaucccgca

SEQ ID NO: 1733125 - RNA, 23 nt, Salmonella enterica enterica serovar Typhi Ty2
ucgguauaaauuuccgcagccag

SEQ ID NO: 1733126 - RNA, 20 nt, Salmonella enterica enterica serovar Typhi Ty2
ucggucagauaaauaacgcc

SEQ ID NO: 1733127 - RNA, 19 nt, Salmonella enterica enterica serovar Typhi Ty2
ucgggcaggcuuccacgca

SEQ ID NO: 1733128 - RNA, 15 nt, Salmonella enterica enterica serovar Typhi Ty2
ucgggcagaaagugg

SEQ ID NO: 1733129 - RNA, 20 nt, Salmonella enterica enterica serovar Typhi Ty2
ucgggcaacugauaugacgu

SEQ ID NO: 1733130 - RNA, 22 nt, Salmonella enterica enterica serovar Typhi Ty2
ucgggaaguccuucuccuucgc

SEQ ID NO: 1733131 - RNA, 19 nt, Salmonella enterica enterica serovar Typhi Ty2
ucggcuuugacguaauacc

SEQ ID NO: 1733132 - RNA, 16 nt, Salmonella enterica enterica serovar Typhi Ty2
uccgccuggaacccag

SEQ ID NO: 1733133 - RNA, 14 nt, Salmonella enterica enterica serovar Typhi Ty2
uccgcguagcccag

SEQ ID NO: 1733134 - RNA, 20 nt, Salmonella enterica enterica serovar Typhi Ty2
uccgcguauucucaaccagc

SEQ ID NO: 1733135 - RNA, 14 nt, Salmonella enterica enterica serovar Typhi Ty2
uccgacaaccggcu

SEQ ID NO: 1733136 - RNA, 14 nt, Salmonella enterica enterica serovar Typhi Ty2
uccgccccgccuuc

SEQ ID NO: 1733137 - RNA, 13 nt, Salmonella enterica enterica serovar Typhi Ty2
uccgcccgccuuc

SEQ ID NO: 1733138 - RNA, 16 nt, Salmonella enterica enterica serovar Typhi Ty2
ucccugcaacgccugc

SEQ ID NO: 1733139 - RNA, 21 nt, Salmonella enterica enterica serovar Typhi Ty2
uccggguaacggacucaggcc

SEQ ID NO: 1733140 - RNA, 23 nt, Salmonella enterica enterica serovar Typhi Ty2
uccggcggugcagguugccugau

SEQ ID NO: 1733141 - RNA, 17 nt, Salmonella enterica enterica serovar Typhi Ty2
uccggcggucagccagc

SEQ ID NO: 1733142 - RNA, 15 nt, Salmonella enterica enterica serovar Typhi Ty2
uccggcgucgcguuc

SEQ ID NO: 1733143 - RNA, 18 nt, Salmonella enterica enterica serovar Typhi Ty2
uccggccuguaaggucuc

SEQ ID NO: 1733144 - RNA, 23 nt, Salmonella enterica enterica serovar Typhi Ty2
uccggccuaccugagaugaaauc

SEQ ID NO: 1733145 - RNA, 16 nt, Salmonella enterica enterica serovar Typhi Ty2
uccgcguuuaucgcau

SEQ ID NO: 1733146 - RNA, 15 nt, Salmonella enterica enterica serovar Typhi Ty2
uccgcucacgccaac

SEQ ID NO: 1733147 - RNA, 16 nt, Salmonella enterica enterica serovar Typhi Ty2
uccgcuggcguccagc

SEQ ID NO: 1733148 - RNA, 20 nt, Salmonella enterica enterica serovar Typhi Ty2
uccggaugccccaucacggg

SEQ ID NO: 1733149 - RNA, 23 nt, Salmonella enterica enterica serovar Typhi Ty2
uccggcacgauaaauugccugau

SEQ ID NO: 1733150 - RNA, 21 nt, Salmonella enterica enterica serovar Typhi Ty2
uccggcacgccagcgccguug

SEQ ID NO: 1733151 - RNA, 17 nt, Salmonella enterica enterica serovar Typhi Ty2
uccggccagcgccagcg

SEQ ID NO: 1733152 - RNA, 19 nt, Salmonella enterica enterica serovar Typhi Ty2
uccggcaccucguccagau

SEQ ID NO: 1733153 - RNA, 20 nt, Salmonella enterica enterica serovar Typhi Ty2
uccggcacauauuccggcgc

SEQ ID NO: 1733154 - RNA, 19 nt, Salmonella enterica enterica serovar Typhi Ty2
uccggcacauugucagcug

SEQ ID NO: 1733155 - RNA, 21 nt, Salmonella enterica enterica serovar Typhi Ty2
uccggcaagucagaccagucg

SEQ ID NO: 1733156 - RNA, 21 nt, Salmonella enterica enterica serovar Typhi Ty2
uccggauggaacgcauccagc

SEQ ID NO: 1733157 - RNA, 17 nt, Salmonella enterica enterica serovar Typhi Ty2
ucccacgggcgcaccau

SEQ ID NO: 1733158 - RNA, 20 nt, Salmonella enterica enterica serovar Typhi Ty2
uccaggucaucaccuccagc

SEQ ID NO: 1733159 - RNA, 18 nt, Salmonella enterica enterica serovar Typhi Ty2
ucccaggccggcauaaug

SEQ ID NO: 1733160 - RNA, 16 nt, Salmonella enterica enterica serovar Typhi Ty2
ucccagaauccgcgca

SEQ ID NO: 1733161 - RNA, 15 nt, Salmonella enterica enterica serovar Typhi Ty2
ucccagccccacauu

SEQ ID NO: 1733162 - RNA, 16 nt, Salmonella enterica enterica serovar Typhi Ty2
ucccaucguaacgccg

SEQ ID NO: 1733163 - RNA, 17 nt, Salmonella enterica enterica serovar Typhi Ty2
ucccaucguaacgccgu

SEQ ID NO: 1733164 - RNA, 14 nt, Salmonella enterica enterica serovar Typhi Ty2
uccccaaccgccag

SEQ ID NO: 1733165 - RNA, 13 nt, Salmonella enterica enterica serovar Typhi Ty2
ucccauuccugca

SEQ ID NO: 1733166 - RNA, 19 nt, Salmonella enterica enterica serovar Typhi Ty2
uccccaucaggaacaggcg

SEQ ID NO: 1733167 - RNA, 14 nt, Salmonella enterica enterica serovar Typhi Ty2
uccccaucuccaga

SEQ ID NO: 1733168 - RNA, 17 nt, Salmonella enterica enterica serovar Typhi Ty2
uccccagaaugauaaug

SEQ ID NO: 1733169 - RNA, 20 nt, Salmonella enterica enterica serovar Typhi Ty2
uccccagcuaaaaacgccaa

SEQ ID NO: 1733170 - RNA, 17 nt, Salmonella enterica enterica serovar Typhi Ty2
ucccgccucggucagua

SEQ ID NO: 1733171 - RNA, 13 nt, Salmonella enterica enterica serovar Typhi Ty2
ucccgcgccguuc

SEQ ID NO: 1733172 - RNA, 15 nt, Salmonella enterica enterica serovar Typhi Ty2
uccccggcuuccagc

SEQ ID NO: 1733173 - RNA, 11 nt, Salmonella enterica enterica serovar Typhi Ty2
uccccggcaac

SEQ ID NO: 1733174 - RNA, 20 nt, Salmonella enterica enterica serovar Typhi Ty2
uccccggcaggcucaccagc

SEQ ID NO: 1733175 - RNA, 22 nt, Salmonella enterica enterica serovar Typhi Ty2
ucccgcugugauccauguugcc

SEQ ID NO: 1733176 - RNA, 15 nt, Salmonella enterica enterica serovar Typhi Ty2
ucccgcuggcuggcg

SEQ ID NO: 1733177 - RNA, 13 nt, Salmonella enterica enterica serovar Typhi Ty2
ucccgucgucagc

SEQ ID NO: 1733178 - RNA, 15 nt, Salmonella enterica enterica serovar Typhi Ty2
ucccugcaacgccug

SEQ ID NO: 1733179 - RNA, 12 nt, Salmonella enterica enterica serovar Typhi Ty2
ucccucuccagg

SEQ ID NO: 1733180 - RNA, 15 nt, Salmonella enterica enterica serovar Typhi Ty2
uccuuuuuccgccac

SEQ ID NO: 1733181 - RNA, 14 nt, Salmonella enterica enterica serovar Typhi Ty2
uccuugcagccaga

SEQ ID NO: 1733182 - RNA, 21 nt, Salmonella enterica enterica serovar Typhi Ty2
uccuggugcgacaccacgcag

SEQ ID NO: 1733183 - RNA, 23 nt, Salmonella enterica enterica serovar Typhi Ty2
ucgacaugggcgggauccugcaa

SEQ ID NO: 1733184 - RNA, 22 nt, Salmonella enterica enterica serovar Typhi Ty2
ucgacaucuucaccgaugccca

SEQ ID NO: 1733185 - RNA, 17 nt, Salmonella enterica enterica serovar Typhi Ty2
ucgaacagcggcaggcg

SEQ ID NO: 1733186 - RNA, 23 nt, Salmonella enterica enterica serovar Typhi Ty2
uccugaccgggcucacgcuggug

SEQ ID NO: 1733187 - RNA, 20 nt, Salmonella enterica enterica serovar Typhi Ty2
uccugacggugcgcgacgcc

SEQ ID NO: 1733188 - RNA, 17 nt, Salmonella enterica enterica serovar Typhi Ty2
uccugaccaugccacaa

SEQ ID NO: 1733189 - RNA, 15 nt, Salmonella enterica enterica serovar Typhi Ty2
uccugaaucgccguc

SEQ ID NO: 1733190 - RNA, 19 nt, Salmonella enterica enterica serovar Typhi Ty2
uccugaucaaggcgcaaaa

SEQ ID NO: 1733191 - RNA, 17 nt, Salmonella enterica enterica serovar Typhi Ty2
uccugcgcggauaccgg

SEQ ID NO: 1733192 - RNA, 14 nt, Salmonella enterica enterica serovar Typhi Ty2
uccugcgccggacg

SEQ ID NO: 1733193 - RNA, 19 nt, Salmonella enterica enterica serovar Typhi Ty2
uccugcggguucaucgcca

SEQ ID NO: 1733194 - RNA, 21 nt, Salmonella enterica enterica serovar Typhi Ty2
uccugccgaugccgccgcaac

SEQ ID NO: 1733195 - RNA, 22 nt, Salmonella enterica enterica serovar Typhi Ty2
uccguagcggauugccgcgcuc

SEQ ID NO: 1733196 - RNA, 22 nt, Salmonella enterica enterica serovar Typhi Ty2
uccguaggcggcuaccgccgua

SEQ ID NO: 1733197 - RNA, 19 nt, Salmonella enterica enterica serovar Typhi Ty2
uccguaggcggcuaccgcc

SEQ ID NO: 1733198 - RNA, 14 nt, Salmonella enterica enterica serovar Typhi Ty2
uccggucugcgcgc

SEQ ID NO: 1733199 - RNA, 21 nt, Salmonella enterica enterica serovar Typhi Ty2
ucgaccccaaugauccacagg

SEQ ID NO: 1733200 - RNA, 14 nt, Salmonella enterica enterica serovar Typhi Ty2
ucgauaaacucaug

SEQ ID NO: 1733201 - RNA, 20 nt, Salmonella enterica enterica serovar Typhi Ty2
ucgaguucuucacgcugaug

SEQ ID NO: 1733202 - RNA, 21 nt, Salmonella enterica enterica serovar Typhi Ty2
ucgauaaagcgguuaucggca

SEQ ID NO: 1733203 - RNA, 14 nt, Salmonella enterica enterica serovar Typhi Ty2
ucgauaaccgccga

SEQ ID NO: 1733204 - RNA, 17 nt, Salmonella enterica enterica serovar Typhi Ty2
ucgauccccucuuccau

SEQ ID NO: 1733205 - RNA, 20 nt, Salmonella enterica enterica serovar Typhi Ty2
ucgauccgcaucagcaacgc

SEQ ID NO: 1733206 - RNA, 23 nt, Salmonella enterica enterica serovar Typhi Ty2
ucgauccgguuacucgcaucgaa

SEQ ID NO: 1733207 - RNA, 19 nt, Salmonella enterica enterica serovar Typhi Ty2
ucgagcuuuugcugcgcca

SEQ ID NO: 1733208 - RNA, 22 nt, Salmonella enterica enterica serovar Typhi Ty2
ucgaggucagcauuucauccau

SEQ ID NO: 1733209 - RNA, 16 nt, Salmonella enterica enterica serovar Typhi Ty2
ucgagcucaguccagc

SEQ ID NO: 1733210 - RNA, 15 nt, Salmonella enterica enterica serovar Typhi Ty2
ucgagauaaugcuca

SEQ ID NO: 1733211 - RNA, 22 nt, Salmonella enterica enterica serovar Typhi Ty2
ucgccugauauaaucgaaucgc

SEQ ID NO: 1733212 - RNA, 15 nt, Salmonella enterica enterica serovar Typhi Ty2
ucgccuuccagcgac

SEQ ID NO: 1733213 - RNA, 19 nt, Salmonella enterica enterica serovar Typhi Ty2
ucgccuucgcccauaucca

SEQ ID NO: 1733214 - RNA, 21 nt, Salmonella enterica enterica serovar Typhi Ty2
ucgccugucugucgcgggcga

SEQ ID NO: 1733215 - RNA, 14 nt, Salmonella enterica enterica serovar Typhi Ty2
ucgccuucauccgc

SEQ ID NO: 1733216 - RNA, 13 nt, Salmonella enterica enterica serovar Typhi Ty2
ucgcgacagcgcu

SEQ ID NO: 1733217 - RNA, 13 nt, Salmonella enterica enterica serovar Typhi Ty2
ucgcgccagcgac

SEQ ID NO: 1733218 - RNA, 17 nt, Salmonella enterica enterica serovar Typhi Ty2
ucgcgcccuccuccagc

SEQ ID NO: 1733219 - RNA, 18 nt, Salmonella enterica enterica serovar Typhi Ty2
ucgcgauccucauacagc

SEQ ID NO: 1733220 - RNA, 19 nt, Salmonella enterica enterica serovar Typhi Ty2
ucgccgccaucggcgcgua

SEQ ID NO: 1733221 - RNA, 20 nt, Salmonella enterica enterica serovar Typhi Ty2
ucgccggaaagaaacgccgc

SEQ ID NO: 1733222 - RNA, 22 nt, Salmonella enterica enterica serovar Typhi Ty2
ucgccguuaaaccguuaugaau

SEQ ID NO: 1733223 - RNA, 18 nt, Salmonella enterica enterica serovar Typhi Ty2
ucgccguuaacuggcgca

SEQ ID NO: 1733224 - RNA, 16 nt, Salmonella enterica enterica serovar Typhi Ty2
ucgccucauucgggca

SEQ ID NO: 1733225 - RNA, 14 nt, Salmonella enterica enterica serovar Typhi Ty2
ucgccuccagcgau

SEQ ID NO: 1733226 - RNA, 13 nt, Salmonella enterica enterica serovar Typhi Ty2
ucgccucccgcac

SEQ ID NO: 1733227 - RNA, 22 nt, Salmonella enterica enterica serovar Typhi Ty2
ucgcccaccgcauagacgugcg

SEQ ID NO: 1733228 - RNA, 14 nt, Salmonella enterica enterica serovar Typhi Ty2
ucgccagaccgaaa

SEQ ID NO: 1733229 - RNA, 18 nt, Salmonella enterica enterica serovar Typhi Ty2
ucgccagaucgaacagcg

SEQ ID NO: 1733230 - RNA, 23 nt, Salmonella enterica enterica serovar Typhi Ty2
ucgccagaucgauauccgugcgc

SEQ ID NO: 1733231 - RNA, 14 nt, Salmonella enterica enterica serovar Typhi Ty2
ucgcccugauggcg

SEQ ID NO: 1733232 - RNA, 13 nt, Salmonella enterica enterica serovar Typhi Ty2
ucgcccugcggua

SEQ ID NO: 1733233 - RNA, 21 nt, Salmonella enterica enterica serovar Typhi Ty2
ucgcccuucgggccgccgcaa

SEQ ID NO: 1733234 - RNA, 21 nt, Salmonella enterica enterica serovar Typhi Ty2
ucgcagccacccuggcauaug

SEQ ID NO: 1733235 - RNA, 13 nt, Salmonella enterica enterica serovar Typhi Ty2
ucgcagcgcaggu

SEQ ID NO: 1733236 - RNA, 23 nt, Salmonella enterica enterica serovar Typhi Ty2
ucgcauucauaucgccugcggca

SEQ ID NO: 1733237 - RNA, 16 nt, Salmonella enterica enterica serovar Typhi Ty2
ucgccaaagcguaaac

SEQ ID NO: 1733238 - RNA, 21 nt, Salmonella enterica enterica serovar Typhi Ty2
ucgcauucauaucgccugcgg

SEQ ID NO: 1733239 - RNA, 12 nt, Salmonella enterica enterica serovar Typhi Ty2
ucgcauccucgc

SEQ ID NO: 1733240 - RNA, 13 nt, Salmonella enterica enterica serovar Typhi Ty2
ucgcaucagggcg

SEQ ID NO: 1733241 - RNA, 18 nt, Salmonella enterica enterica serovar Typhi Ty2
ucgccaccgcgcgcuuaa

SEQ ID NO: 1733242 - RNA, 15 nt, Salmonella enterica enterica serovar Typhi Ty2
ucgccaaugccgcag

SEQ ID NO: 1733243 - RNA, 16 nt, Salmonella enterica enterica serovar Typhi Ty2
ucgccaccagcgauau

SEQ ID NO: 1733244 - RNA, 19 nt, Salmonella enterica enterica serovar Typhi Ty2
ucgcuuuuugcgccagcgc

SEQ ID NO: 1733245 - RNA, 21 nt, Salmonella enterica enterica serovar Typhi Ty2
ucgcuucaaucgugguuggca

SEQ ID NO: 1733246 - RNA, 19 nt, Salmonella enterica enterica serovar Typhi Ty2
ucgcuuaucuggccuacgg

SEQ ID NO: 1733247 - RNA, 13 nt, Salmonella enterica enterica serovar Typhi Ty2
ucgcuuaucuggc

SEQ ID NO: 1733248 - RNA, 17 nt, Salmonella enterica enterica serovar Typhi Ty2
ucgcgucuacgucagga

SEQ ID NO: 1733249 - RNA, 14 nt, Salmonella enterica enterica serovar Typhi Ty2
ucgcucgcggcaga

SEQ ID NO: 1733250 - RNA, 15 nt, Salmonella enterica enterica serovar Typhi Ty2
ucgcucuuccaguug

SEQ ID NO: 1733251 - RNA, 18 nt, Salmonella enterica enterica serovar Typhi Ty2
ucgcucuuucucgggcgu

SEQ ID NO: 1733252 - RNA, 17 nt, Salmonella enterica enterica serovar Typhi Ty2
ucgcucuauauccugcc

SEQ ID NO: 1733253 - RNA, 22 nt, Salmonella enterica enterica serovar Typhi Ty2
ucgcuaucugacagccaaacug

SEQ ID NO: 1733254 - RNA, 24 nt, Salmonella enterica enterica serovar Typhi Ty2
ucgcguacaggauguccaggcgac

SEQ ID NO: 1733255 - RNA, 20 nt, Salmonella enterica enterica serovar Typhi Ty2
ucgcggguaaacucacccag

SEQ ID NO: 1733256 - RNA, 16 nt, Salmonella enterica enterica serovar Typhi Ty2
ucgcgcggcauggaug

SEQ ID NO: 1733257 - RNA, 19 nt, Salmonella enterica enterica serovar Typhi Ty2
aauacccaggccaucagaa

SEQ ID NO: 1733258 - RNA, 23 nt, Salmonella enterica enterica serovar Typhi Ty2
ucggcgaccagcagcgcggcgua

SEQ ID NO: 1733259 - RNA, 13 nt, Salmonella enterica enterica serovar Typhi Ty2
ucggacucaucgg

SEQ ID NO: 1733260 - RNA, 15 nt, Salmonella enterica enterica serovar Typhi Ty2
ucggagaaauagacg

SEQ ID NO: 1733261 - RNA, 19 nt, Salmonella enterica enterica serovar Typhi Ty2
ucggcaauaaacucccgca

SEQ ID NO: 1733262 - RNA, 18 nt, Salmonella enterica enterica serovar Typhi Ty2
ucggcaauuuccggcgac

SEQ ID NO: 1733263 - RNA, 18 nt, Salmonella enterica enterica serovar Typhi Ty2
ucggcagcaauacgcccg

SEQ ID NO: 1733264 - RNA, 16 nt, Salmonella enterica enterica serovar Typhi Ty2
ucggccauauccagcc

SEQ ID NO: 1733265 - RNA, 15 nt, Salmonella enterica enterica serovar Typhi Ty2
accccaucccggcaa

SEQ ID NO: 1733266 - RNA, 20 nt, Salmonella enterica enterica serovar Typhi Ty2
accccaguagcccugacgaa

SEQ ID NO: 1733267 - RNA, 16 nt, Salmonella enterica enterica serovar Typhi Ty2
accccaaucuugcgua

SEQ ID NO: 1733268 - RNA, 20 nt, Salmonella enterica enterica serovar Typhi Ty2
accccauuaugugcgacgua

SEQ ID NO: 1733269 - RNA, 23 nt, Salmonella enterica enterica serovar Typhi Ty2
accccgccagcagguuaaacaga

SEQ ID NO: 1733270 - RNA, 19 nt, Salmonella enterica enterica serovar Typhi Ty2
accccggucacaucguuau

SEQ ID NO: 1733271 - RNA, 16 nt, Salmonella enterica enterica serovar Typhi Ty2
acccacgccggaaauc

SEQ ID NO: 1733272 - RNA, 14 nt, Salmonella enterica enterica serovar Typhi Ty2
accaggaacgccau

SEQ ID NO: 1733273 - RNA, 18 nt, Salmonella enterica enterica serovar Typhi Ty2
acccacuguaucgacaua

SEQ ID NO: 1733274 - RNA, 12 nt, Salmonella enterica enterica serovar Typhi Ty2
acccagcccaau

SEQ ID NO: 1733275 - RNA, 19 nt, Salmonella enterica enterica serovar Typhi Ty2
acccagcgcgaauuugccc

SEQ ID NO: 1733276 - RNA, 16 nt, Salmonella enterica enterica serovar Typhi Ty2
acccaguucauuaaca

SEQ ID NO: 1733277 - RNA, 17 nt, Salmonella enterica enterica serovar Typhi Ty2
acccgcgugcggacgua

SEQ ID NO: 1733278 - RNA, 22 nt, Salmonella enterica enterica serovar Typhi Ty2
acccgcuacgcgugaugugccg

SEQ ID NO: 1733279 - RNA, 16 nt, Salmonella enterica enterica serovar Typhi Ty2
acccgcgggcggcguu

SEQ ID NO: 1733280 - RNA, 20 nt, Salmonella enterica enterica serovar Typhi Ty2
accccuccggccagcgccag

SEQ ID NO: 1733281 - RNA, 22 nt, Salmonella enterica enterica serovar Typhi Ty2
accccuucgcccucgccagcaa

SEQ ID NO: 1733282 - RNA, 21 nt, Salmonella enterica enterica serovar Typhi Ty2
accgacaauauucgccgcgau

SEQ ID NO: 1733283 - RNA, 20 nt, Salmonella enterica enterica serovar Typhi Ty2
accgaaaucgguacgcgucu

SEQ ID NO: 1733284 - RNA, 15 nt, Salmonella enterica enterica serovar Typhi Ty2
accgacaucgccagu

SEQ ID NO: 1733285 - RNA, 12 nt, Salmonella enterica enterica serovar Typhi Ty2
acccuugcggcu

SEQ ID NO: 1733286 - RNA, 18 nt, Salmonella enterica enterica serovar Typhi Ty2
accgccuuauccggccua

SEQ ID NO: 1733287 - RNA, 21 nt, Salmonella enterica enterica serovar Typhi Ty2
accgccuuauccggccuacaa

SEQ ID NO: 1733288 - RNA, 16 nt, Salmonella enterica enterica serovar Typhi Ty2
accgccugcguuugcg

SEQ ID NO: 1733289 - RNA, 22 nt, Salmonella enterica enterica serovar Typhi Ty2
accgcgccacggccaacgcgcc

SEQ ID NO: 1733290 - RNA, 21 nt, Salmonella enterica enterica serovar Typhi Ty2
accgcaucaaugcccagcgca

SEQ ID NO: 1733291 - RNA, 18 nt, Salmonella enterica enterica serovar Typhi Ty2
accgcagaaacagauagu

SEQ ID NO: 1733292 - RNA, 17 nt, Salmonella enterica enterica serovar Typhi Ty2
accgccagcagagcgaa

SEQ ID NO: 1733293 - RNA, 12 nt, Salmonella enterica enterica serovar Typhi Ty2
accgccgacagu

SEQ ID NO: 1733294 - RNA, 13 nt, Salmonella enterica enterica serovar Typhi Ty2
accgccgcugcaa

SEQ ID NO: 1733295 - RNA, 16 nt, Salmonella enterica enterica serovar Typhi Ty2
accgguaaugauacca

SEQ ID NO: 1733296 - RNA, 21 nt, Salmonella enterica enterica serovar Typhi Ty2
accgggcucacgcuggugcuu

SEQ ID NO: 1733297 - RNA, 19 nt, Salmonella enterica enterica serovar Typhi Ty2
accggcgacgugacgcgcc

SEQ ID NO: 1733298 - RNA, 14 nt, Salmonella enterica enterica serovar Typhi Ty2
accggccugccuau

SEQ ID NO: 1733299 - RNA, 21 nt, Salmonella enterica enterica serovar Typhi Ty2
accgcgcuccuggaaccagug

SEQ ID NO: 1733300 - RNA, 13 nt, Salmonella enterica enterica serovar Typhi Ty2
accgcgcggcguu

SEQ ID NO: 1733301 - RNA, 19 nt, Salmonella enterica enterica serovar Typhi Ty2
accgcgcgcccgacgcgcc

SEQ ID NO: 1733302 - RNA, 17 nt, Salmonella enterica enterica serovar Typhi Ty2
accgcguuugcgucguu

SEQ ID NO: 1733303 - RNA, 24 nt, Salmonella enterica enterica serovar Typhi Ty2
accgcguuuaacgcagcgcgcgua

SEQ ID NO: 1733304 - RNA, 17 nt, Salmonella enterica enterica serovar Typhi Ty2
accgcguuugcgcaaca

SEQ ID NO: 1733305 - RNA, 17 nt, Salmonella enterica enterica serovar Typhi Ty2
accgcuuuaugcgcuuc

SEQ ID NO: 1733306 - RNA, 16 nt, Salmonella enterica enterica serovar Typhi Ty2
accgcuuuaugcgcuu

SEQ ID NO: 1733307 - RNA, 14 nt, Salmonella enterica enterica serovar Typhi Ty2
accgcugacugaac

SEQ ID NO: 1733308 - RNA, 19 nt, Salmonella enterica enterica serovar Typhi Ty2
accgcuucccacagucggc

SEQ ID NO: 1733309 - RNA, 20 nt, Salmonella enterica enterica serovar Typhi Ty2
accggaucaauaugccagau

SEQ ID NO: 1733310 - RNA, 16 nt, Salmonella enterica enterica serovar Typhi Ty2
accggaugauggccug

SEQ ID NO: 1733311 - RNA, 15 nt, Salmonella enterica enterica serovar Typhi Ty2
accggaugugccaau

SEQ ID NO: 1733312 - RNA, 18 nt, Salmonella enterica enterica serovar Typhi Ty2
accaccaguacauggcuc

SEQ ID NO: 1733313 - RNA, 20 nt, Salmonella enterica enterica serovar Typhi Ty2
accacaucagaccgccaagc

SEQ ID NO: 1733314 - RNA, 16 nt, Salmonella enterica enterica serovar Typhi Ty2
accacaugaccagcgc

SEQ ID NO: 1733315 - RNA, 15 nt, Salmonella enterica enterica serovar Typhi Ty2
accacaucagaccgc

SEQ ID NO: 1733316 - RNA, 14 nt, Salmonella enterica enterica serovar Typhi Ty2
accagcgaaaugac

SEQ ID NO: 1733317 - RNA, 15 nt, Salmonella enterica enterica serovar Typhi Ty2
accagcagaugcagu

SEQ ID NO: 1733318 - RNA, 21 nt, Salmonella enterica enterica serovar Typhi Ty2
accacuucaacgccgcgcuuc

SEQ ID NO: 1733319 - RNA, 14 nt, Salmonella enterica enterica serovar Typhi Ty2
acagcgucauccag

SEQ ID NO: 1733320 - RNA, 12 nt, Salmonella enterica enterica serovar Typhi Ty2
acaguacgcccg

SEQ ID NO: 1733321 - RNA, 17 nt, Salmonella enterica enterica serovar Typhi Ty2
acagcguaaugcgccag

SEQ ID NO: 1733322 - RNA, 21 nt, Salmonella enterica enterica serovar Typhi Ty2
acagcggcggcaguugccgga

SEQ ID NO: 1733323 - RNA, 17 nt, Salmonella enterica enterica serovar Typhi Ty2
acagucgucuggcgcua

SEQ ID NO: 1733324 - RNA, 13 nt, Salmonella enterica enterica serovar Typhi Ty2
acaguacgcccgg

SEQ ID NO: 1733325 - RNA, 21 nt, Salmonella enterica enterica serovar Typhi Ty2
acagcguacaauggcaggcau

SEQ ID NO: 1733326 - RNA, 20 nt, Salmonella enterica enterica serovar Typhi Ty2
acagugacccgccgccagca

SEQ ID NO: 1733327 - RNA, 13 nt, Salmonella enterica enterica serovar Typhi Ty2
acagugcgccaua

SEQ ID NO: 1733328 - RNA, 22 nt, Salmonella enterica enterica serovar Typhi Ty2
acauaaacagcgugaacacgcc

SEQ ID NO: 1733329 - RNA, 14 nt, Salmonella enterica enterica serovar Typhi Ty2
acaguuaacgccaa

SEQ ID NO: 1733330 - RNA, 24 nt, Salmonella enterica enterica serovar Typhi Ty2
acaucgucuuuuaccgcgucgcua

SEQ ID NO: 1733331 - RNA, 12 nt, Salmonella enterica enterica serovar Typhi Ty2
acaucguuaccc

SEQ ID NO: 1733332 - RNA, 23 nt, Salmonella enterica enterica serovar Typhi Ty2
acaucgucuuuuaccgcgucgcu

SEQ ID NO: 1733333 - RNA, 22 nt, Salmonella enterica enterica serovar Typhi Ty2
acaucccgauaauggcgccgau

SEQ ID NO: 1733334 - RNA, 16 nt, Salmonella enterica enterica serovar Typhi Ty2
acauauugcgcuucac

SEQ ID NO: 1733335 - RNA, 20 nt, Salmonella enterica enterica serovar Typhi Ty2
acauacuguuaugggucgcu

SEQ ID NO: 1733336 - RNA, 12 nt, Salmonella enterica enterica serovar Typhi Ty2
acauauccaguu

SEQ ID NO: 1733337 - RNA, 19 nt, Salmonella enterica enterica serovar Typhi Ty2
acauauuccagaagcgcuu

SEQ ID NO: 1733338 - RNA, 17 nt, Salmonella enterica enterica serovar Typhi Ty2
acauacaccggcgccag

SEQ ID NO: 1733339 - RNA, 22 nt, Salmonella enterica enterica serovar Typhi Ty2
acauacuguuaugggucgcuuc

SEQ ID NO: 1733340 - RNA, 20 nt, Salmonella enterica enterica serovar Typhi Ty2
acauagccucaagagaugca

SEQ ID NO: 1733341 - RNA, 17 nt, Salmonella enterica enterica serovar Typhi Ty2
acaucuucuacaugccc

SEQ ID NO: 1733342 - RNA, 18 nt, Salmonella enterica enterica serovar Typhi Ty2
acaugaccagcgcaaaca

SEQ ID NO: 1733343 - RNA, 15 nt, Salmonella enterica enterica serovar Typhi Ty2
acauugccggcauca

SEQ ID NO: 1733344 - RNA, 22 nt, Salmonella enterica enterica serovar Typhi Ty2
acauugagcgucaggccaucgc

SEQ ID NO: 1733345 - RNA, 18 nt, Salmonella enterica enterica serovar Typhi Ty2
accaacccagccugcgau

SEQ ID NO: 1733346 - RNA, 22 nt, Salmonella enterica enterica serovar Typhi Ty2
accaaaugguugguauugcgaa

SEQ ID NO: 1733347 - RNA, 21 nt, Salmonella enterica enterica serovar Typhi Ty2
accaaagccaggccgccagca

SEQ ID NO: 1733348 - RNA, 20 nt, Salmonella enterica enterica serovar Typhi Ty2
accaacgucgugccagugau

SEQ ID NO: 1733349 - RNA, 15 nt, Salmonella enterica enterica serovar Typhi Ty2
accaacggcgcuggc

SEQ ID NO: 1733350 - RNA, 21 nt, Salmonella enterica enterica serovar Typhi Ty2
acaauagcgcuaaacagcgcc

SEQ ID NO: 1733351 - RNA, 14 nt, Salmonella enterica enterica serovar Typhi Ty2
acaaucccgccaga

SEQ ID NO: 1733352 - RNA, 23 nt, Salmonella enterica enterica serovar Typhi Ty2
acaaucaaauggcuggcgcuauu

SEQ ID NO: 1733353 - RNA, 16 nt, Salmonella enterica enterica serovar Typhi Ty2
acaaugccacgccccu

SEQ ID NO: 1733354 - RNA, 22 nt, Salmonella enterica enterica serovar Typhi Ty2
acaauuucccccacuucugaca

SEQ ID NO: 1733355 - RNA, 15 nt, Salmonella enterica enterica serovar Typhi Ty2
acaauuuaucagaca

SEQ ID NO: 1733356 - RNA, 22 nt, Salmonella enterica enterica serovar Typhi Ty2
acaauuucgcaaacacccgacg

SEQ ID NO: 1733357 - RNA, 15 nt, Salmonella enterica enterica serovar Typhi Ty2
acacaauagcaaucu

SEQ ID NO: 1733358 - RNA, 21 nt, Salmonella enterica enterica serovar Typhi Ty2
acaacgucaguggaaaacagc

SEQ ID NO: 1733359 - RNA, 22 nt, Salmonella enterica enterica serovar Typhi Ty2
acaaggcgguacgccgccaucc

SEQ ID NO: 1733360 - RNA, 14 nt, Salmonella enterica enterica serovar Typhi Ty2
acaagcugcgccau

SEQ ID NO: 1733361 - RNA, 16 nt, Salmonella enterica enterica serovar Typhi Ty2
acaagaauuuaucgca

SEQ ID NO: 1733362 - RNA, 15 nt, Salmonella enterica enterica serovar Typhi Ty2
aauuuuugaucugcu

SEQ ID NO: 1733363 - RNA, 14 nt, Salmonella enterica enterica serovar Typhi Ty2
acaaaaccgcuaau

SEQ ID NO: 1733364 - RNA, 17 nt, Salmonella enterica enterica serovar Typhi Ty2
acaaacgccaggcgcug

SEQ ID NO: 1733365 - RNA, 17 nt, Salmonella enterica enterica serovar Typhi Ty2
aauguuaauaagcagaa

SEQ ID NO: 1733366 - RNA, 12 nt, Salmonella enterica enterica serovar Typhi Ty2
acaaccagcgaa

SEQ ID NO: 1733367 - RNA, 14 nt, Salmonella enterica enterica serovar Typhi Ty2
acaaccagaauaau

SEQ ID NO: 1733368 - RNA, 15 nt, Salmonella enterica enterica serovar Typhi Ty2
acaaccugcccuuuc

SEQ ID NO: 1733369 - RNA, 13 nt, Salmonella enterica enterica serovar Typhi Ty2
acaacccggcugc

SEQ ID NO: 1733370 - RNA, 19 nt, Salmonella enterica enterica serovar Typhi Ty2
acaaaucgacagccagcau

SEQ ID NO: 1733371 - RNA, 22 nt, Salmonella enterica enterica serovar Typhi Ty2
acaaagagcuccccacgaaagu

SEQ ID NO: 1733372 - RNA, 18 nt, Salmonella enterica enterica serovar Typhi Ty2
acaaagcgguaaaucgca

SEQ ID NO: 1733373 - RNA, 14 nt, Salmonella enterica enterica serovar Typhi Ty2
acacgcgaauagcc

SEQ ID NO: 1733374 - RNA, 19 nt, Salmonella enterica enterica serovar Typhi Ty2
acacgcacaucccgaauac

SEQ ID NO: 1733375 - RNA, 14 nt, Salmonella enterica enterica serovar Typhi Ty2
acaccgcaaaccgu

SEQ ID NO: 1733376 - RNA, 19 nt, Salmonella enterica enterica serovar Typhi Ty2
acacccggcuuuugcuuuc

SEQ ID NO: 1733377 - RNA, 15 nt, Salmonella enterica enterica serovar Typhi Ty2
acacagcgucgcgcg

SEQ ID NO: 1733378 - RNA, 13 nt, Salmonella enterica enterica serovar Typhi Ty2
acacagcgucgcg

SEQ ID NO: 1733379 - RNA, 18 nt, Salmonella enterica enterica serovar Typhi Ty2
acagcccgccagcaccag

SEQ ID NO: 1733380 - RNA, 12 nt, Salmonella enterica enterica serovar Typhi Ty2
acagcgccauca

SEQ ID NO: 1733381 - RNA, 16 nt, Salmonella enterica enterica serovar Typhi Ty2
acagcgccggcagcag

SEQ ID NO: 1733382 - RNA, 22 nt, Salmonella enterica enterica serovar Typhi Ty2
acagcgcgcgcgacggcagccu

SEQ ID NO: 1733383 - RNA, 19 nt, Salmonella enterica enterica serovar Typhi Ty2
acagcgcuccacgcguccu

SEQ ID NO: 1733384 - RNA, 21 nt, Salmonella enterica enterica serovar Typhi Ty2
acagcggacacccgcagccag

SEQ ID NO: 1733385 - RNA, 13 nt, Salmonella enterica enterica serovar Typhi Ty2
acagccauccgac

SEQ ID NO: 1733386 - RNA, 15 nt, Salmonella enterica enterica serovar Typhi Ty2
acgcauaccagccau

SEQ ID NO: 1733387 - RNA, 22 nt, Salmonella enterica enterica serovar Typhi Ty2
acgcauaaugagcgcuugaucc

SEQ ID NO: 1733388 - RNA, 13 nt, Salmonella enterica enterica serovar Typhi Ty2
acgcauccagcgu

SEQ ID NO: 1733389 - RNA, 20 nt, Salmonella enterica enterica serovar Typhi Ty2
acgccacaaacugcgcuagc

SEQ ID NO: 1733390 - RNA, 16 nt, Salmonella enterica enterica serovar Typhi Ty2
acgccaggcagaacgc

SEQ ID NO: 1733391 - RNA, 22 nt, Salmonella enterica enterica serovar Typhi Ty2
acgcccgccguaacgcgcaucu

SEQ ID NO: 1733392 - RNA, 16 nt, Salmonella enterica enterica serovar Typhi Ty2
acgcccacgcggcgug

SEQ ID NO: 1733393 - RNA, 15 nt, Salmonella enterica enterica serovar Typhi Ty2
acgcagcaucgccau

SEQ ID NO: 1733394 - RNA, 16 nt, Salmonella enterica enterica serovar Typhi Ty2
acgcagcaaacgccau

SEQ ID NO: 1733395 - RNA, 23 nt, Salmonella enterica enterica serovar Typhi Ty2
acgcaaucucuuccgcccagaua

SEQ ID NO: 1733396 - RNA, 19 nt, Salmonella enterica enterica serovar Typhi Ty2
acgauucagguuuugcuga

SEQ ID NO: 1733397 - RNA, 17 nt, Salmonella enterica enterica serovar Typhi Ty2
acgauguaaaaccuggc

SEQ ID NO: 1733398 - RNA, 18 nt, Salmonella enterica enterica serovar Typhi Ty2
acgagcauccagaucggc

SEQ ID NO: 1733399 - RNA, 19 nt, Salmonella enterica enterica serovar Typhi Ty2
acgccgacucacgcagcgc

SEQ ID NO: 1733400 - RNA, 17 nt, Salmonella enterica enterica serovar Typhi Ty2
acgccgacgcauccgcc

SEQ ID NO: 1733401 - RNA, 17 nt, Salmonella enterica enterica serovar Typhi Ty2
acgccgccauccggcac

SEQ ID NO: 1733402 - RNA, 18 nt, Salmonella enterica enterica serovar Typhi Ty2
acgccgccauccgacaac

SEQ ID NO: 1733403 - RNA, 23 nt, Salmonella enterica enterica serovar Typhi Ty2
acgccgcccgcguuggcggcuuu

SEQ ID NO: 1733404 - RNA, 13 nt, Salmonella enterica enterica serovar Typhi Ty2
acgccgcaaacgc

SEQ ID NO: 1733405 - RNA, 19 nt, Salmonella enterica enterica serovar Typhi Ty2
acgccgcuaucgaccagca

SEQ ID NO: 1733406 - RNA, 16 nt, Salmonella enterica enterica serovar Typhi Ty2
acgccgccgcaggcca

SEQ ID NO: 1733407 - RNA, 14 nt, Salmonella enterica enterica serovar Typhi Ty2
acgccggaugcgag

SEQ ID NO: 1733408 - RNA, 17 nt, Salmonella enterica enterica serovar Typhi Ty2
acgccggaugcgagaau

SEQ ID NO: 1733409 - RNA, 17 nt, Salmonella enterica enterica serovar Typhi Ty2
acgccggagaccggcga

SEQ ID NO: 1733410 - RNA, 15 nt, Salmonella enterica enterica serovar Typhi Ty2
acgcgauagcgcagc

SEQ ID NO: 1733411 - RNA, 18 nt, Salmonella enterica enterica serovar Typhi Ty2
acgcgauauguuugcgcg

SEQ ID NO: 1733412 - RNA, 19 nt, Salmonella enterica enterica serovar Typhi Ty2
acgcgauauguuugcgcgu

SEQ ID NO: 1733413 - RNA, 18 nt, Salmonella enterica enterica serovar Typhi Ty2
acgcgaucgcgauucgcc

SEQ ID NO: 1733414 - RNA, 17 nt, Salmonella enterica enterica serovar Typhi Ty2
acgcgaugccuggcgau

SEQ ID NO: 1733415 - RNA, 21 nt, Salmonella enterica enterica serovar Typhi Ty2
acgccuuacccgaccuacauc

SEQ ID NO: 1733416 - RNA, 21 nt, Salmonella enterica enterica serovar Typhi Ty2
acgccuuauccgaccuacaga

SEQ ID NO: 1733417 - RNA, 21 nt, Salmonella enterica enterica serovar Typhi Ty2
acgccuuauccggccuacaga

SEQ ID NO: 1733418 - RNA, 15 nt, Salmonella enterica enterica serovar Typhi Ty2
acgccuuacccgacc

SEQ ID NO: 1733419 - RNA, 13 nt, Salmonella enterica enterica serovar Typhi Ty2
acgccuaaaugaa

SEQ ID NO: 1733420 - RNA, 15 nt, Salmonella enterica enterica serovar Typhi Ty2
acgcgccacgcgcca

SEQ ID NO: 1733421 - RNA, 19 nt, Salmonella enterica enterica serovar Typhi Ty2
acgcgcauuaauaugcgca

SEQ ID NO: 1733422 - RNA, 22 nt, Salmonella enterica enterica serovar Typhi Ty2
acgcgcauccugcauaauccaa

SEQ ID NO: 1733423 - RNA, 22 nt, Salmonella enterica enterica serovar Typhi Ty2
acgcgccagcaaaauuuugcgc

SEQ ID NO: 1733424 - RNA, 12 nt, Salmonella enterica enterica serovar Typhi Ty2
acgcgcggcguc

SEQ ID NO: 1733425 - RNA, 23 nt, Salmonella enterica enterica serovar Typhi Ty2
acgacccuuuuuugguuauccag

SEQ ID NO: 1733426 - RNA, 17 nt, Salmonella enterica enterica serovar Typhi Ty2
acgacccaucaauaacg

SEQ ID NO: 1733427 - RNA, 15 nt, Salmonella enterica enterica serovar Typhi Ty2
acgaccauaaauagc

SEQ ID NO: 1733428 - RNA, 19 nt, Salmonella enterica enterica serovar Typhi Ty2
acgaauuuacucgccaaua

SEQ ID NO: 1733429 - RNA, 21 nt, Salmonella enterica enterica serovar Typhi Ty2
acgaccugguggcgaacaaua

SEQ ID NO: 1733430 - RNA, 16 nt, Salmonella enterica enterica serovar Typhi Ty2
acgacgcugccacaau

SEQ ID NO: 1733431 - RNA, 19 nt, Salmonella enterica enterica serovar Typhi Ty2
acgacgccggagaccggcg

SEQ ID NO: 1733432 - RNA, 20 nt, Salmonella enterica enterica serovar Typhi Ty2
accugcgcgacggcggcguc

SEQ ID NO: 1733433 - RNA, 22 nt, Salmonella enterica enterica serovar Typhi Ty2
accuggaauagcgugggcagac

SEQ ID NO: 1733434 - RNA, 16 nt, Salmonella enterica enterica serovar Typhi Ty2
accugcuggcggcgua

SEQ ID NO: 1733435 - RNA, 17 nt, Salmonella enterica enterica serovar Typhi Ty2
accugcuggcggcguaa

SEQ ID NO: 1733436 - RNA, 18 nt, Salmonella enterica enterica serovar Typhi Ty2
accuguucaugccagauu

SEQ ID NO: 1733437 - RNA, 17 nt, Salmonella enterica enterica serovar Typhi Ty2
accuucacccccaucgc

SEQ ID NO: 1733438 - RNA, 17 nt, Salmonella enterica enterica serovar Typhi Ty2
accuuaucgcagucagc

SEQ ID NO: 1733439 - RNA, 17 nt, Salmonella enterica enterica serovar Typhi Ty2
accuuaucaagcgauac

SEQ ID NO: 1733440 - RNA, 15 nt, Salmonella enterica enterica serovar Typhi Ty2
accuccugcaucgac

SEQ ID NO: 1733441 - RNA, 18 nt, Salmonella enterica enterica serovar Typhi Ty2
accuccugcaaucguucu

SEQ ID NO: 1733442 - RNA, 15 nt, Salmonella enterica enterica serovar Typhi Ty2
accucgccagucagg

SEQ ID NO: 1733443 - RNA, 17 nt, Salmonella enterica enterica serovar Typhi Ty2
accuccacgcccagcgc

SEQ ID NO: 1733444 - RNA, 23 nt, Salmonella enterica enterica serovar Typhi Ty2
accucagucgcuuguaccgucgg

SEQ ID NO: 1733445 - RNA, 17 nt, Salmonella enterica enterica serovar Typhi Ty2
accucauccaucagcgc

SEQ ID NO: 1733446 - RNA, 13 nt, Salmonella enterica enterica serovar Typhi Ty2
accucguucggcg

SEQ ID NO: 1733447 - RNA, 22 nt, Salmonella enterica enterica serovar Typhi Ty2
accucuaaauggaucgcccguc

SEQ ID NO: 1733448 - RNA, 23 nt, Salmonella enterica enterica serovar Typhi Ty2
accugcagggugaagauggcgcc

SEQ ID NO: 1733449 - RNA, 21 nt, Salmonella enterica enterica serovar Typhi Ty2
accugcagggugaagauggcg

SEQ ID NO: 1733450 - RNA, 18 nt, Salmonella enterica enterica serovar Typhi Ty2
accugauugauacgcgcc

SEQ ID NO: 1733451 - RNA, 20 nt, Salmonella enterica enterica serovar Typhi Ty2
accugcaaacguagcgcguc

SEQ ID NO: 1733452 - RNA, 16 nt, Salmonella enterica enterica serovar Typhi Ty2
accugauagcggguaa

SEQ ID NO: 1733453 - RNA, 14 nt, Salmonella enterica enterica serovar Typhi Ty2
accugaucgccaac

SEQ ID NO: 1733454 - RNA, 17 nt, Salmonella enterica enterica serovar Typhi Ty2
accugaagccauccuca

SEQ ID NO: 1733455 - RNA, 21 nt, Salmonella enterica enterica serovar Typhi Ty2
acucauuaccggcugccgaua

SEQ ID NO: 1733456 - RNA, 20 nt, Salmonella enterica enterica serovar Typhi Ty2
acucaugccuuuggcaauca

SEQ ID NO: 1733457 - RNA, 22 nt, Salmonella enterica enterica serovar Typhi Ty2
acuauauguccuuuacugcgcc

SEQ ID NO: 1733458 - RNA, 21 nt, Salmonella enterica enterica serovar Typhi Ty2
acuccagugcagaaaguguga

SEQ ID NO: 1733459 - RNA, 14 nt, Salmonella enterica enterica serovar Typhi Ty2
acuccagcagacgc

SEQ ID NO: 1733460 - RNA, 15 nt, Salmonella enterica enterica serovar Typhi Ty2
acuccagcagaccgg

SEQ ID NO: 1733461 - RNA, 19 nt, Salmonella enterica enterica serovar Typhi Ty2
acucgccaugccaucggcc

SEQ ID NO: 1733462 - RNA, 19 nt, Salmonella enterica enterica serovar Typhi Ty2
acuccgucucuuuauugaa

SEQ ID NO: 1733463 - RNA, 19 nt, Salmonella enterica enterica serovar Typhi Ty2
acuccggugcccauuccgc

SEQ ID NO: 1733464 - RNA, 22 nt, Salmonella enterica enterica serovar Typhi Ty2
acugauggcuggcgucgccaaa

SEQ ID NO: 1733465 - RNA, 15 nt, Salmonella enterica enterica serovar Typhi Ty2
acugccagcgucgcu

SEQ ID NO: 1733466 - RNA, 17 nt, Salmonella enterica enterica serovar Typhi Ty2
acugcccugaccggcug

SEQ ID NO: 1733467 - RNA, 17 nt, Salmonella enterica enterica serovar Typhi Ty2
acugccgccacgccgcu

SEQ ID NO: 1733468 - RNA, 18 nt, Salmonella enterica enterica serovar Typhi Ty2
acugcgccgccagcgaca

SEQ ID NO: 1733469 - RNA, 22 nt, Salmonella enterica enterica serovar Typhi Ty2
acugcgccgccagcgacauggc

SEQ ID NO: 1733470 - RNA, 20 nt, Salmonella enterica enterica serovar Typhi Ty2
acugcgaaaucaccgacagg

SEQ ID NO: 1733471 - RNA, 15 nt, Salmonella enterica enterica serovar Typhi Ty2
acucuuccugcugcg

SEQ ID NO: 1733472 - RNA, 17 nt, Salmonella enterica enterica serovar Typhi Ty2
acucuuccaccauccgc

SEQ ID NO: 1733473 - RNA, 17 nt, Salmonella enterica enterica serovar Typhi Ty2
acucuuuuuucagaaua

SEQ ID NO: 1733474 - RNA, 19 nt, Salmonella enterica enterica serovar Typhi Ty2
acugaacaagcgaucgcca

SEQ ID NO: 1733475 - RNA, 15 nt, Salmonella enterica enterica serovar Typhi Ty2
acucuuccgcaauca

SEQ ID NO: 1733476 - RNA, 23 nt, Salmonella enterica enterica serovar Typhi Ty2
acuacggcaaacacaaucacgcc

SEQ ID NO: 1733477 - RNA, 16 nt, Salmonella enterica enterica serovar Typhi Ty2
acguuuuuucgcacgc

SEQ ID NO: 1733478 - RNA, 20 nt, Salmonella enterica enterica serovar Typhi Ty2
acguuuuccugcgcuugcau

SEQ ID NO: 1733479 - RNA, 22 nt, Salmonella enterica enterica serovar Typhi Ty2
acguucuaucagguaucccgcc

SEQ ID NO: 1733480 - RNA, 17 nt, Salmonella enterica enterica serovar Typhi Ty2
acguuguccagcggcca

SEQ ID NO: 1733481 - RNA, 18 nt, Salmonella enterica enterica serovar Typhi Ty2
acguuggggauaaccaga

SEQ ID NO: 1733482 - RNA, 19 nt, Salmonella enterica enterica serovar Typhi Ty2
acguuggugcguccgguag

SEQ ID NO: 1733483 - RNA, 16 nt, Salmonella enterica enterica serovar Typhi Ty2
acgucgucccaggcca

SEQ ID NO: 1733484 - RNA, 15 nt, Salmonella enterica enterica serovar Typhi Ty2
acgucgucaccacgg

SEQ ID NO: 1733485 - RNA, 14 nt, Salmonella enterica enterica serovar Typhi Ty2
acguuccccagcac

SEQ ID NO: 1733486 - RNA, 20 nt, Salmonella enterica enterica serovar Typhi Ty2
acguucgcggguaacgucga

SEQ ID NO: 1733487 - RNA, 23 nt, Salmonella enterica enterica serovar Typhi Ty2
acguucggcaaaacgccgcagaa

SEQ ID NO: 1733488 - RNA, 17 nt, Salmonella enterica enterica serovar Typhi Ty2
acguucagcauauccag

SEQ ID NO: 1733489 - RNA, 21 nt, Salmonella enterica enterica serovar Typhi Ty2
acguuccagcguuuccggaau

SEQ ID NO: 1733490 - RNA, 13 nt, Salmonella enterica enterica serovar Typhi Ty2
acguucauccgac

SEQ ID NO: 1733491 - RNA, 19 nt, Salmonella enterica enterica serovar Typhi Ty2
acgugcgguauaucacgcc

SEQ ID NO: 1733492 - RNA, 15 nt, Salmonella enterica enterica serovar Typhi Ty2
acguaguccggcaau

SEQ ID NO: 1733493 - RNA, 20 nt, Salmonella enterica enterica serovar Typhi Ty2
acguaggccgaauaagacgc

SEQ ID NO: 1733494 - RNA, 12 nt, Salmonella enterica enterica serovar Typhi Ty2
acgguaucagcg

SEQ ID NO: 1733495 - RNA, 20 nt, Salmonella enterica enterica serovar Typhi Ty2
acgguaggccggguaggaca

SEQ ID NO: 1733496 - RNA, 12 nt, Salmonella enterica enterica serovar Typhi Ty2
acguccauccgc

SEQ ID NO: 1733497 - RNA, 20 nt, Salmonella enterica enterica serovar Typhi Ty2
acguccauaccgguugcgcg

SEQ ID NO: 1733498 - RNA, 15 nt, Salmonella enterica enterica serovar Typhi Ty2
acgggcgcgacaaua

SEQ ID NO: 1733499 - RNA, 14 nt, Salmonella enterica enterica serovar Typhi Ty2
acgggcgcggcaua

SEQ ID NO: 1733500 - RNA, 15 nt, Salmonella enterica enterica serovar Typhi Ty2
acgguaaaacacgcc

SEQ ID NO: 1733501 - RNA, 19 nt, Salmonella enterica enterica serovar Typhi Ty2
acgggcauuguuaauccag

SEQ ID NO: 1733502 - RNA, 16 nt, Salmonella enterica enterica serovar Typhi Ty2
acggccugcgcuggaa

SEQ ID NO: 1733503 - RNA, 16 nt, Salmonella enterica enterica serovar Typhi Ty2
acggccugcgcggcga

SEQ ID NO: 1733504 - RNA, 19 nt, Salmonella enterica enterica serovar Typhi Ty2
acggcgacguuccgcgaca

SEQ ID NO: 1733505 - RNA, 15 nt, Salmonella enterica enterica serovar Typhi Ty2
acggcgauaccagua

SEQ ID NO: 1733506 - RNA, 14 nt, Salmonella enterica enterica serovar Typhi Ty2
acggcccguaaaca

SEQ ID NO: 1733507 - RNA, 19 nt, Salmonella enterica enterica serovar Typhi Ty2
acggcccguaaacaggcug

SEQ ID NO: 1733508 - RNA, 14 nt, Salmonella enterica enterica serovar Typhi Ty2
acggcccguaaacg

SEQ ID NO: 1733509 - RNA, 12 nt, Salmonella enterica enterica serovar Typhi Ty2
acggcccgcugu

SEQ ID NO: 1733510 - RNA, 15 nt, Salmonella enterica enterica serovar Typhi Ty2
acggccaguugcgca

SEQ ID NO: 1733511 - RNA, 13 nt, Salmonella enterica enterica serovar Typhi Ty2
acggcaucaggaa

SEQ ID NO: 1733512 - RNA, 20 nt, Salmonella enterica enterica serovar Typhi Ty2
acggcauagcuguuccgcaa

SEQ ID NO: 1733513 - RNA, 12 nt, Salmonella enterica enterica serovar Typhi Ty2
acggcaucagga

SEQ ID NO: 1733514 - RNA, 16 nt, Salmonella enterica enterica serovar Typhi Ty2
acggcagccacgccga

SEQ ID NO: 1733515 - RNA, 14 nt, Salmonella enterica enterica serovar Typhi Ty2
acggcagccagcgu

SEQ ID NO: 1733516 - RNA, 22 nt, Salmonella enterica enterica serovar Typhi Ty2
acggcagccucuuucagaucgc

SEQ ID NO: 1733517 - RNA, 20 nt, Salmonella enterica enterica serovar Typhi Ty2
acggcagcguauacgccgga

SEQ ID NO: 1733518 - RNA, 13 nt, Salmonella enterica enterica serovar Typhi Ty2
acggcagcgccau

SEQ ID NO: 1733519 - RNA, 16 nt, Salmonella enterica enterica serovar Typhi Ty2
acgcggauguugcugu

SEQ ID NO: 1733520 - RNA, 15 nt, Salmonella enterica enterica serovar Typhi Ty2
acgcgcuagcuucag

SEQ ID NO: 1733521 - RNA, 17 nt, Salmonella enterica enterica serovar Typhi Ty2
acggaucaugguugaaa

SEQ ID NO: 1733522 - RNA, 22 nt, Salmonella enterica enterica serovar Typhi Ty2
acggaucuuccacuaccgcaau

SEQ ID NO: 1733523 - RNA, 19 nt, Salmonella enterica enterica serovar Typhi Ty2
acggcaccggaaccggcau

SEQ ID NO: 1733524 - RNA, 22 nt, Salmonella enterica enterica serovar Typhi Ty2
acggcacuacagcccuuucagg

SEQ ID NO: 1733525 - RNA, 11 nt, Salmonella enterica enterica serovar Typhi Ty2
acgcuuauccu

SEQ ID NO: 1733526 - RNA, 19 nt, Salmonella enterica enterica serovar Typhi Ty2
acgcuuaucagcccuacaa

SEQ ID NO: 1733527 - RNA, 23 nt, Salmonella enterica enterica serovar Typhi Ty2
acgcuuccagaugaagcgcaucg

SEQ ID NO: 1733528 - RNA, 15 nt, Salmonella enterica enterica serovar Typhi Ty2
aaucccauuagccac

SEQ ID NO: 1733529 - RNA, 22 nt, Salmonella enterica enterica serovar Typhi Ty2
uuggcaacccguaccuccagcg

SEQ ID NO: 1733530 - RNA, 21 nt, Salmonella enterica enterica serovar Typhi Ty2
uuggcaggaggggcagauaaa

SEQ ID NO: 1733531 - RNA, 19 nt, Salmonella enterica enterica serovar Typhi Ty2
uuggcaacggcagccagcg

SEQ ID NO: 1733532 - RNA, 17 nt, Salmonella enterica enterica serovar Typhi Ty2
uuggcgccaaaaccgcu

SEQ ID NO: 1733533 - RNA, 15 nt, Salmonella enterica enterica serovar Typhi Ty2
uuggcgcucaauagc

SEQ ID NO: 1733534 - RNA, 18 nt, Salmonella enterica enterica serovar Typhi Ty2
aauccgcuccacauccug

SEQ ID NO: 1733535 - RNA, 19 nt, Salmonella enterica enterica serovar Typhi Ty2
uuggcgaucacaauuacgc

SEQ ID NO: 1733536 - RNA, 18 nt, Salmonella enterica enterica serovar Typhi Ty2
aaucgauaagccagcgau

SEQ ID NO: 1733537 - RNA, 14 nt, Salmonella enterica enterica serovar Typhi Ty2
aaucgagaucagac

SEQ ID NO: 1733538 - RNA, 15 nt, Salmonella enterica enterica serovar Typhi Ty2
aaucgauggugccga

SEQ ID NO: 1733539 - RNA, 16 nt, Salmonella enterica enterica serovar Typhi Ty2
uugguuucggcguaag

SEQ ID NO: 1733540 - RNA, 16 nt, Salmonella enterica enterica serovar Typhi Ty2
uuggugcgacgccaga

SEQ ID NO: 1733541 - RNA, 15 nt, Salmonella enterica enterica serovar Typhi Ty2
uugucuccucaugcc

SEQ ID NO: 1733542 - RNA, 19 nt, Salmonella enterica enterica serovar Typhi Ty2
uugucaucaguaugagcga

SEQ ID NO: 1733543 - RNA, 23 nt, Salmonella enterica enterica serovar Typhi Ty2
uugugcauuccaggugucacuca

SEQ ID NO: 1733544 - RNA, 20 nt, Salmonella enterica enterica serovar Typhi Ty2
uugugcugguggugccgacg

SEQ ID NO: 1733545 - RNA, 16 nt, Salmonella enterica enterica serovar Typhi Ty2
aaucaucaggcuggcg

SEQ ID NO: 1733546 - RNA, 13 nt, Salmonella enterica enterica serovar Typhi Ty2
aaucauaccagcg

SEQ ID NO: 1733547 - RNA, 14 nt, Salmonella enterica enterica serovar Typhi Ty2
uugccacuacgcag

SEQ ID NO: 1733548 - RNA, 18 nt, Salmonella enterica enterica serovar Typhi Ty2
uugccagaggcagcacau

SEQ ID NO: 1733549 - RNA, 15 nt, Salmonella enterica enterica serovar Typhi Ty2
uugcccgaugcgccc

SEQ ID NO: 1733550 - RNA, 18 nt, Salmonella enterica enterica serovar Typhi Ty2
uugccauugcgacgauau

SEQ ID NO: 1733551 - RNA, 23 nt, Salmonella enterica enterica serovar Typhi Ty2
uugccgcacgguacuauuaccgc

SEQ ID NO: 1733552 - RNA, 13 nt, Salmonella enterica enterica serovar Typhi Ty2
uugccggauggcg

SEQ ID NO: 1733553 - RNA, 19 nt, Salmonella enterica enterica serovar Typhi Ty2
uugcgcaggguaucaucgc

SEQ ID NO: 1733554 - RNA, 20 nt, Salmonella enterica enterica serovar Typhi Ty2
uugccgucaacacgcagacc

SEQ ID NO: 1733555 - RNA, 12 nt, Salmonella enterica enterica serovar Typhi Ty2
uugcgccagacc

SEQ ID NO: 1733556 - RNA, 18 nt, Salmonella enterica enterica serovar Typhi Ty2
uugcgccacuuuuccggc

SEQ ID NO: 1733557 - RNA, 16 nt, Salmonella enterica enterica serovar Typhi Ty2
uugcgcauauuccggc

SEQ ID NO: 1733558 - RNA, 22 nt, Salmonella enterica enterica serovar Typhi Ty2
uugcgccaaagcaaucgccagc

SEQ ID NO: 1733559 - RNA, 22 nt, Salmonella enterica enterica serovar Typhi Ty2
uugcgccauccuuaauugccgc

SEQ ID NO: 1733560 - RNA, 15 nt, Salmonella enterica enterica serovar Typhi Ty2
uugcgccagcgccac

SEQ ID NO: 1733561 - RNA, 20 nt, Salmonella enterica enterica serovar Typhi Ty2
uugcagcagcgagauggcuu

SEQ ID NO: 1733562 - RNA, 21 nt, Salmonella enterica enterica serovar Typhi Ty2
uugcauagaucuuugggccgg

SEQ ID NO: 1733563 - RNA, 18 nt, Salmonella enterica enterica serovar Typhi Ty2
uugccacauuucccgagc

SEQ ID NO: 1733564 - RNA, 15 nt, Salmonella enterica enterica serovar Typhi Ty2
aaucaggacaucaaa

SEQ ID NO: 1733565 - RNA, 19 nt, Salmonella enterica enterica serovar Typhi Ty2
uugcaaaucuuguaggccg

SEQ ID NO: 1733566 - RNA, 17 nt, Salmonella enterica enterica serovar Typhi Ty2
uugcagcgcggccagcg

SEQ ID NO: 1733567 - RNA, 15 nt, Salmonella enterica enterica serovar Typhi Ty2
uugcagauaccagcg

SEQ ID NO: 1733568 - RNA, 17 nt, Salmonella enterica enterica serovar Typhi Ty2
uugcagacgugcaauau

SEQ ID NO: 1733569 - RNA, 16 nt, Salmonella enterica enterica serovar Typhi Ty2
uucugucagaaaucug

SEQ ID NO: 1733570 - RNA, 19 nt, Salmonella enterica enterica serovar Typhi Ty2
uucuggcauuggcaucugu

SEQ ID NO: 1733571 - RNA, 18 nt, Salmonella enterica enterica serovar Typhi Ty2
uucuggcauuggcaucug

SEQ ID NO: 1733572 - RNA, 13 nt, Salmonella enterica enterica serovar Typhi Ty2
uugaugaaccgcu

SEQ ID NO: 1733573 - RNA, 13 nt, Salmonella enterica enterica serovar Typhi Ty2
aaucuuugccgca

SEQ ID NO: 1733574 - RNA, 15 nt, Salmonella enterica enterica serovar Typhi Ty2
aaugaaaacgaaucg

SEQ ID NO: 1733575 - RNA, 11 nt, Salmonella enterica enterica serovar Typhi Ty2
aaugacgcccu

SEQ ID NO: 1733576 - RNA, 14 nt, Salmonella enterica enterica serovar Typhi Ty2
aaugaagcgacgcu

SEQ ID NO: 1733577 - RNA, 18 nt, Salmonella enterica enterica serovar Typhi Ty2
aaucuaagagccuguccc

SEQ ID NO: 1733578 - RNA, 16 nt, Salmonella enterica enterica serovar Typhi Ty2
aaucgucucucauccg

SEQ ID NO: 1733579 - RNA, 14 nt, Salmonella enterica enterica serovar Typhi Ty2
aaucgucaucagau

SEQ ID NO: 1733580 - RNA, 17 nt, Salmonella enterica enterica serovar Typhi Ty2
aaucgguuaugcgauuu

SEQ ID NO: 1733581 - RNA, 17 nt, Salmonella enterica enterica serovar Typhi Ty2
uuuuagcguuucaucgg

SEQ ID NO: 1733582 - RNA, 20 nt, Salmonella enterica enterica serovar Typhi Ty2
uuuuagcaauaacucaauag

SEQ ID NO: 1733583 - RNA, 17 nt, Salmonella enterica enterica serovar Typhi Ty2
uuuuguugugauacgcg

SEQ ID NO: 1733584 - RNA, 22 nt, Salmonella enterica enterica serovar Typhi Ty2
aaucgccucuucgaccgucgcg

SEQ ID NO: 1733585 - RNA, 14 nt, Salmonella enterica enterica serovar Typhi Ty2
aaucgccgucagug

SEQ ID NO: 1733586 - RNA, 13 nt, Salmonella enterica enterica serovar Typhi Ty2
uuuuucaccauaa

SEQ ID NO: 1733587 - RNA, 17 nt, Salmonella enterica enterica serovar Typhi Ty2
aaucgcgaauaaaugag

SEQ ID NO: 1733588 - RNA, 14 nt, Salmonella enterica enterica serovar Typhi Ty2
aaucggccagcgaa

SEQ ID NO: 1733589 - RNA, 23 nt, Salmonella enterica enterica serovar Typhi Ty2
aaucgggaucagaaauucgcagc

SEQ ID NO: 1733590 - RNA, 11 nt, Salmonella enterica enterica serovar Typhi Ty2
aaucggcaccu

SEQ ID NO: 1733591 - RNA, 15 nt, Salmonella enterica enterica serovar Typhi Ty2
aaugauaaugccgcu

SEQ ID NO: 1733592 - RNA, 13 nt, Salmonella enterica enterica serovar Typhi Ty2
aaugagcgucgcc

SEQ ID NO: 1733593 - RNA, 23 nt, Salmonella enterica enterica serovar Typhi Ty2
aaugacgcgcgagaacugcugca

SEQ ID NO: 1733594 - RNA, 17 nt, Salmonella enterica enterica serovar Typhi Ty2
aaugacuggcuuugcgc

SEQ ID NO: 1733595 - RNA, 22 nt, Salmonella enterica enterica serovar Typhi Ty2
aaugaugguagacaggcuggcu

SEQ ID NO: 1733596 - RNA, 17 nt, Salmonella enterica enterica serovar Typhi Ty2
aauggccgcagcgccau

SEQ ID NO: 1733597 - RNA, 15 nt, Salmonella enterica enterica serovar Typhi Ty2
aaugcgcgucaggcc

SEQ ID NO: 1733598 - RNA, 16 nt, Salmonella enterica enterica serovar Typhi Ty2
aaugcgccagcggcca

SEQ ID NO: 1733599 - RNA, 20 nt, Salmonella enterica enterica serovar Typhi Ty2
aauggcgacgaucagcgcca

SEQ ID NO: 1733600 - RNA, 23 nt, Salmonella enterica enterica serovar Typhi Ty2
aaugguggucgcggccaccgcca

SEQ ID NO: 1733601 - RNA, 13 nt, Salmonella enterica enterica serovar Typhi Ty2
aaugguugcguuu

SEQ ID NO: 1733602 - RNA, 15 nt, Salmonella enterica enterica serovar Typhi Ty2
aaugguggucgccau

SEQ ID NO: 1733603 - RNA, 13 nt, Salmonella enterica enterica serovar Typhi Ty2
aauguagcgcccu

SEQ ID NO: 1733604 - RNA, 14 nt, Salmonella enterica enterica serovar Typhi Ty2
uuucgccguccaga

SEQ ID NO: 1733605 - RNA, 18 nt, Salmonella enterica enterica serovar Typhi Ty2
uuucgccgccauccggca

SEQ ID NO: 1733606 - RNA, 19 nt, Salmonella enterica enterica serovar Typhi Ty2
uuucgcccggcgccagcuc

SEQ ID NO: 1733607 - RNA, 15 nt, Salmonella enterica enterica serovar Typhi Ty2
uuuccggcgggagcu

SEQ ID NO: 1733608 - RNA, 18 nt, Salmonella enterica enterica serovar Typhi Ty2
uuuccgcuuuuccugcca

SEQ ID NO: 1733609 - RNA, 17 nt, Salmonella enterica enterica serovar Typhi Ty2
uuucuggcgaugugccc

SEQ ID NO: 1733610 - RNA, 19 nt, Salmonella enterica enterica serovar Typhi Ty2
uuucuguacagcgucgaca

SEQ ID NO: 1733611 - RNA, 22 nt, Salmonella enterica enterica serovar Typhi Ty2
uuuaaaccaugcgagaucggca

SEQ ID NO: 1733612 - RNA, 15 nt, Salmonella enterica enterica serovar Typhi Ty2
uuuaaaacauaucca

SEQ ID NO: 1733613 - RNA, 19 nt, Salmonella enterica enterica serovar Typhi Ty2
uuuaaacuuauccgccauc

SEQ ID NO: 1733614 - RNA, 21 nt, Salmonella enterica enterica serovar Typhi Ty2
uuuaccggaucgaucccggca

SEQ ID NO: 1733615 - RNA, 20 nt, Salmonella enterica enterica serovar Typhi Ty2
uuuacccagcgaaugcugca

SEQ ID NO: 1733616 - RNA, 14 nt, Salmonella enterica enterica serovar Typhi Ty2
uuuccagcagccag

SEQ ID NO: 1733617 - RNA, 12 nt, Salmonella enterica enterica serovar Typhi Ty2
uuuccaucgccg

SEQ ID NO: 1733618 - RNA, 22 nt, Salmonella enterica enterica serovar Typhi Ty2
uuugccccagauacgcacggug

SEQ ID NO: 1733619 - RNA, 15 nt, Salmonella enterica enterica serovar Typhi Ty2
uuugcccagcgcugg

SEQ ID NO: 1733620 - RNA, 14 nt, Salmonella enterica enterica serovar Typhi Ty2
uuugccauccggcg

SEQ ID NO: 1733621 - RNA, 21 nt, Salmonella enterica enterica serovar Typhi Ty2
uuugcaccaucaacgccggug

SEQ ID NO: 1733622 - RNA, 16 nt, Salmonella enterica enterica serovar Typhi Ty2
uuugcaggccggauaa

SEQ ID NO: 1733623 - RNA, 19 nt, Salmonella enterica enterica serovar Typhi Ty2
uuugauccguuucagaaag

SEQ ID NO: 1733624 - RNA, 23 nt, Salmonella enterica enterica serovar Typhi Ty2
uuugacccacgccagcagcucgc

SEQ ID NO: 1733625 - RNA, 19 nt, Salmonella enterica enterica serovar Typhi Ty2
uuuguaggccugauaagcg

SEQ ID NO: 1733626 - RNA, 19 nt, Salmonella enterica enterica serovar Typhi Ty2
uuuguaaacccgauucugc

SEQ ID NO: 1733627 - RNA, 21 nt, Salmonella enterica enterica serovar Typhi Ty2
uuuggcggcaagaucauccgg

SEQ ID NO: 1733628 - RNA, 19 nt, Salmonella enterica enterica serovar Typhi Ty2
uuuggcucacugcuaagga

SEQ ID NO: 1733629 - RNA, 15 nt, Salmonella enterica enterica serovar Typhi Ty2
uuugcuuauccggcc

SEQ ID NO: 1733630 - RNA, 13 nt, Salmonella enterica enterica serovar Typhi Ty2
uucaucaaauaag

SEQ ID NO: 1733631 - RNA, 23 nt, Salmonella enterica enterica serovar Typhi Ty2
uucagggggccacuuacggacaa

SEQ ID NO: 1733632 - RNA, 14 nt, Salmonella enterica enterica serovar Typhi Ty2
uucaggggucccca

SEQ ID NO: 1733633 - RNA, 15 nt, Salmonella enterica enterica serovar Typhi Ty2
uucaggcgcugucug

SEQ ID NO: 1733634 - RNA, 14 nt, Salmonella enterica enterica serovar Typhi Ty2
uucaucgccgcgac

SEQ ID NO: 1733635 - RNA, 21 nt, Salmonella enterica enterica serovar Typhi Ty2
uucaucgcuuuuaccaggaau

SEQ ID NO: 1733636 - RNA, 20 nt, Salmonella enterica enterica serovar Typhi Ty2
uucauccaugccaagcggca

SEQ ID NO: 1733637 - RNA, 23 nt, Salmonella enterica enterica serovar Typhi Ty2
uucaucccugcgacggcuaccug

SEQ ID NO: 1733638 - RNA, 18 nt, Salmonella enterica enterica serovar Typhi Ty2
uucaugaaucaucacaau

SEQ ID NO: 1733639 - RNA, 15 nt, Salmonella enterica enterica serovar Typhi Ty2
uucauggauaccggg

SEQ ID NO: 1733640 - RNA, 21 nt, Salmonella enterica enterica serovar Typhi Ty2
uuauccgccagcgcaacgcgc

SEQ ID NO: 1733641 - RNA, 19 nt, Salmonella enterica enterica serovar Typhi Ty2
uucacgacgcucauuaacg

SEQ ID NO: 1733642 - RNA, 20 nt, Salmonella enterica enterica serovar Typhi Ty2
uucacgcuauguuugcugag

SEQ ID NO: 1733643 - RNA, 22 nt, Salmonella enterica enterica serovar Typhi Ty2
uucaggacgagagacugauaau

SEQ ID NO: 1733644 - RNA, 21 nt, Salmonella enterica enterica serovar Typhi Ty2
uucagcagcgaauagcggcaa

SEQ ID NO: 1733645 - RNA, 19 nt, Salmonella enterica enterica serovar Typhi Ty2
uucagcacgcuuacccagc

SEQ ID NO: 1733646 - RNA, 13 nt, Salmonella enterica enterica serovar Typhi Ty2
uucagcacccagc

SEQ ID NO: 1733647 - RNA, 16 nt, Salmonella enterica enterica serovar Typhi Ty2
uucacuggcaugcgcc

SEQ ID NO: 1733648 - RNA, 11 nt, Salmonella enterica enterica serovar Typhi Ty2
uucagaucaaa

SEQ ID NO: 1733649 - RNA, 17 nt, Salmonella enterica enterica serovar Typhi Ty2
uuccacucuucgggaau

SEQ ID NO: 1733650 - RNA, 16 nt, Salmonella enterica enterica serovar Typhi Ty2
uuccacgcacgccggc

SEQ ID NO: 1733651 - RNA, 16 nt, Salmonella enterica enterica serovar Typhi Ty2
uuccagccaugccagc

SEQ ID NO: 1733652 - RNA, 22 nt, Salmonella enterica enterica serovar Typhi Ty2
uuccagcagccagccguugugc

SEQ ID NO: 1733653 - RNA, 17 nt, Salmonella enterica enterica serovar Typhi Ty2
uuccagcagcucaucaa

SEQ ID NO: 1733654 - RNA, 17 nt, Salmonella enterica enterica serovar Typhi Ty2
uucauuucuuccagcac

SEQ ID NO: 1733655 - RNA, 20 nt, Salmonella enterica enterica serovar Typhi Ty2
uucauugucuuuuucucaau

SEQ ID NO: 1733656 - RNA, 13 nt, Salmonella enterica enterica serovar Typhi Ty2
uucauuacaggug

SEQ ID NO: 1733657 - RNA, 13 nt, Salmonella enterica enterica serovar Typhi Ty2
uuccaccgccaau

SEQ ID NO: 1733658 - RNA, 22 nt, Salmonella enterica enterica serovar Typhi Ty2
uuccaccagccaggccgccagc

SEQ ID NO: 1733659 - RNA, 16 nt, Salmonella enterica enterica serovar Typhi Ty2
uuccaucagccaggcg

SEQ ID NO: 1733660 - RNA, 13 nt, Salmonella enterica enterica serovar Typhi Ty2
uuccauucccgcc

SEQ ID NO: 1733661 - RNA, 18 nt, Salmonella enterica enterica serovar Typhi Ty2
uuccaguagucgcgccau

SEQ ID NO: 1733662 - RNA, 15 nt, Salmonella enterica enterica serovar Typhi Ty2
uuccaggccgccagc

SEQ ID NO: 1733663 - RNA, 14 nt, Salmonella enterica enterica serovar Typhi Ty2
uuccaggacggaca

SEQ ID NO: 1733664 - RNA, 16 nt, Salmonella enterica enterica serovar Typhi Ty2
uuccagcgugccgagc

SEQ ID NO: 1733665 - RNA, 16 nt, Salmonella enterica enterica serovar Typhi Ty2
uucccugacgcgcagc

SEQ ID NO: 1733666 - RNA, 12 nt, Salmonella enterica enterica serovar Typhi Ty2
uucccugaccag

SEQ ID NO: 1733667 - RNA, 16 nt, Salmonella enterica enterica serovar Typhi Ty2
uuccgcaucaauaugc

SEQ ID NO: 1733668 - RNA, 18 nt, Salmonella enterica enterica serovar Typhi Ty2
uuccgcaucaauaugcgu

SEQ ID NO: 1733669 - RNA, 21 nt, Salmonella enterica enterica serovar Typhi Ty2
uucccacagcuucaggcucau

SEQ ID NO: 1733670 - RNA, 18 nt, Salmonella enterica enterica serovar Typhi Ty2
uucccaagucacgcccgc

SEQ ID NO: 1733671 - RNA, 21 nt, Salmonella enterica enterica serovar Typhi Ty2
uucgacaauguccgccagacu

SEQ ID NO: 1733672 - RNA, 13 nt, Salmonella enterica enterica serovar Typhi Ty2
uucgcccagucau

SEQ ID NO: 1733673 - RNA, 16 nt, Salmonella enterica enterica serovar Typhi Ty2
uucgcccggcgccagc

SEQ ID NO: 1733674 - RNA, 17 nt, Salmonella enterica enterica serovar Typhi Ty2
uuccgcuggugcguaac

SEQ ID NO: 1733675 - RNA, 20 nt, Salmonella enterica enterica serovar Typhi Ty2
uuccgcggagagaucgacag

SEQ ID NO: 1733676 - RNA, 20 nt, Salmonella enterica enterica serovar Typhi Ty2
uuccgccgucgugccugacg

SEQ ID NO: 1733677 - RNA, 14 nt, Salmonella enterica enterica serovar Typhi Ty2
uucgcgguaaucgc

SEQ ID NO: 1733678 - RNA, 20 nt, Salmonella enterica enterica serovar Typhi Ty2
aaucacguuuugcagcgcca

SEQ ID NO: 1733679 - RNA, 18 nt, Salmonella enterica enterica serovar Typhi Ty2
aaucacugccgccacgcc

SEQ ID NO: 1733680 - RNA, 13 nt, Salmonella enterica enterica serovar Typhi Ty2
aaucacguaaucg

SEQ ID NO: 1733681 - RNA, 23 nt, Salmonella enterica enterica serovar Typhi Ty2
aaucagcacauucagcagcgccc

SEQ ID NO: 1733682 - RNA, 18 nt, Salmonella enterica enterica serovar Typhi Ty2
aaucagccacggcaacgc

SEQ ID NO: 1733683 - RNA, 17 nt, Salmonella enterica enterica serovar Typhi Ty2
aaucagccgacggcgau

SEQ ID NO: 1733684 - RNA, 14 nt, Salmonella enterica enterica serovar Typhi Ty2
uucuccagcagacg

SEQ ID NO: 1733685 - RNA, 16 nt, Salmonella enterica enterica serovar Typhi Ty2
uucugcgccagccagc

SEQ ID NO: 1733686 - RNA, 13 nt, Salmonella enterica enterica serovar Typhi Ty2
uucugccagguuc

SEQ ID NO: 1733687 - RNA, 14 nt, Salmonella enterica enterica serovar Typhi Ty2
uucugcuccagacg

SEQ ID NO: 1733688 - RNA, 15 nt, Salmonella enterica enterica serovar Typhi Ty2
uucugcgucaugcuu

SEQ ID NO: 1733689 - RNA, 14 nt, Salmonella enterica enterica serovar Typhi Ty2
uucuccugccagcg

SEQ ID NO: 1733690 - RNA, 13 nt, Salmonella enterica enterica serovar Typhi Ty2
uucucgauaucuu

SEQ ID NO: 1733691 - RNA, 18 nt, Salmonella enterica enterica serovar Typhi Ty2
uucucgcccgccagaucg

SEQ ID NO: 1733692 - RNA, 21 nt, Salmonella enterica enterica serovar Typhi Ty2
uucgucggggauucgccagcg

SEQ ID NO: 1733693 - RNA, 16 nt, Salmonella enterica enterica serovar Typhi Ty2
uucguugguaccgcuu

SEQ ID NO: 1733694 - RNA, 13 nt, Salmonella enterica enterica serovar Typhi Ty2
uuaaaugcgccca

SEQ ID NO: 1733695 - RNA, 16 nt, Salmonella enterica enterica serovar Typhi Ty2
uuaaaugcuugcuuua

SEQ ID NO: 1733696 - RNA, 14 nt, Salmonella enterica enterica serovar Typhi Ty2
uuaaaucagauaac

SEQ ID NO: 1733697 - RNA, 13 nt, Salmonella enterica enterica serovar Typhi Ty2
uuaaagucgcggu

SEQ ID NO: 1733698 - RNA, 18 nt, Salmonella enterica enterica serovar Typhi Ty2
uuaaacagcgaucacgcc

SEQ ID NO: 1733699 - RNA, 15 nt, Salmonella enterica enterica serovar Typhi Ty2
uguugaugucacuca

SEQ ID NO: 1733700 - RNA, 23 nt, Salmonella enterica enterica serovar Typhi Ty2
uguucuugcugcugcugauggcc

SEQ ID NO: 1733701 - RNA, 14 nt, Salmonella enterica enterica serovar Typhi Ty2
uuaauacaucaaca

SEQ ID NO: 1733702 - RNA, 12 nt, Salmonella enterica enterica serovar Typhi Ty2
uuacaggcugga

SEQ ID NO: 1733703 - RNA, 14 nt, Salmonella enterica enterica serovar Typhi Ty2
uuaccauuacgcua

SEQ ID NO: 1733704 - RNA, 13 nt, Salmonella enterica enterica serovar Typhi Ty2
uuaccaaucgcgg

SEQ ID NO: 1733705 - RNA, 13 nt, Salmonella enterica enterica serovar Typhi Ty2
uuaaugauuugcu

SEQ ID NO: 1733706 - RNA, 23 nt, Salmonella enterica enterica serovar Typhi Ty2
uuaaugcgccccugcaggcgauc

SEQ ID NO: 1733707 - RNA, 15 nt, Salmonella enterica enterica serovar Typhi Ty2
uuaaugcgacgccca

SEQ ID NO: 1733708 - RNA, 19 nt, Salmonella enterica enterica serovar Typhi Ty2
uuaucaacaaauuccggca

SEQ ID NO: 1733709 - RNA, 23 nt, Salmonella enterica enterica serovar Typhi Ty2
uuaucaccaaguagacagagaag

SEQ ID NO: 1733710 - RNA, 19 nt, Salmonella enterica enterica serovar Typhi Ty2
uuaucaauaaccgccagca

SEQ ID NO: 1733711 - RNA, 17 nt, Salmonella enterica enterica serovar Typhi Ty2
uuauccauguuuguuua

SEQ ID NO: 1733712 - RNA, 13 nt, Salmonella enterica enterica serovar Typhi Ty2
uuauccaguaacg

SEQ ID NO: 1733713 - RNA, 21 nt, Salmonella enterica enterica serovar Typhi Ty2
uuaucaggccuaccaucgcgc

SEQ ID NO: 1733714 - RNA, 19 nt, Salmonella enterica enterica serovar Typhi Ty2
uuaucaggccuacauccgg

SEQ ID NO: 1733715 - RNA, 21 nt, Salmonella enterica enterica serovar Typhi Ty2
uuaucaggcgacccauaacgg

SEQ ID NO: 1733716 - RNA, 14 nt, Salmonella enterica enterica serovar Typhi Ty2
uuaggaaacauaag

SEQ ID NO: 1733717 - RNA, 22 nt, Salmonella enterica enterica serovar Typhi Ty2
uuaggaaugcccagcucagcuu

SEQ ID NO: 1733718 - RNA, 16 nt, Salmonella enterica enterica serovar Typhi Ty2
uuaguaccgucuggcu

SEQ ID NO: 1733719 - RNA, 22 nt, Salmonella enterica enterica serovar Typhi Ty2
uuagcaaccagcuaaccuguuc

SEQ ID NO: 1733720 - RNA, 16 nt, Salmonella enterica enterica serovar Typhi Ty2
uuagcgaacguccagc

SEQ ID NO: 1733721 - RNA, 15 nt, Salmonella enterica enterica serovar Typhi Ty2
uuagccagauggcug

SEQ ID NO: 1733722 - RNA, 20 nt, Salmonella enterica enterica serovar Typhi Ty2
uuacgccauaaaaagcguac

SEQ ID NO: 1733723 - RNA, 23 nt, Salmonella enterica enterica serovar Typhi Ty2
uuacgcccuguggaaacuccagc

SEQ ID NO: 1733724 - RNA, 16 nt, Salmonella enterica enterica serovar Typhi Ty2
uguuacugucggcgau

SEQ ID NO: 1733725 - RNA, 15 nt, Salmonella enterica enterica serovar Typhi Ty2
uguggcugucgaccg

SEQ ID NO: 1733726 - RNA, 18 nt, Salmonella enterica enterica serovar Typhi Ty2
ugugcuaucaggccuaca

SEQ ID NO: 1733727 - RNA, 18 nt, Salmonella enterica enterica serovar Typhi Ty2
ugugcgccagccuuaucc

SEQ ID NO: 1733728 - RNA, 15 nt, Salmonella enterica enterica serovar Typhi Ty2
ugugccaauaacgcc

SEQ ID NO: 1733729 - RNA, 17 nt, Salmonella enterica enterica serovar Typhi Ty2
ugugccgaagucaaagg

SEQ ID NO: 1733730 - RNA, 17 nt, Salmonella enterica enterica serovar Typhi Ty2
ugucggucaggcugcgg

SEQ ID NO: 1733731 - RNA, 21 nt, Salmonella enterica enterica serovar Typhi Ty2
ugucagaucguaugcgccugu

SEQ ID NO: 1733732 - RNA, 19 nt, Salmonella enterica enterica serovar Typhi Ty2
ugugauugaauucaccgca

SEQ ID NO: 1733733 - RNA, 16 nt, Salmonella enterica enterica serovar Typhi Ty2
ugugaucaccgcccug

SEQ ID NO: 1733734 - RNA, 12 nt, Salmonella enterica enterica serovar Typhi Ty2
ugugaaacgcga

SEQ ID NO: 1733735 - RNA, 19 nt, Salmonella enterica enterica serovar Typhi Ty2
ugugaauaugaucugcaca

SEQ ID NO: 1733736 - RNA, 19 nt, Salmonella enterica enterica serovar Typhi Ty2
ugugaauaugaucugcgca

SEQ ID NO: 1733737 - RNA, 20 nt, Salmonella enterica enterica serovar Typhi Ty2
ugucuucccugaccagcgac

SEQ ID NO: 1733738 - RNA, 11 nt, Salmonella enterica enterica serovar Typhi Ty2
ugucuaccgcg

SEQ ID NO: 1733739 - RNA, 20 nt, Salmonella enterica enterica serovar Typhi Ty2
ugucguuguaguuaucgccg

SEQ ID NO: 1733740 - RNA, 19 nt, Salmonella enterica enterica serovar Typhi Ty2
ugcugaucuggcugcguaa

SEQ ID NO: 1733741 - RNA, 16 nt, Salmonella enterica enterica serovar Typhi Ty2
ugcugcacauucaggu

SEQ ID NO: 1733742 - RNA, 19 nt, Salmonella enterica enterica serovar Typhi Ty2
aauauagccguggcuggcg

SEQ ID NO: 1733743 - RNA, 14 nt, Salmonella enterica enterica serovar Typhi Ty2
ugcucccccaguug

SEQ ID NO: 1733744 - RNA, 19 nt, Salmonella enterica enterica serovar Typhi Ty2
uggaacaggccaaacccug

SEQ ID NO: 1733745 - RNA, 14 nt, Salmonella enterica enterica serovar Typhi Ty2
uggaaaccgcagaa

SEQ ID NO: 1733746 - RNA, 17 nt, Salmonella enterica enterica serovar Typhi Ty2
ugcuucuugaguuggca

SEQ ID NO: 1733747 - RNA, 12 nt, Salmonella enterica enterica serovar Typhi Ty2
ugcuuugcggca

SEQ ID NO: 1733748 - RNA, 15 nt, Salmonella enterica enterica serovar Typhi Ty2
ugcuuucuccugcgg

SEQ ID NO: 1733749 - RNA, 18 nt, Salmonella enterica enterica serovar Typhi Ty2
ugcugcuuuaaccuggcg

SEQ ID NO: 1733750 - RNA, 20 nt, Salmonella enterica enterica serovar Typhi Ty2
ugcuucacguuuuccaggug

SEQ ID NO: 1733751 - RNA, 22 nt, Salmonella enterica enterica serovar Typhi Ty2
ugcuucaugcacaaaacccgca

SEQ ID NO: 1733752 - RNA, 20 nt, Salmonella enterica enterica serovar Typhi Ty2
ugcuuaccaucuggccuacg

SEQ ID NO: 1733753 - RNA, 17 nt, Salmonella enterica enterica serovar Typhi Ty2
ugcuuaccgcaucgccc

SEQ ID NO: 1733754 - RNA, 20 nt, Salmonella enterica enterica serovar Typhi Ty2
ugcggcuuugcgccggcagu

SEQ ID NO: 1733755 - RNA, 18 nt, Salmonella enterica enterica serovar Typhi Ty2
ugcggcuaauacgccagc

SEQ ID NO: 1733756 - RNA, 17 nt, Salmonella enterica enterica serovar Typhi Ty2
ugcggauuacgaauacc

SEQ ID NO: 1733757 - RNA, 20 nt, Salmonella enterica enterica serovar Typhi Ty2
ugcgcuuuaugcccuucgac

SEQ ID NO: 1733758 - RNA, 18 nt, Salmonella enterica enterica serovar Typhi Ty2
ugcgcuuuuagccaguug

SEQ ID NO: 1733759 - RNA, 14 nt, Salmonella enterica enterica serovar Typhi Ty2
ugcggaacaccagc

SEQ ID NO: 1733760 - RNA, 16 nt, Salmonella enterica enterica serovar Typhi Ty2
ugcgccuaccgccaua

SEQ ID NO: 1733761 - RNA, 16 nt, Salmonella enterica enterica serovar Typhi Ty2
ugcgcuucggccacgg

SEQ ID NO: 1733762 - RNA, 19 nt, Salmonella enterica enterica serovar Typhi Ty2
ugcgcuuaucaggccuacg

SEQ ID NO: 1733763 - RNA, 19 nt, Salmonella enterica enterica serovar Typhi Ty2
ugcgcuuaucaggccuaca

SEQ ID NO: 1733764 - RNA, 13 nt, Salmonella enterica enterica serovar Typhi Ty2
ugcgguaccgcgu

SEQ ID NO: 1733765 - RNA, 22 nt, Salmonella enterica enterica serovar Typhi Ty2
ugcgggaguggcgaaauuggua

SEQ ID NO: 1733766 - RNA, 23 nt, Salmonella enterica enterica serovar Typhi Ty2
ugcgucguuggcauggucagcau

SEQ ID NO: 1733767 - RNA, 20 nt, Salmonella enterica enterica serovar Typhi Ty2
ugcgucgcgcuuucaaucgu

SEQ ID NO: 1733768 - RNA, 17 nt, Salmonella enterica enterica serovar Typhi Ty2
ugcgucgcguaccagcg

SEQ ID NO: 1733769 - RNA, 17 nt, Salmonella enterica enterica serovar Typhi Ty2
ugcguaauccggccugg

SEQ ID NO: 1733770 - RNA, 17 nt, Salmonella enterica enterica serovar Typhi Ty2
ugcgguuaaaccaggcg

SEQ ID NO: 1733771 - RNA, 20 nt, Salmonella enterica enterica serovar Typhi Ty2
ugcgccauucuuucgcguaa

SEQ ID NO: 1733772 - RNA, 21 nt, Salmonella enterica enterica serovar Typhi Ty2
ugcgccaucgcgaccggauca

SEQ ID NO: 1733773 - RNA, 20 nt, Salmonella enterica enterica serovar Typhi Ty2
ugcgccauuuccagccccga

SEQ ID NO: 1733774 - RNA, 19 nt, Salmonella enterica enterica serovar Typhi Ty2
ugcgcccaucaucaucggc

SEQ ID NO: 1733775 - RNA, 17 nt, Salmonella enterica enterica serovar Typhi Ty2
ugcgccccuugcagcaa

SEQ ID NO: 1733776 - RNA, 23 nt, Salmonella enterica enterica serovar Typhi Ty2
ugcgccgacggaacccagcaaau

SEQ ID NO: 1733777 - RNA, 19 nt, Salmonella enterica enterica serovar Typhi Ty2
ugcgccagaauugccugau

SEQ ID NO: 1733778 - RNA, 21 nt, Salmonella enterica enterica serovar Typhi Ty2
ugcgccagcccggcgaaagcg

SEQ ID NO: 1733779 - RNA, 13 nt, Salmonella enterica enterica serovar Typhi Ty2
ugcgccagcgccg

SEQ ID NO: 1733780 - RNA, 23 nt, Salmonella enterica enterica serovar Typhi Ty2
ugcgccaagaccgccuaacagcg

SEQ ID NO: 1733781 - RNA, 12 nt, Salmonella enterica enterica serovar Typhi Ty2
aauauaagaucu

SEQ ID NO: 1733782 - RNA, 15 nt, Salmonella enterica enterica serovar Typhi Ty2
aauagcuggcugucu

SEQ ID NO: 1733783 - RNA, 22 nt, Salmonella enterica enterica serovar Typhi Ty2
ugccuguguucguggacgagca

SEQ ID NO: 1733784 - RNA, 13 nt, Salmonella enterica enterica serovar Typhi Ty2
ugccugucacgca

SEQ ID NO: 1733785 - RNA, 18 nt, Salmonella enterica enterica serovar Typhi Ty2
ugccuucgccgccgcuga

SEQ ID NO: 1733786 - RNA, 14 nt, Salmonella enterica enterica serovar Typhi Ty2
ugccuuuacuguug

SEQ ID NO: 1733787 - RNA, 17 nt, Salmonella enterica enterica serovar Typhi Ty2
ugcgaaaaaaagcccga

SEQ ID NO: 1733788 - RNA, 13 nt, Salmonella enterica enterica serovar Typhi Ty2
ugcgaaaagccgg

SEQ ID NO: 1733789 - RNA, 19 nt, Salmonella enterica enterica serovar Typhi Ty2
ugccgcuuaaauuaccgcc

SEQ ID NO: 1733790 - RNA, 15 nt, Salmonella enterica enterica serovar Typhi Ty2
ugccgacgcgaugcc

SEQ ID NO: 1733791 - RNA, 17 nt, Salmonella enterica enterica serovar Typhi Ty2
ugccggauggcggcgua

SEQ ID NO: 1733792 - RNA, 14 nt, Salmonella enterica enterica serovar Typhi Ty2
ugccggacgccacc

SEQ ID NO: 1733793 - RNA, 13 nt, Salmonella enterica enterica serovar Typhi Ty2
ugccggauggcgu

SEQ ID NO: 1733794 - RNA, 17 nt, Salmonella enterica enterica serovar Typhi Ty2
ugccggauggcggcgug

SEQ ID NO: 1733795 - RNA, 14 nt, Salmonella enterica enterica serovar Typhi Ty2
ugccggauggcguu

SEQ ID NO: 1733796 - RNA, 13 nt, Salmonella enterica enterica serovar Typhi Ty2
ugccggcaucauu

SEQ ID NO: 1733797 - RNA, 18 nt, Salmonella enterica enterica serovar Typhi Ty2
ugccgguuuuugaaccau

SEQ ID NO: 1733798 - RNA, 15 nt, Salmonella enterica enterica serovar Typhi Ty2
ugccggugcgagaaa

SEQ ID NO: 1733799 - RNA, 22 nt, Salmonella enterica enterica serovar Typhi Ty2
aauagcgaucgagauaagaucu

SEQ ID NO: 1733800 - RNA, 20 nt, Salmonella enterica enterica serovar Typhi Ty2
ugccgucguacucaccaguc

SEQ ID NO: 1733801 - RNA, 15 nt, Salmonella enterica enterica serovar Typhi Ty2
uggacaauccgcgaa

SEQ ID NO: 1733802 - RNA, 15 nt, Salmonella enterica enterica serovar Typhi Ty2
uggccacaucguuac

SEQ ID NO: 1733803 - RNA, 12 nt, Salmonella enterica enterica serovar Typhi Ty2
uggccaggcuuu

SEQ ID NO: 1733804 - RNA, 14 nt, Salmonella enterica enterica serovar Typhi Ty2
uggccaucuuccag

SEQ ID NO: 1733805 - RNA, 15 nt, Salmonella enterica enterica serovar Typhi Ty2
uggccgcagcgccau

SEQ ID NO: 1733806 - RNA, 12 nt, Salmonella enterica enterica serovar Typhi Ty2
uggccgaacacg

SEQ ID NO: 1733807 - RNA, 22 nt, Salmonella enterica enterica serovar Typhi Ty2
uggcgaauccuaaacucaacug

SEQ ID NO: 1733808 - RNA, 16 nt, Salmonella enterica enterica serovar Typhi Ty2
uggcgacacuugcgca

SEQ ID NO: 1733809 - RNA, 18 nt, Salmonella enterica enterica serovar Typhi Ty2
uggcgaacgacucacgcg

SEQ ID NO: 1733810 - RNA, 18 nt, Salmonella enterica enterica serovar Typhi Ty2
uggcgcacaucgugcgcc

SEQ ID NO: 1733811 - RNA, 18 nt, Salmonella enterica enterica serovar Typhi Ty2
uggcgauuuucaccggcg

SEQ ID NO: 1733812 - RNA, 20 nt, Salmonella enterica enterica serovar Typhi Ty2
uggcgcgaagugccagguuu

SEQ ID NO: 1733813 - RNA, 21 nt, Salmonella enterica enterica serovar Typhi Ty2
uggcgccuuuuggcagcagcg

SEQ ID NO: 1733814 - RNA, 16 nt, Salmonella enterica enterica serovar Typhi Ty2
uggcgcuaagacguga

SEQ ID NO: 1733815 - RNA, 19 nt, Salmonella enterica enterica serovar Typhi Ty2
uggcgcuaaugcuuauccg

SEQ ID NO: 1733816 - RNA, 18 nt, Salmonella enterica enterica serovar Typhi Ty2
uggcgcuacgcuuaucag

SEQ ID NO: 1733817 - RNA, 18 nt, Salmonella enterica enterica serovar Typhi Ty2
uggcgcuacgcuuauccg

SEQ ID NO: 1733818 - RNA, 21 nt, Salmonella enterica enterica serovar Typhi Ty2
uggcgcucggaugugcauuga

SEQ ID NO: 1733819 - RNA, 21 nt, Salmonella enterica enterica serovar Typhi Ty2
uggcgcgucuguguuuauccg

SEQ ID NO: 1733820 - RNA, 18 nt, Salmonella enterica enterica serovar Typhi Ty2
uggcgcugcgcuuaucag

SEQ ID NO: 1733821 - RNA, 19 nt, Salmonella enterica enterica serovar Typhi Ty2
uggcgcugccgcuuauccg

SEQ ID NO: 1733822 - RNA, 18 nt, Salmonella enterica enterica serovar Typhi Ty2
uggcgcugcgcuuauccg

SEQ ID NO: 1733823 - RNA, 20 nt, Salmonella enterica enterica serovar Typhi Ty2
uggcgcugcguuuaucaggc

SEQ ID NO: 1733824 - RNA, 18 nt, Salmonella enterica enterica serovar Typhi Ty2
uggcgcuuugcuuauccg

SEQ ID NO: 1733825 - RNA, 15 nt, Salmonella enterica enterica serovar Typhi Ty2
uggcgggcuuauccc

SEQ ID NO: 1733826 - RNA, 21 nt, Salmonella enterica enterica serovar Typhi Ty2
uggcggcuaacgccugauccg

SEQ ID NO: 1733827 - RNA, 20 nt, Salmonella enterica enterica serovar Typhi Ty2
uggcggcuacgccuuacccg

SEQ ID NO: 1733828 - RNA, 23 nt, Salmonella enterica enterica serovar Typhi Ty2
uggcgguauaacugccuuauccg

SEQ ID NO: 1733829 - RNA, 23 nt, Salmonella enterica enterica serovar Typhi Ty2
uggcguccggccacuauuucggc

SEQ ID NO: 1733830 - RNA, 17 nt, Salmonella enterica enterica serovar Typhi Ty2
aauaucgagcggcagua

SEQ ID NO: 1733831 - RNA, 14 nt, Salmonella enterica enterica serovar Typhi Ty2
aauauccuccggcg

SEQ ID NO: 1733832 - RNA, 16 nt, Salmonella enterica enterica serovar Typhi Ty2
aauauuaucgccauca

SEQ ID NO: 1733833 - RNA, 20 nt, Salmonella enterica enterica serovar Typhi Ty2
aauaugcuguuuauggcgcu

SEQ ID NO: 1733834 - RNA, 21 nt, Salmonella enterica enterica serovar Typhi Ty2
aauauugccauaaauacaauu

SEQ ID NO: 1733835 - RNA, 22 nt, Salmonella enterica enterica serovar Typhi Ty2
aaucaccuuacgcucgcugaug

SEQ ID NO: 1733836 - RNA, 20 nt, Salmonella enterica enterica serovar Typhi Ty2
uguaggccggauaagcauua

SEQ ID NO: 1733837 - RNA, 20 nt, Salmonella enterica enterica serovar Typhi Ty2
uguaggccggauaagcggca

SEQ ID NO: 1733838 - RNA, 21 nt, Salmonella enterica enterica serovar Typhi Ty2
uguaggcccgguaagcgcuag

SEQ ID NO: 1733839 - RNA, 18 nt, Salmonella enterica enterica serovar Typhi Ty2
aaucaccuuacgcucgcu

SEQ ID NO: 1733840 - RNA, 20 nt, Salmonella enterica enterica serovar Typhi Ty2
uguaggcccgguaagcgcag

SEQ ID NO: 1733841 - RNA, 16 nt, Salmonella enterica enterica serovar Typhi Ty2
uguaggcacuuuccag

SEQ ID NO: 1733842 - RNA, 15 nt, Salmonella enterica enterica serovar Typhi Ty2
uguagcuugaaagcg

SEQ ID NO: 1733843 - RNA, 16 nt, Salmonella enterica enterica serovar Typhi Ty2
uguacgaccgucaaac

SEQ ID NO: 1733844 - RNA, 20 nt, Salmonella enterica enterica serovar Typhi Ty2
uguaccggcaggugauggcg

SEQ ID NO: 1733845 - RNA, 21 nt, Salmonella enterica enterica serovar Typhi Ty2
uguaccgucccuaagccggca

SEQ ID NO: 1733846 - RNA, 14 nt, Salmonella enterica enterica serovar Typhi Ty2
ugguuucgcgguga

SEQ ID NO: 1733847 - RNA, 19 nt, Salmonella enterica enterica serovar Typhi Ty2
ugguuucccugaccaguug

SEQ ID NO: 1733848 - RNA, 15 nt, Salmonella enterica enterica serovar Typhi Ty2
uggugcguccgguag

SEQ ID NO: 1733849 - RNA, 21 nt, Salmonella enterica enterica serovar Typhi Ty2
uggugcagccgccaucgcuga

SEQ ID NO: 1733850 - RNA, 20 nt, Salmonella enterica enterica serovar Typhi Ty2
uggugcaagcaccuuauccg

SEQ ID NO: 1733851 - RNA, 23 nt, Salmonella enterica enterica serovar Typhi Ty2
uggucucucgugcaggccggaua

SEQ ID NO: 1733852 - RNA, 13 nt, Salmonella enterica enterica serovar Typhi Ty2
aaaucgucgccaa

SEQ ID NO: 1733853 - RNA, 21 nt, Salmonella enterica enterica serovar Typhi Ty2
aaaugccuguuuauauucugg

SEQ ID NO: 1733854 - RNA, 21 nt, Salmonella enterica enterica serovar Typhi Ty2
aaaucuggugauaaagcagac

SEQ ID NO: 1733855 - RNA, 15 nt, Salmonella enterica enterica serovar Typhi Ty2
aaauggguaucuuca

SEQ ID NO: 1733856 - RNA, 23 nt, Salmonella enterica enterica serovar Typhi Ty2
aaauuccagcaaugagccgucgc

SEQ ID NO: 1733857 - RNA, 18 nt, Salmonella enterica enterica serovar Typhi Ty2
aaauugagaauuauucgu

SEQ ID NO: 1733858 - RNA, 22 nt, Salmonella enterica enterica serovar Typhi Ty2
aaauugaccucacgcuuaucgc

SEQ ID NO: 1733859 - RNA, 18 nt, Salmonella enterica enterica serovar Typhi Ty2
aaauugccugauggcgcu

SEQ ID NO: 1733860 - RNA, 19 nt, Salmonella enterica enterica serovar Typhi Ty2
aaaagccacgcaagcagca

SEQ ID NO: 1733861 - RNA, 11 nt, Salmonella enterica enterica serovar Typhi Ty2
aaaagcagcau

SEQ ID NO: 1733862 - RNA, 17 nt, Salmonella enterica enterica serovar Typhi Ty2
aacagguaguuaccgua

SEQ ID NO: 1733863 - RNA, 16 nt, Salmonella enterica enterica serovar Typhi Ty2
aacagguacuuaccca

SEQ ID NO: 1733864 - RNA, 15 nt, Salmonella enterica enterica serovar Typhi Ty2
aacagccagaagccu

SEQ ID NO: 1733865 - RNA, 16 nt, Salmonella enterica enterica serovar Typhi Ty2
aacagcggcaggcgga

SEQ ID NO: 1733866 - RNA, 14 nt, Salmonella enterica enterica serovar Typhi Ty2
aaaagcgacgcugu

SEQ ID NO: 1733867 - RNA, 12 nt, Salmonella enterica enterica serovar Typhi Ty2
aacacuuugcgc

SEQ ID NO: 1733868 - RNA, 14 nt, Salmonella enterica enterica serovar Typhi Ty2
aaauagccagcauc

SEQ ID NO: 1733869 - RNA, 12 nt, Salmonella enterica enterica serovar Typhi Ty2
aaauaccagcac

SEQ ID NO: 1733870 - RNA, 14 nt, Salmonella enterica enterica serovar Typhi Ty2
aaaguuaaucagcg

SEQ ID NO: 1733871 - RNA, 23 nt, Salmonella enterica enterica serovar Typhi Ty2
aaauauccgccaucgacagcgcc

SEQ ID NO: 1733872 - RNA, 20 nt, Salmonella enterica enterica serovar Typhi Ty2
aaauauugauuaaucgucau

SEQ ID NO: 1733873 - RNA, 19 nt, Salmonella enterica enterica serovar Typhi Ty2
aaaggcgcaacgucgccau

SEQ ID NO: 1733874 - RNA, 12 nt, Salmonella enterica enterica serovar Typhi Ty2
aaaggcguauuc

SEQ ID NO: 1733875 - RNA, 23 nt, Salmonella enterica enterica serovar Typhi Ty2
aaagcuccggacgcaccagccag

SEQ ID NO: 1733876 - RNA, 17 nt, Salmonella enterica enterica serovar Typhi Ty2
aaagcguuggcgugcga

SEQ ID NO: 1733877 - RNA, 15 nt, Salmonella enterica enterica serovar Typhi Ty2
aaagcguugcaaccc

SEQ ID NO: 1733878 - RNA, 12 nt, Salmonella enterica enterica serovar Typhi Ty2
aaaaaaccguau

SEQ ID NO: 1733879 - RNA, 16 nt, Salmonella enterica enterica serovar Typhi Ty2
aaacgaaucucaucag

SEQ ID NO: 1733880 - RNA, 16 nt, Salmonella enterica enterica serovar Typhi Ty2
aaaaacacuggcgcuc

SEQ ID NO: 1733881 - RNA, 17 nt, Salmonella enterica enterica serovar Typhi Ty2
aaacgguucagucagcg

SEQ ID NO: 1733882 - RNA, 22 nt, Salmonella enterica enterica serovar Typhi Ty2
aaacgccaagaaugaaacaagc

SEQ ID NO: 1733883 - RNA, 15 nt, Salmonella enterica enterica serovar Typhi Ty2
aaacgcagcaaacgc

SEQ ID NO: 1733884 - RNA, 17 nt, Salmonella enterica enterica serovar Typhi Ty2
aaacgcaucccagguaa

SEQ ID NO: 1733885 - RNA, 19 nt, Salmonella enterica enterica serovar Typhi Ty2
aaacuaauggcgcagcggu

SEQ ID NO: 1733886 - RNA, 16 nt, Salmonella enterica enterica serovar Typhi Ty2
aaacugaaacguagcg

SEQ ID NO: 1733887 - RNA, 16 nt, Salmonella enterica enterica serovar Typhi Ty2
aaagcaauaauccgcu

SEQ ID NO: 1733888 - RNA, 17 nt, Salmonella enterica enterica serovar Typhi Ty2
aaacuucaucguuacgc

SEQ ID NO: 1733889 - RNA, 20 nt, Salmonella enterica enterica serovar Typhi Ty2
aaagauagcugcuuaccaua

SEQ ID NO: 1733890 - RNA, 17 nt, Salmonella enterica enterica serovar Typhi Ty2
aaccauuucuccugcau

SEQ ID NO: 1733891 - RNA, 21 nt, Salmonella enterica enterica serovar Typhi Ty2
aacccgaucgccauccugcac

SEQ ID NO: 1733892 - RNA, 15 nt, Salmonella enterica enterica serovar Typhi Ty2
aaccccaaaucagca

SEQ ID NO: 1733893 - RNA, 13 nt, Salmonella enterica enterica serovar Typhi Ty2
aacccgccgccau

SEQ ID NO: 1733894 - RNA, 17 nt, Salmonella enterica enterica serovar Typhi Ty2
aacccgccgccaucaac

SEQ ID NO: 1733895 - RNA, 22 nt, Salmonella enterica enterica serovar Typhi Ty2
aaccccggcaaaccuaccggca

SEQ ID NO: 1733896 - RNA, 14 nt, Salmonella enterica enterica serovar Typhi Ty2
aacccggcugccau

SEQ ID NO: 1733897 - RNA, 21 nt, Salmonella enterica enterica serovar Typhi Ty2
aaccgaacaauaugcgcauca

SEQ ID NO: 1733898 - RNA, 19 nt, Salmonella enterica enterica serovar Typhi Ty2
aaccgacaauauucgccgc

SEQ ID NO: 1733899 - RNA, 23 nt, Salmonella enterica enterica serovar Typhi Ty2
aaccgacaauauucgccgcgaua

SEQ ID NO: 1733900 - RNA, 19 nt, Salmonella enterica enterica serovar Typhi Ty2
aacagugggcuaugaagag

SEQ ID NO: 1733901 - RNA, 15 nt, Salmonella enterica enterica serovar Typhi Ty2
aacaucagcgcuacc

SEQ ID NO: 1733902 - RNA, 13 nt, Salmonella enterica enterica serovar Typhi Ty2
aacauagauaacu

SEQ ID NO: 1733903 - RNA, 12 nt, Salmonella enterica enterica serovar Typhi Ty2
aacauaucgccg

SEQ ID NO: 1733904 - RNA, 12 nt, Salmonella enterica enterica serovar Typhi Ty2
aacaucauuauu

SEQ ID NO: 1733905 - RNA, 14 nt, Salmonella enterica enterica serovar Typhi Ty2
aacaugcccaguuu

SEQ ID NO: 1733906 - RNA, 12 nt, Salmonella enterica enterica serovar Typhi Ty2
aacaugcauauu

SEQ ID NO: 1733907 - RNA, 14 nt, Salmonella enterica enterica serovar Typhi Ty2
aacauuucagcgcc

SEQ ID NO: 1733908 - RNA, 20 nt, Salmonella enterica enterica serovar Typhi Ty2
aaccaauuuaaaauccggcu

SEQ ID NO: 1733909 - RNA, 19 nt, Salmonella enterica enterica serovar Typhi Ty2
aacaugccugauggcgcug

SEQ ID NO: 1733910 - RNA, 12 nt, Salmonella enterica enterica serovar Typhi Ty2
aaccagccgauc

SEQ ID NO: 1733911 - RNA, 15 nt, Salmonella enterica enterica serovar Typhi Ty2
aaccacgccgucgcg

SEQ ID NO: 1733912 - RNA, 21 nt, Salmonella enterica enterica serovar Typhi Ty2
aacgcaucgcggauggcggca

SEQ ID NO: 1733913 - RNA, 20 nt, Salmonella enterica enterica serovar Typhi Ty2
aacgcaucgcugcgcuuaca

SEQ ID NO: 1733914 - RNA, 16 nt, Salmonella enterica enterica serovar Typhi Ty2
aacgcauccagcguca

SEQ ID NO: 1733915 - RNA, 14 nt, Salmonella enterica enterica serovar Typhi Ty2
aacgcacuaccaga

SEQ ID NO: 1733916 - RNA, 11 nt, Salmonella enterica enterica serovar Typhi Ty2
aacgcaaccgu

SEQ ID NO: 1733917 - RNA, 18 nt, Salmonella enterica enterica serovar Typhi Ty2
aacgcgaccagcgcgcca

SEQ ID NO: 1733918 - RNA, 14 nt, Salmonella enterica enterica serovar Typhi Ty2
aacgcgacaacgcc

SEQ ID NO: 1733919 - RNA, 21 nt, Salmonella enterica enterica serovar Typhi Ty2
aacgccgaccacuucaacgcc

SEQ ID NO: 1733920 - RNA, 20 nt, Salmonella enterica enterica serovar Typhi Ty2
aacgccgaccacuucaacgc

SEQ ID NO: 1733921 - RNA, 14 nt, Salmonella enterica enterica serovar Typhi Ty2
aacgaaucgaaucg

SEQ ID NO: 1733922 - RNA, 19 nt, Salmonella enterica enterica serovar Typhi Ty2
aacgaacugauguuccggc

SEQ ID NO: 1733923 - RNA, 16 nt, Salmonella enterica enterica serovar Typhi Ty2
aacgauaauucgccgg

SEQ ID NO: 1733924 - RNA, 14 nt, Salmonella enterica enterica serovar Typhi Ty2
aacgauaauucgcc

SEQ ID NO: 1733925 - RNA, 17 nt, Salmonella enterica enterica serovar Typhi Ty2
aacgaucuggucgccaa

SEQ ID NO: 1733926 - RNA, 21 nt, Salmonella enterica enterica serovar Typhi Ty2
aaccgcccgcggcgaucacca

SEQ ID NO: 1733927 - RNA, 19 nt, Salmonella enterica enterica serovar Typhi Ty2
aacguaaucaucaugcugc

SEQ ID NO: 1733928 - RNA, 20 nt, Salmonella enterica enterica serovar Typhi Ty2
aacguaaucaucaugcugca

SEQ ID NO: 1733929 - RNA, 23 nt, Salmonella enterica enterica serovar Typhi Ty2
aacguacggguguccgguagcgu

SEQ ID NO: 1733930 - RNA, 13 nt, Salmonella enterica enterica serovar Typhi Ty2
aacgucagcgcca

SEQ ID NO: 1733931 - RNA, 20 nt, Salmonella enterica enterica serovar Typhi Ty2
aacgucuuauccggccugca

SEQ ID NO: 1733932 - RNA, 12 nt, Salmonella enterica enterica serovar Typhi Ty2
aacgguaacgga

SEQ ID NO: 1733933 - RNA, 12 nt, Salmonella enterica enterica serovar Typhi Ty2
aacgggcgauaa

SEQ ID NO: 1733934 - RNA, 23 nt, Salmonella enterica enterica serovar Typhi Ty2
aacgcuuugcgauagcccggcau

SEQ ID NO: 1733935 - RNA, 13 nt, Salmonella enterica enterica serovar Typhi Ty2
aacgcuuuugcgc

SEQ ID NO: 1733936 - RNA, 15 nt, Salmonella enterica enterica serovar Typhi Ty2
aacggcuacgcagcg

SEQ ID NO: 1733937 - RNA, 13 nt, Salmonella enterica enterica serovar Typhi Ty2
aaucauaaagcgc

SEQ ID NO: 1733938 - RNA, 14 nt, Salmonella enterica enterica serovar Typhi Ty2
aaucagucgcagcg

SEQ ID NO: 1733939 - RNA, 13 nt, Salmonella enterica enterica serovar Typhi Ty2
aaucaucagaauc

SEQ ID NO: 1733940 - RNA, 19 nt, Salmonella enterica enterica serovar Typhi Ty2
aauccaacgaaacgcaucg

SEQ ID NO: 1733941 - RNA, 13 nt, Salmonella enterica enterica serovar Typhi Ty2
aauccagcgcgcu

SEQ ID NO: 1733942 - RNA, 15 nt, Salmonella enterica enterica serovar Typhi Ty2
aauccccgaaagccg

SEQ ID NO: 1733943 - RNA, 23 nt, Salmonella enterica enterica serovar Typhi Ty2
aaucccccggaucaccggcauuu

SEQ ID NO: 1733944 - RNA, 17 nt, Salmonella enterica enterica serovar Typhi Ty2
aaucccgcguucgcgca

SEQ ID NO: 1733945 - RNA, 18 nt, Salmonella enterica enterica serovar Typhi Ty2
aauagccccggucaacgc

SEQ ID NO: 1733946 - RNA, 19 nt, Salmonella enterica enterica serovar Typhi Ty2
aauagcauuaagcugauau

SEQ ID NO: 1733947 - RNA, 19 nt, Salmonella enterica enterica serovar Typhi Ty2
aauagcgccacgcgaugca

SEQ ID NO: 1733948 - RNA, 21 nt, Salmonella enterica enterica serovar Typhi Ty2
aauagcgcugaggcgcuggcu

SEQ ID NO: 1733949 - RNA, 15 nt, Salmonella enterica enterica serovar Typhi Ty2
aauagcgccauccug

SEQ ID NO: 1733950 - RNA, 17 nt, Salmonella enterica enterica serovar Typhi Ty2
aauaguccagcagccau

SEQ ID NO: 1733951 - RNA, 17 nt, Salmonella enterica enterica serovar Typhi Ty2
aauaguguuagcgucag

SEQ ID NO: 1733952 - RNA, 17 nt, Salmonella enterica enterica serovar Typhi Ty2
aaucaggaaagagccgc

SEQ ID NO: 1733953 - RNA, 21 nt, Salmonella enterica enterica serovar Typhi Ty2
aaucagcgcggcgugaucaaa

SEQ ID NO: 1733954 - RNA, 15 nt, Salmonella enterica enterica serovar Typhi Ty2
aaucagcuuugcggc

SEQ ID NO: 1733955 - RNA, 14 nt, Salmonella enterica enterica serovar Typhi Ty2
aaucagaauaccgc

SEQ ID NO: 1733956 - RNA, 13 nt, Salmonella enterica enterica serovar Typhi Ty2
aauccggcugccu

SEQ ID NO: 1733957 - RNA, 14 nt, Salmonella enterica enterica serovar Typhi Ty2
aaucgacaauccgc

SEQ ID NO: 1733958 - RNA, 15 nt, Salmonella enterica enterica serovar Typhi Ty2
aauccugcgcuggcu

SEQ ID NO: 1733959 - RNA, 16 nt, Salmonella enterica enterica serovar Typhi Ty2
aauccugauuaaguuu

SEQ ID NO: 1733960 - RNA, 22 nt, Salmonella enterica enterica serovar Typhi Ty2
aaucgaugccacagcgcauuca

SEQ ID NO: 1733961 - RNA, 17 nt, Salmonella enterica enterica serovar Typhi Ty2
aaucgccaucagcgcga

SEQ ID NO: 1733962 - RNA, 16 nt, Salmonella enterica enterica serovar Typhi Ty2
aaucgccagcaucggc

SEQ ID NO: 1733963 - RNA, 23 nt, Salmonella enterica enterica serovar Typhi Ty2
aaucucagauaauagcugcggcu

SEQ ID NO: 1733964 - RNA, 20 nt, Salmonella enterica enterica serovar Typhi Ty2
aaucucacgcucauagccgc

SEQ ID NO: 1733965 - RNA, 15 nt, Salmonella enterica enterica serovar Typhi Ty2
aaucgugcaauccug

SEQ ID NO: 1733966 - RNA, 20 nt, Salmonella enterica enterica serovar Typhi Ty2
aaucggcaaauacaucgcca

SEQ ID NO: 1733967 - RNA, 13 nt, Salmonella enterica enterica serovar Typhi Ty2
aaucggcaggcca

SEQ ID NO: 1733968 - RNA, 14 nt, Salmonella enterica enterica serovar Typhi Ty2
aaucgcuuccuggg

SEQ ID NO: 1733969 - RNA, 22 nt, Salmonella enterica enterica serovar Typhi Ty2
aaucgcuuuuaccggaucgauc

SEQ ID NO: 1733970 - RNA, 14 nt, Salmonella enterica enterica serovar Typhi Ty2
aaucgcguucgcgg

SEQ ID NO: 1733971 - RNA, 16 nt, Salmonella enterica enterica serovar Typhi Ty2
aaucgcuaaggcggca

SEQ ID NO: 1733972 - RNA, 12 nt, Salmonella enterica enterica serovar Typhi Ty2
aaucgcguucgc

SEQ ID NO: 1733973 - RNA, 23 nt, Salmonella enterica enterica serovar Typhi Ty2
aauuucaccuuuggcuuccggca

SEQ ID NO: 1733974 - RNA, 22 nt, Salmonella enterica enterica serovar Typhi Ty2
aauuuauaagccugagcgcgag

SEQ ID NO: 1733975 - RNA, 13 nt, Salmonella enterica enterica serovar Typhi Ty2
aauuuaucugcgu

SEQ ID NO: 1733976 - RNA, 20 nt, Salmonella enterica enterica serovar Typhi Ty2
aauucguguuuuugaacauu

SEQ ID NO: 1733977 - RNA, 18 nt, Salmonella enterica enterica serovar Typhi Ty2
aauucgucgccgccaaag

SEQ ID NO: 1733978 - RNA, 15 nt, Salmonella enterica enterica serovar Typhi Ty2
aauguuagcgucugc

SEQ ID NO: 1733979 - RNA, 23 nt, Salmonella enterica enterica serovar Typhi Ty2
aauuaaugugcguaaacaggcgc

SEQ ID NO: 1733980 - RNA, 17 nt, Salmonella enterica enterica serovar Typhi Ty2
aaugugaauccaggcca

SEQ ID NO: 1733981 - RNA, 14 nt, Salmonella enterica enterica serovar Typhi Ty2
aaugucuggcgcua

SEQ ID NO: 1733982 - RNA, 15 nt, Salmonella enterica enterica serovar Typhi Ty2
aaugauccgaugcgc

SEQ ID NO: 1733983 - RNA, 16 nt, Salmonella enterica enterica serovar Typhi Ty2
aaugccggaucaggcg

SEQ ID NO: 1733984 - RNA, 12 nt, Salmonella enterica enterica serovar Typhi Ty2
aaucuucgcggc

SEQ ID NO: 1733985 - RNA, 14 nt, Salmonella enterica enterica serovar Typhi Ty2
aaugagccgucgcu

SEQ ID NO: 1733986 - RNA, 23 nt, Salmonella enterica enterica serovar Typhi Ty2
aaucuggcgcaaaugggccuacg

SEQ ID NO: 1733987 - RNA, 20 nt, Salmonella enterica enterica serovar Typhi Ty2
aaucuguuucaguucggaga

SEQ ID NO: 1733988 - RNA, 19 nt, Salmonella enterica enterica serovar Typhi Ty2
aaucucgugaucgccaaag

SEQ ID NO: 1733989 - RNA, 16 nt, Salmonella enterica enterica serovar Typhi Ty2
aaugccuuaugcccgg

SEQ ID NO: 1733990 - RNA, 15 nt, Salmonella enterica enterica serovar Typhi Ty2
aaugcgacagcgaca

SEQ ID NO: 1733991 - RNA, 13 nt, Salmonella enterica enterica serovar Typhi Ty2
aaugcgcacgcca

SEQ ID NO: 1733992 - RNA, 20 nt, Salmonella enterica enterica serovar Typhi Ty2
aauggauuuauggcacauca

SEQ ID NO: 1733993 - RNA, 16 nt, Salmonella enterica enterica serovar Typhi Ty2
aauggccgcagcgcca

SEQ ID NO: 1733994 - RNA, 14 nt, Salmonella enterica enterica serovar Typhi Ty2
aaugucaugcgcca

SEQ ID NO: 1733995 - RNA, 13 nt, Salmonella enterica enterica serovar Typhi Ty2
aauaacguaaccg

SEQ ID NO: 1733996 - RNA, 22 nt, Salmonella enterica enterica serovar Typhi Ty2
aauaagccggaugcguguucag

SEQ ID NO: 1733997 - RNA, 22 nt, Salmonella enterica enterica serovar Typhi Ty2
aauaaagagcacuucugacauu

SEQ ID NO: 1733998 - RNA, 21 nt, Salmonella enterica enterica serovar Typhi Ty2
aagucagcucgguggcgguau

SEQ ID NO: 1733999 - RNA, 18 nt, Salmonella enterica enterica serovar Typhi Ty2
aauaccuuauucagccca

SEQ ID NO: 1734000 - RNA, 19 nt, Salmonella enterica enterica serovar Typhi Ty2
aauaccugccugucacgca

SEQ ID NO: 1734001 - RNA, 16 nt, Salmonella enterica enterica serovar Typhi Ty2
aauagaacgucgcgcg

SEQ ID NO: 1734002 - RNA, 13 nt, Salmonella enterica enterica serovar Typhi Ty2
aauaccggcauca

SEQ ID NO: 1734003 - RNA, 21 nt, Salmonella enterica enterica serovar Typhi Ty2
aauacaccguuuaucguuacc

SEQ ID NO: 1734004 - RNA, 14 nt, Salmonella enterica enterica serovar Typhi Ty2
aaguagccgucagg

SEQ ID NO: 1734005 - RNA, 17 nt, Salmonella enterica enterica serovar Typhi Ty2
aagguuugcugcgucac

SEQ ID NO: 1734006 - RNA, 16 nt, Salmonella enterica enterica serovar Typhi Ty2
aagguuugcugcguca

SEQ ID NO: 1734007 - RNA, 16 nt, Salmonella enterica enterica serovar Typhi Ty2
aagguucccugcgcca

SEQ ID NO: 1734008 - RNA, 18 nt, Salmonella enterica enterica serovar Typhi Ty2
aagguuaugcagcaugau

SEQ ID NO: 1734009 - RNA, 16 nt, Salmonella enterica enterica serovar Typhi Ty2
aaggcgcagccgccau

SEQ ID NO: 1734010 - RNA, 16 nt, Salmonella enterica enterica serovar Typhi Ty2
aacguuguccagcaga

SEQ ID NO: 1734011 - RNA, 15 nt, Salmonella enterica enterica serovar Typhi Ty2
aacguuuuacgcugc

SEQ ID NO: 1734012 - RNA, 22 nt, Salmonella enterica enterica serovar Typhi Ty2
aacguuucauggaaaucaagcg

SEQ ID NO: 1734013 - RNA, 21 nt, Salmonella enterica enterica serovar Typhi Ty2
aacgugcgguauaucacgcca

SEQ ID NO: 1734014 - RNA, 19 nt, Salmonella enterica enterica serovar Typhi Ty2
aagcacuucuccacgcgau

SEQ ID NO: 1734015 - RNA, 22 nt, Salmonella enterica enterica serovar Typhi Ty2
aagaucguuauccagcagccac

SEQ ID NO: 1734016 - RNA, 22 nt, Salmonella enterica enterica serovar Typhi Ty2
aagauauucuguuugcgcaguu

SEQ ID NO: 1734017 - RNA, 14 nt, Salmonella enterica enterica serovar Typhi Ty2
aagccauugccgcg

SEQ ID NO: 1734018 - RNA, 19 nt, Salmonella enterica enterica serovar Typhi Ty2
aagccauugccgcgacaaa

SEQ ID NO: 1734019 - RNA, 17 nt, Salmonella enterica enterica serovar Typhi Ty2
aagcgaauccagcgccg

SEQ ID NO: 1734020 - RNA, 12 nt, Salmonella enterica enterica serovar Typhi Ty2
aagccugagcgc

SEQ ID NO: 1734021 - RNA, 20 nt, Salmonella enterica enterica serovar Typhi Ty2
aagccugcuucaccgcgcca

SEQ ID NO: 1734022 - RNA, 22 nt, Salmonella enterica enterica serovar Typhi Ty2
aagcguuguaacaaaccgguaa

SEQ ID NO: 1734023 - RNA, 15 nt, Salmonella enterica enterica serovar Typhi Ty2
aagcgucauccggca

SEQ ID NO: 1734024 - RNA, 14 nt, Salmonella enterica enterica serovar Typhi Ty2
aagcggcagcgcca

SEQ ID NO: 1734025 - RNA, 22 nt, Salmonella enterica enterica serovar Typhi Ty2
aagcguaguacguuccagcguu

SEQ ID NO: 1734026 - RNA, 19 nt, Salmonella enterica enterica serovar Typhi Ty2
aagcgcucaugccacgcca

SEQ ID NO: 1734027 - RNA, 19 nt, Salmonella enterica enterica serovar Typhi Ty2
aagcgcucaagcggcacca

SEQ ID NO: 1734028 - RNA, 14 nt, Salmonella enterica enterica serovar Typhi Ty2
aagcgcugccgcaa

SEQ ID NO: 1734029 - RNA, 18 nt, Salmonella enterica enterica serovar Typhi Ty2
aagcuaauccccagcgcu

SEQ ID NO: 1734030 - RNA, 21 nt, Salmonella enterica enterica serovar Typhi Ty2
aagcguuuaauuccaucggca

SEQ ID NO: 1734031 - RNA, 22 nt, Salmonella enterica enterica serovar Typhi Ty2
aagcugagaaaagggcgcacca

SEQ ID NO: 1734032 - RNA, 12 nt, Salmonella enterica enterica serovar Typhi Ty2
aagcugcauaau

SEQ ID NO: 1734033 - RNA, 21 nt, Salmonella enterica enterica serovar Typhi Ty2
accccgccgucagacaggccu

SEQ ID NO: 1734034 - RNA, 19 nt, Salmonella enterica enterica serovar Typhi Ty2
accccaggcgauaccgcgc

SEQ ID NO: 1734035 - RNA, 13 nt, Salmonella enterica enterica serovar Typhi Ty2
accccauggcguc

SEQ ID NO: 1734036 - RNA, 18 nt, Salmonella enterica enterica serovar Typhi Ty2
accccaguaauccggcaa

SEQ ID NO: 1734037 - RNA, 18 nt, Salmonella enterica enterica serovar Typhi Ty2
accccgcaucgcccgcuc

SEQ ID NO: 1734038 - RNA, 13 nt, Salmonella enterica enterica serovar Typhi Ty2
acccgcaggccug

SEQ ID NO: 1734039 - RNA, 18 nt, Salmonella enterica enterica serovar Typhi Ty2
acccaguuuuaagcgcag

SEQ ID NO: 1734040 - RNA, 21 nt, Salmonella enterica enterica serovar Typhi Ty2
acccagacugugauggcgguc

SEQ ID NO: 1734041 - RNA, 13 nt, Salmonella enterica enterica serovar Typhi Ty2
acccagacggcga

SEQ ID NO: 1734042 - RNA, 17 nt, Salmonella enterica enterica serovar Typhi Ty2
acccacaacgcgccaac

SEQ ID NO: 1734043 - RNA, 22 nt, Salmonella enterica enterica serovar Typhi Ty2
acccaccacgaucuugucacaa

SEQ ID NO: 1734044 - RNA, 16 nt, Salmonella enterica enterica serovar Typhi Ty2
acccaaacagauaaca

SEQ ID NO: 1734045 - RNA, 22 nt, Salmonella enterica enterica serovar Typhi Ty2
acccgguguaaaaaauggguau

SEQ ID NO: 1734046 - RNA, 22 nt, Salmonella enterica enterica serovar Typhi Ty2
acccgggaaaaaugacgccggg

SEQ ID NO: 1734047 - RNA, 20 nt, Salmonella enterica enterica serovar Typhi Ty2
aaaauggucggucacgcgau

SEQ ID NO: 1734048 - RNA, 13 nt, Salmonella enterica enterica serovar Typhi Ty2
aaaauggggaucg

SEQ ID NO: 1734049 - RNA, 19 nt, Salmonella enterica enterica serovar Typhi Ty2
acccggcauugaaacgcau

SEQ ID NO: 1734050 - RNA, 20 nt, Salmonella enterica enterica serovar Typhi Ty2
accgcgacaauaugauccuc

SEQ ID NO: 1734051 - RNA, 18 nt, Salmonella enterica enterica serovar Typhi Ty2
accgcuauucaccagcgu

SEQ ID NO: 1734052 - RNA, 16 nt, Salmonella enterica enterica serovar Typhi Ty2
accgcguuuugcugau

SEQ ID NO: 1734053 - RNA, 16 nt, Salmonella enterica enterica serovar Typhi Ty2
accgccguccuggcga

SEQ ID NO: 1734054 - RNA, 14 nt, Salmonella enterica enterica serovar Typhi Ty2
accgccuucagcgc

SEQ ID NO: 1734055 - RNA, 14 nt, Salmonella enterica enterica serovar Typhi Ty2
accgccgaugcuga

SEQ ID NO: 1734056 - RNA, 14 nt, Salmonella enterica enterica serovar Typhi Ty2
accgagcauccgcg

SEQ ID NO: 1734057 - RNA, 17 nt, Salmonella enterica enterica serovar Typhi Ty2
accgccaaacgcgguca

SEQ ID NO: 1734058 - RNA, 16 nt, Salmonella enterica enterica serovar Typhi Ty2
accgccaucaaacgca

SEQ ID NO: 1734059 - RNA, 20 nt, Salmonella enterica enterica serovar Typhi Ty2
accgccauacggaugccgau

SEQ ID NO: 1734060 - RNA, 21 nt, Salmonella enterica enterica serovar Typhi Ty2
accggcuccggguugccugau

SEQ ID NO: 1734061 - RNA, 13 nt, Salmonella enterica enterica serovar Typhi Ty2
accggcuccggca

SEQ ID NO: 1734062 - RNA, 18 nt, Salmonella enterica enterica serovar Typhi Ty2
accggcugugggcguguc

SEQ ID NO: 1734063 - RNA, 15 nt, Salmonella enterica enterica serovar Typhi Ty2
accggcggaauagcu

SEQ ID NO: 1734064 - RNA, 19 nt, Salmonella enterica enterica serovar Typhi Ty2
accggcgcgccuuccagca

SEQ ID NO: 1734065 - RNA, 17 nt, Salmonella enterica enterica serovar Typhi Ty2
accggcguaauugcgcc

SEQ ID NO: 1734066 - RNA, 22 nt, Salmonella enterica enterica serovar Typhi Ty2
accggcagcggucaucaaugau

SEQ ID NO: 1734067 - RNA, 16 nt, Salmonella enterica enterica serovar Typhi Ty2
accggcagcgucagcc

SEQ ID NO: 1734068 - RNA, 18 nt, Salmonella enterica enterica serovar Typhi Ty2
accggcagccugccgcau

SEQ ID NO: 1734069 - RNA, 14 nt, Salmonella enterica enterica serovar Typhi Ty2
accggccgccaucg

SEQ ID NO: 1734070 - RNA, 19 nt, Salmonella enterica enterica serovar Typhi Ty2
accggccgccaucgcaauc

SEQ ID NO: 1734071 - RNA, 17 nt, Salmonella enterica enterica serovar Typhi Ty2
accggccacgagcuguc

SEQ ID NO: 1734072 - RNA, 16 nt, Salmonella enterica enterica serovar Typhi Ty2
accacgcagcccguaa

SEQ ID NO: 1734073 - RNA, 15 nt, Salmonella enterica enterica serovar Typhi Ty2
accacgaaucaggau

SEQ ID NO: 1734074 - RNA, 14 nt, Salmonella enterica enterica serovar Typhi Ty2
accaccugcuguug

SEQ ID NO: 1734075 - RNA, 13 nt, Salmonella enterica enterica serovar Typhi Ty2
accaccuguucgc

SEQ ID NO: 1734076 - RNA, 18 nt, Salmonella enterica enterica serovar Typhi Ty2
accaccguuuaaucgccc

SEQ ID NO: 1734077 - RNA, 20 nt, Salmonella enterica enterica serovar Typhi Ty2
accacggagagacaguucag

SEQ ID NO: 1734078 - RNA, 15 nt, Salmonella enterica enterica serovar Typhi Ty2
accacguaaugcgcc

SEQ ID NO: 1734079 - RNA, 22 nt, Salmonella enterica enterica serovar Typhi Ty2
accacccgggaaaaaugacgcc

SEQ ID NO: 1734080 - RNA, 20 nt, Salmonella enterica enterica serovar Typhi Ty2
accacaucaauagcgcuaca

SEQ ID NO: 1734081 - RNA, 14 nt, Salmonella enterica enterica serovar Typhi Ty2
accacagucaucgc

SEQ ID NO: 1734082 - RNA, 17 nt, Salmonella enterica enterica serovar Typhi Ty2
accaauggcgcgucuua

SEQ ID NO: 1734083 - RNA, 17 nt, Salmonella enterica enterica serovar Typhi Ty2
accaccaggaacgccau

SEQ ID NO: 1734084 - RNA, 17 nt, Salmonella enterica enterica serovar Typhi Ty2
accagcagcgggcuguc

SEQ ID NO: 1734085 - RNA, 23 nt, Salmonella enterica enterica serovar Typhi Ty2
accagcaucccacgaaugccgau

SEQ ID NO: 1734086 - RNA, 14 nt, Salmonella enterica enterica serovar Typhi Ty2
accagcaucgcguu

SEQ ID NO: 1734087 - RNA, 12 nt, Salmonella enterica enterica serovar Typhi Ty2
accagcauaaua

SEQ ID NO: 1734088 - RNA, 13 nt, Salmonella enterica enterica serovar Typhi Ty2
accagcaugugcc

SEQ ID NO: 1734089 - RNA, 17 nt, Salmonella enterica enterica serovar Typhi Ty2
accagaauaauggggau

SEQ ID NO: 1734090 - RNA, 22 nt, Salmonella enterica enterica serovar Typhi Ty2
accagcccaacggucuuugccg

SEQ ID NO: 1734091 - RNA, 15 nt, Salmonella enterica enterica serovar Typhi Ty2
accagccugccgucu

SEQ ID NO: 1734092 - RNA, 12 nt, Salmonella enterica enterica serovar Typhi Ty2
accagcgcaucu

SEQ ID NO: 1734093 - RNA, 15 nt, Salmonella enterica enterica serovar Typhi Ty2
accagcgacggcgua

SEQ ID NO: 1734094 - RNA, 17 nt, Salmonella enterica enterica serovar Typhi Ty2
accagcgcauugacgau

SEQ ID NO: 1734095 - RNA, 16 nt, Salmonella enterica enterica serovar Typhi Ty2
accagcgcaugacggu

SEQ ID NO: 1734096 - RNA, 15 nt, Salmonella enterica enterica serovar Typhi Ty2
accagcgcgccaucc

SEQ ID NO: 1734097 - RNA, 14 nt, Salmonella enterica enterica serovar Typhi Ty2
accagcgcgccaaa

SEQ ID NO: 1734098 - RNA, 15 nt, Salmonella enterica enterica serovar Typhi Ty2
accaauaucgccguu

SEQ ID NO: 1734099 - RNA, 23 nt, Salmonella enterica enterica serovar Typhi Ty2
accaacggcgacgcccgccaucu

SEQ ID NO: 1734100 - RNA, 18 nt, Salmonella enterica enterica serovar Typhi Ty2
acauguuuauguagccag

SEQ ID NO: 1734101 - RNA, 19 nt, Salmonella enterica enterica serovar Typhi Ty2
acaugguguuugcggcaca

SEQ ID NO: 1734102 - RNA, 17 nt, Salmonella enterica enterica serovar Typhi Ty2
acauuaacgccgcguuc

SEQ ID NO: 1734103 - RNA, 20 nt, Salmonella enterica enterica serovar Typhi Ty2
acauuagcggugcgucaugc

SEQ ID NO: 1734104 - RNA, 22 nt, Salmonella enterica enterica serovar Typhi Ty2
acauuagagaguaaaaccggca

SEQ ID NO: 1734105 - RNA, 15 nt, Salmonella enterica enterica serovar Typhi Ty2
acauucaggcgguaa

SEQ ID NO: 1734106 - RNA, 20 nt, Salmonella enterica enterica serovar Typhi Ty2
acauuucccgagccggguua

SEQ ID NO: 1734107 - RNA, 16 nt, Salmonella enterica enterica serovar Typhi Ty2
acauuguucuaaacgu

SEQ ID NO: 1734108 - RNA, 20 nt, Salmonella enterica enterica serovar Typhi Ty2
accaaaaacgcccccagaua

SEQ ID NO: 1734109 - RNA, 14 nt, Salmonella enterica enterica serovar Typhi Ty2
acaucgcucgcgcc

SEQ ID NO: 1734110 - RNA, 18 nt, Salmonella enterica enterica serovar Typhi Ty2
acaucgcucccggcacca

SEQ ID NO: 1734111 - RNA, 17 nt, Salmonella enterica enterica serovar Typhi Ty2
acaucgcaaugccacca

SEQ ID NO: 1734112 - RNA, 14 nt, Salmonella enterica enterica serovar Typhi Ty2
acaucccgaauacg

SEQ ID NO: 1734113 - RNA, 15 nt, Salmonella enterica enterica serovar Typhi Ty2
acaucuucggcguug

SEQ ID NO: 1734114 - RNA, 19 nt, Salmonella enterica enterica serovar Typhi Ty2
acaugccgacggagacgau

SEQ ID NO: 1734115 - RNA, 21 nt, Salmonella enterica enterica serovar Typhi Ty2
acaugcuacaggcaaguuuaa

SEQ ID NO: 1734116 - RNA, 12 nt, Salmonella enterica enterica serovar Typhi Ty2
acaugcggcuuu

SEQ ID NO: 1734117 - RNA, 23 nt, Salmonella enterica enterica serovar Typhi Ty2
acaugccgcuaugcggcguuaau

SEQ ID NO: 1734118 - RNA, 20 nt, Salmonella enterica enterica serovar Typhi Ty2
acaugccuucuuuggugcga

SEQ ID NO: 1734119 - RNA, 16 nt, Salmonella enterica enterica serovar Typhi Ty2
acaugcugugcgcgug

SEQ ID NO: 1734120 - RNA, 16 nt, Salmonella enterica enterica serovar Typhi Ty2
acauggcgcggcguaa

SEQ ID NO: 1734121 - RNA, 21 nt, Salmonella enterica enterica serovar Typhi Ty2
acauauagcagcagucucuac

SEQ ID NO: 1734122 - RNA, 19 nt, Salmonella enterica enterica serovar Typhi Ty2
acauagccgccacccggca

SEQ ID NO: 1734123 - RNA, 21 nt, Salmonella enterica enterica serovar Typhi Ty2
acauagaaaauauaugacaac

SEQ ID NO: 1734124 - RNA, 16 nt, Salmonella enterica enterica serovar Typhi Ty2
acaguguaaacgccag

SEQ ID NO: 1734125 - RNA, 22 nt, Salmonella enterica enterica serovar Typhi Ty2
acaucaugcuugcuuugcggca

SEQ ID NO: 1734126 - RNA, 21 nt, Salmonella enterica enterica serovar Typhi Ty2
acaucauccggcugcgucgcu

SEQ ID NO: 1734127 - RNA, 13 nt, Salmonella enterica enterica serovar Typhi Ty2
acauauugcgcuu

SEQ ID NO: 1734128 - RNA, 12 nt, Salmonella enterica enterica serovar Typhi Ty2
acaggcauuguc

SEQ ID NO: 1734129 - RNA, 19 nt, Salmonella enterica enterica serovar Typhi Ty2
acaggcaggcccgcgcuuu

SEQ ID NO: 1734130 - RNA, 20 nt, Salmonella enterica enterica serovar Typhi Ty2
acaggcauccgugaccugcu

SEQ ID NO: 1734131 - RNA, 23 nt, Salmonella enterica enterica serovar Typhi Ty2
acagcguguucaugcgcggcgga

SEQ ID NO: 1734132 - RNA, 19 nt, Salmonella enterica enterica serovar Typhi Ty2
acagcgccgcgcaagcgau

SEQ ID NO: 1734133 - RNA, 23 nt, Salmonella enterica enterica serovar Typhi Ty2
acaaacugcgcuagccgccgugu

SEQ ID NO: 1734134 - RNA, 12 nt, Salmonella enterica enterica serovar Typhi Ty2
acaaacagcgcc

SEQ ID NO: 1734135 - RNA, 16 nt, Salmonella enterica enterica serovar Typhi Ty2
acaaacccccagccau

SEQ ID NO: 1734136 - RNA, 14 nt, Salmonella enterica enterica serovar Typhi Ty2
acgccaucgacaaa

SEQ ID NO: 1734137 - RNA, 22 nt, Salmonella enterica enterica serovar Typhi Ty2
acgcccacgcggcgugcgcugc

SEQ ID NO: 1734138 - RNA, 18 nt, Salmonella enterica enterica serovar Typhi Ty2
acgccagugccugguggc

SEQ ID NO: 1734139 - RNA, 16 nt, Salmonella enterica enterica serovar Typhi Ty2
acgcccguccggcuuu

SEQ ID NO: 1734140 - RNA, 20 nt, Salmonella enterica enterica serovar Typhi Ty2
acgcauuuuuccguauugca

SEQ ID NO: 1734141 - RNA, 12 nt, Salmonella enterica enterica serovar Typhi Ty2
acgccaaucggc

SEQ ID NO: 1734142 - RNA, 23 nt, Salmonella enterica enterica serovar Typhi Ty2
acgccaaucggcgucuugccgca

SEQ ID NO: 1734143 - RNA, 15 nt, Salmonella enterica enterica serovar Typhi Ty2
acgccacccagcgaa

SEQ ID NO: 1734144 - RNA, 23 nt, Salmonella enterica enterica serovar Typhi Ty2
acgcauugccauguuaauaccag

SEQ ID NO: 1734145 - RNA, 20 nt, Salmonella enterica enterica serovar Typhi Ty2
acgcauugagacaugccgcc

SEQ ID NO: 1734146 - RNA, 18 nt, Salmonella enterica enterica serovar Typhi Ty2
acgcauugagacaugccg

SEQ ID NO: 1734147 - RNA, 19 nt, Salmonella enterica enterica serovar Typhi Ty2
acgcauuucaagcaggcga

SEQ ID NO: 1734148 - RNA, 16 nt, Salmonella enterica enterica serovar Typhi Ty2
acgcauauccagcaga

SEQ ID NO: 1734149 - RNA, 20 nt, Salmonella enterica enterica serovar Typhi Ty2
acgcauaaugcgccccgcaa

SEQ ID NO: 1734150 - RNA, 13 nt, Salmonella enterica enterica serovar Typhi Ty2
acgcaucccgcca

SEQ ID NO: 1734151 - RNA, 17 nt, Salmonella enterica enterica serovar Typhi Ty2
acgcauccgcguuaccc

SEQ ID NO: 1734152 - RNA, 11 nt, Salmonella enterica enterica serovar Typhi Ty2
acgauggcgau

SEQ ID NO: 1734153 - RNA, 18 nt, Salmonella enterica enterica serovar Typhi Ty2
acgcagcacguccagaua

SEQ ID NO: 1734154 - RNA, 14 nt, Salmonella enterica enterica serovar Typhi Ty2
accuucauggcguu

SEQ ID NO: 1734155 - RNA, 19 nt, Salmonella enterica enterica serovar Typhi Ty2
accuucacccccaucgccc

SEQ ID NO: 1734156 - RNA, 15 nt, Salmonella enterica enterica serovar Typhi Ty2
accuucaccggauac

SEQ ID NO: 1734157 - RNA, 11 nt, Salmonella enterica enterica serovar Typhi Ty2
accuucgcguu

SEQ ID NO: 1734158 - RNA, 19 nt, Salmonella enterica enterica serovar Typhi Ty2
accuucaacagcucgccau

SEQ ID NO: 1734159 - RNA, 15 nt, Salmonella enterica enterica serovar Typhi Ty2
accugucuaucaccg

SEQ ID NO: 1734160 - RNA, 21 nt, Salmonella enterica enterica serovar Typhi Ty2
acgaucaauaaaauuauccag

SEQ ID NO: 1734161 - RNA, 14 nt, Salmonella enterica enterica serovar Typhi Ty2
acgauauagucgcc

SEQ ID NO: 1734162 - RNA, 16 nt, Salmonella enterica enterica serovar Typhi Ty2
acgauaugcauaaucg

SEQ ID NO: 1734163 - RNA, 16 nt, Salmonella enterica enterica serovar Typhi Ty2
acgauauuucgccuau

SEQ ID NO: 1734164 - RNA, 23 nt, Salmonella enterica enterica serovar Typhi Ty2
acgaucaauaaaauuauccaguu

SEQ ID NO: 1734165 - RNA, 22 nt, Salmonella enterica enterica serovar Typhi Ty2
acgaugauaauacauugccgca

SEQ ID NO: 1734166 - RNA, 15 nt, Salmonella enterica enterica serovar Typhi Ty2
acgaucguuugccca

SEQ ID NO: 1734167 - RNA, 14 nt, Salmonella enterica enterica serovar Typhi Ty2
acgaucaugccgcc

SEQ ID NO: 1734168 - RNA, 20 nt, Salmonella enterica enterica serovar Typhi Ty2
acgaucgguuaucacgguau

SEQ ID NO: 1734169 - RNA, 22 nt, Salmonella enterica enterica serovar Typhi Ty2
accugcggccaugaucgccgcc

SEQ ID NO: 1734170 - RNA, 18 nt, Salmonella enterica enterica serovar Typhi Ty2
accugccguuuuccagcc

SEQ ID NO: 1734171 - RNA, 19 nt, Salmonella enterica enterica serovar Typhi Ty2
accugguacaccagacgau

SEQ ID NO: 1734172 - RNA, 18 nt, Salmonella enterica enterica serovar Typhi Ty2
acgccgucgaugauggcg

SEQ ID NO: 1734173 - RNA, 11 nt, Salmonella enterica enterica serovar Typhi Ty2
acgccgucgcg

SEQ ID NO: 1734174 - RNA, 15 nt, Salmonella enterica enterica serovar Typhi Ty2
acgccgugcggcgug

SEQ ID NO: 1734175 - RNA, 19 nt, Salmonella enterica enterica serovar Typhi Ty2
acgccgugaacgccaaaua

SEQ ID NO: 1734176 - RNA, 16 nt, Salmonella enterica enterica serovar Typhi Ty2
acgccgugcacuucug

SEQ ID NO: 1734177 - RNA, 13 nt, Salmonella enterica enterica serovar Typhi Ty2
acgccugaugcug

SEQ ID NO: 1734178 - RNA, 14 nt, Salmonella enterica enterica serovar Typhi Ty2
acgccucauccggc

SEQ ID NO: 1734179 - RNA, 21 nt, Salmonella enterica enterica serovar Typhi Ty2
acgccggcgcguaauuccgca

SEQ ID NO: 1734180 - RNA, 13 nt, Salmonella enterica enterica serovar Typhi Ty2
acgccggaaauca

SEQ ID NO: 1734181 - RNA, 11 nt, Salmonella enterica enterica serovar Typhi Ty2
acgccgguacu

SEQ ID NO: 1734182 - RNA, 22 nt, Salmonella enterica enterica serovar Typhi Ty2
acgccguagcugcgcgccgcaa

SEQ ID NO: 1734183 - RNA, 22 nt, Salmonella enterica enterica serovar Typhi Ty2
acgccggggauaucaaugcgcg

SEQ ID NO: 1734184 - RNA, 15 nt, Salmonella enterica enterica serovar Typhi Ty2
acgccgauaaccagc

SEQ ID NO: 1734185 - RNA, 18 nt, Salmonella enterica enterica serovar Typhi Ty2
acgccgaggcauucagcc

SEQ ID NO: 1734186 - RNA, 19 nt, Salmonella enterica enterica serovar Typhi Ty2
acgccgaacaacacggcgg

SEQ ID NO: 1734187 - RNA, 16 nt, Salmonella enterica enterica serovar Typhi Ty2
acgcccuucacgccga

SEQ ID NO: 1734188 - RNA, 18 nt, Salmonella enterica enterica serovar Typhi Ty2
acgccgcgcugcggcguc

SEQ ID NO: 1734189 - RNA, 18 nt, Salmonella enterica enterica serovar Typhi Ty2
acgccgccauccggcacg

SEQ ID NO: 1734190 - RNA, 17 nt, Salmonella enterica enterica serovar Typhi Ty2
acgccgccauccggcaa

SEQ ID NO: 1734191 - RNA, 14 nt, Salmonella enterica enterica serovar Typhi Ty2
acgccgccgacaug

SEQ ID NO: 1734192 - RNA, 19 nt, Salmonella enterica enterica serovar Typhi Ty2
acgccgcacacagcagaaa

SEQ ID NO: 1734193 - RNA, 13 nt, Salmonella enterica enterica serovar Typhi Ty2
acgccgccagcaa

SEQ ID NO: 1734194 - RNA, 22 nt, Salmonella enterica enterica serovar Typhi Ty2
acgcgccgccaacgauacagca

SEQ ID NO: 1734195 - RNA, 16 nt, Salmonella enterica enterica serovar Typhi Ty2
acgcggaucagacggc

SEQ ID NO: 1734196 - RNA, 22 nt, Salmonella enterica enterica serovar Typhi Ty2
acgcggccaaaacccaccagca

SEQ ID NO: 1734197 - RNA, 13 nt, Salmonella enterica enterica serovar Typhi Ty2
acgcggcaucagg

SEQ ID NO: 1734198 - RNA, 20 nt, Salmonella enterica enterica serovar Typhi Ty2
acgcgauauuacuccagcgu

SEQ ID NO: 1734199 - RNA, 18 nt, Salmonella enterica enterica serovar Typhi Ty2
acgcgagaagcccggcca

SEQ ID NO: 1734200 - RNA, 20 nt, Salmonella enterica enterica serovar Typhi Ty2
acgcgacuuuuuucacccag

SEQ ID NO: 1734201 - RNA, 20 nt, Salmonella enterica enterica serovar Typhi Ty2
acgccuuccggagacuaucu

SEQ ID NO: 1734202 - RNA, 20 nt, Salmonella enterica enterica serovar Typhi Ty2
acgcgcauuaauaugcgcaa

SEQ ID NO: 1734203 - RNA, 23 nt, Salmonella enterica enterica serovar Typhi Ty2
acgcgcauuaauaugcgcaauca

SEQ ID NO: 1734204 - RNA, 21 nt, Salmonella enterica enterica serovar Typhi Ty2
acgcgcccaacggaugcgcca

SEQ ID NO: 1734205 - RNA, 16 nt, Salmonella enterica enterica serovar Typhi Ty2
acgcguaggccggaua

SEQ ID NO: 1734206 - RNA, 21 nt, Salmonella enterica enterica serovar Typhi Ty2
acgcgucuguagcgcgcgcca

SEQ ID NO: 1734207 - RNA, 20 nt, Salmonella enterica enterica serovar Typhi Ty2
acgcgucugaaugacgccgu

SEQ ID NO: 1734208 - RNA, 16 nt, Salmonella enterica enterica serovar Typhi Ty2
acgcguucuacgguau

SEQ ID NO: 1734209 - RNA, 14 nt, Salmonella enterica enterica serovar Typhi Ty2
aaacaucagcgcau

SEQ ID NO: 1734210 - RNA, 13 nt, Salmonella enterica enterica serovar Typhi Ty2
aaacaucagcgca

SEQ ID NO: 1734211 - RNA, 21 nt, Salmonella enterica enterica serovar Typhi Ty2
acgcugaccuuuuucauccuc

SEQ ID NO: 1734212 - RNA, 21 nt, Salmonella enterica enterica serovar Typhi Ty2
acgcugaauaucgucaguaug

SEQ ID NO: 1734213 - RNA, 21 nt, Salmonella enterica enterica serovar Typhi Ty2
acgcuggcggcccgcauugaa

SEQ ID NO: 1734214 - RNA, 19 nt, Salmonella enterica enterica serovar Typhi Ty2
acgcucuuuuccacggcgc

SEQ ID NO: 1734215 - RNA, 22 nt, Salmonella enterica enterica serovar Typhi Ty2
acgcguuucacaucgccaguua

SEQ ID NO: 1734216 - RNA, 16 nt, Salmonella enterica enterica serovar Typhi Ty2
acgcuauguuugcuga

SEQ ID NO: 1734217 - RNA, 12 nt, Salmonella enterica enterica serovar Typhi Ty2
acggcgaucagc

SEQ ID NO: 1734218 - RNA, 14 nt, Salmonella enterica enterica serovar Typhi Ty2
acggcgaccggcaa

SEQ ID NO: 1734219 - RNA, 16 nt, Salmonella enterica enterica serovar Typhi Ty2
acggcgaauacgggau

SEQ ID NO: 1734220 - RNA, 15 nt, Salmonella enterica enterica serovar Typhi Ty2
acggcgacaggcaca

SEQ ID NO: 1734221 - RNA, 18 nt, Salmonella enterica enterica serovar Typhi Ty2
acggccuucgcagaucgc

SEQ ID NO: 1734222 - RNA, 17 nt, Salmonella enterica enterica serovar Typhi Ty2
acggccuaagaccagca

SEQ ID NO: 1734223 - RNA, 23 nt, Salmonella enterica enterica serovar Typhi Ty2
acggcgcuaagcgcccguagcuc

SEQ ID NO: 1734224 - RNA, 13 nt, Salmonella enterica enterica serovar Typhi Ty2
acggcgcgccaau

SEQ ID NO: 1734225 - RNA, 14 nt, Salmonella enterica enterica serovar Typhi Ty2
acggcgcuggcgua

SEQ ID NO: 1734226 - RNA, 16 nt, Salmonella enterica enterica serovar Typhi Ty2
acggcgugacaccggu

SEQ ID NO: 1734227 - RNA, 19 nt, Salmonella enterica enterica serovar Typhi Ty2
acggcuuuccagcagccag

SEQ ID NO: 1734228 - RNA, 22 nt, Salmonella enterica enterica serovar Typhi Ty2
acgggcagucuggcggcagccg

SEQ ID NO: 1734229 - RNA, 15 nt, Salmonella enterica enterica serovar Typhi Ty2
acgucccaugacgac

SEQ ID NO: 1734230 - RNA, 19 nt, Salmonella enterica enterica serovar Typhi Ty2
acguccauccgccgggaca

SEQ ID NO: 1734231 - RNA, 15 nt, Salmonella enterica enterica serovar Typhi Ty2
acgucaucaugcugc

SEQ ID NO: 1734232 - RNA, 20 nt, Salmonella enterica enterica serovar Typhi Ty2
acgucagccgggauaaucag

SEQ ID NO: 1734233 - RNA, 14 nt, Salmonella enterica enterica serovar Typhi Ty2
acggguaacgccaa

SEQ ID NO: 1734234 - RNA, 19 nt, Salmonella enterica enterica serovar Typhi Ty2
acguaaguuaaaacgccau

SEQ ID NO: 1734235 - RNA, 20 nt, Salmonella enterica enterica serovar Typhi Ty2
acgucggcgaauuucgcguu

SEQ ID NO: 1734236 - RNA, 17 nt, Salmonella enterica enterica serovar Typhi Ty2
acguccugguuaccgcg

SEQ ID NO: 1734237 - RNA, 17 nt, Salmonella enterica enterica serovar Typhi Ty2
acgugccgaccagcggu

SEQ ID NO: 1734238 - RNA, 19 nt, Salmonella enterica enterica serovar Typhi Ty2
acgugcgaaccacggcgua

SEQ ID NO: 1734239 - RNA, 15 nt, Salmonella enterica enterica serovar Typhi Ty2
acguguggcgcugug

SEQ ID NO: 1734240 - RNA, 17 nt, Salmonella enterica enterica serovar Typhi Ty2
acguucuuccagaacgc

SEQ ID NO: 1734241 - RNA, 20 nt, Salmonella enterica enterica serovar Typhi Ty2
acgugcgguauaucacgcca

SEQ ID NO: 1734242 - RNA, 15 nt, Salmonella enterica enterica serovar Typhi Ty2
acuccggcugcacca

SEQ ID NO: 1734243 - RNA, 13 nt, Salmonella enterica enterica serovar Typhi Ty2
acuccugcaucga

SEQ ID NO: 1734244 - RNA, 19 nt, Salmonella enterica enterica serovar Typhi Ty2
acuccugccugacaaugac

SEQ ID NO: 1734245 - RNA, 16 nt, Salmonella enterica enterica serovar Typhi Ty2
acucgcugauacgcug

SEQ ID NO: 1734246 - RNA, 17 nt, Salmonella enterica enterica serovar Typhi Ty2
acucgcucauuugcgag

SEQ ID NO: 1734247 - RNA, 20 nt, Salmonella enterica enterica serovar Typhi Ty2
acuccagcagacgcugcuuc

SEQ ID NO: 1734248 - RNA, 17 nt, Salmonella enterica enterica serovar Typhi Ty2
acuccccggcuugcggg

SEQ ID NO: 1734249 - RNA, 14 nt, Salmonella enterica enterica serovar Typhi Ty2
acucauuaccggcu

SEQ ID NO: 1734250 - RNA, 13 nt, Salmonella enterica enterica serovar Typhi Ty2
acucagccagaua

SEQ ID NO: 1734251 - RNA, 15 nt, Salmonella enterica enterica serovar Typhi Ty2
acucagcagcgcaua

SEQ ID NO: 1734252 - RNA, 13 nt, Salmonella enterica enterica serovar Typhi Ty2
acucaccaguccg

SEQ ID NO: 1734253 - RNA, 23 nt, Salmonella enterica enterica serovar Typhi Ty2
acucacccaggcgaugcgcggaa

SEQ ID NO: 1734254 - RNA, 19 nt, Salmonella enterica enterica serovar Typhi Ty2
acucacgacuuucaccaga

SEQ ID NO: 1734255 - RNA, 21 nt, Salmonella enterica enterica serovar Typhi Ty2
acucaaucauugucauuaacg

SEQ ID NO: 1734256 - RNA, 22 nt, Salmonella enterica enterica serovar Typhi Ty2
acuguaagccucgcucaccggu

SEQ ID NO: 1734257 - RNA, 21 nt, Salmonella enterica enterica serovar Typhi Ty2
acuuauuuguauugacgccga

SEQ ID NO: 1734258 - RNA, 14 nt, Salmonella enterica enterica serovar Typhi Ty2
acuucacccaucgc

SEQ ID NO: 1734259 - RNA, 15 nt, Salmonella enterica enterica serovar Typhi Ty2
acuucauccggauaa

SEQ ID NO: 1734260 - RNA, 16 nt, Salmonella enterica enterica serovar Typhi Ty2
acuugaagccuuucug

SEQ ID NO: 1734261 - RNA, 13 nt, Salmonella enterica enterica serovar Typhi Ty2
acuugaucgugcc

SEQ ID NO: 1734262 - RNA, 12 nt, Salmonella enterica enterica serovar Typhi Ty2
acugcuccggca

SEQ ID NO: 1734263 - RNA, 14 nt, Salmonella enterica enterica serovar Typhi Ty2
acucuucaucgcgc

SEQ ID NO: 1734264 - RNA, 22 nt, Salmonella enterica enterica serovar Typhi Ty2
acugccuaaauugacgcugccu

SEQ ID NO: 1734265 - RNA, 19 nt, Salmonella enterica enterica serovar Typhi Ty2
acugggcgcaugaggccug

SEQ ID NO: 1734266 - RNA, 21 nt, Salmonella enterica enterica serovar Typhi Ty2
acugguucaacaucagcgcua

SEQ ID NO: 1734267 - RNA, 16 nt, Salmonella enterica enterica serovar Typhi Ty2
acuggguaugcagugg

SEQ ID NO: 1734268 - RNA, 15 nt, Salmonella enterica enterica serovar Typhi Ty2
acuggcuuuccugau

SEQ ID NO: 1734269 - RNA, 14 nt, Salmonella enterica enterica serovar Typhi Ty2
acuggcuaucgccg

SEQ ID NO: 1734270 - RNA, 14 nt, Salmonella enterica enterica serovar Typhi Ty2
acugcuuuaauacc

SEQ ID NO: 1734271 - RNA, 15 nt, Salmonella enterica enterica serovar Typhi Ty2
acuggcaaucaugcg

SEQ ID NO: 1734272 - RNA, 20 nt, Salmonella enterica enterica serovar Typhi Ty2
acuggaauaguuacggacau

SEQ ID NO: 1734273 - RNA, 15 nt, Salmonella enterica enterica serovar Typhi Ty2
agcacgcccugccau

SEQ ID NO: 1734274 - RNA, 17 nt, Salmonella enterica enterica serovar Typhi Ty2
agcacuguagcggcugc

SEQ ID NO: 1734275 - RNA, 19 nt, Salmonella enterica enterica serovar Typhi Ty2
agcagaccgguacgcgcgu

SEQ ID NO: 1734276 - RNA, 18 nt, Salmonella enterica enterica serovar Typhi Ty2
agcacgguaacuucgcgg

SEQ ID NO: 1734277 - RNA, 17 nt, Salmonella enterica enterica serovar Typhi Ty2
aaaccccaucccggcaa

SEQ ID NO: 1734278 - RNA, 15 nt, Salmonella enterica enterica serovar Typhi Ty2
agcagauagcccgcc

SEQ ID NO: 1734279 - RNA, 13 nt, Salmonella enterica enterica serovar Typhi Ty2
agcagcagccggu

SEQ ID NO: 1734280 - RNA, 16 nt, Salmonella enterica enterica serovar Typhi Ty2
agcagcagagccggaa

SEQ ID NO: 1734281 - RNA, 20 nt, Salmonella enterica enterica serovar Typhi Ty2
agcagauuuuucgccaggua

SEQ ID NO: 1734282 - RNA, 23 nt, Salmonella enterica enterica serovar Typhi Ty2
agcaauuucucgcccgccagauc

SEQ ID NO: 1734283 - RNA, 14 nt, Salmonella enterica enterica serovar Typhi Ty2
agcaauacgcccgc

SEQ ID NO: 1734284 - RNA, 16 nt, Salmonella enterica enterica serovar Typhi Ty2
agcaacgggcagucug

SEQ ID NO: 1734285 - RNA, 18 nt, Salmonella enterica enterica serovar Typhi Ty2
agcaagcgcacgguuaau

SEQ ID NO: 1734286 - RNA, 16 nt, Salmonella enterica enterica serovar Typhi Ty2
agcaacccacuuucgg

SEQ ID NO: 1734287 - RNA, 21 nt, Salmonella enterica enterica serovar Typhi Ty2
agcaaacgccauagcaucgac

SEQ ID NO: 1734288 - RNA, 16 nt, Salmonella enterica enterica serovar Typhi Ty2
agcaaaaucaccauca

SEQ ID NO: 1734289 - RNA, 22 nt, Salmonella enterica enterica serovar Typhi Ty2
agcaaacgaccuuucgccguca

SEQ ID NO: 1734290 - RNA, 16 nt, Salmonella enterica enterica serovar Typhi Ty2
agcaacaguugcugga

SEQ ID NO: 1734291 - RNA, 12 nt, Salmonella enterica enterica serovar Typhi Ty2
agcaaaucagcu

SEQ ID NO: 1734292 - RNA, 14 nt, Salmonella enterica enterica serovar Typhi Ty2
agcaccauuucgcc

SEQ ID NO: 1734293 - RNA, 15 nt, Salmonella enterica enterica serovar Typhi Ty2
agcacccaccaucac

SEQ ID NO: 1734294 - RNA, 20 nt, Salmonella enterica enterica serovar Typhi Ty2
agcacauuaagcauggcguu

SEQ ID NO: 1734295 - RNA, 17 nt, Salmonella enterica enterica serovar Typhi Ty2
agcccggcggcgcaucg

SEQ ID NO: 1734296 - RNA, 18 nt, Salmonella enterica enterica serovar Typhi Ty2
agccccuucgcuguccau

SEQ ID NO: 1734297 - RNA, 13 nt, Salmonella enterica enterica serovar Typhi Ty2
agccagguugcgc

SEQ ID NO: 1734298 - RNA, 21 nt, Salmonella enterica enterica serovar Typhi Ty2
agccgacgcauuucuccugau

SEQ ID NO: 1734299 - RNA, 21 nt, Salmonella enterica enterica serovar Typhi Ty2
agccgaccuggcggucggcuu

SEQ ID NO: 1734300 - RNA, 21 nt, Salmonella enterica enterica serovar Typhi Ty2
aaacgaccaggaucagaccga

SEQ ID NO: 1734301 - RNA, 20 nt, Salmonella enterica enterica serovar Typhi Ty2
aaacgaugaccauaaaugaa

SEQ ID NO: 1734302 - RNA, 20 nt, Salmonella enterica enterica serovar Typhi Ty2
aaaccguucacgcucacgca

SEQ ID NO: 1734303 - RNA, 20 nt, Salmonella enterica enterica serovar Typhi Ty2
aaaccuccggcuaugccgga

SEQ ID NO: 1734304 - RNA, 17 nt, Salmonella enterica enterica serovar Typhi Ty2
aaaccuuaccgucagcc

SEQ ID NO: 1734305 - RNA, 23 nt, Salmonella enterica enterica serovar Typhi Ty2
agcauugccgucaaacgcuauca

SEQ ID NO: 1734306 - RNA, 18 nt, Salmonella enterica enterica serovar Typhi Ty2
agcauugccgucaaacgc

SEQ ID NO: 1734307 - RNA, 19 nt, Salmonella enterica enterica serovar Typhi Ty2
agcauuuccgcagccaaca

SEQ ID NO: 1734308 - RNA, 17 nt, Salmonella enterica enterica serovar Typhi Ty2
agccacacgacgguauu

SEQ ID NO: 1734309 - RNA, 22 nt, Salmonella enterica enterica serovar Typhi Ty2
agccacuuaccaaucgcggcga

SEQ ID NO: 1734310 - RNA, 14 nt, Salmonella enterica enterica serovar Typhi Ty2
agccacccacggca

SEQ ID NO: 1734311 - RNA, 23 nt, Salmonella enterica enterica serovar Typhi Ty2
agccagaaaaagggaaaagccau

SEQ ID NO: 1734312 - RNA, 14 nt, Salmonella enterica enterica serovar Typhi Ty2
agccagagcgcgcu

SEQ ID NO: 1734313 - RNA, 20 nt, Salmonella enterica enterica serovar Typhi Ty2
agccagacgguuaagccggu

SEQ ID NO: 1734314 - RNA, 19 nt, Salmonella enterica enterica serovar Typhi Ty2
agccacugcgccauuaacg

SEQ ID NO: 1734315 - RNA, 12 nt, Salmonella enterica enterica serovar Typhi Ty2
agcauuagcgcc

SEQ ID NO: 1734316 - RNA, 19 nt, Salmonella enterica enterica serovar Typhi Ty2
agcauuauuuuuaaccgcc

SEQ ID NO: 1734317 - RNA, 23 nt, Salmonella enterica enterica serovar Typhi Ty2
agcaucucaauaucguugccgcc

SEQ ID NO: 1734318 - RNA, 15 nt, Salmonella enterica enterica serovar Typhi Ty2
agcaucguuaccgcu

SEQ ID NO: 1734319 - RNA, 15 nt, Salmonella enterica enterica serovar Typhi Ty2
agcauccagcucaug

SEQ ID NO: 1734320 - RNA, 16 nt, Salmonella enterica enterica serovar Typhi Ty2
agcaucccgcuggcgc

SEQ ID NO: 1734321 - RNA, 14 nt, Salmonella enterica enterica serovar Typhi Ty2
agcaucaugucacc

SEQ ID NO: 1734322 - RNA, 15 nt, Salmonella enterica enterica serovar Typhi Ty2
agcaucaauaucugc

SEQ ID NO: 1734323 - RNA, 17 nt, Salmonella enterica enterica serovar Typhi Ty2
agcaucaggacaugguc

SEQ ID NO: 1734324 - RNA, 18 nt, Salmonella enterica enterica serovar Typhi Ty2
agcaucccgcuggcgcca

SEQ ID NO: 1734325 - RNA, 15 nt, Salmonella enterica enterica serovar Typhi Ty2
agcaggguuaugccg

SEQ ID NO: 1734326 - RNA, 19 nt, Salmonella enterica enterica serovar Typhi Ty2
agcagcgaggugauaauca

SEQ ID NO: 1734327 - RNA, 12 nt, Salmonella enterica enterica serovar Typhi Ty2
agcagcgcauca

SEQ ID NO: 1734328 - RNA, 20 nt, Salmonella enterica enterica serovar Typhi Ty2
agcagcuuaucuuuacgcuu

SEQ ID NO: 1734329 - RNA, 21 nt, Salmonella enterica enterica serovar Typhi Ty2
agcugagcgucaggcgcaucc

SEQ ID NO: 1734330 - RNA, 14 nt, Salmonella enterica enterica serovar Typhi Ty2
agcguccccggcga

SEQ ID NO: 1734331 - RNA, 20 nt, Salmonella enterica enterica serovar Typhi Ty2
agcgguccaauaaacgccag

SEQ ID NO: 1734332 - RNA, 15 nt, Salmonella enterica enterica serovar Typhi Ty2
agcguccguucugau

SEQ ID NO: 1734333 - RNA, 19 nt, Salmonella enterica enterica serovar Typhi Ty2
agcgucuguuucaacgcau

SEQ ID NO: 1734334 - RNA, 19 nt, Salmonella enterica enterica serovar Typhi Ty2
agcguuuaaaaagcugcau

SEQ ID NO: 1734335 - RNA, 17 nt, Salmonella enterica enterica serovar Typhi Ty2
agcguugauaugcucga

SEQ ID NO: 1734336 - RNA, 21 nt, Salmonella enterica enterica serovar Typhi Ty2
agcguucuauuuggccugcag

SEQ ID NO: 1734337 - RNA, 16 nt, Salmonella enterica enterica serovar Typhi Ty2
agcggcgcgcuggcgc

SEQ ID NO: 1734338 - RNA, 15 nt, Salmonella enterica enterica serovar Typhi Ty2
agcggcaucucgcca

SEQ ID NO: 1734339 - RNA, 19 nt, Salmonella enterica enterica serovar Typhi Ty2
agcgguaaaucgcaaacgg

SEQ ID NO: 1734340 - RNA, 14 nt, Salmonella enterica enterica serovar Typhi Ty2
agcgcuugauccag

SEQ ID NO: 1734341 - RNA, 16 nt, Salmonella enterica enterica serovar Typhi Ty2
agcgcggccagcgccu

SEQ ID NO: 1734342 - RNA, 19 nt, Salmonella enterica enterica serovar Typhi Ty2
agcgcggcaugaacgcgau

SEQ ID NO: 1734343 - RNA, 22 nt, Salmonella enterica enterica serovar Typhi Ty2
agcgcguucgccgucacgccga

SEQ ID NO: 1734344 - RNA, 15 nt, Salmonella enterica enterica serovar Typhi Ty2
agcgcgucagcgccu

SEQ ID NO: 1734345 - RNA, 16 nt, Salmonella enterica enterica serovar Typhi Ty2
agcgcgguggcgcaca

SEQ ID NO: 1734346 - RNA, 13 nt, Salmonella enterica enterica serovar Typhi Ty2
agcgcuaucaggc

SEQ ID NO: 1734347 - RNA, 21 nt, Salmonella enterica enterica serovar Typhi Ty2
agcgccugaauguacgcauau

SEQ ID NO: 1734348 - RNA, 21 nt, Salmonella enterica enterica serovar Typhi Ty2
agcgccguuaacgcggccgua

SEQ ID NO: 1734349 - RNA, 15 nt, Salmonella enterica enterica serovar Typhi Ty2
agcgccuccggguuu

SEQ ID NO: 1734350 - RNA, 21 nt, Salmonella enterica enterica serovar Typhi Ty2
agcgcagcgccaccgggcaac

SEQ ID NO: 1734351 - RNA, 13 nt, Salmonella enterica enterica serovar Typhi Ty2
agcgcagcgccau

SEQ ID NO: 1734352 - RNA, 15 nt, Salmonella enterica enterica serovar Typhi Ty2
agcgcagcggaaagu

SEQ ID NO: 1734353 - RNA, 18 nt, Salmonella enterica enterica serovar Typhi Ty2
agcgcagcuugguagcgc

SEQ ID NO: 1734354 - RNA, 12 nt, Salmonella enterica enterica serovar Typhi Ty2
agcgccaggcca

SEQ ID NO: 1734355 - RNA, 15 nt, Salmonella enterica enterica serovar Typhi Ty2
agcgccagcggcugc

SEQ ID NO: 1734356 - RNA, 17 nt, Salmonella enterica enterica serovar Typhi Ty2
agcgccauauccgcaga

SEQ ID NO: 1734357 - RNA, 20 nt, Salmonella enterica enterica serovar Typhi Ty2
agcgccaucaggcacggcgu

SEQ ID NO: 1734358 - RNA, 13 nt, Salmonella enterica enterica serovar Typhi Ty2
agcgccaucagga

SEQ ID NO: 1734359 - RNA, 23 nt, Salmonella enterica enterica serovar Typhi Ty2
agcgcgaccaggaaaccgguaaa

SEQ ID NO: 1734360 - RNA, 21 nt, Salmonella enterica enterica serovar Typhi Ty2
agcgcgaccaggaaaccggua

SEQ ID NO: 1734361 - RNA, 23 nt, Salmonella enterica enterica serovar Typhi Ty2
agcgccuggcgguaugaaagcca

SEQ ID NO: 1734362 - RNA, 21 nt, Salmonella enterica enterica serovar Typhi Ty2
agcgcgaucgccccgaccagg

SEQ ID NO: 1734363 - RNA, 22 nt, Salmonella enterica enterica serovar Typhi Ty2
agcgcgacgggaaggaaauuca

SEQ ID NO: 1734364 - RNA, 13 nt, Salmonella enterica enterica serovar Typhi Ty2
agcgcgcuggcaa

SEQ ID NO: 1734365 - RNA, 15 nt, Salmonella enterica enterica serovar Typhi Ty2
agcgcgcgcaguuug

SEQ ID NO: 1734366 - RNA, 12 nt, Salmonella enterica enterica serovar Typhi Ty2
aaacgcugcgcu

SEQ ID NO: 1734367 - RNA, 17 nt, Salmonella enterica enterica serovar Typhi Ty2
aaacgcgcucgccagcg

SEQ ID NO: 1734368 - RNA, 14 nt, Salmonella enterica enterica serovar Typhi Ty2
agcgaauccagcgc

SEQ ID NO: 1734369 - RNA, 14 nt, Salmonella enterica enterica serovar Typhi Ty2
agcgaauagcggca

SEQ ID NO: 1734370 - RNA, 14 nt, Salmonella enterica enterica serovar Typhi Ty2
aaacgccucauccg

SEQ ID NO: 1734371 - RNA, 13 nt, Salmonella enterica enterica serovar Typhi Ty2
aaacgcuggugcu

SEQ ID NO: 1734372 - RNA, 13 nt, Salmonella enterica enterica serovar Typhi Ty2
agcgaaugcugca

SEQ ID NO: 1734373 - RNA, 12 nt, Salmonella enterica enterica serovar Typhi Ty2
agcgacaacgcu

SEQ ID NO: 1734374 - RNA, 12 nt, Salmonella enterica enterica serovar Typhi Ty2
agcgacgcuggc

SEQ ID NO: 1734375 - RNA, 17 nt, Salmonella enterica enterica serovar Typhi Ty2
agccgcucaggguaauc

SEQ ID NO: 1734376 - RNA, 12 nt, Salmonella enterica enterica serovar Typhi Ty2
agccuggucacc

SEQ ID NO: 1734377 - RNA, 19 nt, Salmonella enterica enterica serovar Typhi Ty2
agccuggagagcagcgcca

SEQ ID NO: 1734378 - RNA, 13 nt, Salmonella enterica enterica serovar Typhi Ty2
agccguuaccgcc

SEQ ID NO: 1734379 - RNA, 17 nt, Salmonella enterica enterica serovar Typhi Ty2
agccguaucuuccggug

SEQ ID NO: 1734380 - RNA, 18 nt, Salmonella enterica enterica serovar Typhi Ty2
aucacuaccgccgcggau

SEQ ID NO: 1734381 - RNA, 13 nt, Salmonella enterica enterica serovar Typhi Ty2
aucacuaccgcca

SEQ ID NO: 1734382 - RNA, 23 nt, Salmonella enterica enterica serovar Typhi Ty2
aucagagguaauuagaucggcaa

SEQ ID NO: 1734383 - RNA, 18 nt, Salmonella enterica enterica serovar Typhi Ty2
aucagauaggcggcaaau

SEQ ID NO: 1734384 - RNA, 13 nt, Salmonella enterica enterica serovar Typhi Ty2
aucagcaacgcgc

SEQ ID NO: 1734385 - RNA, 13 nt, Salmonella enterica enterica serovar Typhi Ty2
aucagcgccacca

SEQ ID NO: 1734386 - RNA, 19 nt, Salmonella enterica enterica serovar Typhi Ty2
aucagcgccgucgccauca

SEQ ID NO: 1734387 - RNA, 22 nt, Salmonella enterica enterica serovar Typhi Ty2
aucagcgauugcgccagaccca

SEQ ID NO: 1734388 - RNA, 15 nt, Salmonella enterica enterica serovar Typhi Ty2
aucagcgcuccgaca

SEQ ID NO: 1734389 - RNA, 16 nt, Salmonella enterica enterica serovar Typhi Ty2
aucaggacauggucac

SEQ ID NO: 1734390 - RNA, 20 nt, Salmonella enterica enterica serovar Typhi Ty2
aucagcgcggcgaaggucgc

SEQ ID NO: 1734391 - RNA, 22 nt, Salmonella enterica enterica serovar Typhi Ty2
aucacccaacguucaugucggc

SEQ ID NO: 1734392 - RNA, 15 nt, Salmonella enterica enterica serovar Typhi Ty2
aucaccauggcgcca

SEQ ID NO: 1734393 - RNA, 15 nt, Salmonella enterica enterica serovar Typhi Ty2
aucacgaaauaacgc

SEQ ID NO: 1734394 - RNA, 22 nt, Salmonella enterica enterica serovar Typhi Ty2
aucaauuuuucgcccggcucau

SEQ ID NO: 1734395 - RNA, 16 nt, Salmonella enterica enterica serovar Typhi Ty2
aucacaacgucauccc

SEQ ID NO: 1734396 - RNA, 17 nt, Salmonella enterica enterica serovar Typhi Ty2
aucaauuuuaauaacgg

SEQ ID NO: 1734397 - RNA, 21 nt, Salmonella enterica enterica serovar Typhi Ty2
aucacaucauuaaagcgcuca

SEQ ID NO: 1734398 - RNA, 22 nt, Salmonella enterica enterica serovar Typhi Ty2
aucacaggggucaucggcacgu

SEQ ID NO: 1734399 - RNA, 23 nt, Salmonella enterica enterica serovar Typhi Ty2
aucaaugucugauggcgcugcgc

SEQ ID NO: 1734400 - RNA, 20 nt, Salmonella enterica enterica serovar Typhi Ty2
aucaauguauuguucaugca

SEQ ID NO: 1734401 - RNA, 17 nt, Salmonella enterica enterica serovar Typhi Ty2
aucaagcccagcucagg

SEQ ID NO: 1734402 - RNA, 18 nt, Salmonella enterica enterica serovar Typhi Ty2
aucaauguaaaacgguau

SEQ ID NO: 1734403 - RNA, 15 nt, Salmonella enterica enterica serovar Typhi Ty2
aucaacugcgccaca

SEQ ID NO: 1734404 - RNA, 13 nt, Salmonella enterica enterica serovar Typhi Ty2
aucaacugcgcca

SEQ ID NO: 1734405 - RNA, 16 nt, Salmonella enterica enterica serovar Typhi Ty2
aucaacucuuuaccca

SEQ ID NO: 1734406 - RNA, 14 nt, Salmonella enterica enterica serovar Typhi Ty2
auauuaaaagccgc

SEQ ID NO: 1734407 - RNA, 15 nt, Salmonella enterica enterica serovar Typhi Ty2
auauucaaaauccgc

SEQ ID NO: 1734408 - RNA, 20 nt, Salmonella enterica enterica serovar Typhi Ty2
auaugguauucgugcaucag

SEQ ID NO: 1734409 - RNA, 14 nt, Salmonella enterica enterica serovar Typhi Ty2
auauguuugcgcgu

SEQ ID NO: 1734410 - RNA, 12 nt, Salmonella enterica enterica serovar Typhi Ty2
auauguugcgcu

SEQ ID NO: 1734411 - RNA, 18 nt, Salmonella enterica enterica serovar Typhi Ty2
auauguuccggcgucgcg

SEQ ID NO: 1734412 - RNA, 23 nt, Salmonella enterica enterica serovar Typhi Ty2
aucaaacuugcccagcgccuucu

SEQ ID NO: 1734413 - RNA, 15 nt, Salmonella enterica enterica serovar Typhi Ty2
aucaacaaugucgcc

SEQ ID NO: 1734414 - RNA, 20 nt, Salmonella enterica enterica serovar Typhi Ty2
aucaacagaccgacgaugac

SEQ ID NO: 1734415 - RNA, 22 nt, Salmonella enterica enterica serovar Typhi Ty2
aucaacguaaauagagaaauca

SEQ ID NO: 1734416 - RNA, 12 nt, Salmonella enterica enterica serovar Typhi Ty2
auagcgccaucc

SEQ ID NO: 1734417 - RNA, 17 nt, Salmonella enterica enterica serovar Typhi Ty2
auagcgcugaaguccgc

SEQ ID NO: 1734418 - RNA, 22 nt, Salmonella enterica enterica serovar Typhi Ty2
auagcuuuucaagaauuacauc

SEQ ID NO: 1734419 - RNA, 20 nt, Salmonella enterica enterica serovar Typhi Ty2
auagcuuuucaugacgcucu

SEQ ID NO: 1734420 - RNA, 19 nt, Salmonella enterica enterica serovar Typhi Ty2
auagcgccuucaggcauca

SEQ ID NO: 1734421 - RNA, 21 nt, Salmonella enterica enterica serovar Typhi Ty2
auagccuugauccuguaacgc

SEQ ID NO: 1734422 - RNA, 22 nt, Salmonella enterica enterica serovar Typhi Ty2
auagcgaggcguuuugguccgc

SEQ ID NO: 1734423 - RNA, 22 nt, Salmonella enterica enterica serovar Typhi Ty2
auaggcaauauccuccggcgua

SEQ ID NO: 1734424 - RNA, 19 nt, Salmonella enterica enterica serovar Typhi Ty2
auaggcgcgucauaaccgc

SEQ ID NO: 1734425 - RNA, 17 nt, Salmonella enterica enterica serovar Typhi Ty2
auauaacgugccgacca

SEQ ID NO: 1734426 - RNA, 15 nt, Salmonella enterica enterica serovar Typhi Ty2
auauaaauuuggcga

SEQ ID NO: 1734427 - RNA, 22 nt, Salmonella enterica enterica serovar Typhi Ty2
auauacguugcggcgcguucag

SEQ ID NO: 1734428 - RNA, 16 nt, Salmonella enterica enterica serovar Typhi Ty2
auauagccguggcugg

SEQ ID NO: 1734429 - RNA, 19 nt, Salmonella enterica enterica serovar Typhi Ty2
auaugcguugacccgucca

SEQ ID NO: 1734430 - RNA, 21 nt, Salmonella enterica enterica serovar Typhi Ty2
auaugcgucagauguucgcga

SEQ ID NO: 1734431 - RNA, 17 nt, Salmonella enterica enterica serovar Typhi Ty2
auaugcguguagcagau

SEQ ID NO: 1734432 - RNA, 16 nt, Salmonella enterica enterica serovar Typhi Ty2
auaugcggcgccauca

SEQ ID NO: 1734433 - RNA, 17 nt, Salmonella enterica enterica serovar Typhi Ty2
auaugcgcggcgaucag

SEQ ID NO: 1734434 - RNA, 18 nt, Salmonella enterica enterica serovar Typhi Ty2
auaugcugaucuggcugc

SEQ ID NO: 1734435 - RNA, 16 nt, Salmonella enterica enterica serovar Typhi Ty2
auaucuggcgaggcuu

SEQ ID NO: 1734436 - RNA, 13 nt, Salmonella enterica enterica serovar Typhi Ty2
auaugcgcaauca

SEQ ID NO: 1734437 - RNA, 13 nt, Salmonella enterica enterica serovar Typhi Ty2
auaugcgcaucag

SEQ ID NO: 1734438 - RNA, 19 nt, Salmonella enterica enterica serovar Typhi Ty2
auaucuggacgggccgcca

SEQ ID NO: 1734439 - RNA, 18 nt, Salmonella enterica enterica serovar Typhi Ty2
auaucggccggaugccag

SEQ ID NO: 1734440 - RNA, 20 nt, Salmonella enterica enterica serovar Typhi Ty2
auaucggcaauauugccgca

SEQ ID NO: 1734441 - RNA, 12 nt, Salmonella enterica enterica serovar Typhi Ty2
auaucggcugcu

SEQ ID NO: 1734442 - RNA, 13 nt, Salmonella enterica enterica serovar Typhi Ty2
auaucgccgccac

SEQ ID NO: 1734443 - RNA, 23 nt, Salmonella enterica enterica serovar Typhi Ty2
auaucgauaaucaacaaugucgc

SEQ ID NO: 1734444 - RNA, 17 nt, Salmonella enterica enterica serovar Typhi Ty2
auagagagcgacagccc

SEQ ID NO: 1734445 - RNA, 23 nt, Salmonella enterica enterica serovar Typhi Ty2
auagccggauaauuuauccagua

SEQ ID NO: 1734446 - RNA, 21 nt, Salmonella enterica enterica serovar Typhi Ty2
auagccccggucaacgcgccg

SEQ ID NO: 1734447 - RNA, 17 nt, Salmonella enterica enterica serovar Typhi Ty2
auagccgacccgcaucg

SEQ ID NO: 1734448 - RNA, 15 nt, Salmonella enterica enterica serovar Typhi Ty2
auagcaccucgcaau

SEQ ID NO: 1734449 - RNA, 17 nt, Salmonella enterica enterica serovar Typhi Ty2
auagcaccucgcaauau

SEQ ID NO: 1734450 - RNA, 12 nt, Salmonella enterica enterica serovar Typhi Ty2
auacuuccgcug

SEQ ID NO: 1734451 - RNA, 14 nt, Salmonella enterica enterica serovar Typhi Ty2
auacuuacugcugu

SEQ ID NO: 1734452 - RNA, 17 nt, Salmonella enterica enterica serovar Typhi Ty2
auacugucgcgcggcgu

SEQ ID NO: 1734453 - RNA, 21 nt, Salmonella enterica enterica serovar Typhi Ty2
auacugccgcccaucgccaca

SEQ ID NO: 1734454 - RNA, 20 nt, Salmonella enterica enterica serovar Typhi Ty2
auacugaccaagcgucagca

SEQ ID NO: 1734455 - RNA, 21 nt, Salmonella enterica enterica serovar Typhi Ty2
auacgcggcacaaaguccgcc

SEQ ID NO: 1734456 - RNA, 13 nt, Salmonella enterica enterica serovar Typhi Ty2
auacgccgucacg

SEQ ID NO: 1734457 - RNA, 15 nt, Salmonella enterica enterica serovar Typhi Ty2
auacgcucgcgguuu

SEQ ID NO: 1734458 - RNA, 15 nt, Salmonella enterica enterica serovar Typhi Ty2
auacgcugcgucagg

SEQ ID NO: 1734459 - RNA, 19 nt, Salmonella enterica enterica serovar Typhi Ty2
auacggcggcaaugccgcc

SEQ ID NO: 1734460 - RNA, 17 nt, Salmonella enterica enterica serovar Typhi Ty2
auacggauucuugacgu

SEQ ID NO: 1734461 - RNA, 22 nt, Salmonella enterica enterica serovar Typhi Ty2
auacggccuucuuccgucaccg

SEQ ID NO: 1734462 - RNA, 13 nt, Salmonella enterica enterica serovar Typhi Ty2
auacguucgcggg

SEQ ID NO: 1734463 - RNA, 17 nt, Salmonella enterica enterica serovar Typhi Ty2
auaccaaguuuggcaau

SEQ ID NO: 1734464 - RNA, 16 nt, Salmonella enterica enterica serovar Typhi Ty2
auacagguuuuaaucg

SEQ ID NO: 1734465 - RNA, 15 nt, Salmonella enterica enterica serovar Typhi Ty2
auaauaaugaucgcu

SEQ ID NO: 1734466 - RNA, 16 nt, Salmonella enterica enterica serovar Typhi Ty2
auaauuugcgccguca

SEQ ID NO: 1734467 - RNA, 19 nt, Salmonella enterica enterica serovar Typhi Ty2
auaauuugucgauaagcgu

SEQ ID NO: 1734468 - RNA, 17 nt, Salmonella enterica enterica serovar Typhi Ty2
auaauaugcaacacgcc

SEQ ID NO: 1734469 - RNA, 19 nt, Salmonella enterica enterica serovar Typhi Ty2
auaccggccacgagcuguc

SEQ ID NO: 1734470 - RNA, 20 nt, Salmonella enterica enterica serovar Typhi Ty2
auaccgggaaucaaugggau

SEQ ID NO: 1734471 - RNA, 19 nt, Salmonella enterica enterica serovar Typhi Ty2
auaccgccauccggcauuc

SEQ ID NO: 1734472 - RNA, 16 nt, Salmonella enterica enterica serovar Typhi Ty2
auacccgcuuaccgcg

SEQ ID NO: 1734473 - RNA, 14 nt, Salmonella enterica enterica serovar Typhi Ty2
auaccuaacucuuc

SEQ ID NO: 1734474 - RNA, 17 nt, Salmonella enterica enterica serovar Typhi Ty2
auaccuucccgcgauaa

SEQ ID NO: 1734475 - RNA, 22 nt, Salmonella enterica enterica serovar Typhi Ty2
auacgauugcgcguguuaccca

SEQ ID NO: 1734476 - RNA, 15 nt, Salmonella enterica enterica serovar Typhi Ty2
auacgcauucucgcc

SEQ ID NO: 1734477 - RNA, 19 nt, Salmonella enterica enterica serovar Typhi Ty2
auacgcagcauuucgucga

SEQ ID NO: 1734478 - RNA, 15 nt, Salmonella enterica enterica serovar Typhi Ty2
aguuuuccgccugaa

SEQ ID NO: 1734479 - RNA, 22 nt, Salmonella enterica enterica serovar Typhi Ty2
auaacacggcuggcaaugcgcu

SEQ ID NO: 1734480 - RNA, 20 nt, Salmonella enterica enterica serovar Typhi Ty2
auaacgugccgaccagcggu

SEQ ID NO: 1734481 - RNA, 18 nt, Salmonella enterica enterica serovar Typhi Ty2
auaacgcguucuggcgau

SEQ ID NO: 1734482 - RNA, 15 nt, Salmonella enterica enterica serovar Typhi Ty2
auaacugcgccaucu

SEQ ID NO: 1734483 - RNA, 14 nt, Salmonella enterica enterica serovar Typhi Ty2
auaacguuaccgca

SEQ ID NO: 1734484 - RNA, 18 nt, Salmonella enterica enterica serovar Typhi Ty2
aguauuaaggcagccauu

SEQ ID NO: 1734485 - RNA, 23 nt, Salmonella enterica enterica serovar Typhi Ty2
agucagcaacauggauucgcugg

SEQ ID NO: 1734486 - RNA, 18 nt, Salmonella enterica enterica serovar Typhi Ty2
agugacguggcuucgccg

SEQ ID NO: 1734487 - RNA, 18 nt, Salmonella enterica enterica serovar Typhi Ty2
agucuguucguagcccau

SEQ ID NO: 1734488 - RNA, 14 nt, Salmonella enterica enterica serovar Typhi Ty2
aguggacgcgucgc

SEQ ID NO: 1734489 - RNA, 15 nt, Salmonella enterica enterica serovar Typhi Ty2
aguggacgcgucgcu

SEQ ID NO: 1734490 - RNA, 20 nt, Salmonella enterica enterica serovar Typhi Ty2
agugcuauacaguaaaacgc

SEQ ID NO: 1734491 - RNA, 23 nt, Salmonella enterica enterica serovar Typhi Ty2
agugcuauacaguaaaacgccaa

SEQ ID NO: 1734492 - RNA, 18 nt, Salmonella enterica enterica serovar Typhi Ty2
agugauaaagcacagccc

SEQ ID NO: 1734493 - RNA, 15 nt, Salmonella enterica enterica serovar Typhi Ty2
agugaguuaagacgc

SEQ ID NO: 1734494 - RNA, 12 nt, Salmonella enterica enterica serovar Typhi Ty2
aguugcgucagc

SEQ ID NO: 1734495 - RNA, 13 nt, Salmonella enterica enterica serovar Typhi Ty2
aguugccuucgau

SEQ ID NO: 1734496 - RNA, 22 nt, Salmonella enterica enterica serovar Typhi Ty2
aguucggcgauuuccagcgccg

SEQ ID NO: 1734497 - RNA, 22 nt, Salmonella enterica enterica serovar Typhi Ty2
aguucgucuuccggauaacgcg

SEQ ID NO: 1734498 - RNA, 13 nt, Salmonella enterica enterica serovar Typhi Ty2
aguugauagcgau

SEQ ID NO: 1734499 - RNA, 19 nt, Salmonella enterica enterica serovar Typhi Ty2
aguucuggcuuugcgccgg

SEQ ID NO: 1734500 - RNA, 22 nt, Salmonella enterica enterica serovar Typhi Ty2
aguuccaaucucuuuugcggcg

SEQ ID NO: 1734501 - RNA, 12 nt, Salmonella enterica enterica serovar Typhi Ty2
agugguucgcca

SEQ ID NO: 1734502 - RNA, 21 nt, Salmonella enterica enterica serovar Typhi Ty2
aguuccgccagacucagccag

SEQ ID NO: 1734503 - RNA, 17 nt, Salmonella enterica enterica serovar Typhi Ty2
aguaucgggauggcgau

SEQ ID NO: 1734504 - RNA, 16 nt, Salmonella enterica enterica serovar Typhi Ty2
aguauguuaacgccga

SEQ ID NO: 1734505 - RNA, 18 nt, Salmonella enterica enterica serovar Typhi Ty2
aguaugcuuauugucgcc

SEQ ID NO: 1734506 - RNA, 18 nt, Salmonella enterica enterica serovar Typhi Ty2
aguaugaccccuccggcc

SEQ ID NO: 1734507 - RNA, 19 nt, Salmonella enterica enterica serovar Typhi Ty2
aguagacgguaacggcugg

SEQ ID NO: 1734508 - RNA, 14 nt, Salmonella enterica enterica serovar Typhi Ty2
aguauaacgaugau

SEQ ID NO: 1734509 - RNA, 19 nt, Salmonella enterica enterica serovar Typhi Ty2
aguaacugcccgucggacu

SEQ ID NO: 1734510 - RNA, 11 nt, Salmonella enterica enterica serovar Typhi Ty2
aguacgcccgg

SEQ ID NO: 1734511 - RNA, 17 nt, Salmonella enterica enterica serovar Typhi Ty2
aguacgcgacugaucag

SEQ ID NO: 1734512 - RNA, 22 nt, Salmonella enterica enterica serovar Typhi Ty2
agguuugacucgcuacgcucgc

SEQ ID NO: 1734513 - RNA, 16 nt, Salmonella enterica enterica serovar Typhi Ty2
agggugaauaccagcg

SEQ ID NO: 1734514 - RNA, 20 nt, Salmonella enterica enterica serovar Typhi Ty2
aggucggguaagcguagcgc

SEQ ID NO: 1734515 - RNA, 21 nt, Salmonella enterica enterica serovar Typhi Ty2
aggcuccaaguauugauaccu

SEQ ID NO: 1734516 - RNA, 15 nt, Salmonella enterica enterica serovar Typhi Ty2
aggcuacccagacaa

SEQ ID NO: 1734517 - RNA, 14 nt, Salmonella enterica enterica serovar Typhi Ty2
aggcucaaaguuac

SEQ ID NO: 1734518 - RNA, 13 nt, Salmonella enterica enterica serovar Typhi Ty2
aggcuaaauggca

SEQ ID NO: 1734519 - RNA, 21 nt, Salmonella enterica enterica serovar Typhi Ty2
aggcguuuacgcugcuauccg

SEQ ID NO: 1734520 - RNA, 16 nt, Salmonella enterica enterica serovar Typhi Ty2
agggcgugacgcgcca

SEQ ID NO: 1734521 - RNA, 18 nt, Salmonella enterica enterica serovar Typhi Ty2
agggcgugccgugagcgc

SEQ ID NO: 1734522 - RNA, 17 nt, Salmonella enterica enterica serovar Typhi Ty2
agggccgauaccggcaa

SEQ ID NO: 1734523 - RNA, 13 nt, Salmonella enterica enterica serovar Typhi Ty2
agggccaggcgcg

SEQ ID NO: 1734524 - RNA, 19 nt, Salmonella enterica enterica serovar Typhi Ty2
aggcuuaacacccggauau

SEQ ID NO: 1734525 - RNA, 17 nt, Salmonella enterica enterica serovar Typhi Ty2
aggcuuaacacccggau

SEQ ID NO: 1734526 - RNA, 15 nt, Salmonella enterica enterica serovar Typhi Ty2
aggccggacaggcga

SEQ ID NO: 1734527 - RNA, 12 nt, Salmonella enterica enterica serovar Typhi Ty2
aggccggauaag

SEQ ID NO: 1734528 - RNA, 20 nt, Salmonella enterica enterica serovar Typhi Ty2
aggccgggcaagcgaagcgc

SEQ ID NO: 1734529 - RNA, 16 nt, Salmonella enterica enterica serovar Typhi Ty2
agcuggccaaucagcg

SEQ ID NO: 1734530 - RNA, 21 nt, Salmonella enterica enterica serovar Typhi Ty2
aggcagccggauuuuaaauug

SEQ ID NO: 1734531 - RNA, 16 nt, Salmonella enterica enterica serovar Typhi Ty2
aggcagcgcgccagcg

SEQ ID NO: 1734532 - RNA, 17 nt, Salmonella enterica enterica serovar Typhi Ty2
aggcgcguuuacuggcg

SEQ ID NO: 1734533 - RNA, 21 nt, Salmonella enterica enterica serovar Typhi Ty2
aggcgcugcguaguaccagua

SEQ ID NO: 1734534 - RNA, 22 nt, Salmonella enterica enterica serovar Typhi Ty2
aggcgcucggccagauaacgcg

SEQ ID NO: 1734535 - RNA, 20 nt, Salmonella enterica enterica serovar Typhi Ty2
aggcggaccgagauacgcug

SEQ ID NO: 1734536 - RNA, 21 nt, Salmonella enterica enterica serovar Typhi Ty2
aggcgccgcucaucaccagca

SEQ ID NO: 1734537 - RNA, 20 nt, Salmonella enterica enterica serovar Typhi Ty2
aggcgcauccgucaggccca

SEQ ID NO: 1734538 - RNA, 14 nt, Salmonella enterica enterica serovar Typhi Ty2
aggcgcauaucgcc

SEQ ID NO: 1734539 - RNA, 15 nt, Salmonella enterica enterica serovar Typhi Ty2
aggcgcauaucgccc

SEQ ID NO: 1734540 - RNA, 13 nt, Salmonella enterica enterica serovar Typhi Ty2
aggccuauagaca

SEQ ID NO: 1734541 - RNA, 20 nt, Salmonella enterica enterica serovar Typhi Ty2
aggccugcaucaacaggcga

SEQ ID NO: 1734542 - RNA, 18 nt, Salmonella enterica enterica serovar Typhi Ty2
aggccugaugagcgcagc

SEQ ID NO: 1734543 - RNA, 20 nt, Salmonella enterica enterica serovar Typhi Ty2
aggccucguuuugcugccac

SEQ ID NO: 1734544 - RNA, 20 nt, Salmonella enterica enterica serovar Typhi Ty2
aggccugguaagcguagcgc

SEQ ID NO: 1734545 - RNA, 16 nt, Salmonella enterica enterica serovar Typhi Ty2
aggcgaacuccagcgc

SEQ ID NO: 1734546 - RNA, 22 nt, Salmonella enterica enterica serovar Typhi Ty2
aggcgacuaccguucacggcga

SEQ ID NO: 1734547 - RNA, 22 nt, Salmonella enterica enterica serovar Typhi Ty2
aggcgcaacgucgccauccggc

SEQ ID NO: 1734548 - RNA, 17 nt, Salmonella enterica enterica serovar Typhi Ty2
augccgcgucaggagcg

SEQ ID NO: 1734549 - RNA, 20 nt, Salmonella enterica enterica serovar Typhi Ty2
augccgcuggcguauucgcc

SEQ ID NO: 1734550 - RNA, 15 nt, Salmonella enterica enterica serovar Typhi Ty2
augccucuuccggua

SEQ ID NO: 1734551 - RNA, 20 nt, Salmonella enterica enterica serovar Typhi Ty2
augccuaacguguuaucgcu

SEQ ID NO: 1734552 - RNA, 21 nt, Salmonella enterica enterica serovar Typhi Ty2
augaucugcgcaacauucugc

SEQ ID NO: 1734553 - RNA, 13 nt, Salmonella enterica enterica serovar Typhi Ty2
augauggcuccug

SEQ ID NO: 1734554 - RNA, 17 nt, Salmonella enterica enterica serovar Typhi Ty2
augaugcucgcucauca

SEQ ID NO: 1734555 - RNA, 19 nt, Salmonella enterica enterica serovar Typhi Ty2
augccgaucaccagcgcau

SEQ ID NO: 1734556 - RNA, 23 nt, Salmonella enterica enterica serovar Typhi Ty2
augccgauaauaaacgcgccaag

SEQ ID NO: 1734557 - RNA, 20 nt, Salmonella enterica enterica serovar Typhi Ty2
augcgucgcauccuuaugca

SEQ ID NO: 1734558 - RNA, 21 nt, Salmonella enterica enterica serovar Typhi Ty2
augcguucuagcuuaucgcca

SEQ ID NO: 1734559 - RNA, 12 nt, Salmonella enterica enterica serovar Typhi Ty2
augcuggugcau

SEQ ID NO: 1734560 - RNA, 20 nt, Salmonella enterica enterica serovar Typhi Ty2
augcuugccauauugccgca

SEQ ID NO: 1734561 - RNA, 16 nt, Salmonella enterica enterica serovar Typhi Ty2
augcgcucauaaccgc

SEQ ID NO: 1734562 - RNA, 17 nt, Salmonella enterica enterica serovar Typhi Ty2
augcgcagaaacugauc

SEQ ID NO: 1734563 - RNA, 19 nt, Salmonella enterica enterica serovar Typhi Ty2
augcgcaaaauucacacca

SEQ ID NO: 1734564 - RNA, 13 nt, Salmonella enterica enterica serovar Typhi Ty2
augcgcuuuccgc

SEQ ID NO: 1734565 - RNA, 16 nt, Salmonella enterica enterica serovar Typhi Ty2
augcgcuuccagcaug

SEQ ID NO: 1734566 - RNA, 17 nt, Salmonella enterica enterica serovar Typhi Ty2
auggcuugugaauacca

SEQ ID NO: 1734567 - RNA, 13 nt, Salmonella enterica enterica serovar Typhi Ty2
auggcuuugcugu

SEQ ID NO: 1734568 - RNA, 13 nt, Salmonella enterica enterica serovar Typhi Ty2
auggcggcgcaaa

SEQ ID NO: 1734569 - RNA, 20 nt, Salmonella enterica enterica serovar Typhi Ty2
auggcggcgaaaugccuuau

SEQ ID NO: 1734570 - RNA, 20 nt, Salmonella enterica enterica serovar Typhi Ty2
auggcguggcgcuuuccggc

SEQ ID NO: 1734571 - RNA, 16 nt, Salmonella enterica enterica serovar Typhi Ty2
auggcgcucuuuucca

SEQ ID NO: 1734572 - RNA, 20 nt, Salmonella enterica enterica serovar Typhi Ty2
auggcgcuacgcuuauccgg

SEQ ID NO: 1734573 - RNA, 20 nt, Salmonella enterica enterica serovar Typhi Ty2
auggcgcugcgcuuaucaga

SEQ ID NO: 1734574 - RNA, 18 nt, Salmonella enterica enterica serovar Typhi Ty2
auggccagcaccagcauu

SEQ ID NO: 1734575 - RNA, 22 nt, Salmonella enterica enterica serovar Typhi Ty2
auggccugcucaauacuuuccg

SEQ ID NO: 1734576 - RNA, 21 nt, Salmonella enterica enterica serovar Typhi Ty2
auggcgaauccguugaucguc

SEQ ID NO: 1734577 - RNA, 21 nt, Salmonella enterica enterica serovar Typhi Ty2
auggucuguaccaccagaauc

SEQ ID NO: 1734578 - RNA, 23 nt, Salmonella enterica enterica serovar Typhi Ty2
auggucucaaucgcaaauugcug

SEQ ID NO: 1734579 - RNA, 22 nt, Salmonella enterica enterica serovar Typhi Ty2
auggucgccuccguaugaccgc

SEQ ID NO: 1734580 - RNA, 20 nt, Salmonella enterica enterica serovar Typhi Ty2
auguaguccgggugcaaauc

SEQ ID NO: 1734581 - RNA, 20 nt, Salmonella enterica enterica serovar Typhi Ty2
auguaggccgggcaagcgaa

SEQ ID NO: 1734582 - RNA, 15 nt, Salmonella enterica enterica serovar Typhi Ty2
auguccgccuaccag

SEQ ID NO: 1734583 - RNA, 15 nt, Salmonella enterica enterica serovar Typhi Ty2
auguccgacgccgcu

SEQ ID NO: 1734584 - RNA, 22 nt, Salmonella enterica enterica serovar Typhi Ty2
augucggcguaaauccagccuc

SEQ ID NO: 1734585 - RNA, 20 nt, Salmonella enterica enterica serovar Typhi Ty2
augucgacauaauuuccggc

SEQ ID NO: 1734586 - RNA, 20 nt, Salmonella enterica enterica serovar Typhi Ty2
augucguuguaguuaucgcc

SEQ ID NO: 1734587 - RNA, 23 nt, Salmonella enterica enterica serovar Typhi Ty2
auuaaaagucaacugcucuacca

SEQ ID NO: 1734588 - RNA, 15 nt, Salmonella enterica enterica serovar Typhi Ty2
auguuuccguuugua

SEQ ID NO: 1734589 - RNA, 19 nt, Salmonella enterica enterica serovar Typhi Ty2
auguucgcuucugccgcca

SEQ ID NO: 1734590 - RNA, 17 nt, Salmonella enterica enterica serovar Typhi Ty2
augugccacuccgccag

SEQ ID NO: 1734591 - RNA, 14 nt, Salmonella enterica enterica serovar Typhi Ty2
augugcaucggcac

SEQ ID NO: 1734592 - RNA, 12 nt, Salmonella enterica enterica serovar Typhi Ty2
augugagcgcau

SEQ ID NO: 1734593 - RNA, 13 nt, Salmonella enterica enterica serovar Typhi Ty2
augugagcgcauc

SEQ ID NO: 1734594 - RNA, 22 nt, Salmonella enterica enterica serovar Typhi Ty2
augugauacgcuuuaggguauc

SEQ ID NO: 1734595 - RNA, 15 nt, Salmonella enterica enterica serovar Typhi Ty2
auguuagcaaaaaug

SEQ ID NO: 1734596 - RNA, 17 nt, Salmonella enterica enterica serovar Typhi Ty2
auguuaauuucaucgcc

SEQ ID NO: 1734597 - RNA, 17 nt, Salmonella enterica enterica serovar Typhi Ty2
auguucaauaucaaauu

SEQ ID NO: 1734598 - RNA, 17 nt, Salmonella enterica enterica serovar Typhi Ty2
auguucauaccggauau

SEQ ID NO: 1734599 - RNA, 13 nt, Salmonella enterica enterica serovar Typhi Ty2
auguuaacgccga

SEQ ID NO: 1734600 - RNA, 12 nt, Salmonella enterica enterica serovar Typhi Ty2
auuaacagcgcc

SEQ ID NO: 1734601 - RNA, 17 nt, Salmonella enterica enterica serovar Typhi Ty2
auuaacagucuaucgcu

SEQ ID NO: 1734602 - RNA, 18 nt, Salmonella enterica enterica serovar Typhi Ty2
auuaacgggaaacuguuu

SEQ ID NO: 1734603 - RNA, 14 nt, Salmonella enterica enterica serovar Typhi Ty2
auuaacuccggacg

SEQ ID NO: 1734604 - RNA, 16 nt, Salmonella enterica enterica serovar Typhi Ty2
auuaguccugccgcua

SEQ ID NO: 1734605 - RNA, 20 nt, Salmonella enterica enterica serovar Typhi Ty2
auuaggcguaaaauugccgc

SEQ ID NO: 1734606 - RNA, 16 nt, Salmonella enterica enterica serovar Typhi Ty2
auuaauacaucacuuu

SEQ ID NO: 1734607 - RNA, 12 nt, Salmonella enterica enterica serovar Typhi Ty2
auuagccgccag

SEQ ID NO: 1734608 - RNA, 14 nt, Salmonella enterica enterica serovar Typhi Ty2
auuagccgccaucc

SEQ ID NO: 1734609 - RNA, 18 nt, Salmonella enterica enterica serovar Typhi Ty2
auuagccgccauccggca

SEQ ID NO: 1734610 - RNA, 19 nt, Salmonella enterica enterica serovar Typhi Ty2
auucaacagggguuccggc

SEQ ID NO: 1734611 - RNA, 15 nt, Salmonella enterica enterica serovar Typhi Ty2
auucauagccacagc

SEQ ID NO: 1734612 - RNA, 20 nt, Salmonella enterica enterica serovar Typhi Ty2
auucauaaugguugugccag

SEQ ID NO: 1734613 - RNA, 13 nt, Salmonella enterica enterica serovar Typhi Ty2
auucaucaaaaug

SEQ ID NO: 1734614 - RNA, 18 nt, Salmonella enterica enterica serovar Typhi Ty2
auuauccacaaacuccag

SEQ ID NO: 1734615 - RNA, 13 nt, Salmonella enterica enterica serovar Typhi Ty2
auuaucgccauca

SEQ ID NO: 1734616 - RNA, 16 nt, Salmonella enterica enterica serovar Typhi Ty2
auucugcgaaagccuc

SEQ ID NO: 1734617 - RNA, 15 nt, Salmonella enterica enterica serovar Typhi Ty2
auucuugccgcaucu

SEQ ID NO: 1734618 - RNA, 19 nt, Salmonella enterica enterica serovar Typhi Ty2
auucuuuaauuugugccag

SEQ ID NO: 1734619 - RNA, 12 nt, Salmonella enterica enterica serovar Typhi Ty2
auugaagugcga

SEQ ID NO: 1734620 - RNA, 22 nt, Salmonella enterica enterica serovar Typhi Ty2
auugaguaaauaaaucagcgcg

SEQ ID NO: 1734621 - RNA, 21 nt, Salmonella enterica enterica serovar Typhi Ty2
auugaauccggguuccugcau

SEQ ID NO: 1734622 - RNA, 22 nt, Salmonella enterica enterica serovar Typhi Ty2
auugaauucaccgcaugacaau

SEQ ID NO: 1734623 - RNA, 17 nt, Salmonella enterica enterica serovar Typhi Ty2
auucggcgcuucgcagc

SEQ ID NO: 1734624 - RNA, 16 nt, Salmonella enterica enterica serovar Typhi Ty2
auuccguuugcgccgg

SEQ ID NO: 1734625 - RNA, 22 nt, Salmonella enterica enterica serovar Typhi Ty2
auucauuaaaauugaacggacg

SEQ ID NO: 1734626 - RNA, 16 nt, Salmonella enterica enterica serovar Typhi Ty2
auucauggauaccggg

SEQ ID NO: 1734627 - RNA, 22 nt, Salmonella enterica enterica serovar Typhi Ty2
auuccuccgccgaucagcacca

SEQ ID NO: 1734628 - RNA, 15 nt, Salmonella enterica enterica serovar Typhi Ty2
auuggggaaccuggc

SEQ ID NO: 1734629 - RNA, 14 nt, Salmonella enterica enterica serovar Typhi Ty2
auugguacaacgcc

SEQ ID NO: 1734630 - RNA, 18 nt, Salmonella enterica enterica serovar Typhi Ty2
auugcuuucaauuuccgc

SEQ ID NO: 1734631 - RNA, 15 nt, Salmonella enterica enterica serovar Typhi Ty2
auuuaccacgguaac

SEQ ID NO: 1734632 - RNA, 11 nt, Salmonella enterica enterica serovar Typhi Ty2
auuuaccagug

SEQ ID NO: 1734633 - RNA, 18 nt, Salmonella enterica enterica serovar Typhi Ty2
auuguucuaaacguucau

SEQ ID NO: 1734634 - RNA, 21 nt, Salmonella enterica enterica serovar Typhi Ty2
auugaucacaaaaucauugcg

SEQ ID NO: 1734635 - RNA, 20 nt, Salmonella enterica enterica serovar Typhi Ty2
auugauuuccgcgcaaucgc

SEQ ID NO: 1734636 - RNA, 14 nt, Salmonella enterica enterica serovar Typhi Ty2
auugccggaaacca

SEQ ID NO: 1734637 - RNA, 24 nt, Salmonella enterica enterica serovar Typhi Ty2
auugccggauggggcauuagccgc

SEQ ID NO: 1734638 - RNA, 19 nt, Salmonella enterica enterica serovar Typhi Ty2
auugccggauggcggcgua

SEQ ID NO: 1734639 - RNA, 16 nt, Salmonella enterica enterica serovar Typhi Ty2
auugccguuaacugcu

SEQ ID NO: 1734640 - RNA, 16 nt, Salmonella enterica enterica serovar Typhi Ty2
auugcugacgcgcuuu

SEQ ID NO: 1734641 - RNA, 20 nt, Salmonella enterica enterica serovar Typhi Ty2
aucgccaucaacuccuccgg

SEQ ID NO: 1734642 - RNA, 13 nt, Salmonella enterica enterica serovar Typhi Ty2
aucgccauuacgc

SEQ ID NO: 1734643 - RNA, 12 nt, Salmonella enterica enterica serovar Typhi Ty2
aucgccagcuuc

SEQ ID NO: 1734644 - RNA, 19 nt, Salmonella enterica enterica serovar Typhi Ty2
aucgccacaugcggcaggc

SEQ ID NO: 1734645 - RNA, 18 nt, Salmonella enterica enterica serovar Typhi Ty2
aucgcauaaauauccggg

SEQ ID NO: 1734646 - RNA, 22 nt, Salmonella enterica enterica serovar Typhi Ty2
aucgcauuaacguccauaccgg

SEQ ID NO: 1734647 - RNA, 20 nt, Salmonella enterica enterica serovar Typhi Ty2
aucgccaaagucauugcugc

SEQ ID NO: 1734648 - RNA, 20 nt, Salmonella enterica enterica serovar Typhi Ty2
aucgcaggauaaagaccggc

SEQ ID NO: 1734649 - RNA, 22 nt, Salmonella enterica enterica serovar Typhi Ty2
aucgcagaaauauuuugccugc

SEQ ID NO: 1734650 - RNA, 21 nt, Salmonella enterica enterica serovar Typhi Ty2
aucgcagagcguaauuccgca

SEQ ID NO: 1734651 - RNA, 19 nt, Salmonella enterica enterica serovar Typhi Ty2
aucgauggcagucgcauca

SEQ ID NO: 1734652 - RNA, 22 nt, Salmonella enterica enterica serovar Typhi Ty2
aucaggccugccugaucgccac

SEQ ID NO: 1734653 - RNA, 17 nt, Salmonella enterica enterica serovar Typhi Ty2
aucaggcaaugucugcc

SEQ ID NO: 1734654 - RNA, 12 nt, Salmonella enterica enterica serovar Typhi Ty2
aucaggcaauau

SEQ ID NO: 1734655 - RNA, 20 nt, Salmonella enterica enterica serovar Typhi Ty2
aucgacguugaucgccaucg

SEQ ID NO: 1734656 - RNA, 17 nt, Salmonella enterica enterica serovar Typhi Ty2
aucgaccguauccgcca

SEQ ID NO: 1734657 - RNA, 15 nt, Salmonella enterica enterica serovar Typhi Ty2
aucgagaagccauca

SEQ ID NO: 1734658 - RNA, 14 nt, Salmonella enterica enterica serovar Typhi Ty2
aucgauaauugcuc

SEQ ID NO: 1734659 - RNA, 20 nt, Salmonella enterica enterica serovar Typhi Ty2
aucgauacagacgccaacgc

SEQ ID NO: 1734660 - RNA, 22 nt, Salmonella enterica enterica serovar Typhi Ty2
aucgauccgcaucagcaacgcg

SEQ ID NO: 1734661 - RNA, 16 nt, Salmonella enterica enterica serovar Typhi Ty2
aucgcugucggucaga

SEQ ID NO: 1734662 - RNA, 22 nt, Salmonella enterica enterica serovar Typhi Ty2
aucgcugugguuuauccgcaga

SEQ ID NO: 1734663 - RNA, 20 nt, Salmonella enterica enterica serovar Typhi Ty2
aucgcugaccaacgucagca

SEQ ID NO: 1734664 - RNA, 20 nt, Salmonella enterica enterica serovar Typhi Ty2
aucgcuaaacauauaccgca

SEQ ID NO: 1734665 - RNA, 23 nt, Salmonella enterica enterica serovar Typhi Ty2
aucggaaacuauccuggccugau

SEQ ID NO: 1734666 - RNA, 20 nt, Salmonella enterica enterica serovar Typhi Ty2
aucggaagacuggcgcagca

SEQ ID NO: 1734667 - RNA, 16 nt, Salmonella enterica enterica serovar Typhi Ty2
aucgcguacagcgcca

SEQ ID NO: 1734668 - RNA, 17 nt, Salmonella enterica enterica serovar Typhi Ty2
aucgcguacagcgccau

SEQ ID NO: 1734669 - RNA, 15 nt, Salmonella enterica enterica serovar Typhi Ty2
aucgcggccagcaug

SEQ ID NO: 1734670 - RNA, 20 nt, Salmonella enterica enterica serovar Typhi Ty2
aucgcgcuggcaguuugcgc

SEQ ID NO: 1734671 - RNA, 12 nt, Salmonella enterica enterica serovar Typhi Ty2
aucgcgcggcga

SEQ ID NO: 1734672 - RNA, 22 nt, Salmonella enterica enterica serovar Typhi Ty2
aucgccgcgccggacuccagca

SEQ ID NO: 1734673 - RNA, 23 nt, Salmonella enterica enterica serovar Typhi Ty2
aucgccgucuucuucuucgcgca

SEQ ID NO: 1734674 - RNA, 23 nt, Salmonella enterica enterica serovar Typhi Ty2
aucgccgcccgcaugguaaacgc

SEQ ID NO: 1734675 - RNA, 13 nt, Salmonella enterica enterica serovar Typhi Ty2
aucgccgccaucg

SEQ ID NO: 1734676 - RNA, 15 nt, Salmonella enterica enterica serovar Typhi Ty2
aucgcccuccagcuc

SEQ ID NO: 1734677 - RNA, 12 nt, Salmonella enterica enterica serovar Typhi Ty2
aucgcgccaucg

SEQ ID NO: 1734678 - RNA, 15 nt, Salmonella enterica enterica serovar Typhi Ty2
aucgccugcggcgua

SEQ ID NO: 1734679 - RNA, 14 nt, Salmonella enterica enterica serovar Typhi Ty2
aucggcguaccgca

SEQ ID NO: 1734680 - RNA, 17 nt, Salmonella enterica enterica serovar Typhi Ty2
aucggcgucuugccgca

SEQ ID NO: 1734681 - RNA, 19 nt, Salmonella enterica enterica serovar Typhi Ty2
aucggcgucgcggcaauag

SEQ ID NO: 1734682 - RNA, 14 nt, Salmonella enterica enterica serovar Typhi Ty2
aucggcuggcgcaa

SEQ ID NO: 1734683 - RNA, 19 nt, Salmonella enterica enterica serovar Typhi Ty2
aucggccauauccagccag

SEQ ID NO: 1734684 - RNA, 14 nt, Salmonella enterica enterica serovar Typhi Ty2
aucggccagcgcca

SEQ ID NO: 1734685 - RNA, 16 nt, Salmonella enterica enterica serovar Typhi Ty2
aucggcaccuggagcg

SEQ ID NO: 1734686 - RNA, 20 nt, Salmonella enterica enterica serovar Typhi Ty2
aucggauuauuuucacgcca

SEQ ID NO: 1734687 - RNA, 17 nt, Salmonella enterica enterica serovar Typhi Ty2
aucuacgcuauuuccag

SEQ ID NO: 1734688 - RNA, 18 nt, Salmonella enterica enterica serovar Typhi Ty2
aucgugagcgcgucauca

SEQ ID NO: 1734689 - RNA, 17 nt, Salmonella enterica enterica serovar Typhi Ty2
aucgugaggauaaucca

SEQ ID NO: 1734690 - RNA, 17 nt, Salmonella enterica enterica serovar Typhi Ty2
aucguugccagcggcca

SEQ ID NO: 1734691 - RNA, 18 nt, Salmonella enterica enterica serovar Typhi Ty2
aucgugaccaccgccaua

SEQ ID NO: 1734692 - RNA, 22 nt, Salmonella enterica enterica serovar Typhi Ty2
aucgugacgcgaauuucaacgc

SEQ ID NO: 1734693 - RNA, 14 nt, Salmonella enterica enterica serovar Typhi Ty2
aucguugucgcaau

SEQ ID NO: 1734694 - RNA, 17 nt, Salmonella enterica enterica serovar Typhi Ty2
aucguuuucuaacgagg

SEQ ID NO: 1734695 - RNA, 22 nt, Salmonella enterica enterica serovar Typhi Ty2
aucguugccgccgucgccgaau

SEQ ID NO: 1734696 - RNA, 16 nt, Salmonella enterica enterica serovar Typhi Ty2
aucgucguugcugcaa

SEQ ID NO: 1734697 - RNA, 14 nt, Salmonella enterica enterica serovar Typhi Ty2
aucgucucccgaca

SEQ ID NO: 1734698 - RNA, 18 nt, Salmonella enterica enterica serovar Typhi Ty2
aucgguaguguuaucgcc

SEQ ID NO: 1734699 - RNA, 20 nt, Salmonella enterica enterica serovar Typhi Ty2
aucggguggccuaacgccag

SEQ ID NO: 1734700 - RNA, 23 nt, Salmonella enterica enterica serovar Typhi Ty2
aucgucaaaaccaaacagcgaca

SEQ ID NO: 1734701 - RNA, 17 nt, Salmonella enterica enterica serovar Typhi Ty2
aucgguaggccggauaa

SEQ ID NO: 1734702 - RNA, 22 nt, Salmonella enterica enterica serovar Typhi Ty2
aucuucauaaauagccagcauc

SEQ ID NO: 1734703 - RNA, 14 nt, Salmonella enterica enterica serovar Typhi Ty2
aucuucaucgucgc

SEQ ID NO: 1734704 - RNA, 13 nt, Salmonella enterica enterica serovar Typhi Ty2
aucuuccagcauc

SEQ ID NO: 1734705 - RNA, 19 nt, Salmonella enterica enterica serovar Typhi Ty2
aucuuccccgaacucgcga

SEQ ID NO: 1734706 - RNA, 18 nt, Salmonella enterica enterica serovar Typhi Ty2
aucuucgauaaacucaau

SEQ ID NO: 1734707 - RNA, 15 nt, Salmonella enterica enterica serovar Typhi Ty2
aucuucacuguuauc

SEQ ID NO: 1734708 - RNA, 18 nt, Salmonella enterica enterica serovar Typhi Ty2
aucuucaucaaccaugau

SEQ ID NO: 1734709 - RNA, 22 nt, Salmonella enterica enterica serovar Typhi Ty2
aucuguuccacagaucuaucug

SEQ ID NO: 1734710 - RNA, 14 nt, Salmonella enterica enterica serovar Typhi Ty2
aucuguuccagcga

SEQ ID NO: 1734711 - RNA, 21 nt, Salmonella enterica enterica serovar Typhi Ty2
aucuguaauugacgcgucagg

SEQ ID NO: 1734712 - RNA, 16 nt, Salmonella enterica enterica serovar Typhi Ty2
aucugcuccgccagca

SEQ ID NO: 1734713 - RNA, 13 nt, Salmonella enterica enterica serovar Typhi Ty2
aucugcuccgcgc

SEQ ID NO: 1734714 - RNA, 19 nt, Salmonella enterica enterica serovar Typhi Ty2
aucugcgucaguaccugau

SEQ ID NO: 1734715 - RNA, 22 nt, Salmonella enterica enterica serovar Typhi Ty2
aucugcgugaugcaucagaaca

SEQ ID NO: 1734716 - RNA, 22 nt, Salmonella enterica enterica serovar Typhi Ty2
aucuccgggaaaaacgugucca

SEQ ID NO: 1734717 - RNA, 18 nt, Salmonella enterica enterica serovar Typhi Ty2
aucuccucgcacuggcga

SEQ ID NO: 1734718 - RNA, 23 nt, Salmonella enterica enterica serovar Typhi Ty2
augaaucgcgugcgcugcggcca

SEQ ID NO: 1734719 - RNA, 19 nt, Salmonella enterica enterica serovar Typhi Ty2
augaaugccggauggcggc

SEQ ID NO: 1734720 - RNA, 17 nt, Salmonella enterica enterica serovar Typhi Ty2
augaaugacgagcaggu

SEQ ID NO: 1734721 - RNA, 18 nt, Salmonella enterica enterica serovar Typhi Ty2
aucuuucagcgccggaaa

SEQ ID NO: 1734722 - RNA, 17 nt, Salmonella enterica enterica serovar Typhi Ty2
augaccccuccggccag

SEQ ID NO: 1734723 - RNA, 22 nt, Salmonella enterica enterica serovar Typhi Ty2
augaccauuaacgccagcgauc

SEQ ID NO: 1734724 - RNA, 17 nt, Salmonella enterica enterica serovar Typhi Ty2
augacgguucaucgcag

SEQ ID NO: 1734725 - RNA, 18 nt, Salmonella enterica enterica serovar Typhi Ty2
augacgguauucccgguc

SEQ ID NO: 1734726 - RNA, 20 nt, Salmonella enterica enterica serovar Typhi Ty2
augaccggaacggacgugcg

SEQ ID NO: 1734727 - RNA, 16 nt, Salmonella enterica enterica serovar Typhi Ty2
augacggguaacgcca

SEQ ID NO: 1734728 - RNA, 18 nt, Salmonella enterica enterica serovar Typhi Ty2
augaccugaauauggcca

SEQ ID NO: 1734729 - RNA, 14 nt, Salmonella enterica enterica serovar Typhi Ty2
augauaaugccgcu

SEQ ID NO: 1734730 - RNA, 16 nt, Salmonella enterica enterica serovar Typhi Ty2
augauaagugauaccg

SEQ ID NO: 1734731 - RNA, 16 nt, Salmonella enterica enterica serovar Typhi Ty2
augaucagacgcacaa

SEQ ID NO: 1734732 - RNA, 23 nt, Salmonella enterica enterica serovar Typhi Ty2
augaucagcgacgguccuggcca

SEQ ID NO: 1734733 - RNA, 13 nt, Salmonella enterica enterica serovar Typhi Ty2
augaucgacaaug

SEQ ID NO: 1734734 - RNA, 15 nt, Salmonella enterica enterica serovar Typhi Ty2
caccgccaaacgcgg

SEQ ID NO: 1734735 - RNA, 15 nt, Salmonella enterica enterica serovar Typhi Ty2
caccgccagagcacg

SEQ ID NO: 1734736 - RNA, 20 nt, Salmonella enterica enterica serovar Typhi Ty2
cacccgggaaaaaugacgcc

SEQ ID NO: 1734737 - RNA, 14 nt, Salmonella enterica enterica serovar Typhi Ty2
cacccguagcccag

SEQ ID NO: 1734738 - RNA, 18 nt, Salmonella enterica enterica serovar Typhi Ty2
caccgcucguucgauagc

SEQ ID NO: 1734739 - RNA, 15 nt, Salmonella enterica enterica serovar Typhi Ty2
caccgggccaaugcc

SEQ ID NO: 1734740 - RNA, 14 nt, Salmonella enterica enterica serovar Typhi Ty2
caccaugcaaaaug

SEQ ID NO: 1734741 - RNA, 17 nt, Salmonella enterica enterica serovar Typhi Ty2
caccauaucgcagacca

SEQ ID NO: 1734742 - RNA, 18 nt, Salmonella enterica enterica serovar Typhi Ty2
caccauuaucgcuccgga

SEQ ID NO: 1734743 - RNA, 16 nt, Salmonella enterica enterica serovar Typhi Ty2
caccauaaaucauuac

SEQ ID NO: 1734744 - RNA, 20 nt, Salmonella enterica enterica serovar Typhi Ty2
caccauaauuaccggcacac

SEQ ID NO: 1734745 - RNA, 16 nt, Salmonella enterica enterica serovar Typhi Ty2
caccagcgaugcgcgc

SEQ ID NO: 1734746 - RNA, 12 nt, Salmonella enterica enterica serovar Typhi Ty2
caccagcgccag

SEQ ID NO: 1734747 - RNA, 13 nt, Salmonella enterica enterica serovar Typhi Ty2
caccagccgcauc

SEQ ID NO: 1734748 - RNA, 12 nt, Salmonella enterica enterica serovar Typhi Ty2
cacauaacugag

SEQ ID NO: 1734749 - RNA, 14 nt, Salmonella enterica enterica serovar Typhi Ty2
cacauaagccacuu

SEQ ID NO: 1734750 - RNA, 17 nt, Salmonella enterica enterica serovar Typhi Ty2
cacauaucgccagccau

SEQ ID NO: 1734751 - RNA, 14 nt, Salmonella enterica enterica serovar Typhi Ty2
cacauccaccccgg

SEQ ID NO: 1734752 - RNA, 15 nt, Salmonella enterica enterica serovar Typhi Ty2
cacauccgccagcgc

SEQ ID NO: 1734753 - RNA, 17 nt, Salmonella enterica enterica serovar Typhi Ty2
cacaggcgugguggaua

SEQ ID NO: 1734754 - RNA, 22 nt, Salmonella enterica enterica serovar Typhi Ty2
cacaaaucuguuaucuggaugu

SEQ ID NO: 1734755 - RNA, 16 nt, Salmonella enterica enterica serovar Typhi Ty2
cacagcccaguaauau

SEQ ID NO: 1734756 - RNA, 20 nt, Salmonella enterica enterica serovar Typhi Ty2
cacaaaaaaaccgcucaacu

SEQ ID NO: 1734757 - RNA, 16 nt, Salmonella enterica enterica serovar Typhi Ty2
cacaaacuccagacga

SEQ ID NO: 1734758 - RNA, 23 nt, Salmonella enterica enterica serovar Typhi Ty2
cacaaaaacacccgcagccgcaa

SEQ ID NO: 1734759 - RNA, 20 nt, Salmonella enterica enterica serovar Typhi Ty2
cacauucagagcguccacgc

SEQ ID NO: 1734760 - RNA, 19 nt, Salmonella enterica enterica serovar Typhi Ty2
cacauuggaaaaccccauc

SEQ ID NO: 1734761 - RNA, 19 nt, Salmonella enterica enterica serovar Typhi Ty2
cacauuucuuuugaucguc

SEQ ID NO: 1734762 - RNA, 15 nt, Salmonella enterica enterica serovar Typhi Ty2
cacauuuuuaucagg

SEQ ID NO: 1734763 - RNA, 22 nt, Salmonella enterica enterica serovar Typhi Ty2
caccacgcccggaucaaacaua

SEQ ID NO: 1734764 - RNA, 15 nt, Salmonella enterica enterica serovar Typhi Ty2
caaaugggaucuuca

SEQ ID NO: 1734765 - RNA, 21 nt, Salmonella enterica enterica serovar Typhi Ty2
caaagcguugcaaccccagac

SEQ ID NO: 1734766 - RNA, 20 nt, Salmonella enterica enterica serovar Typhi Ty2
caaagccgccauccggccug

SEQ ID NO: 1734767 - RNA, 17 nt, Salmonella enterica enterica serovar Typhi Ty2
caaaguuaaucagcgcc

SEQ ID NO: 1734768 - RNA, 22 nt, Salmonella enterica enterica serovar Typhi Ty2
caaauaagguggcuaacccgcu

SEQ ID NO: 1734769 - RNA, 20 nt, Salmonella enterica enterica serovar Typhi Ty2
auuuacgguuggccagcaug

SEQ ID NO: 1734770 - RNA, 20 nt, Salmonella enterica enterica serovar Typhi Ty2
auuuacggcgauuugccccg

SEQ ID NO: 1734771 - RNA, 15 nt, Salmonella enterica enterica serovar Typhi Ty2
auuuacugugaucca

SEQ ID NO: 1734772 - RNA, 16 nt, Salmonella enterica enterica serovar Typhi Ty2
caaagcccacgcccug

SEQ ID NO: 1734773 - RNA, 17 nt, Salmonella enterica enterica serovar Typhi Ty2
caacaguugcuggagca

SEQ ID NO: 1734774 - RNA, 16 nt, Salmonella enterica enterica serovar Typhi Ty2
caaccaaugcaacgcc

SEQ ID NO: 1734775 - RNA, 19 nt, Salmonella enterica enterica serovar Typhi Ty2
caaccagugcggcaaccac

SEQ ID NO: 1734776 - RNA, 23 nt, Salmonella enterica enterica serovar Typhi Ty2
caaccagcgcggccagaaugccc

SEQ ID NO: 1734777 - RNA, 16 nt, Salmonella enterica enterica serovar Typhi Ty2
caaccagccgaucauc

SEQ ID NO: 1734778 - RNA, 20 nt, Salmonella enterica enterica serovar Typhi Ty2
caaccuuugggcagauaucg

SEQ ID NO: 1734779 - RNA, 13 nt, Salmonella enterica enterica serovar Typhi Ty2
caacgcauccagc

SEQ ID NO: 1734780 - RNA, 15 nt, Salmonella enterica enterica serovar Typhi Ty2
caacgcauccagcgu

SEQ ID NO: 1734781 - RNA, 18 nt, Salmonella enterica enterica serovar Typhi Ty2
caacgccgccgacaugac

SEQ ID NO: 1734782 - RNA, 20 nt, Salmonella enterica enterica serovar Typhi Ty2
caacgccgcuuuaccgccuu

SEQ ID NO: 1734783 - RNA, 15 nt, Salmonella enterica enterica serovar Typhi Ty2
caacgccuccagcgg

SEQ ID NO: 1734784 - RNA, 17 nt, Salmonella enterica enterica serovar Typhi Ty2
caacgcgaccggauaac

SEQ ID NO: 1734785 - RNA, 17 nt, Salmonella enterica enterica serovar Typhi Ty2
caacgcucagaccgauc

SEQ ID NO: 1734786 - RNA, 14 nt, Salmonella enterica enterica serovar Typhi Ty2
caaccaugaucacc

SEQ ID NO: 1734787 - RNA, 15 nt, Salmonella enterica enterica serovar Typhi Ty2
caaccgcaccggauc

SEQ ID NO: 1734788 - RNA, 16 nt, Salmonella enterica enterica serovar Typhi Ty2
caaccgacgcgaauug

SEQ ID NO: 1734789 - RNA, 14 nt, Salmonella enterica enterica serovar Typhi Ty2
caaccggaugccga

SEQ ID NO: 1734790 - RNA, 18 nt, Salmonella enterica enterica serovar Typhi Ty2
caauaugcgucagcgcgg

SEQ ID NO: 1734791 - RNA, 22 nt, Salmonella enterica enterica serovar Typhi Ty2
caaucacgccgauaaugcguuu

SEQ ID NO: 1734792 - RNA, 19 nt, Salmonella enterica enterica serovar Typhi Ty2
caaucgacaaaacacggcu

SEQ ID NO: 1734793 - RNA, 17 nt, Salmonella enterica enterica serovar Typhi Ty2
caauauccgccccgcug

SEQ ID NO: 1734794 - RNA, 14 nt, Salmonella enterica enterica serovar Typhi Ty2
caauauaccgucag

SEQ ID NO: 1734795 - RNA, 23 nt, Salmonella enterica enterica serovar Typhi Ty2
caauaguuaauguugaaccguca

SEQ ID NO: 1734796 - RNA, 21 nt, Salmonella enterica enterica serovar Typhi Ty2
caauagaccugaaaucagccu

SEQ ID NO: 1734797 - RNA, 21 nt, Salmonella enterica enterica serovar Typhi Ty2
caauagcagcuucacgcgcug

SEQ ID NO: 1734798 - RNA, 23 nt, Salmonella enterica enterica serovar Typhi Ty2
caauggauuuauggcacaucagg

SEQ ID NO: 1734799 - RNA, 22 nt, Salmonella enterica enterica serovar Typhi Ty2
caaugcagggguguccagaugc

SEQ ID NO: 1734800 - RNA, 22 nt, Salmonella enterica enterica serovar Typhi Ty2
caaugauaacggcgccacgcgc

SEQ ID NO: 1734801 - RNA, 18 nt, Salmonella enterica enterica serovar Typhi Ty2
caaugauucaagcgggug

SEQ ID NO: 1734802 - RNA, 16 nt, Salmonella enterica enterica serovar Typhi Ty2
caaucucgccaaugcc

SEQ ID NO: 1734803 - RNA, 14 nt, Salmonella enterica enterica serovar Typhi Ty2
caaucguaugcgcc

SEQ ID NO: 1734804 - RNA, 18 nt, Salmonella enterica enterica serovar Typhi Ty2
caauuuuacagccucucu

SEQ ID NO: 1734805 - RNA, 16 nt, Salmonella enterica enterica serovar Typhi Ty2
caauuuuaauaacggc

SEQ ID NO: 1734806 - RNA, 16 nt, Salmonella enterica enterica serovar Typhi Ty2
caauuccugacugcgc

SEQ ID NO: 1734807 - RNA, 14 nt, Salmonella enterica enterica serovar Typhi Ty2
caauuccgccauaa

SEQ ID NO: 1734808 - RNA, 20 nt, Salmonella enterica enterica serovar Typhi Ty2
caauguucugggaauaggcc

SEQ ID NO: 1734809 - RNA, 13 nt, Salmonella enterica enterica serovar Typhi Ty2
caauguugucgca

SEQ ID NO: 1734810 - RNA, 20 nt, Salmonella enterica enterica serovar Typhi Ty2
caauggcgacgaucagcgcc

SEQ ID NO: 1734811 - RNA, 15 nt, Salmonella enterica enterica serovar Typhi Ty2
caauuauacgcuggu

SEQ ID NO: 1734812 - RNA, 18 nt, Salmonella enterica enterica serovar Typhi Ty2
caauuauacgcuggugca

SEQ ID NO: 1734813 - RNA, 20 nt, Salmonella enterica enterica serovar Typhi Ty2
caacguaaauuacuuaugau

SEQ ID NO: 1734814 - RNA, 23 nt, Salmonella enterica enterica serovar Typhi Ty2
caacggucuuugccgagucgauc

SEQ ID NO: 1734815 - RNA, 14 nt, Salmonella enterica enterica serovar Typhi Ty2
caacguucaugucg

SEQ ID NO: 1734816 - RNA, 17 nt, Salmonella enterica enterica serovar Typhi Ty2
caacgugugccaggaag

SEQ ID NO: 1734817 - RNA, 19 nt, Salmonella enterica enterica serovar Typhi Ty2
caacucuuuacccagcggg

SEQ ID NO: 1734818 - RNA, 15 nt, Salmonella enterica enterica serovar Typhi Ty2
caacguuucgcuauc

SEQ ID NO: 1734819 - RNA, 18 nt, Salmonella enterica enterica serovar Typhi Ty2
caacguuucuuucaucag

SEQ ID NO: 1734820 - RNA, 16 nt, Salmonella enterica enterica serovar Typhi Ty2
caacggcacaacggcc

SEQ ID NO: 1734821 - RNA, 15 nt, Salmonella enterica enterica serovar Typhi Ty2
caagccgccaacgcc

SEQ ID NO: 1734822 - RNA, 23 nt, Salmonella enterica enterica serovar Typhi Ty2
caagaccgggcugcacgccaucg

SEQ ID NO: 1734823 - RNA, 14 nt, Salmonella enterica enterica serovar Typhi Ty2
caagaucauccggg

SEQ ID NO: 1734824 - RNA, 14 nt, Salmonella enterica enterica serovar Typhi Ty2
ccaucucuuccgcg

SEQ ID NO: 1734825 - RNA, 22 nt, Salmonella enterica enterica serovar Typhi Ty2
ccaucuccugcgauagcugcug

SEQ ID NO: 1734826 - RNA, 17 nt, Salmonella enterica enterica serovar Typhi Ty2
ccaugaacaccucauau

SEQ ID NO: 1734827 - RNA, 15 nt, Salmonella enterica enterica serovar Typhi Ty2
ccaugaugagcgcca

SEQ ID NO: 1734828 - RNA, 18 nt, Salmonella enterica enterica serovar Typhi Ty2
ccaugaucgucaggcgcc

SEQ ID NO: 1734829 - RNA, 23 nt, Salmonella enterica enterica serovar Typhi Ty2
ccauggcaggcagcacaaucagc

SEQ ID NO: 1734830 - RNA, 18 nt, Salmonella enterica enterica serovar Typhi Ty2
ccauccggcaauuaaccg

SEQ ID NO: 1734831 - RNA, 18 nt, Salmonella enterica enterica serovar Typhi Ty2
ccauccgugcgaugagau

SEQ ID NO: 1734832 - RNA, 18 nt, Salmonella enterica enterica serovar Typhi Ty2
ccaucaggcuuugcgcca

SEQ ID NO: 1734833 - RNA, 23 nt, Salmonella enterica enterica serovar Typhi Ty2
ccaucgcguuguaaucgccugaa

SEQ ID NO: 1734834 - RNA, 23 nt, Salmonella enterica enterica serovar Typhi Ty2
ccaucggcaucggucucgcuaua

SEQ ID NO: 1734835 - RNA, 16 nt, Salmonella enterica enterica serovar Typhi Ty2
ccaucguaggcgcaaa

SEQ ID NO: 1734836 - RNA, 15 nt, Salmonella enterica enterica serovar Typhi Ty2
ccaucgucgccagac

SEQ ID NO: 1734837 - RNA, 16 nt, Salmonella enterica enterica serovar Typhi Ty2
ccaucggucgcgcgca

SEQ ID NO: 1734838 - RNA, 12 nt, Salmonella enterica enterica serovar Typhi Ty2
ccaucgccgcag

SEQ ID NO: 1734839 - RNA, 14 nt, Salmonella enterica enterica serovar Typhi Ty2
ccaucgccagauaa

SEQ ID NO: 1734840 - RNA, 13 nt, Salmonella enterica enterica serovar Typhi Ty2
cccagauuacugc

SEQ ID NO: 1734841 - RNA, 22 nt, Salmonella enterica enterica serovar Typhi Ty2
cccagcgccgagaaaaucagug

SEQ ID NO: 1734842 - RNA, 17 nt, Salmonella enterica enterica serovar Typhi Ty2
cccagcgcgauacgcag

SEQ ID NO: 1734843 - RNA, 22 nt, Salmonella enterica enterica serovar Typhi Ty2
cccaaucaggcuugagcgaugg

SEQ ID NO: 1734844 - RNA, 12 nt, Salmonella enterica enterica serovar Typhi Ty2
cccacuucgccg

SEQ ID NO: 1734845 - RNA, 18 nt, Salmonella enterica enterica serovar Typhi Ty2
cccacuuguagcgagcgc

SEQ ID NO: 1734846 - RNA, 14 nt, Salmonella enterica enterica serovar Typhi Ty2
cccacacaucacaa

SEQ ID NO: 1734847 - RNA, 18 nt, Salmonella enterica enterica serovar Typhi Ty2
cccacagucgucuggcgc

SEQ ID NO: 1734848 - RNA, 15 nt, Salmonella enterica enterica serovar Typhi Ty2
ccagggaaugccaua

SEQ ID NO: 1734849 - RNA, 15 nt, Salmonella enterica enterica serovar Typhi Ty2
ccaggcuucaucgga

SEQ ID NO: 1734850 - RNA, 14 nt, Salmonella enterica enterica serovar Typhi Ty2
ccaggcauugauaa

SEQ ID NO: 1734851 - RNA, 21 nt, Salmonella enterica enterica serovar Typhi Ty2
ccagcgcuaacggcgguacca

SEQ ID NO: 1734852 - RNA, 16 nt, Salmonella enterica enterica serovar Typhi Ty2
ccaggucugcgcguuu

SEQ ID NO: 1734853 - RNA, 21 nt, Salmonella enterica enterica serovar Typhi Ty2
ccaggucugcaccacgguguc

SEQ ID NO: 1734854 - RNA, 14 nt, Salmonella enterica enterica serovar Typhi Ty2
ccaguaaugccaua

SEQ ID NO: 1734855 - RNA, 23 nt, Salmonella enterica enterica serovar Typhi Ty2
ccaguaaucggcgcgaaacaggu

SEQ ID NO: 1734856 - RNA, 19 nt, Salmonella enterica enterica serovar Typhi Ty2
ccaguaaagacacgacgau

SEQ ID NO: 1734857 - RNA, 14 nt, Salmonella enterica enterica serovar Typhi Ty2
ccaguaacucaucg

SEQ ID NO: 1734858 - RNA, 22 nt, Salmonella enterica enterica serovar Typhi Ty2
ccauagcgggcagcauugacca

SEQ ID NO: 1734859 - RNA, 18 nt, Salmonella enterica enterica serovar Typhi Ty2
ccauagaaaucagcaggu

SEQ ID NO: 1734860 - RNA, 16 nt, Salmonella enterica enterica serovar Typhi Ty2
ccauacggaugccgau

SEQ ID NO: 1734861 - RNA, 20 nt, Salmonella enterica enterica serovar Typhi Ty2
ccaguuguuccgcgcugaug

SEQ ID NO: 1734862 - RNA, 13 nt, Salmonella enterica enterica serovar Typhi Ty2
ccauacagcccau

SEQ ID NO: 1734863 - RNA, 16 nt, Salmonella enterica enterica serovar Typhi Ty2
ccauaaagaagcgugc

SEQ ID NO: 1734864 - RNA, 15 nt, Salmonella enterica enterica serovar Typhi Ty2
ccaucaacagcguga

SEQ ID NO: 1734865 - RNA, 15 nt, Salmonella enterica enterica serovar Typhi Ty2
ccauauuuaugcagc

SEQ ID NO: 1734866 - RNA, 14 nt, Salmonella enterica enterica serovar Typhi Ty2
ccauauucacgcag

SEQ ID NO: 1734867 - RNA, 21 nt, Salmonella enterica enterica serovar Typhi Ty2
ccauaucgccgcugccgcuau

SEQ ID NO: 1734868 - RNA, 14 nt, Salmonella enterica enterica serovar Typhi Ty2
ccauaucgccgcca

SEQ ID NO: 1734869 - RNA, 17 nt, Salmonella enterica enterica serovar Typhi Ty2
ccaucaacaucaucgga

SEQ ID NO: 1734870 - RNA, 13 nt, Salmonella enterica enterica serovar Typhi Ty2
ccaucagcgccag

SEQ ID NO: 1734871 - RNA, 13 nt, Salmonella enterica enterica serovar Typhi Ty2
ccaguggcgaaac

SEQ ID NO: 1734872 - RNA, 21 nt, Salmonella enterica enterica serovar Typhi Ty2
ccaguucauaagucauccaga

SEQ ID NO: 1734873 - RNA, 14 nt, Salmonella enterica enterica serovar Typhi Ty2
ccaguucaaucagg

SEQ ID NO: 1734874 - RNA, 15 nt, Salmonella enterica enterica serovar Typhi Ty2
ccaguugauagcgau

SEQ ID NO: 1734875 - RNA, 18 nt, Salmonella enterica enterica serovar Typhi Ty2
ccaguugcgccagcguaa

SEQ ID NO: 1734876 - RNA, 15 nt, Salmonella enterica enterica serovar Typhi Ty2
ccagucguaauucag

SEQ ID NO: 1734877 - RNA, 13 nt, Salmonella enterica enterica serovar Typhi Ty2
ccccuccggccag

SEQ ID NO: 1734878 - RNA, 23 nt, Salmonella enterica enterica serovar Typhi Ty2
ccccucgacaggaguauagcggc

SEQ ID NO: 1734879 - RNA, 19 nt, Salmonella enterica enterica serovar Typhi Ty2
ccccucuuccaucagccag

SEQ ID NO: 1734880 - RNA, 20 nt, Salmonella enterica enterica serovar Typhi Ty2
ccccguugagaauggcggga

SEQ ID NO: 1734881 - RNA, 19 nt, Salmonella enterica enterica serovar Typhi Ty2
cccgacucugacgccggua

SEQ ID NO: 1734882 - RNA, 15 nt, Salmonella enterica enterica serovar Typhi Ty2
ccccaggccgguugu

SEQ ID NO: 1734883 - RNA, 15 nt, Salmonella enterica enterica serovar Typhi Ty2
ccccauacaguaguu

SEQ ID NO: 1734884 - RNA, 19 nt, Salmonella enterica enterica serovar Typhi Ty2
ccccgacauucccagucgu

SEQ ID NO: 1734885 - RNA, 13 nt, Salmonella enterica enterica serovar Typhi Ty2
cccgccgccugau

SEQ ID NO: 1734886 - RNA, 13 nt, Salmonella enterica enterica serovar Typhi Ty2
cccgccagcacca

SEQ ID NO: 1734887 - RNA, 17 nt, Salmonella enterica enterica serovar Typhi Ty2
cccgcaaaccaggucug

SEQ ID NO: 1734888 - RNA, 21 nt, Salmonella enterica enterica serovar Typhi Ty2
cccgcaaacuggccacagcaa

SEQ ID NO: 1734889 - RNA, 15 nt, Salmonella enterica enterica serovar Typhi Ty2
cccggcgaccgguga

SEQ ID NO: 1734890 - RNA, 17 nt, Salmonella enterica enterica serovar Typhi Ty2
cccggccacagcgccag

SEQ ID NO: 1734891 - RNA, 18 nt, Salmonella enterica enterica serovar Typhi Ty2
cccgguacacuucagcca

SEQ ID NO: 1734892 - RNA, 15 nt, Salmonella enterica enterica serovar Typhi Ty2
cccgguaaacgucga

SEQ ID NO: 1734893 - RNA, 13 nt, Salmonella enterica enterica serovar Typhi Ty2
cccugcggcugau

SEQ ID NO: 1734894 - RNA, 18 nt, Salmonella enterica enterica serovar Typhi Ty2
cccugcgguagcgccgau

SEQ ID NO: 1734895 - RNA, 21 nt, Salmonella enterica enterica serovar Typhi Ty2
cccugcgucgcguaccagcgc

SEQ ID NO: 1734896 - RNA, 19 nt, Salmonella enterica enterica serovar Typhi Ty2
cccugacaauacugcacgc

SEQ ID NO: 1734897 - RNA, 19 nt, Salmonella enterica enterica serovar Typhi Ty2
cccugaccuuccauccaca

SEQ ID NO: 1734898 - RNA, 19 nt, Salmonella enterica enterica serovar Typhi Ty2
cccugaugcguauccagcg

SEQ ID NO: 1734899 - RNA, 20 nt, Salmonella enterica enterica serovar Typhi Ty2
cccugaugcguauccagcgc

SEQ ID NO: 1734900 - RNA, 15 nt, Salmonella enterica enterica serovar Typhi Ty2
cccuguaggccugau

SEQ ID NO: 1734901 - RNA, 20 nt, Salmonella enterica enterica serovar Typhi Ty2
cccuuacgcuuuauucuguc

SEQ ID NO: 1734902 - RNA, 22 nt, Salmonella enterica enterica serovar Typhi Ty2
cccucuuccaucagccaggcgg

SEQ ID NO: 1734903 - RNA, 13 nt, Salmonella enterica enterica serovar Typhi Ty2
cccuaucccaauu

SEQ ID NO: 1734904 - RNA, 15 nt, Salmonella enterica enterica serovar Typhi Ty2
ccagcauuagcgcca

SEQ ID NO: 1734905 - RNA, 17 nt, Salmonella enterica enterica serovar Typhi Ty2
ccagcaugcccgccagc

SEQ ID NO: 1734906 - RNA, 15 nt, Salmonella enterica enterica serovar Typhi Ty2
ccagcaugcccgcca

SEQ ID NO: 1734907 - RNA, 19 nt, Salmonella enterica enterica serovar Typhi Ty2
ccagcaucggcagcgccag

SEQ ID NO: 1734908 - RNA, 14 nt, Salmonella enterica enterica serovar Typhi Ty2
aaauagcguccagc

SEQ ID NO: 1734909 - RNA, 22 nt, Salmonella enterica enterica serovar Typhi Ty2
aaauagccccggucaacgcgcc

SEQ ID NO: 1734910 - RNA, 16 nt, Salmonella enterica enterica serovar Typhi Ty2
aaauagccagcaucau

SEQ ID NO: 1734911 - RNA, 17 nt, Salmonella enterica enterica serovar Typhi Ty2
aaauaucaaauacgcua

SEQ ID NO: 1734912 - RNA, 13 nt, Salmonella enterica enterica serovar Typhi Ty2
ccagcagcagccg

SEQ ID NO: 1734913 - RNA, 13 nt, Salmonella enterica enterica serovar Typhi Ty2
ccagcgcggcaca

SEQ ID NO: 1734914 - RNA, 16 nt, Salmonella enterica enterica serovar Typhi Ty2
ccagcgcgcugagcgg

SEQ ID NO: 1734915 - RNA, 13 nt, Salmonella enterica enterica serovar Typhi Ty2
ccagcgcggccca

SEQ ID NO: 1734916 - RNA, 14 nt, Salmonella enterica enterica serovar Typhi Ty2
ccagcgcgauacgc

SEQ ID NO: 1734917 - RNA, 19 nt, Salmonella enterica enterica serovar Typhi Ty2
aaauauuucuuugucgcca

SEQ ID NO: 1734918 - RNA, 16 nt, Salmonella enterica enterica serovar Typhi Ty2
aaaucaaagaccuccg

SEQ ID NO: 1734919 - RNA, 12 nt, Salmonella enterica enterica serovar Typhi Ty2
ccagcgccggac

SEQ ID NO: 1734920 - RNA, 14 nt, Salmonella enterica enterica serovar Typhi Ty2
ccagcgccggauaa

SEQ ID NO: 1734921 - RNA, 15 nt, Salmonella enterica enterica serovar Typhi Ty2
ccagcgcauugacga

SEQ ID NO: 1734922 - RNA, 12 nt, Salmonella enterica enterica serovar Typhi Ty2
ccagcgccagaa

SEQ ID NO: 1734923 - RNA, 22 nt, Salmonella enterica enterica serovar Typhi Ty2
ccagcgaaaaccagcgccgcca

SEQ ID NO: 1734924 - RNA, 19 nt, Salmonella enterica enterica serovar Typhi Ty2
ccagcgauuacgccagaca

SEQ ID NO: 1734925 - RNA, 20 nt, Salmonella enterica enterica serovar Typhi Ty2
ccagccuaccugccgccaua

SEQ ID NO: 1734926 - RNA, 16 nt, Salmonella enterica enterica serovar Typhi Ty2
ccagccuaucgccaua

SEQ ID NO: 1734927 - RNA, 13 nt, Salmonella enterica enterica serovar Typhi Ty2
ccacgggcgccac

SEQ ID NO: 1734928 - RNA, 18 nt, Salmonella enterica enterica serovar Typhi Ty2
ccagaauagcgcagucaa

SEQ ID NO: 1734929 - RNA, 12 nt, Salmonella enterica enterica serovar Typhi Ty2
ccacuucagcag

SEQ ID NO: 1734930 - RNA, 18 nt, Salmonella enterica enterica serovar Typhi Ty2
ccacucacgcucgcggaa

SEQ ID NO: 1734931 - RNA, 12 nt, Salmonella enterica enterica serovar Typhi Ty2
ccacuagcgcuu

SEQ ID NO: 1734932 - RNA, 20 nt, Salmonella enterica enterica serovar Typhi Ty2
ccacugagcuucaccgccag

SEQ ID NO: 1734933 - RNA, 17 nt, Salmonella enterica enterica serovar Typhi Ty2
ccagauauugccgacca

SEQ ID NO: 1734934 - RNA, 12 nt, Salmonella enterica enterica serovar Typhi Ty2
ccagauaauagc

SEQ ID NO: 1734935 - RNA, 21 nt, Salmonella enterica enterica serovar Typhi Ty2
ccagauagcgcugcgccagau

SEQ ID NO: 1734936 - RNA, 18 nt, Salmonella enterica enterica serovar Typhi Ty2
ccagauaaauagcgcugg

SEQ ID NO: 1734937 - RNA, 16 nt, Salmonella enterica enterica serovar Typhi Ty2
ccagauaaagcagcga

SEQ ID NO: 1734938 - RNA, 23 nt, Salmonella enterica enterica serovar Typhi Ty2
ccagcaaguauuggcugccgaca

SEQ ID NO: 1734939 - RNA, 12 nt, Salmonella enterica enterica serovar Typhi Ty2
ccagcacauuac

SEQ ID NO: 1734940 - RNA, 15 nt, Salmonella enterica enterica serovar Typhi Ty2
ccagagcgcgcuggc

SEQ ID NO: 1734941 - RNA, 13 nt, Salmonella enterica enterica serovar Typhi Ty2
ccagaauccgcgc

SEQ ID NO: 1734942 - RNA, 23 nt, Salmonella enterica enterica serovar Typhi Ty2
ccagaaucaguaacacaaucagg

SEQ ID NO: 1734943 - RNA, 20 nt, Salmonella enterica enterica serovar Typhi Ty2
ccagacacggugugccgcca

SEQ ID NO: 1734944 - RNA, 20 nt, Salmonella enterica enterica serovar Typhi Ty2
ccagacacuggaaacagcca

SEQ ID NO: 1734945 - RNA, 13 nt, Salmonella enterica enterica serovar Typhi Ty2
ccagacaauccgc

SEQ ID NO: 1734946 - RNA, 21 nt, Salmonella enterica enterica serovar Typhi Ty2
ccagaccacuaacccggcgac

SEQ ID NO: 1734947 - RNA, 22 nt, Salmonella enterica enterica serovar Typhi Ty2
ccagacaucacguucgcgcaua

SEQ ID NO: 1734948 - RNA, 23 nt, Salmonella enterica enterica serovar Typhi Ty2
ccagaccccaguaauccggcaac

SEQ ID NO: 1734949 - RNA, 13 nt, Salmonella enterica enterica serovar Typhi Ty2
ccaccuucgcgga

SEQ ID NO: 1734950 - RNA, 15 nt, Salmonella enterica enterica serovar Typhi Ty2
ccacgacauccggaa

SEQ ID NO: 1734951 - RNA, 14 nt, Salmonella enterica enterica serovar Typhi Ty2
ccacgacauccgga

SEQ ID NO: 1734952 - RNA, 15 nt, Salmonella enterica enterica serovar Typhi Ty2
aaagugcugaacaau

SEQ ID NO: 1734953 - RNA, 13 nt, Salmonella enterica enterica serovar Typhi Ty2
aaauaaacagcgc

SEQ ID NO: 1734954 - RNA, 22 nt, Salmonella enterica enterica serovar Typhi Ty2
ccacgccuaaacugauagacaa

SEQ ID NO: 1734955 - RNA, 19 nt, Salmonella enterica enterica serovar Typhi Ty2
ccacgcgaugcaaccccug

SEQ ID NO: 1734956 - RNA, 17 nt, Salmonella enterica enterica serovar Typhi Ty2
ccacgccgcuaucgacc

SEQ ID NO: 1734957 - RNA, 18 nt, Salmonella enterica enterica serovar Typhi Ty2
ccacccagugccaccagc

SEQ ID NO: 1734958 - RNA, 12 nt, Salmonella enterica enterica serovar Typhi Ty2
ccaccagcguac

SEQ ID NO: 1734959 - RNA, 19 nt, Salmonella enterica enterica serovar Typhi Ty2
ccaccacccagugccacca

SEQ ID NO: 1734960 - RNA, 14 nt, Salmonella enterica enterica serovar Typhi Ty2
ccaccaccagcauc

SEQ ID NO: 1734961 - RNA, 15 nt, Salmonella enterica enterica serovar Typhi Ty2
ccacauuacgcccau

SEQ ID NO: 1734962 - RNA, 20 nt, Salmonella enterica enterica serovar Typhi Ty2
ccacaugaccagcgccgcga

SEQ ID NO: 1734963 - RNA, 20 nt, Salmonella enterica enterica serovar Typhi Ty2
ccaccagaaucgccagcauc

SEQ ID NO: 1734964 - RNA, 16 nt, Salmonella enterica enterica serovar Typhi Ty2
ccacaguuaacgccaa

SEQ ID NO: 1734965 - RNA, 20 nt, Salmonella enterica enterica serovar Typhi Ty2
ccacaguugcgacugauaac

SEQ ID NO: 1734966 - RNA, 13 nt, Salmonella enterica enterica serovar Typhi Ty2
ccacagcgguaua

SEQ ID NO: 1734967 - RNA, 20 nt, Salmonella enterica enterica serovar Typhi Ty2
ccacaauuguagcugcgcca

SEQ ID NO: 1734968 - RNA, 20 nt, Salmonella enterica enterica serovar Typhi Ty2
ccaauacccagcgccaacgc

SEQ ID NO: 1734969 - RNA, 17 nt, Salmonella enterica enterica serovar Typhi Ty2
ccaauacccagcgccaa

SEQ ID NO: 1734970 - RNA, 16 nt, Salmonella enterica enterica serovar Typhi Ty2
ccaauacccagcgcca

SEQ ID NO: 1734971 - RNA, 17 nt, Salmonella enterica enterica serovar Typhi Ty2
ccaauaccacaaccgga

SEQ ID NO: 1734972 - RNA, 15 nt, Salmonella enterica enterica serovar Typhi Ty2
ccaauaccggcguaa

SEQ ID NO: 1734973 - RNA, 16 nt, Salmonella enterica enterica serovar Typhi Ty2
ccaauaacguaaccgc

SEQ ID NO: 1734974 - RNA, 16 nt, Salmonella enterica enterica serovar Typhi Ty2
ccaagcgucagcaugg

SEQ ID NO: 1734975 - RNA, 19 nt, Salmonella enterica enterica serovar Typhi Ty2
ccaacaaggauauccgcca

SEQ ID NO: 1734976 - RNA, 16 nt, Salmonella enterica enterica serovar Typhi Ty2
ccaacaccagccgcau

SEQ ID NO: 1734977 - RNA, 14 nt, Salmonella enterica enterica serovar Typhi Ty2
ccaaaacgaacagg

SEQ ID NO: 1734978 - RNA, 17 nt, Salmonella enterica enterica serovar Typhi Ty2
ccaaaaauaacgcccug

SEQ ID NO: 1734979 - RNA, 15 nt, Salmonella enterica enterica serovar Typhi Ty2
cauuuuuucagccug

SEQ ID NO: 1734980 - RNA, 16 nt, Salmonella enterica enterica serovar Typhi Ty2
cauuuuuuucagccuu

SEQ ID NO: 1734981 - RNA, 15 nt, Salmonella enterica enterica serovar Typhi Ty2
cauuuccgcagccaa

SEQ ID NO: 1734982 - RNA, 14 nt, Salmonella enterica enterica serovar Typhi Ty2
cauuuccugcauua

SEQ ID NO: 1734983 - RNA, 16 nt, Salmonella enterica enterica serovar Typhi Ty2
cauuucgcccucgcca

SEQ ID NO: 1734984 - RNA, 21 nt, Salmonella enterica enterica serovar Typhi Ty2
cauuucgacgucaacgguaaa

SEQ ID NO: 1734985 - RNA, 14 nt, Salmonella enterica enterica serovar Typhi Ty2
cauuucuccugcau

SEQ ID NO: 1734986 - RNA, 13 nt, Salmonella enterica enterica serovar Typhi Ty2
cauuuagcgccug

SEQ ID NO: 1734987 - RNA, 14 nt, Salmonella enterica enterica serovar Typhi Ty2
cauuuaugccgcca

SEQ ID NO: 1734988 - RNA, 21 nt, Salmonella enterica enterica serovar Typhi Ty2
cauuucaagcaggcgaucggc

SEQ ID NO: 1734989 - RNA, 20 nt, Salmonella enterica enterica serovar Typhi Ty2
cauuuuguugcuccagcauc

SEQ ID NO: 1734990 - RNA, 21 nt, Salmonella enterica enterica serovar Typhi Ty2
cauuuguuccucgaaacgcug

SEQ ID NO: 1734991 - RNA, 22 nt, Salmonella enterica enterica serovar Typhi Ty2
cauuugucgcuguuaaucucau

SEQ ID NO: 1734992 - RNA, 13 nt, Salmonella enterica enterica serovar Typhi Ty2
cauuguuaaucca

SEQ ID NO: 1734993 - RNA, 20 nt, Salmonella enterica enterica serovar Typhi Ty2
cauugugccugauggcgcua

SEQ ID NO: 1734994 - RNA, 17 nt, Salmonella enterica enterica serovar Typhi Ty2
cauugucggaacgcugu

SEQ ID NO: 1734995 - RNA, 22 nt, Salmonella enterica enterica serovar Typhi Ty2
cauugcuguuaauuucccgcug

SEQ ID NO: 1734996 - RNA, 16 nt, Salmonella enterica enterica serovar Typhi Ty2
cauugcugucgacaau

SEQ ID NO: 1734997 - RNA, 18 nt, Salmonella enterica enterica serovar Typhi Ty2
cauugcguaaugagcguc

SEQ ID NO: 1734998 - RNA, 21 nt, Salmonella enterica enterica serovar Typhi Ty2
cauugcggaucuucaccacgc

SEQ ID NO: 1734999 - RNA, 17 nt, Salmonella enterica enterica serovar Typhi Ty2
cauugccuuucgcgcga

SEQ ID NO: 1735000 - RNA, 19 nt, Salmonella enterica enterica serovar Typhi Ty2
cauugccuguaucgcuauc

SEQ ID NO: 1735001 - RNA, 15 nt, Salmonella enterica enterica serovar Typhi Ty2
cauugccuuccaggc

SEQ ID NO: 1735002 - RNA, 15 nt, Salmonella enterica enterica serovar Typhi Ty2
cauugcugucgacaa

SEQ ID NO: 1735003 - RNA, 17 nt, Salmonella enterica enterica serovar Typhi Ty2
cauggcagccccggcau

SEQ ID NO: 1735004 - RNA, 19 nt, Salmonella enterica enterica serovar Typhi Ty2
caugggacgggucuccauc

SEQ ID NO: 1735005 - RNA, 15 nt, Salmonella enterica enterica serovar Typhi Ty2
cauggugaugaucgc

SEQ ID NO: 1735006 - RNA, 16 nt, Salmonella enterica enterica serovar Typhi Ty2
caugguuccgccguua

SEQ ID NO: 1735007 - RNA, 15 nt, Salmonella enterica enterica serovar Typhi Ty2
caugcggcgccauca

SEQ ID NO: 1735008 - RNA, 18 nt, Salmonella enterica enterica serovar Typhi Ty2
caugcugaugacuaaugg

SEQ ID NO: 1735009 - RNA, 20 nt, Salmonella enterica enterica serovar Typhi Ty2
cauggauagucaugaaaucu

SEQ ID NO: 1735010 - RNA, 15 nt, Salmonella enterica enterica serovar Typhi Ty2
cauggagauccagua

SEQ ID NO: 1735011 - RNA, 20 nt, Salmonella enterica enterica serovar Typhi Ty2
caugcgcuggacugggucga

SEQ ID NO: 1735012 - RNA, 16 nt, Salmonella enterica enterica serovar Typhi Ty2
caucgccgcccagugg

SEQ ID NO: 1735013 - RNA, 16 nt, Salmonella enterica enterica serovar Typhi Ty2
caucgccgcgaauaaa

SEQ ID NO: 1735014 - RNA, 18 nt, Salmonella enterica enterica serovar Typhi Ty2
caucgccgcaagcggcaa

SEQ ID NO: 1735015 - RNA, 22 nt, Salmonella enterica enterica serovar Typhi Ty2
cauugaccaccauauucgccac

SEQ ID NO: 1735016 - RNA, 13 nt, Salmonella enterica enterica serovar Typhi Ty2
cauucuugccgca

SEQ ID NO: 1735017 - RNA, 15 nt, Salmonella enterica enterica serovar Typhi Ty2
cauugaacgcgcgcu

SEQ ID NO: 1735018 - RNA, 17 nt, Salmonella enterica enterica serovar Typhi Ty2
cauucggcguaucggaa

SEQ ID NO: 1735019 - RNA, 14 nt, Salmonella enterica enterica serovar Typhi Ty2
cauugccgcgccga

SEQ ID NO: 1735020 - RNA, 23 nt, Salmonella enterica enterica serovar Typhi Ty2
cauugccauguuaauaccagcgc

SEQ ID NO: 1735021 - RNA, 23 nt, Salmonella enterica enterica serovar Typhi Ty2
cauugcauagaucuuugggccgg

SEQ ID NO: 1735022 - RNA, 17 nt, Salmonella enterica enterica serovar Typhi Ty2
cauugcaauaccggcug

SEQ ID NO: 1735023 - RNA, 16 nt, Salmonella enterica enterica serovar Typhi Ty2
cauucgccccagcaua

SEQ ID NO: 1735024 - RNA, 15 nt, Salmonella enterica enterica serovar Typhi Ty2
cauucgccagcggau

SEQ ID NO: 1735025 - RNA, 20 nt, Salmonella enterica enterica serovar Typhi Ty2
cauuccaggugucacucauc

SEQ ID NO: 1735026 - RNA, 21 nt, Salmonella enterica enterica serovar Typhi Ty2
cauuauugcgaaauagcgcgg

SEQ ID NO: 1735027 - RNA, 16 nt, Salmonella enterica enterica serovar Typhi Ty2
cauuauuuggauuacg

SEQ ID NO: 1735028 - RNA, 15 nt, Salmonella enterica enterica serovar Typhi Ty2
cauuagcaauugcca

SEQ ID NO: 1735029 - RNA, 13 nt, Salmonella enterica enterica serovar Typhi Ty2
cauucagagcguc

SEQ ID NO: 1735030 - RNA, 16 nt, Salmonella enterica enterica serovar Typhi Ty2
cauguccagaucuuca

SEQ ID NO: 1735031 - RNA, 15 nt, Salmonella enterica enterica serovar Typhi Ty2
cauuauaagcgccaa

SEQ ID NO: 1735032 - RNA, 12 nt, Salmonella enterica enterica serovar Typhi Ty2
cauuacgcuggc

SEQ ID NO: 1735033 - RNA, 13 nt, Salmonella enterica enterica serovar Typhi Ty2
cauuaauaccauc

SEQ ID NO: 1735034 - RNA, 23 nt, Salmonella enterica enterica serovar Typhi Ty2
cauuacccggccaggcgugauug

SEQ ID NO: 1735035 - RNA, 14 nt, Salmonella enterica enterica serovar Typhi Ty2
cauguugccaugau

SEQ ID NO: 1735036 - RNA, 15 nt, Salmonella enterica enterica serovar Typhi Ty2
cauguucgaacaugc

SEQ ID NO: 1735037 - RNA, 20 nt, Salmonella enterica enterica serovar Typhi Ty2
cagucgcuauggugcggggu

SEQ ID NO: 1735038 - RNA, 13 nt, Salmonella enterica enterica serovar Typhi Ty2
caguaccagcgag

SEQ ID NO: 1735039 - RNA, 20 nt, Salmonella enterica enterica serovar Typhi Ty2
caguccgguauaaaacguca

SEQ ID NO: 1735040 - RNA, 17 nt, Salmonella enterica enterica serovar Typhi Ty2
caguaauccggcaacug

SEQ ID NO: 1735041 - RNA, 14 nt, Salmonella enterica enterica serovar Typhi Ty2
caguacagcagcga

SEQ ID NO: 1735042 - RNA, 16 nt, Salmonella enterica enterica serovar Typhi Ty2
caguaaauuaaacagc

SEQ ID NO: 1735043 - RNA, 22 nt, Salmonella enterica enterica serovar Typhi Ty2
caguggccagaaugaucgcauc

SEQ ID NO: 1735044 - RNA, 22 nt, Salmonella enterica enterica serovar Typhi Ty2
caguucgccuucuucaucuuca

SEQ ID NO: 1735045 - RNA, 17 nt, Salmonella enterica enterica serovar Typhi Ty2
caguucgccuucuucau

SEQ ID NO: 1735046 - RNA, 14 nt, Salmonella enterica enterica serovar Typhi Ty2
caguucucaaucgc

SEQ ID NO: 1735047 - RNA, 14 nt, Salmonella enterica enterica serovar Typhi Ty2
caguugaugaugcc

SEQ ID NO: 1735048 - RNA, 20 nt, Salmonella enterica enterica serovar Typhi Ty2
caggucgccagaagccgucg

SEQ ID NO: 1735049 - RNA, 20 nt, Salmonella enterica enterica serovar Typhi Ty2
caggucgccagcgggauaaa

SEQ ID NO: 1735050 - RNA, 18 nt, Salmonella enterica enterica serovar Typhi Ty2
caggugccgacucgcgca

SEQ ID NO: 1735051 - RNA, 18 nt, Salmonella enterica enterica serovar Typhi Ty2
cagguguacuguuccgga

SEQ ID NO: 1735052 - RNA, 23 nt, Salmonella enterica enterica serovar Typhi Ty2
cagguauuaaauacagagucgcu

SEQ ID NO: 1735053 - RNA, 21 nt, Salmonella enterica enterica serovar Typhi Ty2
caggucauucaggacgguggu

SEQ ID NO: 1735054 - RNA, 16 nt, Salmonella enterica enterica serovar Typhi Ty2
caggguuuuacgcugg

SEQ ID NO: 1735055 - RNA, 14 nt, Salmonella enterica enterica serovar Typhi Ty2
caggguugcguucg

SEQ ID NO: 1735056 - RNA, 22 nt, Salmonella enterica enterica serovar Typhi Ty2
caucaaacgcagcaaacgccau

SEQ ID NO: 1735057 - RNA, 14 nt, Salmonella enterica enterica serovar Typhi Ty2
cauauagccgcgca

SEQ ID NO: 1735058 - RNA, 20 nt, Salmonella enterica enterica serovar Typhi Ty2
cauaucaauauguuccggcg

SEQ ID NO: 1735059 - RNA, 22 nt, Salmonella enterica enterica serovar Typhi Ty2
cauaucaauauguuccggcguc

SEQ ID NO: 1735060 - RNA, 13 nt, Salmonella enterica enterica serovar Typhi Ty2
cauagcuaccgcg

SEQ ID NO: 1735061 - RNA, 16 nt, Salmonella enterica enterica serovar Typhi Ty2
cauagcuaccgcgcga

SEQ ID NO: 1735062 - RNA, 17 nt, Salmonella enterica enterica serovar Typhi Ty2
cauagcguugauaugcu

SEQ ID NO: 1735063 - RNA, 21 nt, Salmonella enterica enterica serovar Typhi Ty2
cauagcuguuccgcaacacgg

SEQ ID NO: 1735064 - RNA, 17 nt, Salmonella enterica enterica serovar Typhi Ty2
cauaccccacgccauaa

SEQ ID NO: 1735065 - RNA, 23 nt, Salmonella enterica enterica serovar Typhi Ty2
cauagccuuugucgaaauugccg

SEQ ID NO: 1735066 - RNA, 22 nt, Salmonella enterica enterica serovar Typhi Ty2
cauaggcgacaggcgugauagc

SEQ ID NO: 1735067 - RNA, 19 nt, Salmonella enterica enterica serovar Typhi Ty2
cauaguuugcauaaccggu

SEQ ID NO: 1735068 - RNA, 15 nt, Salmonella enterica enterica serovar Typhi Ty2
cauaguuugcauaac

SEQ ID NO: 1735069 - RNA, 23 nt, Salmonella enterica enterica serovar Typhi Ty2
caguuuagcuaaaucacgcaggu

SEQ ID NO: 1735070 - RNA, 22 nt, Salmonella enterica enterica serovar Typhi Ty2
cauaaucugugauugaauucac

SEQ ID NO: 1735071 - RNA, 17 nt, Salmonella enterica enterica serovar Typhi Ty2
cauaaucaguacugcgc

SEQ ID NO: 1735072 - RNA, 15 nt, Salmonella enterica enterica serovar Typhi Ty2
cauaccagcgaaaug

SEQ ID NO: 1735073 - RNA, 22 nt, Salmonella enterica enterica serovar Typhi Ty2
cauaccacaacagaaucgcgau

SEQ ID NO: 1735074 - RNA, 16 nt, Salmonella enterica enterica serovar Typhi Ty2
cauaaauaacauuuca

SEQ ID NO: 1735075 - RNA, 20 nt, Salmonella enterica enterica serovar Typhi Ty2
cauaaaauccugguaacggc

SEQ ID NO: 1735076 - RNA, 21 nt, Salmonella enterica enterica serovar Typhi Ty2
caucgauuuuagcgcaucgcu

SEQ ID NO: 1735077 - RNA, 17 nt, Salmonella enterica enterica serovar Typhi Ty2
cauccugcgggaugcgu

SEQ ID NO: 1735078 - RNA, 23 nt, Salmonella enterica enterica serovar Typhi Ty2
cauccgcgcaauaugcggcgcca

SEQ ID NO: 1735079 - RNA, 18 nt, Salmonella enterica enterica serovar Typhi Ty2
cauccgcguaaucgcgaa

SEQ ID NO: 1735080 - RNA, 18 nt, Salmonella enterica enterica serovar Typhi Ty2
cauccugauuuuacugac

SEQ ID NO: 1735081 - RNA, 15 nt, Salmonella enterica enterica serovar Typhi Ty2
cauccugccgcacca

SEQ ID NO: 1735082 - RNA, 15 nt, Salmonella enterica enterica serovar Typhi Ty2
cauccugcgcacagc

SEQ ID NO: 1735083 - RNA, 14 nt, Salmonella enterica enterica serovar Typhi Ty2
cauccugacaggcc

SEQ ID NO: 1735084 - RNA, 13 nt, Salmonella enterica enterica serovar Typhi Ty2
caucagucucaaa

SEQ ID NO: 1735085 - RNA, 21 nt, Salmonella enterica enterica serovar Typhi Ty2
caucauuacaggcgaauagcg

SEQ ID NO: 1735086 - RNA, 13 nt, Salmonella enterica enterica serovar Typhi Ty2
caucauccgcgcu

SEQ ID NO: 1735087 - RNA, 12 nt, Salmonella enterica enterica serovar Typhi Ty2
caucccggcaac

SEQ ID NO: 1735088 - RNA, 13 nt, Salmonella enterica enterica serovar Typhi Ty2
caucccauccggg

SEQ ID NO: 1735089 - RNA, 14 nt, Salmonella enterica enterica serovar Typhi Ty2
cauccagcgaaccu

SEQ ID NO: 1735090 - RNA, 12 nt, Salmonella enterica enterica serovar Typhi Ty2
cauccagcgcaa

SEQ ID NO: 1735091 - RNA, 21 nt, Salmonella enterica enterica serovar Typhi Ty2
cauccacuuuucgcggauaac

SEQ ID NO: 1735092 - RNA, 18 nt, Salmonella enterica enterica serovar Typhi Ty2
caucauugacuucaacgc

SEQ ID NO: 1735093 - RNA, 23 nt, Salmonella enterica enterica serovar Typhi Ty2
caucauugauacuguacgcccag

SEQ ID NO: 1735094 - RNA, 19 nt, Salmonella enterica enterica serovar Typhi Ty2
caucauuaccuuuuccggc

SEQ ID NO: 1735095 - RNA, 20 nt, Salmonella enterica enterica serovar Typhi Ty2
cauccaccgcccgcguauug

SEQ ID NO: 1735096 - RNA, 18 nt, Salmonella enterica enterica serovar Typhi Ty2
cagcguauuaagccaacg

SEQ ID NO: 1735097 - RNA, 13 nt, Salmonella enterica enterica serovar Typhi Ty2
cagcgucccggcg

SEQ ID NO: 1735098 - RNA, 14 nt, Salmonella enterica enterica serovar Typhi Ty2
cagcguccggaaaa

SEQ ID NO: 1735099 - RNA, 14 nt, Salmonella enterica enterica serovar Typhi Ty2
cagcguccggagca

SEQ ID NO: 1735100 - RNA, 17 nt, Salmonella enterica enterica serovar Typhi Ty2
cagcgucacaggcuucg

SEQ ID NO: 1735101 - RNA, 11 nt, Salmonella enterica enterica serovar Typhi Ty2
cagcggcguug

SEQ ID NO: 1735102 - RNA, 18 nt, Salmonella enterica enterica serovar Typhi Ty2
cagcggcgguuauccgcc

SEQ ID NO: 1735103 - RNA, 21 nt, Salmonella enterica enterica serovar Typhi Ty2
cagcggcguaucuuccagcgu

SEQ ID NO: 1735104 - RNA, 16 nt, Salmonella enterica enterica serovar Typhi Ty2
cagcgccggcagcagu

SEQ ID NO: 1735105 - RNA, 17 nt, Salmonella enterica enterica serovar Typhi Ty2
cagcgugaagcugccgu

SEQ ID NO: 1735106 - RNA, 22 nt, Salmonella enterica enterica serovar Typhi Ty2
cagcuauuagcguuuuuaccgg

SEQ ID NO: 1735107 - RNA, 21 nt, Salmonella enterica enterica serovar Typhi Ty2
cagcucaacgccuuugcaauc

SEQ ID NO: 1735108 - RNA, 18 nt, Salmonella enterica enterica serovar Typhi Ty2
cagcguuuaacugaacau

SEQ ID NO: 1735109 - RNA, 17 nt, Salmonella enterica enterica serovar Typhi Ty2
cagcucaucgaaccuau

SEQ ID NO: 1735110 - RNA, 17 nt, Salmonella enterica enterica serovar Typhi Ty2
cagcuggaaugcccacu

SEQ ID NO: 1735111 - RNA, 18 nt, Salmonella enterica enterica serovar Typhi Ty2
cagcugggccugcuccgu

SEQ ID NO: 1735112 - RNA, 19 nt, Salmonella enterica enterica serovar Typhi Ty2
cagcuucaggcucaucagc

SEQ ID NO: 1735113 - RNA, 16 nt, Salmonella enterica enterica serovar Typhi Ty2
cagcuuauucgucguu

SEQ ID NO: 1735114 - RNA, 20 nt, Salmonella enterica enterica serovar Typhi Ty2
cagcuuaucuuuacgcuugu

SEQ ID NO: 1735115 - RNA, 16 nt, Salmonella enterica enterica serovar Typhi Ty2
cagcuguuuaagcgcc

SEQ ID NO: 1735116 - RNA, 15 nt, Salmonella enterica enterica serovar Typhi Ty2
cagcuuacgcgcaga

SEQ ID NO: 1735117 - RNA, 18 nt, Salmonella enterica enterica serovar Typhi Ty2
cagcuugaucaucagggc

SEQ ID NO: 1735118 - RNA, 17 nt, Salmonella enterica enterica serovar Typhi Ty2
cagcuugcuggccgcgu

SEQ ID NO: 1735119 - RNA, 20 nt, Salmonella enterica enterica serovar Typhi Ty2
caggcgugccccgcaacgcc

SEQ ID NO: 1735120 - RNA, 13 nt, Salmonella enterica enterica serovar Typhi Ty2
cagggaaucagcg

SEQ ID NO: 1735121 - RNA, 17 nt, Salmonella enterica enterica serovar Typhi Ty2
caggccugguuaacaau

SEQ ID NO: 1735122 - RNA, 15 nt, Salmonella enterica enterica serovar Typhi Ty2
caggccugcggaaaa

SEQ ID NO: 1735123 - RNA, 15 nt, Salmonella enterica enterica serovar Typhi Ty2
caggcgagacgcgcc

SEQ ID NO: 1735124 - RNA, 19 nt, Salmonella enterica enterica serovar Typhi Ty2
caggccaacguaguuauug

SEQ ID NO: 1735125 - RNA, 18 nt, Salmonella enterica enterica serovar Typhi Ty2
caggcaucuuccagcguc

SEQ ID NO: 1735126 - RNA, 15 nt, Salmonella enterica enterica serovar Typhi Ty2
caggcauggcagcag

SEQ ID NO: 1735127 - RNA, 18 nt, Salmonella enterica enterica serovar Typhi Ty2
caggcaccauccgguaaa

SEQ ID NO: 1735128 - RNA, 16 nt, Salmonella enterica enterica serovar Typhi Ty2
aaagcacuccccggcu

SEQ ID NO: 1735129 - RNA, 23 nt, Salmonella enterica enterica serovar Typhi Ty2
aaagcagcagugaggauaaggca

SEQ ID NO: 1735130 - RNA, 17 nt, Salmonella enterica enterica serovar Typhi Ty2
aaagcacuucucgcgca

SEQ ID NO: 1735131 - RNA, 14 nt, Salmonella enterica enterica serovar Typhi Ty2
aaagccaggccgcc

SEQ ID NO: 1735132 - RNA, 21 nt, Salmonella enterica enterica serovar Typhi Ty2
aaagcccagcacggcaagcgc

SEQ ID NO: 1735133 - RNA, 12 nt, Salmonella enterica enterica serovar Typhi Ty2
aaagccccggcu

SEQ ID NO: 1735134 - RNA, 20 nt, Salmonella enterica enterica serovar Typhi Ty2
caggaaggcgugcagcgugc

SEQ ID NO: 1735135 - RNA, 16 nt, Salmonella enterica enterica serovar Typhi Ty2
caggaagccgguguac

SEQ ID NO: 1735136 - RNA, 18 nt, Salmonella enterica enterica serovar Typhi Ty2
caggaacgcggcgccgaa

SEQ ID NO: 1735137 - RNA, 21 nt, Salmonella enterica enterica serovar Typhi Ty2
cagcuuguagaaaggcagcga

SEQ ID NO: 1735138 - RNA, 20 nt, Salmonella enterica enterica serovar Typhi Ty2
caggacauggucaccaugac

SEQ ID NO: 1735139 - RNA, 17 nt, Salmonella enterica enterica serovar Typhi Ty2
cagcgacgccagauuau

SEQ ID NO: 1735140 - RNA, 15 nt, Salmonella enterica enterica serovar Typhi Ty2
cagcgaaaugacggc

SEQ ID NO: 1735141 - RNA, 13 nt, Salmonella enterica enterica serovar Typhi Ty2
cagccuaccgcuu

SEQ ID NO: 1735142 - RNA, 23 nt, Salmonella enterica enterica serovar Typhi Ty2
cagccugcuggucugaaucugcu

SEQ ID NO: 1735143 - RNA, 14 nt, Salmonella enterica enterica serovar Typhi Ty2
cagcgaugcgcgcg

SEQ ID NO: 1735144 - RNA, 17 nt, Salmonella enterica enterica serovar Typhi Ty2
cagcgauuacgccagac

SEQ ID NO: 1735145 - RNA, 16 nt, Salmonella enterica enterica serovar Typhi Ty2
cagcgauccugcggca

SEQ ID NO: 1735146 - RNA, 12 nt, Salmonella enterica enterica serovar Typhi Ty2
cagcgcaacgcg

SEQ ID NO: 1735147 - RNA, 16 nt, Salmonella enterica enterica serovar Typhi Ty2
cagcgcauaccggcca

SEQ ID NO: 1735148 - RNA, 20 nt, Salmonella enterica enterica serovar Typhi Ty2
cagcgcauacuuauacagcg

SEQ ID NO: 1735149 - RNA, 17 nt, Salmonella enterica enterica serovar Typhi Ty2
cagcgcaacgcgcauca

SEQ ID NO: 1735150 - RNA, 17 nt, Salmonella enterica enterica serovar Typhi Ty2
cagcgauuuuuacgcca

SEQ ID NO: 1735151 - RNA, 21 nt, Salmonella enterica enterica serovar Typhi Ty2
cagcgccauuaacgccaugac

SEQ ID NO: 1735152 - RNA, 17 nt, Salmonella enterica enterica serovar Typhi Ty2
cagcgccauccggcaaa

SEQ ID NO: 1735153 - RNA, 14 nt, Salmonella enterica enterica serovar Typhi Ty2
cagcgccauccggc

SEQ ID NO: 1735154 - RNA, 18 nt, Salmonella enterica enterica serovar Typhi Ty2
cagcgccaucaggcaaug

SEQ ID NO: 1735155 - RNA, 16 nt, Salmonella enterica enterica serovar Typhi Ty2
cagcgccaucaggcau

SEQ ID NO: 1735156 - RNA, 13 nt, Salmonella enterica enterica serovar Typhi Ty2
cagcgccgccugu

SEQ ID NO: 1735157 - RNA, 13 nt, Salmonella enterica enterica serovar Typhi Ty2
cagcgccgcgcga

SEQ ID NO: 1735158 - RNA, 13 nt, Salmonella enterica enterica serovar Typhi Ty2
cagcgccgccaga

SEQ ID NO: 1735159 - RNA, 20 nt, Salmonella enterica enterica serovar Typhi Ty2
cagccgacuauuccgcaaac

SEQ ID NO: 1735160 - RNA, 20 nt, Salmonella enterica enterica serovar Typhi Ty2
cagccgagacuaucgauagc

SEQ ID NO: 1735161 - RNA, 14 nt, Salmonella enterica enterica serovar Typhi Ty2
cagccgaucaggcc

SEQ ID NO: 1735162 - RNA, 22 nt, Salmonella enterica enterica serovar Typhi Ty2
cagccgauagcaccucgcaaua

SEQ ID NO: 1735163 - RNA, 13 nt, Salmonella enterica enterica serovar Typhi Ty2
cagccgcccgcga

SEQ ID NO: 1735164 - RNA, 15 nt, Salmonella enterica enterica serovar Typhi Ty2
cagccauaaauauug

SEQ ID NO: 1735165 - RNA, 17 nt, Salmonella enterica enterica serovar Typhi Ty2
cagccauucaccacugg

SEQ ID NO: 1735166 - RNA, 20 nt, Salmonella enterica enterica serovar Typhi Ty2
cagccauguagaauagcgcc

SEQ ID NO: 1735167 - RNA, 18 nt, Salmonella enterica enterica serovar Typhi Ty2
cagccauucggcugccuu

SEQ ID NO: 1735168 - RNA, 22 nt, Salmonella enterica enterica serovar Typhi Ty2
cagcccaugaaggagcaaugag

SEQ ID NO: 1735169 - RNA, 16 nt, Salmonella enterica enterica serovar Typhi Ty2
cagccccaccgccaga

SEQ ID NO: 1735170 - RNA, 17 nt, Salmonella enterica enterica serovar Typhi Ty2
cagcacgguaaaccucu

SEQ ID NO: 1735171 - RNA, 13 nt, Salmonella enterica enterica serovar Typhi Ty2
cagcaccagcauu

SEQ ID NO: 1735172 - RNA, 12 nt, Salmonella enterica enterica serovar Typhi Ty2
cagcaccaggau

SEQ ID NO: 1735173 - RNA, 18 nt, Salmonella enterica enterica serovar Typhi Ty2
cagauagcccgccagcac

SEQ ID NO: 1735174 - RNA, 13 nt, Salmonella enterica enterica serovar Typhi Ty2
cagauagcgcugc

SEQ ID NO: 1735175 - RNA, 14 nt, Salmonella enterica enterica serovar Typhi Ty2
cagauaauccagcg

SEQ ID NO: 1735176 - RNA, 16 nt, Salmonella enterica enterica serovar Typhi Ty2
cagauaauccagcguc

SEQ ID NO: 1735177 - RNA, 17 nt, Salmonella enterica enterica serovar Typhi Ty2
cagauacggcgcgucgg

SEQ ID NO: 1735178 - RNA, 18 nt, Salmonella enterica enterica serovar Typhi Ty2
cagccaggccgccagcgu

SEQ ID NO: 1735179 - RNA, 12 nt, Salmonella enterica enterica serovar Typhi Ty2
cagccaggaaug

SEQ ID NO: 1735180 - RNA, 11 nt, Salmonella enterica enterica serovar Typhi Ty2
cagccagcggg

SEQ ID NO: 1735181 - RNA, 14 nt, Salmonella enterica enterica serovar Typhi Ty2
cagccagccgccaa

SEQ ID NO: 1735182 - RNA, 20 nt, Salmonella enterica enterica serovar Typhi Ty2
cagccacuucuuccagcggc

SEQ ID NO: 1735183 - RNA, 17 nt, Salmonella enterica enterica serovar Typhi Ty2
cagccagcagcucaacg

SEQ ID NO: 1735184 - RNA, 15 nt, Salmonella enterica enterica serovar Typhi Ty2
cagccacacugcugu

SEQ ID NO: 1735185 - RNA, 22 nt, Salmonella enterica enterica serovar Typhi Ty2
cagccaaucauaaacgccugac

SEQ ID NO: 1735186 - RNA, 16 nt, Salmonella enterica enterica serovar Typhi Ty2
cagcaucgugccggaa

SEQ ID NO: 1735187 - RNA, 17 nt, Salmonella enterica enterica serovar Typhi Ty2
cagcaucuccuggcgca

SEQ ID NO: 1735188 - RNA, 13 nt, Salmonella enterica enterica serovar Typhi Ty2
cagcagcgacgca

SEQ ID NO: 1735189 - RNA, 17 nt, Salmonella enterica enterica serovar Typhi Ty2
cagcagccgggccagac

SEQ ID NO: 1735190 - RNA, 12 nt, Salmonella enterica enterica serovar Typhi Ty2
cagcauaccgcc

SEQ ID NO: 1735191 - RNA, 17 nt, Salmonella enterica enterica serovar Typhi Ty2
cagcauacgacaucgcc

SEQ ID NO: 1735192 - RNA, 20 nt, Salmonella enterica enterica serovar Typhi Ty2
cagcaguaaauaaucgacga

SEQ ID NO: 1735193 - RNA, 13 nt, Salmonella enterica enterica serovar Typhi Ty2
cagcauaaacauc

SEQ ID NO: 1735194 - RNA, 20 nt, Salmonella enterica enterica serovar Typhi Ty2
cagcaucaauagcagcuuca

SEQ ID NO: 1735195 - RNA, 15 nt, Salmonella enterica enterica serovar Typhi Ty2
cagcauagucgcucc

SEQ ID NO: 1735196 - RNA, 15 nt, Salmonella enterica enterica serovar Typhi Ty2
cagcaucacaucaaa

SEQ ID NO: 1735197 - RNA, 14 nt, Salmonella enterica enterica serovar Typhi Ty2
cacggggcggcaau

SEQ ID NO: 1735198 - RNA, 23 nt, Salmonella enterica enterica serovar Typhi Ty2
cacgguucacggccaaagcgcga

SEQ ID NO: 1735199 - RNA, 21 nt, Salmonella enterica enterica serovar Typhi Ty2
cacgguuaucuggcgcaaccg

SEQ ID NO: 1735200 - RNA, 17 nt, Salmonella enterica enterica serovar Typhi Ty2
cacggugugccgccauc

SEQ ID NO: 1735201 - RNA, 15 nt, Salmonella enterica enterica serovar Typhi Ty2
cacgguuuuacgcug

SEQ ID NO: 1735202 - RNA, 16 nt, Salmonella enterica enterica serovar Typhi Ty2
cacguaauuuauuacg

SEQ ID NO: 1735203 - RNA, 23 nt, Salmonella enterica enterica serovar Typhi Ty2
cacguaaugcgccccggcggcgu

SEQ ID NO: 1735204 - RNA, 15 nt, Salmonella enterica enterica serovar Typhi Ty2
aaagaaacgcugauc

SEQ ID NO: 1735205 - RNA, 14 nt, Salmonella enterica enterica serovar Typhi Ty2
aaacuucacgucgc

SEQ ID NO: 1735206 - RNA, 13 nt, Salmonella enterica enterica serovar Typhi Ty2
cacggcuggcaau

SEQ ID NO: 1735207 - RNA, 15 nt, Salmonella enterica enterica serovar Typhi Ty2
aaacuguucagcggu

SEQ ID NO: 1735208 - RNA, 12 nt, Salmonella enterica enterica serovar Typhi Ty2
aaacuggugcag

SEQ ID NO: 1735209 - RNA, 20 nt, Salmonella enterica enterica serovar Typhi Ty2
cacgcgcgcgcgucaacgcc

SEQ ID NO: 1735210 - RNA, 12 nt, Salmonella enterica enterica serovar Typhi Ty2
caccuccagcgc

SEQ ID NO: 1735211 - RNA, 14 nt, Salmonella enterica enterica serovar Typhi Ty2
cacgcggcaucagg

SEQ ID NO: 1735212 - RNA, 20 nt, Salmonella enterica enterica serovar Typhi Ty2
caccguuucuuugcugccgu

SEQ ID NO: 1735213 - RNA, 21 nt, Salmonella enterica enterica serovar Typhi Ty2
caccguuacgaacgaagguca

SEQ ID NO: 1735214 - RNA, 12 nt, Salmonella enterica enterica serovar Typhi Ty2
caccguuauccg

SEQ ID NO: 1735215 - RNA, 13 nt, Salmonella enterica enterica serovar Typhi Ty2
caccguuauccgg

SEQ ID NO: 1735216 - RNA, 16 nt, Salmonella enterica enterica serovar Typhi Ty2
cacgcguuauacgcau

SEQ ID NO: 1735217 - RNA, 19 nt, Salmonella enterica enterica serovar Typhi Ty2
cacgcguucaauauucgcg

SEQ ID NO: 1735218 - RNA, 13 nt, Salmonella enterica enterica serovar Typhi Ty2
cacgcuaaagcgc

SEQ ID NO: 1735219 - RNA, 14 nt, Salmonella enterica enterica serovar Typhi Ty2
cacgcucacgcaga

SEQ ID NO: 1735220 - RNA, 13 nt, Salmonella enterica enterica serovar Typhi Ty2
cacggcauucacg

SEQ ID NO: 1735221 - RNA, 15 nt, Salmonella enterica enterica serovar Typhi Ty2
cacgcuuuucagcgc

SEQ ID NO: 1735222 - RNA, 15 nt, Salmonella enterica enterica serovar Typhi Ty2
cacugccgccacgcc

SEQ ID NO: 1735223 - RNA, 18 nt, Salmonella enterica enterica serovar Typhi Ty2
cacuggcgcucagcgccg

SEQ ID NO: 1735224 - RNA, 16 nt, Salmonella enterica enterica serovar Typhi Ty2
cacucuucaaccggca

SEQ ID NO: 1735225 - RNA, 18 nt, Salmonella enterica enterica serovar Typhi Ty2
cacucguaggccggauaa

SEQ ID NO: 1735226 - RNA, 23 nt, Salmonella enterica enterica serovar Typhi Ty2
cacucuuuggacggcaucaggaa

SEQ ID NO: 1735227 - RNA, 16 nt, Salmonella enterica enterica serovar Typhi Ty2
cacguuaccggcgguu

SEQ ID NO: 1735228 - RNA, 15 nt, Salmonella enterica enterica serovar Typhi Ty2
cacuaaaaacaggcu

SEQ ID NO: 1735229 - RNA, 20 nt, Salmonella enterica enterica serovar Typhi Ty2
cacuacacagggucgucaaa

SEQ ID NO: 1735230 - RNA, 14 nt, Salmonella enterica enterica serovar Typhi Ty2
cacucgcggauaau

SEQ ID NO: 1735231 - RNA, 18 nt, Salmonella enterica enterica serovar Typhi Ty2
cacuaccauuuccggcgc

SEQ ID NO: 1735232 - RNA, 19 nt, Salmonella enterica enterica serovar Typhi Ty2
cacuacggcaaacgcuggu

SEQ ID NO: 1735233 - RNA, 18 nt, Salmonella enterica enterica serovar Typhi Ty2
cacguagccgucggcuuu

SEQ ID NO: 1735234 - RNA, 18 nt, Salmonella enterica enterica serovar Typhi Ty2
cacguuaucugaccuaca

SEQ ID NO: 1735235 - RNA, 18 nt, Salmonella enterica enterica serovar Typhi Ty2
cagacuuuggauaaagcc

SEQ ID NO: 1735236 - RNA, 21 nt, Salmonella enterica enterica serovar Typhi Ty2
aaagaaccgacugucgaaacc

SEQ ID NO: 1735237 - RNA, 18 nt, Salmonella enterica enterica serovar Typhi Ty2
cagacuguaaaucugccg

SEQ ID NO: 1735238 - RNA, 21 nt, Salmonella enterica enterica serovar Typhi Ty2
cagacggcgcuaauguacgcc

SEQ ID NO: 1735239 - RNA, 21 nt, Salmonella enterica enterica serovar Typhi Ty2
cagaccgggcgaaguuugccg

SEQ ID NO: 1735240 - RNA, 19 nt, Salmonella enterica enterica serovar Typhi Ty2
cagaccuacgcuauccggc

SEQ ID NO: 1735241 - RNA, 23 nt, Salmonella enterica enterica serovar Typhi Ty2
cagaccgccaagcgcggacagca

SEQ ID NO: 1735242 - RNA, 14 nt, Salmonella enterica enterica serovar Typhi Ty2
cagaccgcugcgga

SEQ ID NO: 1735243 - RNA, 23 nt, Salmonella enterica enterica serovar Typhi Ty2
cagaccuuuauaagguuagccag

SEQ ID NO: 1735244 - RNA, 17 nt, Salmonella enterica enterica serovar Typhi Ty2
cagacgaccauccacca

SEQ ID NO: 1735245 - RNA, 21 nt, Salmonella enterica enterica serovar Typhi Ty2
cagaccuucaacccagcagca

SEQ ID NO: 1735246 - RNA, 20 nt, Salmonella enterica enterica serovar Typhi Ty2
cagacgccgcgcugcggcgu

SEQ ID NO: 1735247 - RNA, 18 nt, Salmonella enterica enterica serovar Typhi Ty2
cagacgccgcgcugcggc

SEQ ID NO: 1735248 - RNA, 18 nt, Salmonella enterica enterica serovar Typhi Ty2
cagaccgacgccaaccgc

SEQ ID NO: 1735249 - RNA, 20 nt, Salmonella enterica enterica serovar Typhi Ty2
cagaccgauauuuugcugca

SEQ ID NO: 1735250 - RNA, 13 nt, Salmonella enterica enterica serovar Typhi Ty2
cagacccgcaaua

SEQ ID NO: 1735251 - RNA, 18 nt, Salmonella enterica enterica serovar Typhi Ty2
cagaccacgaaucaggau

SEQ ID NO: 1735252 - RNA, 23 nt, Salmonella enterica enterica serovar Typhi Ty2
cagaaggugaguuucgcaucagg

SEQ ID NO: 1735253 - RNA, 18 nt, Salmonella enterica enterica serovar Typhi Ty2
cagaccaauagagagcga

SEQ ID NO: 1735254 - RNA, 16 nt, Salmonella enterica enterica serovar Typhi Ty2
cagaauaagccagguu

SEQ ID NO: 1735255 - RNA, 17 nt, Salmonella enterica enterica serovar Typhi Ty2
cagaccaaacaugcggc

SEQ ID NO: 1735256 - RNA, 18 nt, Salmonella enterica enterica serovar Typhi Ty2
cagaaagcggaccaaugc

SEQ ID NO: 1735257 - RNA, 16 nt, Salmonella enterica enterica serovar Typhi Ty2
cagaagcaaauucagg

SEQ ID NO: 1735258 - RNA, 13 nt, Salmonella enterica enterica serovar Typhi Ty2
cagaaaaccggca

SEQ ID NO: 1735259 - RNA, 16 nt, Salmonella enterica enterica serovar Typhi Ty2
cagaaaaaaaagcgcc

SEQ ID NO: 1735260 - RNA, 18 nt, Salmonella enterica enterica serovar Typhi Ty2
cacuuuucuuuccugcaa

SEQ ID NO: 1735261 - RNA, 19 nt, Salmonella enterica enterica serovar Typhi Ty2
cacuguucaaucaucacga

SEQ ID NO: 1735262 - RNA, 18 nt, Salmonella enterica enterica serovar Typhi Ty2
ccgaugccgacggcgcuu

SEQ ID NO: 1735263 - RNA, 14 nt, Salmonella enterica enterica serovar Typhi Ty2
ccgaugcccagcuu

SEQ ID NO: 1735264 - RNA, 21 nt, Salmonella enterica enterica serovar Typhi Ty2
ccgaugcucagggcauccgcc

SEQ ID NO: 1735265 - RNA, 17 nt, Salmonella enterica enterica serovar Typhi Ty2
ccgauggcgcugcguuu

SEQ ID NO: 1735266 - RNA, 23 nt, Salmonella enterica enterica serovar Typhi Ty2
ccgauggcgcugcguuuaucagg

SEQ ID NO: 1735267 - RNA, 14 nt, Salmonella enterica enterica serovar Typhi Ty2
ccgauacgaucguc

SEQ ID NO: 1735268 - RNA, 16 nt, Salmonella enterica enterica serovar Typhi Ty2
ccgauagcguaaagaa

SEQ ID NO: 1735269 - RNA, 18 nt, Salmonella enterica enterica serovar Typhi Ty2
ccgauagcuaucacacau

SEQ ID NO: 1735270 - RNA, 16 nt, Salmonella enterica enterica serovar Typhi Ty2
ccgaucaccagcgcau

SEQ ID NO: 1735271 - RNA, 23 nt, Salmonella enterica enterica serovar Typhi Ty2
ccgauauugccuucacccagacu

SEQ ID NO: 1735272 - RNA, 12 nt, Salmonella enterica enterica serovar Typhi Ty2
ccgaucacggcu

SEQ ID NO: 1735273 - RNA, 17 nt, Salmonella enterica enterica serovar Typhi Ty2
ccgauaagcaagcgcca

SEQ ID NO: 1735274 - RNA, 15 nt, Salmonella enterica enterica serovar Typhi Ty2
ccgauaaacggcuuu

SEQ ID NO: 1735275 - RNA, 18 nt, Salmonella enterica enterica serovar Typhi Ty2
ccgauaagcaagcgccau

SEQ ID NO: 1735276 - RNA, 21 nt, Salmonella enterica enterica serovar Typhi Ty2
ccgauacaggacugacugcug

SEQ ID NO: 1735277 - RNA, 17 nt, Salmonella enterica enterica serovar Typhi Ty2
ccgaguggaaucagcca

SEQ ID NO: 1735278 - RNA, 23 nt, Salmonella enterica enterica serovar Typhi Ty2
ccgagucgaucgucgggauaagc

SEQ ID NO: 1735279 - RNA, 22 nt, Salmonella enterica enterica serovar Typhi Ty2
ccgaggguggacaugauaagcg

SEQ ID NO: 1735280 - RNA, 21 nt, Salmonella enterica enterica serovar Typhi Ty2
ccgaggguggacaugauaagc

SEQ ID NO: 1735281 - RNA, 17 nt, Salmonella enterica enterica serovar Typhi Ty2
ccgaggcuaagccagaa

SEQ ID NO: 1735282 - RNA, 12 nt, Salmonella enterica enterica serovar Typhi Ty2
ccgaggcgaaac

SEQ ID NO: 1735283 - RNA, 17 nt, Salmonella enterica enterica serovar Typhi Ty2
ccgagccggguuauagc

SEQ ID NO: 1735284 - RNA, 18 nt, Salmonella enterica enterica serovar Typhi Ty2
ccgaaaugaccaccgcau

SEQ ID NO: 1735285 - RNA, 16 nt, Salmonella enterica enterica serovar Typhi Ty2
ccgaaaggaagcgggc

SEQ ID NO: 1735286 - RNA, 23 nt, Salmonella enterica enterica serovar Typhi Ty2
ccgcagcacccgcucgcugcauu

SEQ ID NO: 1735287 - RNA, 12 nt, Salmonella enterica enterica serovar Typhi Ty2
ccgcagcgccau

SEQ ID NO: 1735288 - RNA, 19 nt, Salmonella enterica enterica serovar Typhi Ty2
ccgcacagcagacaaccga

SEQ ID NO: 1735289 - RNA, 22 nt, Salmonella enterica enterica serovar Typhi Ty2
ccgcaaacagcacgcccugcca

SEQ ID NO: 1735290 - RNA, 16 nt, Salmonella enterica enterica serovar Typhi Ty2
ccgcaaaccagaccaa

SEQ ID NO: 1735291 - RNA, 14 nt, Salmonella enterica enterica serovar Typhi Ty2
ccgauuuugaacau

SEQ ID NO: 1735292 - RNA, 23 nt, Salmonella enterica enterica serovar Typhi Ty2
ccgauuuugucggaauuuccggg

SEQ ID NO: 1735293 - RNA, 12 nt, Salmonella enterica enterica serovar Typhi Ty2
ccgcaacgccag

SEQ ID NO: 1735294 - RNA, 16 nt, Salmonella enterica enterica serovar Typhi Ty2
ccgcaacucucgauau

SEQ ID NO: 1735295 - RNA, 17 nt, Salmonella enterica enterica serovar Typhi Ty2
ccgccaucgcugacgau

SEQ ID NO: 1735296 - RNA, 19 nt, Salmonella enterica enterica serovar Typhi Ty2
ccgccauugccaguaccga

SEQ ID NO: 1735297 - RNA, 22 nt, Salmonella enterica enterica serovar Typhi Ty2
ccgccaggcgagcacaccauau

SEQ ID NO: 1735298 - RNA, 19 nt, Salmonella enterica enterica serovar Typhi Ty2
ccgccaggcauguuaugaa

SEQ ID NO: 1735299 - RNA, 21 nt, Salmonella enterica enterica serovar Typhi Ty2
ccgccagcgugacccagacaa

SEQ ID NO: 1735300 - RNA, 19 nt, Salmonella enterica enterica serovar Typhi Ty2
ccgccagcgugacccagac

SEQ ID NO: 1735301 - RNA, 23 nt, Salmonella enterica enterica serovar Typhi Ty2
ccgccagcgucuguuucaacgca

SEQ ID NO: 1735302 - RNA, 20 nt, Salmonella enterica enterica serovar Typhi Ty2
ccgccauuuuauccaggcca

SEQ ID NO: 1735303 - RNA, 13 nt, Salmonella enterica enterica serovar Typhi Ty2
ccgcccaaccagc

SEQ ID NO: 1735304 - RNA, 13 nt, Salmonella enterica enterica serovar Typhi Ty2
ccgcccaggauau

SEQ ID NO: 1735305 - RNA, 19 nt, Salmonella enterica enterica serovar Typhi Ty2
ccgccagaaaagaaccgac

SEQ ID NO: 1735306 - RNA, 15 nt, Salmonella enterica enterica serovar Typhi Ty2
ccgccaauauccggc

SEQ ID NO: 1735307 - RNA, 19 nt, Salmonella enterica enterica serovar Typhi Ty2
ccgccaagauuaagaccgu

SEQ ID NO: 1735308 - RNA, 16 nt, Salmonella enterica enterica serovar Typhi Ty2
ccgcagcgcggccugc

SEQ ID NO: 1735309 - RNA, 15 nt, Salmonella enterica enterica serovar Typhi Ty2
ccgcaucguuaucau

SEQ ID NO: 1735310 - RNA, 20 nt, Salmonella enterica enterica serovar Typhi Ty2
ccgccaaaccggcgaauagc

SEQ ID NO: 1735311 - RNA, 17 nt, Salmonella enterica enterica serovar Typhi Ty2
ccgcauuuuaaacgauc

SEQ ID NO: 1735312 - RNA, 23 nt, Salmonella enterica enterica serovar Typhi Ty2
ccgcauuuuuucuucaguucagc

SEQ ID NO: 1735313 - RNA, 18 nt, Salmonella enterica enterica serovar Typhi Ty2
ccgccaacaccgcaucgc

SEQ ID NO: 1735314 - RNA, 14 nt, Salmonella enterica enterica serovar Typhi Ty2
aaaugacgucagca

SEQ ID NO: 1735315 - RNA, 17 nt, Salmonella enterica enterica serovar Typhi Ty2
aaauggccgucgccaca

SEQ ID NO: 1735316 - RNA, 11 nt, Salmonella enterica enterica serovar Typhi Ty2
aaauggcgcug

SEQ ID NO: 1735317 - RNA, 17 nt, Salmonella enterica enterica serovar Typhi Ty2
aaauguaggccggauaa

SEQ ID NO: 1735318 - RNA, 20 nt, Salmonella enterica enterica serovar Typhi Ty2
ccgccgugauaaauacgcug

SEQ ID NO: 1735319 - RNA, 13 nt, Salmonella enterica enterica serovar Typhi Ty2
ccgccugccagau

SEQ ID NO: 1735320 - RNA, 23 nt, Salmonella enterica enterica serovar Typhi Ty2
ccgccugacgaaagucauccagu

SEQ ID NO: 1735321 - RNA, 20 nt, Salmonella enterica enterica serovar Typhi Ty2
ccgcgacagucgcagagccc

SEQ ID NO: 1735322 - RNA, 22 nt, Salmonella enterica enterica serovar Typhi Ty2
ccgcgacuuuggcuuuauccgg

SEQ ID NO: 1735323 - RNA, 11 nt, Salmonella enterica enterica serovar Typhi Ty2
ccgcgccggac

SEQ ID NO: 1735324 - RNA, 18 nt, Salmonella enterica enterica serovar Typhi Ty2
aaauuaaagauuagcguu

SEQ ID NO: 1735325 - RNA, 19 nt, Salmonella enterica enterica serovar Typhi Ty2
ccgcggcauuaauccgugc

SEQ ID NO: 1735326 - RNA, 22 nt, Salmonella enterica enterica serovar Typhi Ty2
aaauucacgcuucucuggcgcg

SEQ ID NO: 1735327 - RNA, 16 nt, Salmonella enterica enterica serovar Typhi Ty2
ccgcggacuuauuaac

SEQ ID NO: 1735328 - RNA, 19 nt, Salmonella enterica enterica serovar Typhi Ty2
ccgcuauucaccagcguca

SEQ ID NO: 1735329 - RNA, 15 nt, Salmonella enterica enterica serovar Typhi Ty2
ccgcguuuaucgcau

SEQ ID NO: 1735330 - RNA, 14 nt, Salmonella enterica enterica serovar Typhi Ty2
ccgcugucgccaga

SEQ ID NO: 1735331 - RNA, 14 nt, Salmonella enterica enterica serovar Typhi Ty2
ccgcuguuaugcac

SEQ ID NO: 1735332 - RNA, 21 nt, Salmonella enterica enterica serovar Typhi Ty2
ccggcgugugucccggacaau

SEQ ID NO: 1735333 - RNA, 16 nt, Salmonella enterica enterica serovar Typhi Ty2
ccggcguuacuccgcg

SEQ ID NO: 1735334 - RNA, 18 nt, Salmonella enterica enterica serovar Typhi Ty2
ccggcgucgaucagcgcg

SEQ ID NO: 1735335 - RNA, 19 nt, Salmonella enterica enterica serovar Typhi Ty2
ccggcuaaaugacgcgcga

SEQ ID NO: 1735336 - RNA, 23 nt, Salmonella enterica enterica serovar Typhi Ty2
ccggcgggguuuuuuuaugcguu

SEQ ID NO: 1735337 - RNA, 17 nt, Salmonella enterica enterica serovar Typhi Ty2
ccggggaagcgcgcgca

SEQ ID NO: 1735338 - RNA, 20 nt, Salmonella enterica enterica serovar Typhi Ty2
aaauuuucaaccacggauaa

SEQ ID NO: 1735339 - RNA, 19 nt, Salmonella enterica enterica serovar Typhi Ty2
aaauuuucagacacugcac

SEQ ID NO: 1735340 - RNA, 13 nt, Salmonella enterica enterica serovar Typhi Ty2
ccgggcgauaaac

SEQ ID NO: 1735341 - RNA, 16 nt, Salmonella enterica enterica serovar Typhi Ty2
ccgggccugccagguu

SEQ ID NO: 1735342 - RNA, 11 nt, Salmonella enterica enterica serovar Typhi Ty2
ccgggcaucug

SEQ ID NO: 1735343 - RNA, 16 nt, Salmonella enterica enterica serovar Typhi Ty2
ccggcuuaccggcuau

SEQ ID NO: 1735344 - RNA, 13 nt, Salmonella enterica enterica serovar Typhi Ty2
ccggcuuauccgg

SEQ ID NO: 1735345 - RNA, 14 nt, Salmonella enterica enterica serovar Typhi Ty2
ccgggauaaucagg

SEQ ID NO: 1735346 - RNA, 21 nt, Salmonella enterica enterica serovar Typhi Ty2
ccggcaugccauaaucgauau

SEQ ID NO: 1735347 - RNA, 18 nt, Salmonella enterica enterica serovar Typhi Ty2
ccgcuuuuuccgccgucg

SEQ ID NO: 1735348 - RNA, 16 nt, Salmonella enterica enterica serovar Typhi Ty2
ccgcuuuaucauacca

SEQ ID NO: 1735349 - RNA, 15 nt, Salmonella enterica enterica serovar Typhi Ty2
ccgcuuuaagcgcug

SEQ ID NO: 1735350 - RNA, 14 nt, Salmonella enterica enterica serovar Typhi Ty2
ccggccagcgccag

SEQ ID NO: 1735351 - RNA, 13 nt, Salmonella enterica enterica serovar Typhi Ty2
ccggccagcgcca

SEQ ID NO: 1735352 - RNA, 17 nt, Salmonella enterica enterica serovar Typhi Ty2
ccggccucgcccgcgau

SEQ ID NO: 1735353 - RNA, 15 nt, Salmonella enterica enterica serovar Typhi Ty2
ccggccuccaaauga

SEQ ID NO: 1735354 - RNA, 13 nt, Salmonella enterica enterica serovar Typhi Ty2
ccggccagcguca

SEQ ID NO: 1735355 - RNA, 16 nt, Salmonella enterica enterica serovar Typhi Ty2
ccggcgcccauccgcc

SEQ ID NO: 1735356 - RNA, 18 nt, Salmonella enterica enterica serovar Typhi Ty2
ccggcgaaaucgugcgcc

SEQ ID NO: 1735357 - RNA, 22 nt, Salmonella enterica enterica serovar Typhi Ty2
ccggccugcagggaauaagcgc

SEQ ID NO: 1735358 - RNA, 16 nt, Salmonella enterica enterica serovar Typhi Ty2
ccggcgcaaacaguac

SEQ ID NO: 1735359 - RNA, 13 nt, Salmonella enterica enterica serovar Typhi Ty2
ccggcgcgguauu

SEQ ID NO: 1735360 - RNA, 18 nt, Salmonella enterica enterica serovar Typhi Ty2
ccggcgcgaucaucgcau

SEQ ID NO: 1735361 - RNA, 14 nt, Salmonella enterica enterica serovar Typhi Ty2
ccgguggcgcuguc

SEQ ID NO: 1735362 - RNA, 16 nt, Salmonella enterica enterica serovar Typhi Ty2
ccgguuauaccgccau

SEQ ID NO: 1735363 - RNA, 19 nt, Salmonella enterica enterica serovar Typhi Ty2
ccguaaacgggcugcccgg

SEQ ID NO: 1735364 - RNA, 15 nt, Salmonella enterica enterica serovar Typhi Ty2
ccguaauaaguauca

SEQ ID NO: 1735365 - RNA, 20 nt, Salmonella enterica enterica serovar Typhi Ty2
ccguaaggcgauucaacagg

SEQ ID NO: 1735366 - RNA, 12 nt, Salmonella enterica enterica serovar Typhi Ty2
ccguaaggcgcc

SEQ ID NO: 1735367 - RNA, 13 nt, Salmonella enterica enterica serovar Typhi Ty2
ccgguuugucgcu

SEQ ID NO: 1735368 - RNA, 15 nt, Salmonella enterica enterica serovar Typhi Ty2
ccggguaaacgccau

SEQ ID NO: 1735369 - RNA, 22 nt, Salmonella enterica enterica serovar Typhi Ty2
ccgugaauaaugaccagcgccc

SEQ ID NO: 1735370 - RNA, 14 nt, Salmonella enterica enterica serovar Typhi Ty2
ccgugacgccaggc

SEQ ID NO: 1735371 - RNA, 23 nt, Salmonella enterica enterica serovar Typhi Ty2
ccgucccagcggaugucggucau

SEQ ID NO: 1735372 - RNA, 20 nt, Salmonella enterica enterica serovar Typhi Ty2
ccguccauuucaaugcauac

SEQ ID NO: 1735373 - RNA, 22 nt, Salmonella enterica enterica serovar Typhi Ty2
ccgucaggaacggauaacgacg

SEQ ID NO: 1735374 - RNA, 18 nt, Salmonella enterica enterica serovar Typhi Ty2
ccgucauaaucgcgauac

SEQ ID NO: 1735375 - RNA, 16 nt, Salmonella enterica enterica serovar Typhi Ty2
ccguacuccagcccau

SEQ ID NO: 1735376 - RNA, 19 nt, Salmonella enterica enterica serovar Typhi Ty2
ccguaaucaucgcgaucgc

SEQ ID NO: 1735377 - RNA, 22 nt, Salmonella enterica enterica serovar Typhi Ty2
ccucaacgucgcucagaauagg

SEQ ID NO: 1735378 - RNA, 18 nt, Salmonella enterica enterica serovar Typhi Ty2
ccucaucgggacggcggu

SEQ ID NO: 1735379 - RNA, 15 nt, Salmonella enterica enterica serovar Typhi Ty2
ccuauaacagcgcug

SEQ ID NO: 1735380 - RNA, 17 nt, Salmonella enterica enterica serovar Typhi Ty2
ccuauugcaacgccgau

SEQ ID NO: 1735381 - RNA, 21 nt, Salmonella enterica enterica serovar Typhi Ty2
ccuauuugcuugugacggcaa

SEQ ID NO: 1735382 - RNA, 18 nt, Salmonella enterica enterica serovar Typhi Ty2
ccuccggcgagcgaugcu

SEQ ID NO: 1735383 - RNA, 22 nt, Salmonella enterica enterica serovar Typhi Ty2
ccuccggcagaaaugaccacgu

SEQ ID NO: 1735384 - RNA, 17 nt, Salmonella enterica enterica serovar Typhi Ty2
ccuccgccgaucagcac

SEQ ID NO: 1735385 - RNA, 19 nt, Salmonella enterica enterica serovar Typhi Ty2
ccuccgcguaccucagcau

SEQ ID NO: 1735386 - RNA, 16 nt, Salmonella enterica enterica serovar Typhi Ty2
ccucgcaguuaugcgc

SEQ ID NO: 1735387 - RNA, 23 nt, Salmonella enterica enterica serovar Typhi Ty2
ccguugccacccaaugauccgga

SEQ ID NO: 1735388 - RNA, 19 nt, Salmonella enterica enterica serovar Typhi Ty2
ccguugccgggugcgcguc

SEQ ID NO: 1735389 - RNA, 17 nt, Salmonella enterica enterica serovar Typhi Ty2
ccguucugaccugcgca

SEQ ID NO: 1735390 - RNA, 16 nt, Salmonella enterica enterica serovar Typhi Ty2
ccguucuuccugggga

SEQ ID NO: 1735391 - RNA, 18 nt, Salmonella enterica enterica serovar Typhi Ty2
ccguucauaguuugcaua

SEQ ID NO: 1735392 - RNA, 20 nt, Salmonella enterica enterica serovar Typhi Ty2
ccuacgcaggcuaacgcgcc

SEQ ID NO: 1735393 - RNA, 23 nt, Salmonella enterica enterica serovar Typhi Ty2
ccuacugcuuagcucaucagccu

SEQ ID NO: 1735394 - RNA, 16 nt, Salmonella enterica enterica serovar Typhi Ty2
ccuaacaggcgcauac

SEQ ID NO: 1735395 - RNA, 18 nt, Salmonella enterica enterica serovar Typhi Ty2
ccuacaagaauuuaucgc

SEQ ID NO: 1735396 - RNA, 21 nt, Salmonella enterica enterica serovar Typhi Ty2
ccguuugcaguccguccagac

SEQ ID NO: 1735397 - RNA, 20 nt, Salmonella enterica enterica serovar Typhi Ty2
ccguuuuccggucgcgcaau

SEQ ID NO: 1735398 - RNA, 16 nt, Salmonella enterica enterica serovar Typhi Ty2
ccguuuuucccgcugg

SEQ ID NO: 1735399 - RNA, 21 nt, Salmonella enterica enterica serovar Typhi Ty2
ccguuuuguugccgcccguuu

SEQ ID NO: 1735400 - RNA, 17 nt, Salmonella enterica enterica serovar Typhi Ty2
ccguuuaccccgccagc

SEQ ID NO: 1735401 - RNA, 15 nt, Salmonella enterica enterica serovar Typhi Ty2
cgcaguucgccgcca

SEQ ID NO: 1735402 - RNA, 16 nt, Salmonella enterica enterica serovar Typhi Ty2
cgcagucguuccagac

SEQ ID NO: 1735403 - RNA, 22 nt, Salmonella enterica enterica serovar Typhi Ty2
cgcagucguuucuauuauugau

SEQ ID NO: 1735404 - RNA, 22 nt, Salmonella enterica enterica serovar Typhi Ty2
cgcaguccagaugcgccagauu

SEQ ID NO: 1735405 - RNA, 21 nt, Salmonella enterica enterica serovar Typhi Ty2
cgcaguaauacgccgccgcag

SEQ ID NO: 1735406 - RNA, 14 nt, Salmonella enterica enterica serovar Typhi Ty2
cgcaguacgcgcaa

SEQ ID NO: 1735407 - RNA, 21 nt, Salmonella enterica enterica serovar Typhi Ty2
cgcauagguugauauaaaacg

SEQ ID NO: 1735408 - RNA, 18 nt, Salmonella enterica enterica serovar Typhi Ty2
cgcauaggcuuugcugag

SEQ ID NO: 1735409 - RNA, 15 nt, Salmonella enterica enterica serovar Typhi Ty2
cgcauaccagccaua

SEQ ID NO: 1735410 - RNA, 19 nt, Salmonella enterica enterica serovar Typhi Ty2
cgcauaaugcgccccgcaa

SEQ ID NO: 1735411 - RNA, 17 nt, Salmonella enterica enterica serovar Typhi Ty2
cgcauaaugagcgcuug

SEQ ID NO: 1735412 - RNA, 13 nt, Salmonella enterica enterica serovar Typhi Ty2
cgcauccagcgca

SEQ ID NO: 1735413 - RNA, 13 nt, Salmonella enterica enterica serovar Typhi Ty2
cgcauccagccac

SEQ ID NO: 1735414 - RNA, 13 nt, Salmonella enterica enterica serovar Typhi Ty2
cgcauccagcguc

SEQ ID NO: 1735415 - RNA, 14 nt, Salmonella enterica enterica serovar Typhi Ty2
cgcauccagcgcaa

SEQ ID NO: 1735416 - RNA, 19 nt, Salmonella enterica enterica serovar Typhi Ty2
cgcauaucccacugcacgc

SEQ ID NO: 1735417 - RNA, 13 nt, Salmonella enterica enterica serovar Typhi Ty2
cgcauauccagca

SEQ ID NO: 1735418 - RNA, 17 nt, Salmonella enterica enterica serovar Typhi Ty2
cgcaucaauaugcguca

SEQ ID NO: 1735419 - RNA, 14 nt, Salmonella enterica enterica serovar Typhi Ty2
cgcaucaaugccca

SEQ ID NO: 1735420 - RNA, 22 nt, Salmonella enterica enterica serovar Typhi Ty2
cgcaggauaaagaccggcacaa

SEQ ID NO: 1735421 - RNA, 21 nt, Salmonella enterica enterica serovar Typhi Ty2
cgcaggacuuucgcuucacga

SEQ ID NO: 1735422 - RNA, 21 nt, Salmonella enterica enterica serovar Typhi Ty2
cgcaggauaaagaccggcaca

SEQ ID NO: 1735423 - RNA, 15 nt, Salmonella enterica enterica serovar Typhi Ty2
cgcaggacagcgaca

SEQ ID NO: 1735424 - RNA, 16 nt, Salmonella enterica enterica serovar Typhi Ty2
cgcagcccugcgucgc

SEQ ID NO: 1735425 - RNA, 17 nt, Salmonella enterica enterica serovar Typhi Ty2
cgcagguuaaagccucu

SEQ ID NO: 1735426 - RNA, 20 nt, Salmonella enterica enterica serovar Typhi Ty2
cgcaggucuucgucagcgca

SEQ ID NO: 1735427 - RNA, 16 nt, Salmonella enterica enterica serovar Typhi Ty2
cgcaucguggccgaua

SEQ ID NO: 1735428 - RNA, 17 nt, Salmonella enterica enterica serovar Typhi Ty2
cgcauggcagggcgaua

SEQ ID NO: 1735429 - RNA, 24 nt, Salmonella enterica enterica serovar Typhi Ty2
cgcauccgggaguuucaugccaua

SEQ ID NO: 1735430 - RNA, 14 nt, Salmonella enterica enterica serovar Typhi Ty2
cgcauccagcguca

SEQ ID NO: 1735431 - RNA, 16 nt, Salmonella enterica enterica serovar Typhi Ty2
cgcauccgcggcgcuu

SEQ ID NO: 1735432 - RNA, 19 nt, Salmonella enterica enterica serovar Typhi Ty2
cgcauccggaaucgccguu

SEQ ID NO: 1735433 - RNA, 17 nt, Salmonella enterica enterica serovar Typhi Ty2
cgccacaccgagacaga

SEQ ID NO: 1735434 - RNA, 20 nt, Salmonella enterica enterica serovar Typhi Ty2
cgccacaccggauaccgguu

SEQ ID NO: 1735435 - RNA, 15 nt, Salmonella enterica enterica serovar Typhi Ty2
cgccacauugcgcgc

SEQ ID NO: 1735436 - RNA, 18 nt, Salmonella enterica enterica serovar Typhi Ty2
cgccacauugaccccaua

SEQ ID NO: 1735437 - RNA, 18 nt, Salmonella enterica enterica serovar Typhi Ty2
cgccaccacaaacgccgu

SEQ ID NO: 1735438 - RNA, 19 nt, Salmonella enterica enterica serovar Typhi Ty2
cgccaccacauucaggcgg

SEQ ID NO: 1735439 - RNA, 15 nt, Salmonella enterica enterica serovar Typhi Ty2
cgcauggggagaccc

SEQ ID NO: 1735440 - RNA, 21 nt, Salmonella enterica enterica serovar Typhi Ty2
cgcaugugagcaucggcgauu

SEQ ID NO: 1735441 - RNA, 14 nt, Salmonella enterica enterica serovar Typhi Ty2
cgcauguuccgcua

SEQ ID NO: 1735442 - RNA, 12 nt, Salmonella enterica enterica serovar Typhi Ty2
cgccaaccggcu

SEQ ID NO: 1735443 - RNA, 16 nt, Salmonella enterica enterica serovar Typhi Ty2
cgccaacaccgcaucg

SEQ ID NO: 1735444 - RNA, 20 nt, Salmonella enterica enterica serovar Typhi Ty2
cgcacauuuacgccagccag

SEQ ID NO: 1735445 - RNA, 22 nt, Salmonella enterica enterica serovar Typhi Ty2
cgcacauggaacucugcgacgc

SEQ ID NO: 1735446 - RNA, 16 nt, Salmonella enterica enterica serovar Typhi Ty2
cgcacauaaucaccgc

SEQ ID NO: 1735447 - RNA, 14 nt, Salmonella enterica enterica serovar Typhi Ty2
cgcaauaugcguca

SEQ ID NO: 1735448 - RNA, 21 nt, Salmonella enterica enterica serovar Typhi Ty2
cgcaaucucuuccgcccagau

SEQ ID NO: 1735449 - RNA, 14 nt, Salmonella enterica enterica serovar Typhi Ty2
cgcaaucgccgauc

SEQ ID NO: 1735450 - RNA, 17 nt, Salmonella enterica enterica serovar Typhi Ty2
cgcaaucugcucgacgc

SEQ ID NO: 1735451 - RNA, 20 nt, Salmonella enterica enterica serovar Typhi Ty2
cgauuuucagcaccuuacga

SEQ ID NO: 1735452 - RNA, 21 nt, Salmonella enterica enterica serovar Typhi Ty2
cgauuuucccuucugaaauga

SEQ ID NO: 1735453 - RNA, 17 nt, Salmonella enterica enterica serovar Typhi Ty2
cgauuucauuacgccug

SEQ ID NO: 1735454 - RNA, 18 nt, Salmonella enterica enterica serovar Typhi Ty2
cgauggccagaaugacau

SEQ ID NO: 1735455 - RNA, 14 nt, Salmonella enterica enterica serovar Typhi Ty2
cgcaagcggcguuc

SEQ ID NO: 1735456 - RNA, 16 nt, Salmonella enterica enterica serovar Typhi Ty2
cgcaacgcgcacggcg

SEQ ID NO: 1735457 - RNA, 13 nt, Salmonella enterica enterica serovar Typhi Ty2
cgcaaauucugua

SEQ ID NO: 1735458 - RNA, 20 nt, Salmonella enterica enterica serovar Typhi Ty2
cgauuuugaacaugcgcaga

SEQ ID NO: 1735459 - RNA, 20 nt, Salmonella enterica enterica serovar Typhi Ty2
cgcaccgucgagaaaccgcu

SEQ ID NO: 1735460 - RNA, 12 nt, Salmonella enterica enterica serovar Typhi Ty2
cgcacggcguua

SEQ ID NO: 1735461 - RNA, 15 nt, Salmonella enterica enterica serovar Typhi Ty2
cgcagcaaaucagcu

SEQ ID NO: 1735462 - RNA, 15 nt, Salmonella enterica enterica serovar Typhi Ty2
cgcagauacgcguca

SEQ ID NO: 1735463 - RNA, 13 nt, Salmonella enterica enterica serovar Typhi Ty2
cgcagauccagca

SEQ ID NO: 1735464 - RNA, 16 nt, Salmonella enterica enterica serovar Typhi Ty2
cgcagacgccgcgguu

SEQ ID NO: 1735465 - RNA, 17 nt, Salmonella enterica enterica serovar Typhi Ty2
cgcacugauagccgcca

SEQ ID NO: 1735466 - RNA, 17 nt, Salmonella enterica enterica serovar Typhi Ty2
cgcagagugagcaggcu

SEQ ID NO: 1735467 - RNA, 15 nt, Salmonella enterica enterica serovar Typhi Ty2
cgcagaguaucguug

SEQ ID NO: 1735468 - RNA, 17 nt, Salmonella enterica enterica serovar Typhi Ty2
cgcagacugcgccacgu

SEQ ID NO: 1735469 - RNA, 15 nt, Salmonella enterica enterica serovar Typhi Ty2
cgcagcaagaacaga

SEQ ID NO: 1735470 - RNA, 23 nt, Salmonella enterica enterica serovar Typhi Ty2
cgcagcaacgucucgacauuagc

SEQ ID NO: 1735471 - RNA, 17 nt, Salmonella enterica enterica serovar Typhi Ty2
cgcagcauaucgccguu

SEQ ID NO: 1735472 - RNA, 20 nt, Salmonella enterica enterica serovar Typhi Ty2
cgagcugucaccgacacgca

SEQ ID NO: 1735473 - RNA, 18 nt, Salmonella enterica enterica serovar Typhi Ty2
cgagcuguaccgucccua

SEQ ID NO: 1735474 - RNA, 21 nt, Salmonella enterica enterica serovar Typhi Ty2
cgagcgguuucucgacggugc

SEQ ID NO: 1735475 - RNA, 19 nt, Salmonella enterica enterica serovar Typhi Ty2
cgagcuuccaguucgcuga

SEQ ID NO: 1735476 - RNA, 15 nt, Salmonella enterica enterica serovar Typhi Ty2
cgaucacuaccgcca

SEQ ID NO: 1735477 - RNA, 13 nt, Salmonella enterica enterica serovar Typhi Ty2
cgaucagcgcgua

SEQ ID NO: 1735478 - RNA, 18 nt, Salmonella enterica enterica serovar Typhi Ty2
cgaucagcgcguagaugu

SEQ ID NO: 1735479 - RNA, 18 nt, Salmonella enterica enterica serovar Typhi Ty2
cgaucaguggcgccgcaa

SEQ ID NO: 1735480 - RNA, 12 nt, Salmonella enterica enterica serovar Typhi Ty2
cgauaaccgaug

SEQ ID NO: 1735481 - RNA, 15 nt, Salmonella enterica enterica serovar Typhi Ty2
cgauaacacggcugg

SEQ ID NO: 1735482 - RNA, 15 nt, Salmonella enterica enterica serovar Typhi Ty2
cgauaaauuucacgu

SEQ ID NO: 1735483 - RNA, 17 nt, Salmonella enterica enterica serovar Typhi Ty2
cgauaacccgcgcaugg

SEQ ID NO: 1735484 - RNA, 22 nt, Salmonella enterica enterica serovar Typhi Ty2
cgauaaucuccgccgugcguuu

SEQ ID NO: 1735485 - RNA, 16 nt, Salmonella enterica enterica serovar Typhi Ty2
cgauagacagcaccau

SEQ ID NO: 1735486 - RNA, 14 nt, Salmonella enterica enterica serovar Typhi Ty2
cgauacggauagcg

SEQ ID NO: 1735487 - RNA, 12 nt, Salmonella enterica enterica serovar Typhi Ty2
cgaucaaucacg

SEQ ID NO: 1735488 - RNA, 18 nt, Salmonella enterica enterica serovar Typhi Ty2
cgauaguguaaacgcgcc

SEQ ID NO: 1735489 - RNA, 18 nt, Salmonella enterica enterica serovar Typhi Ty2
cgauaggugccgccgcac

SEQ ID NO: 1735490 - RNA, 20 nt, Salmonella enterica enterica serovar Typhi Ty2
cgauagcauuuuuacucagc

SEQ ID NO: 1735491 - RNA, 12 nt, Salmonella enterica enterica serovar Typhi Ty2
cgauagcgccgg

SEQ ID NO: 1735492 - RNA, 18 nt, Salmonella enterica enterica serovar Typhi Ty2
cgaucccgggcgauaaac

SEQ ID NO: 1735493 - RNA, 15 nt, Salmonella enterica enterica serovar Typhi Ty2
cgaucccgggcgaua

SEQ ID NO: 1735494 - RNA, 14 nt, Salmonella enterica enterica serovar Typhi Ty2
cgaucaugccgccc

SEQ ID NO: 1735495 - RNA, 17 nt, Salmonella enterica enterica serovar Typhi Ty2
cgauccauauaaucaaa

SEQ ID NO: 1735496 - RNA, 16 nt, Salmonella enterica enterica serovar Typhi Ty2
cgaucccgccgcaucc

SEQ ID NO: 1735497 - RNA, 17 nt, Salmonella enterica enterica serovar Typhi Ty2
cgaucgcuaaucaggac

SEQ ID NO: 1735498 - RNA, 16 nt, Salmonella enterica enterica serovar Typhi Ty2
cgaucgagcgcaauac

SEQ ID NO: 1735499 - RNA, 12 nt, Salmonella enterica enterica serovar Typhi Ty2
cgaucgauaaag

SEQ ID NO: 1735500 - RNA, 16 nt, Salmonella enterica enterica serovar Typhi Ty2
cgaucgccuaauccgc

SEQ ID NO: 1735501 - RNA, 21 nt, Salmonella enterica enterica serovar Typhi Ty2
cgaucgccccgaccaggauga

SEQ ID NO: 1735502 - RNA, 12 nt, Salmonella enterica enterica serovar Typhi Ty2
cgaucugaaugc

SEQ ID NO: 1735503 - RNA, 17 nt, Salmonella enterica enterica serovar Typhi Ty2
cgaugacgccugccaga

SEQ ID NO: 1735504 - RNA, 20 nt, Salmonella enterica enterica serovar Typhi Ty2
cgaucgguaggccggauaag

SEQ ID NO: 1735505 - RNA, 19 nt, Salmonella enterica enterica serovar Typhi Ty2
cgaugaucgucgcgaucgc

SEQ ID NO: 1735506 - RNA, 17 nt, Salmonella enterica enterica serovar Typhi Ty2
cgaugccuuauccggcc

SEQ ID NO: 1735507 - RNA, 14 nt, Salmonella enterica enterica serovar Typhi Ty2
cgaaauugccgccc

SEQ ID NO: 1735508 - RNA, 13 nt, Salmonella enterica enterica serovar Typhi Ty2
cgaaauaaucagg

SEQ ID NO: 1735509 - RNA, 23 nt, Salmonella enterica enterica serovar Typhi Ty2
cgaaauccgcgccgccgccgaag

SEQ ID NO: 1735510 - RNA, 19 nt, Salmonella enterica enterica serovar Typhi Ty2
cgaacagcggcaggcggaa

SEQ ID NO: 1735511 - RNA, 19 nt, Salmonella enterica enterica serovar Typhi Ty2
cgaacaggcucagcgccac

SEQ ID NO: 1735512 - RNA, 19 nt, Salmonella enterica enterica serovar Typhi Ty2
cgaaccggcaucggcagcg

SEQ ID NO: 1735513 - RNA, 21 nt, Salmonella enterica enterica serovar Typhi Ty2
cgaaccguggccuccggcaga

SEQ ID NO: 1735514 - RNA, 13 nt, Salmonella enterica enterica serovar Typhi Ty2
cgaacauuucagc

SEQ ID NO: 1735515 - RNA, 14 nt, Salmonella enterica enterica serovar Typhi Ty2
cgaacaugccgacg

SEQ ID NO: 1735516 - RNA, 19 nt, Salmonella enterica enterica serovar Typhi Ty2
cgaacauccuugcacgcca

SEQ ID NO: 1735517 - RNA, 14 nt, Salmonella enterica enterica serovar Typhi Ty2
cgaacaugccgccg

SEQ ID NO: 1735518 - RNA, 17 nt, Salmonella enterica enterica serovar Typhi Ty2
cgaacaugcggauaucg

SEQ ID NO: 1735519 - RNA, 17 nt, Salmonella enterica enterica serovar Typhi Ty2
cgaagccgcgggcggua

SEQ ID NO: 1735520 - RNA, 19 nt, Salmonella enterica enterica serovar Typhi Ty2
cgaagcgucauccggcaau

SEQ ID NO: 1735521 - RNA, 16 nt, Salmonella enterica enterica serovar Typhi Ty2
cgaagcgaauagcgua

SEQ ID NO: 1735522 - RNA, 19 nt, Salmonella enterica enterica serovar Typhi Ty2
cgaaguagauuacgaaugu

SEQ ID NO: 1735523 - RNA, 19 nt, Salmonella enterica enterica serovar Typhi Ty2
cgaauauucauuuccagca

SEQ ID NO: 1735524 - RNA, 18 nt, Salmonella enterica enterica serovar Typhi Ty2
cgaauauacgcaccugau

SEQ ID NO: 1735525 - RNA, 22 nt, Salmonella enterica enterica serovar Typhi Ty2
cgaauaguggcgcgccagcgau

SEQ ID NO: 1735526 - RNA, 21 nt, Salmonella enterica enterica serovar Typhi Ty2
ccuugcggugagaaacgcgcc

SEQ ID NO: 1735527 - RNA, 13 nt, Salmonella enterica enterica serovar Typhi Ty2
ccuugucguaaua

SEQ ID NO: 1735528 - RNA, 21 nt, Salmonella enterica enterica serovar Typhi Ty2
cgaaaaguguguaccagcagc

SEQ ID NO: 1735529 - RNA, 15 nt, Salmonella enterica enterica serovar Typhi Ty2
cgaaaaugcgcauga

SEQ ID NO: 1735530 - RNA, 18 nt, Salmonella enterica enterica serovar Typhi Ty2
cgaaaacagcuggcgaua

SEQ ID NO: 1735531 - RNA, 16 nt, Salmonella enterica enterica serovar Typhi Ty2
cgaaaaggccuggcug

SEQ ID NO: 1735532 - RNA, 13 nt, Salmonella enterica enterica serovar Typhi Ty2
cgaaacggcggaa

SEQ ID NO: 1735533 - RNA, 15 nt, Salmonella enterica enterica serovar Typhi Ty2
cgaaacuccagcgau

SEQ ID NO: 1735534 - RNA, 19 nt, Salmonella enterica enterica serovar Typhi Ty2
cgaaagcacuucucgcgca

SEQ ID NO: 1735535 - RNA, 13 nt, Salmonella enterica enterica serovar Typhi Ty2
cgaaaccagcaua

SEQ ID NO: 1735536 - RNA, 15 nt, Salmonella enterica enterica serovar Typhi Ty2
ccuucgacaaucagc

SEQ ID NO: 1735537 - RNA, 18 nt, Salmonella enterica enterica serovar Typhi Ty2
ccuuccaguaguaaaccg

SEQ ID NO: 1735538 - RNA, 15 nt, Salmonella enterica enterica serovar Typhi Ty2
ccuucauacugcgga

SEQ ID NO: 1735539 - RNA, 15 nt, Salmonella enterica enterica serovar Typhi Ty2
ccuucuuuaugcgcc

SEQ ID NO: 1735540 - RNA, 15 nt, Salmonella enterica enterica serovar Typhi Ty2
ccuugaccgccugau

SEQ ID NO: 1735541 - RNA, 15 nt, Salmonella enterica enterica serovar Typhi Ty2
ccuucuucgccguca

SEQ ID NO: 1735542 - RNA, 17 nt, Salmonella enterica enterica serovar Typhi Ty2
ccuucuccuucgccaaa

SEQ ID NO: 1735543 - RNA, 18 nt, Salmonella enterica enterica serovar Typhi Ty2
ccuucgucaggaggccug

SEQ ID NO: 1735544 - RNA, 13 nt, Salmonella enterica enterica serovar Typhi Ty2
ccuucguccggau

SEQ ID NO: 1735545 - RNA, 22 nt, Salmonella enterica enterica serovar Typhi Ty2
ccuucaacccagcagcagauaa

SEQ ID NO: 1735546 - RNA, 19 nt, Salmonella enterica enterica serovar Typhi Ty2
ccuuauuuuucagcgccag

SEQ ID NO: 1735547 - RNA, 17 nt, Salmonella enterica enterica serovar Typhi Ty2
ccuucacucuucgacau

SEQ ID NO: 1735548 - RNA, 18 nt, Salmonella enterica enterica serovar Typhi Ty2
ccuguuucugcgccgcuu

SEQ ID NO: 1735549 - RNA, 24 nt, Salmonella enterica enterica serovar Typhi Ty2
ccuguuuaaaaucaacgcucagac

SEQ ID NO: 1735550 - RNA, 14 nt, Salmonella enterica enterica serovar Typhi Ty2
ccuguucaucggcu

SEQ ID NO: 1735551 - RNA, 19 nt, Salmonella enterica enterica serovar Typhi Ty2
ccugugucggcagaugaug

SEQ ID NO: 1735552 - RNA, 21 nt, Salmonella enterica enterica serovar Typhi Ty2
ccugucguccucaggccggau

SEQ ID NO: 1735553 - RNA, 15 nt, Salmonella enterica enterica serovar Typhi Ty2
cgaccaccauccggc

SEQ ID NO: 1735554 - RNA, 20 nt, Salmonella enterica enterica serovar Typhi Ty2
cgaccacccgcgaccagguc

SEQ ID NO: 1735555 - RNA, 15 nt, Salmonella enterica enterica serovar Typhi Ty2
cgaccagaugcagca

SEQ ID NO: 1735556 - RNA, 17 nt, Salmonella enterica enterica serovar Typhi Ty2
cgaccagcgucagccag

SEQ ID NO: 1735557 - RNA, 22 nt, Salmonella enterica enterica serovar Typhi Ty2
cgaccauuguuguaagggcugg

SEQ ID NO: 1735558 - RNA, 14 nt, Salmonella enterica enterica serovar Typhi Ty2
cgacaugcgcaugu

SEQ ID NO: 1735559 - RNA, 17 nt, Salmonella enterica enterica serovar Typhi Ty2
cgacaugcuccugcauc

SEQ ID NO: 1735560 - RNA, 15 nt, Salmonella enterica enterica serovar Typhi Ty2
cgacauaaccggcaa

SEQ ID NO: 1735561 - RNA, 12 nt, Salmonella enterica enterica serovar Typhi Ty2
cgacauacgcgc

SEQ ID NO: 1735562 - RNA, 14 nt, Salmonella enterica enterica serovar Typhi Ty2
cgacaaccagcgaa

SEQ ID NO: 1735563 - RNA, 13 nt, Salmonella enterica enterica serovar Typhi Ty2
cgacauaaacauu

SEQ ID NO: 1735564 - RNA, 23 nt, Salmonella enterica enterica serovar Typhi Ty2
cgacauauuugcgugucaucaaa

SEQ ID NO: 1735565 - RNA, 15 nt, Salmonella enterica enterica serovar Typhi Ty2
cgacauacauaacgc

SEQ ID NO: 1735566 - RNA, 16 nt, Salmonella enterica enterica serovar Typhi Ty2
cgaaugccugcauaua

SEQ ID NO: 1735567 - RNA, 19 nt, Salmonella enterica enterica serovar Typhi Ty2
cgacaaaagccagauaaag

SEQ ID NO: 1735568 - RNA, 14 nt, Salmonella enterica enterica serovar Typhi Ty2
cgaccguauccgcc

SEQ ID NO: 1735569 - RNA, 22 nt, Salmonella enterica enterica serovar Typhi Ty2
cgaccguauccgccaccaugau

SEQ ID NO: 1735570 - RNA, 15 nt, Salmonella enterica enterica serovar Typhi Ty2
cgaccgucagcagca

SEQ ID NO: 1735571 - RNA, 21 nt, Salmonella enterica enterica serovar Typhi Ty2
cgaccucgcagguacgacacc

SEQ ID NO: 1735572 - RNA, 15 nt, Salmonella enterica enterica serovar Typhi Ty2
cgaccggcagcguca

SEQ ID NO: 1735573 - RNA, 19 nt, Salmonella enterica enterica serovar Typhi Ty2
cgaccuguagaugaaacuc

SEQ ID NO: 1735574 - RNA, 21 nt, Salmonella enterica enterica serovar Typhi Ty2
cgaccuguucaaaauugccac

SEQ ID NO: 1735575 - RNA, 16 nt, Salmonella enterica enterica serovar Typhi Ty2
cgacgaauggcggcgu

SEQ ID NO: 1735576 - RNA, 15 nt, Salmonella enterica enterica serovar Typhi Ty2
cgacgaucagcgcca

SEQ ID NO: 1735577 - RNA, 15 nt, Salmonella enterica enterica serovar Typhi Ty2
cgacgauaaacagau

SEQ ID NO: 1735578 - RNA, 19 nt, Salmonella enterica enterica serovar Typhi Ty2
cgacgaucagcgccacgca

SEQ ID NO: 1735579 - RNA, 15 nt, Salmonella enterica enterica serovar Typhi Ty2
cgagacugcccggca

SEQ ID NO: 1735580 - RNA, 15 nt, Salmonella enterica enterica serovar Typhi Ty2
cgagaagucggcuuu

SEQ ID NO: 1735581 - RNA, 14 nt, Salmonella enterica enterica serovar Typhi Ty2
cgagaaugucgcca

SEQ ID NO: 1735582 - RNA, 14 nt, Salmonella enterica enterica serovar Typhi Ty2
cgacugccgcagac

SEQ ID NO: 1735583 - RNA, 22 nt, Salmonella enterica enterica serovar Typhi Ty2
cgagagauuaagcgaaccuuaa

SEQ ID NO: 1735584 - RNA, 15 nt, Salmonella enterica enterica serovar Typhi Ty2
cgacugaccagacag

SEQ ID NO: 1735585 - RNA, 17 nt, Salmonella enterica enterica serovar Typhi Ty2
cgacucggcgaucacca

SEQ ID NO: 1735586 - RNA, 19 nt, Salmonella enterica enterica serovar Typhi Ty2
cgacuauuccgcaaacgcc

SEQ ID NO: 1735587 - RNA, 16 nt, Salmonella enterica enterica serovar Typhi Ty2
aacacaaucaggcgca

SEQ ID NO: 1735588 - RNA, 22 nt, Salmonella enterica enterica serovar Typhi Ty2
aacaauagaccugaaaucagcc

SEQ ID NO: 1735589 - RNA, 14 nt, Salmonella enterica enterica serovar Typhi Ty2
cgacgucaacggua

SEQ ID NO: 1735590 - RNA, 14 nt, Salmonella enterica enterica serovar Typhi Ty2
cgacggccauaaac

SEQ ID NO: 1735591 - RNA, 17 nt, Salmonella enterica enterica serovar Typhi Ty2
cgacggcgaccggcaaa

SEQ ID NO: 1735592 - RNA, 14 nt, Salmonella enterica enterica serovar Typhi Ty2
cgacgcuucacgua

SEQ ID NO: 1735593 - RNA, 14 nt, Salmonella enterica enterica serovar Typhi Ty2
cgacgcuguuuaug

SEQ ID NO: 1735594 - RNA, 13 nt, Salmonella enterica enterica serovar Typhi Ty2
cgacgccagccag

SEQ ID NO: 1735595 - RNA, 23 nt, Salmonella enterica enterica serovar Typhi Ty2
cgacgcauugagacaugccgcca

SEQ ID NO: 1735596 - RNA, 13 nt, Salmonella enterica enterica serovar Typhi Ty2
cgacggggcguua

SEQ ID NO: 1735597 - RNA, 21 nt, Salmonella enterica enterica serovar Typhi Ty2
cgacguaacugucuuauccgg

SEQ ID NO: 1735598 - RNA, 21 nt, Salmonella enterica enterica serovar Typhi Ty2
cgacguaacgguguuucaucu

SEQ ID NO: 1735599 - RNA, 15 nt, Salmonella enterica enterica serovar Typhi Ty2
cgggccauucgccau

SEQ ID NO: 1735600 - RNA, 17 nt, Salmonella enterica enterica serovar Typhi Ty2
cgggcagacaucgccgu

SEQ ID NO: 1735601 - RNA, 22 nt, Salmonella enterica enterica serovar Typhi Ty2
cgggcagacaugaccgcacagc

SEQ ID NO: 1735602 - RNA, 17 nt, Salmonella enterica enterica serovar Typhi Ty2
cgggcaagcgaagcgcc

SEQ ID NO: 1735603 - RNA, 23 nt, Salmonella enterica enterica serovar Typhi Ty2
cgggcagcaucucgauuacagcg

SEQ ID NO: 1735604 - RNA, 22 nt, Salmonella enterica enterica serovar Typhi Ty2
aacaugccugauggcgcugcgc

SEQ ID NO: 1735605 - RNA, 16 nt, Salmonella enterica enterica serovar Typhi Ty2
aacaugucaaaauccu

SEQ ID NO: 1735606 - RNA, 15 nt, Salmonella enterica enterica serovar Typhi Ty2
cgggauagcacuacc

SEQ ID NO: 1735607 - RNA, 19 nt, Salmonella enterica enterica serovar Typhi Ty2
cgggacggcggccagcauu

SEQ ID NO: 1735608 - RNA, 17 nt, Salmonella enterica enterica serovar Typhi Ty2
cgggacguuucgauaac

SEQ ID NO: 1735609 - RNA, 17 nt, Salmonella enterica enterica serovar Typhi Ty2
cgggagaaaacgcggcc

SEQ ID NO: 1735610 - RNA, 21 nt, Salmonella enterica enterica serovar Typhi Ty2
cggcugaggcuuugagcguca

SEQ ID NO: 1735611 - RNA, 20 nt, Salmonella enterica enterica serovar Typhi Ty2
cggcugaggcuuugagcguc

SEQ ID NO: 1735612 - RNA, 19 nt, Salmonella enterica enterica serovar Typhi Ty2
cggcugacacucauccaga

SEQ ID NO: 1735613 - RNA, 12 nt, Salmonella enterica enterica serovar Typhi Ty2
cggcugaagcug

SEQ ID NO: 1735614 - RNA, 13 nt, Salmonella enterica enterica serovar Typhi Ty2
cggcuggcuauag

SEQ ID NO: 1735615 - RNA, 13 nt, Salmonella enterica enterica serovar Typhi Ty2
cggcuguucacgu

SEQ ID NO: 1735616 - RNA, 21 nt, Salmonella enterica enterica serovar Typhi Ty2
cggcuguugguuuaucgccga

SEQ ID NO: 1735617 - RNA, 18 nt, Salmonella enterica enterica serovar Typhi Ty2
cggcuuaaauggcgcugu

SEQ ID NO: 1735618 - RNA, 23 nt, Salmonella enterica enterica serovar Typhi Ty2
cggcuuaaccucgcuacuggcaa

SEQ ID NO: 1735619 - RNA, 15 nt, Salmonella enterica enterica serovar Typhi Ty2
cggcuuguuaugcgg

SEQ ID NO: 1735620 - RNA, 17 nt, Salmonella enterica enterica serovar Typhi Ty2
cggcuuuaaugccgccg

SEQ ID NO: 1735621 - RNA, 19 nt, Salmonella enterica enterica serovar Typhi Ty2
cgggaaacuguuugaacga

SEQ ID NO: 1735622 - RNA, 18 nt, Salmonella enterica enterica serovar Typhi Ty2
cgggaaagggcggcagcg

SEQ ID NO: 1735623 - RNA, 16 nt, Salmonella enterica enterica serovar Typhi Ty2
cgggaacaugcauauu

SEQ ID NO: 1735624 - RNA, 22 nt, Salmonella enterica enterica serovar Typhi Ty2
cggcuuucuuucuccagcguac

SEQ ID NO: 1735625 - RNA, 16 nt, Salmonella enterica enterica serovar Typhi Ty2
cggcuuuuaucgacag

SEQ ID NO: 1735626 - RNA, 22 nt, Salmonella enterica enterica serovar Typhi Ty2
cgggaagagagaaaaucggcgg

SEQ ID NO: 1735627 - RNA, 16 nt, Salmonella enterica enterica serovar Typhi Ty2
cggguaaauagacguc

SEQ ID NO: 1735628 - RNA, 21 nt, Salmonella enterica enterica serovar Typhi Ty2
cggggucuuccagcagaucca

SEQ ID NO: 1735629 - RNA, 22 nt, Salmonella enterica enterica serovar Typhi Ty2
cggggcuuuugagucgcaucca

SEQ ID NO: 1735630 - RNA, 15 nt, Salmonella enterica enterica serovar Typhi Ty2
cggggauggcggauu

SEQ ID NO: 1735631 - RNA, 18 nt, Salmonella enterica enterica serovar Typhi Ty2
cggggcgcaaaaucgcaa

SEQ ID NO: 1735632 - RNA, 15 nt, Salmonella enterica enterica serovar Typhi Ty2
cgggcgauaaccucu

SEQ ID NO: 1735633 - RNA, 19 nt, Salmonella enterica enterica serovar Typhi Ty2
cgggcgcuaaacccaacgu

SEQ ID NO: 1735634 - RNA, 13 nt, Salmonella enterica enterica serovar Typhi Ty2
cgggcgcugguga

SEQ ID NO: 1735635 - RNA, 16 nt, Salmonella enterica enterica serovar Typhi Ty2
cgggccugugccugac

SEQ ID NO: 1735636 - RNA, 15 nt, Salmonella enterica enterica serovar Typhi Ty2
cgggcucacgcuggu

SEQ ID NO: 1735637 - RNA, 15 nt, Salmonella enterica enterica serovar Typhi Ty2
cgggcugcacgccau

SEQ ID NO: 1735638 - RNA, 14 nt, Salmonella enterica enterica serovar Typhi Ty2
cggcggcguacagc

SEQ ID NO: 1735639 - RNA, 23 nt, Salmonella enterica enterica serovar Typhi Ty2
cggcggccuaugacuauaucagc

SEQ ID NO: 1735640 - RNA, 21 nt, Salmonella enterica enterica serovar Typhi Ty2
cggcgguuauccgccagcgca

SEQ ID NO: 1735641 - RNA, 20 nt, Salmonella enterica enterica serovar Typhi Ty2
cggcguagcgcguucagggu

SEQ ID NO: 1735642 - RNA, 16 nt, Salmonella enterica enterica serovar Typhi Ty2
cggcgcgguuuccggu

SEQ ID NO: 1735643 - RNA, 13 nt, Salmonella enterica enterica serovar Typhi Ty2
cggcgcgccgcug

SEQ ID NO: 1735644 - RNA, 22 nt, Salmonella enterica enterica serovar Typhi Ty2
cggcggaaaauagccagaaugc

SEQ ID NO: 1735645 - RNA, 23 nt, Salmonella enterica enterica serovar Typhi Ty2
cggcggaaccauuuuccccagaa

SEQ ID NO: 1735646 - RNA, 18 nt, Salmonella enterica enterica serovar Typhi Ty2
cggcggcaagcuggcgaa

SEQ ID NO: 1735647 - RNA, 15 nt, Salmonella enterica enterica serovar Typhi Ty2
cggcgccaucaccau

SEQ ID NO: 1735648 - RNA, 19 nt, Salmonella enterica enterica serovar Typhi Ty2
cggcgauggugcggcgcac

SEQ ID NO: 1735649 - RNA, 16 nt, Salmonella enterica enterica serovar Typhi Ty2
cggcgaaaccgauuuc

SEQ ID NO: 1735650 - RNA, 11 nt, Salmonella enterica enterica serovar Typhi Ty2
cggaucgggcu

SEQ ID NO: 1735651 - RNA, 16 nt, Salmonella enterica enterica serovar Typhi Ty2
cggaucgugauaacgc

SEQ ID NO: 1735652 - RNA, 18 nt, Salmonella enterica enterica serovar Typhi Ty2
cggaugccauauucaacg

SEQ ID NO: 1735653 - RNA, 19 nt, Salmonella enterica enterica serovar Typhi Ty2
cggaugauggccuggcgga

SEQ ID NO: 1735654 - RNA, 19 nt, Salmonella enterica enterica serovar Typhi Ty2
cggaucgaucucgauauuc

SEQ ID NO: 1735655 - RNA, 19 nt, Salmonella enterica enterica serovar Typhi Ty2
cggaucgcaagauccugau

SEQ ID NO: 1735656 - RNA, 12 nt, Salmonella enterica enterica serovar Typhi Ty2
cggaucgcguuu

SEQ ID NO: 1735657 - RNA, 18 nt, Salmonella enterica enterica serovar Typhi Ty2
cggauggcggcuaacgcc

SEQ ID NO: 1735658 - RNA, 20 nt, Salmonella enterica enterica serovar Typhi Ty2
cggauggcaguacagggcga

SEQ ID NO: 1735659 - RNA, 18 nt, Salmonella enterica enterica serovar Typhi Ty2
cggauuagcgacagcgcu

SEQ ID NO: 1735660 - RNA, 15 nt, Salmonella enterica enterica serovar Typhi Ty2
cggauuaugcgcuuu

SEQ ID NO: 1735661 - RNA, 17 nt, Salmonella enterica enterica serovar Typhi Ty2
cggauuaacaagcagau

SEQ ID NO: 1735662 - RNA, 20 nt, Salmonella enterica enterica serovar Typhi Ty2
cggauuaagcgaauccagcg

SEQ ID NO: 1735663 - RNA, 22 nt, Salmonella enterica enterica serovar Typhi Ty2
cggauugccgcgcucaaucuga

SEQ ID NO: 1735664 - RNA, 19 nt, Salmonella enterica enterica serovar Typhi Ty2
cggauucgacugcggucgu

SEQ ID NO: 1735665 - RNA, 16 nt, Salmonella enterica enterica serovar Typhi Ty2
cggauucaauauugaa

SEQ ID NO: 1735666 - RNA, 15 nt, Salmonella enterica enterica serovar Typhi Ty2
cggcaaacagcuuca

SEQ ID NO: 1735667 - RNA, 22 nt, Salmonella enterica enterica serovar Typhi Ty2
cggcaaaauaaauauccuccgg

SEQ ID NO: 1735668 - RNA, 20 nt, Salmonella enterica enterica serovar Typhi Ty2
cggcaaaauaguucagcgca

SEQ ID NO: 1735669 - RNA, 18 nt, Salmonella enterica enterica serovar Typhi Ty2
cggcaaacacaaucacgc

SEQ ID NO: 1735670 - RNA, 12 nt, Salmonella enterica enterica serovar Typhi Ty2
cggauuugcugc

SEQ ID NO: 1735671 - RNA, 20 nt, Salmonella enterica enterica serovar Typhi Ty2
cggcaaagguugccgcaaua

SEQ ID NO: 1735672 - RNA, 17 nt, Salmonella enterica enterica serovar Typhi Ty2
cggcaaagguugccgca

SEQ ID NO: 1735673 - RNA, 17 nt, Salmonella enterica enterica serovar Typhi Ty2
cggcaaacauagccuca

SEQ ID NO: 1735674 - RNA, 19 nt, Salmonella enterica enterica serovar Typhi Ty2
cggcaaaccuaccggcaua

SEQ ID NO: 1735675 - RNA, 17 nt, Salmonella enterica enterica serovar Typhi Ty2
aacagguugcguaacgc

SEQ ID NO: 1735676 - RNA, 16 nt, Salmonella enterica enterica serovar Typhi Ty2
aacagguuaaucagca

SEQ ID NO: 1735677 - RNA, 15 nt, Salmonella enterica enterica serovar Typhi Ty2
cggcaccagcaauga

SEQ ID NO: 1735678 - RNA, 15 nt, Salmonella enterica enterica serovar Typhi Ty2
cggcaauuaccgcca

SEQ ID NO: 1735679 - RNA, 20 nt, Salmonella enterica enterica serovar Typhi Ty2
cggcaauuaaccgauaacgc

SEQ ID NO: 1735680 - RNA, 24 nt, Salmonella enterica enterica serovar Typhi Ty2
cggcaaugggguuuguccugcagc

SEQ ID NO: 1735681 - RNA, 20 nt, Salmonella enterica enterica serovar Typhi Ty2
cggcacaaugcccggcauac

SEQ ID NO: 1735682 - RNA, 15 nt, Salmonella enterica enterica serovar Typhi Ty2
cggcaauuuccggcg

SEQ ID NO: 1735683 - RNA, 17 nt, Salmonella enterica enterica serovar Typhi Ty2
cggcaauggccagauga

SEQ ID NO: 1735684 - RNA, 21 nt, Salmonella enterica enterica serovar Typhi Ty2
cggcacauucaccacgcagcc

SEQ ID NO: 1735685 - RNA, 13 nt, Salmonella enterica enterica serovar Typhi Ty2
cggcaaucaauac

SEQ ID NO: 1735686 - RNA, 16 nt, Salmonella enterica enterica serovar Typhi Ty2
cggcaauauugccgca

SEQ ID NO: 1735687 - RNA, 20 nt, Salmonella enterica enterica serovar Typhi Ty2
cggcaaugcucugcagguca

SEQ ID NO: 1735688 - RNA, 17 nt, Salmonella enterica enterica serovar Typhi Ty2
cggcaagcaucugauau

SEQ ID NO: 1735689 - RNA, 18 nt, Salmonella enterica enterica serovar Typhi Ty2
cggcaaggucugcgccca

SEQ ID NO: 1735690 - RNA, 22 nt, Salmonella enterica enterica serovar Typhi Ty2
cggcaagagauucaggccgcca

SEQ ID NO: 1735691 - RNA, 12 nt, Salmonella enterica enterica serovar Typhi Ty2
cggcaacccgcu

SEQ ID NO: 1735692 - RNA, 16 nt, Salmonella enterica enterica serovar Typhi Ty2
cggcaaauccuccaua

SEQ ID NO: 1735693 - RNA, 17 nt, Salmonella enterica enterica serovar Typhi Ty2
cggcaaauaccgucaua

SEQ ID NO: 1735694 - RNA, 22 nt, Salmonella enterica enterica serovar Typhi Ty2
cggcaacauaaauaaacagcgc

SEQ ID NO: 1735695 - RNA, 24 nt, Salmonella enterica enterica serovar Typhi Ty2
cgcugacgccaggccaucgacgaa

SEQ ID NO: 1735696 - RNA, 20 nt, Salmonella enterica enterica serovar Typhi Ty2
cgcugacgaucaugccgccc

SEQ ID NO: 1735697 - RNA, 21 nt, Salmonella enterica enterica serovar Typhi Ty2
cgcugagcggcucauccagca

SEQ ID NO: 1735698 - RNA, 23 nt, Salmonella enterica enterica serovar Typhi Ty2
cggacauaaaggaaaugccgggc

SEQ ID NO: 1735699 - RNA, 14 nt, Salmonella enterica enterica serovar Typhi Ty2
cggacgcaccagcc

SEQ ID NO: 1735700 - RNA, 19 nt, Salmonella enterica enterica serovar Typhi Ty2
cggacgagcgcgucagcgc

SEQ ID NO: 1735701 - RNA, 19 nt, Salmonella enterica enterica serovar Typhi Ty2
cggacgaacaacaucagac

SEQ ID NO: 1735702 - RNA, 21 nt, Salmonella enterica enterica serovar Typhi Ty2
cggacugauagcgaggcagca

SEQ ID NO: 1735703 - RNA, 13 nt, Salmonella enterica enterica serovar Typhi Ty2
cggacucggcuga

SEQ ID NO: 1735704 - RNA, 20 nt, Salmonella enterica enterica serovar Typhi Ty2
cggacguaccgcuuuaucau

SEQ ID NO: 1735705 - RNA, 15 nt, Salmonella enterica enterica serovar Typhi Ty2
cggagagacauuggu

SEQ ID NO: 1735706 - RNA, 17 nt, Salmonella enterica enterica serovar Typhi Ty2
cggagauuaacagcgcg

SEQ ID NO: 1735707 - RNA, 21 nt, Salmonella enterica enterica serovar Typhi Ty2
cggagaacgguucauccagca

SEQ ID NO: 1735708 - RNA, 14 nt, Salmonella enterica enterica serovar Typhi Ty2
cggagaacggcaca

SEQ ID NO: 1735709 - RNA, 18 nt, Salmonella enterica enterica serovar Typhi Ty2
cggagcggcguccgccag

SEQ ID NO: 1735710 - RNA, 13 nt, Salmonella enterica enterica serovar Typhi Ty2
cggauaacgcgcu

SEQ ID NO: 1735711 - RNA, 20 nt, Salmonella enterica enterica serovar Typhi Ty2
cggauaagcggcagcgccau

SEQ ID NO: 1735712 - RNA, 19 nt, Salmonella enterica enterica serovar Typhi Ty2
cggauaagcggcagcgcca

SEQ ID NO: 1735713 - RNA, 19 nt, Salmonella enterica enterica serovar Typhi Ty2
cggauaagcgcagcgccau

SEQ ID NO: 1735714 - RNA, 17 nt, Salmonella enterica enterica serovar Typhi Ty2
cggauaagcggcagcgc

SEQ ID NO: 1735715 - RNA, 18 nt, Salmonella enterica enterica serovar Typhi Ty2
cggauaagcgcagcgcca

SEQ ID NO: 1735716 - RNA, 19 nt, Salmonella enterica enterica serovar Typhi Ty2
cggauaagcauuagcgcca

SEQ ID NO: 1735717 - RNA, 15 nt, Salmonella enterica enterica serovar Typhi Ty2
cggagucuuauccga

SEQ ID NO: 1735718 - RNA, 22 nt, Salmonella enterica enterica serovar Typhi Ty2
cggauagcggcuucgccagauc

SEQ ID NO: 1735719 - RNA, 21 nt, Salmonella enterica enterica serovar Typhi Ty2
cggauagcucgcuguagcgcc

SEQ ID NO: 1735720 - RNA, 16 nt, Salmonella enterica enterica serovar Typhi Ty2
cggauagcguagcgcc

SEQ ID NO: 1735721 - RNA, 18 nt, Salmonella enterica enterica serovar Typhi Ty2
cggauagcggcuucgcca

SEQ ID NO: 1735722 - RNA, 19 nt, Salmonella enterica enterica serovar Typhi Ty2
cggauaagcgugagcgcau

SEQ ID NO: 1735723 - RNA, 11 nt, Salmonella enterica enterica serovar Typhi Ty2
cggauaagcgu

SEQ ID NO: 1735724 - RNA, 20 nt, Salmonella enterica enterica serovar Typhi Ty2
cggauaaggcggagccgcca

SEQ ID NO: 1735725 - RNA, 16 nt, Salmonella enterica enterica serovar Typhi Ty2
cggaucaccggcauuu

SEQ ID NO: 1735726 - RNA, 14 nt, Salmonella enterica enterica serovar Typhi Ty2
cggauaucgcuauc

SEQ ID NO: 1735727 - RNA, 21 nt, Salmonella enterica enterica serovar Typhi Ty2
cggccagauaaguuugcagau

SEQ ID NO: 1735728 - RNA, 23 nt, Salmonella enterica enterica serovar Typhi Ty2
cggccagacaauacuuaaaccug

SEQ ID NO: 1735729 - RNA, 17 nt, Salmonella enterica enterica serovar Typhi Ty2
cggccacuccgccacaa

SEQ ID NO: 1735730 - RNA, 15 nt, Salmonella enterica enterica serovar Typhi Ty2
cggccacgguguggc

SEQ ID NO: 1735731 - RNA, 18 nt, Salmonella enterica enterica serovar Typhi Ty2
cggcauauucccugacug

SEQ ID NO: 1735732 - RNA, 17 nt, Salmonella enterica enterica serovar Typhi Ty2
cggcauaugcaggucgc

SEQ ID NO: 1735733 - RNA, 11 nt, Salmonella enterica enterica serovar Typhi Ty2
cggcaucacgc

SEQ ID NO: 1735734 - RNA, 18 nt, Salmonella enterica enterica serovar Typhi Ty2
cggcaucauaaaucgaca

SEQ ID NO: 1735735 - RNA, 23 nt, Salmonella enterica enterica serovar Typhi Ty2
cggcagguagucauauucacggc

SEQ ID NO: 1735736 - RNA, 15 nt, Salmonella enterica enterica serovar Typhi Ty2
cggcaggcagcgcca

SEQ ID NO: 1735737 - RNA, 21 nt, Salmonella enterica enterica serovar Typhi Ty2
cggcaggaucgggaucagcgc

SEQ ID NO: 1735738 - RNA, 13 nt, Salmonella enterica enterica serovar Typhi Ty2
aacaguaaucgca

SEQ ID NO: 1735739 - RNA, 18 nt, Salmonella enterica enterica serovar Typhi Ty2
cggccacccauccccaua

SEQ ID NO: 1735740 - RNA, 13 nt, Salmonella enterica enterica serovar Typhi Ty2
cggccacagccau

SEQ ID NO: 1735741 - RNA, 17 nt, Salmonella enterica enterica serovar Typhi Ty2
cggccacagcgccagac

SEQ ID NO: 1735742 - RNA, 19 nt, Salmonella enterica enterica serovar Typhi Ty2
cggcauuaugcaggcgucg

SEQ ID NO: 1735743 - RNA, 18 nt, Salmonella enterica enterica serovar Typhi Ty2
cggcaugucgccagccag

SEQ ID NO: 1735744 - RNA, 15 nt, Salmonella enterica enterica serovar Typhi Ty2
cggccuccgcuuccu

SEQ ID NO: 1735745 - RNA, 15 nt, Salmonella enterica enterica serovar Typhi Ty2
cggccgguuucacca

SEQ ID NO: 1735746 - RNA, 19 nt, Salmonella enterica enterica serovar Typhi Ty2
cggccuucgcagaucgccu

SEQ ID NO: 1735747 - RNA, 18 nt, Salmonella enterica enterica serovar Typhi Ty2
cgcgaugagcugcgauaa

SEQ ID NO: 1735748 - RNA, 15 nt, Salmonella enterica enterica serovar Typhi Ty2
cgcgaugacucguau

SEQ ID NO: 1735749 - RNA, 14 nt, Salmonella enterica enterica serovar Typhi Ty2
cgcgauggcgucac

SEQ ID NO: 1735750 - RNA, 16 nt, Salmonella enterica enterica serovar Typhi Ty2
cgcgaugccuggcgau

SEQ ID NO: 1735751 - RNA, 23 nt, Salmonella enterica enterica serovar Typhi Ty2
cgcgagaccaucgcgugacgcag

SEQ ID NO: 1735752 - RNA, 21 nt, Salmonella enterica enterica serovar Typhi Ty2
cgcgauacccgcgaucacuac

SEQ ID NO: 1735753 - RNA, 23 nt, Salmonella enterica enterica serovar Typhi Ty2
cgcgauacgcagcaccgccgcga

SEQ ID NO: 1735754 - RNA, 20 nt, Salmonella enterica enterica serovar Typhi Ty2
cgcgauauguuugcgcgucg

SEQ ID NO: 1735755 - RNA, 18 nt, Salmonella enterica enterica serovar Typhi Ty2
cgcgacguccgccaacag

SEQ ID NO: 1735756 - RNA, 13 nt, Salmonella enterica enterica serovar Typhi Ty2
cgcgacggcagcc

SEQ ID NO: 1735757 - RNA, 20 nt, Salmonella enterica enterica serovar Typhi Ty2
cgcgacgcuuaucagcccua

SEQ ID NO: 1735758 - RNA, 20 nt, Salmonella enterica enterica serovar Typhi Ty2
cgcgccauacuuacugcugu

SEQ ID NO: 1735759 - RNA, 14 nt, Salmonella enterica enterica serovar Typhi Ty2
cgcgccccagguga

SEQ ID NO: 1735760 - RNA, 17 nt, Salmonella enterica enterica serovar Typhi Ty2
cgcgccggucgccagca

SEQ ID NO: 1735761 - RNA, 11 nt, Salmonella enterica enterica serovar Typhi Ty2
cgcgccggcaa

SEQ ID NO: 1735762 - RNA, 22 nt, Salmonella enterica enterica serovar Typhi Ty2
cgcgcaucuucacuguuaucgc

SEQ ID NO: 1735763 - RNA, 22 nt, Salmonella enterica enterica serovar Typhi Ty2
cgcgccaguuuggugaugcgau

SEQ ID NO: 1735764 - RNA, 14 nt, Salmonella enterica enterica serovar Typhi Ty2
cgcgcggugaaagu

SEQ ID NO: 1735765 - RNA, 15 nt, Salmonella enterica enterica serovar Typhi Ty2
cgcgcgguuuauccc

SEQ ID NO: 1735766 - RNA, 23 nt, Salmonella enterica enterica serovar Typhi Ty2
cgcgcguacugcccguggcggag

SEQ ID NO: 1735767 - RNA, 16 nt, Salmonella enterica enterica serovar Typhi Ty2
cgcgcuaucgguauca

SEQ ID NO: 1735768 - RNA, 13 nt, Salmonella enterica enterica serovar Typhi Ty2
cgcgcguauccgc

SEQ ID NO: 1735769 - RNA, 20 nt, Salmonella enterica enterica serovar Typhi Ty2
cgcgcuuuucgccagcgcau

SEQ ID NO: 1735770 - RNA, 19 nt, Salmonella enterica enterica serovar Typhi Ty2
cgcggaagccacguucuuc

SEQ ID NO: 1735771 - RNA, 20 nt, Salmonella enterica enterica serovar Typhi Ty2
cgcgcugcggcgucugccuu

SEQ ID NO: 1735772 - RNA, 17 nt, Salmonella enterica enterica serovar Typhi Ty2
cgcgcugcugcggcguu

SEQ ID NO: 1735773 - RNA, 15 nt, Salmonella enterica enterica serovar Typhi Ty2
cgcgcuggaucagau

SEQ ID NO: 1735774 - RNA, 19 nt, Salmonella enterica enterica serovar Typhi Ty2
cgcgcgccgcuuccggcag

SEQ ID NO: 1735775 - RNA, 23 nt, Salmonella enterica enterica serovar Typhi Ty2
cgcgcgccaucgucccaucgucg

SEQ ID NO: 1735776 - RNA, 17 nt, Salmonella enterica enterica serovar Typhi Ty2
cgcgcgcaggcccaccg

SEQ ID NO: 1735777 - RNA, 13 nt, Salmonella enterica enterica serovar Typhi Ty2
cgcgcgcgcguca

SEQ ID NO: 1735778 - RNA, 14 nt, Salmonella enterica enterica serovar Typhi Ty2
cgcgcgccggugau

SEQ ID NO: 1735779 - RNA, 17 nt, Salmonella enterica enterica serovar Typhi Ty2
cgcgcggauucuccagg

SEQ ID NO: 1735780 - RNA, 16 nt, Salmonella enterica enterica serovar Typhi Ty2
cgcgccuuccagcaau

SEQ ID NO: 1735781 - RNA, 16 nt, Salmonella enterica enterica serovar Typhi Ty2
cgcucacccgauaaaa

SEQ ID NO: 1735782 - RNA, 15 nt, Salmonella enterica enterica serovar Typhi Ty2
cgcucaugccacgcc

SEQ ID NO: 1735783 - RNA, 22 nt, Salmonella enterica enterica serovar Typhi Ty2
cgcucaugauucuugcggauua

SEQ ID NO: 1735784 - RNA, 19 nt, Salmonella enterica enterica serovar Typhi Ty2
cgcuaucuuugagcagaua

SEQ ID NO: 1735785 - RNA, 14 nt, Salmonella enterica enterica serovar Typhi Ty2
cgcuauccggcuuu

SEQ ID NO: 1735786 - RNA, 20 nt, Salmonella enterica enterica serovar Typhi Ty2
cgcuaucucuuccagcgucu

SEQ ID NO: 1735787 - RNA, 22 nt, Salmonella enterica enterica serovar Typhi Ty2
cgcuaucgcuuuaacgcugcaa

SEQ ID NO: 1735788 - RNA, 12 nt, Salmonella enterica enterica serovar Typhi Ty2
cgcuaucgccaa

SEQ ID NO: 1735789 - RNA, 23 nt, Salmonella enterica enterica serovar Typhi Ty2
cgcuauccgcgcucgccagcaua

SEQ ID NO: 1735790 - RNA, 15 nt, Salmonella enterica enterica serovar Typhi Ty2
cgcuauuaccaguaa

SEQ ID NO: 1735791 - RNA, 12 nt, Salmonella enterica enterica serovar Typhi Ty2
cgcuauuaccag

SEQ ID NO: 1735792 - RNA, 20 nt, Salmonella enterica enterica serovar Typhi Ty2
cgcucaaauacgcgauaaaa

SEQ ID NO: 1735793 - RNA, 13 nt, Salmonella enterica enterica serovar Typhi Ty2
cgcucaaucagcg

SEQ ID NO: 1735794 - RNA, 18 nt, Salmonella enterica enterica serovar Typhi Ty2
cgcucaagcugggcguua

SEQ ID NO: 1735795 - RNA, 20 nt, Salmonella enterica enterica serovar Typhi Ty2
cgcuacguuuaucaggccua

SEQ ID NO: 1735796 - RNA, 16 nt, Salmonella enterica enterica serovar Typhi Ty2
cgcuacgcuuaucagg

SEQ ID NO: 1735797 - RNA, 12 nt, Salmonella enterica enterica serovar Typhi Ty2
cgcuacgcgucg

SEQ ID NO: 1735798 - RNA, 14 nt, Salmonella enterica enterica serovar Typhi Ty2
cgcuagccgcaucc

SEQ ID NO: 1735799 - RNA, 13 nt, Salmonella enterica enterica serovar Typhi Ty2
cgcuauaucacgc

SEQ ID NO: 1735800 - RNA, 12 nt, Salmonella enterica enterica serovar Typhi Ty2
cgcuauccagca

SEQ ID NO: 1735801 - RNA, 14 nt, Salmonella enterica enterica serovar Typhi Ty2
cgcguucuggcgau

SEQ ID NO: 1735802 - RNA, 13 nt, Salmonella enterica enterica serovar Typhi Ty2
cgcguugccgccg

SEQ ID NO: 1735803 - RNA, 17 nt, Salmonella enterica enterica serovar Typhi Ty2
cgcgucuucaucagcca

SEQ ID NO: 1735804 - RNA, 19 nt, Salmonella enterica enterica serovar Typhi Ty2
cgcgucuguguuuauccgg

SEQ ID NO: 1735805 - RNA, 18 nt, Salmonella enterica enterica serovar Typhi Ty2
cgcgucacgaccggcgaa

SEQ ID NO: 1735806 - RNA, 17 nt, Salmonella enterica enterica serovar Typhi Ty2
cgcgucacgaccggcga

SEQ ID NO: 1735807 - RNA, 13 nt, Salmonella enterica enterica serovar Typhi Ty2
cgcgucaacgcca

SEQ ID NO: 1735808 - RNA, 18 nt, Salmonella enterica enterica serovar Typhi Ty2
cgcgucgccauccggcga

SEQ ID NO: 1735809 - RNA, 22 nt, Salmonella enterica enterica serovar Typhi Ty2
cgcucgauuugcccuuccagca

SEQ ID NO: 1735810 - RNA, 12 nt, Salmonella enterica enterica serovar Typhi Ty2
cgcuccagggcu

SEQ ID NO: 1735811 - RNA, 16 nt, Salmonella enterica enterica serovar Typhi Ty2
cgcuccagaccaccag

SEQ ID NO: 1735812 - RNA, 16 nt, Salmonella enterica enterica serovar Typhi Ty2
cgcucgcccgccgcaa

SEQ ID NO: 1735813 - RNA, 13 nt, Salmonella enterica enterica serovar Typhi Ty2
cgcucggcauaca

SEQ ID NO: 1735814 - RNA, 23 nt, Salmonella enterica enterica serovar Typhi Ty2
cgcucucgauauacuccgcgacg

SEQ ID NO: 1735815 - RNA, 21 nt, Salmonella enterica enterica serovar Typhi Ty2
cgcucugcuucggaaugacaa

SEQ ID NO: 1735816 - RNA, 12 nt, Salmonella enterica enterica serovar Typhi Ty2
cgcucuuaccgc

SEQ ID NO: 1735817 - RNA, 14 nt, Salmonella enterica enterica serovar Typhi Ty2
cgcucuuaccgcua

SEQ ID NO: 1735818 - RNA, 12 nt, Salmonella enterica enterica serovar Typhi Ty2
cgcucuucgcca

SEQ ID NO: 1735819 - RNA, 22 nt, Salmonella enterica enterica serovar Typhi Ty2
cgcugaagccugcuucaccgcg

SEQ ID NO: 1735820 - RNA, 15 nt, Salmonella enterica enterica serovar Typhi Ty2
cgcucucagcgucgg

SEQ ID NO: 1735821 - RNA, 21 nt, Salmonella enterica enterica serovar Typhi Ty2
cgcucguuauaauugcccgca

SEQ ID NO: 1735822 - RNA, 23 nt, Salmonella enterica enterica serovar Typhi Ty2
cgcguaauuugcgacauggcgac

SEQ ID NO: 1735823 - RNA, 12 nt, Salmonella enterica enterica serovar Typhi Ty2
cgcguaccagcg

SEQ ID NO: 1735824 - RNA, 15 nt, Salmonella enterica enterica serovar Typhi Ty2
cgcguacagcgccau

SEQ ID NO: 1735825 - RNA, 13 nt, Salmonella enterica enterica serovar Typhi Ty2
cgcguaaucgcga

SEQ ID NO: 1735826 - RNA, 17 nt, Salmonella enterica enterica serovar Typhi Ty2
cgcguaaacuuccgcca

SEQ ID NO: 1735827 - RNA, 16 nt, Salmonella enterica enterica serovar Typhi Ty2
cgcgggcuucacguug

SEQ ID NO: 1735828 - RNA, 20 nt, Salmonella enterica enterica serovar Typhi Ty2
cgcggggaucgguuuauccc

SEQ ID NO: 1735829 - RNA, 14 nt, Salmonella enterica enterica serovar Typhi Ty2
cgcgggcggcguuu

SEQ ID NO: 1735830 - RNA, 13 nt, Salmonella enterica enterica serovar Typhi Ty2
cgcgggcgguauu

SEQ ID NO: 1735831 - RNA, 16 nt, Salmonella enterica enterica serovar Typhi Ty2
aacagcacgcccugcc

SEQ ID NO: 1735832 - RNA, 22 nt, Salmonella enterica enterica serovar Typhi Ty2
cgcggccuccggaucgacagca

SEQ ID NO: 1735833 - RNA, 17 nt, Salmonella enterica enterica serovar Typhi Ty2
cgcggcguucugcgcca

SEQ ID NO: 1735834 - RNA, 22 nt, Salmonella enterica enterica serovar Typhi Ty2
cgccgcggccuccggaucgaca

SEQ ID NO: 1735835 - RNA, 22 nt, Salmonella enterica enterica serovar Typhi Ty2
cgccgcgcugaugcagcuugca

SEQ ID NO: 1735836 - RNA, 14 nt, Salmonella enterica enterica serovar Typhi Ty2
cgccgcgcguucca

SEQ ID NO: 1735837 - RNA, 13 nt, Salmonella enterica enterica serovar Typhi Ty2
cgccgcgccgaua

SEQ ID NO: 1735838 - RNA, 20 nt, Salmonella enterica enterica serovar Typhi Ty2
cgccgccucuucaaacggca

SEQ ID NO: 1735839 - RNA, 23 nt, Salmonella enterica enterica serovar Typhi Ty2
cgccgccucccccucaaucggcg

SEQ ID NO: 1735840 - RNA, 18 nt, Salmonella enterica enterica serovar Typhi Ty2
aacaccgcauggcuggca

SEQ ID NO: 1735841 - RNA, 17 nt, Salmonella enterica enterica serovar Typhi Ty2
cgccgcuuuucaggggu

SEQ ID NO: 1735842 - RNA, 17 nt, Salmonella enterica enterica serovar Typhi Ty2
cgccgcuuuuuucagcg

SEQ ID NO: 1735843 - RNA, 21 nt, Salmonella enterica enterica serovar Typhi Ty2
cgccgcuggucaacacgcggu

SEQ ID NO: 1735844 - RNA, 16 nt, Salmonella enterica enterica serovar Typhi Ty2
cgccgcguucgcacca

SEQ ID NO: 1735845 - RNA, 12 nt, Salmonella enterica enterica serovar Typhi Ty2
cgccuaccagca

SEQ ID NO: 1735846 - RNA, 13 nt, Salmonella enterica enterica serovar Typhi Ty2
aacacggcgcuca

SEQ ID NO: 1735847 - RNA, 15 nt, Salmonella enterica enterica serovar Typhi Ty2
cgccguuuguuuauu

SEQ ID NO: 1735848 - RNA, 15 nt, Salmonella enterica enterica serovar Typhi Ty2
cgccuaaaucaagca

SEQ ID NO: 1735849 - RNA, 20 nt, Salmonella enterica enterica serovar Typhi Ty2
cgccguuaaaccguuaugaa

SEQ ID NO: 1735850 - RNA, 15 nt, Salmonella enterica enterica serovar Typhi Ty2
cgccguuccauucca

SEQ ID NO: 1735851 - RNA, 18 nt, Salmonella enterica enterica serovar Typhi Ty2
cgccuagcgucccggcaa

SEQ ID NO: 1735852 - RNA, 18 nt, Salmonella enterica enterica serovar Typhi Ty2
cgccucaauugccgccag

SEQ ID NO: 1735853 - RNA, 20 nt, Salmonella enterica enterica serovar Typhi Ty2
cgccucaucggcguugccca

SEQ ID NO: 1735854 - RNA, 14 nt, Salmonella enterica enterica serovar Typhi Ty2
cgccucaaaucagg

SEQ ID NO: 1735855 - RNA, 14 nt, Salmonella enterica enterica serovar Typhi Ty2
cgccucaauugccg

SEQ ID NO: 1735856 - RNA, 18 nt, Salmonella enterica enterica serovar Typhi Ty2
cgccucgcgauccgccag

SEQ ID NO: 1735857 - RNA, 22 nt, Salmonella enterica enterica serovar Typhi Ty2
cgccucgcguagcgccaacaug

SEQ ID NO: 1735858 - RNA, 21 nt, Salmonella enterica enterica serovar Typhi Ty2
cgccucauugauaccuaaacg

SEQ ID NO: 1735859 - RNA, 17 nt, Salmonella enterica enterica serovar Typhi Ty2
cgccugaauaaucggcg

SEQ ID NO: 1735860 - RNA, 13 nt, Salmonella enterica enterica serovar Typhi Ty2
cgccugcauaaug

SEQ ID NO: 1735861 - RNA, 23 nt, Salmonella enterica enterica serovar Typhi Ty2
cgccugacgaaagucauccagua

SEQ ID NO: 1735862 - RNA, 17 nt, Salmonella enterica enterica serovar Typhi Ty2
cgccugacgcggacgcc

SEQ ID NO: 1735863 - RNA, 14 nt, Salmonella enterica enterica serovar Typhi Ty2
cgccguccggcgaa

SEQ ID NO: 1735864 - RNA, 20 nt, Salmonella enterica enterica serovar Typhi Ty2
cgccgugcacuucugcggua

SEQ ID NO: 1735865 - RNA, 16 nt, Salmonella enterica enterica serovar Typhi Ty2
cgccgugucuggcgaa

SEQ ID NO: 1735866 - RNA, 17 nt, Salmonella enterica enterica serovar Typhi Ty2
cgccguguaagagcugg

SEQ ID NO: 1735867 - RNA, 13 nt, Salmonella enterica enterica serovar Typhi Ty2
cgccgucaggcua

SEQ ID NO: 1735868 - RNA, 17 nt, Salmonella enterica enterica serovar Typhi Ty2
cgccgggauauuuccgc

SEQ ID NO: 1735869 - RNA, 17 nt, Salmonella enterica enterica serovar Typhi Ty2
cgccggugacggcggaa

SEQ ID NO: 1735870 - RNA, 14 nt, Salmonella enterica enterica serovar Typhi Ty2
cgccccacagaccu

SEQ ID NO: 1735871 - RNA, 20 nt, Salmonella enterica enterica serovar Typhi Ty2
cgcccauuagcauuccgccc

SEQ ID NO: 1735872 - RNA, 18 nt, Salmonella enterica enterica serovar Typhi Ty2
cgccaccgccagccaugg

SEQ ID NO: 1735873 - RNA, 13 nt, Salmonella enterica enterica serovar Typhi Ty2
cgccaccgcaugg

SEQ ID NO: 1735874 - RNA, 18 nt, Salmonella enterica enterica serovar Typhi Ty2
cgcccaguccuuccggcg

SEQ ID NO: 1735875 - RNA, 15 nt, Salmonella enterica enterica serovar Typhi Ty2
cgcccaguaccagca

SEQ ID NO: 1735876 - RNA, 23 nt, Salmonella enterica enterica serovar Typhi Ty2
cgcccagucaucauaauucagcu

SEQ ID NO: 1735877 - RNA, 15 nt, Salmonella enterica enterica serovar Typhi Ty2
cgcccauaaucacca

SEQ ID NO: 1735878 - RNA, 12 nt, Salmonella enterica enterica serovar Typhi Ty2
cgcccaggccug

SEQ ID NO: 1735879 - RNA, 14 nt, Salmonella enterica enterica serovar Typhi Ty2
cgcccgagcgacgc

SEQ ID NO: 1735880 - RNA, 15 nt, Salmonella enterica enterica serovar Typhi Ty2
cgcccgcaacggcuu

SEQ ID NO: 1735881 - RNA, 14 nt, Salmonella enterica enterica serovar Typhi Ty2
cgcccgcauucgcg

SEQ ID NO: 1735882 - RNA, 23 nt, Salmonella enterica enterica serovar Typhi Ty2
cgcccgccagaucggacaucggc

SEQ ID NO: 1735883 - RNA, 13 nt, Salmonella enterica enterica serovar Typhi Ty2
cgcccgccgccag

SEQ ID NO: 1735884 - RNA, 18 nt, Salmonella enterica enterica serovar Typhi Ty2
cgccgaugccgccgacaa

SEQ ID NO: 1735885 - RNA, 15 nt, Salmonella enterica enterica serovar Typhi Ty2
cgccgaucggcguuu

SEQ ID NO: 1735886 - RNA, 13 nt, Salmonella enterica enterica serovar Typhi Ty2
cgccgaccaccag

SEQ ID NO: 1735887 - RNA, 17 nt, Salmonella enterica enterica serovar Typhi Ty2
cgccgacaaccagcgaa

SEQ ID NO: 1735888 - RNA, 15 nt, Salmonella enterica enterica serovar Typhi Ty2
cgccgaccauccaga

SEQ ID NO: 1735889 - RNA, 14 nt, Salmonella enterica enterica serovar Typhi Ty2
cgccgaccauccag

SEQ ID NO: 1735890 - RNA, 17 nt, Salmonella enterica enterica serovar Typhi Ty2
cgccgacccccuccuug

SEQ ID NO: 1735891 - RNA, 18 nt, Salmonella enterica enterica serovar Typhi Ty2
cgccgacggaacccagca

SEQ ID NO: 1735892 - RNA, 21 nt, Salmonella enterica enterica serovar Typhi Ty2
cgccgacgaccggcagcguca

SEQ ID NO: 1735893 - RNA, 14 nt, Salmonella enterica enterica serovar Typhi Ty2
cgccgaagcaggcg

SEQ ID NO: 1735894 - RNA, 18 nt, Salmonella enterica enterica serovar Typhi Ty2
cgcccugggcuucgucga

SEQ ID NO: 1735895 - RNA, 14 nt, Salmonella enterica enterica serovar Typhi Ty2
cgcccuucacgccg

SEQ ID NO: 1735896 - RNA, 18 nt, Salmonella enterica enterica serovar Typhi Ty2
cgcccugcgccagcaugg

SEQ ID NO: 1735897 - RNA, 21 nt, Salmonella enterica enterica serovar Typhi Ty2
cgcccugcgccagcauggcgu

SEQ ID NO: 1735898 - RNA, 20 nt, Salmonella enterica enterica serovar Typhi Ty2
cgcccugccauucccagccg

SEQ ID NO: 1735899 - RNA, 13 nt, Salmonella enterica enterica serovar Typhi Ty2
cgcccugacgccg

SEQ ID NO: 1735900 - RNA, 19 nt, Salmonella enterica enterica serovar Typhi Ty2
cgcccgugacgccaggcag

SEQ ID NO: 1735901 - RNA, 13 nt, Salmonella enterica enterica serovar Typhi Ty2
cgcccguccgcua

SEQ ID NO: 1735902 - RNA, 17 nt, Salmonella enterica enterica serovar Typhi Ty2
cgcccguacaccugcaa

SEQ ID NO: 1735903 - RNA, 13 nt, Salmonella enterica enterica serovar Typhi Ty2
cgcccguuuccgc

SEQ ID NO: 1735904 - RNA, 14 nt, Salmonella enterica enterica serovar Typhi Ty2
gcgccgacaggcuc

SEQ ID NO: 1735905 - RNA, 13 nt, Salmonella enterica enterica serovar Typhi Ty2
gcgccagguauac

SEQ ID NO: 1735906 - RNA, 18 nt, Salmonella enterica enterica serovar Typhi Ty2
gcgccaugauucaucccg

SEQ ID NO: 1735907 - RNA, 17 nt, Salmonella enterica enterica serovar Typhi Ty2
gcgccaguaaucggcgc

SEQ ID NO: 1735908 - RNA, 19 nt, Salmonella enterica enterica serovar Typhi Ty2
gcgccaugcggaaucacgc

SEQ ID NO: 1735909 - RNA, 13 nt, Salmonella enterica enterica serovar Typhi Ty2
gcgcccagcgccg

SEQ ID NO: 1735910 - RNA, 21 nt, Salmonella enterica enterica serovar Typhi Ty2
gcgccauuaacgccaugacgc

SEQ ID NO: 1735911 - RNA, 12 nt, Salmonella enterica enterica serovar Typhi Ty2
gcgccagcgcau

SEQ ID NO: 1735912 - RNA, 12 nt, Salmonella enterica enterica serovar Typhi Ty2
gcgccagcgacg

SEQ ID NO: 1735913 - RNA, 23 nt, Salmonella enterica enterica serovar Typhi Ty2
gcgccagccgucaaacaucgcgc

SEQ ID NO: 1735914 - RNA, 17 nt, Salmonella enterica enterica serovar Typhi Ty2
gcgccagccgcgccauc

SEQ ID NO: 1735915 - RNA, 18 nt, Salmonella enterica enterica serovar Typhi Ty2
gcgccacgcgaugcaacc

SEQ ID NO: 1735916 - RNA, 13 nt, Salmonella enterica enterica serovar Typhi Ty2
gcgccaaucgcga

SEQ ID NO: 1735917 - RNA, 20 nt, Salmonella enterica enterica serovar Typhi Ty2
gcgccaaaguuaaucagcgc

SEQ ID NO: 1735918 - RNA, 19 nt, Salmonella enterica enterica serovar Typhi Ty2
gcgcaucccacaccacacg

SEQ ID NO: 1735919 - RNA, 13 nt, Salmonella enterica enterica serovar Typhi Ty2
gcgcauccggcau

SEQ ID NO: 1735920 - RNA, 14 nt, Salmonella enterica enterica serovar Typhi Ty2
gcgcauccggcauc

SEQ ID NO: 1735921 - RNA, 15 nt, Salmonella enterica enterica serovar Typhi Ty2
gcgcauauuccggcg

SEQ ID NO: 1735922 - RNA, 19 nt, Salmonella enterica enterica serovar Typhi Ty2
gcgcauacuuauacagcgc

SEQ ID NO: 1735923 - RNA, 15 nt, Salmonella enterica enterica serovar Typhi Ty2
gcgccuaccgccaua

SEQ ID NO: 1735924 - RNA, 14 nt, Salmonella enterica enterica serovar Typhi Ty2
gcgccguccugcaa

SEQ ID NO: 1735925 - RNA, 21 nt, Salmonella enterica enterica serovar Typhi Ty2
gcgccgugcccagcaucccgc

SEQ ID NO: 1735926 - RNA, 17 nt, Salmonella enterica enterica serovar Typhi Ty2
gcgccgugccuggcgcu

SEQ ID NO: 1735927 - RNA, 15 nt, Salmonella enterica enterica serovar Typhi Ty2
gcgccgcuuccggca

SEQ ID NO: 1735928 - RNA, 14 nt, Salmonella enterica enterica serovar Typhi Ty2
gcgccgcuggcgau

SEQ ID NO: 1735929 - RNA, 22 nt, Salmonella enterica enterica serovar Typhi Ty2
gcgcgaacgccuuauccggccu

SEQ ID NO: 1735930 - RNA, 15 nt, Salmonella enterica enterica serovar Typhi Ty2
gcgccuuuccggccu

SEQ ID NO: 1735931 - RNA, 14 nt, Salmonella enterica enterica serovar Typhi Ty2
gcgccuuuccggcc

SEQ ID NO: 1735932 - RNA, 14 nt, Salmonella enterica enterica serovar Typhi Ty2
gcgcgaaaacagcu

SEQ ID NO: 1735933 - RNA, 19 nt, Salmonella enterica enterica serovar Typhi Ty2
gcgcgaaacgcacccgcgc

SEQ ID NO: 1735934 - RNA, 23 nt, Salmonella enterica enterica serovar Typhi Ty2
gcgccuuuaauuccgccgggcaa

SEQ ID NO: 1735935 - RNA, 18 nt, Salmonella enterica enterica serovar Typhi Ty2
gcgcgaggcauaccgccc

SEQ ID NO: 1735936 - RNA, 17 nt, Salmonella enterica enterica serovar Typhi Ty2
gcgccugggauaagcag

SEQ ID NO: 1735937 - RNA, 21 nt, Salmonella enterica enterica serovar Typhi Ty2
gcgccuguuagggcgcggcug

SEQ ID NO: 1735938 - RNA, 14 nt, Salmonella enterica enterica serovar Typhi Ty2
gcgccuucaggcau

SEQ ID NO: 1735939 - RNA, 18 nt, Salmonella enterica enterica serovar Typhi Ty2
gcgccuuaucgaccaggc

SEQ ID NO: 1735940 - RNA, 19 nt, Salmonella enterica enterica serovar Typhi Ty2
gcgccuuaucgaccaggcg

SEQ ID NO: 1735941 - RNA, 14 nt, Salmonella enterica enterica serovar Typhi Ty2
gcgccuuauccggc

SEQ ID NO: 1735942 - RNA, 23 nt, Salmonella enterica enterica serovar Typhi Ty2
gcgccuucgcggugaucccaggc

SEQ ID NO: 1735943 - RNA, 18 nt, Salmonella enterica enterica serovar Typhi Ty2
gcgccugaagauacgcca

SEQ ID NO: 1735944 - RNA, 19 nt, Salmonella enterica enterica serovar Typhi Ty2
gcgccugaugcacauuguc

SEQ ID NO: 1735945 - RNA, 15 nt, Salmonella enterica enterica serovar Typhi Ty2
gcgauacguaggccu

SEQ ID NO: 1735946 - RNA, 15 nt, Salmonella enterica enterica serovar Typhi Ty2
gcgauacucucgcag

SEQ ID NO: 1735947 - RNA, 18 nt, Salmonella enterica enterica serovar Typhi Ty2
gcgauaccgugacugacc

SEQ ID NO: 1735948 - RNA, 23 nt, Salmonella enterica enterica serovar Typhi Ty2
gcgauaaccgguuuaugaugccg

SEQ ID NO: 1735949 - RNA, 17 nt, Salmonella enterica enterica serovar Typhi Ty2
gcgauacccccaaccgu

SEQ ID NO: 1735950 - RNA, 19 nt, Salmonella enterica enterica serovar Typhi Ty2
gcgauauucaacagcccga

SEQ ID NO: 1735951 - RNA, 21 nt, Salmonella enterica enterica serovar Typhi Ty2
gcgauaauagaaccgaauaac

SEQ ID NO: 1735952 - RNA, 21 nt, Salmonella enterica enterica serovar Typhi Ty2
gcgauaaaaauauccgccauc

SEQ ID NO: 1735953 - RNA, 20 nt, Salmonella enterica enterica serovar Typhi Ty2
gcgaggucuggucagcgaug

SEQ ID NO: 1735954 - RNA, 15 nt, Salmonella enterica enterica serovar Typhi Ty2
gcgaggaacaucagc

SEQ ID NO: 1735955 - RNA, 20 nt, Salmonella enterica enterica serovar Typhi Ty2
gcgagccguaaacggaacca

SEQ ID NO: 1735956 - RNA, 14 nt, Salmonella enterica enterica serovar Typhi Ty2
gcgacguuccgcga

SEQ ID NO: 1735957 - RNA, 17 nt, Salmonella enterica enterica serovar Typhi Ty2
gcgagaccauauugaag

SEQ ID NO: 1735958 - RNA, 14 nt, Salmonella enterica enterica serovar Typhi Ty2
gcgacuuauccggc

SEQ ID NO: 1735959 - RNA, 16 nt, Salmonella enterica enterica serovar Typhi Ty2
gcgacuucauucaggc

SEQ ID NO: 1735960 - RNA, 23 nt, Salmonella enterica enterica serovar Typhi Ty2
gcgacuuccgucuccggacguuu

SEQ ID NO: 1735961 - RNA, 18 nt, Salmonella enterica enterica serovar Typhi Ty2
gcgacuucgcuuccugca

SEQ ID NO: 1735962 - RNA, 20 nt, Salmonella enterica enterica serovar Typhi Ty2
gcgagaccaucaacagcgug

SEQ ID NO: 1735963 - RNA, 14 nt, Salmonella enterica enterica serovar Typhi Ty2
gcgagacgcgccga

SEQ ID NO: 1735964 - RNA, 16 nt, Salmonella enterica enterica serovar Typhi Ty2
gccuucgacuuccgca

SEQ ID NO: 1735965 - RNA, 16 nt, Salmonella enterica enterica serovar Typhi Ty2
gccuuccuccagcauc

SEQ ID NO: 1735966 - RNA, 18 nt, Salmonella enterica enterica serovar Typhi Ty2
gccuuauccggccuacag

SEQ ID NO: 1735967 - RNA, 19 nt, Salmonella enterica enterica serovar Typhi Ty2
gccuuauccggccuacacg

SEQ ID NO: 1735968 - RNA, 19 nt, Salmonella enterica enterica serovar Typhi Ty2
gccuuauccggccuacaga

SEQ ID NO: 1735969 - RNA, 18 nt, Salmonella enterica enterica serovar Typhi Ty2
gcgacagcgcuauccggc

SEQ ID NO: 1735970 - RNA, 15 nt, Salmonella enterica enterica serovar Typhi Ty2
gcgaccacuccggca

SEQ ID NO: 1735971 - RNA, 17 nt, Salmonella enterica enterica serovar Typhi Ty2
gcgacagucgcagagcc

SEQ ID NO: 1735972 - RNA, 20 nt, Salmonella enterica enterica serovar Typhi Ty2
gcgacccauaacgggaagcc

SEQ ID NO: 1735973 - RNA, 16 nt, Salmonella enterica enterica serovar Typhi Ty2
gcgaugagauccgggc

SEQ ID NO: 1735974 - RNA, 17 nt, Salmonella enterica enterica serovar Typhi Ty2
gcgaugccuuauccggc

SEQ ID NO: 1735975 - RNA, 20 nt, Salmonella enterica enterica serovar Typhi Ty2
gcgaugccaguagcucgccg

SEQ ID NO: 1735976 - RNA, 19 nt, Salmonella enterica enterica serovar Typhi Ty2
gcgaugccaguagcucgcc

SEQ ID NO: 1735977 - RNA, 18 nt, Salmonella enterica enterica serovar Typhi Ty2
gcgaucacuaccgccauc

SEQ ID NO: 1735978 - RNA, 16 nt, Salmonella enterica enterica serovar Typhi Ty2
gcgaucacuaccgcca

SEQ ID NO: 1735979 - RNA, 13 nt, Salmonella enterica enterica serovar Typhi Ty2
gcgaucagcgcca

SEQ ID NO: 1735980 - RNA, 21 nt, Salmonella enterica enterica serovar Typhi Ty2
gcgauccacaaucgucgugcc

SEQ ID NO: 1735981 - RNA, 14 nt, Salmonella enterica enterica serovar Typhi Ty2
gcgaucccggccuu

SEQ ID NO: 1735982 - RNA, 17 nt, Salmonella enterica enterica serovar Typhi Ty2
gcgaucgcgauucgccc

SEQ ID NO: 1735983 - RNA, 16 nt, Salmonella enterica enterica serovar Typhi Ty2
gcgauuuucaucaagc

SEQ ID NO: 1735984 - RNA, 18 nt, Salmonella enterica enterica serovar Typhi Ty2
gcgauuuucaccggcguu

SEQ ID NO: 1735985 - RNA, 15 nt, Salmonella enterica enterica serovar Typhi Ty2
gcgauuuuuacgcca

SEQ ID NO: 1735986 - RNA, 21 nt, Salmonella enterica enterica serovar Typhi Ty2
gcgauuuauccaccgccagac

SEQ ID NO: 1735987 - RNA, 22 nt, Salmonella enterica enterica serovar Typhi Ty2
gcgauugucaucauucgcgaau

SEQ ID NO: 1735988 - RNA, 18 nt, Salmonella enterica enterica serovar Typhi Ty2
gcgauuccggacaacgca

SEQ ID NO: 1735989 - RNA, 17 nt, Salmonella enterica enterica serovar Typhi Ty2
gcgauucauaugcgcca

SEQ ID NO: 1735990 - RNA, 17 nt, Salmonella enterica enterica serovar Typhi Ty2
gcgcaaccgcaucacgc

SEQ ID NO: 1735991 - RNA, 14 nt, Salmonella enterica enterica serovar Typhi Ty2
gcgcaaaucgccau

SEQ ID NO: 1735992 - RNA, 13 nt, Salmonella enterica enterica serovar Typhi Ty2
gcgcaaauacuga

SEQ ID NO: 1735993 - RNA, 14 nt, Salmonella enterica enterica serovar Typhi Ty2
gcgauuuuuaggcc

SEQ ID NO: 1735994 - RNA, 13 nt, Salmonella enterica enterica serovar Typhi Ty2
gcgauuuucucgc

SEQ ID NO: 1735995 - RNA, 12 nt, Salmonella enterica enterica serovar Typhi Ty2
gcgcaaacggcg

SEQ ID NO: 1735996 - RNA, 14 nt, Salmonella enterica enterica serovar Typhi Ty2
gcgcaaacguaacc

SEQ ID NO: 1735997 - RNA, 15 nt, Salmonella enterica enterica serovar Typhi Ty2
gcgauguucuugccg

SEQ ID NO: 1735998 - RNA, 15 nt, Salmonella enterica enterica serovar Typhi Ty2
gcgauuacgccagac

SEQ ID NO: 1735999 - RNA, 15 nt, Salmonella enterica enterica serovar Typhi Ty2
gcgauguccgguccg

SEQ ID NO: 1736000 - RNA, 22 nt, Salmonella enterica enterica serovar Typhi Ty2
gcgcacgagugaucccgacaua

SEQ ID NO: 1736001 - RNA, 19 nt, Salmonella enterica enterica serovar Typhi Ty2
gcgcaacgcgcaucaacgc

SEQ ID NO: 1736002 - RNA, 14 nt, Salmonella enterica enterica serovar Typhi Ty2
gcgcaaggccgagc

SEQ ID NO: 1736003 - RNA, 13 nt, Salmonella enterica enterica serovar Typhi Ty2
gcgcaauccgcgc

SEQ ID NO: 1736004 - RNA, 23 nt, Salmonella enterica enterica serovar Typhi Ty2
gccgguaagaagaaccagcgcga

SEQ ID NO: 1736005 - RNA, 15 nt, Salmonella enterica enterica serovar Typhi Ty2
gccgguauccagcgc

SEQ ID NO: 1736006 - RNA, 14 nt, Salmonella enterica enterica serovar Typhi Ty2
gccgguaaucgcgc

SEQ ID NO: 1736007 - RNA, 14 nt, Salmonella enterica enterica serovar Typhi Ty2
gccgucauccgcgu

SEQ ID NO: 1736008 - RNA, 21 nt, Salmonella enterica enterica serovar Typhi Ty2
gccgucaggcuacccgcaaua

SEQ ID NO: 1736009 - RNA, 16 nt, Salmonella enterica enterica serovar Typhi Ty2
gccgucacuuuaucac

SEQ ID NO: 1736010 - RNA, 20 nt, Salmonella enterica enterica serovar Typhi Ty2
gccgucaaacaagccgccaa

SEQ ID NO: 1736011 - RNA, 16 nt, Salmonella enterica enterica serovar Typhi Ty2
gccguacuccagccca

SEQ ID NO: 1736012 - RNA, 16 nt, Salmonella enterica enterica serovar Typhi Ty2
gccgguguacgacccu

SEQ ID NO: 1736013 - RNA, 22 nt, Salmonella enterica enterica serovar Typhi Ty2
gccguugcgauaauacacggua

SEQ ID NO: 1736014 - RNA, 13 nt, Salmonella enterica enterica serovar Typhi Ty2
gccgugcgccgac

SEQ ID NO: 1736015 - RNA, 22 nt, Salmonella enterica enterica serovar Typhi Ty2
gccgugccugggcggcaacccg

SEQ ID NO: 1736016 - RNA, 18 nt, Salmonella enterica enterica serovar Typhi Ty2
gccgugccugcuccgcca

SEQ ID NO: 1736017 - RNA, 19 nt, Salmonella enterica enterica serovar Typhi Ty2
gccgugaauaaaaccggca

SEQ ID NO: 1736018 - RNA, 15 nt, Salmonella enterica enterica serovar Typhi Ty2
gccugccguccugau

SEQ ID NO: 1736019 - RNA, 21 nt, Salmonella enterica enterica serovar Typhi Ty2
gccugccgggccugcggcgac

SEQ ID NO: 1736020 - RNA, 19 nt, Salmonella enterica enterica serovar Typhi Ty2
gccugccgggccugcggcg

SEQ ID NO: 1736021 - RNA, 17 nt, Salmonella enterica enterica serovar Typhi Ty2
gccugauggcgcuacgc

SEQ ID NO: 1736022 - RNA, 11 nt, Salmonella enterica enterica serovar Typhi Ty2
gccugauggcg

SEQ ID NO: 1736023 - RNA, 12 nt, Salmonella enterica enterica serovar Typhi Ty2
gccugcaaacga

SEQ ID NO: 1736024 - RNA, 13 nt, Salmonella enterica enterica serovar Typhi Ty2
gccugccagcgcu

SEQ ID NO: 1736025 - RNA, 15 nt, Salmonella enterica enterica serovar Typhi Ty2
gccugaauaaugacc

SEQ ID NO: 1736026 - RNA, 16 nt, Salmonella enterica enterica serovar Typhi Ty2
gccugaugcugcgcau

SEQ ID NO: 1736027 - RNA, 22 nt, Salmonella enterica enterica serovar Typhi Ty2
gccugaugcgcguuuagcgcca

SEQ ID NO: 1736028 - RNA, 15 nt, Salmonella enterica enterica serovar Typhi Ty2
gccuacauccggcuc

SEQ ID NO: 1736029 - RNA, 18 nt, Salmonella enterica enterica serovar Typhi Ty2
gccuacccgcgugcggac

SEQ ID NO: 1736030 - RNA, 22 nt, Salmonella enterica enterica serovar Typhi Ty2
gccuacaaaaucgcccaggccu

SEQ ID NO: 1736031 - RNA, 18 nt, Salmonella enterica enterica serovar Typhi Ty2
gccuacaaaaucgcccag

SEQ ID NO: 1736032 - RNA, 20 nt, Salmonella enterica enterica serovar Typhi Ty2
gccuacacucugcgcgcgau

SEQ ID NO: 1736033 - RNA, 15 nt, Salmonella enterica enterica serovar Typhi Ty2
gccguuggcgcgaau

SEQ ID NO: 1736034 - RNA, 16 nt, Salmonella enterica enterica serovar Typhi Ty2
aagcccaucagcgcca

SEQ ID NO: 1736035 - RNA, 19 nt, Salmonella enterica enterica serovar Typhi Ty2
gccucgcugauacgcacca

SEQ ID NO: 1736036 - RNA, 18 nt, Salmonella enterica enterica serovar Typhi Ty2
gccugguaagcguagcgc

SEQ ID NO: 1736037 - RNA, 17 nt, Salmonella enterica enterica serovar Typhi Ty2
gccuguacuugcgccgc

SEQ ID NO: 1736038 - RNA, 19 nt, Salmonella enterica enterica serovar Typhi Ty2
gccuguaaacguuccugcc

SEQ ID NO: 1736039 - RNA, 14 nt, Salmonella enterica enterica serovar Typhi Ty2
gccuguaaaccgcc

SEQ ID NO: 1736040 - RNA, 13 nt, Salmonella enterica enterica serovar Typhi Ty2
gccugucaggccu

SEQ ID NO: 1736041 - RNA, 16 nt, Salmonella enterica enterica serovar Typhi Ty2
gccuguagcagcgcca

SEQ ID NO: 1736042 - RNA, 24 nt, Salmonella enterica enterica serovar Typhi Ty2
gccuguaguacaugccauccggcg

SEQ ID NO: 1736043 - RNA, 15 nt, Salmonella enterica enterica serovar Typhi Ty2
gccuuaucaggccug

SEQ ID NO: 1736044 - RNA, 19 nt, Salmonella enterica enterica serovar Typhi Ty2
gccuuaucaagccuacacc

SEQ ID NO: 1736045 - RNA, 14 nt, Salmonella enterica enterica serovar Typhi Ty2
gccuuacaggcgca

SEQ ID NO: 1736046 - RNA, 19 nt, Salmonella enterica enterica serovar Typhi Ty2
gccuguugcgggccagcag

SEQ ID NO: 1736047 - RNA, 15 nt, Salmonella enterica enterica serovar Typhi Ty2
gccugcuucagacaa

SEQ ID NO: 1736048 - RNA, 17 nt, Salmonella enterica enterica serovar Typhi Ty2
gccugcuggaaaggccg

SEQ ID NO: 1736049 - RNA, 16 nt, Salmonella enterica enterica serovar Typhi Ty2
gccugcucuugcggca

SEQ ID NO: 1736050 - RNA, 20 nt, Salmonella enterica enterica serovar Typhi Ty2
gccuggagagcagcgccagc

SEQ ID NO: 1736051 - RNA, 21 nt, Salmonella enterica enterica serovar Typhi Ty2
gccugcgcgccugacgcggac

SEQ ID NO: 1736052 - RNA, 19 nt, Salmonella enterica enterica serovar Typhi Ty2
gccugcgcucauauacccu

SEQ ID NO: 1736053 - RNA, 12 nt, Salmonella enterica enterica serovar Typhi Ty2
gccugcgccagc

SEQ ID NO: 1736054 - RNA, 20 nt, Salmonella enterica enterica serovar Typhi Ty2
gccugcucaauacuuuccgg

SEQ ID NO: 1736055 - RNA, 17 nt, Salmonella enterica enterica serovar Typhi Ty2
gccugcguugcuauggc

SEQ ID NO: 1736056 - RNA, 17 nt, Salmonella enterica enterica serovar Typhi Ty2
gccggcgaccaugccag

SEQ ID NO: 1736057 - RNA, 18 nt, Salmonella enterica enterica serovar Typhi Ty2
gccggcgauaacccgcgc

SEQ ID NO: 1736058 - RNA, 16 nt, Salmonella enterica enterica serovar Typhi Ty2
aagcauagcgucauca

SEQ ID NO: 1736059 - RNA, 18 nt, Salmonella enterica enterica serovar Typhi Ty2
aagcaucuuuccggaacg

SEQ ID NO: 1736060 - RNA, 17 nt, Salmonella enterica enterica serovar Typhi Ty2
aagcauuaccccguggu

SEQ ID NO: 1736061 - RNA, 17 nt, Salmonella enterica enterica serovar Typhi Ty2
gccgggaucugauacgg

SEQ ID NO: 1736062 - RNA, 21 nt, Salmonella enterica enterica serovar Typhi Ty2
gccggcggaaaaaagcagcau

SEQ ID NO: 1736063 - RNA, 14 nt, Salmonella enterica enterica serovar Typhi Ty2
gccggauguaggcc

SEQ ID NO: 1736064 - RNA, 17 nt, Salmonella enterica enterica serovar Typhi Ty2
gccggaugugagcgcau

SEQ ID NO: 1736065 - RNA, 23 nt, Salmonella enterica enterica serovar Typhi Ty2
gccggauggggcauuagccgcca

SEQ ID NO: 1736066 - RNA, 21 nt, Salmonella enterica enterica serovar Typhi Ty2
gccggauggcgcuuugcuuau

SEQ ID NO: 1736067 - RNA, 22 nt, Salmonella enterica enterica serovar Typhi Ty2
gccggaugugagcgcauccggc

SEQ ID NO: 1736068 - RNA, 20 nt, Salmonella enterica enterica serovar Typhi Ty2
gccggauuagcgacagcgcu

SEQ ID NO: 1736069 - RNA, 16 nt, Salmonella enterica enterica serovar Typhi Ty2
gccggcaaagguugcc

SEQ ID NO: 1736070 - RNA, 14 nt, Salmonella enterica enterica serovar Typhi Ty2
gccggcaaagccau

SEQ ID NO: 1736071 - RNA, 14 nt, Salmonella enterica enterica serovar Typhi Ty2
gccggaugcagucu

SEQ ID NO: 1736072 - RNA, 21 nt, Salmonella enterica enterica serovar Typhi Ty2
gccggaugagcguuagcgcca

SEQ ID NO: 1736073 - RNA, 20 nt, Salmonella enterica enterica serovar Typhi Ty2
gccggauaagcguagcgcca

SEQ ID NO: 1736074 - RNA, 15 nt, Salmonella enterica enterica serovar Typhi Ty2
gccggauaagcgcag

SEQ ID NO: 1736075 - RNA, 21 nt, Salmonella enterica enterica serovar Typhi Ty2
gccggauaagcauuagcgcca

SEQ ID NO: 1736076 - RNA, 14 nt, Salmonella enterica enterica serovar Typhi Ty2
gccggauaagccgg

SEQ ID NO: 1736077 - RNA, 21 nt, Salmonella enterica enterica serovar Typhi Ty2
gccggauaaggcgcuugugau

SEQ ID NO: 1736078 - RNA, 19 nt, Salmonella enterica enterica serovar Typhi Ty2
gccggauaagcguagcgca

SEQ ID NO: 1736079 - RNA, 17 nt, Salmonella enterica enterica serovar Typhi Ty2
gccggauaaggccacgc

SEQ ID NO: 1736080 - RNA, 17 nt, Salmonella enterica enterica serovar Typhi Ty2
gccggauagggcguaag

SEQ ID NO: 1736081 - RNA, 23 nt, Salmonella enterica enterica serovar Typhi Ty2
gccggauacgucacgucagcguc

SEQ ID NO: 1736082 - RNA, 20 nt, Salmonella enterica enterica serovar Typhi Ty2
gccggauaucgcuauccggc

SEQ ID NO: 1736083 - RNA, 14 nt, Salmonella enterica enterica serovar Typhi Ty2
gccggaucaggcgu

SEQ ID NO: 1736084 - RNA, 15 nt, Salmonella enterica enterica serovar Typhi Ty2
gccggcagccgcuga

SEQ ID NO: 1736085 - RNA, 21 nt, Salmonella enterica enterica serovar Typhi Ty2
gccggacguaccuugccgaau

SEQ ID NO: 1736086 - RNA, 22 nt, Salmonella enterica enterica serovar Typhi Ty2
gccggagagcggauaauccgcc

SEQ ID NO: 1736087 - RNA, 17 nt, Salmonella enterica enterica serovar Typhi Ty2
gccggagaucugucgcc

SEQ ID NO: 1736088 - RNA, 23 nt, Salmonella enterica enterica serovar Typhi Ty2
gccggaaucgcgauccagcccca

SEQ ID NO: 1736089 - RNA, 23 nt, Salmonella enterica enterica serovar Typhi Ty2
gccggaagacguuuacaccgcca

SEQ ID NO: 1736090 - RNA, 18 nt, Salmonella enterica enterica serovar Typhi Ty2
gccgcuuuugccgcgacu

SEQ ID NO: 1736091 - RNA, 12 nt, Salmonella enterica enterica serovar Typhi Ty2
gccgcuggcggg

SEQ ID NO: 1736092 - RNA, 16 nt, Salmonella enterica enterica serovar Typhi Ty2
gccgcugucgccagaa

SEQ ID NO: 1736093 - RNA, 23 nt, Salmonella enterica enterica serovar Typhi Ty2
gcggcaugauccaccaucggcgc

SEQ ID NO: 1736094 - RNA, 19 nt, Salmonella enterica enterica serovar Typhi Ty2
gcggcauuggcguuaccgg

SEQ ID NO: 1736095 - RNA, 21 nt, Salmonella enterica enterica serovar Typhi Ty2
gcggccgcuuuucggcgcuua

SEQ ID NO: 1736096 - RNA, 15 nt, Salmonella enterica enterica serovar Typhi Ty2
gcggcgacaccagcg

SEQ ID NO: 1736097 - RNA, 19 nt, Salmonella enterica enterica serovar Typhi Ty2
gcggcgacacaacggcaca

SEQ ID NO: 1736098 - RNA, 20 nt, Salmonella enterica enterica serovar Typhi Ty2
gcggcgaagcaucuuuccgg

SEQ ID NO: 1736099 - RNA, 20 nt, Salmonella enterica enterica serovar Typhi Ty2
gcggcgacagagaaugcgcc

SEQ ID NO: 1736100 - RNA, 17 nt, Salmonella enterica enterica serovar Typhi Ty2
gcggcggcccgaagggc

SEQ ID NO: 1736101 - RNA, 22 nt, Salmonella enterica enterica serovar Typhi Ty2
aagcuauuacaaaaaucaugcc

SEQ ID NO: 1736102 - RNA, 13 nt, Salmonella enterica enterica serovar Typhi Ty2
aagcucagcggca

SEQ ID NO: 1736103 - RNA, 17 nt, Salmonella enterica enterica serovar Typhi Ty2
aagcucccgccagcgag

SEQ ID NO: 1736104 - RNA, 14 nt, Salmonella enterica enterica serovar Typhi Ty2
gcggcguaacggcu

SEQ ID NO: 1736105 - RNA, 14 nt, Salmonella enterica enterica serovar Typhi Ty2
gcggcguaaacgcc

SEQ ID NO: 1736106 - RNA, 17 nt, Salmonella enterica enterica serovar Typhi Ty2
gcggcgcaaaucgccau

SEQ ID NO: 1736107 - RNA, 22 nt, Salmonella enterica enterica serovar Typhi Ty2
gcggcgcacugccugauggcgc

SEQ ID NO: 1736108 - RNA, 14 nt, Salmonella enterica enterica serovar Typhi Ty2
gcggcggaccgcaa

SEQ ID NO: 1736109 - RNA, 17 nt, Salmonella enterica enterica serovar Typhi Ty2
gcgggugaugcgccagc

SEQ ID NO: 1736110 - RNA, 21 nt, Salmonella enterica enterica serovar Typhi Ty2
gcgguaccggcauuacccagu

SEQ ID NO: 1736111 - RNA, 21 nt, Salmonella enterica enterica serovar Typhi Ty2
gcgguaaaaucugucucaucg

SEQ ID NO: 1736112 - RNA, 18 nt, Salmonella enterica enterica serovar Typhi Ty2
gcgguacgccgccauccg

SEQ ID NO: 1736113 - RNA, 15 nt, Salmonella enterica enterica serovar Typhi Ty2
gcgguauuauccgcc

SEQ ID NO: 1736114 - RNA, 23 nt, Salmonella enterica enterica serovar Typhi Ty2
gcgguaucaaugcgacagcgaca

SEQ ID NO: 1736115 - RNA, 15 nt, Salmonella enterica enterica serovar Typhi Ty2
gcggucaaaagcugc

SEQ ID NO: 1736116 - RNA, 20 nt, Salmonella enterica enterica serovar Typhi Ty2
gcggucaaaagcugcauccg

SEQ ID NO: 1736117 - RNA, 16 nt, Salmonella enterica enterica serovar Typhi Ty2
gcgggcuuauccccau

SEQ ID NO: 1736118 - RNA, 16 nt, Salmonella enterica enterica serovar Typhi Ty2
gcgggacgcugcgcgg

SEQ ID NO: 1736119 - RNA, 19 nt, Salmonella enterica enterica serovar Typhi Ty2
gcgggcagaaaaaucagca

SEQ ID NO: 1736120 - RNA, 13 nt, Salmonella enterica enterica serovar Typhi Ty2
gcggcuuucagca

SEQ ID NO: 1736121 - RNA, 20 nt, Salmonella enterica enterica serovar Typhi Ty2
gcggcuuuaaugccgccgua

SEQ ID NO: 1736122 - RNA, 22 nt, Salmonella enterica enterica serovar Typhi Ty2
gcggcuugaguuuuccgccauu

SEQ ID NO: 1736123 - RNA, 21 nt, Salmonella enterica enterica serovar Typhi Ty2
gcggcuauugucugauggcgc

SEQ ID NO: 1736124 - RNA, 14 nt, Salmonella enterica enterica serovar Typhi Ty2
gcggcucaccagcu

SEQ ID NO: 1736125 - RNA, 14 nt, Salmonella enterica enterica serovar Typhi Ty2
gcggcuacugccag

SEQ ID NO: 1736126 - RNA, 18 nt, Salmonella enterica enterica serovar Typhi Ty2
aagcuggauaccgcgcca

SEQ ID NO: 1736127 - RNA, 21 nt, Salmonella enterica enterica serovar Typhi Ty2
aagcugguggcgaguccugcc

SEQ ID NO: 1736128 - RNA, 16 nt, Salmonella enterica enterica serovar Typhi Ty2
aagcuguaacacugcc

SEQ ID NO: 1736129 - RNA, 21 nt, Salmonella enterica enterica serovar Typhi Ty2
gcggagagaucgacagcgcgc

SEQ ID NO: 1736130 - RNA, 14 nt, Salmonella enterica enterica serovar Typhi Ty2
gcggacugggcuga

SEQ ID NO: 1736131 - RNA, 14 nt, Salmonella enterica enterica serovar Typhi Ty2
gcggacugccuaac

SEQ ID NO: 1736132 - RNA, 17 nt, Salmonella enterica enterica serovar Typhi Ty2
gcggaugaucgccucuu

SEQ ID NO: 1736133 - RNA, 16 nt, Salmonella enterica enterica serovar Typhi Ty2
gcggaucgcguccauu

SEQ ID NO: 1736134 - RNA, 18 nt, Salmonella enterica enterica serovar Typhi Ty2
gcggaucagacggcugac

SEQ ID NO: 1736135 - RNA, 20 nt, Salmonella enterica enterica serovar Typhi Ty2
gcggauaagcgcagcgccau

SEQ ID NO: 1736136 - RNA, 19 nt, Salmonella enterica enterica serovar Typhi Ty2
gcggauaagauagcaggcg

SEQ ID NO: 1736137 - RNA, 16 nt, Salmonella enterica enterica serovar Typhi Ty2
gcggauaguccugcgc

SEQ ID NO: 1736138 - RNA, 21 nt, Salmonella enterica enterica serovar Typhi Ty2
gcggauaagauagcaggcgau

SEQ ID NO: 1736139 - RNA, 18 nt, Salmonella enterica enterica serovar Typhi Ty2
gcggaucaaacuccgcgc

SEQ ID NO: 1736140 - RNA, 18 nt, Salmonella enterica enterica serovar Typhi Ty2
gcggauugccauacacgc

SEQ ID NO: 1736141 - RNA, 19 nt, Salmonella enterica enterica serovar Typhi Ty2
gcggauugccauacacgcg

SEQ ID NO: 1736142 - RNA, 19 nt, Salmonella enterica enterica serovar Typhi Ty2
gcggauuaucguccggcau

SEQ ID NO: 1736143 - RNA, 19 nt, Salmonella enterica enterica serovar Typhi Ty2
gcggcaagccgaucagcgu

SEQ ID NO: 1736144 - RNA, 15 nt, Salmonella enterica enterica serovar Typhi Ty2
aagccgucggcgcca

SEQ ID NO: 1736145 - RNA, 23 nt, Salmonella enterica enterica serovar Typhi Ty2
gcggcaauggccgcagcgccaua

SEQ ID NO: 1736146 - RNA, 15 nt, Salmonella enterica enterica serovar Typhi Ty2
aagccgccauccggc

SEQ ID NO: 1736147 - RNA, 22 nt, Salmonella enterica enterica serovar Typhi Ty2
aagccgggucagcccccaguuu

SEQ ID NO: 1736148 - RNA, 13 nt, Salmonella enterica enterica serovar Typhi Ty2
aagccuuuccgca

SEQ ID NO: 1736149 - RNA, 22 nt, Salmonella enterica enterica serovar Typhi Ty2
aagccugcacauugcaggcuuu

SEQ ID NO: 1736150 - RNA, 20 nt, Salmonella enterica enterica serovar Typhi Ty2
gcggcacgccaaaaucaggc

SEQ ID NO: 1736151 - RNA, 14 nt, Salmonella enterica enterica serovar Typhi Ty2
gcggcacaucgcgc

SEQ ID NO: 1736152 - RNA, 15 nt, Salmonella enterica enterica serovar Typhi Ty2
gcgcgcacguucagg

SEQ ID NO: 1736153 - RNA, 22 nt, Salmonella enterica enterica serovar Typhi Ty2
gcgcgcaucgggccguccggca

SEQ ID NO: 1736154 - RNA, 15 nt, Salmonella enterica enterica serovar Typhi Ty2
gcgcucgcucaucac

SEQ ID NO: 1736155 - RNA, 14 nt, Salmonella enterica enterica serovar Typhi Ty2
gcgcugaccgcgcu

SEQ ID NO: 1736156 - RNA, 15 nt, Salmonella enterica enterica serovar Typhi Ty2
gcgcucucauagccg

SEQ ID NO: 1736157 - RNA, 18 nt, Salmonella enterica enterica serovar Typhi Ty2
gcgcugccagcugcguca

SEQ ID NO: 1736158 - RNA, 18 nt, Salmonella enterica enterica serovar Typhi Ty2
gcgcugcgcgcgaugcug

SEQ ID NO: 1736159 - RNA, 20 nt, Salmonella enterica enterica serovar Typhi Ty2
gcgcugcggguagucaucgc

SEQ ID NO: 1736160 - RNA, 17 nt, Salmonella enterica enterica serovar Typhi Ty2
gcgcugcggucagggcu

SEQ ID NO: 1736161 - RNA, 18 nt, Salmonella enterica enterica serovar Typhi Ty2
gcgcugcguuuaucaggc

SEQ ID NO: 1736162 - RNA, 23 nt, Salmonella enterica enterica serovar Typhi Ty2
gcgcuggcgcacgcgucaucggc

SEQ ID NO: 1736163 - RNA, 18 nt, Salmonella enterica enterica serovar Typhi Ty2
gcgcuggccuucauaccg

SEQ ID NO: 1736164 - RNA, 18 nt, Salmonella enterica enterica serovar Typhi Ty2
gcgcuguucuugcugcug

SEQ ID NO: 1736165 - RNA, 23 nt, Salmonella enterica enterica serovar Typhi Ty2
gcgcuguucuugcugcugcugau

SEQ ID NO: 1736166 - RNA, 20 nt, Salmonella enterica enterica serovar Typhi Ty2
gcgcuuaccgggccuacagg

SEQ ID NO: 1736167 - RNA, 22 nt, Salmonella enterica enterica serovar Typhi Ty2
gcgcuuaccgggccgacaggcg

SEQ ID NO: 1736168 - RNA, 24 nt, Salmonella enterica enterica serovar Typhi Ty2
gcgcuuacacacccggccuaucaa

SEQ ID NO: 1736169 - RNA, 18 nt, Salmonella enterica enterica serovar Typhi Ty2
gcgcuguuuuuacgccau

SEQ ID NO: 1736170 - RNA, 18 nt, Salmonella enterica enterica serovar Typhi Ty2
gcgcugugcuaucaggcc

SEQ ID NO: 1736171 - RNA, 23 nt, Salmonella enterica enterica serovar Typhi Ty2
gcgcugugcuaucaggccuacaa

SEQ ID NO: 1736172 - RNA, 12 nt, Salmonella enterica enterica serovar Typhi Ty2
gcgcugucgccg

SEQ ID NO: 1736173 - RNA, 20 nt, Salmonella enterica enterica serovar Typhi Ty2
gcgcuuaccgggccuacacg

SEQ ID NO: 1736174 - RNA, 17 nt, Salmonella enterica enterica serovar Typhi Ty2
gcgcuuccagacuacgg

SEQ ID NO: 1736175 - RNA, 21 nt, Salmonella enterica enterica serovar Typhi Ty2
gcgcuucguugagcuuaucgg

SEQ ID NO: 1736176 - RNA, 17 nt, Salmonella enterica enterica serovar Typhi Ty2
gcgcuguaacuucacgc

SEQ ID NO: 1736177 - RNA, 16 nt, Salmonella enterica enterica serovar Typhi Ty2
gcgcugguagcaccga

SEQ ID NO: 1736178 - RNA, 15 nt, Salmonella enterica enterica serovar Typhi Ty2
gcgcuggcgcgucug

SEQ ID NO: 1736179 - RNA, 14 nt, Salmonella enterica enterica serovar Typhi Ty2
gcgcuggcggcgac

SEQ ID NO: 1736180 - RNA, 12 nt, Salmonella enterica enterica serovar Typhi Ty2
gcgcuggcguga

SEQ ID NO: 1736181 - RNA, 17 nt, Salmonella enterica enterica serovar Typhi Ty2
gcggaaucuccggcgaa

SEQ ID NO: 1736182 - RNA, 21 nt, Salmonella enterica enterica serovar Typhi Ty2
gcggaauucccacaucgcgau

SEQ ID NO: 1736183 - RNA, 16 nt, Salmonella enterica enterica serovar Typhi Ty2
gcggaaucgcuuccug

SEQ ID NO: 1736184 - RNA, 23 nt, Salmonella enterica enterica serovar Typhi Ty2
gcggaagggauucccauccgugc

SEQ ID NO: 1736185 - RNA, 21 nt, Salmonella enterica enterica serovar Typhi Ty2
gcggaaguagccuccggcggu

SEQ ID NO: 1736186 - RNA, 23 nt, Salmonella enterica enterica serovar Typhi Ty2
gcggaaauuagcccgcuucacgc

SEQ ID NO: 1736187 - RNA, 19 nt, Salmonella enterica enterica serovar Typhi Ty2
gcggaaauuagcccgcuuc

SEQ ID NO: 1736188 - RNA, 16 nt, Salmonella enterica enterica serovar Typhi Ty2
gcggaaauguagcccc

SEQ ID NO: 1736189 - RNA, 21 nt, Salmonella enterica enterica serovar Typhi Ty2
gcgcuuuacugucgcuggaua

SEQ ID NO: 1736190 - RNA, 17 nt, Salmonella enterica enterica serovar Typhi Ty2
gcgcuugcgccgccauc

SEQ ID NO: 1736191 - RNA, 19 nt, Salmonella enterica enterica serovar Typhi Ty2
gcggaaaauauucagcaca

SEQ ID NO: 1736192 - RNA, 21 nt, Salmonella enterica enterica serovar Typhi Ty2
gcgcuuuccagucccugaaga

SEQ ID NO: 1736193 - RNA, 16 nt, Salmonella enterica enterica serovar Typhi Ty2
gcgcuuugacaucggg

SEQ ID NO: 1736194 - RNA, 23 nt, Salmonella enterica enterica serovar Typhi Ty2
gcgcuuuuaauugcgcaucaagc

SEQ ID NO: 1736195 - RNA, 14 nt, Salmonella enterica enterica serovar Typhi Ty2
gcgcuuuuucacga

SEQ ID NO: 1736196 - RNA, 14 nt, Salmonella enterica enterica serovar Typhi Ty2
gcgcuuuuccagca

SEQ ID NO: 1736197 - RNA, 20 nt, Salmonella enterica enterica serovar Typhi Ty2
gcucacgcuuauccggccua

SEQ ID NO: 1736198 - RNA, 20 nt, Salmonella enterica enterica serovar Typhi Ty2
gcucacggcacgcccuucgu

SEQ ID NO: 1736199 - RNA, 13 nt, Salmonella enterica enterica serovar Typhi Ty2
gcucagaccgauc

SEQ ID NO: 1736200 - RNA, 17 nt, Salmonella enterica enterica serovar Typhi Ty2
gcuccggguugccugau

SEQ ID NO: 1736201 - RNA, 17 nt, Salmonella enterica enterica serovar Typhi Ty2
gcuccgguuuuugcgcg

SEQ ID NO: 1736202 - RNA, 19 nt, Salmonella enterica enterica serovar Typhi Ty2
gcuccgccagggcggcaaa

SEQ ID NO: 1736203 - RNA, 13 nt, Salmonella enterica enterica serovar Typhi Ty2
gcuccucgcgaau

SEQ ID NO: 1736204 - RNA, 22 nt, Salmonella enterica enterica serovar Typhi Ty2
gcucgaguucuucacgcugaug

SEQ ID NO: 1736205 - RNA, 21 nt, Salmonella enterica enterica serovar Typhi Ty2
gcucgcucaucaguuugcgau

SEQ ID NO: 1736206 - RNA, 23 nt, Salmonella enterica enterica serovar Typhi Ty2
gcucgucaaacaguucagacacc

SEQ ID NO: 1736207 - RNA, 18 nt, Salmonella enterica enterica serovar Typhi Ty2
gcucggucacuucaaccu

SEQ ID NO: 1736208 - RNA, 18 nt, Salmonella enterica enterica serovar Typhi Ty2
gcugaccugaacgccuac

SEQ ID NO: 1736209 - RNA, 18 nt, Salmonella enterica enterica serovar Typhi Ty2
gcugaccucaauccgugc

SEQ ID NO: 1736210 - RNA, 15 nt, Salmonella enterica enterica serovar Typhi Ty2
gcugaccucaauccg

SEQ ID NO: 1736211 - RNA, 23 nt, Salmonella enterica enterica serovar Typhi Ty2
gcucuguggggggaacggcagac

SEQ ID NO: 1736212 - RNA, 20 nt, Salmonella enterica enterica serovar Typhi Ty2
gcugcgcuuaucaggccuac

SEQ ID NO: 1736213 - RNA, 19 nt, Salmonella enterica enterica serovar Typhi Ty2
gcugcgcuuaucaggccua

SEQ ID NO: 1736214 - RNA, 20 nt, Salmonella enterica enterica serovar Typhi Ty2
gcugcgcuuaccgggccuac

SEQ ID NO: 1736215 - RNA, 16 nt, Salmonella enterica enterica serovar Typhi Ty2
gcugcgcuuaucaggc

SEQ ID NO: 1736216 - RNA, 15 nt, Salmonella enterica enterica serovar Typhi Ty2
gcugcgcauccgcgg

SEQ ID NO: 1736217 - RNA, 13 nt, Salmonella enterica enterica serovar Typhi Ty2
gcugcgcagcacu

SEQ ID NO: 1736218 - RNA, 17 nt, Salmonella enterica enterica serovar Typhi Ty2
gcugccuuauccggccu

SEQ ID NO: 1736219 - RNA, 13 nt, Salmonella enterica enterica serovar Typhi Ty2
gcugccuuauccg

SEQ ID NO: 1736220 - RNA, 14 nt, Salmonella enterica enterica serovar Typhi Ty2
gcugccgucaaagu

SEQ ID NO: 1736221 - RNA, 15 nt, Salmonella enterica enterica serovar Typhi Ty2
gcugcccggauaacc

SEQ ID NO: 1736222 - RNA, 16 nt, Salmonella enterica enterica serovar Typhi Ty2
gcugcauaaugcgcga

SEQ ID NO: 1736223 - RNA, 13 nt, Salmonella enterica enterica serovar Typhi Ty2
gcugcauauacuc

SEQ ID NO: 1736224 - RNA, 13 nt, Salmonella enterica enterica serovar Typhi Ty2
gcugccaucaggc

SEQ ID NO: 1736225 - RNA, 14 nt, Salmonella enterica enterica serovar Typhi Ty2
gcugccaucaggca

SEQ ID NO: 1736226 - RNA, 18 nt, Salmonella enterica enterica serovar Typhi Ty2
gcugccagucugcccggc

SEQ ID NO: 1736227 - RNA, 20 nt, Salmonella enterica enterica serovar Typhi Ty2
gcugacgcccaucagcaucc

SEQ ID NO: 1736228 - RNA, 15 nt, Salmonella enterica enterica serovar Typhi Ty2
gcugacgcugcccgc

SEQ ID NO: 1736229 - RNA, 19 nt, Salmonella enterica enterica serovar Typhi Ty2
gcugacugcaaaucugccg

SEQ ID NO: 1736230 - RNA, 18 nt, Salmonella enterica enterica serovar Typhi Ty2
gcugaugcuguaggccgg

SEQ ID NO: 1736231 - RNA, 19 nt, Salmonella enterica enterica serovar Typhi Ty2
gcugauuuuuuugcuggcc

SEQ ID NO: 1736232 - RNA, 17 nt, Salmonella enterica enterica serovar Typhi Ty2
gcuggcgauauccgugc

SEQ ID NO: 1736233 - RNA, 16 nt, Salmonella enterica enterica serovar Typhi Ty2
gcuggcgaauccggga

SEQ ID NO: 1736234 - RNA, 18 nt, Salmonella enterica enterica serovar Typhi Ty2
gcuggcaguuugcgcuga

SEQ ID NO: 1736235 - RNA, 20 nt, Salmonella enterica enterica serovar Typhi Ty2
gcuggcauaaccgcagcgcg

SEQ ID NO: 1736236 - RNA, 20 nt, Salmonella enterica enterica serovar Typhi Ty2
gcuggauaauugcucugcca

SEQ ID NO: 1736237 - RNA, 21 nt, Salmonella enterica enterica serovar Typhi Ty2
gcuggagccuguuccagcugc

SEQ ID NO: 1736238 - RNA, 17 nt, Salmonella enterica enterica serovar Typhi Ty2
gcuggacgucaugccgc

SEQ ID NO: 1736239 - RNA, 15 nt, Salmonella enterica enterica serovar Typhi Ty2
gcuggacgugauaau

SEQ ID NO: 1736240 - RNA, 12 nt, Salmonella enterica enterica serovar Typhi Ty2
gcugcuucacgg

SEQ ID NO: 1736241 - RNA, 19 nt, Salmonella enterica enterica serovar Typhi Ty2
gcgucugaguuaaugccau

SEQ ID NO: 1736242 - RNA, 14 nt, Salmonella enterica enterica serovar Typhi Ty2
gcgucugcggcuga

SEQ ID NO: 1736243 - RNA, 17 nt, Salmonella enterica enterica serovar Typhi Ty2
gcgugcgccauccggcg

SEQ ID NO: 1736244 - RNA, 22 nt, Salmonella enterica enterica serovar Typhi Ty2
aagcuuuuaguuacgcacgcca

SEQ ID NO: 1736245 - RNA, 13 nt, Salmonella enterica enterica serovar Typhi Ty2
aaggaagauagcg

SEQ ID NO: 1736246 - RNA, 19 nt, Salmonella enterica enterica serovar Typhi Ty2
aaggaauuaugcagacgcu

SEQ ID NO: 1736247 - RNA, 14 nt, Salmonella enterica enterica serovar Typhi Ty2
aaggacaggugcgc

SEQ ID NO: 1736248 - RNA, 15 nt, Salmonella enterica enterica serovar Typhi Ty2
gcguguaaucgccgu

SEQ ID NO: 1736249 - RNA, 19 nt, Salmonella enterica enterica serovar Typhi Ty2
gcguguaacugcaaacgcg

SEQ ID NO: 1736250 - RNA, 20 nt, Salmonella enterica enterica serovar Typhi Ty2
gcguggucauuaggcguaau

SEQ ID NO: 1736251 - RNA, 19 nt, Salmonella enterica enterica serovar Typhi Ty2
gcgugcgcugcggccagac

SEQ ID NO: 1736252 - RNA, 15 nt, Salmonella enterica enterica serovar Typhi Ty2
gcguccgccaucgcc

SEQ ID NO: 1736253 - RNA, 15 nt, Salmonella enterica enterica serovar Typhi Ty2
gcgucaaaucgccga

SEQ ID NO: 1736254 - RNA, 17 nt, Salmonella enterica enterica serovar Typhi Ty2
gcgucaaaguugcauca

SEQ ID NO: 1736255 - RNA, 22 nt, Salmonella enterica enterica serovar Typhi Ty2
gcgucaguaaaagcccgcccag

SEQ ID NO: 1736256 - RNA, 19 nt, Salmonella enterica enterica serovar Typhi Ty2
gcgucagaaauccgcgaau

SEQ ID NO: 1736257 - RNA, 19 nt, Salmonella enterica enterica serovar Typhi Ty2
gcgucaugucguuagaacc

SEQ ID NO: 1736258 - RNA, 20 nt, Salmonella enterica enterica serovar Typhi Ty2
gcgucauggcuaaucgccac

SEQ ID NO: 1736259 - RNA, 13 nt, Salmonella enterica enterica serovar Typhi Ty2
gcgucauccggca

SEQ ID NO: 1736260 - RNA, 14 nt, Salmonella enterica enterica serovar Typhi Ty2
gcgucauccugcag

SEQ ID NO: 1736261 - RNA, 20 nt, Salmonella enterica enterica serovar Typhi Ty2
gcguagccgccgagcgccgu

SEQ ID NO: 1736262 - RNA, 19 nt, Salmonella enterica enterica serovar Typhi Ty2
gcguaucucauugaugguc

SEQ ID NO: 1736263 - RNA, 18 nt, Salmonella enterica enterica serovar Typhi Ty2
gcguagcgcauccggcag

SEQ ID NO: 1736264 - RNA, 18 nt, Salmonella enterica enterica serovar Typhi Ty2
gcguaggguagaucacgc

SEQ ID NO: 1736265 - RNA, 23 nt, Salmonella enterica enterica serovar Typhi Ty2
gcucaccgagacugcccggcaua

SEQ ID NO: 1736266 - RNA, 23 nt, Salmonella enterica enterica serovar Typhi Ty2
gcucaccagcugacgcagcaguu

SEQ ID NO: 1736267 - RNA, 19 nt, Salmonella enterica enterica serovar Typhi Ty2
gcucaagccagguugcgcc

SEQ ID NO: 1736268 - RNA, 22 nt, Salmonella enterica enterica serovar Typhi Ty2
gcucaagaguaggccggauaag

SEQ ID NO: 1736269 - RNA, 20 nt, Salmonella enterica enterica serovar Typhi Ty2
gcucaauguagcgucagccg

SEQ ID NO: 1736270 - RNA, 13 nt, Salmonella enterica enterica serovar Typhi Ty2
gcucaauauacuu

SEQ ID NO: 1736271 - RNA, 21 nt, Salmonella enterica enterica serovar Typhi Ty2
gcuaugcuuaccaucuggccu

SEQ ID NO: 1736272 - RNA, 21 nt, Salmonella enterica enterica serovar Typhi Ty2
gcuauggccguuuacgagcca

SEQ ID NO: 1736273 - RNA, 20 nt, Salmonella enterica enterica serovar Typhi Ty2
gcuaugcggcguuaauggcc

SEQ ID NO: 1736274 - RNA, 23 nt, Salmonella enterica enterica serovar Typhi Ty2
gcuauggugcgggguuuccggca

SEQ ID NO: 1736275 - RNA, 16 nt, Salmonella enterica enterica serovar Typhi Ty2
gcuauauuccagccag

SEQ ID NO: 1736276 - RNA, 14 nt, Salmonella enterica enterica serovar Typhi Ty2
gcuauccagcucac

SEQ ID NO: 1736277 - RNA, 23 nt, Salmonella enterica enterica serovar Typhi Ty2
gcuaucugcuccgccagcaaugc

SEQ ID NO: 1736278 - RNA, 22 nt, Salmonella enterica enterica serovar Typhi Ty2
gcuaucggcgggguuuaacgag

SEQ ID NO: 1736279 - RNA, 16 nt, Salmonella enterica enterica serovar Typhi Ty2
gcuacccgcugacgcu

SEQ ID NO: 1736280 - RNA, 16 nt, Salmonella enterica enterica serovar Typhi Ty2
gcuacgccuuacccga

SEQ ID NO: 1736281 - RNA, 16 nt, Salmonella enterica enterica serovar Typhi Ty2
gcuacgcuuaucaggc

SEQ ID NO: 1736282 - RNA, 17 nt, Salmonella enterica enterica serovar Typhi Ty2
gcuacgcuuaucaggcc

SEQ ID NO: 1736283 - RNA, 18 nt, Salmonella enterica enterica serovar Typhi Ty2
gcuaaucccgcucgccag

SEQ ID NO: 1736284 - RNA, 19 nt, Salmonella enterica enterica serovar Typhi Ty2
gcuacacgcgaauagccag

SEQ ID NO: 1736285 - RNA, 19 nt, Salmonella enterica enterica serovar Typhi Ty2
gcuagcuuaucgggccuac

SEQ ID NO: 1736286 - RNA, 19 nt, Salmonella enterica enterica serovar Typhi Ty2
gcuacgcuuaucaggccua

SEQ ID NO: 1736287 - RNA, 21 nt, Salmonella enterica enterica serovar Typhi Ty2
gcuacgccuuauccggccuac

SEQ ID NO: 1736288 - RNA, 17 nt, Salmonella enterica enterica serovar Typhi Ty2
gcuacgccuuauccggc

SEQ ID NO: 1736289 - RNA, 16 nt, Salmonella enterica enterica serovar Typhi Ty2
gcuacgccuuauccgg

SEQ ID NO: 1736290 - RNA, 20 nt, Salmonella enterica enterica serovar Typhi Ty2
gcuacgcuuaucaggccuac

SEQ ID NO: 1736291 - RNA, 14 nt, Salmonella enterica enterica serovar Typhi Ty2
gcuacuggcaaaug

SEQ ID NO: 1736292 - RNA, 21 nt, Salmonella enterica enterica serovar Typhi Ty2
gcguuucaagcaguuccagca

SEQ ID NO: 1736293 - RNA, 15 nt, Salmonella enterica enterica serovar Typhi Ty2
gcguuuagcgccagc

SEQ ID NO: 1736294 - RNA, 20 nt, Salmonella enterica enterica serovar Typhi Ty2
gcguuuaucaggccuacaag

SEQ ID NO: 1736295 - RNA, 18 nt, Salmonella enterica enterica serovar Typhi Ty2
gcguuucguuuagcgccu

SEQ ID NO: 1736296 - RNA, 22 nt, Salmonella enterica enterica serovar Typhi Ty2
gcguuucguaauggccuacaca

SEQ ID NO: 1736297 - RNA, 15 nt, Salmonella enterica enterica serovar Typhi Ty2
gcguugucgcugauu

SEQ ID NO: 1736298 - RNA, 21 nt, Salmonella enterica enterica serovar Typhi Ty2
gcguuguccuauugcaacgcc

SEQ ID NO: 1736299 - RNA, 13 nt, Salmonella enterica enterica serovar Typhi Ty2
gcguuguaccguu

SEQ ID NO: 1736300 - RNA, 18 nt, Salmonella enterica enterica serovar Typhi Ty2
gcguuguaaucgccugaa

SEQ ID NO: 1736301 - RNA, 21 nt, Salmonella enterica enterica serovar Typhi Ty2
gcuaacgcuuauccggccuac

SEQ ID NO: 1736302 - RNA, 17 nt, Salmonella enterica enterica serovar Typhi Ty2
gcuaacgcuuauccggc

SEQ ID NO: 1736303 - RNA, 15 nt, Salmonella enterica enterica serovar Typhi Ty2
gcuaaccaucagcgg

SEQ ID NO: 1736304 - RNA, 14 nt, Salmonella enterica enterica serovar Typhi Ty2
gcuaaacagcaaau

SEQ ID NO: 1736305 - RNA, 22 nt, Salmonella enterica enterica serovar Typhi Ty2
gcuaaaccacaugaccagcgcc

SEQ ID NO: 1736306 - RNA, 18 nt, Salmonella enterica enterica serovar Typhi Ty2
gcguuuuccaucaucagg

SEQ ID NO: 1736307 - RNA, 13 nt, Salmonella enterica enterica serovar Typhi Ty2
gcguuuuauccgu

SEQ ID NO: 1736308 - RNA, 14 nt, Salmonella enterica enterica serovar Typhi Ty2
gcguuuuagcgcca

SEQ ID NO: 1736309 - RNA, 13 nt, Salmonella enterica enterica serovar Typhi Ty2
gcguugauggcgu

SEQ ID NO: 1736310 - RNA, 14 nt, Salmonella enterica enterica serovar Typhi Ty2
gcguugaccgcuuc

SEQ ID NO: 1736311 - RNA, 22 nt, Salmonella enterica enterica serovar Typhi Ty2
gcgugugucccggacaauguaa

SEQ ID NO: 1736312 - RNA, 19 nt, Salmonella enterica enterica serovar Typhi Ty2
gcguuccccaacagcgacc

SEQ ID NO: 1736313 - RNA, 15 nt, Salmonella enterica enterica serovar Typhi Ty2
gcguuccuuaucagc

SEQ ID NO: 1736314 - RNA, 13 nt, Salmonella enterica enterica serovar Typhi Ty2
gcguuccuuauca

SEQ ID NO: 1736315 - RNA, 23 nt, Salmonella enterica enterica serovar Typhi Ty2
gcguucggaagacugcuccggca

SEQ ID NO: 1736316 - RNA, 15 nt, Salmonella enterica enterica serovar Typhi Ty2
gucacccacgccgga

SEQ ID NO: 1736317 - RNA, 13 nt, Salmonella enterica enterica serovar Typhi Ty2
gucaacgccaagc

SEQ ID NO: 1736318 - RNA, 17 nt, Salmonella enterica enterica serovar Typhi Ty2
gucaacgccaagcgcgg

SEQ ID NO: 1736319 - RNA, 16 nt, Salmonella enterica enterica serovar Typhi Ty2
gucaacucgcacagua

SEQ ID NO: 1736320 - RNA, 18 nt, Salmonella enterica enterica serovar Typhi Ty2
gucaacgguaaaauggcu

SEQ ID NO: 1736321 - RNA, 19 nt, Salmonella enterica enterica serovar Typhi Ty2
gucaacugcgccugcucag

SEQ ID NO: 1736322 - RNA, 22 nt, Salmonella enterica enterica serovar Typhi Ty2
gucacaauaugguuauccagca

SEQ ID NO: 1736323 - RNA, 14 nt, Salmonella enterica enterica serovar Typhi Ty2
gucaauaaucgcgc

SEQ ID NO: 1736324 - RNA, 19 nt, Salmonella enterica enterica serovar Typhi Ty2
guaugacacccguguguua

SEQ ID NO: 1736325 - RNA, 11 nt, Salmonella enterica enterica serovar Typhi Ty2
guaucuuccag

SEQ ID NO: 1736326 - RNA, 16 nt, Salmonella enterica enterica serovar Typhi Ty2
guaucuuccagcguaa

SEQ ID NO: 1736327 - RNA, 16 nt, Salmonella enterica enterica serovar Typhi Ty2
guaugcaccguuauuc

SEQ ID NO: 1736328 - RNA, 20 nt, Salmonella enterica enterica serovar Typhi Ty2
guaucccgccagcggcgcca

SEQ ID NO: 1736329 - RNA, 22 nt, Salmonella enterica enterica serovar Typhi Ty2
guaucaucgcuuaacggcccag

SEQ ID NO: 1736330 - RNA, 12 nt, Salmonella enterica enterica serovar Typhi Ty2
guaucagcggaa

SEQ ID NO: 1736331 - RNA, 16 nt, Salmonella enterica enterica serovar Typhi Ty2
guaucauguuccggca

SEQ ID NO: 1736332 - RNA, 15 nt, Salmonella enterica enterica serovar Typhi Ty2
guauccagcgcguaa

SEQ ID NO: 1736333 - RNA, 14 nt, Salmonella enterica enterica serovar Typhi Ty2
guauccagcggcaa

SEQ ID NO: 1736334 - RNA, 21 nt, Salmonella enterica enterica serovar Typhi Ty2
guaucugucccagccuuccug

SEQ ID NO: 1736335 - RNA, 16 nt, Salmonella enterica enterica serovar Typhi Ty2
guaucgcgacagcgcu

SEQ ID NO: 1736336 - RNA, 13 nt, Salmonella enterica enterica serovar Typhi Ty2
gucaaaaucgcgc

SEQ ID NO: 1736337 - RNA, 22 nt, Salmonella enterica enterica serovar Typhi Ty2
gucaaauucacccguuauucau

SEQ ID NO: 1736338 - RNA, 19 nt, Salmonella enterica enterica serovar Typhi Ty2
guauuaccgcucguuaauc

SEQ ID NO: 1736339 - RNA, 19 nt, Salmonella enterica enterica serovar Typhi Ty2
guauuauuaaugucgucca

SEQ ID NO: 1736340 - RNA, 16 nt, Salmonella enterica enterica serovar Typhi Ty2
guauucgugcaucagg

SEQ ID NO: 1736341 - RNA, 21 nt, Salmonella enterica enterica serovar Typhi Ty2
guauugccggauaagacgcag

SEQ ID NO: 1736342 - RNA, 14 nt, Salmonella enterica enterica serovar Typhi Ty2
gucagccgggauaa

SEQ ID NO: 1736343 - RNA, 20 nt, Salmonella enterica enterica serovar Typhi Ty2
gucauaugcacgcgauuugc

SEQ ID NO: 1736344 - RNA, 17 nt, Salmonella enterica enterica serovar Typhi Ty2
gucagaggaauucucca

SEQ ID NO: 1736345 - RNA, 15 nt, Salmonella enterica enterica serovar Typhi Ty2
gucacgccauuaucg

SEQ ID NO: 1736346 - RNA, 15 nt, Salmonella enterica enterica serovar Typhi Ty2
gucaccgggcgcugg

SEQ ID NO: 1736347 - RNA, 16 nt, Salmonella enterica enterica serovar Typhi Ty2
guaagagagccuuaca

SEQ ID NO: 1736348 - RNA, 13 nt, Salmonella enterica enterica serovar Typhi Ty2
guaagagagugag

SEQ ID NO: 1736349 - RNA, 13 nt, Salmonella enterica enterica serovar Typhi Ty2
guaagagguaucc

SEQ ID NO: 1736350 - RNA, 22 nt, Salmonella enterica enterica serovar Typhi Ty2
guaagcaauauggcugcgauaa

SEQ ID NO: 1736351 - RNA, 17 nt, Salmonella enterica enterica serovar Typhi Ty2
guaagaaugcgcgucag

SEQ ID NO: 1736352 - RNA, 20 nt, Salmonella enterica enterica serovar Typhi Ty2
guaacuauuucuaucaggua

SEQ ID NO: 1736353 - RNA, 15 nt, Salmonella enterica enterica serovar Typhi Ty2
guaacucaucgccag

SEQ ID NO: 1736354 - RNA, 22 nt, Salmonella enterica enterica serovar Typhi Ty2
guaaauucucuauacugcugac

SEQ ID NO: 1736355 - RNA, 19 nt, Salmonella enterica enterica serovar Typhi Ty2
guaaauuccgcaggcaaca

SEQ ID NO: 1736356 - RNA, 15 nt, Salmonella enterica enterica serovar Typhi Ty2
guaaagguuuucacg

SEQ ID NO: 1736357 - RNA, 19 nt, Salmonella enterica enterica serovar Typhi Ty2
guaaaucugccgucaucga

SEQ ID NO: 1736358 - RNA, 19 nt, Salmonella enterica enterica serovar Typhi Ty2
guaaaugccuuauccggcc

SEQ ID NO: 1736359 - RNA, 17 nt, Salmonella enterica enterica serovar Typhi Ty2
guaagcccuauuaggca

SEQ ID NO: 1736360 - RNA, 16 nt, Salmonella enterica enterica serovar Typhi Ty2
guaagcuauuccugua

SEQ ID NO: 1736361 - RNA, 22 nt, Salmonella enterica enterica serovar Typhi Ty2
guaagcgcagcgccaucaggca

SEQ ID NO: 1736362 - RNA, 17 nt, Salmonella enterica enterica serovar Typhi Ty2
guaaguuaaaacgccau

SEQ ID NO: 1736363 - RNA, 20 nt, Salmonella enterica enterica serovar Typhi Ty2
guaauaacuuaaacgccgga

SEQ ID NO: 1736364 - RNA, 17 nt, Salmonella enterica enterica serovar Typhi Ty2
guaauaacucaugacuu

SEQ ID NO: 1736365 - RNA, 20 nt, Salmonella enterica enterica serovar Typhi Ty2
guaaaacuggcuaucgccgu

SEQ ID NO: 1736366 - RNA, 14 nt, Salmonella enterica enterica serovar Typhi Ty2
guaaauccgcgaug

SEQ ID NO: 1736367 - RNA, 12 nt, Salmonella enterica enterica serovar Typhi Ty2
guaaaucaggcc

SEQ ID NO: 1736368 - RNA, 20 nt, Salmonella enterica enterica serovar Typhi Ty2
guaaauaaugcgguucggca

SEQ ID NO: 1736369 - RNA, 11 nt, Salmonella enterica enterica serovar Typhi Ty2
guaaauaccag

SEQ ID NO: 1736370 - RNA, 23 nt, Salmonella enterica enterica serovar Typhi Ty2
gguuugucgcuuuucacggucaa

SEQ ID NO: 1736371 - RNA, 18 nt, Salmonella enterica enterica serovar Typhi Ty2
guacaucuacuucagcac

SEQ ID NO: 1736372 - RNA, 12 nt, Salmonella enterica enterica serovar Typhi Ty2
guacauauacug

SEQ ID NO: 1736373 - RNA, 23 nt, Salmonella enterica enterica serovar Typhi Ty2
guacagcuuaaucaccagcgcau

SEQ ID NO: 1736374 - RNA, 13 nt, Salmonella enterica enterica serovar Typhi Ty2
guaaucgccgcga

SEQ ID NO: 1736375 - RNA, 20 nt, Salmonella enterica enterica serovar Typhi Ty2
guaaucuacaaacgcggaca

SEQ ID NO: 1736376 - RNA, 16 nt, Salmonella enterica enterica serovar Typhi Ty2
guaauccagaggguaa

SEQ ID NO: 1736377 - RNA, 15 nt, Salmonella enterica enterica serovar Typhi Ty2
guacggcgucagcca

SEQ ID NO: 1736378 - RNA, 22 nt, Salmonella enterica enterica serovar Typhi Ty2
guacgacacccgauacacgccg

SEQ ID NO: 1736379 - RNA, 21 nt, Salmonella enterica enterica serovar Typhi Ty2
guagcggaaccagccaugcca

SEQ ID NO: 1736380 - RNA, 20 nt, Salmonella enterica enterica serovar Typhi Ty2
guagcucaagcccgcgucgu

SEQ ID NO: 1736381 - RNA, 22 nt, Salmonella enterica enterica serovar Typhi Ty2
guagcucaguugguuagagcac

SEQ ID NO: 1736382 - RNA, 16 nt, Salmonella enterica enterica serovar Typhi Ty2
guagcgccaucaggca

SEQ ID NO: 1736383 - RNA, 21 nt, Salmonella enterica enterica serovar Typhi Ty2
guagcgccugugcuuucgcca

SEQ ID NO: 1736384 - RNA, 14 nt, Salmonella enterica enterica serovar Typhi Ty2
guagcgacugauaa

SEQ ID NO: 1736385 - RNA, 14 nt, Salmonella enterica enterica serovar Typhi Ty2
guagcagcgccagc

SEQ ID NO: 1736386 - RNA, 14 nt, Salmonella enterica enterica serovar Typhi Ty2
guagcauaaucagg

SEQ ID NO: 1736387 - RNA, 16 nt, Salmonella enterica enterica serovar Typhi Ty2
guacuugcgccgccau

SEQ ID NO: 1736388 - RNA, 22 nt, Salmonella enterica enterica serovar Typhi Ty2
guagacccggcauugaaacgca

SEQ ID NO: 1736389 - RNA, 23 nt, Salmonella enterica enterica serovar Typhi Ty2
guagaccgcccaggauaucgcgg

SEQ ID NO: 1736390 - RNA, 14 nt, Salmonella enterica enterica serovar Typhi Ty2
guagcugcgccagc

SEQ ID NO: 1736391 - RNA, 18 nt, Salmonella enterica enterica serovar Typhi Ty2
aagucgccacccggcuuu

SEQ ID NO: 1736392 - RNA, 18 nt, Salmonella enterica enterica serovar Typhi Ty2
aagucgaugaaugacgag

SEQ ID NO: 1736393 - RNA, 18 nt, Salmonella enterica enterica serovar Typhi Ty2
guaggcgaacuacaggcg

SEQ ID NO: 1736394 - RNA, 15 nt, Salmonella enterica enterica serovar Typhi Ty2
guaucacaaucagcc

SEQ ID NO: 1736395 - RNA, 22 nt, Salmonella enterica enterica serovar Typhi Ty2
guauauuugccgaacgcgucca

SEQ ID NO: 1736396 - RNA, 18 nt, Salmonella enterica enterica serovar Typhi Ty2
guaguaaccccaguagcc

SEQ ID NO: 1736397 - RNA, 18 nt, Salmonella enterica enterica serovar Typhi Ty2
guaguacaugccauccgg

SEQ ID NO: 1736398 - RNA, 20 nt, Salmonella enterica enterica serovar Typhi Ty2
guccugaucaaggcgcaaaa

SEQ ID NO: 1736399 - RNA, 16 nt, Salmonella enterica enterica serovar Typhi Ty2
guccugguacaucgcg

SEQ ID NO: 1736400 - RNA, 14 nt, Salmonella enterica enterica serovar Typhi Ty2
gucgacaugcgcau

SEQ ID NO: 1736401 - RNA, 20 nt, Salmonella enterica enterica serovar Typhi Ty2
gucaucaaaaucaucgccac

SEQ ID NO: 1736402 - RNA, 22 nt, Salmonella enterica enterica serovar Typhi Ty2
gucaucaaaaucaucgccacga

SEQ ID NO: 1736403 - RNA, 18 nt, Salmonella enterica enterica serovar Typhi Ty2
gucauccgcguaaucgcg

SEQ ID NO: 1736404 - RNA, 20 nt, Salmonella enterica enterica serovar Typhi Ty2
gucaucgcggaaagcaaugu

SEQ ID NO: 1736405 - RNA, 18 nt, Salmonella enterica enterica serovar Typhi Ty2
guccauccgcacgaacgc

SEQ ID NO: 1736406 - RNA, 12 nt, Salmonella enterica enterica serovar Typhi Ty2
guccaucaggcu

SEQ ID NO: 1736407 - RNA, 14 nt, Salmonella enterica enterica serovar Typhi Ty2
guccggauucgcgg

SEQ ID NO: 1736408 - RNA, 18 nt, Salmonella enterica enterica serovar Typhi Ty2
gucggcgcaguucgccgc

SEQ ID NO: 1736409 - RNA, 17 nt, Salmonella enterica enterica serovar Typhi Ty2
gucgcugauugccgcca

SEQ ID NO: 1736410 - RNA, 22 nt, Salmonella enterica enterica serovar Typhi Ty2
gucgcuaccacagaaaucgccg

SEQ ID NO: 1736411 - RNA, 23 nt, Salmonella enterica enterica serovar Typhi Ty2
gucgcucacauucauugccgcca

SEQ ID NO: 1736412 - RNA, 22 nt, Salmonella enterica enterica serovar Typhi Ty2
gucgcucgacauagguucugcg

SEQ ID NO: 1736413 - RNA, 22 nt, Salmonella enterica enterica serovar Typhi Ty2
gucggaaaucuguuccagcgag

SEQ ID NO: 1736414 - RNA, 18 nt, Salmonella enterica enterica serovar Typhi Ty2
gucgcuucgcuuaucugg

SEQ ID NO: 1736415 - RNA, 14 nt, Salmonella enterica enterica serovar Typhi Ty2
gucggacagcgaca

SEQ ID NO: 1736416 - RNA, 18 nt, Salmonella enterica enterica serovar Typhi Ty2
gucgcggauaugcagcag

SEQ ID NO: 1736417 - RNA, 14 nt, Salmonella enterica enterica serovar Typhi Ty2
gucgcgauccgcga

SEQ ID NO: 1736418 - RNA, 22 nt, Salmonella enterica enterica serovar Typhi Ty2
gucgcgaaugcgcaaucccgga

SEQ ID NO: 1736419 - RNA, 16 nt, Salmonella enterica enterica serovar Typhi Ty2
gucgcguucagcgccu

SEQ ID NO: 1736420 - RNA, 20 nt, Salmonella enterica enterica serovar Typhi Ty2
gucgcccggaaauggguauc

SEQ ID NO: 1736421 - RNA, 13 nt, Salmonella enterica enterica serovar Typhi Ty2
gucgccauccuga

SEQ ID NO: 1736422 - RNA, 15 nt, Salmonella enterica enterica serovar Typhi Ty2
gucgccgcccaucgg

SEQ ID NO: 1736423 - RNA, 16 nt, Salmonella enterica enterica serovar Typhi Ty2
gucgccgcccaucggg

SEQ ID NO: 1736424 - RNA, 22 nt, Salmonella enterica enterica serovar Typhi Ty2
ggugcuacgggcgcugucgccg

SEQ ID NO: 1736425 - RNA, 19 nt, Salmonella enterica enterica serovar Typhi Ty2
ggugcgguuacguccggca

SEQ ID NO: 1736426 - RNA, 19 nt, Salmonella enterica enterica serovar Typhi Ty2
ggugcagcagacugguaac

SEQ ID NO: 1736427 - RNA, 17 nt, Salmonella enterica enterica serovar Typhi Ty2
ggucuccaucagacguu

SEQ ID NO: 1736428 - RNA, 13 nt, Salmonella enterica enterica serovar Typhi Ty2
ggucuugauggcg

SEQ ID NO: 1736429 - RNA, 17 nt, Salmonella enterica enterica serovar Typhi Ty2
ggugauuaacagcgcca

SEQ ID NO: 1736430 - RNA, 18 nt, Salmonella enterica enterica serovar Typhi Ty2
ggugauucugcaucccgc

SEQ ID NO: 1736431 - RNA, 23 nt, Salmonella enterica enterica serovar Typhi Ty2
ggugagaucgguaauuuccacgc

SEQ ID NO: 1736432 - RNA, 12 nt, Salmonella enterica enterica serovar Typhi Ty2
ggugagcgccgc

SEQ ID NO: 1736433 - RNA, 21 nt, Salmonella enterica enterica serovar Typhi Ty2
ggugaauagcauugccgucaa

SEQ ID NO: 1736434 - RNA, 17 nt, Salmonella enterica enterica serovar Typhi Ty2
ggugaauaacuucacgc

SEQ ID NO: 1736435 - RNA, 14 nt, Salmonella enterica enterica serovar Typhi Ty2
gguaccccagccau

SEQ ID NO: 1736436 - RNA, 18 nt, Salmonella enterica enterica serovar Typhi Ty2
gguaaucacugccgccac

SEQ ID NO: 1736437 - RNA, 18 nt, Salmonella enterica enterica serovar Typhi Ty2
gguaaggcuauagccgcg

SEQ ID NO: 1736438 - RNA, 17 nt, Salmonella enterica enterica serovar Typhi Ty2
gguaagcgcagcgccau

SEQ ID NO: 1736439 - RNA, 22 nt, Salmonella enterica enterica serovar Typhi Ty2
gguaagacguuuaugccgccau

SEQ ID NO: 1736440 - RNA, 18 nt, Salmonella enterica enterica serovar Typhi Ty2
gguaaauccacaaccggc

SEQ ID NO: 1736441 - RNA, 21 nt, Salmonella enterica enterica serovar Typhi Ty2
gguaaacucacccaggcgaug

SEQ ID NO: 1736442 - RNA, 12 nt, Salmonella enterica enterica serovar Typhi Ty2
gguaaccauuuc

SEQ ID NO: 1736443 - RNA, 18 nt, Salmonella enterica enterica serovar Typhi Ty2
ggguggugugcguaucgc

SEQ ID NO: 1736444 - RNA, 16 nt, Salmonella enterica enterica serovar Typhi Ty2
ggguggucacgccauu

SEQ ID NO: 1736445 - RNA, 19 nt, Salmonella enterica enterica serovar Typhi Ty2
ggguucguuaacccggcau

SEQ ID NO: 1736446 - RNA, 19 nt, Salmonella enterica enterica serovar Typhi Ty2
gguaucaucagauccugcg

SEQ ID NO: 1736447 - RNA, 12 nt, Salmonella enterica enterica serovar Typhi Ty2
gguagcagaccg

SEQ ID NO: 1736448 - RNA, 15 nt, Salmonella enterica enterica serovar Typhi Ty2
gguagcguuauccag

SEQ ID NO: 1736449 - RNA, 14 nt, Salmonella enterica enterica serovar Typhi Ty2
gguauuauccgccg

SEQ ID NO: 1736450 - RNA, 16 nt, Salmonella enterica enterica serovar Typhi Ty2
gguauuaacaggcgcc

SEQ ID NO: 1736451 - RNA, 15 nt, Salmonella enterica enterica serovar Typhi Ty2
gguaugcggcuaaua

SEQ ID NO: 1736452 - RNA, 16 nt, Salmonella enterica enterica serovar Typhi Ty2
gguauguuugucgacc

SEQ ID NO: 1736453 - RNA, 13 nt, Salmonella enterica enterica serovar Typhi Ty2
gguauccgccaua

SEQ ID NO: 1736454 - RNA, 21 nt, Salmonella enterica enterica serovar Typhi Ty2
ggucacaucgcccugauggcg

SEQ ID NO: 1736455 - RNA, 16 nt, Salmonella enterica enterica serovar Typhi Ty2
ggucaauacaucacgc

SEQ ID NO: 1736456 - RNA, 16 nt, Salmonella enterica enterica serovar Typhi Ty2
ggucauauugucgcgc

SEQ ID NO: 1736457 - RNA, 16 nt, Salmonella enterica enterica serovar Typhi Ty2
gggcgcggcugguaag

SEQ ID NO: 1736458 - RNA, 13 nt, Salmonella enterica enterica serovar Typhi Ty2
gggcgcggcgcaa

SEQ ID NO: 1736459 - RNA, 13 nt, Salmonella enterica enterica serovar Typhi Ty2
gggcgccucggcg

SEQ ID NO: 1736460 - RNA, 13 nt, Salmonella enterica enterica serovar Typhi Ty2
gggcgcacagcgc

SEQ ID NO: 1736461 - RNA, 13 nt, Salmonella enterica enterica serovar Typhi Ty2
gggcugcggcaaa

SEQ ID NO: 1736462 - RNA, 15 nt, Salmonella enterica enterica serovar Typhi Ty2
gggcugccaucaggc

SEQ ID NO: 1736463 - RNA, 19 nt, Salmonella enterica enterica serovar Typhi Ty2
gggcugcacgccaucggcu

SEQ ID NO: 1736464 - RNA, 23 nt, Salmonella enterica enterica serovar Typhi Ty2
gggcugauuuuuuugcuggccgu

SEQ ID NO: 1736465 - RNA, 17 nt, Salmonella enterica enterica serovar Typhi Ty2
gggcguuuguuguagcc

SEQ ID NO: 1736466 - RNA, 13 nt, Salmonella enterica enterica serovar Typhi Ty2
aaguaaaagccgu

SEQ ID NO: 1736467 - RNA, 14 nt, Salmonella enterica enterica serovar Typhi Ty2
aaguaagcgccagc

SEQ ID NO: 1736468 - RNA, 15 nt, Salmonella enterica enterica serovar Typhi Ty2
ggcguauucggcaua

SEQ ID NO: 1736469 - RNA, 14 nt, Salmonella enterica enterica serovar Typhi Ty2
ggcgucaaacagcu

SEQ ID NO: 1736470 - RNA, 13 nt, Salmonella enterica enterica serovar Typhi Ty2
ggcgucaucggcg

SEQ ID NO: 1736471 - RNA, 19 nt, Salmonella enterica enterica serovar Typhi Ty2
gggauaaagaucuuuacgc

SEQ ID NO: 1736472 - RNA, 19 nt, Salmonella enterica enterica serovar Typhi Ty2
gggauaacgauucccgccg

SEQ ID NO: 1736473 - RNA, 14 nt, Salmonella enterica enterica serovar Typhi Ty2
gggauaagcgaugc

SEQ ID NO: 1736474 - RNA, 19 nt, Salmonella enterica enterica serovar Typhi Ty2
gggaggugauucugcaucc

SEQ ID NO: 1736475 - RNA, 13 nt, Salmonella enterica enterica serovar Typhi Ty2
gggagaccgggcu

SEQ ID NO: 1736476 - RNA, 19 nt, Salmonella enterica enterica serovar Typhi Ty2
gggagaaaacgcggccugg

SEQ ID NO: 1736477 - RNA, 22 nt, Salmonella enterica enterica serovar Typhi Ty2
gggcagcaucucgauuacagcg

SEQ ID NO: 1736478 - RNA, 20 nt, Salmonella enterica enterica serovar Typhi Ty2
gggcaauccauuaauggcgc

SEQ ID NO: 1736479 - RNA, 18 nt, Salmonella enterica enterica serovar Typhi Ty2
gggcaaugccaccagcgc

SEQ ID NO: 1736480 - RNA, 17 nt, Salmonella enterica enterica serovar Typhi Ty2
gggauguugccacaggc

SEQ ID NO: 1736481 - RNA, 24 nt, Salmonella enterica enterica serovar Typhi Ty2
gggcaacccggcuaaaugacgcgc

SEQ ID NO: 1736482 - RNA, 23 nt, Salmonella enterica enterica serovar Typhi Ty2
gggcaacaaacauaagcaaaucc

SEQ ID NO: 1736483 - RNA, 15 nt, Salmonella enterica enterica serovar Typhi Ty2
gggaucuuuuucagc

SEQ ID NO: 1736484 - RNA, 17 nt, Salmonella enterica enterica serovar Typhi Ty2
gggccagcagcgcauca

SEQ ID NO: 1736485 - RNA, 17 nt, Salmonella enterica enterica serovar Typhi Ty2
gggccacuuacggacaa

SEQ ID NO: 1736486 - RNA, 17 nt, Salmonella enterica enterica serovar Typhi Ty2
gggcaugggaaauaacg

SEQ ID NO: 1736487 - RNA, 20 nt, Salmonella enterica enterica serovar Typhi Ty2
ggacgagcgcgucagcgccu

SEQ ID NO: 1736488 - RNA, 15 nt, Salmonella enterica enterica serovar Typhi Ty2
ggacgaugaaccugu

SEQ ID NO: 1736489 - RNA, 17 nt, Salmonella enterica enterica serovar Typhi Ty2
ggaccguguucaugcag

SEQ ID NO: 1736490 - RNA, 12 nt, Salmonella enterica enterica serovar Typhi Ty2
ggacaucgccau

SEQ ID NO: 1736491 - RNA, 13 nt, Salmonella enterica enterica serovar Typhi Ty2
ggacaauccgcga

SEQ ID NO: 1736492 - RNA, 22 nt, Salmonella enterica enterica serovar Typhi Ty2
ggacaaggcgguacgccgccau

SEQ ID NO: 1736493 - RNA, 18 nt, Salmonella enterica enterica serovar Typhi Ty2
ggacaacgccgguacgca

SEQ ID NO: 1736494 - RNA, 11 nt, Salmonella enterica enterica serovar Typhi Ty2
ggacagcgaca

SEQ ID NO: 1736495 - RNA, 15 nt, Salmonella enterica enterica serovar Typhi Ty2
ggaacguugcgccau

SEQ ID NO: 1736496 - RNA, 14 nt, Salmonella enterica enterica serovar Typhi Ty2
ggaacgugccguuu

SEQ ID NO: 1736497 - RNA, 13 nt, Salmonella enterica enterica serovar Typhi Ty2
ggaacgucaucau

SEQ ID NO: 1736498 - RNA, 12 nt, Salmonella enterica enterica serovar Typhi Ty2
ggaaccuggcag

SEQ ID NO: 1736499 - RNA, 18 nt, Salmonella enterica enterica serovar Typhi Ty2
ggaaccggguugcggaag

SEQ ID NO: 1736500 - RNA, 21 nt, Salmonella enterica enterica serovar Typhi Ty2
ggaacaguuuaguugccguuu

SEQ ID NO: 1736501 - RNA, 15 nt, Salmonella enterica enterica serovar Typhi Ty2
ggaacagaagccugc

SEQ ID NO: 1736502 - RNA, 16 nt, Salmonella enterica enterica serovar Typhi Ty2
ggaacacgaauaugca

SEQ ID NO: 1736503 - RNA, 23 nt, Salmonella enterica enterica serovar Typhi Ty2
gcuggcgcgucuguguuuauccg

SEQ ID NO: 1736504 - RNA, 17 nt, Salmonella enterica enterica serovar Typhi Ty2
ggaagcgcgaaucgccu

SEQ ID NO: 1736505 - RNA, 21 nt, Salmonella enterica enterica serovar Typhi Ty2
ggaagacguuuacaccgccau

SEQ ID NO: 1736506 - RNA, 17 nt, Salmonella enterica enterica serovar Typhi Ty2
ggaagacugcuccggca

SEQ ID NO: 1736507 - RNA, 17 nt, Salmonella enterica enterica serovar Typhi Ty2
ggaagacuggcgcagca

SEQ ID NO: 1736508 - RNA, 17 nt, Salmonella enterica enterica serovar Typhi Ty2
ggaagaaggcuccggca

SEQ ID NO: 1736509 - RNA, 15 nt, Salmonella enterica enterica serovar Typhi Ty2
ggaacuguucagcca

SEQ ID NO: 1736510 - RNA, 21 nt, Salmonella enterica enterica serovar Typhi Ty2
ggaaguaugccucgcgcacca

SEQ ID NO: 1736511 - RNA, 12 nt, Salmonella enterica enterica serovar Typhi Ty2
ggaaucgaugcu

SEQ ID NO: 1736512 - RNA, 17 nt, Salmonella enterica enterica serovar Typhi Ty2
ggaaucgcgauuccgga

SEQ ID NO: 1736513 - RNA, 21 nt, Salmonella enterica enterica serovar Typhi Ty2
ggaauauucgcuucuucggca

SEQ ID NO: 1736514 - RNA, 22 nt, Salmonella enterica enterica serovar Typhi Ty2
ggaaucauggcuugaucgcgca

SEQ ID NO: 1736515 - RNA, 17 nt, Salmonella enterica enterica serovar Typhi Ty2
ggaauguuuggcgccau

SEQ ID NO: 1736516 - RNA, 15 nt, Salmonella enterica enterica serovar Typhi Ty2
ggaucagacggcuga

SEQ ID NO: 1736517 - RNA, 17 nt, Salmonella enterica enterica serovar Typhi Ty2
ggaucagaaauucgcag

SEQ ID NO: 1736518 - RNA, 19 nt, Salmonella enterica enterica serovar Typhi Ty2
ggaucaucuuuuaccgccu

SEQ ID NO: 1736519 - RNA, 21 nt, Salmonella enterica enterica serovar Typhi Ty2
ggaucaggcguuagccgccau

SEQ ID NO: 1736520 - RNA, 14 nt, Salmonella enterica enterica serovar Typhi Ty2
ggauacagcgccgc

SEQ ID NO: 1736521 - RNA, 13 nt, Salmonella enterica enterica serovar Typhi Ty2
ggauacagcgccg

SEQ ID NO: 1736522 - RNA, 17 nt, Salmonella enterica enterica serovar Typhi Ty2
ggauaagguguuuacgc

SEQ ID NO: 1736523 - RNA, 22 nt, Salmonella enterica enterica serovar Typhi Ty2
ggauaaucacggcggaggccga

SEQ ID NO: 1736524 - RNA, 15 nt, Salmonella enterica enterica serovar Typhi Ty2
ggauaaucagcagcg

SEQ ID NO: 1736525 - RNA, 15 nt, Salmonella enterica enterica serovar Typhi Ty2
ggauaccgcgccagc

SEQ ID NO: 1736526 - RNA, 12 nt, Salmonella enterica enterica serovar Typhi Ty2
ggauaccgcacu

SEQ ID NO: 1736527 - RNA, 16 nt, Salmonella enterica enterica serovar Typhi Ty2
ggauacccagccacau

SEQ ID NO: 1736528 - RNA, 14 nt, Salmonella enterica enterica serovar Typhi Ty2
ggauaguacugacc

SEQ ID NO: 1736529 - RNA, 23 nt, Salmonella enterica enterica serovar Typhi Ty2
ggauacguuccagcagcgcauca

SEQ ID NO: 1736530 - RNA, 22 nt, Salmonella enterica enterica serovar Typhi Ty2
ggauauccucuuuucgaacgcc

SEQ ID NO: 1736531 - RNA, 16 nt, Salmonella enterica enterica serovar Typhi Ty2
ggauaucuuccgggcg

SEQ ID NO: 1736532 - RNA, 18 nt, Salmonella enterica enterica serovar Typhi Ty2
ggaucaauaugccagaua

SEQ ID NO: 1736533 - RNA, 17 nt, Salmonella enterica enterica serovar Typhi Ty2
ggauaaggcguuuacgc

SEQ ID NO: 1736534 - RNA, 15 nt, Salmonella enterica enterica serovar Typhi Ty2
ggauaaggcgugagc

SEQ ID NO: 1736535 - RNA, 20 nt, Salmonella enterica enterica serovar Typhi Ty2
ggauaaggcguaaccgccau

SEQ ID NO: 1736536 - RNA, 20 nt, Salmonella enterica enterica serovar Typhi Ty2
ggauaaggcggagccgccau

SEQ ID NO: 1736537 - RNA, 23 nt, Salmonella enterica enterica serovar Typhi Ty2
ggauaaggcgcuugcgccgccau

SEQ ID NO: 1736538 - RNA, 20 nt, Salmonella enterica enterica serovar Typhi Ty2
ggauaaggcgcuugcgccau

SEQ ID NO: 1736539 - RNA, 14 nt, Salmonella enterica enterica serovar Typhi Ty2
ggauaaggcgcagc

SEQ ID NO: 1736540 - RNA, 23 nt, Salmonella enterica enterica serovar Typhi Ty2
ggauaaggcauuuaugccgccau

SEQ ID NO: 1736541 - RNA, 15 nt, Salmonella enterica enterica serovar Typhi Ty2
ggauaaggcagcaau

SEQ ID NO: 1736542 - RNA, 17 nt, Salmonella enterica enterica serovar Typhi Ty2
ggauaagcgugcgccau

SEQ ID NO: 1736543 - RNA, 18 nt, Salmonella enterica enterica serovar Typhi Ty2
ggauaagcguagcgccau

SEQ ID NO: 1736544 - RNA, 19 nt, Salmonella enterica enterica serovar Typhi Ty2
ggauaagcggcagcgccau

SEQ ID NO: 1736545 - RNA, 21 nt, Salmonella enterica enterica serovar Typhi Ty2
ggauaaccuuuaacagauggc

SEQ ID NO: 1736546 - RNA, 20 nt, Salmonella enterica enterica serovar Typhi Ty2
ggauaagauagcaggcgauu

SEQ ID NO: 1736547 - RNA, 15 nt, Salmonella enterica enterica serovar Typhi Ty2
ggauaacggcgcaaa

SEQ ID NO: 1736548 - RNA, 22 nt, Salmonella enterica enterica serovar Typhi Ty2
ggauaaauagugacgccgccau

SEQ ID NO: 1736549 - RNA, 16 nt, Salmonella enterica enterica serovar Typhi Ty2
ggauaaccuucgggca

SEQ ID NO: 1736550 - RNA, 15 nt, Salmonella enterica enterica serovar Typhi Ty2
ggauaaaaucgccaa

SEQ ID NO: 1736551 - RNA, 15 nt, Salmonella enterica enterica serovar Typhi Ty2
ggaggucauuauuca

SEQ ID NO: 1736552 - RNA, 22 nt, Salmonella enterica enterica serovar Typhi Ty2
ggagucaugaaugucauugccg

SEQ ID NO: 1736553 - RNA, 14 nt, Salmonella enterica enterica serovar Typhi Ty2
ggagcggcguccgc

SEQ ID NO: 1736554 - RNA, 15 nt, Salmonella enterica enterica serovar Typhi Ty2
ggaggaacagcgccg

SEQ ID NO: 1736555 - RNA, 18 nt, Salmonella enterica enterica serovar Typhi Ty2
ggagcugacugcaaaucu

SEQ ID NO: 1736556 - RNA, 11 nt, Salmonella enterica enterica serovar Typhi Ty2
ggagcgugcuu

SEQ ID NO: 1736557 - RNA, 12 nt, Salmonella enterica enterica serovar Typhi Ty2
ggacuggugcau

SEQ ID NO: 1736558 - RNA, 11 nt, Salmonella enterica enterica serovar Typhi Ty2
ggagcccagua

SEQ ID NO: 1736559 - RNA, 19 nt, Salmonella enterica enterica serovar Typhi Ty2
ggagcauuggaaauucagg

SEQ ID NO: 1736560 - RNA, 17 nt, Salmonella enterica enterica serovar Typhi Ty2
ggagccgccauccggcg

SEQ ID NO: 1736561 - RNA, 23 nt, Salmonella enterica enterica serovar Typhi Ty2
ggagaguucauaacgcacaacgu

SEQ ID NO: 1736562 - RNA, 15 nt, Salmonella enterica enterica serovar Typhi Ty2
ggagagcaacgccau

SEQ ID NO: 1736563 - RNA, 19 nt, Salmonella enterica enterica serovar Typhi Ty2
ggagaagacgccgccgcau

SEQ ID NO: 1736564 - RNA, 14 nt, Salmonella enterica enterica serovar Typhi Ty2
aaggaugcccguag

SEQ ID NO: 1736565 - RNA, 15 nt, Salmonella enterica enterica serovar Typhi Ty2
aaggauacagcgccg

SEQ ID NO: 1736566 - RNA, 20 nt, Salmonella enterica enterica serovar Typhi Ty2
aaggcagcaaugugcgccag

SEQ ID NO: 1736567 - RNA, 21 nt, Salmonella enterica enterica serovar Typhi Ty2
aaggcaccguuucuuugcugc

SEQ ID NO: 1736568 - RNA, 22 nt, Salmonella enterica enterica serovar Typhi Ty2
aaggccagacucaucgccgcaa

SEQ ID NO: 1736569 - RNA, 20 nt, Salmonella enterica enterica serovar Typhi Ty2
aaggccgcgaaagcggccuu

SEQ ID NO: 1736570 - RNA, 21 nt, Salmonella enterica enterica serovar Typhi Ty2
ggccagcgaaaaccagcgccg

SEQ ID NO: 1736571 - RNA, 13 nt, Salmonella enterica enterica serovar Typhi Ty2
ggccagcauggcg

SEQ ID NO: 1736572 - RNA, 16 nt, Salmonella enterica enterica serovar Typhi Ty2
ggccaucauaccgcca

SEQ ID NO: 1736573 - RNA, 15 nt, Salmonella enterica enterica serovar Typhi Ty2
ggccaucuggcguug

SEQ ID NO: 1736574 - RNA, 21 nt, Salmonella enterica enterica serovar Typhi Ty2
ggcccaggccauuaaccuugc

SEQ ID NO: 1736575 - RNA, 16 nt, Salmonella enterica enterica serovar Typhi Ty2
ggcccacgcgcagaga

SEQ ID NO: 1736576 - RNA, 12 nt, Salmonella enterica enterica serovar Typhi Ty2
ggcaccagcgua

SEQ ID NO: 1736577 - RNA, 12 nt, Salmonella enterica enterica serovar Typhi Ty2
ggcaccagcaau

SEQ ID NO: 1736578 - RNA, 12 nt, Salmonella enterica enterica serovar Typhi Ty2
ggcaccacguca

SEQ ID NO: 1736579 - RNA, 21 nt, Salmonella enterica enterica serovar Typhi Ty2
ggcaccggaaccggcaucggg

SEQ ID NO: 1736580 - RNA, 16 nt, Salmonella enterica enterica serovar Typhi Ty2
ggcaauuucucgcucg

SEQ ID NO: 1736581 - RNA, 18 nt, Salmonella enterica enterica serovar Typhi Ty2
ggcaauuugauagcgcca

SEQ ID NO: 1736582 - RNA, 22 nt, Salmonella enterica enterica serovar Typhi Ty2
ggcaaucgacguugaucgccau

SEQ ID NO: 1736583 - RNA, 13 nt, Salmonella enterica enterica serovar Typhi Ty2
ggcaauuucucgc

SEQ ID NO: 1736584 - RNA, 19 nt, Salmonella enterica enterica serovar Typhi Ty2
ggcaaguucuuguuucauc

SEQ ID NO: 1736585 - RNA, 12 nt, Salmonella enterica enterica serovar Typhi Ty2
ggcaaucaguac

SEQ ID NO: 1736586 - RNA, 18 nt, Salmonella enterica enterica serovar Typhi Ty2
ggcaauagccuuuaucgg

SEQ ID NO: 1736587 - RNA, 21 nt, Salmonella enterica enterica serovar Typhi Ty2
ggcaauauccuccggcguaaa

SEQ ID NO: 1736588 - RNA, 21 nt, Salmonella enterica enterica serovar Typhi Ty2
ggcaauauaccgucaguacca

SEQ ID NO: 1736589 - RNA, 16 nt, Salmonella enterica enterica serovar Typhi Ty2
ggcaacggccagcgca

SEQ ID NO: 1736590 - RNA, 20 nt, Salmonella enterica enterica serovar Typhi Ty2
ggcaagcuggcgaaucgcau

SEQ ID NO: 1736591 - RNA, 18 nt, Salmonella enterica enterica serovar Typhi Ty2
ggcaaauucuuuucacgc

SEQ ID NO: 1736592 - RNA, 12 nt, Salmonella enterica enterica serovar Typhi Ty2
ggcaaauaccgu

SEQ ID NO: 1736593 - RNA, 12 nt, Salmonella enterica enterica serovar Typhi Ty2
ggcaacagccau

SEQ ID NO: 1736594 - RNA, 21 nt, Salmonella enterica enterica serovar Typhi Ty2
ggcaacaugaccagcgcaaac

SEQ ID NO: 1736595 - RNA, 13 nt, Salmonella enterica enterica serovar Typhi Ty2
ggcauaucgccau

SEQ ID NO: 1736596 - RNA, 12 nt, Salmonella enterica enterica serovar Typhi Ty2
ggcagcgucagc

SEQ ID NO: 1736597 - RNA, 22 nt, Salmonella enterica enterica serovar Typhi Ty2
ggcagucccaaugcggaaacca

SEQ ID NO: 1736598 - RNA, 15 nt, Salmonella enterica enterica serovar Typhi Ty2
ggcagccucaggccu

SEQ ID NO: 1736599 - RNA, 12 nt, Salmonella enterica enterica serovar Typhi Ty2
ggcagcgaaagc

SEQ ID NO: 1736600 - RNA, 16 nt, Salmonella enterica enterica serovar Typhi Ty2
ggcagccaggcaaagc

SEQ ID NO: 1736601 - RNA, 15 nt, Salmonella enterica enterica serovar Typhi Ty2
ggcagacaucgccgu

SEQ ID NO: 1736602 - RNA, 13 nt, Salmonella enterica enterica serovar Typhi Ty2
ggcagacagccau

SEQ ID NO: 1736603 - RNA, 12 nt, Salmonella enterica enterica serovar Typhi Ty2
ggcagacagcca

SEQ ID NO: 1736604 - RNA, 17 nt, Salmonella enterica enterica serovar Typhi Ty2
ggccuacagaugaacgu

SEQ ID NO: 1736605 - RNA, 19 nt, Salmonella enterica enterica serovar Typhi Ty2
ggccgcguuaacgccguug

SEQ ID NO: 1736606 - RNA, 21 nt, Salmonella enterica enterica serovar Typhi Ty2
ggcccgaagggcgagcguagc

SEQ ID NO: 1736607 - RNA, 20 nt, Salmonella enterica enterica serovar Typhi Ty2
ggcgaauaaaauucagcgca

SEQ ID NO: 1736608 - RNA, 22 nt, Salmonella enterica enterica serovar Typhi Ty2
ggcgaaucucgugaucgccaaa

SEQ ID NO: 1736609 - RNA, 17 nt, Salmonella enterica enterica serovar Typhi Ty2
ggcgacacaacggcaca

SEQ ID NO: 1736610 - RNA, 16 nt, Salmonella enterica enterica serovar Typhi Ty2
ggcgacaaucucaccg

SEQ ID NO: 1736611 - RNA, 16 nt, Salmonella enterica enterica serovar Typhi Ty2
ggcgacgaaucagcga

SEQ ID NO: 1736612 - RNA, 21 nt, Salmonella enterica enterica serovar Typhi Ty2
ggcgaccgccaccauccggcg

SEQ ID NO: 1736613 - RNA, 20 nt, Salmonella enterica enterica serovar Typhi Ty2
ggcgacuaccucuuauccgg

SEQ ID NO: 1736614 - RNA, 21 nt, Salmonella enterica enterica serovar Typhi Ty2
ggcgacuaacgucuuauccgg

SEQ ID NO: 1736615 - RNA, 22 nt, Salmonella enterica enterica serovar Typhi Ty2
aagggaagaucauuaucaauag

SEQ ID NO: 1736616 - RNA, 16 nt, Salmonella enterica enterica serovar Typhi Ty2
ggcgacgaucagcgcc

SEQ ID NO: 1736617 - RNA, 22 nt, Salmonella enterica enterica serovar Typhi Ty2
aaggcguucacaccgccgccag

SEQ ID NO: 1736618 - RNA, 12 nt, Salmonella enterica enterica serovar Typhi Ty2
ggcgaaaacgcu

SEQ ID NO: 1736619 - RNA, 17 nt, Salmonella enterica enterica serovar Typhi Ty2
ggcgaaaaaguucacgc

SEQ ID NO: 1736620 - RNA, 15 nt, Salmonella enterica enterica serovar Typhi Ty2
ggcgaacaauaccgu

SEQ ID NO: 1736621 - RNA, 21 nt, Salmonella enterica enterica serovar Typhi Ty2
ggcgaacaggcucagcgccac

SEQ ID NO: 1736622 - RNA, 19 nt, Salmonella enterica enterica serovar Typhi Ty2
ggcgaacaggcguaauacu

SEQ ID NO: 1736623 - RNA, 22 nt, Salmonella enterica enterica serovar Typhi Ty2
ggcgaacagccccaccgccaga

SEQ ID NO: 1736624 - RNA, 16 nt, Salmonella enterica enterica serovar Typhi Ty2
ggcgaacgacucacgc

SEQ ID NO: 1736625 - RNA, 17 nt, Salmonella enterica enterica serovar Typhi Ty2
ggcgaagcaucuuuccg

SEQ ID NO: 1736626 - RNA, 20 nt, Salmonella enterica enterica serovar Typhi Ty2
ggccugguuaacaauauugc

SEQ ID NO: 1736627 - RNA, 12 nt, Salmonella enterica enterica serovar Typhi Ty2
aaggcgcagccg

SEQ ID NO: 1736628 - RNA, 23 nt, Salmonella enterica enterica serovar Typhi Ty2
aaggcgaaaccgcuacccggcac

SEQ ID NO: 1736629 - RNA, 15 nt, Salmonella enterica enterica serovar Typhi Ty2
aaggcggcaaagaua

SEQ ID NO: 1736630 - RNA, 20 nt, Salmonella enterica enterica serovar Typhi Ty2
ggcgcaggggcauuuuccgg

SEQ ID NO: 1736631 - RNA, 14 nt, Salmonella enterica enterica serovar Typhi Ty2
ggcgcaguuuacgc

SEQ ID NO: 1736632 - RNA, 17 nt, Salmonella enterica enterica serovar Typhi Ty2
ggcgccaaucaccgcca

SEQ ID NO: 1736633 - RNA, 21 nt, Salmonella enterica enterica serovar Typhi Ty2
ggcgcauaaugacguccaggc

SEQ ID NO: 1736634 - RNA, 14 nt, Salmonella enterica enterica serovar Typhi Ty2
ggcgcacagcgcca

SEQ ID NO: 1736635 - RNA, 20 nt, Salmonella enterica enterica serovar Typhi Ty2
ggcgcgccaauaaagcuuga

SEQ ID NO: 1736636 - RNA, 18 nt, Salmonella enterica enterica serovar Typhi Ty2
ggcgcuacguuuaucugg

SEQ ID NO: 1736637 - RNA, 20 nt, Salmonella enterica enterica serovar Typhi Ty2
ggcgcuacgcuuaucaggcc

SEQ ID NO: 1736638 - RNA, 20 nt, Salmonella enterica enterica serovar Typhi Ty2
aaggucgcauccgcguuagc

SEQ ID NO: 1736639 - RNA, 21 nt, Salmonella enterica enterica serovar Typhi Ty2
aaggucagguuaugcgcgcca

SEQ ID NO: 1736640 - RNA, 18 nt, Salmonella enterica enterica serovar Typhi Ty2
ggcgcuacgcuuaucagg

SEQ ID NO: 1736641 - RNA, 21 nt, Salmonella enterica enterica serovar Typhi Ty2
ggcgcucagccagaaacgguc

SEQ ID NO: 1736642 - RNA, 17 nt, Salmonella enterica enterica serovar Typhi Ty2
ggcgcuauccggcauca

SEQ ID NO: 1736643 - RNA, 19 nt, Salmonella enterica enterica serovar Typhi Ty2
aaggugagcauugcgcuca

SEQ ID NO: 1736644 - RNA, 21 nt, Salmonella enterica enterica serovar Typhi Ty2
aaggugaguuucgcaucagga

SEQ ID NO: 1736645 - RNA, 17 nt, Salmonella enterica enterica serovar Typhi Ty2
aaggucgcuauccagca

SEQ ID NO: 1736646 - RNA, 23 nt, Salmonella enterica enterica serovar Typhi Ty2
ggcgguauaacugccuuauccgg

SEQ ID NO: 1736647 - RNA, 16 nt, Salmonella enterica enterica serovar Typhi Ty2
ggcgguagcugcgcca

SEQ ID NO: 1736648 - RNA, 14 nt, Salmonella enterica enterica serovar Typhi Ty2
ggcggucaucgccc

SEQ ID NO: 1736649 - RNA, 20 nt, Salmonella enterica enterica serovar Typhi Ty2
ggcgguuauccgccagcgca

SEQ ID NO: 1736650 - RNA, 19 nt, Salmonella enterica enterica serovar Typhi Ty2
ggcgguucauccugcgcca

SEQ ID NO: 1736651 - RNA, 12 nt, Salmonella enterica enterica serovar Typhi Ty2
ggcgguuauccg

SEQ ID NO: 1736652 - RNA, 13 nt, Salmonella enterica enterica serovar Typhi Ty2
ggcguagauauuc

SEQ ID NO: 1736653 - RNA, 14 nt, Salmonella enterica enterica serovar Typhi Ty2
ggcguacgggcaaa

SEQ ID NO: 1736654 - RNA, 17 nt, Salmonella enterica enterica serovar Typhi Ty2
ggcguacacuucauccg

SEQ ID NO: 1736655 - RNA, 13 nt, Salmonella enterica enterica serovar Typhi Ty2
ggcguaagcgcgu

SEQ ID NO: 1736656 - RNA, 23 nt, Salmonella enterica enterica serovar Typhi Ty2
ggcguaauaugaauauccgccgc

SEQ ID NO: 1736657 - RNA, 17 nt, Salmonella enterica enterica serovar Typhi Ty2
ggcgguuucaucgagcg

SEQ ID NO: 1736658 - RNA, 23 nt, Salmonella enterica enterica serovar Typhi Ty2
ggcggcgugaccgccuuauccgg

SEQ ID NO: 1736659 - RNA, 20 nt, Salmonella enterica enterica serovar Typhi Ty2
ggcggcuacgccuuauccgg

SEQ ID NO: 1736660 - RNA, 19 nt, Salmonella enterica enterica serovar Typhi Ty2
ggcggcuacgccuuauccg

SEQ ID NO: 1736661 - RNA, 21 nt, Salmonella enterica enterica serovar Typhi Ty2
ggcggcuaacgccugauccgg

SEQ ID NO: 1736662 - RNA, 14 nt, Salmonella enterica enterica serovar Typhi Ty2
ggcggcuaccgccg

SEQ ID NO: 1736663 - RNA, 21 nt, Salmonella enterica enterica serovar Typhi Ty2
ggcggcgaaaugccuuauccg

SEQ ID NO: 1736664 - RNA, 16 nt, Salmonella enterica enterica serovar Typhi Ty2
ggcggaagguuuccgc

SEQ ID NO: 1736665 - RNA, 20 nt, Salmonella enterica enterica serovar Typhi Ty2
ggcgcuuugcuuauccggcc

SEQ ID NO: 1736666 - RNA, 17 nt, Salmonella enterica enterica serovar Typhi Ty2
ggcggcaagaucauccg

SEQ ID NO: 1736667 - RNA, 16 nt, Salmonella enterica enterica serovar Typhi Ty2
gcaagacacagcgucg

SEQ ID NO: 1736668 - RNA, 12 nt, Salmonella enterica enterica serovar Typhi Ty2
gcaagaauauga

SEQ ID NO: 1736669 - RNA, 18 nt, Salmonella enterica enterica serovar Typhi Ty2
gcaacugccaggcgugug

SEQ ID NO: 1736670 - RNA, 19 nt, Salmonella enterica enterica serovar Typhi Ty2
gcaacugauuaaucugccg

SEQ ID NO: 1736671 - RNA, 16 nt, Salmonella enterica enterica serovar Typhi Ty2
gcaacucucgauaucg

SEQ ID NO: 1736672 - RNA, 13 nt, Salmonella enterica enterica serovar Typhi Ty2
gcaagcagcacac

SEQ ID NO: 1736673 - RNA, 14 nt, Salmonella enterica enterica serovar Typhi Ty2
gcaaggacgccagu

SEQ ID NO: 1736674 - RNA, 22 nt, Salmonella enterica enterica serovar Typhi Ty2
gcaaccgauagcuaaugcgguu

SEQ ID NO: 1736675 - RNA, 17 nt, Salmonella enterica enterica serovar Typhi Ty2
gcaacgcugcauccugu

SEQ ID NO: 1736676 - RNA, 22 nt, Salmonella enterica enterica serovar Typhi Ty2
gcaacgcuuuagugccgccauu

SEQ ID NO: 1736677 - RNA, 15 nt, Salmonella enterica enterica serovar Typhi Ty2
gcaacggccagcgca

SEQ ID NO: 1736678 - RNA, 20 nt, Salmonella enterica enterica serovar Typhi Ty2
gcaacguuucuuucaucaga

SEQ ID NO: 1736679 - RNA, 22 nt, Salmonella enterica enterica serovar Typhi Ty2
gcaacguucagcucgauccggc

SEQ ID NO: 1736680 - RNA, 21 nt, Salmonella enterica enterica serovar Typhi Ty2
gcaauaaguucaaacucauua

SEQ ID NO: 1736681 - RNA, 16 nt, Salmonella enterica enterica serovar Typhi Ty2
gcaauaauccgcuaac

SEQ ID NO: 1736682 - RNA, 15 nt, Salmonella enterica enterica serovar Typhi Ty2
gcaauaccacgcccg

SEQ ID NO: 1736683 - RNA, 21 nt, Salmonella enterica enterica serovar Typhi Ty2
gcaauaccacgcccgccgcca

SEQ ID NO: 1736684 - RNA, 19 nt, Salmonella enterica enterica serovar Typhi Ty2
gcaagucgcgggcgcuaaa

SEQ ID NO: 1736685 - RNA, 15 nt, Salmonella enterica enterica serovar Typhi Ty2
gcaaucaucagaccg

SEQ ID NO: 1736686 - RNA, 22 nt, Salmonella enterica enterica serovar Typhi Ty2
gcaaucauccugauuuuacuga

SEQ ID NO: 1736687 - RNA, 18 nt, Salmonella enterica enterica serovar Typhi Ty2
gcaaucaguggcggcaaa

SEQ ID NO: 1736688 - RNA, 16 nt, Salmonella enterica enterica serovar Typhi Ty2
gcaaucgcgguaugcg

SEQ ID NO: 1736689 - RNA, 15 nt, Salmonella enterica enterica serovar Typhi Ty2
gcaauacuguaagcc

SEQ ID NO: 1736690 - RNA, 24 nt, Salmonella enterica enterica serovar Typhi Ty2
gcaauaugucuuaaacagcgauca

SEQ ID NO: 1736691 - RNA, 20 nt, Salmonella enterica enterica serovar Typhi Ty2
gcaauauuguuaaccaggcc

SEQ ID NO: 1736692 - RNA, 17 nt, Salmonella enterica enterica serovar Typhi Ty2
gcaaucacuuccgccuc

SEQ ID NO: 1736693 - RNA, 18 nt, Salmonella enterica enterica serovar Typhi Ty2
gcacacuuucaucagccg

SEQ ID NO: 1736694 - RNA, 22 nt, Salmonella enterica enterica serovar Typhi Ty2
gcacaauacuuuuugacuccug

SEQ ID NO: 1736695 - RNA, 23 nt, Salmonella enterica enterica serovar Typhi Ty2
gcacaauaacgucacgauagcgc

SEQ ID NO: 1736696 - RNA, 17 nt, Salmonella enterica enterica serovar Typhi Ty2
gcaauuccggucaucgc

SEQ ID NO: 1736697 - RNA, 18 nt, Salmonella enterica enterica serovar Typhi Ty2
gcaauuccgccaucucau

SEQ ID NO: 1736698 - RNA, 17 nt, Salmonella enterica enterica serovar Typhi Ty2
gcacaaaguccgccguc

SEQ ID NO: 1736699 - RNA, 12 nt, Salmonella enterica enterica serovar Typhi Ty2
gcaauucauccu

SEQ ID NO: 1736700 - RNA, 15 nt, Salmonella enterica enterica serovar Typhi Ty2
gcaauuaccgccagc

SEQ ID NO: 1736701 - RNA, 22 nt, Salmonella enterica enterica serovar Typhi Ty2
gcacaauaacgucacgauagcg

SEQ ID NO: 1736702 - RNA, 20 nt, Salmonella enterica enterica serovar Typhi Ty2
gcaaugcccccucggcagca

SEQ ID NO: 1736703 - RNA, 22 nt, Salmonella enterica enterica serovar Typhi Ty2
gcaaucuuuacccggcgcaaac

SEQ ID NO: 1736704 - RNA, 20 nt, Salmonella enterica enterica serovar Typhi Ty2
gcaaucuuuacccggcgcaa

SEQ ID NO: 1736705 - RNA, 22 nt, Salmonella enterica enterica serovar Typhi Ty2
gcaaucgguaaaggucgccgca

SEQ ID NO: 1736706 - RNA, 18 nt, Salmonella enterica enterica serovar Typhi Ty2
gcaauggccgcagcgcca

SEQ ID NO: 1736707 - RNA, 19 nt, Salmonella enterica enterica serovar Typhi Ty2
gcaaugcgaauaacaucau

SEQ ID NO: 1736708 - RNA, 17 nt, Salmonella enterica enterica serovar Typhi Ty2
gcaauguuccccugaug

SEQ ID NO: 1736709 - RNA, 22 nt, Salmonella enterica enterica serovar Typhi Ty2
gcaaugcggguuucguucggca

SEQ ID NO: 1736710 - RNA, 16 nt, Salmonella enterica enterica serovar Typhi Ty2
gauuggccucuaccca

SEQ ID NO: 1736711 - RNA, 17 nt, Salmonella enterica enterica serovar Typhi Ty2
gauuugcgcucgcgcca

SEQ ID NO: 1736712 - RNA, 21 nt, Salmonella enterica enterica serovar Typhi Ty2
gauuuggcguaaucgauaagc

SEQ ID NO: 1736713 - RNA, 21 nt, Salmonella enterica enterica serovar Typhi Ty2
gauuucuugagcggcaucacu

SEQ ID NO: 1736714 - RNA, 17 nt, Salmonella enterica enterica serovar Typhi Ty2
gauuagccccagcgcca

SEQ ID NO: 1736715 - RNA, 18 nt, Salmonella enterica enterica serovar Typhi Ty2
gauuauuuuaucaucagc

SEQ ID NO: 1736716 - RNA, 17 nt, Salmonella enterica enterica serovar Typhi Ty2
gauuauuugaucccguc

SEQ ID NO: 1736717 - RNA, 20 nt, Salmonella enterica enterica serovar Typhi Ty2
gauuagcuuuaauccguuac

SEQ ID NO: 1736718 - RNA, 16 nt, Salmonella enterica enterica serovar Typhi Ty2
gauucccagucauccg

SEQ ID NO: 1736719 - RNA, 13 nt, Salmonella enterica enterica serovar Typhi Ty2
gauucccauccgu

SEQ ID NO: 1736720 - RNA, 18 nt, Salmonella enterica enterica serovar Typhi Ty2
gcaaagccaucaauccau

SEQ ID NO: 1736721 - RNA, 16 nt, Salmonella enterica enterica serovar Typhi Ty2
gcaaagcccacgcccu

SEQ ID NO: 1736722 - RNA, 16 nt, Salmonella enterica enterica serovar Typhi Ty2
gcaaagccuuuccgca

SEQ ID NO: 1736723 - RNA, 20 nt, Salmonella enterica enterica serovar Typhi Ty2
gcaaacacaaucacgcccag

SEQ ID NO: 1736724 - RNA, 14 nt, Salmonella enterica enterica serovar Typhi Ty2
gcaaacagcacgcc

SEQ ID NO: 1736725 - RNA, 21 nt, Salmonella enterica enterica serovar Typhi Ty2
gcaaacagcacgcccugccau

SEQ ID NO: 1736726 - RNA, 21 nt, Salmonella enterica enterica serovar Typhi Ty2
gcaaaccaugauaauaaucau

SEQ ID NO: 1736727 - RNA, 17 nt, Salmonella enterica enterica serovar Typhi Ty2
gcaaaauaccggcagcg

SEQ ID NO: 1736728 - RNA, 14 nt, Salmonella enterica enterica serovar Typhi Ty2
gauuugcguuguuu

SEQ ID NO: 1736729 - RNA, 15 nt, Salmonella enterica enterica serovar Typhi Ty2
gauuuuuuugcccgg

SEQ ID NO: 1736730 - RNA, 20 nt, Salmonella enterica enterica serovar Typhi Ty2
gcaaaaaaauccccgcgcaa

SEQ ID NO: 1736731 - RNA, 14 nt, Salmonella enterica enterica serovar Typhi Ty2
gcaacacagccagc

SEQ ID NO: 1736732 - RNA, 14 nt, Salmonella enterica enterica serovar Typhi Ty2
gcaacaagcaucau

SEQ ID NO: 1736733 - RNA, 17 nt, Salmonella enterica enterica serovar Typhi Ty2
gcaaagguugccgcaau

SEQ ID NO: 1736734 - RNA, 15 nt, Salmonella enterica enterica serovar Typhi Ty2
gcaaauucuuccgca

SEQ ID NO: 1736735 - RNA, 20 nt, Salmonella enterica enterica serovar Typhi Ty2
gcaacccauacagcccauac

SEQ ID NO: 1736736 - RNA, 20 nt, Salmonella enterica enterica serovar Typhi Ty2
gaugcguaccgcuaucgcca

SEQ ID NO: 1736737 - RNA, 18 nt, Salmonella enterica enterica serovar Typhi Ty2
gauggacaauccgcgaau

SEQ ID NO: 1736738 - RNA, 21 nt, Salmonella enterica enterica serovar Typhi Ty2
gaucugcgccauugaggucgc

SEQ ID NO: 1736739 - RNA, 20 nt, Salmonella enterica enterica serovar Typhi Ty2
gaugcggcgccaacgcgcua

SEQ ID NO: 1736740 - RNA, 22 nt, Salmonella enterica enterica serovar Typhi Ty2
gauggcggcuacgccuuauccg

SEQ ID NO: 1736741 - RNA, 22 nt, Salmonella enterica enterica serovar Typhi Ty2
gauggcggcugcgccuuauccg

SEQ ID NO: 1736742 - RNA, 20 nt, Salmonella enterica enterica serovar Typhi Ty2
gauggcgcgacgcuuaucag

SEQ ID NO: 1736743 - RNA, 21 nt, Salmonella enterica enterica serovar Typhi Ty2
gauggcgauucauaugcgcca

SEQ ID NO: 1736744 - RNA, 22 nt, Salmonella enterica enterica serovar Typhi Ty2
gauggcgacuaccucuuauccg

SEQ ID NO: 1736745 - RNA, 17 nt, Salmonella enterica enterica serovar Typhi Ty2
gauggcgaucagcgcca

SEQ ID NO: 1736746 - RNA, 19 nt, Salmonella enterica enterica serovar Typhi Ty2
gaugguauaaaucacgcug

SEQ ID NO: 1736747 - RNA, 19 nt, Salmonella enterica enterica serovar Typhi Ty2
gauggcgucacauggcgaa

SEQ ID NO: 1736748 - RNA, 16 nt, Salmonella enterica enterica serovar Typhi Ty2
gcagcgccauccggca

SEQ ID NO: 1736749 - RNA, 20 nt, Salmonella enterica enterica serovar Typhi Ty2
gcagcgaggugauaaucagc

SEQ ID NO: 1736750 - RNA, 17 nt, Salmonella enterica enterica serovar Typhi Ty2
gcagcgacuucaggcgu

SEQ ID NO: 1736751 - RNA, 17 nt, Salmonella enterica enterica serovar Typhi Ty2
gcagccgccauccggca

SEQ ID NO: 1736752 - RNA, 16 nt, Salmonella enterica enterica serovar Typhi Ty2
gcagccgguauccagc

SEQ ID NO: 1736753 - RNA, 18 nt, Salmonella enterica enterica serovar Typhi Ty2
gcagccgguauccagcgc

SEQ ID NO: 1736754 - RNA, 23 nt, Salmonella enterica enterica serovar Typhi Ty2
gcagcccuuacgcuuuauucugu

SEQ ID NO: 1736755 - RNA, 13 nt, Salmonella enterica enterica serovar Typhi Ty2
gcagcaucccggc

SEQ ID NO: 1736756 - RNA, 17 nt, Salmonella enterica enterica serovar Typhi Ty2
gcagcauaaacaucagc

SEQ ID NO: 1736757 - RNA, 14 nt, Salmonella enterica enterica serovar Typhi Ty2
gcagcaugauaucg

SEQ ID NO: 1736758 - RNA, 18 nt, Salmonella enterica enterica serovar Typhi Ty2
gcagccaacgccgccaua

SEQ ID NO: 1736759 - RNA, 21 nt, Salmonella enterica enterica serovar Typhi Ty2
gcagccacccuggcauaugga

SEQ ID NO: 1736760 - RNA, 14 nt, Salmonella enterica enterica serovar Typhi Ty2
gcagccacgccgau

SEQ ID NO: 1736761 - RNA, 14 nt, Salmonella enterica enterica serovar Typhi Ty2
gcagcagcggaauc

SEQ ID NO: 1736762 - RNA, 14 nt, Salmonella enterica enterica serovar Typhi Ty2
gcagcacugcuuaa

SEQ ID NO: 1736763 - RNA, 15 nt, Salmonella enterica enterica serovar Typhi Ty2
gcagaccgagcgcau

SEQ ID NO: 1736764 - RNA, 19 nt, Salmonella enterica enterica serovar Typhi Ty2
gcagaccuauauggcgcaa

SEQ ID NO: 1736765 - RNA, 16 nt, Salmonella enterica enterica serovar Typhi Ty2
gcagaccguuuucaac

SEQ ID NO: 1736766 - RNA, 20 nt, Salmonella enterica enterica serovar Typhi Ty2
gcacguuuugguccaugccg

SEQ ID NO: 1736767 - RNA, 14 nt, Salmonella enterica enterica serovar Typhi Ty2
gcagaagcagaccg

SEQ ID NO: 1736768 - RNA, 16 nt, Salmonella enterica enterica serovar Typhi Ty2
aacuuuuggugcccau

SEQ ID NO: 1736769 - RNA, 19 nt, Salmonella enterica enterica serovar Typhi Ty2
gcagacuguaaaucugccg

SEQ ID NO: 1736770 - RNA, 13 nt, Salmonella enterica enterica serovar Typhi Ty2
gcagauccaucgc

SEQ ID NO: 1736771 - RNA, 21 nt, Salmonella enterica enterica serovar Typhi Ty2
gcaccggcuguucacguacca

SEQ ID NO: 1736772 - RNA, 22 nt, Salmonella enterica enterica serovar Typhi Ty2
gcacgaccuuuucuucaucgau

SEQ ID NO: 1736773 - RNA, 21 nt, Salmonella enterica enterica serovar Typhi Ty2
gcaccucagaccguuagccgg

SEQ ID NO: 1736774 - RNA, 17 nt, Salmonella enterica enterica serovar Typhi Ty2
gcaccucaucgcuaccu

SEQ ID NO: 1736775 - RNA, 16 nt, Salmonella enterica enterica serovar Typhi Ty2
gcaccucuuuaugcgg

SEQ ID NO: 1736776 - RNA, 17 nt, Salmonella enterica enterica serovar Typhi Ty2
gcacgcgucaucggcgc

SEQ ID NO: 1736777 - RNA, 19 nt, Salmonella enterica enterica serovar Typhi Ty2
gcacgcgggccaauccagc

SEQ ID NO: 1736778 - RNA, 22 nt, Salmonella enterica enterica serovar Typhi Ty2
gaucgccaucgauagcagcgcu

SEQ ID NO: 1736779 - RNA, 18 nt, Salmonella enterica enterica serovar Typhi Ty2
gaucgcccagaugaaucg

SEQ ID NO: 1736780 - RNA, 14 nt, Salmonella enterica enterica serovar Typhi Ty2
gaucgccuggaucg

SEQ ID NO: 1736781 - RNA, 18 nt, Salmonella enterica enterica serovar Typhi Ty2
gaucgcauaaauauccgg

SEQ ID NO: 1736782 - RNA, 20 nt, Salmonella enterica enterica serovar Typhi Ty2
gaucgagccgucgccggccu

SEQ ID NO: 1736783 - RNA, 20 nt, Salmonella enterica enterica serovar Typhi Ty2
gaucccgggcgauaaaccag

SEQ ID NO: 1736784 - RNA, 21 nt, Salmonella enterica enterica serovar Typhi Ty2
gaucagaccaucggccgcuau

SEQ ID NO: 1736785 - RNA, 12 nt, Salmonella enterica enterica serovar Typhi Ty2
gaucagacgcac

SEQ ID NO: 1736786 - RNA, 21 nt, Salmonella enterica enterica serovar Typhi Ty2
gaucagaaauucgcagcgcag

SEQ ID NO: 1736787 - RNA, 21 nt, Salmonella enterica enterica serovar Typhi Ty2
gaucccagggcggcgucgcca

SEQ ID NO: 1736788 - RNA, 22 nt, Salmonella enterica enterica serovar Typhi Ty2
gauccccucuuccaucagccag

SEQ ID NO: 1736789 - RNA, 18 nt, Salmonella enterica enterica serovar Typhi Ty2
gauccaucgccugcggcg

SEQ ID NO: 1736790 - RNA, 16 nt, Salmonella enterica enterica serovar Typhi Ty2
gauccaacacggcgcu

SEQ ID NO: 1736791 - RNA, 17 nt, Salmonella enterica enterica serovar Typhi Ty2
gaucaguagacgguaac

SEQ ID NO: 1736792 - RNA, 19 nt, Salmonella enterica enterica serovar Typhi Ty2
gaucaugcguccgcccaga

SEQ ID NO: 1736793 - RNA, 12 nt, Salmonella enterica enterica serovar Typhi Ty2
gaucgucaacga

SEQ ID NO: 1736794 - RNA, 17 nt, Salmonella enterica enterica serovar Typhi Ty2
gaucguauccagcggca

SEQ ID NO: 1736795 - RNA, 24 nt, Salmonella enterica enterica serovar Typhi Ty2
gaucgugccaugaccauucacacu

SEQ ID NO: 1736796 - RNA, 15 nt, Salmonella enterica enterica serovar Typhi Ty2
gaucgugccguccgg

SEQ ID NO: 1736797 - RNA, 13 nt, Salmonella enterica enterica serovar Typhi Ty2
gaucgugguacgc

SEQ ID NO: 1736798 - RNA, 21 nt, Salmonella enterica enterica serovar Typhi Ty2
gaucggcggcccacucaucca

SEQ ID NO: 1736799 - RNA, 13 nt, Salmonella enterica enterica serovar Typhi Ty2
gaucggaacgcga

SEQ ID NO: 1736800 - RNA, 18 nt, Salmonella enterica enterica serovar Typhi Ty2
gaucggaagacuggcgca

SEQ ID NO: 1736801 - RNA, 22 nt, Salmonella enterica enterica serovar Typhi Ty2
gaucggcaaaagugugauaagc

SEQ ID NO: 1736802 - RNA, 20 nt, Salmonella enterica enterica serovar Typhi Ty2
gaucgcuggugcccgguacg

SEQ ID NO: 1736803 - RNA, 15 nt, Salmonella enterica enterica serovar Typhi Ty2
gaucgcuaaucagga

SEQ ID NO: 1736804 - RNA, 20 nt, Salmonella enterica enterica serovar Typhi Ty2
gaucgcggcaaccguaucca

SEQ ID NO: 1736805 - RNA, 20 nt, Salmonella enterica enterica serovar Typhi Ty2
gaucgcgccggucgccagca

SEQ ID NO: 1736806 - RNA, 13 nt, Salmonella enterica enterica serovar Typhi Ty2
gauagucaggcga

SEQ ID NO: 1736807 - RNA, 14 nt, Salmonella enterica enterica serovar Typhi Ty2
gauagucuucaagc

SEQ ID NO: 1736808 - RNA, 17 nt, Salmonella enterica enterica serovar Typhi Ty2
gauagggccaggcgcga

SEQ ID NO: 1736809 - RNA, 21 nt, Salmonella enterica enterica serovar Typhi Ty2
gauagggcguaaguugcccga

SEQ ID NO: 1736810 - RNA, 22 nt, Salmonella enterica enterica serovar Typhi Ty2
gauauccauugggggguuagug

SEQ ID NO: 1736811 - RNA, 18 nt, Salmonella enterica enterica serovar Typhi Ty2
gauaguguaaacgcgcca

SEQ ID NO: 1736812 - RNA, 14 nt, Salmonella enterica enterica serovar Typhi Ty2
gauagcacuaccca

SEQ ID NO: 1736813 - RNA, 16 nt, Salmonella enterica enterica serovar Typhi Ty2
gauagcuacgauaaag

SEQ ID NO: 1736814 - RNA, 13 nt, Salmonella enterica enterica serovar Typhi Ty2
gaucaaccggaug

SEQ ID NO: 1736815 - RNA, 19 nt, Salmonella enterica enterica serovar Typhi Ty2
gauaucugccugcagaccc

SEQ ID NO: 1736816 - RNA, 22 nt, Salmonella enterica enterica serovar Typhi Ty2
gauaucugccgcgcccgccauc

SEQ ID NO: 1736817 - RNA, 23 nt, Salmonella enterica enterica serovar Typhi Ty2
gauaucuuccagcgcguccagcc

SEQ ID NO: 1736818 - RNA, 20 nt, Salmonella enterica enterica serovar Typhi Ty2
gauaagcgcagcgccaucag

SEQ ID NO: 1736819 - RNA, 21 nt, Salmonella enterica enterica serovar Typhi Ty2
gauaaguccuaacaccugcca

SEQ ID NO: 1736820 - RNA, 14 nt, Salmonella enterica enterica serovar Typhi Ty2
gauaauacgcgcga

SEQ ID NO: 1736821 - RNA, 16 nt, Salmonella enterica enterica serovar Typhi Ty2
gauaagcaagcgccau

SEQ ID NO: 1736822 - RNA, 23 nt, Salmonella enterica enterica serovar Typhi Ty2
gauaagcaacgcgccauccggca

SEQ ID NO: 1736823 - RNA, 20 nt, Salmonella enterica enterica serovar Typhi Ty2
gauaagcauagcgccaucag

SEQ ID NO: 1736824 - RNA, 14 nt, Salmonella enterica enterica serovar Typhi Ty2
gauaagacgcuacg

SEQ ID NO: 1736825 - RNA, 20 nt, Salmonella enterica enterica serovar Typhi Ty2
gauaagcgaagcgccaucag

SEQ ID NO: 1736826 - RNA, 23 nt, Salmonella enterica enterica serovar Typhi Ty2
gauaagcgaagcgccaucaggca

SEQ ID NO: 1736827 - RNA, 19 nt, Salmonella enterica enterica serovar Typhi Ty2
gauaagcgcagcgcaucag

SEQ ID NO: 1736828 - RNA, 16 nt, Salmonella enterica enterica serovar Typhi Ty2
gauaagcgaagcgcca

SEQ ID NO: 1736829 - RNA, 22 nt, Salmonella enterica enterica serovar Typhi Ty2
gauaagcaagcgccaucgggca

SEQ ID NO: 1736830 - RNA, 17 nt, Salmonella enterica enterica serovar Typhi Ty2
gauaagccgcguccggc

SEQ ID NO: 1736831 - RNA, 22 nt, Salmonella enterica enterica serovar Typhi Ty2
gauaauuuucccaguucaucca

SEQ ID NO: 1736832 - RNA, 18 nt, Salmonella enterica enterica serovar Typhi Ty2
gauacacgccuuccucca

SEQ ID NO: 1736833 - RNA, 19 nt, Salmonella enterica enterica serovar Typhi Ty2
gauaauuuuaccuucgcgu

SEQ ID NO: 1736834 - RNA, 21 nt, Salmonella enterica enterica serovar Typhi Ty2
gauaauuaaugcgacgcccaa

SEQ ID NO: 1736835 - RNA, 14 nt, Salmonella enterica enterica serovar Typhi Ty2
gauaccgcgccagc

SEQ ID NO: 1736836 - RNA, 17 nt, Salmonella enterica enterica serovar Typhi Ty2
gauaccgcacuggauca

SEQ ID NO: 1736837 - RNA, 15 nt, Salmonella enterica enterica serovar Typhi Ty2
gauacgccagcagac

SEQ ID NO: 1736838 - RNA, 21 nt, Salmonella enterica enterica serovar Typhi Ty2
gauaaagaacgcgccgaccau

SEQ ID NO: 1736839 - RNA, 16 nt, Salmonella enterica enterica serovar Typhi Ty2
gauaaagaacgcgccg

SEQ ID NO: 1736840 - RNA, 20 nt, Salmonella enterica enterica serovar Typhi Ty2
gauaaacguagcgucaucag

SEQ ID NO: 1736841 - RNA, 23 nt, Salmonella enterica enterica serovar Typhi Ty2
gauaaacguagcgucaucaggcg

SEQ ID NO: 1736842 - RNA, 20 nt, Salmonella enterica enterica serovar Typhi Ty2
gauaaacgcaaugucaucag

SEQ ID NO: 1736843 - RNA, 20 nt, Salmonella enterica enterica serovar Typhi Ty2
gauaaacgcgucuucaucag

SEQ ID NO: 1736844 - RNA, 15 nt, Salmonella enterica enterica serovar Typhi Ty2
gauaaaaucgccaaa

SEQ ID NO: 1736845 - RNA, 14 nt, Salmonella enterica enterica serovar Typhi Ty2
gauaaagcagcgac

SEQ ID NO: 1736846 - RNA, 13 nt, Salmonella enterica enterica serovar Typhi Ty2
gauaaagauauuc

SEQ ID NO: 1736847 - RNA, 22 nt, Salmonella enterica enterica serovar Typhi Ty2
gaguauaaaacucgccgcgaac

SEQ ID NO: 1736848 - RNA, 12 nt, Salmonella enterica enterica serovar Typhi Ty2
gaguuccggaua

SEQ ID NO: 1736849 - RNA, 22 nt, Salmonella enterica enterica serovar Typhi Ty2
gaggcggaguuauacagugcca

SEQ ID NO: 1736850 - RNA, 18 nt, Salmonella enterica enterica serovar Typhi Ty2
gaggcgugagcgaacagg

SEQ ID NO: 1736851 - RNA, 13 nt, Salmonella enterica enterica serovar Typhi Ty2
gaggaaaccuuuc

SEQ ID NO: 1736852 - RNA, 18 nt, Salmonella enterica enterica serovar Typhi Ty2
gacugucuuaucaggccu

SEQ ID NO: 1736853 - RNA, 19 nt, Salmonella enterica enterica serovar Typhi Ty2
aacguuucuuucaucagau

SEQ ID NO: 1736854 - RNA, 19 nt, Salmonella enterica enterica serovar Typhi Ty2
aacguuuuucagccgcgca

SEQ ID NO: 1736855 - RNA, 15 nt, Salmonella enterica enterica serovar Typhi Ty2
gagaaccaacugcca

SEQ ID NO: 1736856 - RNA, 23 nt, Salmonella enterica enterica serovar Typhi Ty2
gagaaagugguggcggaaaugcg

SEQ ID NO: 1736857 - RNA, 17 nt, Salmonella enterica enterica serovar Typhi Ty2
gacuucgcuuccugcau

SEQ ID NO: 1736858 - RNA, 18 nt, Salmonella enterica enterica serovar Typhi Ty2
gacuggcgaccgccacca

SEQ ID NO: 1736859 - RNA, 10 nt, Salmonella enterica enterica serovar Typhi Ty2
gacuggcuga

SEQ ID NO: 1736860 - RNA, 18 nt, Salmonella enterica enterica serovar Typhi Ty2
aacguggcggcagagcca

SEQ ID NO: 1736861 - RNA, 21 nt, Salmonella enterica enterica serovar Typhi Ty2
gacuguaaaucugccgucauc

SEQ ID NO: 1736862 - RNA, 16 nt, Salmonella enterica enterica serovar Typhi Ty2
gacugaaccuucacgc

SEQ ID NO: 1736863 - RNA, 21 nt, Salmonella enterica enterica serovar Typhi Ty2
gacugaacauagccaucggcc

SEQ ID NO: 1736864 - RNA, 19 nt, Salmonella enterica enterica serovar Typhi Ty2
gacucuucggcuuccggca

SEQ ID NO: 1736865 - RNA, 16 nt, Salmonella enterica enterica serovar Typhi Ty2
gacugauaccgcguuu

SEQ ID NO: 1736866 - RNA, 20 nt, Salmonella enterica enterica serovar Typhi Ty2
gacugauaaaagcccuuauc

SEQ ID NO: 1736867 - RNA, 13 nt, Salmonella enterica enterica serovar Typhi Ty2
gacgucgccauau

SEQ ID NO: 1736868 - RNA, 20 nt, Salmonella enterica enterica serovar Typhi Ty2
gacgugauuuuggcagcccg

SEQ ID NO: 1736869 - RNA, 17 nt, Salmonella enterica enterica serovar Typhi Ty2
gacguagcgccaucagg

SEQ ID NO: 1736870 - RNA, 18 nt, Salmonella enterica enterica serovar Typhi Ty2
gacguugaucgccaucgc

SEQ ID NO: 1736871 - RNA, 19 nt, Salmonella enterica enterica serovar Typhi Ty2
gacguggauauucaucagu

SEQ ID NO: 1736872 - RNA, 18 nt, Salmonella enterica enterica serovar Typhi Ty2
gacuaaccuugauucccu

SEQ ID NO: 1736873 - RNA, 15 nt, Salmonella enterica enterica serovar Typhi Ty2
gacguuuauacccca

SEQ ID NO: 1736874 - RNA, 18 nt, Salmonella enterica enterica serovar Typhi Ty2
gacguuuaugccgccauc

SEQ ID NO: 1736875 - RNA, 20 nt, Salmonella enterica enterica serovar Typhi Ty2
gacguuuaugccgccauccg

SEQ ID NO: 1736876 - RNA, 20 nt, Salmonella enterica enterica serovar Typhi Ty2
gacuauucgcuaucagaaua

SEQ ID NO: 1736877 - RNA, 22 nt, Salmonella enterica enterica serovar Typhi Ty2
gagcgccgcgccuaccagcgcu

SEQ ID NO: 1736878 - RNA, 21 nt, Salmonella enterica enterica serovar Typhi Ty2
gagcgaaggggcgggcagcag

SEQ ID NO: 1736879 - RNA, 14 nt, Salmonella enterica enterica serovar Typhi Ty2
aacucaaucaggcu

SEQ ID NO: 1736880 - RNA, 14 nt, Salmonella enterica enterica serovar Typhi Ty2
aacuccaccugauc

SEQ ID NO: 1736881 - RNA, 13 nt, Salmonella enterica enterica serovar Typhi Ty2
aacuccuccggcg

SEQ ID NO: 1736882 - RNA, 15 nt, Salmonella enterica enterica serovar Typhi Ty2
gagccacaggaaccg

SEQ ID NO: 1736883 - RNA, 15 nt, Salmonella enterica enterica serovar Typhi Ty2
gagcagucguugcgc

SEQ ID NO: 1736884 - RNA, 13 nt, Salmonella enterica enterica serovar Typhi Ty2
gagaucagcggau

SEQ ID NO: 1736885 - RNA, 18 nt, Salmonella enterica enterica serovar Typhi Ty2
gagauacgucaucaugcu

SEQ ID NO: 1736886 - RNA, 20 nt, Salmonella enterica enterica serovar Typhi Ty2
gagauaguugagcagcgcga

SEQ ID NO: 1736887 - RNA, 17 nt, Salmonella enterica enterica serovar Typhi Ty2
gagaguugcuuuccguu

SEQ ID NO: 1736888 - RNA, 15 nt, Salmonella enterica enterica serovar Typhi Ty2
gagaguccagcgcca

SEQ ID NO: 1736889 - RNA, 18 nt, Salmonella enterica enterica serovar Typhi Ty2
gagaggccaccagcgcca

SEQ ID NO: 1736890 - RNA, 19 nt, Salmonella enterica enterica serovar Typhi Ty2
gagaguaaaaccggcacau

SEQ ID NO: 1736891 - RNA, 17 nt, Salmonella enterica enterica serovar Typhi Ty2
gagagcaacauaccgca

SEQ ID NO: 1736892 - RNA, 13 nt, Salmonella enterica enterica serovar Typhi Ty2
gagacugccgccg

SEQ ID NO: 1736893 - RNA, 16 nt, Salmonella enterica enterica serovar Typhi Ty2
gagacuaucgauagcg

SEQ ID NO: 1736894 - RNA, 13 nt, Salmonella enterica enterica serovar Typhi Ty2
gagacgcuggaaa

SEQ ID NO: 1736895 - RNA, 17 nt, Salmonella enterica enterica serovar Typhi Ty2
gagcagaaguaaauccg

SEQ ID NO: 1736896 - RNA, 22 nt, Salmonella enterica enterica serovar Typhi Ty2
gagcacuucugacauucagcgc

SEQ ID NO: 1736897 - RNA, 13 nt, Salmonella enterica enterica serovar Typhi Ty2
gagaucuccagau

SEQ ID NO: 1736898 - RNA, 15 nt, Salmonella enterica enterica serovar Typhi Ty2
gagcaacuggcaaua

SEQ ID NO: 1736899 - RNA, 11 nt, Salmonella enterica enterica serovar Typhi Ty2
gcccgaaucgc

SEQ ID NO: 1736900 - RNA, 22 nt, Salmonella enterica enterica serovar Typhi Ty2
gcccgaccccauuaaacuggcc

SEQ ID NO: 1736901 - RNA, 13 nt, Salmonella enterica enterica serovar Typhi Ty2
gcccgacgcgcca

SEQ ID NO: 1736902 - RNA, 17 nt, Salmonella enterica enterica serovar Typhi Ty2
aagauaaaaagacagau

SEQ ID NO: 1736903 - RNA, 16 nt, Salmonella enterica enterica serovar Typhi Ty2
gccccuuuacgcguga

SEQ ID NO: 1736904 - RNA, 17 nt, Salmonella enterica enterica serovar Typhi Ty2
gcccgaaagcaauacug

SEQ ID NO: 1736905 - RNA, 14 nt, Salmonella enterica enterica serovar Typhi Ty2
gcccgccagcacag

SEQ ID NO: 1736906 - RNA, 16 nt, Salmonella enterica enterica serovar Typhi Ty2
gcccgccagcacagca

SEQ ID NO: 1736907 - RNA, 14 nt, Salmonella enterica enterica serovar Typhi Ty2
gcccgccagcacca

SEQ ID NO: 1736908 - RNA, 14 nt, Salmonella enterica enterica serovar Typhi Ty2
gcccgccuccguca

SEQ ID NO: 1736909 - RNA, 21 nt, Salmonella enterica enterica serovar Typhi Ty2
aagagccgcgcagcgcaacgc

SEQ ID NO: 1736910 - RNA, 16 nt, Salmonella enterica enterica serovar Typhi Ty2
aagagcauaugcgcug

SEQ ID NO: 1736911 - RNA, 22 nt, Salmonella enterica enterica serovar Typhi Ty2
aagacggcagcgccauccggca

SEQ ID NO: 1736912 - RNA, 20 nt, Salmonella enterica enterica serovar Typhi Ty2
gccccauguucaguucaacc

SEQ ID NO: 1736913 - RNA, 19 nt, Salmonella enterica enterica serovar Typhi Ty2
gcccauuauugaucucuuc

SEQ ID NO: 1736914 - RNA, 15 nt, Salmonella enterica enterica serovar Typhi Ty2
gcccauuccgccaac

SEQ ID NO: 1736915 - RNA, 11 nt, Salmonella enterica enterica serovar Typhi Ty2
gcccaggccug

SEQ ID NO: 1736916 - RNA, 19 nt, Salmonella enterica enterica serovar Typhi Ty2
gccaugccuaaaccgacaa

SEQ ID NO: 1736917 - RNA, 12 nt, Salmonella enterica enterica serovar Typhi Ty2
gcccaggucgcc

SEQ ID NO: 1736918 - RNA, 15 nt, Salmonella enterica enterica serovar Typhi Ty2
gcccggcaguugcug

SEQ ID NO: 1736919 - RNA, 15 nt, Salmonella enterica enterica serovar Typhi Ty2
gcccggccuacguuu

SEQ ID NO: 1736920 - RNA, 23 nt, Salmonella enterica enterica serovar Typhi Ty2
gcccggcgcgcguugcgucaccg

SEQ ID NO: 1736921 - RNA, 17 nt, Salmonella enterica enterica serovar Typhi Ty2
gcccggcguaugccggg

SEQ ID NO: 1736922 - RNA, 14 nt, Salmonella enterica enterica serovar Typhi Ty2
gcccggcggcgcga

SEQ ID NO: 1736923 - RNA, 19 nt, Salmonella enterica enterica serovar Typhi Ty2
gcccgggcgauaucacgga

SEQ ID NO: 1736924 - RNA, 19 nt, Salmonella enterica enterica serovar Typhi Ty2
gcccggcuuuuugccgggc

SEQ ID NO: 1736925 - RNA, 21 nt, Salmonella enterica enterica serovar Typhi Ty2
gcccgguaagaaugcgcguca

SEQ ID NO: 1736926 - RNA, 21 nt, Salmonella enterica enterica serovar Typhi Ty2
gcccgguaagcgcuagcgcca

SEQ ID NO: 1736927 - RNA, 17 nt, Salmonella enterica enterica serovar Typhi Ty2
gcccgguacguuaaccg

SEQ ID NO: 1736928 - RNA, 19 nt, Salmonella enterica enterica serovar Typhi Ty2
gcccgguacguuaaccgga

SEQ ID NO: 1736929 - RNA, 19 nt, Salmonella enterica enterica serovar Typhi Ty2
gcccgguggcguggcgcca

SEQ ID NO: 1736930 - RNA, 18 nt, Salmonella enterica enterica serovar Typhi Ty2
gcccgucccuuccgccac

SEQ ID NO: 1736931 - RNA, 12 nt, Salmonella enterica enterica serovar Typhi Ty2
gccgaaagcgau

SEQ ID NO: 1736932 - RNA, 18 nt, Salmonella enterica enterica serovar Typhi Ty2
gcccuccagcuccgcgua

SEQ ID NO: 1736933 - RNA, 15 nt, Salmonella enterica enterica serovar Typhi Ty2
gccgaaccuggcggg

SEQ ID NO: 1736934 - RNA, 21 nt, Salmonella enterica enterica serovar Typhi Ty2
gccgaauucguuacccgauac

SEQ ID NO: 1736935 - RNA, 21 nt, Salmonella enterica enterica serovar Typhi Ty2
aagaucccagggcggcgucgc

SEQ ID NO: 1736936 - RNA, 17 nt, Salmonella enterica enterica serovar Typhi Ty2
aagaucgcguacagcgc

SEQ ID NO: 1736937 - RNA, 17 nt, Salmonella enterica enterica serovar Typhi Ty2
gccgaccgucggcgcaa

SEQ ID NO: 1736938 - RNA, 17 nt, Salmonella enterica enterica serovar Typhi Ty2
gccgaccaccgcccugu

SEQ ID NO: 1736939 - RNA, 17 nt, Salmonella enterica enterica serovar Typhi Ty2
gccgaccaccauccggc

SEQ ID NO: 1736940 - RNA, 20 nt, Salmonella enterica enterica serovar Typhi Ty2
gccgagucgguuuuauuaac

SEQ ID NO: 1736941 - RNA, 18 nt, Salmonella enterica enterica serovar Typhi Ty2
gccgaguggaaucagcca

SEQ ID NO: 1736942 - RNA, 19 nt, Salmonella enterica enterica serovar Typhi Ty2
gccgauaauaaacgcgcca

SEQ ID NO: 1736943 - RNA, 15 nt, Salmonella enterica enterica serovar Typhi Ty2
gccgauaauacgcgc

SEQ ID NO: 1736944 - RNA, 16 nt, Salmonella enterica enterica serovar Typhi Ty2
gccgauaaucgcgucu

SEQ ID NO: 1736945 - RNA, 13 nt, Salmonella enterica enterica serovar Typhi Ty2
gccgauaagcgcu

SEQ ID NO: 1736946 - RNA, 20 nt, Salmonella enterica enterica serovar Typhi Ty2
gccgaucagcaccacgcccg

SEQ ID NO: 1736947 - RNA, 13 nt, Salmonella enterica enterica serovar Typhi Ty2
gccgaucaggccg

SEQ ID NO: 1736948 - RNA, 19 nt, Salmonella enterica enterica serovar Typhi Ty2
gccgauauggccguuuuca

SEQ ID NO: 1736949 - RNA, 20 nt, Salmonella enterica enterica serovar Typhi Ty2
gccgauaguggucgccacgc

SEQ ID NO: 1736950 - RNA, 19 nt, Salmonella enterica enterica serovar Typhi Ty2
gccgacuuuacggccuagc

SEQ ID NO: 1736951 - RNA, 20 nt, Salmonella enterica enterica serovar Typhi Ty2
gccgagaguccagcgccagc

SEQ ID NO: 1736952 - RNA, 13 nt, Salmonella enterica enterica serovar Typhi Ty2
gccgccgccagau

SEQ ID NO: 1736953 - RNA, 17 nt, Salmonella enterica enterica serovar Typhi Ty2
gccgccauccggcaaac

SEQ ID NO: 1736954 - RNA, 17 nt, Salmonella enterica enterica serovar Typhi Ty2
gccgccauccgacaacc

SEQ ID NO: 1736955 - RNA, 22 nt, Salmonella enterica enterica serovar Typhi Ty2
gccgccauccgacauuauuaca

SEQ ID NO: 1736956 - RNA, 23 nt, Salmonella enterica enterica serovar Typhi Ty2
gccgccaucaacgaccaugguuc

SEQ ID NO: 1736957 - RNA, 16 nt, Salmonella enterica enterica serovar Typhi Ty2
gccgccauugccagua

SEQ ID NO: 1736958 - RNA, 15 nt, Salmonella enterica enterica serovar Typhi Ty2
gccgccauccggcac

SEQ ID NO: 1736959 - RNA, 22 nt, Salmonella enterica enterica serovar Typhi Ty2
gccgccaucuccggcagcgaau

SEQ ID NO: 1736960 - RNA, 15 nt, Salmonella enterica enterica serovar Typhi Ty2
gccgcccaucgccac

SEQ ID NO: 1736961 - RNA, 16 nt, Salmonella enterica enterica serovar Typhi Ty2
gccgcccauccagagc

SEQ ID NO: 1736962 - RNA, 20 nt, Salmonella enterica enterica serovar Typhi Ty2
gccgcccauuaauaucagcc

SEQ ID NO: 1736963 - RNA, 22 nt, Salmonella enterica enterica serovar Typhi Ty2
gccgcccagggaaagaucaaac

SEQ ID NO: 1736964 - RNA, 19 nt, Salmonella enterica enterica serovar Typhi Ty2
gccgccaaagcgauccggc

SEQ ID NO: 1736965 - RNA, 19 nt, Salmonella enterica enterica serovar Typhi Ty2
gccgccagccauccccaua

SEQ ID NO: 1736966 - RNA, 13 nt, Salmonella enterica enterica serovar Typhi Ty2
gccgccaggaacg

SEQ ID NO: 1736967 - RNA, 14 nt, Salmonella enterica enterica serovar Typhi Ty2
gccgccaacgccag

SEQ ID NO: 1736968 - RNA, 22 nt, Salmonella enterica enterica serovar Typhi Ty2
gccgccagcauuucaaucgcgc

SEQ ID NO: 1736969 - RNA, 13 nt, Salmonella enterica enterica serovar Typhi Ty2
gccgccagccacu

SEQ ID NO: 1736970 - RNA, 17 nt, Salmonella enterica enterica serovar Typhi Ty2
gccgcaccagucggcaa

SEQ ID NO: 1736971 - RNA, 19 nt, Salmonella enterica enterica serovar Typhi Ty2
gccgcagaaaauggucugc

SEQ ID NO: 1736972 - RNA, 14 nt, Salmonella enterica enterica serovar Typhi Ty2
gccgcagacggaga

SEQ ID NO: 1736973 - RNA, 22 nt, Salmonella enterica enterica serovar Typhi Ty2
gccgcaaacgccugcuccgucc

SEQ ID NO: 1736974 - RNA, 15 nt, Salmonella enterica enterica serovar Typhi Ty2
gccgcaaacagcacg

SEQ ID NO: 1736975 - RNA, 14 nt, Salmonella enterica enterica serovar Typhi Ty2
gccgcaaugaccac

SEQ ID NO: 1736976 - RNA, 14 nt, Salmonella enterica enterica serovar Typhi Ty2
gccgcaaucagcgu

SEQ ID NO: 1736977 - RNA, 17 nt, Salmonella enterica enterica serovar Typhi Ty2
gccagcgucaucagauc

SEQ ID NO: 1736978 - RNA, 16 nt, Salmonella enterica enterica serovar Typhi Ty2
gccagcgucgcugauu

SEQ ID NO: 1736979 - RNA, 21 nt, Salmonella enterica enterica serovar Typhi Ty2
gccagcgucaccucuuucgcc

SEQ ID NO: 1736980 - RNA, 14 nt, Salmonella enterica enterica serovar Typhi Ty2
gccagcgucaucag

SEQ ID NO: 1736981 - RNA, 15 nt, Salmonella enterica enterica serovar Typhi Ty2
gccaggaagucagcu

SEQ ID NO: 1736982 - RNA, 15 nt, Salmonella enterica enterica serovar Typhi Ty2
gccaggucugcacca

SEQ ID NO: 1736983 - RNA, 15 nt, Salmonella enterica enterica serovar Typhi Ty2
gccaggguucaaccu

SEQ ID NO: 1736984 - RNA, 22 nt, Salmonella enterica enterica serovar Typhi Ty2
gccaguuauuaaucaagcccag

SEQ ID NO: 1736985 - RNA, 14 nt, Salmonella enterica enterica serovar Typhi Ty2
gccaguucauuccg

SEQ ID NO: 1736986 - RNA, 19 nt, Salmonella enterica enterica serovar Typhi Ty2
gccaguucauucgccacca

SEQ ID NO: 1736987 - RNA, 13 nt, Salmonella enterica enterica serovar Typhi Ty2
gccagugaaucca

SEQ ID NO: 1736988 - RNA, 17 nt, Salmonella enterica enterica serovar Typhi Ty2
gccauccggcacuacag

SEQ ID NO: 1736989 - RNA, 23 nt, Salmonella enterica enterica serovar Typhi Ty2
gccauccggcacuacagcguuaa

SEQ ID NO: 1736990 - RNA, 17 nt, Salmonella enterica enterica serovar Typhi Ty2
gccauccggcaucacgu

SEQ ID NO: 1736991 - RNA, 14 nt, Salmonella enterica enterica serovar Typhi Ty2
gccauccggcaaca

SEQ ID NO: 1736992 - RNA, 12 nt, Salmonella enterica enterica serovar Typhi Ty2
gccauccugccg

SEQ ID NO: 1736993 - RNA, 13 nt, Salmonella enterica enterica serovar Typhi Ty2
gccauccugcgug

SEQ ID NO: 1736994 - RNA, 16 nt, Salmonella enterica enterica serovar Typhi Ty2
gccaucgucaccggau

SEQ ID NO: 1736995 - RNA, 19 nt, Salmonella enterica enterica serovar Typhi Ty2
gccaucguaugcugucgcc

SEQ ID NO: 1736996 - RNA, 17 nt, Salmonella enterica enterica serovar Typhi Ty2
gccaucgucaccggauc

SEQ ID NO: 1736997 - RNA, 21 nt, Salmonella enterica enterica serovar Typhi Ty2
gccaucggcgccggggugcug

SEQ ID NO: 1736998 - RNA, 18 nt, Salmonella enterica enterica serovar Typhi Ty2
gccaucggcuuuggcaaa

SEQ ID NO: 1736999 - RNA, 22 nt, Salmonella enterica enterica serovar Typhi Ty2
gccaucgcggcgcaaaucgcca

SEQ ID NO: 1737000 - RNA, 14 nt, Salmonella enterica enterica serovar Typhi Ty2
gccaucgccuccag

SEQ ID NO: 1737001 - RNA, 16 nt, Salmonella enterica enterica serovar Typhi Ty2
aagaaugcgcgucagg

SEQ ID NO: 1737002 - RNA, 16 nt, Salmonella enterica enterica serovar Typhi Ty2
gccaugcaucaauggc

SEQ ID NO: 1737003 - RNA, 15 nt, Salmonella enterica enterica serovar Typhi Ty2
gccaugccagcaguu

SEQ ID NO: 1737004 - RNA, 15 nt, Salmonella enterica enterica serovar Typhi Ty2
gccaugccaucggcc

SEQ ID NO: 1737005 - RNA, 21 nt, Salmonella enterica enterica serovar Typhi Ty2
gccaucaguaaaggaugccac

SEQ ID NO: 1737006 - RNA, 19 nt, Salmonella enterica enterica serovar Typhi Ty2
gccauccaucuccggcauc

SEQ ID NO: 1737007 - RNA, 14 nt, Salmonella enterica enterica serovar Typhi Ty2
gccaucaggcaauu

SEQ ID NO: 1737008 - RNA, 19 nt, Salmonella enterica enterica serovar Typhi Ty2
gccauauuguucaguuuca

SEQ ID NO: 1737009 - RNA, 13 nt, Salmonella enterica enterica serovar Typhi Ty2
gccauacgcccac

SEQ ID NO: 1737010 - RNA, 18 nt, Salmonella enterica enterica serovar Typhi Ty2
gccauauggcauucgcag

SEQ ID NO: 1737011 - RNA, 16 nt, Salmonella enterica enterica serovar Typhi Ty2
gccauauuaugcuggc

SEQ ID NO: 1737012 - RNA, 19 nt, Salmonella enterica enterica serovar Typhi Ty2
gccauauucaacgaaugcc

SEQ ID NO: 1737013 - RNA, 15 nt, Salmonella enterica enterica serovar Typhi Ty2
gccauauccagccag

SEQ ID NO: 1737014 - RNA, 20 nt, Salmonella enterica enterica serovar Typhi Ty2
gccauauacgccacggccag

SEQ ID NO: 1737015 - RNA, 15 nt, Salmonella enterica enterica serovar Typhi Ty2
gccaguuuccugacc

SEQ ID NO: 1737016 - RNA, 22 nt, Salmonella enterica enterica serovar Typhi Ty2
gccauaaugcacaauacgccga

SEQ ID NO: 1737017 - RNA, 18 nt, Salmonella enterica enterica serovar Typhi Ty2
gccauaaaacgggcaaac

SEQ ID NO: 1737018 - RNA, 18 nt, Salmonella enterica enterica serovar Typhi Ty2
gccagacgaacggccuga

SEQ ID NO: 1737019 - RNA, 17 nt, Salmonella enterica enterica serovar Typhi Ty2
gccagacgcuuauucgc

SEQ ID NO: 1737020 - RNA, 14 nt, Salmonella enterica enterica serovar Typhi Ty2
gccagauaaagcag

SEQ ID NO: 1737021 - RNA, 16 nt, Salmonella enterica enterica serovar Typhi Ty2
gccagaggcagcacau

SEQ ID NO: 1737022 - RNA, 22 nt, Salmonella enterica enterica serovar Typhi Ty2
gccagaggcgugcaugggcagc

SEQ ID NO: 1737023 - RNA, 19 nt, Salmonella enterica enterica serovar Typhi Ty2
gccagagcgcgcuggcaag

SEQ ID NO: 1737024 - RNA, 21 nt, Salmonella enterica enterica serovar Typhi Ty2
gccagaccccaguaauccggc

SEQ ID NO: 1737025 - RNA, 20 nt, Salmonella enterica enterica serovar Typhi Ty2
gccagaauacaccgccuagc

SEQ ID NO: 1737026 - RNA, 17 nt, Salmonella enterica enterica serovar Typhi Ty2
gccacggccagcagcca

SEQ ID NO: 1737027 - RNA, 13 nt, Salmonella enterica enterica serovar Typhi Ty2
gccacaugcggca

SEQ ID NO: 1737028 - RNA, 13 nt, Salmonella enterica enterica serovar Typhi Ty2
gccacaucgccag

SEQ ID NO: 1737029 - RNA, 16 nt, Salmonella enterica enterica serovar Typhi Ty2
gccagcaccaggcucg

SEQ ID NO: 1737030 - RNA, 23 nt, Salmonella enterica enterica serovar Typhi Ty2
gccagaugguaagcauagcgccu

SEQ ID NO: 1737031 - RNA, 22 nt, Salmonella enterica enterica serovar Typhi Ty2
gccagaugaaacugcauaucgc

SEQ ID NO: 1737032 - RNA, 19 nt, Salmonella enterica enterica serovar Typhi Ty2
gccagauaaaucagcccga

SEQ ID NO: 1737033 - RNA, 14 nt, Salmonella enterica enterica serovar Typhi Ty2
gccagccaaaacgu

SEQ ID NO: 1737034 - RNA, 22 nt, Salmonella enterica enterica serovar Typhi Ty2
gccagcccgacuaccggcacca

SEQ ID NO: 1737035 - RNA, 17 nt, Salmonella enterica enterica serovar Typhi Ty2
gccagcgcaacgcgcau

SEQ ID NO: 1737036 - RNA, 11 nt, Salmonella enterica enterica serovar Typhi Ty2
gccagcgcugc

SEQ ID NO: 1737037 - RNA, 19 nt, Salmonella enterica enterica serovar Typhi Ty2
gcaucgccgcaagcggcaa

SEQ ID NO: 1737038 - RNA, 15 nt, Salmonella enterica enterica serovar Typhi Ty2
gcaucggcagcgcca

SEQ ID NO: 1737039 - RNA, 22 nt, Salmonella enterica enterica serovar Typhi Ty2
gcaucguuaucauuaucgccaa

SEQ ID NO: 1737040 - RNA, 14 nt, Salmonella enterica enterica serovar Typhi Ty2
gcaucuccagcgca

SEQ ID NO: 1737041 - RNA, 18 nt, Salmonella enterica enterica serovar Typhi Ty2
gcaucgggccguccggca

SEQ ID NO: 1737042 - RNA, 12 nt, Salmonella enterica enterica serovar Typhi Ty2
gcaucguaccgu

SEQ ID NO: 1737043 - RNA, 22 nt, Salmonella enterica enterica serovar Typhi Ty2
gcaucaucucccaggccgccac

SEQ ID NO: 1737044 - RNA, 20 nt, Salmonella enterica enterica serovar Typhi Ty2
gcaucaggacauggucacca

SEQ ID NO: 1737045 - RNA, 17 nt, Salmonella enterica enterica serovar Typhi Ty2
gcaucaggaucuucauc

SEQ ID NO: 1737046 - RNA, 16 nt, Salmonella enterica enterica serovar Typhi Ty2
gcauccgccgccgcaa

SEQ ID NO: 1737047 - RNA, 20 nt, Salmonella enterica enterica serovar Typhi Ty2
gcaucccggugucaaagcgc

SEQ ID NO: 1737048 - RNA, 19 nt, Salmonella enterica enterica serovar Typhi Ty2
gcauccauauaagcgguau

SEQ ID NO: 1737049 - RNA, 17 nt, Salmonella enterica enterica serovar Typhi Ty2
gcauccggccagcgacu

SEQ ID NO: 1737050 - RNA, 18 nt, Salmonella enterica enterica serovar Typhi Ty2
gcaucaccggaucgccga

SEQ ID NO: 1737051 - RNA, 18 nt, Salmonella enterica enterica serovar Typhi Ty2
gcaucaggaaauccugga

SEQ ID NO: 1737052 - RNA, 17 nt, Salmonella enterica enterica serovar Typhi Ty2
gcaucacaaugaccucu

SEQ ID NO: 1737053 - RNA, 22 nt, Salmonella enterica enterica serovar Typhi Ty2
gcauauucauaucgaagcccag

SEQ ID NO: 1737054 - RNA, 13 nt, Salmonella enterica enterica serovar Typhi Ty2
gcaucaaagccac

SEQ ID NO: 1737055 - RNA, 17 nt, Salmonella enterica enterica serovar Typhi Ty2
gcauauuuuucauucgc

SEQ ID NO: 1737056 - RNA, 14 nt, Salmonella enterica enterica serovar Typhi Ty2
gcauaucgccauac

SEQ ID NO: 1737057 - RNA, 15 nt, Salmonella enterica enterica serovar Typhi Ty2
gcauauccagcgccu

SEQ ID NO: 1737058 - RNA, 22 nt, Salmonella enterica enterica serovar Typhi Ty2
gcauaggcuuugcugagcgcga

SEQ ID NO: 1737059 - RNA, 19 nt, Salmonella enterica enterica serovar Typhi Ty2
gcauagccccagcgcaaac

SEQ ID NO: 1737060 - RNA, 22 nt, Salmonella enterica enterica serovar Typhi Ty2
gcauaauaugcaacacgccgaa

SEQ ID NO: 1737061 - RNA, 19 nt, Salmonella enterica enterica serovar Typhi Ty2
gcauacagaugccguccau

SEQ ID NO: 1737062 - RNA, 18 nt, Salmonella enterica enterica serovar Typhi Ty2
gcauaccgcccagaacgg

SEQ ID NO: 1737063 - RNA, 22 nt, Salmonella enterica enterica serovar Typhi Ty2
gcauacucuccuccauaccuuu

SEQ ID NO: 1737064 - RNA, 16 nt, Salmonella enterica enterica serovar Typhi Ty2
gcauacguuucaccag

SEQ ID NO: 1737065 - RNA, 15 nt, Salmonella enterica enterica serovar Typhi Ty2
gcauacgucugcgcu

SEQ ID NO: 1737066 - RNA, 15 nt, Salmonella enterica enterica serovar Typhi Ty2
gcauaccggccacga

SEQ ID NO: 1737067 - RNA, 15 nt, Salmonella enterica enterica serovar Typhi Ty2
gcaguggcucaguca

SEQ ID NO: 1737068 - RNA, 17 nt, Salmonella enterica enterica serovar Typhi Ty2
gcaguggcucagucagu

SEQ ID NO: 1737069 - RNA, 13 nt, Salmonella enterica enterica serovar Typhi Ty2
gcaguucagcagc

SEQ ID NO: 1737070 - RNA, 22 nt, Salmonella enterica enterica serovar Typhi Ty2
gcaguucagucgggaucgccag

SEQ ID NO: 1737071 - RNA, 20 nt, Salmonella enterica enterica serovar Typhi Ty2
gcaguggccagaaugaucgc

SEQ ID NO: 1737072 - RNA, 22 nt, Salmonella enterica enterica serovar Typhi Ty2
gcauaauccagcaggugcggac

SEQ ID NO: 1737073 - RNA, 15 nt, Salmonella enterica enterica serovar Typhi Ty2
gcauaauauccagga

SEQ ID NO: 1737074 - RNA, 13 nt, Salmonella enterica enterica serovar Typhi Ty2
gcauaaauaucug

SEQ ID NO: 1737075 - RNA, 16 nt, Salmonella enterica enterica serovar Typhi Ty2
gcauaaaaaacaucau

SEQ ID NO: 1737076 - RNA, 20 nt, Salmonella enterica enterica serovar Typhi Ty2
gcauaaaaaacaucaugccc

SEQ ID NO: 1737077 - RNA, 20 nt, Salmonella enterica enterica serovar Typhi Ty2
gcaguucuucgccguuaucg

SEQ ID NO: 1737078 - RNA, 12 nt, Salmonella enterica enterica serovar Typhi Ty2
gcaguucaucca

SEQ ID NO: 1737079 - RNA, 17 nt, Salmonella enterica enterica serovar Typhi Ty2
gcaguuccgcaauccug

SEQ ID NO: 1737080 - RNA, 19 nt, Salmonella enterica enterica serovar Typhi Ty2
gcaucuuuccggaacgcgu

SEQ ID NO: 1737081 - RNA, 17 nt, Salmonella enterica enterica serovar Typhi Ty2
gcaugaagaaaauacug

SEQ ID NO: 1737082 - RNA, 15 nt, Salmonella enterica enterica serovar Typhi Ty2
gcaucuuauauuuug

SEQ ID NO: 1737083 - RNA, 13 nt, Salmonella enterica enterica serovar Typhi Ty2
gcaucugggcuga

SEQ ID NO: 1737084 - RNA, 23 nt, Salmonella enterica enterica serovar Typhi Ty2
gcaugauccaccaucggcgcgua

SEQ ID NO: 1737085 - RNA, 19 nt, Salmonella enterica enterica serovar Typhi Ty2
gcaugacuacgaaucgcgu

SEQ ID NO: 1737086 - RNA, 18 nt, Salmonella enterica enterica serovar Typhi Ty2
gcaugagugauagcgcca

SEQ ID NO: 1737087 - RNA, 21 nt, Salmonella enterica enterica serovar Typhi Ty2
gcaugauaccgauagcgcgga

SEQ ID NO: 1737088 - RNA, 22 nt, Salmonella enterica enterica serovar Typhi Ty2
gcaugaugggcgcacagcgcca

SEQ ID NO: 1737089 - RNA, 14 nt, Salmonella enterica enterica serovar Typhi Ty2
gcaugaugccacga

SEQ ID NO: 1737090 - RNA, 20 nt, Salmonella enterica enterica serovar Typhi Ty2
gcaugcagcucaagcgccgc

SEQ ID NO: 1737091 - RNA, 13 nt, Salmonella enterica enterica serovar Typhi Ty2
gcauucagccagc

SEQ ID NO: 1737092 - RNA, 20 nt, Salmonella enterica enterica serovar Typhi Ty2
gcauuauuuuuaaccgccuc

SEQ ID NO: 1737093 - RNA, 19 nt, Salmonella enterica enterica serovar Typhi Ty2
gcauguucucccugacacu

SEQ ID NO: 1737094 - RNA, 16 nt, Salmonella enterica enterica serovar Typhi Ty2
gcauguaccauuguca

SEQ ID NO: 1737095 - RNA, 20 nt, Salmonella enterica enterica serovar Typhi Ty2
gcauggcgucguaccguuaa

SEQ ID NO: 1737096 - RNA, 17 nt, Salmonella enterica enterica serovar Typhi Ty2
gcauggcgucggcgacu

SEQ ID NO: 1737097 - RNA, 22 nt, Salmonella enterica enterica serovar Typhi Ty2
gccaauccugcacccgccuuac

SEQ ID NO: 1737098 - RNA, 13 nt, Salmonella enterica enterica serovar Typhi Ty2
gccaagcggcauc

SEQ ID NO: 1737099 - RNA, 13 nt, Salmonella enterica enterica serovar Typhi Ty2
gccaacgccaaca

SEQ ID NO: 1737100 - RNA, 14 nt, Salmonella enterica enterica serovar Typhi Ty2
gcauuguccgcauu

SEQ ID NO: 1737101 - RNA, 13 nt, Salmonella enterica enterica serovar Typhi Ty2
gcauuuuccggcg

SEQ ID NO: 1737102 - RNA, 16 nt, Salmonella enterica enterica serovar Typhi Ty2
gccaacauagccacag

SEQ ID NO: 1737103 - RNA, 16 nt, Salmonella enterica enterica serovar Typhi Ty2
gccaaauagcgccaga

SEQ ID NO: 1737104 - RNA, 17 nt, Salmonella enterica enterica serovar Typhi Ty2
gccaaauagcgccagac

SEQ ID NO: 1737105 - RNA, 19 nt, Salmonella enterica enterica serovar Typhi Ty2
gccaacaacaggccgccga

SEQ ID NO: 1737106 - RNA, 14 nt, Salmonella enterica enterica serovar Typhi Ty2
gccaaacugcggaa

SEQ ID NO: 1737107 - RNA, 23 nt, Salmonella enterica enterica serovar Typhi Ty2
gccaaacuccaccugaucgccaa

SEQ ID NO: 1737108 - RNA, 15 nt, Salmonella enterica enterica serovar Typhi Ty2
gccaaagaaacgcug

SEQ ID NO: 1737109 - RNA, 12 nt, Salmonella enterica enterica serovar Typhi Ty2
gccaaacugcug

SEQ ID NO: 1737110 - RNA, 23 nt, Salmonella enterica enterica serovar Typhi Ty2
gccaaagauuagccccagcgcca

SEQ ID NO: 1737111 - RNA, 22 nt, Salmonella enterica enterica serovar Typhi Ty2
gccaaagcuggauaucacgcgc

SEQ ID NO: 1737112 - RNA, 21 nt, Salmonella enterica enterica serovar Typhi Ty2
gccaaaguuaaucagcgccgu

SEQ ID NO: 1737113 - RNA, 12 nt, Salmonella enterica enterica serovar Typhi Ty2
gccaaaauggcg

SEQ ID NO: 1737114 - RNA, 22 nt, Salmonella enterica enterica serovar Typhi Ty2
gccaaacccugcgccgcaaagg

SEQ ID NO: 1737115 - RNA, 20 nt, Salmonella enterica enterica serovar Typhi Ty2
gaaagaucaaacaggcgaaa

SEQ ID NO: 1737116 - RNA, 17 nt, Salmonella enterica enterica serovar Typhi Ty2
gaaagauaaaaauagca

SEQ ID NO: 1737117 - RNA, 22 nt, Salmonella enterica enterica serovar Typhi Ty2
gaaagcacuucucgcgcaucag

SEQ ID NO: 1737118 - RNA, 15 nt, Salmonella enterica enterica serovar Typhi Ty2
gaaagggacgaugau

SEQ ID NO: 1737119 - RNA, 19 nt, Salmonella enterica enterica serovar Typhi Ty2
gaaagugggcgcuuuguua

SEQ ID NO: 1737120 - RNA, 15 nt, Salmonella enterica enterica serovar Typhi Ty2
gaaagugggucacau

SEQ ID NO: 1737121 - RNA, 14 nt, Salmonella enterica enterica serovar Typhi Ty2
gaaacucagcggcc

SEQ ID NO: 1737122 - RNA, 15 nt, Salmonella enterica enterica serovar Typhi Ty2
cuuguaggccuggua

SEQ ID NO: 1737123 - RNA, 18 nt, Salmonella enterica enterica serovar Typhi Ty2
gaacagccccaccgccag

SEQ ID NO: 1737124 - RNA, 18 nt, Salmonella enterica enterica serovar Typhi Ty2
gaacaguguaaacgccag

SEQ ID NO: 1737125 - RNA, 18 nt, Salmonella enterica enterica serovar Typhi Ty2
gaacaucguguccugggu

SEQ ID NO: 1737126 - RNA, 18 nt, Salmonella enterica enterica serovar Typhi Ty2
gaaaucgguacgcgucug

SEQ ID NO: 1737127 - RNA, 23 nt, Salmonella enterica enterica serovar Typhi Ty2
gaaaucuucgccuaaaucaagca

SEQ ID NO: 1737128 - RNA, 17 nt, Salmonella enterica enterica serovar Typhi Ty2
gaacgcauccagccacg

SEQ ID NO: 1737129 - RNA, 15 nt, Salmonella enterica enterica serovar Typhi Ty2
gaaccaacgucauca

SEQ ID NO: 1737130 - RNA, 12 nt, Salmonella enterica enterica serovar Typhi Ty2
gaaccggaccag

SEQ ID NO: 1737131 - RNA, 18 nt, Salmonella enterica enterica serovar Typhi Ty2
gaaccguucagaauagcg

SEQ ID NO: 1737132 - RNA, 13 nt, Salmonella enterica enterica serovar Typhi Ty2
gaaccgucaucag

SEQ ID NO: 1737133 - RNA, 15 nt, Salmonella enterica enterica serovar Typhi Ty2
gaacuguucagccag

SEQ ID NO: 1737134 - RNA, 12 nt, Salmonella enterica enterica serovar Typhi Ty2
gaagaaaccgca

SEQ ID NO: 1737135 - RNA, 16 nt, Salmonella enterica enterica serovar Typhi Ty2
gaagaaaccgcagaaa

SEQ ID NO: 1737136 - RNA, 23 nt, Salmonella enterica enterica serovar Typhi Ty2
gaagacgaugauguagccgcguc

SEQ ID NO: 1737137 - RNA, 17 nt, Salmonella enterica enterica serovar Typhi Ty2
gaagacgcugcaacucu

SEQ ID NO: 1737138 - RNA, 14 nt, Salmonella enterica enterica serovar Typhi Ty2
gaagaccuuauccc

SEQ ID NO: 1737139 - RNA, 21 nt, Salmonella enterica enterica serovar Typhi Ty2
gaacggcuuuccagcagccag

SEQ ID NO: 1737140 - RNA, 19 nt, Salmonella enterica enterica serovar Typhi Ty2
gaacucggaggcggcguaa

SEQ ID NO: 1737141 - RNA, 20 nt, Salmonella enterica enterica serovar Typhi Ty2
gaauaccagaaucaccgaca

SEQ ID NO: 1737142 - RNA, 12 nt, Salmonella enterica enterica serovar Typhi Ty2
gaauaccacauc

SEQ ID NO: 1737143 - RNA, 18 nt, Salmonella enterica enterica serovar Typhi Ty2
gaagugauccuucaacgu

SEQ ID NO: 1737144 - RNA, 19 nt, Salmonella enterica enterica serovar Typhi Ty2
gaagucugugagaaaagcg

SEQ ID NO: 1737145 - RNA, 22 nt, Salmonella enterica enterica serovar Typhi Ty2
gaaucagaugcucaucaacgau

SEQ ID NO: 1737146 - RNA, 15 nt, Salmonella enterica enterica serovar Typhi Ty2
gaaucacgccgauga

SEQ ID NO: 1737147 - RNA, 16 nt, Salmonella enterica enterica serovar Typhi Ty2
gaaucacguaaucggc

SEQ ID NO: 1737148 - RNA, 19 nt, Salmonella enterica enterica serovar Typhi Ty2
gaauacgguccguuuucgc

SEQ ID NO: 1737149 - RNA, 21 nt, Salmonella enterica enterica serovar Typhi Ty2
gaauacgcuccagcuggcugg

SEQ ID NO: 1737150 - RNA, 21 nt, Salmonella enterica enterica serovar Typhi Ty2
gaauacggccuucuuccguca

SEQ ID NO: 1737151 - RNA, 17 nt, Salmonella enterica enterica serovar Typhi Ty2
gaauagcgaacagucca

SEQ ID NO: 1737152 - RNA, 15 nt, Salmonella enterica enterica serovar Typhi Ty2
gaaugccaagcgcau

SEQ ID NO: 1737153 - RNA, 15 nt, Salmonella enterica enterica serovar Typhi Ty2
gaaucgcgauaacgu

SEQ ID NO: 1737154 - RNA, 16 nt, Salmonella enterica enterica serovar Typhi Ty2
gaaucgcucacccgau

SEQ ID NO: 1737155 - RNA, 20 nt, Salmonella enterica enterica serovar Typhi Ty2
gaaucccacggagaaaagcg

SEQ ID NO: 1737156 - RNA, 13 nt, Salmonella enterica enterica serovar Typhi Ty2
gaaucccgucgua

SEQ ID NO: 1737157 - RNA, 12 nt, Salmonella enterica enterica serovar Typhi Ty2
gaaguaaggcau

SEQ ID NO: 1737158 - RNA, 18 nt, Salmonella enterica enterica serovar Typhi Ty2
gaagucagcuuccugcac

SEQ ID NO: 1737159 - RNA, 16 nt, Salmonella enterica enterica serovar Typhi Ty2
gaaggcuuugccauac

SEQ ID NO: 1737160 - RNA, 15 nt, Salmonella enterica enterica serovar Typhi Ty2
gaagggcggcuggau

SEQ ID NO: 1737161 - RNA, 22 nt, Salmonella enterica enterica serovar Typhi Ty2
gaagggguggcgaucguuguuu

SEQ ID NO: 1737162 - RNA, 14 nt, Salmonella enterica enterica serovar Typhi Ty2
gaaggcuccggcac

SEQ ID NO: 1737163 - RNA, 19 nt, Salmonella enterica enterica serovar Typhi Ty2
gaagcggcgcuauccggca

SEQ ID NO: 1737164 - RNA, 17 nt, Salmonella enterica enterica serovar Typhi Ty2
gaagcgcguucguccca

SEQ ID NO: 1737165 - RNA, 19 nt, Salmonella enterica enterica serovar Typhi Ty2
gaagcgauguauuuaucca

SEQ ID NO: 1737166 - RNA, 23 nt, Salmonella enterica enterica serovar Typhi Ty2
gaaggaauuaugcagacgcucgu

SEQ ID NO: 1737167 - RNA, 19 nt, Salmonella enterica enterica serovar Typhi Ty2
gaaggacugauacagccaa

SEQ ID NO: 1737168 - RNA, 20 nt, Salmonella enterica enterica serovar Typhi Ty2
gaaggcaacugauccugcgu

SEQ ID NO: 1737169 - RNA, 13 nt, Salmonella enterica enterica serovar Typhi Ty2
gaaggcaggcugg

SEQ ID NO: 1737170 - RNA, 22 nt, Salmonella enterica enterica serovar Typhi Ty2
gaaggcauuucaaucgccacca

SEQ ID NO: 1737171 - RNA, 22 nt, Salmonella enterica enterica serovar Typhi Ty2
gaagcugcagggauaugcugau

SEQ ID NO: 1737172 - RNA, 15 nt, Salmonella enterica enterica serovar Typhi Ty2
gaagcugccguccca

SEQ ID NO: 1737173 - RNA, 14 nt, Salmonella enterica enterica serovar Typhi Ty2
gaagcacauccaug

SEQ ID NO: 1737174 - RNA, 21 nt, Salmonella enterica enterica serovar Typhi Ty2
gaagauacgccagguuaugcg

SEQ ID NO: 1737175 - RNA, 13 nt, Salmonella enterica enterica serovar Typhi Ty2
gaagccagugccc

SEQ ID NO: 1737176 - RNA, 23 nt, Salmonella enterica enterica serovar Typhi Ty2
gaagccacguucuuccagaacgc

SEQ ID NO: 1737177 - RNA, 13 nt, Salmonella enterica enterica serovar Typhi Ty2
gacagcgccauau

SEQ ID NO: 1737178 - RNA, 16 nt, Salmonella enterica enterica serovar Typhi Ty2
gacagccgaucaggcc

SEQ ID NO: 1737179 - RNA, 19 nt, Salmonella enterica enterica serovar Typhi Ty2
gaaugugaaauacagccag

SEQ ID NO: 1737180 - RNA, 15 nt, Salmonella enterica enterica serovar Typhi Ty2
gacagccgacggcaa

SEQ ID NO: 1737181 - RNA, 19 nt, Salmonella enterica enterica serovar Typhi Ty2
gacagccaaacugcuguag

SEQ ID NO: 1737182 - RNA, 23 nt, Salmonella enterica enterica serovar Typhi Ty2
gacaugcuguugaaacgccguuu

SEQ ID NO: 1737183 - RNA, 17 nt, Salmonella enterica enterica serovar Typhi Ty2
gacauugguuucaugca

SEQ ID NO: 1737184 - RNA, 20 nt, Salmonella enterica enterica serovar Typhi Ty2
gacauuuaucuuccggcauc

SEQ ID NO: 1737185 - RNA, 18 nt, Salmonella enterica enterica serovar Typhi Ty2
gacauugucggcgcuauc

SEQ ID NO: 1737186 - RNA, 23 nt, Salmonella enterica enterica serovar Typhi Ty2
gacagugaaacgggugaggucgg

SEQ ID NO: 1737187 - RNA, 17 nt, Salmonella enterica enterica serovar Typhi Ty2
gacauaaaacccgccuc

SEQ ID NO: 1737188 - RNA, 15 nt, Salmonella enterica enterica serovar Typhi Ty2
gaccaaugacgcuau

SEQ ID NO: 1737189 - RNA, 17 nt, Salmonella enterica enterica serovar Typhi Ty2
gaccaauugcaggcagc

SEQ ID NO: 1737190 - RNA, 20 nt, Salmonella enterica enterica serovar Typhi Ty2
gaccacaccgucaacaucau

SEQ ID NO: 1737191 - RNA, 22 nt, Salmonella enterica enterica serovar Typhi Ty2
gaccaacgguuggauuucggcg

SEQ ID NO: 1737192 - RNA, 14 nt, Salmonella enterica enterica serovar Typhi Ty2
gaccaacgucagca

SEQ ID NO: 1737193 - RNA, 21 nt, Salmonella enterica enterica serovar Typhi Ty2
gaccaacgguuggauuucggc

SEQ ID NO: 1737194 - RNA, 15 nt, Salmonella enterica enterica serovar Typhi Ty2
gaccaccauauucgc

SEQ ID NO: 1737195 - RNA, 15 nt, Salmonella enterica enterica serovar Typhi Ty2
gaccacgaaucagga

SEQ ID NO: 1737196 - RNA, 18 nt, Salmonella enterica enterica serovar Typhi Ty2
aacgcaucacaugcggga

SEQ ID NO: 1737197 - RNA, 18 nt, Salmonella enterica enterica serovar Typhi Ty2
aacgcacgcagccaacgc

SEQ ID NO: 1737198 - RNA, 22 nt, Salmonella enterica enterica serovar Typhi Ty2
aacgcaggcgaaaucaaaaggc

SEQ ID NO: 1737199 - RNA, 15 nt, Salmonella enterica enterica serovar Typhi Ty2
aacgcaaagacaccc

SEQ ID NO: 1737200 - RNA, 20 nt, Salmonella enterica enterica serovar Typhi Ty2
gaccacgccaccgccgccac

SEQ ID NO: 1737201 - RNA, 19 nt, Salmonella enterica enterica serovar Typhi Ty2
aacgccugaugcugcgcau

SEQ ID NO: 1737202 - RNA, 20 nt, Salmonella enterica enterica serovar Typhi Ty2
aacgccggucguggcgauca

SEQ ID NO: 1737203 - RNA, 17 nt, Salmonella enterica enterica serovar Typhi Ty2
aacgccgguacgcagca

SEQ ID NO: 1737204 - RNA, 19 nt, Salmonella enterica enterica serovar Typhi Ty2
aacgccguacuccagccca

SEQ ID NO: 1737205 - RNA, 21 nt, Salmonella enterica enterica serovar Typhi Ty2
aacgcauccagcgucacaggc

SEQ ID NO: 1737206 - RNA, 17 nt, Salmonella enterica enterica serovar Typhi Ty2
gaccacggccacagcca

SEQ ID NO: 1737207 - RNA, 16 nt, Salmonella enterica enterica serovar Typhi Ty2
gaccauaaauagccga

SEQ ID NO: 1737208 - RNA, 17 nt, Salmonella enterica enterica serovar Typhi Ty2
gaccauaauuuccggcg

SEQ ID NO: 1737209 - RNA, 18 nt, Salmonella enterica enterica serovar Typhi Ty2
gaccauauucacgcagcu

SEQ ID NO: 1737210 - RNA, 20 nt, Salmonella enterica enterica serovar Typhi Ty2
gaccaucgcguuguaaucgc

SEQ ID NO: 1737211 - RNA, 16 nt, Salmonella enterica enterica serovar Typhi Ty2
aacgcgccacgcgcca

SEQ ID NO: 1737212 - RNA, 14 nt, Salmonella enterica enterica serovar Typhi Ty2
aacgcgccaucuuu

SEQ ID NO: 1737213 - RNA, 13 nt, Salmonella enterica enterica serovar Typhi Ty2
aacgcgacaacgc

SEQ ID NO: 1737214 - RNA, 16 nt, Salmonella enterica enterica serovar Typhi Ty2
aacgccuucguccgga

SEQ ID NO: 1737215 - RNA, 21 nt, Salmonella enterica enterica serovar Typhi Ty2
gaccaggaauuuaccggugcg

SEQ ID NO: 1737216 - RNA, 13 nt, Salmonella enterica enterica serovar Typhi Ty2
gaccugaucggcc

SEQ ID NO: 1737217 - RNA, 16 nt, Salmonella enterica enterica serovar Typhi Ty2
gaccugaaaucagccu

SEQ ID NO: 1737218 - RNA, 12 nt, Salmonella enterica enterica serovar Typhi Ty2
gacgaacgcuau

SEQ ID NO: 1737219 - RNA, 15 nt, Salmonella enterica enterica serovar Typhi Ty2
gacgaaagucaucca

SEQ ID NO: 1737220 - RNA, 22 nt, Salmonella enterica enterica serovar Typhi Ty2
gaccguaguagguauccagcag

SEQ ID NO: 1737221 - RNA, 17 nt, Salmonella enterica enterica serovar Typhi Ty2
gaccguauccgccacca

SEQ ID NO: 1737222 - RNA, 19 nt, Salmonella enterica enterica serovar Typhi Ty2
gaccgugagaaucgaucag

SEQ ID NO: 1737223 - RNA, 14 nt, Salmonella enterica enterica serovar Typhi Ty2
aacggcguaccaga

SEQ ID NO: 1737224 - RNA, 17 nt, Salmonella enterica enterica serovar Typhi Ty2
aacggcugacgcccauc

SEQ ID NO: 1737225 - RNA, 21 nt, Salmonella enterica enterica serovar Typhi Ty2
aacggcugacgcccaucagca

SEQ ID NO: 1737226 - RNA, 18 nt, Salmonella enterica enterica serovar Typhi Ty2
aacggcugacgcccauca

SEQ ID NO: 1737227 - RNA, 20 nt, Salmonella enterica enterica serovar Typhi Ty2
aacggcuugugagcgucgcg

SEQ ID NO: 1737228 - RNA, 20 nt, Salmonella enterica enterica serovar Typhi Ty2
gaccucacgcuuaucgccaa

SEQ ID NO: 1737229 - RNA, 15 nt, Salmonella enterica enterica serovar Typhi Ty2
gaccguuagcgacgg

SEQ ID NO: 1737230 - RNA, 13 nt, Salmonella enterica enterica serovar Typhi Ty2
gaccuacaggccg

SEQ ID NO: 1737231 - RNA, 23 nt, Salmonella enterica enterica serovar Typhi Ty2
gaccguguucaugcagccauagc

SEQ ID NO: 1737232 - RNA, 15 nt, Salmonella enterica enterica serovar Typhi Ty2
aacgggcccggcuuu

SEQ ID NO: 1737233 - RNA, 17 nt, Salmonella enterica enterica serovar Typhi Ty2
aacgggcaucgccgcaa

SEQ ID NO: 1737234 - RNA, 15 nt, Salmonella enterica enterica serovar Typhi Ty2
gaccgagaucaggcc

SEQ ID NO: 1737235 - RNA, 19 nt, Salmonella enterica enterica serovar Typhi Ty2
gaccgccccguaucauuag

SEQ ID NO: 1737236 - RNA, 15 nt, Salmonella enterica enterica serovar Typhi Ty2
gaccgccaagcgcgg

SEQ ID NO: 1737237 - RNA, 18 nt, Salmonella enterica enterica serovar Typhi Ty2
gaccgccaagcgcggaca

SEQ ID NO: 1737238 - RNA, 14 nt, Salmonella enterica enterica serovar Typhi Ty2
aacgcuggccgcaa

SEQ ID NO: 1737239 - RNA, 14 nt, Salmonella enterica enterica serovar Typhi Ty2
aacgcugcgcuaca

SEQ ID NO: 1737240 - RNA, 22 nt, Salmonella enterica enterica serovar Typhi Ty2
aacgcugcauccuguaccacca

SEQ ID NO: 1737241 - RNA, 14 nt, Salmonella enterica enterica serovar Typhi Ty2
gaccgacaucgcca

SEQ ID NO: 1737242 - RNA, 17 nt, Salmonella enterica enterica serovar Typhi Ty2
gaccgcuuucccggcau

SEQ ID NO: 1737243 - RNA, 20 nt, Salmonella enterica enterica serovar Typhi Ty2
aacggcgcuggcguacgcau

SEQ ID NO: 1737244 - RNA, 21 nt, Salmonella enterica enterica serovar Typhi Ty2
cugcuuaucgauaucugccug

SEQ ID NO: 1737245 - RNA, 17 nt, Salmonella enterica enterica serovar Typhi Ty2
cugcuuagcucaucagc

SEQ ID NO: 1737246 - RNA, 22 nt, Salmonella enterica enterica serovar Typhi Ty2
cugcugguagagcaucgcggca

SEQ ID NO: 1737247 - RNA, 15 nt, Salmonella enterica enterica serovar Typhi Ty2
cugcuggagccggaa

SEQ ID NO: 1737248 - RNA, 19 nt, Salmonella enterica enterica serovar Typhi Ty2
cuggaaucauccaccagaa

SEQ ID NO: 1737249 - RNA, 23 nt, Salmonella enterica enterica serovar Typhi Ty2
cuggaagagaacguucguugucc

SEQ ID NO: 1737250 - RNA, 19 nt, Salmonella enterica enterica serovar Typhi Ty2
cuggacaaagcguuugccg

SEQ ID NO: 1737251 - RNA, 23 nt, Salmonella enterica enterica serovar Typhi Ty2
cuggacaaagcguuugccgugga

SEQ ID NO: 1737252 - RNA, 21 nt, Salmonella enterica enterica serovar Typhi Ty2
cuggacaucaaacucuucgcg

SEQ ID NO: 1737253 - RNA, 19 nt, Salmonella enterica enterica serovar Typhi Ty2
cugcuuucuuacaccucgc

SEQ ID NO: 1737254 - RNA, 16 nt, Salmonella enterica enterica serovar Typhi Ty2
cuggaaaaaacggggc

SEQ ID NO: 1737255 - RNA, 22 nt, Salmonella enterica enterica serovar Typhi Ty2
cugcuuuuucacccuugcggcu

SEQ ID NO: 1737256 - RNA, 14 nt, Salmonella enterica enterica serovar Typhi Ty2
cugcuuuuccggca

SEQ ID NO: 1737257 - RNA, 18 nt, Salmonella enterica enterica serovar Typhi Ty2
cugcuucuggcuugcgcu

SEQ ID NO: 1737258 - RNA, 13 nt, Salmonella enterica enterica serovar Typhi Ty2
cuggccagggcau

SEQ ID NO: 1737259 - RNA, 14 nt, Salmonella enterica enterica serovar Typhi Ty2
aaccggcaacucgc

SEQ ID NO: 1737260 - RNA, 15 nt, Salmonella enterica enterica serovar Typhi Ty2
aaccgcuuuuccugc

SEQ ID NO: 1737261 - RNA, 15 nt, Salmonella enterica enterica serovar Typhi Ty2
aaccgcuacccggca

SEQ ID NO: 1737262 - RNA, 14 nt, Salmonella enterica enterica serovar Typhi Ty2
cugcugauuggcga

SEQ ID NO: 1737263 - RNA, 14 nt, Salmonella enterica enterica serovar Typhi Ty2
cugcucuugcggca

SEQ ID NO: 1737264 - RNA, 21 nt, Salmonella enterica enterica serovar Typhi Ty2
cugcugcucccucacgcguca

SEQ ID NO: 1737265 - RNA, 16 nt, Salmonella enterica enterica serovar Typhi Ty2
cugcggucuccugaac

SEQ ID NO: 1737266 - RNA, 19 nt, Salmonella enterica enterica serovar Typhi Ty2
cugcgguagagaacagcau

SEQ ID NO: 1737267 - RNA, 15 nt, Salmonella enterica enterica serovar Typhi Ty2
cugcuccgccagcaa

SEQ ID NO: 1737268 - RNA, 15 nt, Salmonella enterica enterica serovar Typhi Ty2
cugcuccugcggcgu

SEQ ID NO: 1737269 - RNA, 16 nt, Salmonella enterica enterica serovar Typhi Ty2
cugcguuuaucaggcc

SEQ ID NO: 1737270 - RNA, 15 nt, Salmonella enterica enterica serovar Typhi Ty2
cugccgcgcgguauu

SEQ ID NO: 1737271 - RNA, 17 nt, Salmonella enterica enterica serovar Typhi Ty2
cugccgcgaucgcggca

SEQ ID NO: 1737272 - RNA, 16 nt, Salmonella enterica enterica serovar Typhi Ty2
cugccggcuuaacgcu

SEQ ID NO: 1737273 - RNA, 14 nt, Salmonella enterica enterica serovar Typhi Ty2
cugccgcaaacgcc

SEQ ID NO: 1737274 - RNA, 23 nt, Salmonella enterica enterica serovar Typhi Ty2
cugccgauacuccauugucggca

SEQ ID NO: 1737275 - RNA, 21 nt, Salmonella enterica enterica serovar Typhi Ty2
cugaaagccgacccgcaucag

SEQ ID NO: 1737276 - RNA, 12 nt, Salmonella enterica enterica serovar Typhi Ty2
cugaaagcgccu

SEQ ID NO: 1737277 - RNA, 20 nt, Salmonella enterica enterica serovar Typhi Ty2
cugaaagauuauuuuaucau

SEQ ID NO: 1737278 - RNA, 18 nt, Salmonella enterica enterica serovar Typhi Ty2
cugaaacgcuucaccggc

SEQ ID NO: 1737279 - RNA, 20 nt, Salmonella enterica enterica serovar Typhi Ty2
cucuucuuuuaauugccagg

SEQ ID NO: 1737280 - RNA, 19 nt, Salmonella enterica enterica serovar Typhi Ty2
cugaaauggccgucgccac

SEQ ID NO: 1737281 - RNA, 15 nt, Salmonella enterica enterica serovar Typhi Ty2
cugaaaucacgccac

SEQ ID NO: 1737282 - RNA, 15 nt, Salmonella enterica enterica serovar Typhi Ty2
cugcgaaaagcgugc

SEQ ID NO: 1737283 - RNA, 21 nt, Salmonella enterica enterica serovar Typhi Ty2
cugccuuuguacagcuugccg

SEQ ID NO: 1737284 - RNA, 16 nt, Salmonella enterica enterica serovar Typhi Ty2
cugccuucugaaaguu

SEQ ID NO: 1737285 - RNA, 22 nt, Salmonella enterica enterica serovar Typhi Ty2
cugccguuuuuaacgccggcaa

SEQ ID NO: 1737286 - RNA, 21 nt, Salmonella enterica enterica serovar Typhi Ty2
cugccgucaucgacuucaagg

SEQ ID NO: 1737287 - RNA, 22 nt, Salmonella enterica enterica serovar Typhi Ty2
cugccgucaucgacuucgaagg

SEQ ID NO: 1737288 - RNA, 18 nt, Salmonella enterica enterica serovar Typhi Ty2
cugccguaaggcgauuca

SEQ ID NO: 1737289 - RNA, 22 nt, Salmonella enterica enterica serovar Typhi Ty2
cugcgccguuccguucgcguca

SEQ ID NO: 1737290 - RNA, 13 nt, Salmonella enterica enterica serovar Typhi Ty2
cugcgccgcaucu

SEQ ID NO: 1737291 - RNA, 23 nt, Salmonella enterica enterica serovar Typhi Ty2
cugcgcgccaaaccguucacgcu

SEQ ID NO: 1737292 - RNA, 21 nt, Salmonella enterica enterica serovar Typhi Ty2
cugcgcgccgcccugcaucau

SEQ ID NO: 1737293 - RNA, 16 nt, Salmonella enterica enterica serovar Typhi Ty2
cugcgcgccuugcgca

SEQ ID NO: 1737294 - RNA, 20 nt, Salmonella enterica enterica serovar Typhi Ty2
cugcgccacaucauugcugu

SEQ ID NO: 1737295 - RNA, 18 nt, Salmonella enterica enterica serovar Typhi Ty2
cugcgcauuaacgccaug

SEQ ID NO: 1737296 - RNA, 13 nt, Salmonella enterica enterica serovar Typhi Ty2
cugcgccagcgca

SEQ ID NO: 1737297 - RNA, 20 nt, Salmonella enterica enterica serovar Typhi Ty2
cugcggcacgucauuacggu

SEQ ID NO: 1737298 - RNA, 19 nt, Salmonella enterica enterica serovar Typhi Ty2
cugcggcugacgcgaugac

SEQ ID NO: 1737299 - RNA, 13 nt, Salmonella enterica enterica serovar Typhi Ty2
cugcgcuucugau

SEQ ID NO: 1737300 - RNA, 17 nt, Salmonella enterica enterica serovar Typhi Ty2
cugcgcuucuauccacu

SEQ ID NO: 1737301 - RNA, 18 nt, Salmonella enterica enterica serovar Typhi Ty2
cugcgcuuaucaggccua

SEQ ID NO: 1737302 - RNA, 23 nt, Salmonella enterica enterica serovar Typhi Ty2
cuucugucagccuugcaucucau

SEQ ID NO: 1737303 - RNA, 16 nt, Salmonella enterica enterica serovar Typhi Ty2
cuucuguaauacgcug

SEQ ID NO: 1737304 - RNA, 15 nt, Salmonella enterica enterica serovar Typhi Ty2
cuucugcugugcaua

SEQ ID NO: 1737305 - RNA, 17 nt, Salmonella enterica enterica serovar Typhi Ty2
cuucugacagugacggc

SEQ ID NO: 1737306 - RNA, 14 nt, Salmonella enterica enterica serovar Typhi Ty2
cuucuuaguaacau

SEQ ID NO: 1737307 - RNA, 15 nt, Salmonella enterica enterica serovar Typhi Ty2
cuucuucuuccguca

SEQ ID NO: 1737308 - RNA, 16 nt, Salmonella enterica enterica serovar Typhi Ty2
cuuccaguugaaaacc

SEQ ID NO: 1737309 - RNA, 15 nt, Salmonella enterica enterica serovar Typhi Ty2
cuuccaguugcguca

SEQ ID NO: 1737310 - RNA, 13 nt, Salmonella enterica enterica serovar Typhi Ty2
cuuccaucgcauc

SEQ ID NO: 1737311 - RNA, 16 nt, Salmonella enterica enterica serovar Typhi Ty2
cuucccacagucggcg

SEQ ID NO: 1737312 - RNA, 15 nt, Salmonella enterica enterica serovar Typhi Ty2
cuucagagcugaaaa

SEQ ID NO: 1737313 - RNA, 22 nt, Salmonella enterica enterica serovar Typhi Ty2
cuucagauaccgccuuaccgcg

SEQ ID NO: 1737314 - RNA, 17 nt, Salmonella enterica enterica serovar Typhi Ty2
cuucgccguuaucggcc

SEQ ID NO: 1737315 - RNA, 15 nt, Salmonella enterica enterica serovar Typhi Ty2
cuucgauaaacgccu

SEQ ID NO: 1737316 - RNA, 20 nt, Salmonella enterica enterica serovar Typhi Ty2
cuugccucacccugaaaucc

SEQ ID NO: 1737317 - RNA, 13 nt, Salmonella enterica enterica serovar Typhi Ty2
cuugccgucaaca

SEQ ID NO: 1737318 - RNA, 21 nt, Salmonella enterica enterica serovar Typhi Ty2
cuugcgccgccauccggccug

SEQ ID NO: 1737319 - RNA, 22 nt, Salmonella enterica enterica serovar Typhi Ty2
cuuguaaaaaugccugugccag

SEQ ID NO: 1737320 - RNA, 13 nt, Salmonella enterica enterica serovar Typhi Ty2
cuugccagcgcau

SEQ ID NO: 1737321 - RNA, 14 nt, Salmonella enterica enterica serovar Typhi Ty2
cuugcccagcgccu

SEQ ID NO: 1737322 - RNA, 14 nt, Salmonella enterica enterica serovar Typhi Ty2
cuugcccagcauau

SEQ ID NO: 1737323 - RNA, 21 nt, Salmonella enterica enterica serovar Typhi Ty2
cuugauggcgaucagcgccac

SEQ ID NO: 1737324 - RNA, 21 nt, Salmonella enterica enterica serovar Typhi Ty2
cuugauggaaaacgcaucugg

SEQ ID NO: 1737325 - RNA, 19 nt, Salmonella enterica enterica serovar Typhi Ty2
cuugauccagcucgcgaua

SEQ ID NO: 1737326 - RNA, 19 nt, Salmonella enterica enterica serovar Typhi Ty2
cuuacgcuuacccggccua

SEQ ID NO: 1737327 - RNA, 16 nt, Salmonella enterica enterica serovar Typhi Ty2
cuuacgcucgcugaug

SEQ ID NO: 1737328 - RNA, 13 nt, Salmonella enterica enterica serovar Typhi Ty2
cuuaccgcaucgc

SEQ ID NO: 1737329 - RNA, 23 nt, Salmonella enterica enterica serovar Typhi Ty2
cuuacgaauuuuaucuuccggca

SEQ ID NO: 1737330 - RNA, 16 nt, Salmonella enterica enterica serovar Typhi Ty2
cuuacccggcguauug

SEQ ID NO: 1737331 - RNA, 19 nt, Salmonella enterica enterica serovar Typhi Ty2
cuuagcaacugccggcuua

SEQ ID NO: 1737332 - RNA, 17 nt, Salmonella enterica enterica serovar Typhi Ty2
cuuacacacccggccua

SEQ ID NO: 1737333 - RNA, 23 nt, Salmonella enterica enterica serovar Typhi Ty2
cuuacagcuucgguccggcgcua

SEQ ID NO: 1737334 - RNA, 22 nt, Salmonella enterica enterica serovar Typhi Ty2
cuuacacugauaccccagcgau

SEQ ID NO: 1737335 - RNA, 18 nt, Salmonella enterica enterica serovar Typhi Ty2
cuguugaggaaauucuga

SEQ ID NO: 1737336 - RNA, 20 nt, Salmonella enterica enterica serovar Typhi Ty2
cuguugguuuaucgccgauu

SEQ ID NO: 1737337 - RNA, 23 nt, Salmonella enterica enterica serovar Typhi Ty2
cuuaucaggccuguaaaccgccu

SEQ ID NO: 1737338 - RNA, 12 nt, Salmonella enterica enterica serovar Typhi Ty2
cuuaucgccgua

SEQ ID NO: 1737339 - RNA, 20 nt, Salmonella enterica enterica serovar Typhi Ty2
cuuaucccagccgcgaugau

SEQ ID NO: 1737340 - RNA, 14 nt, Salmonella enterica enterica serovar Typhi Ty2
cuuauaucauggga

SEQ ID NO: 1737341 - RNA, 23 nt, Salmonella enterica enterica serovar Typhi Ty2
cuucacccgcgggcggcguuuca

SEQ ID NO: 1737342 - RNA, 23 nt, Salmonella enterica enterica serovar Typhi Ty2
cuucacauacccgcuuaccgcgg

SEQ ID NO: 1737343 - RNA, 15 nt, Salmonella enterica enterica serovar Typhi Ty2
cuucaccucagccaa

SEQ ID NO: 1737344 - RNA, 22 nt, Salmonella enterica enterica serovar Typhi Ty2
cuucacgcgcggcuacugccag

SEQ ID NO: 1737345 - RNA, 17 nt, Salmonella enterica enterica serovar Typhi Ty2
cugucccugccagcgua

SEQ ID NO: 1737346 - RNA, 18 nt, Salmonella enterica enterica serovar Typhi Ty2
cugucgaaaccagcauaa

SEQ ID NO: 1737347 - RNA, 19 nt, Salmonella enterica enterica serovar Typhi Ty2
cugucgaacaugcggauau

SEQ ID NO: 1737348 - RNA, 12 nt, Salmonella enterica enterica serovar Typhi Ty2
cugucgaccauc

SEQ ID NO: 1737349 - RNA, 13 nt, Salmonella enterica enterica serovar Typhi Ty2
cuguccggguauc

SEQ ID NO: 1737350 - RNA, 19 nt, Salmonella enterica enterica serovar Typhi Ty2
cuguaccagacgcgaacgu

SEQ ID NO: 1737351 - RNA, 20 nt, Salmonella enterica enterica serovar Typhi Ty2
cuguaacuucggccagcgag

SEQ ID NO: 1737352 - RNA, 14 nt, Salmonella enterica enterica serovar Typhi Ty2
cuguaauacgcugu

SEQ ID NO: 1737353 - RNA, 14 nt, Salmonella enterica enterica serovar Typhi Ty2
cuguaacaguaucc

SEQ ID NO: 1737354 - RNA, 15 nt, Salmonella enterica enterica serovar Typhi Ty2
cuguaacaguauccg

SEQ ID NO: 1737355 - RNA, 14 nt, Salmonella enterica enterica serovar Typhi Ty2
cuguucgccuucgu

SEQ ID NO: 1737356 - RNA, 18 nt, Salmonella enterica enterica serovar Typhi Ty2
cuguucuuuuucggcugg

SEQ ID NO: 1737357 - RNA, 19 nt, Salmonella enterica enterica serovar Typhi Ty2
cuguuccagugggcggaua

SEQ ID NO: 1737358 - RNA, 22 nt, Salmonella enterica enterica serovar Typhi Ty2
cugucgauaacagcauaaacgu

SEQ ID NO: 1737359 - RNA, 17 nt, Salmonella enterica enterica serovar Typhi Ty2
cugucguccucaggccg

SEQ ID NO: 1737360 - RNA, 16 nt, Salmonella enterica enterica serovar Typhi Ty2
cuggguagaguaaccc

SEQ ID NO: 1737361 - RNA, 22 nt, Salmonella enterica enterica serovar Typhi Ty2
cuggguuuccggaucgccgaag

SEQ ID NO: 1737362 - RNA, 19 nt, Salmonella enterica enterica serovar Typhi Ty2
cuggccguuuucccggcaa

SEQ ID NO: 1737363 - RNA, 20 nt, Salmonella enterica enterica serovar Typhi Ty2
cuggccguuuucccggcaau

SEQ ID NO: 1737364 - RNA, 14 nt, Salmonella enterica enterica serovar Typhi Ty2
cuggugaaacaggu

SEQ ID NO: 1737365 - RNA, 20 nt, Salmonella enterica enterica serovar Typhi Ty2
cuggugacuuuccgggguga

SEQ ID NO: 1737366 - RNA, 16 nt, Salmonella enterica enterica serovar Typhi Ty2
cuggucgucugaaagc

SEQ ID NO: 1737367 - RNA, 16 nt, Salmonella enterica enterica serovar Typhi Ty2
cuggucgcucugcgca

SEQ ID NO: 1737368 - RNA, 14 nt, Salmonella enterica enterica serovar Typhi Ty2
cugguuaaggauga

SEQ ID NO: 1737369 - RNA, 14 nt, Salmonella enterica enterica serovar Typhi Ty2
cgucgccgacaacg

SEQ ID NO: 1737370 - RNA, 14 nt, Salmonella enterica enterica serovar Typhi Ty2
cgucgacgccgaua

SEQ ID NO: 1737371 - RNA, 23 nt, Salmonella enterica enterica serovar Typhi Ty2
cgucgcgacguccgccaacagcc

SEQ ID NO: 1737372 - RNA, 13 nt, Salmonella enterica enterica serovar Typhi Ty2
cgucgcgaucaca

SEQ ID NO: 1737373 - RNA, 17 nt, Salmonella enterica enterica serovar Typhi Ty2
cgucgggggcgacaaac

SEQ ID NO: 1737374 - RNA, 16 nt, Salmonella enterica enterica serovar Typhi Ty2
cgucggggauggcgga

SEQ ID NO: 1737375 - RNA, 18 nt, Salmonella enterica enterica serovar Typhi Ty2
cgucguaaauuccugcau

SEQ ID NO: 1737376 - RNA, 21 nt, Salmonella enterica enterica serovar Typhi Ty2
cgucucaagcuuuuugcgcca

SEQ ID NO: 1737377 - RNA, 13 nt, Salmonella enterica enterica serovar Typhi Ty2
cguccccagccag

SEQ ID NO: 1737378 - RNA, 11 nt, Salmonella enterica enterica serovar Typhi Ty2
cguccagaugc

SEQ ID NO: 1737379 - RNA, 21 nt, Salmonella enterica enterica serovar Typhi Ty2
cgucaucaggcguuguaauaa

SEQ ID NO: 1737380 - RNA, 13 nt, Salmonella enterica enterica serovar Typhi Ty2
cgucauaaucgcg

SEQ ID NO: 1737381 - RNA, 21 nt, Salmonella enterica enterica serovar Typhi Ty2
cguccguucacuaacgcggca

SEQ ID NO: 1737382 - RNA, 12 nt, Salmonella enterica enterica serovar Typhi Ty2
cguccugcggcu

SEQ ID NO: 1737383 - RNA, 17 nt, Salmonella enterica enterica serovar Typhi Ty2
cgucagauaaagcuucu

SEQ ID NO: 1737384 - RNA, 15 nt, Salmonella enterica enterica serovar Typhi Ty2
cgucagaaauccgcg

SEQ ID NO: 1737385 - RNA, 22 nt, Salmonella enterica enterica serovar Typhi Ty2
cgucagacggcuccagcgccag

SEQ ID NO: 1737386 - RNA, 13 nt, Salmonella enterica enterica serovar Typhi Ty2
cgucacaaucgcg

SEQ ID NO: 1737387 - RNA, 12 nt, Salmonella enterica enterica serovar Typhi Ty2
cgucacagaccc

SEQ ID NO: 1737388 - RNA, 17 nt, Salmonella enterica enterica serovar Typhi Ty2
cgucagcgcuugccgca

SEQ ID NO: 1737389 - RNA, 14 nt, Salmonella enterica enterica serovar Typhi Ty2
cgucagcgcauacc

SEQ ID NO: 1737390 - RNA, 17 nt, Salmonella enterica enterica serovar Typhi Ty2
cgucaggacggcgaaua

SEQ ID NO: 1737391 - RNA, 17 nt, Salmonella enterica enterica serovar Typhi Ty2
cgucaggaggccugaau

SEQ ID NO: 1737392 - RNA, 19 nt, Salmonella enterica enterica serovar Typhi Ty2
cgucaggccgccgcacagg

SEQ ID NO: 1737393 - RNA, 20 nt, Salmonella enterica enterica serovar Typhi Ty2
cgucagguuuaaucggcgug

SEQ ID NO: 1737394 - RNA, 19 nt, Salmonella enterica enterica serovar Typhi Ty2
cguauaaggcgaagcccau

SEQ ID NO: 1737395 - RNA, 16 nt, Salmonella enterica enterica serovar Typhi Ty2
cguauagcccagaauc

SEQ ID NO: 1737396 - RNA, 20 nt, Salmonella enterica enterica serovar Typhi Ty2
cguauugccggauaagacgc

SEQ ID NO: 1737397 - RNA, 14 nt, Salmonella enterica enterica serovar Typhi Ty2
cguauggcgucgug

SEQ ID NO: 1737398 - RNA, 14 nt, Salmonella enterica enterica serovar Typhi Ty2
cguauuaugccgac

SEQ ID NO: 1737399 - RNA, 21 nt, Salmonella enterica enterica serovar Typhi Ty2
cguauugccggauaagacgca

SEQ ID NO: 1737400 - RNA, 12 nt, Salmonella enterica enterica serovar Typhi Ty2
cgucaagacgcu

SEQ ID NO: 1737401 - RNA, 22 nt, Salmonella enterica enterica serovar Typhi Ty2
cgucaacgcacuguaacgcacu

SEQ ID NO: 1737402 - RNA, 23 nt, Salmonella enterica enterica serovar Typhi Ty2
cguaaaucgcgagccuucaacaa

SEQ ID NO: 1737403 - RNA, 13 nt, Salmonella enterica enterica serovar Typhi Ty2
cguaaaucaggcc

SEQ ID NO: 1737404 - RNA, 21 nt, Salmonella enterica enterica serovar Typhi Ty2
cguaagcggcggaccagcgug

SEQ ID NO: 1737405 - RNA, 19 nt, Salmonella enterica enterica serovar Typhi Ty2
cguaauacguaaaccgcuc

SEQ ID NO: 1737406 - RNA, 16 nt, Salmonella enterica enterica serovar Typhi Ty2
cguaauaaggcggaua

SEQ ID NO: 1737407 - RNA, 16 nt, Salmonella enterica enterica serovar Typhi Ty2
cguaagucguaccggc

SEQ ID NO: 1737408 - RNA, 20 nt, Salmonella enterica enterica serovar Typhi Ty2
cguaaugagcgucgccagac

SEQ ID NO: 1737409 - RNA, 19 nt, Salmonella enterica enterica serovar Typhi Ty2
cguaaugccgaccagcguc

SEQ ID NO: 1737410 - RNA, 23 nt, Salmonella enterica enterica serovar Typhi Ty2
cguaggguacagagguaagaugu

SEQ ID NO: 1737411 - RNA, 22 nt, Salmonella enterica enterica serovar Typhi Ty2
cgguuaacugcccguuacgcau

SEQ ID NO: 1737412 - RNA, 19 nt, Salmonella enterica enterica serovar Typhi Ty2
cgguucauaauccggaaaa

SEQ ID NO: 1737413 - RNA, 14 nt, Salmonella enterica enterica serovar Typhi Ty2
cgguucucccggca

SEQ ID NO: 1737414 - RNA, 15 nt, Salmonella enterica enterica serovar Typhi Ty2
cgguuuaagcggaua

SEQ ID NO: 1737415 - RNA, 18 nt, Salmonella enterica enterica serovar Typhi Ty2
cgguuguuuacacggcaa

SEQ ID NO: 1737416 - RNA, 23 nt, Salmonella enterica enterica serovar Typhi Ty2
cguaaaacuggcuaucgccguaa

SEQ ID NO: 1737417 - RNA, 18 nt, Salmonella enterica enterica serovar Typhi Ty2
cguaaagcgcauccagcu

SEQ ID NO: 1737418 - RNA, 18 nt, Salmonella enterica enterica serovar Typhi Ty2
cguaaagaggguaacggc

SEQ ID NO: 1737419 - RNA, 22 nt, Salmonella enterica enterica serovar Typhi Ty2
cguaaauagagaaaucaacgaa

SEQ ID NO: 1737420 - RNA, 13 nt, Salmonella enterica enterica serovar Typhi Ty2
cguaaaaucagca

SEQ ID NO: 1737421 - RNA, 15 nt, Salmonella enterica enterica serovar Typhi Ty2
cguaaaaucagcauc

SEQ ID NO: 1737422 - RNA, 20 nt, Salmonella enterica enterica serovar Typhi Ty2
cguaaacgccauuccuuuaa

SEQ ID NO: 1737423 - RNA, 15 nt, Salmonella enterica enterica serovar Typhi Ty2
cgguuggccagcaug

SEQ ID NO: 1737424 - RNA, 18 nt, Salmonella enterica enterica serovar Typhi Ty2
cgguguaccccgccugac

SEQ ID NO: 1737425 - RNA, 17 nt, Salmonella enterica enterica serovar Typhi Ty2
cgguguagaccgcaucg

SEQ ID NO: 1737426 - RNA, 18 nt, Salmonella enterica enterica serovar Typhi Ty2
cggugugaccagcgcguu

SEQ ID NO: 1737427 - RNA, 16 nt, Salmonella enterica enterica serovar Typhi Ty2
cggugugaccagcgcg

SEQ ID NO: 1737428 - RNA, 17 nt, Salmonella enterica enterica serovar Typhi Ty2
cgguggcgcugcgcuua

SEQ ID NO: 1737429 - RNA, 20 nt, Salmonella enterica enterica serovar Typhi Ty2
cgguggcgcugucgcuuacc

SEQ ID NO: 1737430 - RNA, 23 nt, Salmonella enterica enterica serovar Typhi Ty2
cgguggggauaucuucgauaaga

SEQ ID NO: 1737431 - RNA, 17 nt, Salmonella enterica enterica serovar Typhi Ty2
cggugcgauucagcgca

SEQ ID NO: 1737432 - RNA, 15 nt, Salmonella enterica enterica serovar Typhi Ty2
cggugcgauucagcg

SEQ ID NO: 1737433 - RNA, 15 nt, Salmonella enterica enterica serovar Typhi Ty2
cggugccugccgccu

SEQ ID NO: 1737434 - RNA, 17 nt, Salmonella enterica enterica serovar Typhi Ty2
cggugcuguagcugccc

SEQ ID NO: 1737435 - RNA, 19 nt, Salmonella enterica enterica serovar Typhi Ty2
cggugcggucacaggcaua

SEQ ID NO: 1737436 - RNA, 22 nt, Salmonella enterica enterica serovar Typhi Ty2
cggugacgcgaucgucgguaau

SEQ ID NO: 1737437 - RNA, 23 nt, Salmonella enterica enterica serovar Typhi Ty2
cggucugauaagcgcagcgccau

SEQ ID NO: 1737438 - RNA, 21 nt, Salmonella enterica enterica serovar Typhi Ty2
cggucgccguuaacuggcgca

SEQ ID NO: 1737439 - RNA, 21 nt, Salmonella enterica enterica serovar Typhi Ty2
cggucgccuuuuaacgcggua

SEQ ID NO: 1737440 - RNA, 15 nt, Salmonella enterica enterica serovar Typhi Ty2
cggucggccuuaacg

SEQ ID NO: 1737441 - RNA, 15 nt, Salmonella enterica enterica serovar Typhi Ty2
cguuuggcgauguuu

SEQ ID NO: 1737442 - RNA, 14 nt, Salmonella enterica enterica serovar Typhi Ty2
cguuugcgccgcca

SEQ ID NO: 1737443 - RNA, 16 nt, Salmonella enterica enterica serovar Typhi Ty2
cguuugcauucgcccg

SEQ ID NO: 1737444 - RNA, 19 nt, Salmonella enterica enterica serovar Typhi Ty2
cguuuguguuauacguucu

SEQ ID NO: 1737445 - RNA, 13 nt, Salmonella enterica enterica serovar Typhi Ty2
cguuuuauaagcc

SEQ ID NO: 1737446 - RNA, 17 nt, Salmonella enterica enterica serovar Typhi Ty2
cguuuuaucaugcgcca

SEQ ID NO: 1737447 - RNA, 15 nt, Salmonella enterica enterica serovar Typhi Ty2
cguuuuccaucacca

SEQ ID NO: 1737448 - RNA, 18 nt, Salmonella enterica enterica serovar Typhi Ty2
cguuuucauuagccgcca

SEQ ID NO: 1737449 - RNA, 16 nt, Salmonella enterica enterica serovar Typhi Ty2
cguuuugcagcgccau

SEQ ID NO: 1737450 - RNA, 14 nt, Salmonella enterica enterica serovar Typhi Ty2
cguuuugcgcguaa

SEQ ID NO: 1737451 - RNA, 20 nt, Salmonella enterica enterica serovar Typhi Ty2
cguuuuguaggccggauaag

SEQ ID NO: 1737452 - RNA, 22 nt, Salmonella enterica enterica serovar Typhi Ty2
cguuuugugucaaaaaguuguc

SEQ ID NO: 1737453 - RNA, 18 nt, Salmonella enterica enterica serovar Typhi Ty2
cguuuuuaucgcucgucg

SEQ ID NO: 1737454 - RNA, 19 nt, Salmonella enterica enterica serovar Typhi Ty2
cguuuuuuccugcugguag

SEQ ID NO: 1737455 - RNA, 19 nt, Salmonella enterica enterica serovar Typhi Ty2
cuaacgcuuauccggccua

SEQ ID NO: 1737456 - RNA, 20 nt, Salmonella enterica enterica serovar Typhi Ty2
cuaacgccugauccggccua

SEQ ID NO: 1737457 - RNA, 16 nt, Salmonella enterica enterica serovar Typhi Ty2
cuaacgucagcgccac

SEQ ID NO: 1737458 - RNA, 14 nt, Salmonella enterica enterica serovar Typhi Ty2
cuaaccaaacagac

SEQ ID NO: 1737459 - RNA, 13 nt, Salmonella enterica enterica serovar Typhi Ty2
cuaaccagcgcaa

SEQ ID NO: 1737460 - RNA, 16 nt, Salmonella enterica enterica serovar Typhi Ty2
cuaaagagcgccugac

SEQ ID NO: 1737461 - RNA, 18 nt, Salmonella enterica enterica serovar Typhi Ty2
cuaaaccggcggaauagc

SEQ ID NO: 1737462 - RNA, 11 nt, Salmonella enterica enterica serovar Typhi Ty2
cuaaaccggcg

SEQ ID NO: 1737463 - RNA, 23 nt, Salmonella enterica enterica serovar Typhi Ty2
cuaaacaauuugcccagcgcugg

SEQ ID NO: 1737464 - RNA, 19 nt, Salmonella enterica enterica serovar Typhi Ty2
cuaaacauauaccgcaccu

SEQ ID NO: 1737465 - RNA, 21 nt, Salmonella enterica enterica serovar Typhi Ty2
cuaaacaauuugcccagcgcu

SEQ ID NO: 1737466 - RNA, 14 nt, Salmonella enterica enterica serovar Typhi Ty2
cguugguaccgcuu

SEQ ID NO: 1737467 - RNA, 19 nt, Salmonella enterica enterica serovar Typhi Ty2
cguuguccaacugucgcca

SEQ ID NO: 1737468 - RNA, 12 nt, Salmonella enterica enterica serovar Typhi Ty2
cguuuaaacggg

SEQ ID NO: 1737469 - RNA, 14 nt, Salmonella enterica enterica serovar Typhi Ty2
cguuuaaagcgcuc

SEQ ID NO: 1737470 - RNA, 17 nt, Salmonella enterica enterica serovar Typhi Ty2
cguuuaccuucgauaac

SEQ ID NO: 1737471 - RNA, 20 nt, Salmonella enterica enterica serovar Typhi Ty2
cguuuauauaaaaauagcug

SEQ ID NO: 1737472 - RNA, 14 nt, Salmonella enterica enterica serovar Typhi Ty2
cguuuaugccgcca

SEQ ID NO: 1737473 - RNA, 18 nt, Salmonella enterica enterica serovar Typhi Ty2
cguuucaggacggcauaa

SEQ ID NO: 1737474 - RNA, 18 nt, Salmonella enterica enterica serovar Typhi Ty2
cguuuccagcaucgacca

SEQ ID NO: 1737475 - RNA, 18 nt, Salmonella enterica enterica serovar Typhi Ty2
cguuucgauuguaggccg

SEQ ID NO: 1737476 - RNA, 15 nt, Salmonella enterica enterica serovar Typhi Ty2
cuagcuuaucgggcc

SEQ ID NO: 1737477 - RNA, 20 nt, Salmonella enterica enterica serovar Typhi Ty2
cuagcgccuuauccggccua

SEQ ID NO: 1737478 - RNA, 20 nt, Salmonella enterica enterica serovar Typhi Ty2
cuacuuuaaauucggcguua

SEQ ID NO: 1737479 - RNA, 12 nt, Salmonella enterica enterica serovar Typhi Ty2
cuacugccgcca

SEQ ID NO: 1737480 - RNA, 17 nt, Salmonella enterica enterica serovar Typhi Ty2
cuacugccagcgucgcu

SEQ ID NO: 1737481 - RNA, 19 nt, Salmonella enterica enterica serovar Typhi Ty2
cuaccgccaccaucgcauu

SEQ ID NO: 1737482 - RNA, 16 nt, Salmonella enterica enterica serovar Typhi Ty2
cuaccgucgccgacaa

SEQ ID NO: 1737483 - RNA, 14 nt, Salmonella enterica enterica serovar Typhi Ty2
cuaccgccguauca

SEQ ID NO: 1737484 - RNA, 18 nt, Salmonella enterica enterica serovar Typhi Ty2
cuacgcuuaucaggccua

SEQ ID NO: 1737485 - RNA, 14 nt, Salmonella enterica enterica serovar Typhi Ty2
cuacgcuauccggc

SEQ ID NO: 1737486 - RNA, 23 nt, Salmonella enterica enterica serovar Typhi Ty2
cuacgcuuaucaggccuacaacg

SEQ ID NO: 1737487 - RNA, 16 nt, Salmonella enterica enterica serovar Typhi Ty2
cuacgccaucaggcau

SEQ ID NO: 1737488 - RNA, 19 nt, Salmonella enterica enterica serovar Typhi Ty2
cuaaugcuuauccggccua

SEQ ID NO: 1737489 - RNA, 19 nt, Salmonella enterica enterica serovar Typhi Ty2
cuaauauccaccagcccau

SEQ ID NO: 1737490 - RNA, 15 nt, Salmonella enterica enterica serovar Typhi Ty2
cuaauccccagcgcu

SEQ ID NO: 1737491 - RNA, 14 nt, Salmonella enterica enterica serovar Typhi Ty2
cuaagaccagcauc

SEQ ID NO: 1737492 - RNA, 17 nt, Salmonella enterica enterica serovar Typhi Ty2
cuaagcagaacggcgau

SEQ ID NO: 1737493 - RNA, 23 nt, Salmonella enterica enterica serovar Typhi Ty2
cuaagcacgggcuugaauaacau

SEQ ID NO: 1737494 - RNA, 16 nt, Salmonella enterica enterica serovar Typhi Ty2
cuaccaucggcgcuac

SEQ ID NO: 1737495 - RNA, 15 nt, Salmonella enterica enterica serovar Typhi Ty2
cuaccauuuccggcg

SEQ ID NO: 1737496 - RNA, 13 nt, Salmonella enterica enterica serovar Typhi Ty2
cuaccacccagcc

SEQ ID NO: 1737497 - RNA, 21 nt, Salmonella enterica enterica serovar Typhi Ty2
cuacagacaucuuugccaaac

SEQ ID NO: 1737498 - RNA, 21 nt, Salmonella enterica enterica serovar Typhi Ty2
cuaauuugagucgcagcacau

SEQ ID NO: 1737499 - RNA, 13 nt, Salmonella enterica enterica serovar Typhi Ty2
cuacaacucagcg

SEQ ID NO: 1737500 - RNA, 20 nt, Salmonella enterica enterica serovar Typhi Ty2
cgugucaggaugcugauuaa

SEQ ID NO: 1737501 - RNA, 12 nt, Salmonella enterica enterica serovar Typhi Ty2
cgugucaucaaa

SEQ ID NO: 1737502 - RNA, 23 nt, Salmonella enterica enterica serovar Typhi Ty2
cgugucaucaaaaucaucgccac

SEQ ID NO: 1737503 - RNA, 21 nt, Salmonella enterica enterica serovar Typhi Ty2
cgugguaucgcgacagcgcug

SEQ ID NO: 1737504 - RNA, 15 nt, Salmonella enterica enterica serovar Typhi Ty2
cgugcgcugcggcca

SEQ ID NO: 1737505 - RNA, 17 nt, Salmonella enterica enterica serovar Typhi Ty2
cgugcggacguagcggc

SEQ ID NO: 1737506 - RNA, 16 nt, Salmonella enterica enterica serovar Typhi Ty2
cgucucgcuuaauccg

SEQ ID NO: 1737507 - RNA, 13 nt, Salmonella enterica enterica serovar Typhi Ty2
cguggcaaucagc

SEQ ID NO: 1737508 - RNA, 16 nt, Salmonella enterica enterica serovar Typhi Ty2
cguggcaaucagcaau

SEQ ID NO: 1737509 - RNA, 18 nt, Salmonella enterica enterica serovar Typhi Ty2
cguuagcgucauccggca

SEQ ID NO: 1737510 - RNA, 16 nt, Salmonella enterica enterica serovar Typhi Ty2
cguuagcggcguugcc

SEQ ID NO: 1737511 - RNA, 12 nt, Salmonella enterica enterica serovar Typhi Ty2
cguuagcgcaaa

SEQ ID NO: 1737512 - RNA, 17 nt, Salmonella enterica enterica serovar Typhi Ty2
cgugugcggaugcgcca

SEQ ID NO: 1737513 - RNA, 17 nt, Salmonella enterica enterica serovar Typhi Ty2
cgugucgguacgcuggu

SEQ ID NO: 1737514 - RNA, 14 nt, Salmonella enterica enterica serovar Typhi Ty2
cguuccuuaucagc

SEQ ID NO: 1737515 - RNA, 14 nt, Salmonella enterica enterica serovar Typhi Ty2
cguuccugccguca

SEQ ID NO: 1737516 - RNA, 18 nt, Salmonella enterica enterica serovar Typhi Ty2
cguuccgguucaggcuua

SEQ ID NO: 1737517 - RNA, 21 nt, Salmonella enterica enterica serovar Typhi Ty2
cguuccacacguccauccggg

SEQ ID NO: 1737518 - RNA, 14 nt, Salmonella enterica enterica serovar Typhi Ty2
cguucauucgcccc

SEQ ID NO: 1737519 - RNA, 15 nt, Salmonella enterica enterica serovar Typhi Ty2
cguucaucggcauac

SEQ ID NO: 1737520 - RNA, 18 nt, Salmonella enterica enterica serovar Typhi Ty2
cguuacuggcgaccggca

SEQ ID NO: 1737521 - RNA, 20 nt, Salmonella enterica enterica serovar Typhi Ty2
cguucggacuggggauggcc

SEQ ID NO: 1737522 - RNA, 20 nt, Salmonella enterica enterica serovar Typhi Ty2
cguucgcgucacaaucgcgc

SEQ ID NO: 1737523 - RNA, 17 nt, Salmonella enterica enterica serovar Typhi Ty2
cguucgcgguaaucgcg

SEQ ID NO: 1737524 - RNA, 22 nt, Salmonella enterica enterica serovar Typhi Ty2
cguucgcggggguuauucagcg

SEQ ID NO: 1737525 - RNA, 17 nt, Salmonella enterica enterica serovar Typhi Ty2
cguugcccaucgcaacg

SEQ ID NO: 1737526 - RNA, 23 nt, Salmonella enterica enterica serovar Typhi Ty2
cguugccauacgcccacgcggcg

SEQ ID NO: 1737527 - RNA, 14 nt, Salmonella enterica enterica serovar Typhi Ty2
cguugcggcguauc

SEQ ID NO: 1737528 - RNA, 17 nt, Salmonella enterica enterica serovar Typhi Ty2
cguuggauaacagcgcg

SEQ ID NO: 1737529 - RNA, 19 nt, Salmonella enterica enterica serovar Typhi Ty2
cguugaguuugacugccag

SEQ ID NO: 1737530 - RNA, 13 nt, Salmonella enterica enterica serovar Typhi Ty2
cguugaucgccau

SEQ ID NO: 1737531 - RNA, 20 nt, Salmonella enterica enterica serovar Typhi Ty2
cguugccaacggcgaucagc

SEQ ID NO: 1737532 - RNA, 23 nt, Salmonella enterica enterica serovar Typhi Ty2
cuccagcgauagucguugcgccg

SEQ ID NO: 1737533 - RNA, 19 nt, Salmonella enterica enterica serovar Typhi Ty2
cuccccugccggcggcaga

SEQ ID NO: 1737534 - RNA, 14 nt, Salmonella enterica enterica serovar Typhi Ty2
cuccagccauaaug

SEQ ID NO: 1737535 - RNA, 16 nt, Salmonella enterica enterica serovar Typhi Ty2
cuccgccaucgcgcaa

SEQ ID NO: 1737536 - RNA, 17 nt, Salmonella enterica enterica serovar Typhi Ty2
cuccgcaaagcccauca

SEQ ID NO: 1737537 - RNA, 20 nt, Salmonella enterica enterica serovar Typhi Ty2
cucccuuauacaggcgcagg

SEQ ID NO: 1737538 - RNA, 19 nt, Salmonella enterica enterica serovar Typhi Ty2
cucagguuauauuccgccu

SEQ ID NO: 1737539 - RNA, 14 nt, Salmonella enterica enterica serovar Typhi Ty2
cucaucaaacaggg

SEQ ID NO: 1737540 - RNA, 18 nt, Salmonella enterica enterica serovar Typhi Ty2
cucauccccagcaucaug

SEQ ID NO: 1737541 - RNA, 19 nt, Salmonella enterica enterica serovar Typhi Ty2
cucauacagcccgcgcaga

SEQ ID NO: 1737542 - RNA, 15 nt, Salmonella enterica enterica serovar Typhi Ty2
cucauacgcuuucug

SEQ ID NO: 1737543 - RNA, 13 nt, Salmonella enterica enterica serovar Typhi Ty2
cucaucgccgcaa

SEQ ID NO: 1737544 - RNA, 16 nt, Salmonella enterica enterica serovar Typhi Ty2
cucaucgccgcaauga

SEQ ID NO: 1737545 - RNA, 19 nt, Salmonella enterica enterica serovar Typhi Ty2
cucaugauagggcagcagu

SEQ ID NO: 1737546 - RNA, 23 nt, Salmonella enterica enterica serovar Typhi Ty2
cucauguuauaagcgcgcaggua

SEQ ID NO: 1737547 - RNA, 15 nt, Salmonella enterica enterica serovar Typhi Ty2
cucgaccuggcgcuc

SEQ ID NO: 1737548 - RNA, 19 nt, Salmonella enterica enterica serovar Typhi Ty2
cucgacaugucaugacuua

SEQ ID NO: 1737549 - RNA, 20 nt, Salmonella enterica enterica serovar Typhi Ty2
cuccgcguaccucagcaugu

SEQ ID NO: 1737550 - RNA, 15 nt, Salmonella enterica enterica serovar Typhi Ty2
cuccgcccauccagg

SEQ ID NO: 1737551 - RNA, 20 nt, Salmonella enterica enterica serovar Typhi Ty2
cuccggcuaugccggaggau

SEQ ID NO: 1737552 - RNA, 21 nt, Salmonella enterica enterica serovar Typhi Ty2
cuccggucccagaugcgccag

SEQ ID NO: 1737553 - RNA, 15 nt, Salmonella enterica enterica serovar Typhi Ty2
cucgcugauggcgag

SEQ ID NO: 1737554 - RNA, 17 nt, Salmonella enterica enterica serovar Typhi Ty2
cucgauuccugacgcac

SEQ ID NO: 1737555 - RNA, 23 nt, Salmonella enterica enterica serovar Typhi Ty2
cucgauuugcccuuccagcagcc

SEQ ID NO: 1737556 - RNA, 23 nt, Salmonella enterica enterica serovar Typhi Ty2
cucgccauaauuguucagcuacu

SEQ ID NO: 1737557 - RNA, 20 nt, Salmonella enterica enterica serovar Typhi Ty2
cucguaggccggauaagacg

SEQ ID NO: 1737558 - RNA, 20 nt, Salmonella enterica enterica serovar Typhi Ty2
cucucgugcaggccggauaa

SEQ ID NO: 1737559 - RNA, 20 nt, Salmonella enterica enterica serovar Typhi Ty2
cucuaaaugggcaggagaug

SEQ ID NO: 1737560 - RNA, 16 nt, Salmonella enterica enterica serovar Typhi Ty2
cucucccuggcaggua

SEQ ID NO: 1737561 - RNA, 14 nt, Salmonella enterica enterica serovar Typhi Ty2
cucugaaacgcuuc

SEQ ID NO: 1737562 - RNA, 16 nt, Salmonella enterica enterica serovar Typhi Ty2
cucuucuuccggcgau

SEQ ID NO: 1737563 - RNA, 21 nt, Salmonella enterica enterica serovar Typhi Ty2
cucgugcaggccggauaagcc

SEQ ID NO: 1737564 - RNA, 22 nt, Salmonella enterica enterica serovar Typhi Ty2
cucgugcaggccggauaagccg

SEQ ID NO: 1737565 - RNA, 16 nt, Salmonella enterica enterica serovar Typhi Ty2
uuuuucgccgcgcgga

SEQ ID NO: 1737566 - RNA, 17 nt, Salmonella enterica enterica serovar Typhi Ty2
uuuuuagcgugccgacg

SEQ ID NO: 1737567 - RNA, 18 nt, Salmonella enterica enterica serovar Typhi Ty2
uuuuuaugcacgcuauaa

SEQ ID NO: 1737568 - RNA, 19 nt, Salmonella enterica enterica serovar Typhi Ty2
uuuugucaucgucagcaac

SEQ ID NO: 1737569 - RNA, 14 nt, Salmonella enterica enterica serovar Typhi Ty2
uuuuuacgccauaa

SEQ ID NO: 1737570 - RNA, 15 nt, Salmonella enterica enterica serovar Typhi Ty2
uuuguugccuucgau

SEQ ID NO: 1737571 - RNA, 20 nt, Salmonella enterica enterica serovar Typhi Ty2
uuuguuggaaaugcguggca

SEQ ID NO: 1737572 - RNA, 13 nt, Salmonella enterica enterica serovar Typhi Ty2
uuugugugcagga

SEQ ID NO: 1737573 - RNA, 22 nt, Salmonella enterica enterica serovar Typhi Ty2
uuuuccacgcgcgcgccgauaa

SEQ ID NO: 1737574 - RNA, 12 nt, Salmonella enterica enterica serovar Typhi Ty2
uuuuaauaacgg

SEQ ID NO: 1737575 - RNA, 19 nt, Salmonella enterica enterica serovar Typhi Ty2
uuuccaguugcggcaucag

SEQ ID NO: 1737576 - RNA, 19 nt, Salmonella enterica enterica serovar Typhi Ty2
uuucccagaauccgcgcau

SEQ ID NO: 1737577 - RNA, 13 nt, Salmonella enterica enterica serovar Typhi Ty2
uuuccagugccag

SEQ ID NO: 1737578 - RNA, 16 nt, Salmonella enterica enterica serovar Typhi Ty2
uuuccagcaucgacca

SEQ ID NO: 1737579 - RNA, 17 nt, Salmonella enterica enterica serovar Typhi Ty2
uuucacucuuugccgau

SEQ ID NO: 1737580 - RNA, 14 nt, Salmonella enterica enterica serovar Typhi Ty2
uuucccggcgugaa

SEQ ID NO: 1737581 - RNA, 12 nt, Salmonella enterica enterica serovar Typhi Ty2
uuuccagucaac

SEQ ID NO: 1737582 - RNA, 18 nt, Salmonella enterica enterica serovar Typhi Ty2
uuugaacgagucuuacca

SEQ ID NO: 1737583 - RNA, 15 nt, Salmonella enterica enterica serovar Typhi Ty2
uuucugcgcgauguu

SEQ ID NO: 1737584 - RNA, 18 nt, Salmonella enterica enterica serovar Typhi Ty2
uuucuugcucagcgaccg

SEQ ID NO: 1737585 - RNA, 22 nt, Salmonella enterica enterica serovar Typhi Ty2
uuugacugaaauuacgccauaa

SEQ ID NO: 1737586 - RNA, 11 nt, Salmonella enterica enterica serovar Typhi Ty2
uuugcugcugc

SEQ ID NO: 1737587 - RNA, 21 nt, Salmonella enterica enterica serovar Typhi Ty2
uuugcuucaauaaguuagcuu

SEQ ID NO: 1737588 - RNA, 18 nt, Salmonella enterica enterica serovar Typhi Ty2
uuugcgcgaggucgagcu

SEQ ID NO: 1737589 - RNA, 15 nt, Salmonella enterica enterica serovar Typhi Ty2
uucuuuccugcaaau

SEQ ID NO: 1737590 - RNA, 14 nt, Salmonella enterica enterica serovar Typhi Ty2
uucuuuaugcgccu

SEQ ID NO: 1737591 - RNA, 13 nt, Salmonella enterica enterica serovar Typhi Ty2
uuggcgcugccgg

SEQ ID NO: 1737592 - RNA, 22 nt, Salmonella enterica enterica serovar Typhi Ty2
uuggcgccaaaaccgcucacgg

SEQ ID NO: 1737593 - RNA, 16 nt, Salmonella enterica enterica serovar Typhi Ty2
uuggcgaugcuaucgg

SEQ ID NO: 1737594 - RNA, 13 nt, Salmonella enterica enterica serovar Typhi Ty2
uuguccugguaca

SEQ ID NO: 1737595 - RNA, 20 nt, Salmonella enterica enterica serovar Typhi Ty2
uuguaggccggauaaggcgu

SEQ ID NO: 1737596 - RNA, 15 nt, Salmonella enterica enterica serovar Typhi Ty2
uugucgcccugcaau

SEQ ID NO: 1737597 - RNA, 23 nt, Salmonella enterica enterica serovar Typhi Ty2
uuguacggcggcauuaaagccgc

SEQ ID NO: 1737598 - RNA, 18 nt, Salmonella enterica enterica serovar Typhi Ty2
uugggauuacuuccgguu

SEQ ID NO: 1737599 - RNA, 21 nt, Salmonella enterica enterica serovar Typhi Ty2
uuggcucgauuccugacgcac

SEQ ID NO: 1737600 - RNA, 23 nt, Salmonella enterica enterica serovar Typhi Ty2
uuuacuucuucaggcuugucgcg

SEQ ID NO: 1737601 - RNA, 12 nt, Salmonella enterica enterica serovar Typhi Ty2
uuuacugauaaa

SEQ ID NO: 1737602 - RNA, 18 nt, Salmonella enterica enterica serovar Typhi Ty2
uuuacugcaagcgauguu

SEQ ID NO: 1737603 - RNA, 23 nt, Salmonella enterica enterica serovar Typhi Ty2
uuuauccacgccgcuaucgacca

SEQ ID NO: 1737604 - RNA, 16 nt, Salmonella enterica enterica serovar Typhi Ty2
uuuauccaguaacgcg

SEQ ID NO: 1737605 - RNA, 21 nt, Salmonella enterica enterica serovar Typhi Ty2
uuuaucaaaaagacuccggca

SEQ ID NO: 1737606 - RNA, 22 nt, Salmonella enterica enterica serovar Typhi Ty2
uuuaugcagccgauaguccgga

SEQ ID NO: 1737607 - RNA, 13 nt, Salmonella enterica enterica serovar Typhi Ty2
uuuaugugccgau

SEQ ID NO: 1737608 - RNA, 13 nt, Salmonella enterica enterica serovar Typhi Ty2
uuucacaucgcca

SEQ ID NO: 1737609 - RNA, 23 nt, Salmonella enterica enterica serovar Typhi Ty2
uuucagaucgccgccgguaacga

SEQ ID NO: 1737610 - RNA, 16 nt, Salmonella enterica enterica serovar Typhi Ty2
uuucagcggcagcucu

SEQ ID NO: 1737611 - RNA, 21 nt, Salmonella enterica enterica serovar Typhi Ty2
uuguucaaucggauaauccgc

SEQ ID NO: 1737612 - RNA, 19 nt, Salmonella enterica enterica serovar Typhi Ty2
uugucguucacguaaucgc

SEQ ID NO: 1737613 - RNA, 23 nt, Salmonella enterica enterica serovar Typhi Ty2
uuuacauaauguaaaggugagcu

SEQ ID NO: 1737614 - RNA, 14 nt, Salmonella enterica enterica serovar Typhi Ty2
uuuaccggugcgga

SEQ ID NO: 1737615 - RNA, 17 nt, Salmonella enterica enterica serovar Typhi Ty2
uuuaaucagauuguugc

SEQ ID NO: 1737616 - RNA, 22 nt, Salmonella enterica enterica serovar Typhi Ty2
uucgaacgcuagcucaacgccc

SEQ ID NO: 1737617 - RNA, 16 nt, Salmonella enterica enterica serovar Typhi Ty2
uucgaaccugcgacca

SEQ ID NO: 1737618 - RNA, 12 nt, Salmonella enterica enterica serovar Typhi Ty2
uucgaaccugcg

SEQ ID NO: 1737619 - RNA, 18 nt, Salmonella enterica enterica serovar Typhi Ty2
uucgacgagguuuccggc

SEQ ID NO: 1737620 - RNA, 16 nt, Salmonella enterica enterica serovar Typhi Ty2
uucgacggagauuaac

SEQ ID NO: 1737621 - RNA, 13 nt, Salmonella enterica enterica serovar Typhi Ty2
uucgcaacgccgc

SEQ ID NO: 1737622 - RNA, 17 nt, Salmonella enterica enterica serovar Typhi Ty2
uucgauggccucaucau

SEQ ID NO: 1737623 - RNA, 17 nt, Salmonella enterica enterica serovar Typhi Ty2
uuccugcugcgccagcg

SEQ ID NO: 1737624 - RNA, 12 nt, Salmonella enterica enterica serovar Typhi Ty2
uuccuuccggcg

SEQ ID NO: 1737625 - RNA, 14 nt, Salmonella enterica enterica serovar Typhi Ty2
uuccuuucugcgcc

SEQ ID NO: 1737626 - RNA, 21 nt, Salmonella enterica enterica serovar Typhi Ty2
uuccugcggcgguaacgccuu

SEQ ID NO: 1737627 - RNA, 19 nt, Salmonella enterica enterica serovar Typhi Ty2
uuccugcgccaguugcugg

SEQ ID NO: 1737628 - RNA, 15 nt, Salmonella enterica enterica serovar Typhi Ty2
uuccugcacgccugc

SEQ ID NO: 1737629 - RNA, 15 nt, Salmonella enterica enterica serovar Typhi Ty2
uuccucgucggcaag

SEQ ID NO: 1737630 - RNA, 14 nt, Salmonella enterica enterica serovar Typhi Ty2
uuccgcagccagaa

SEQ ID NO: 1737631 - RNA, 16 nt, Salmonella enterica enterica serovar Typhi Ty2
uuccgcccaagaacau

SEQ ID NO: 1737632 - RNA, 13 nt, Salmonella enterica enterica serovar Typhi Ty2
uuccccacgccau

SEQ ID NO: 1737633 - RNA, 19 nt, Salmonella enterica enterica serovar Typhi Ty2
uuccccacgccaucgcggc

SEQ ID NO: 1737634 - RNA, 13 nt, Salmonella enterica enterica serovar Typhi Ty2
uucggagaucagc

SEQ ID NO: 1737635 - RNA, 19 nt, Salmonella enterica enterica serovar Typhi Ty2
uucggauuauuggucagua

SEQ ID NO: 1737636 - RNA, 14 nt, Salmonella enterica enterica serovar Typhi Ty2
uucggcacaucaau

SEQ ID NO: 1737637 - RNA, 13 nt, Salmonella enterica enterica serovar Typhi Ty2
uucggacuuccug

SEQ ID NO: 1737638 - RNA, 13 nt, Salmonella enterica enterica serovar Typhi Ty2
uucgcugauaccg

SEQ ID NO: 1737639 - RNA, 14 nt, Salmonella enterica enterica serovar Typhi Ty2
uucgcccggcagga

SEQ ID NO: 1737640 - RNA, 18 nt, Salmonella enterica enterica serovar Typhi Ty2
uucgcccguucugaccag

SEQ ID NO: 1737641 - RNA, 19 nt, Salmonella enterica enterica serovar Typhi Ty2
uucgccagcgcaucgauau

SEQ ID NO: 1737642 - RNA, 18 nt, Salmonella enterica enterica serovar Typhi Ty2
uucgcauauucugcgaaa

SEQ ID NO: 1737643 - RNA, 23 nt, Salmonella enterica enterica serovar Typhi Ty2
uucggcguaucggaaguauacau

SEQ ID NO: 1737644 - RNA, 15 nt, Salmonella enterica enterica serovar Typhi Ty2
uucguuaugaauggc

SEQ ID NO: 1737645 - RNA, 15 nt, Salmonella enterica enterica serovar Typhi Ty2
uucguuaacccggca

SEQ ID NO: 1737646 - RNA, 13 nt, Salmonella enterica enterica serovar Typhi Ty2
uucguggacgagc

SEQ ID NO: 1737647 - RNA, 14 nt, Salmonella enterica enterica serovar Typhi Ty2
uucuacgcgccagc

SEQ ID NO: 1737648 - RNA, 12 nt, Salmonella enterica enterica serovar Typhi Ty2
uucgucggcaaa

SEQ ID NO: 1737649 - RNA, 13 nt, Salmonella enterica enterica serovar Typhi Ty2
uucuuaaccccuu

SEQ ID NO: 1737650 - RNA, 23 nt, Salmonella enterica enterica serovar Typhi Ty2
uucugcgcuaagcguuacggaaa

SEQ ID NO: 1737651 - RNA, 15 nt, Salmonella enterica enterica serovar Typhi Ty2
uucugcugaugcugg

SEQ ID NO: 1737652 - RNA, 13 nt, Salmonella enterica enterica serovar Typhi Ty2
uucugcugauaau

SEQ ID NO: 1737653 - RNA, 21 nt, Salmonella enterica enterica serovar Typhi Ty2
uucuggcgaguuucaccggua

SEQ ID NO: 1737654 - RNA, 16 nt, Salmonella enterica enterica serovar Typhi Ty2
uucuggcaacagccau

SEQ ID NO: 1737655 - RNA, 13 nt, Salmonella enterica enterica serovar Typhi Ty2
uucuugcccggug

SEQ ID NO: 1737656 - RNA, 14 nt, Salmonella enterica enterica serovar Typhi Ty2
uucuugccgccauc

SEQ ID NO: 1737657 - RNA, 14 nt, Salmonella enterica enterica serovar Typhi Ty2
uucuucuguaauac

SEQ ID NO: 1737658 - RNA, 18 nt, Salmonella enterica enterica serovar Typhi Ty2
uucuuccagguuaaccca

SEQ ID NO: 1737659 - RNA, 20 nt, Salmonella enterica enterica serovar Typhi Ty2
uucuucaguuccgccagacu

SEQ ID NO: 1737660 - RNA, 18 nt, Salmonella enterica enterica serovar Typhi Ty2
uucuucaaugaagcggaa

SEQ ID NO: 1737661 - RNA, 14 nt, Salmonella enterica enterica serovar Typhi Ty2
uucuuacuaauaaa

SEQ ID NO: 1737662 - RNA, 15 nt, Salmonella enterica enterica serovar Typhi Ty2
uucucaauacgauau

SEQ ID NO: 1737663 - RNA, 16 nt, Salmonella enterica enterica serovar Typhi Ty2
uucucaggacgccagu

SEQ ID NO: 1737664 - RNA, 19 nt, Salmonella enterica enterica serovar Typhi Ty2
uucucaauacgauauucug

SEQ ID NO: 1737665 - RNA, 19 nt, Salmonella enterica enterica serovar Typhi Ty2
uucuccacgcgaugagcug

SEQ ID NO: 1737666 - RNA, 16 nt, Salmonella enterica enterica serovar Typhi Ty2
uucucguucaacggca

SEQ ID NO: 1737667 - RNA, 18 nt, Salmonella enterica enterica serovar Typhi Ty2
uucucgccgguagccagc

SEQ ID NO: 1737668 - RNA, 19 nt, Salmonella enterica enterica serovar Typhi Ty2
uucugaagcuaaccgcgca

SEQ ID NO: 1737669 - RNA, 17 nt, Salmonella enterica enterica serovar Typhi Ty2
uuaauucuggcaauaag

SEQ ID NO: 1737670 - RNA, 12 nt, Salmonella enterica enterica serovar Typhi Ty2
uuaauucuggca

SEQ ID NO: 1737671 - RNA, 18 nt, Salmonella enterica enterica serovar Typhi Ty2
uuaauuucccgcugguug

SEQ ID NO: 1737672 - RNA, 14 nt, Salmonella enterica enterica serovar Typhi Ty2
uuaauuguaccgau

SEQ ID NO: 1737673 - RNA, 21 nt, Salmonella enterica enterica serovar Typhi Ty2
uuaccggacggucggcguaau

SEQ ID NO: 1737674 - RNA, 23 nt, Salmonella enterica enterica serovar Typhi Ty2
uuaccuucauuguccucggcaac

SEQ ID NO: 1737675 - RNA, 18 nt, Salmonella enterica enterica serovar Typhi Ty2
uuacgcuuccugccguga

SEQ ID NO: 1737676 - RNA, 18 nt, Salmonella enterica enterica serovar Typhi Ty2
uuacgcucgcugauggcg

SEQ ID NO: 1737677 - RNA, 21 nt, Salmonella enterica enterica serovar Typhi Ty2
uuacgccgcaaucacuucaua

SEQ ID NO: 1737678 - RNA, 21 nt, Salmonella enterica enterica serovar Typhi Ty2
uuauaaauccccgccgccauc

SEQ ID NO: 1737679 - RNA, 22 nt, Salmonella enterica enterica serovar Typhi Ty2
uuagccacuuaccaaucgcggc

SEQ ID NO: 1737680 - RNA, 17 nt, Salmonella enterica enterica serovar Typhi Ty2
uuagcccucuggcaaau

SEQ ID NO: 1737681 - RNA, 12 nt, Salmonella enterica enterica serovar Typhi Ty2
uuagugccgcca

SEQ ID NO: 1737682 - RNA, 16 nt, Salmonella enterica enterica serovar Typhi Ty2
uuagugacguuaucug

SEQ ID NO: 1737683 - RNA, 16 nt, Salmonella enterica enterica serovar Typhi Ty2
uuagcguuucaaccgc

SEQ ID NO: 1737684 - RNA, 20 nt, Salmonella enterica enterica serovar Typhi Ty2
uuagcgacauacauaacgcg

SEQ ID NO: 1737685 - RNA, 22 nt, Salmonella enterica enterica serovar Typhi Ty2
uuaauaccaucuccaucgggcu

SEQ ID NO: 1737686 - RNA, 15 nt, Salmonella enterica enterica serovar Typhi Ty2
uuaaggcggcaaaga

SEQ ID NO: 1737687 - RNA, 16 nt, Salmonella enterica enterica serovar Typhi Ty2
uuaaaauugaacggac

SEQ ID NO: 1737688 - RNA, 15 nt, Salmonella enterica enterica serovar Typhi Ty2
uuaaacuuucaugaa

SEQ ID NO: 1737689 - RNA, 13 nt, Salmonella enterica enterica serovar Typhi Ty2
uuaaaaaauccug

SEQ ID NO: 1737690 - RNA, 23 nt, Salmonella enterica enterica serovar Typhi Ty2
uuaaaaaaggcagaagaaucugc

SEQ ID NO: 1737691 - RNA, 23 nt, Salmonella enterica enterica serovar Typhi Ty2
uguuguguuuagcccucuggcaa

SEQ ID NO: 1737692 - RNA, 14 nt, Salmonella enterica enterica serovar Typhi Ty2
uguuuaccaucgcg

SEQ ID NO: 1737693 - RNA, 18 nt, Salmonella enterica enterica serovar Typhi Ty2
ugugcuuccagcuccauc

SEQ ID NO: 1737694 - RNA, 19 nt, Salmonella enterica enterica serovar Typhi Ty2
uucagauggugauagcgcg

SEQ ID NO: 1737695 - RNA, 11 nt, Salmonella enterica enterica serovar Typhi Ty2
uucacgccacc

SEQ ID NO: 1737696 - RNA, 21 nt, Salmonella enterica enterica serovar Typhi Ty2
uucacgcagucguuccagacg

SEQ ID NO: 1737697 - RNA, 17 nt, Salmonella enterica enterica serovar Typhi Ty2
uucaccggauacccagc

SEQ ID NO: 1737698 - RNA, 20 nt, Salmonella enterica enterica serovar Typhi Ty2
uucaaacguucuguccgcuu

SEQ ID NO: 1737699 - RNA, 19 nt, Salmonella enterica enterica serovar Typhi Ty2
uuauugaaaagcagccaga

SEQ ID NO: 1737700 - RNA, 21 nt, Salmonella enterica enterica serovar Typhi Ty2
uuauugaccaucgccagccau

SEQ ID NO: 1737701 - RNA, 22 nt, Salmonella enterica enterica serovar Typhi Ty2
uuauucagaaaaucuggcgaga

SEQ ID NO: 1737702 - RNA, 21 nt, Salmonella enterica enterica serovar Typhi Ty2
uuaucgguaaugauaucgccc

SEQ ID NO: 1737703 - RNA, 15 nt, Salmonella enterica enterica serovar Typhi Ty2
uucccagucauccgg

SEQ ID NO: 1737704 - RNA, 23 nt, Salmonella enterica enterica serovar Typhi Ty2
uucccauugggccagcagcgcau

SEQ ID NO: 1737705 - RNA, 19 nt, Salmonella enterica enterica serovar Typhi Ty2
uuccccaaugaucaauggc

SEQ ID NO: 1737706 - RNA, 12 nt, Salmonella enterica enterica serovar Typhi Ty2
uuccaucggcau

SEQ ID NO: 1737707 - RNA, 22 nt, Salmonella enterica enterica serovar Typhi Ty2
uucauucagggaaucagcguaa

SEQ ID NO: 1737708 - RNA, 14 nt, Salmonella enterica enterica serovar Typhi Ty2
uucaggccgccagc

SEQ ID NO: 1737709 - RNA, 18 nt, Salmonella enterica enterica serovar Typhi Ty2
uucaucgauggcgccagc

SEQ ID NO: 1737710 - RNA, 16 nt, Salmonella enterica enterica serovar Typhi Ty2
uucaucuaucgccagc

SEQ ID NO: 1737711 - RNA, 21 nt, Salmonella enterica enterica serovar Typhi Ty2
uucaugaaacucgcguagcgu

SEQ ID NO: 1737712 - RNA, 16 nt, Salmonella enterica enterica serovar Typhi Ty2
uucaugccauacuccu

SEQ ID NO: 1737713 - RNA, 22 nt, Salmonella enterica enterica serovar Typhi Ty2
uucagcggcuugucauccugcu

SEQ ID NO: 1737714 - RNA, 18 nt, Salmonella enterica enterica serovar Typhi Ty2
uucaggaaguuuaacgcg

SEQ ID NO: 1737715 - RNA, 18 nt, Salmonella enterica enterica serovar Typhi Ty2
uucagcuucugucagccu

SEQ ID NO: 1737716 - RNA, 18 nt, Salmonella enterica enterica serovar Typhi Ty2
uucaggcaucagauaaac

SEQ ID NO: 1737717 - RNA, 19 nt, Salmonella enterica enterica serovar Typhi Ty2
uucaggagaccuaaagucu

SEQ ID NO: 1737718 - RNA, 18 nt, Salmonella enterica enterica serovar Typhi Ty2
uucagcccguucucgccg

SEQ ID NO: 1737719 - RNA, 19 nt, Salmonella enterica enterica serovar Typhi Ty2
uucagcgccagauagucac

SEQ ID NO: 1737720 - RNA, 22 nt, Salmonella enterica enterica serovar Typhi Ty2
ugucugccucggguggcaucug

SEQ ID NO: 1737721 - RNA, 22 nt, Salmonella enterica enterica serovar Typhi Ty2
ugucguuccacacguccauccg

SEQ ID NO: 1737722 - RNA, 18 nt, Salmonella enterica enterica serovar Typhi Ty2
ugucguucacguaaucgc

SEQ ID NO: 1737723 - RNA, 15 nt, Salmonella enterica enterica serovar Typhi Ty2
ugucgucguauggug

SEQ ID NO: 1737724 - RNA, 17 nt, Salmonella enterica enterica serovar Typhi Ty2
ugucgccggggcgcugg

SEQ ID NO: 1737725 - RNA, 22 nt, Salmonella enterica enterica serovar Typhi Ty2
ugucgccugcuguugggcagga

SEQ ID NO: 1737726 - RNA, 21 nt, Salmonella enterica enterica serovar Typhi Ty2
  misc_feature (11)..(11): n is a, c, g or u
ugucggucggnuaagcgcuag

SEQ ID NO: 1737727 - RNA, 20 nt, Salmonella enterica enterica serovar Typhi Ty2
ugucggucaggcugcggaca

SEQ ID NO: 1737728 - RNA, 17 nt, Salmonella enterica enterica serovar Typhi Ty2
ugucgggcaaaaugcgu

SEQ ID NO: 1737729 - RNA, 13 nt, Salmonella enterica enterica serovar Typhi Ty2
ugucgaauuccgc

SEQ ID NO: 1737730 - RNA, 18 nt, Salmonella enterica enterica serovar Typhi Ty2
uguccuacacucaauacg

SEQ ID NO: 1737731 - RNA, 12 nt, Salmonella enterica enterica serovar Typhi Ty2
uguccaucaggc

SEQ ID NO: 1737732 - RNA, 12 nt, Salmonella enterica enterica serovar Typhi Ty2
uguaaaccggcc

SEQ ID NO: 1737733 - RNA, 19 nt, Salmonella enterica enterica serovar Typhi Ty2
uguaacuucggccagcgag

SEQ ID NO: 1737734 - RNA, 17 nt, Salmonella enterica enterica serovar Typhi Ty2
uguaacccgccgccauc

SEQ ID NO: 1737735 - RNA, 20 nt, Salmonella enterica enterica serovar Typhi Ty2
uguaacuucggccagcgagu

SEQ ID NO: 1737736 - RNA, 19 nt, Salmonella enterica enterica serovar Typhi Ty2
uguaggccugauaagcgca

SEQ ID NO: 1737737 - RNA, 20 nt, Salmonella enterica enterica serovar Typhi Ty2
uguaggccugauaagcguag

SEQ ID NO: 1737738 - RNA, 20 nt, Salmonella enterica enterica serovar Typhi Ty2
uguaggcuuccagaagguag

SEQ ID NO: 1737739 - RNA, 19 nt, Salmonella enterica enterica serovar Typhi Ty2
uguaucgcccugccagcuc

SEQ ID NO: 1737740 - RNA, 15 nt, Salmonella enterica enterica serovar Typhi Ty2
ugucaauaucgacgg

SEQ ID NO: 1737741 - RNA, 22 nt, Salmonella enterica enterica serovar Typhi Ty2
uggucagacgcucagccuuaua

SEQ ID NO: 1737742 - RNA, 14 nt, Salmonella enterica enterica serovar Typhi Ty2
uggucagcauaaua

SEQ ID NO: 1737743 - RNA, 20 nt, Salmonella enterica enterica serovar Typhi Ty2
uggucaaaaucgacagcgac

SEQ ID NO: 1737744 - RNA, 19 nt, Salmonella enterica enterica serovar Typhi Ty2
ugguaugcggcuaauacgc

SEQ ID NO: 1737745 - RNA, 22 nt, Salmonella enterica enterica serovar Typhi Ty2
uggucagcucacgcgccagcac

SEQ ID NO: 1737746 - RNA, 14 nt, Salmonella enterica enterica serovar Typhi Ty2
uggucaggcgacca

SEQ ID NO: 1737747 - RNA, 21 nt, Salmonella enterica enterica serovar Typhi Ty2
uggucggcaaucaccugcauc

SEQ ID NO: 1737748 - RNA, 22 nt, Salmonella enterica enterica serovar Typhi Ty2
uggucgcgguuuacuucuucag

SEQ ID NO: 1737749 - RNA, 16 nt, Salmonella enterica enterica serovar Typhi Ty2
uggugauauaaacggg

SEQ ID NO: 1737750 - RNA, 20 nt, Salmonella enterica enterica serovar Typhi Ty2
uggugauagcgcgccagcac

SEQ ID NO: 1737751 - RNA, 16 nt, Salmonella enterica enterica serovar Typhi Ty2
uggugaccgccagaug

SEQ ID NO: 1737752 - RNA, 14 nt, Salmonella enterica enterica serovar Typhi Ty2
uggugacaucgccg

SEQ ID NO: 1737753 - RNA, 15 nt, Salmonella enterica enterica serovar Typhi Ty2
uggucgguguucaua

SEQ ID NO: 1737754 - RNA, 16 nt, Salmonella enterica enterica serovar Typhi Ty2
uggucgguguucauau

SEQ ID NO: 1737755 - RNA, 16 nt, Salmonella enterica enterica serovar Typhi Ty2
uggucugacccgcgaa

SEQ ID NO: 1737756 - RNA, 16 nt, Salmonella enterica enterica serovar Typhi Ty2
uggugccaaucuccag

SEQ ID NO: 1737757 - RNA, 15 nt, Salmonella enterica enterica serovar Typhi Ty2
ugguuaauuccgcau

SEQ ID NO: 1737758 - RNA, 23 nt, Salmonella enterica enterica serovar Typhi Ty2
ugguguuaagguagacgcgguga

SEQ ID NO: 1737759 - RNA, 15 nt, Salmonella enterica enterica serovar Typhi Ty2
ugguucccgccacug

SEQ ID NO: 1737760 - RNA, 21 nt, Salmonella enterica enterica serovar Typhi Ty2
uguaaacccgauucugccagu

SEQ ID NO: 1737761 - RNA, 16 nt, Salmonella enterica enterica serovar Typhi Ty2
uguaaaaaauccagcg

SEQ ID NO: 1737762 - RNA, 20 nt, Salmonella enterica enterica serovar Typhi Ty2
uggcgauuuccagcgaauaa

SEQ ID NO: 1737763 - RNA, 22 nt, Salmonella enterica enterica serovar Typhi Ty2
uggcgauaauagaaccgaauaa

SEQ ID NO: 1737764 - RNA, 14 nt, Salmonella enterica enterica serovar Typhi Ty2
uggcggcggucgua

SEQ ID NO: 1737765 - RNA, 21 nt, Salmonella enterica enterica serovar Typhi Ty2
uggcggcggacaugguaauaa

SEQ ID NO: 1737766 - RNA, 17 nt, Salmonella enterica enterica serovar Typhi Ty2
uggcgcucggaugugca

SEQ ID NO: 1737767 - RNA, 21 nt, Salmonella enterica enterica serovar Typhi Ty2
uggcgcuacgcuuaucaggcc

SEQ ID NO: 1737768 - RNA, 16 nt, Salmonella enterica enterica serovar Typhi Ty2
uggccggucuuaugcu

SEQ ID NO: 1737769 - RNA, 19 nt, Salmonella enterica enterica serovar Typhi Ty2
ugcuuugcaauguucaaua

SEQ ID NO: 1737770 - RNA, 17 nt, Salmonella enterica enterica serovar Typhi Ty2
uggaaaaccccaucccg

SEQ ID NO: 1737771 - RNA, 18 nt, Salmonella enterica enterica serovar Typhi Ty2
uggaaaauaauaaucguu

SEQ ID NO: 1737772 - RNA, 19 nt, Salmonella enterica enterica serovar Typhi Ty2
uggaaaccgcagaagguca

SEQ ID NO: 1737773 - RNA, 14 nt, Salmonella enterica enterica serovar Typhi Ty2
uggccucugccagu

SEQ ID NO: 1737774 - RNA, 20 nt, Salmonella enterica enterica serovar Typhi Ty2
uggccucugccaguugcuca

SEQ ID NO: 1737775 - RNA, 17 nt, Salmonella enterica enterica serovar Typhi Ty2
uggccguuuucccggca

SEQ ID NO: 1737776 - RNA, 21 nt, Salmonella enterica enterica serovar Typhi Ty2
uggcgacuaacgucuuauccg

SEQ ID NO: 1737777 - RNA, 23 nt, Salmonella enterica enterica serovar Typhi Ty2
uggcgacguaacugucuuauccg

SEQ ID NO: 1737778 - RNA, 20 nt, Salmonella enterica enterica serovar Typhi Ty2
uggggccuaaugagccagau

SEQ ID NO: 1737779 - RNA, 20 nt, Salmonella enterica enterica serovar Typhi Ty2
uggggauaucuucgauaaga

SEQ ID NO: 1737780 - RNA, 23 nt, Salmonella enterica enterica serovar Typhi Ty2
ugguagagguugcggauaugcgu

SEQ ID NO: 1737781 - RNA, 19 nt, Salmonella enterica enterica serovar Typhi Ty2
ugguaggccugauaagcga

SEQ ID NO: 1737782 - RNA, 16 nt, Salmonella enterica enterica serovar Typhi Ty2
ugguaggccugauaag

SEQ ID NO: 1737783 - RNA, 18 nt, Salmonella enterica enterica serovar Typhi Ty2
uggggaaaauaccgguaa

SEQ ID NO: 1737784 - RNA, 14 nt, Salmonella enterica enterica serovar Typhi Ty2
ugggcuuaaugcgc

SEQ ID NO: 1737785 - RNA, 21 nt, Salmonella enterica enterica serovar Typhi Ty2
ugggcuuuuaaccacgcaauc

SEQ ID NO: 1737786 - RNA, 20 nt, Salmonella enterica enterica serovar Typhi Ty2
ugggccggguauaccaucgg

SEQ ID NO: 1737787 - RNA, 13 nt, Salmonella enterica enterica serovar Typhi Ty2
uggcugucuuccg

SEQ ID NO: 1737788 - RNA, 17 nt, Salmonella enterica enterica serovar Typhi Ty2
ugggauagugcugcgca

SEQ ID NO: 1737789 - RNA, 14 nt, Salmonella enterica enterica serovar Typhi Ty2
uggcuugcggguuu

SEQ ID NO: 1737790 - RNA, 14 nt, Salmonella enterica enterica serovar Typhi Ty2
uggcuaucgccgua

SEQ ID NO: 1737791 - RNA, 16 nt, Salmonella enterica enterica serovar Typhi Ty2
uaaaaaacaggcgcag

SEQ ID NO: 1737792 - RNA, 18 nt, Salmonella enterica enterica serovar Typhi Ty2
uaaaacauuccugacauu

SEQ ID NO: 1737793 - RNA, 16 nt, Salmonella enterica enterica serovar Typhi Ty2
uaaaaaaccggaauuu

SEQ ID NO: 1737794 - RNA, 14 nt, Salmonella enterica enterica serovar Typhi Ty2
uaaaaaaggcucgc

SEQ ID NO: 1737795 - RNA, 21 nt, Salmonella enterica enterica serovar Typhi Ty2
uaaaacuucccgcgcagugca

SEQ ID NO: 1737796 - RNA, 19 nt, Salmonella enterica enterica serovar Typhi Ty2
uaaaacgcgcccaacggau

SEQ ID NO: 1737797 - RNA, 13 nt, Salmonella enterica enterica serovar Typhi Ty2
uaaaauggacauu

SEQ ID NO: 1737798 - RNA, 18 nt, Salmonella enterica enterica serovar Typhi Ty2
uaaacgggcagagucgau

SEQ ID NO: 1737799 - RNA, 22 nt, Salmonella enterica enterica serovar Typhi Ty2
uaaacguaaguuaaaacgccau

SEQ ID NO: 1737800 - RNA, 21 nt, Salmonella enterica enterica serovar Typhi Ty2
uaaagcccgucccuuccgcca

SEQ ID NO: 1737801 - RNA, 13 nt, Salmonella enterica enterica serovar Typhi Ty2
uaaaggcgaaacc

SEQ ID NO: 1737802 - RNA, 22 nt, Salmonella enterica enterica serovar Typhi Ty2
uaaaggcguguguuuagauaac

SEQ ID NO: 1737803 - RNA, 18 nt, Salmonella enterica enterica serovar Typhi Ty2
uaaagccgucggugcccg

SEQ ID NO: 1737804 - RNA, 18 nt, Salmonella enterica enterica serovar Typhi Ty2
uaaacgccaguggaugcg

SEQ ID NO: 1737805 - RNA, 20 nt, Salmonella enterica enterica serovar Typhi Ty2
uaaacgcaaugucaucaggc

SEQ ID NO: 1737806 - RNA, 23 nt, Salmonella enterica enterica serovar Typhi Ty2
uaaacgcuccggcaggcaaaucu

SEQ ID NO: 1737807 - RNA, 19 nt, Salmonella enterica enterica serovar Typhi Ty2
uaaacgcgucuucaucagc

SEQ ID NO: 1737808 - RNA, 17 nt, Salmonella enterica enterica serovar Typhi Ty2
uaaacgccggauuccag

SEQ ID NO: 1737809 - RNA, 17 nt, Salmonella enterica enterica serovar Typhi Ty2
uaaacgccucauccggc

SEQ ID NO: 1737810 - RNA, 16 nt, Salmonella enterica enterica serovar Typhi Ty2
uaaacgccugcaccau

SEQ ID NO: 1737811 - RNA, 15 nt, Salmonella enterica enterica serovar Typhi Ty2
uaaaauugaacggac

SEQ ID NO: 1737812 - RNA, 19 nt, Salmonella enterica enterica serovar Typhi Ty2
uaacggcgccacgcccacg

SEQ ID NO: 1737813 - RNA, 18 nt, Salmonella enterica enterica serovar Typhi Ty2
uaacggcgucauccugca

SEQ ID NO: 1737814 - RNA, 21 nt, Salmonella enterica enterica serovar Typhi Ty2
uaaccggaauggucgcgccag

SEQ ID NO: 1737815 - RNA, 20 nt, Salmonella enterica enterica serovar Typhi Ty2
uaacgcuuaugcugccuaca

SEQ ID NO: 1737816 - RNA, 14 nt, Salmonella enterica enterica serovar Typhi Ty2
uaacggacucaggc

SEQ ID NO: 1737817 - RNA, 16 nt, Salmonella enterica enterica serovar Typhi Ty2
uaacguaaauacccag

SEQ ID NO: 1737818 - RNA, 14 nt, Salmonella enterica enterica serovar Typhi Ty2
uaacccagugcaau

SEQ ID NO: 1737819 - RNA, 16 nt, Salmonella enterica enterica serovar Typhi Ty2
uaaccgaugcaaccgc

SEQ ID NO: 1737820 - RNA, 17 nt, Salmonella enterica enterica serovar Typhi Ty2
uaacccggucauccagc

SEQ ID NO: 1737821 - RNA, 19 nt, Salmonella enterica enterica serovar Typhi Ty2
uaaccgcgccgcuggcguc

SEQ ID NO: 1737822 - RNA, 21 nt, Salmonella enterica enterica serovar Typhi Ty2
uaaauuaacgcgaauccgcca

SEQ ID NO: 1737823 - RNA, 17 nt, Salmonella enterica enterica serovar Typhi Ty2
uaaaucccgcaucaccc

SEQ ID NO: 1737824 - RNA, 16 nt, Salmonella enterica enterica serovar Typhi Ty2
uaaauauugauggacg

SEQ ID NO: 1737825 - RNA, 17 nt, Salmonella enterica enterica serovar Typhi Ty2
uaaaucagcgugauaua

SEQ ID NO: 1737826 - RNA, 18 nt, Salmonella enterica enterica serovar Typhi Ty2
uaaauuuccgcagccaga

SEQ ID NO: 1737827 - RNA, 17 nt, Salmonella enterica enterica serovar Typhi Ty2
uaaauugccugauggcg

SEQ ID NO: 1737828 - RNA, 22 nt, Salmonella enterica enterica serovar Typhi Ty2
uaacagcgguauacaccagcuc

SEQ ID NO: 1737829 - RNA, 18 nt, Salmonella enterica enterica serovar Typhi Ty2
uaacaggcaccagcguau

SEQ ID NO: 1737830 - RNA, 16 nt, Salmonella enterica enterica serovar Typhi Ty2
uaacaguucaaacggc

SEQ ID NO: 1737831 - RNA, 16 nt, Salmonella enterica enterica serovar Typhi Ty2
uaauaccgaaauccgc

SEQ ID NO: 1737832 - RNA, 20 nt, Salmonella enterica enterica serovar Typhi Ty2
uaauaugcgcaaucaccuca

SEQ ID NO: 1737833 - RNA, 12 nt, Salmonella enterica enterica serovar Typhi Ty2
uaauaaggcgga

SEQ ID NO: 1737834 - RNA, 23 nt, Salmonella enterica enterica serovar Typhi Ty2
uaaucugccagcuuaaaucgcgg

SEQ ID NO: 1737835 - RNA, 14 nt, Salmonella enterica enterica serovar Typhi Ty2
uaaucuggccuacg

SEQ ID NO: 1737836 - RNA, 16 nt, Salmonella enterica enterica serovar Typhi Ty2
uaaucuguagauugcg

SEQ ID NO: 1737837 - RNA, 13 nt, Salmonella enterica enterica serovar Typhi Ty2
uaaucgucauccc

SEQ ID NO: 1737838 - RNA, 20 nt, Salmonella enterica enterica serovar Typhi Ty2
uaaucaggcauucagcgggu

SEQ ID NO: 1737839 - RNA, 21 nt, Salmonella enterica enterica serovar Typhi Ty2
uaaucaggacaucaaaggcag

SEQ ID NO: 1737840 - RNA, 15 nt, Salmonella enterica enterica serovar Typhi Ty2
uaaucacuuuuaccg

SEQ ID NO: 1737841 - RNA, 19 nt, Salmonella enterica enterica serovar Typhi Ty2
uaaucaccagcccgaaucc

SEQ ID NO: 1737842 - RNA, 17 nt, Salmonella enterica enterica serovar Typhi Ty2
uaaucaacguagaaucu

SEQ ID NO: 1737843 - RNA, 23 nt, Salmonella enterica enterica serovar Typhi Ty2
uaagcuggcguuaaauauaucug

SEQ ID NO: 1737844 - RNA, 22 nt, Salmonella enterica enterica serovar Typhi Ty2
uaagcgucugcaaugguaaaac

SEQ ID NO: 1737845 - RNA, 19 nt, Salmonella enterica enterica serovar Typhi Ty2
uaagcgugcgccauccggc

SEQ ID NO: 1737846 - RNA, 17 nt, Salmonella enterica enterica serovar Typhi Ty2
uaaggccacgccgccau

SEQ ID NO: 1737847 - RNA, 22 nt, Salmonella enterica enterica serovar Typhi Ty2
uaaggcggagccgccauccggc

SEQ ID NO: 1737848 - RNA, 16 nt, Salmonella enterica enterica serovar Typhi Ty2
uaaggccgcgaaagcg

SEQ ID NO: 1737849 - RNA, 16 nt, Salmonella enterica enterica serovar Typhi Ty2
uaaggcuaaucgcauu

SEQ ID NO: 1737850 - RNA, 18 nt, Salmonella enterica enterica serovar Typhi Ty2
uaagaccgguacgcaacg

SEQ ID NO: 1737851 - RNA, 23 nt, Salmonella enterica enterica serovar Typhi Ty2
uaagacgcuacgcgucgccaucc

SEQ ID NO: 1737852 - RNA, 16 nt, Salmonella enterica enterica serovar Typhi Ty2
uaagagcguuacccag

SEQ ID NO: 1737853 - RNA, 21 nt, Salmonella enterica enterica serovar Typhi Ty2
uaagagacugacaaugacgca

SEQ ID NO: 1737854 - RNA, 20 nt, Salmonella enterica enterica serovar Typhi Ty2
uaaugcuuauccggccuaca

SEQ ID NO: 1737855 - RNA, 12 nt, Salmonella enterica enterica serovar Typhi Ty2
uaauggccuaca

SEQ ID NO: 1737856 - RNA, 12 nt, Salmonella enterica enterica serovar Typhi Ty2
uaauggcgauaa

SEQ ID NO: 1737857 - RNA, 20 nt, Salmonella enterica enterica serovar Typhi Ty2
uaaugaaaucgucgccaaca

SEQ ID NO: 1737858 - RNA, 16 nt, Salmonella enterica enterica serovar Typhi Ty2
uaaugccgccgucgcg

SEQ ID NO: 1737859 - RNA, 16 nt, Salmonella enterica enterica serovar Typhi Ty2
uaaugccggaucaggc

SEQ ID NO: 1737860 - RNA, 21 nt, Salmonella enterica enterica serovar Typhi Ty2
uaaugcgcguugccgccaaca

SEQ ID NO: 1737861 - RNA, 18 nt, Salmonella enterica enterica serovar Typhi Ty2
uacaggcgguaagcgucg

SEQ ID NO: 1737862 - RNA, 17 nt, Salmonella enterica enterica serovar Typhi Ty2
uacaggcaucuuccagc

SEQ ID NO: 1737863 - RNA, 19 nt, Salmonella enterica enterica serovar Typhi Ty2
uacaggcauggccuucaau

SEQ ID NO: 1737864 - RNA, 13 nt, Salmonella enterica enterica serovar Typhi Ty2
uacaucgcgcuga

SEQ ID NO: 1737865 - RNA, 19 nt, Salmonella enterica enterica serovar Typhi Ty2
uacauccgccagccgccau

SEQ ID NO: 1737866 - RNA, 15 nt, Salmonella enterica enterica serovar Typhi Ty2
uacagcguguucaug

SEQ ID NO: 1737867 - RNA, 18 nt, Salmonella enterica enterica serovar Typhi Ty2
uacagcuuaaucaccagc

SEQ ID NO: 1737868 - RNA, 20 nt, Salmonella enterica enterica serovar Typhi Ty2
uacaagaauuuaucgcaaua

SEQ ID NO: 1737869 - RNA, 18 nt, Salmonella enterica enterica serovar Typhi Ty2
uacaagagccgccgccau

SEQ ID NO: 1737870 - RNA, 19 nt, Salmonella enterica enterica serovar Typhi Ty2
uacaccugacggcagccac

SEQ ID NO: 1737871 - RNA, 16 nt, Salmonella enterica enterica serovar Typhi Ty2
uacacgcgaauagcca

SEQ ID NO: 1737872 - RNA, 19 nt, Salmonella enterica enterica serovar Typhi Ty2
uacacgccgacgcauccgc

SEQ ID NO: 1737873 - RNA, 14 nt, Salmonella enterica enterica serovar Typhi Ty2
uacacuucauccgg

SEQ ID NO: 1737874 - RNA, 19 nt, Salmonella enterica enterica serovar Typhi Ty2
guuuuaauacacgauaaac

SEQ ID NO: 1737875 - RNA, 16 nt, Salmonella enterica enterica serovar Typhi Ty2
guuuguuguagccaga

SEQ ID NO: 1737876 - RNA, 21 nt, Salmonella enterica enterica serovar Typhi Ty2
guuuguccugcagcgccagaa

SEQ ID NO: 1737877 - RNA, 17 nt, Salmonella enterica enterica serovar Typhi Ty2
guuuuacuuccuguagc

SEQ ID NO: 1737878 - RNA, 18 nt, Salmonella enterica enterica serovar Typhi Ty2
guuuuaccgcccgacgga

SEQ ID NO: 1737879 - RNA, 13 nt, Salmonella enterica enterica serovar Typhi Ty2
guuuuaccggcag

SEQ ID NO: 1737880 - RNA, 20 nt, Salmonella enterica enterica serovar Typhi Ty2
guuuuaacccccagcacauu

SEQ ID NO: 1737881 - RNA, 14 nt, Salmonella enterica enterica serovar Typhi Ty2
guuuuaucgcccgg

SEQ ID NO: 1737882 - RNA, 14 nt, Salmonella enterica enterica serovar Typhi Ty2
guuuucgccuuugc

SEQ ID NO: 1737883 - RNA, 17 nt, Salmonella enterica enterica serovar Typhi Ty2
guuuucuguacagcguc

SEQ ID NO: 1737884 - RNA, 13 nt, Salmonella enterica enterica serovar Typhi Ty2
guuuuccagcauc

SEQ ID NO: 1737885 - RNA, 14 nt, Salmonella enterica enterica serovar Typhi Ty2
guuuuccagcguaa

SEQ ID NO: 1737886 - RNA, 18 nt, Salmonella enterica enterica serovar Typhi Ty2
guuuuccguaggccggaa

SEQ ID NO: 1737887 - RNA, 16 nt, Salmonella enterica enterica serovar Typhi Ty2
guuuuuaacgccggca

SEQ ID NO: 1737888 - RNA, 15 nt, Salmonella enterica enterica serovar Typhi Ty2
guuuugauguccaga

SEQ ID NO: 1737889 - RNA, 15 nt, Salmonella enterica enterica serovar Typhi Ty2
guuuugcucaguaac

SEQ ID NO: 1737890 - RNA, 18 nt, Salmonella enterica enterica serovar Typhi Ty2
guuuggacuaccgguaaa

SEQ ID NO: 1737891 - RNA, 15 nt, Salmonella enterica enterica serovar Typhi Ty2
guuugaacagcaguu

SEQ ID NO: 1737892 - RNA, 12 nt, Salmonella enterica enterica serovar Typhi Ty2
guuucucaaaca

SEQ ID NO: 1737893 - RNA, 13 nt, Salmonella enterica enterica serovar Typhi Ty2
guuugacggcugc

SEQ ID NO: 1737894 - RNA, 13 nt, Salmonella enterica enterica serovar Typhi Ty2
guuucugauagcc

SEQ ID NO: 1737895 - RNA, 20 nt, Salmonella enterica enterica serovar Typhi Ty2
guuuacaccgccauccggca

SEQ ID NO: 1737896 - RNA, 20 nt, Salmonella enterica enterica serovar Typhi Ty2
guuuacgccgccauccggca

SEQ ID NO: 1737897 - RNA, 20 nt, Salmonella enterica enterica serovar Typhi Ty2
guuuacgcugcuauccggca

SEQ ID NO: 1737898 - RNA, 19 nt, Salmonella enterica enterica serovar Typhi Ty2
guuuauccagcacgguaaa

SEQ ID NO: 1737899 - RNA, 15 nt, Salmonella enterica enterica serovar Typhi Ty2
guuucauauccgaca

SEQ ID NO: 1737900 - RNA, 18 nt, Salmonella enterica enterica serovar Typhi Ty2
guuuagccugcgcguaaa

SEQ ID NO: 1737901 - RNA, 21 nt, Salmonella enterica enterica serovar Typhi Ty2
guuuccgcuagggcaucagac

SEQ ID NO: 1737902 - RNA, 21 nt, Salmonella enterica enterica serovar Typhi Ty2
guuucaguucggagaucagcg

SEQ ID NO: 1737903 - RNA, 15 nt, Salmonella enterica enterica serovar Typhi Ty2
guuggcaaucagcgg

SEQ ID NO: 1737904 - RNA, 18 nt, Salmonella enterica enterica serovar Typhi Ty2
guugauugaaacucgcca

SEQ ID NO: 1737905 - RNA, 14 nt, Salmonella enterica enterica serovar Typhi Ty2
guugauucagcguc

SEQ ID NO: 1737906 - RNA, 18 nt, Salmonella enterica enterica serovar Typhi Ty2
guuggcaacgucuugcca

SEQ ID NO: 1737907 - RNA, 19 nt, Salmonella enterica enterica serovar Typhi Ty2
guugacuuaaaaagcggau

SEQ ID NO: 1737908 - RNA, 20 nt, Salmonella enterica enterica serovar Typhi Ty2
guugagcguuacgggaacag

SEQ ID NO: 1737909 - RNA, 17 nt, Salmonella enterica enterica serovar Typhi Ty2
guugagcuuaucgguaa

SEQ ID NO: 1737910 - RNA, 13 nt, Salmonella enterica enterica serovar Typhi Ty2
guugacgggcgac

SEQ ID NO: 1737911 - RNA, 17 nt, Salmonella enterica enterica serovar Typhi Ty2
guugaaccgucaucagc

SEQ ID NO: 1737912 - RNA, 13 nt, Salmonella enterica enterica serovar Typhi Ty2
guugaacaauggu

SEQ ID NO: 1737913 - RNA, 21 nt, Salmonella enterica enterica serovar Typhi Ty2
guucugauacucguagccaaa

SEQ ID NO: 1737914 - RNA, 20 nt, Salmonella enterica enterica serovar Typhi Ty2
uagucaucgccuucauccgc

SEQ ID NO: 1737915 - RNA, 17 nt, Salmonella enterica enterica serovar Typhi Ty2
uagucauauucacggcc

SEQ ID NO: 1737916 - RNA, 22 nt, Salmonella enterica enterica serovar Typhi Ty2
uagucauaauacucaauauccu

SEQ ID NO: 1737917 - RNA, 20 nt, Salmonella enterica enterica serovar Typhi Ty2
uaggucggguaaggcguagc

SEQ ID NO: 1737918 - RNA, 20 nt, Salmonella enterica enterica serovar Typhi Ty2
uaguccgccagcaccugaua

SEQ ID NO: 1737919 - RNA, 14 nt, Salmonella enterica enterica serovar Typhi Ty2
uagucgccgguaag

SEQ ID NO: 1737920 - RNA, 16 nt, Salmonella enterica enterica serovar Typhi Ty2
uaguucggauucaaua

SEQ ID NO: 1737921 - RNA, 20 nt, Salmonella enterica enterica serovar Typhi Ty2
uaguuaccguaaucaucgcg

SEQ ID NO: 1737922 - RNA, 17 nt, Salmonella enterica enterica serovar Typhi Ty2
uauaugcaaaacuguag

SEQ ID NO: 1737923 - RNA, 14 nt, Salmonella enterica enterica serovar Typhi Ty2
uauaugccugccaa

SEQ ID NO: 1737924 - RNA, 15 nt, Salmonella enterica enterica serovar Typhi Ty2
uauauuccagccagg

SEQ ID NO: 1737925 - RNA, 18 nt, Salmonella enterica enterica serovar Typhi Ty2
uauauucagcaaaugcgc

SEQ ID NO: 1737926 - RNA, 23 nt, Salmonella enterica enterica serovar Typhi Ty2
uauauucgcgaugcucaaccagu

SEQ ID NO: 1737927 - RNA, 16 nt, Salmonella enterica enterica serovar Typhi Ty2
uauagcucaguuggua

SEQ ID NO: 1737928 - RNA, 16 nt, Salmonella enterica enterica serovar Typhi Ty2
uauaguccacuuucug

SEQ ID NO: 1737929 - RNA, 15 nt, Salmonella enterica enterica serovar Typhi Ty2
uauagacaccuuaua

SEQ ID NO: 1737930 - RNA, 14 nt, Salmonella enterica enterica serovar Typhi Ty2
uauaaacucagcaa

SEQ ID NO: 1737931 - RNA, 17 nt, Salmonella enterica enterica serovar Typhi Ty2
uauaaauuuuuuaacag

SEQ ID NO: 1737932 - RNA, 22 nt, Salmonella enterica enterica serovar Typhi Ty2
uauaaaacgggccacugcuggc

SEQ ID NO: 1737933 - RNA, 16 nt, Salmonella enterica enterica serovar Typhi Ty2
uauaaaaauagcuggc

SEQ ID NO: 1737934 - RNA, 18 nt, Salmonella enterica enterica serovar Typhi Ty2
uauaagcgccgucauccg

SEQ ID NO: 1737935 - RNA, 12 nt, Salmonella enterica enterica serovar Typhi Ty2
uauaagcgccau

SEQ ID NO: 1737936 - RNA, 15 nt, Salmonella enterica enterica serovar Typhi Ty2
uauaagcuuuaacca

SEQ ID NO: 1737937 - RNA, 20 nt, Salmonella enterica enterica serovar Typhi Ty2
uauaaucaaacccuuccgca

SEQ ID NO: 1737938 - RNA, 20 nt, Salmonella enterica enterica serovar Typhi Ty2
uaugaaauucuugcccgcug

SEQ ID NO: 1737939 - RNA, 16 nt, Salmonella enterica enterica serovar Typhi Ty2
uaucuauucgcugaca

SEQ ID NO: 1737940 - RNA, 20 nt, Salmonella enterica enterica serovar Typhi Ty2
uaucuauuucuuagcgccag

SEQ ID NO: 1737941 - RNA, 15 nt, Salmonella enterica enterica serovar Typhi Ty2
uaucguuuacguuau

SEQ ID NO: 1737942 - RNA, 16 nt, Salmonella enterica enterica serovar Typhi Ty2
uaucggccagcgccag

SEQ ID NO: 1737943 - RNA, 20 nt, Salmonella enterica enterica serovar Typhi Ty2
uaucgguaguguuaucgccg

SEQ ID NO: 1737944 - RNA, 16 nt, Salmonella enterica enterica serovar Typhi Ty2
uaucgugccggauggc

SEQ ID NO: 1737945 - RNA, 23 nt, Salmonella enterica enterica serovar Typhi Ty2
uaucguuauauauacuucaccau

SEQ ID NO: 1737946 - RNA, 20 nt, Salmonella enterica enterica serovar Typhi Ty2
uauccggccuacaaaugagu

SEQ ID NO: 1737947 - RNA, 13 nt, Salmonella enterica enterica serovar Typhi Ty2
uauccggccuaca

SEQ ID NO: 1737948 - RNA, 13 nt, Salmonella enterica enterica serovar Typhi Ty2
uauccggccuacg

SEQ ID NO: 1737949 - RNA, 20 nt, Salmonella enterica enterica serovar Typhi Ty2
uauccggccugcaggcaacg

SEQ ID NO: 1737950 - RNA, 13 nt, Salmonella enterica enterica serovar Typhi Ty2
uaucccgguauuc

SEQ ID NO: 1737951 - RNA, 15 nt, Salmonella enterica enterica serovar Typhi Ty2
uauccgcgcucaaca

SEQ ID NO: 1737952 - RNA, 21 nt, Salmonella enterica enterica serovar Typhi Ty2
uaucaccagcgauuacgccag

SEQ ID NO: 1737953 - RNA, 22 nt, Salmonella enterica enterica serovar Typhi Ty2
uaucaccgccgcccguccgcua

SEQ ID NO: 1737954 - RNA, 16 nt, Salmonella enterica enterica serovar Typhi Ty2
uaucagcaagcgccag

SEQ ID NO: 1737955 - RNA, 20 nt, Salmonella enterica enterica serovar Typhi Ty2
uaucaggaucaaaaucgcgc

SEQ ID NO: 1737956 - RNA, 13 nt, Salmonella enterica enterica serovar Typhi Ty2
uaucaggccgaca

SEQ ID NO: 1737957 - RNA, 20 nt, Salmonella enterica enterica serovar Typhi Ty2
uaucaggccuaccaucgcgc

SEQ ID NO: 1737958 - RNA, 16 nt, Salmonella enterica enterica serovar Typhi Ty2
uaucaugcugcgguua

SEQ ID NO: 1737959 - RNA, 14 nt, Salmonella enterica enterica serovar Typhi Ty2
uaucauggugcccg

SEQ ID NO: 1737960 - RNA, 15 nt, Salmonella enterica enterica serovar Typhi Ty2
uaucauuaucgccaa

SEQ ID NO: 1737961 - RNA, 18 nt, Salmonella enterica enterica serovar Typhi Ty2
uaucccaaacgucguaaa

SEQ ID NO: 1737962 - RNA, 20 nt, Salmonella enterica enterica serovar Typhi Ty2
uauccagcaccucaucaccc

SEQ ID NO: 1737963 - RNA, 20 nt, Salmonella enterica enterica serovar Typhi Ty2
uauccagcggcaaaggcaug

SEQ ID NO: 1737964 - RNA, 15 nt, Salmonella enterica enterica serovar Typhi Ty2
uauuaaaaagccagc

SEQ ID NO: 1737965 - RNA, 19 nt, Salmonella enterica enterica serovar Typhi Ty2
uauguuaacgccgauuaau

SEQ ID NO: 1737966 - RNA, 18 nt, Salmonella enterica enterica serovar Typhi Ty2
uauuaacgugauggcgau

SEQ ID NO: 1737967 - RNA, 17 nt, Salmonella enterica enterica serovar Typhi Ty2
uaugaaguuucauacgg

SEQ ID NO: 1737968 - RNA, 16 nt, Salmonella enterica enterica serovar Typhi Ty2
uaugaauaauuucggc

SEQ ID NO: 1737969 - RNA, 23 nt, Salmonella enterica enterica serovar Typhi Ty2
uauucaauaauauuaucauaaug

SEQ ID NO: 1737970 - RNA, 19 nt, Salmonella enterica enterica serovar Typhi Ty2
uauucaaaauccgccaccg

SEQ ID NO: 1737971 - RNA, 23 nt, Salmonella enterica enterica serovar Typhi Ty2
uauucacgcagcuuauuggcaau

SEQ ID NO: 1737972 - RNA, 13 nt, Salmonella enterica enterica serovar Typhi Ty2
uauucagcaaaug

SEQ ID NO: 1737973 - RNA, 13 nt, Salmonella enterica enterica serovar Typhi Ty2
uauuccgaauacg

SEQ ID NO: 1737974 - RNA, 18 nt, Salmonella enterica enterica serovar Typhi Ty2
uauucaucaguuuaaccg

SEQ ID NO: 1737975 - RNA, 21 nt, Salmonella enterica enterica serovar Typhi Ty2
uauugcuguaggcacuuucca

SEQ ID NO: 1737976 - RNA, 20 nt, Salmonella enterica enterica serovar Typhi Ty2
uauugcuuucaauuuccgca

SEQ ID NO: 1737977 - RNA, 14 nt, Salmonella enterica enterica serovar Typhi Ty2
uauucguuccgauc

SEQ ID NO: 1737978 - RNA, 19 nt, Salmonella enterica enterica serovar Typhi Ty2
uauucgcugacaucgugua

SEQ ID NO: 1737979 - RNA, 23 nt, Salmonella enterica enterica serovar Typhi Ty2
uagcguuucgaacucuucgcaac

SEQ ID NO: 1737980 - RNA, 15 nt, Salmonella enterica enterica serovar Typhi Ty2
uagcguggugacgcc

SEQ ID NO: 1737981 - RNA, 15 nt, Salmonella enterica enterica serovar Typhi Ty2
uagcgguuugcaaac

SEQ ID NO: 1737982 - RNA, 13 nt, Salmonella enterica enterica serovar Typhi Ty2
uagcgcugcgcca

SEQ ID NO: 1737983 - RNA, 21 nt, Salmonella enterica enterica serovar Typhi Ty2
uagcgcugcgccagaucaggc

SEQ ID NO: 1737984 - RNA, 19 nt, Salmonella enterica enterica serovar Typhi Ty2
uagcgcugugcuaucaggc

SEQ ID NO: 1737985 - RNA, 19 nt, Salmonella enterica enterica serovar Typhi Ty2
uagcguacuuucaaauagc

SEQ ID NO: 1737986 - RNA, 15 nt, Salmonella enterica enterica serovar Typhi Ty2
uagcgucauccggca

SEQ ID NO: 1737987 - RNA, 13 nt, Salmonella enterica enterica serovar Typhi Ty2
uagcgugacggca

SEQ ID NO: 1737988 - RNA, 16 nt, Salmonella enterica enterica serovar Typhi Ty2
uagcgucugcggcuga

SEQ ID NO: 1737989 - RNA, 20 nt, Salmonella enterica enterica serovar Typhi Ty2
uagcgcuccuuuaauucguu

SEQ ID NO: 1737990 - RNA, 13 nt, Salmonella enterica enterica serovar Typhi Ty2
uagcgccuuaucg

SEQ ID NO: 1737991 - RNA, 14 nt, Salmonella enterica enterica serovar Typhi Ty2
uagcgaccuuaccg

SEQ ID NO: 1737992 - RNA, 22 nt, Salmonella enterica enterica serovar Typhi Ty2
uagcgacggcgcgccaaacggc

SEQ ID NO: 1737993 - RNA, 14 nt, Salmonella enterica enterica serovar Typhi Ty2
uagccuugacgcaa

SEQ ID NO: 1737994 - RNA, 20 nt, Salmonella enterica enterica serovar Typhi Ty2
uagggccgggcagugcucga

SEQ ID NO: 1737995 - RNA, 17 nt, Salmonella enterica enterica serovar Typhi Ty2
uagggcugccaucaggc

SEQ ID NO: 1737996 - RNA, 13 nt, Salmonella enterica enterica serovar Typhi Ty2
uaggcgcgaaaug

SEQ ID NO: 1737997 - RNA, 21 nt, Salmonella enterica enterica serovar Typhi Ty2
uaggccggauaaggcgcuagc

SEQ ID NO: 1737998 - RNA, 19 nt, Salmonella enterica enterica serovar Typhi Ty2
uaggcccgguaagcgcagc

SEQ ID NO: 1737999 - RNA, 20 nt, Salmonella enterica enterica serovar Typhi Ty2
uaggcccgguaagcgcuagc

SEQ ID NO: 1738000 - RNA, 17 nt, Salmonella enterica enterica serovar Typhi Ty2
uaggcgccgccgacaau

SEQ ID NO: 1738001 - RNA, 20 nt, Salmonella enterica enterica serovar Typhi Ty2
uaggccggaugagcguuagc

SEQ ID NO: 1738002 - RNA, 19 nt, Salmonella enterica enterica serovar Typhi Ty2
uaggccugguaagcguagc

SEQ ID NO: 1738003 - RNA, 21 nt, Salmonella enterica enterica serovar Typhi Ty2
uagcugcuguaaguuuccguc

SEQ ID NO: 1738004 - RNA, 14 nt, Salmonella enterica enterica serovar Typhi Ty2
uagcugcgccagcg

SEQ ID NO: 1738005 - RNA, 14 nt, Salmonella enterica enterica serovar Typhi Ty2
uagcugcccggaua

SEQ ID NO: 1738006 - RNA, 15 nt, Salmonella enterica enterica serovar Typhi Ty2
uagcuguuccgcaac

SEQ ID NO: 1738007 - RNA, 22 nt, Salmonella enterica enterica serovar Typhi Ty2
uagcuguuguuuaauggcuaac

SEQ ID NO: 1738008 - RNA, 17 nt, Salmonella enterica enterica serovar Typhi Ty2
uagcuuacuuucagaua

SEQ ID NO: 1738009 - RNA, 17 nt, Salmonella enterica enterica serovar Typhi Ty2
uaggcauuaauggcgau

SEQ ID NO: 1738010 - RNA, 16 nt, Salmonella enterica enterica serovar Typhi Ty2
uacuguuuuugcuuua

SEQ ID NO: 1738011 - RNA, 21 nt, Salmonella enterica enterica serovar Typhi Ty2
uacugugggccguuccgcaac

SEQ ID NO: 1738012 - RNA, 13 nt, Salmonella enterica enterica serovar Typhi Ty2
uacugacuaacgc

SEQ ID NO: 1738013 - RNA, 15 nt, Salmonella enterica enterica serovar Typhi Ty2
uacucuuucccggca

SEQ ID NO: 1738014 - RNA, 20 nt, Salmonella enterica enterica serovar Typhi Ty2
uacuucugacagugacggca

SEQ ID NO: 1738015 - RNA, 19 nt, Salmonella enterica enterica serovar Typhi Ty2
uagaaaaggucgucaggcc

SEQ ID NO: 1738016 - RNA, 11 nt, Salmonella enterica enterica serovar Typhi Ty2
uacuucaucag

SEQ ID NO: 1738017 - RNA, 14 nt, Salmonella enterica enterica serovar Typhi Ty2
uagaaguuaugcau

SEQ ID NO: 1738018 - RNA, 20 nt, Salmonella enterica enterica serovar Typhi Ty2
uagaaaguacaucauuggcc

SEQ ID NO: 1738019 - RNA, 23 nt, Salmonella enterica enterica serovar Typhi Ty2
uagaaagauuucaucaggcugac

SEQ ID NO: 1738020 - RNA, 19 nt, Salmonella enterica enterica serovar Typhi Ty2
uacuaacggcgucauccug

SEQ ID NO: 1738021 - RNA, 20 nt, Salmonella enterica enterica serovar Typhi Ty2
uacguuuuuccauucacaca

SEQ ID NO: 1738022 - RNA, 14 nt, Salmonella enterica enterica serovar Typhi Ty2
uacgugcgaaccac

SEQ ID NO: 1738023 - RNA, 14 nt, Salmonella enterica enterica serovar Typhi Ty2
uacgucaucaugcu

SEQ ID NO: 1738024 - RNA, 18 nt, Salmonella enterica enterica serovar Typhi Ty2
uacguaguccggcaauga

SEQ ID NO: 1738025 - RNA, 12 nt, Salmonella enterica enterica serovar Typhi Ty2
uacggcgugaug

SEQ ID NO: 1738026 - RNA, 14 nt, Salmonella enterica enterica serovar Typhi Ty2
uacggcgcacccau

SEQ ID NO: 1738027 - RNA, 16 nt, Salmonella enterica enterica serovar Typhi Ty2
uacgggaaugcgucgg

SEQ ID NO: 1738028 - RNA, 15 nt, Salmonella enterica enterica serovar Typhi Ty2
uacgguuggccagca

SEQ ID NO: 1738029 - RNA, 14 nt, Salmonella enterica enterica serovar Typhi Ty2
uacgguaauaacuc

SEQ ID NO: 1738030 - RNA, 22 nt, Salmonella enterica enterica serovar Typhi Ty2
uacggugaauauuugcgcuagu

SEQ ID NO: 1738031 - RNA, 13 nt, Salmonella enterica enterica serovar Typhi Ty2
uacgccugucgca

SEQ ID NO: 1738032 - RNA, 15 nt, Salmonella enterica enterica serovar Typhi Ty2
uacgccugucgcaac

SEQ ID NO: 1738033 - RNA, 14 nt, Salmonella enterica enterica serovar Typhi Ty2
uacgcuguaacccg

SEQ ID NO: 1738034 - RNA, 14 nt, Salmonella enterica enterica serovar Typhi Ty2
uacgcuuauugaug

SEQ ID NO: 1738035 - RNA, 20 nt, Salmonella enterica enterica serovar Typhi Ty2
uacgcuuaucaggccuacaa

SEQ ID NO: 1738036 - RNA, 21 nt, Salmonella enterica enterica serovar Typhi Ty2
uacgcucgcugauggcgagaa

SEQ ID NO: 1738037 - RNA, 15 nt, Salmonella enterica enterica serovar Typhi Ty2
uacgcugcgucaggc

SEQ ID NO: 1738038 - RNA, 17 nt, Salmonella enterica enterica serovar Typhi Ty2
uacggcaaacgcuggug

SEQ ID NO: 1738039 - RNA, 20 nt, Salmonella enterica enterica serovar Typhi Ty2
uacggcccauaucaaucaac

SEQ ID NO: 1738040 - RNA, 16 nt, Salmonella enterica enterica serovar Typhi Ty2
uacggaugcgcggaug

SEQ ID NO: 1738041 - RNA, 21 nt, Salmonella enterica enterica serovar Typhi Ty2
uacggaauaucccgcaagaaa

SEQ ID NO: 1738042 - RNA, 17 nt, Salmonella enterica enterica serovar Typhi Ty2
uacggaaauagcgccau

SEQ ID NO: 1738043 - RNA, 12 nt, Salmonella enterica enterica serovar Typhi Ty2
uacgacgcgcca

SEQ ID NO: 1738044 - RNA, 20 nt, Salmonella enterica enterica serovar Typhi Ty2
uacgaauuuuaucuuccggc

SEQ ID NO: 1738045 - RNA, 20 nt, Salmonella enterica enterica serovar Typhi Ty2
uacgacacccgauacacgcc

SEQ ID NO: 1738046 - RNA, 18 nt, Salmonella enterica enterica serovar Typhi Ty2
uacgaaaauacgcggaug

SEQ ID NO: 1738047 - RNA, 24 nt, Salmonella enterica enterica serovar Typhi Ty2
uaccugaagccauccucacgcaac

SEQ ID NO: 1738048 - RNA, 19 nt, Salmonella enterica enterica serovar Typhi Ty2
uaccugucguacgccuaaa

SEQ ID NO: 1738049 - RNA, 19 nt, Salmonella enterica enterica serovar Typhi Ty2
uaccuucacccccaucgcc

SEQ ID NO: 1738050 - RNA, 17 nt, Salmonella enterica enterica serovar Typhi Ty2
uaccuggguagcgccau

SEQ ID NO: 1738051 - RNA, 20 nt, Salmonella enterica enterica serovar Typhi Ty2
uaccugccgccauaacgccg

SEQ ID NO: 1738052 - RNA, 20 nt, Salmonella enterica enterica serovar Typhi Ty2
uaccguuuggaucugucgcc

SEQ ID NO: 1738053 - RNA, 15 nt, Salmonella enterica enterica serovar Typhi Ty2
uaccguuuuccaguc

SEQ ID NO: 1738054 - RNA, 20 nt, Salmonella enterica enterica serovar Typhi Ty2
uaccuauuuguuccggcaag

SEQ ID NO: 1738055 - RNA, 19 nt, Salmonella enterica enterica serovar Typhi Ty2
uccuguacaaaaucaucau

SEQ ID NO: 1738056 - RNA, 23 nt, Salmonella enterica enterica serovar Typhi Ty2
uccuggguauuuuuuagcgccaa

SEQ ID NO: 1738057 - RNA, 13 nt, Salmonella enterica enterica serovar Typhi Ty2
uccuggcuucaac

SEQ ID NO: 1738058 - RNA, 18 nt, Salmonella enterica enterica serovar Typhi Ty2
uccuuauaaugcuuacgg

SEQ ID NO: 1738059 - RNA, 21 nt, Salmonella enterica enterica serovar Typhi Ty2
uccuugcggugagaaacgcgc

SEQ ID NO: 1738060 - RNA, 20 nt, Salmonella enterica enterica serovar Typhi Ty2
ucgaacagguuguugauguu

SEQ ID NO: 1738061 - RNA, 19 nt, Salmonella enterica enterica serovar Typhi Ty2
uccucgcgaaucucaaugc

SEQ ID NO: 1738062 - RNA, 19 nt, Salmonella enterica enterica serovar Typhi Ty2
uccucuuuucgaacgccga

SEQ ID NO: 1738063 - RNA, 17 nt, Salmonella enterica enterica serovar Typhi Ty2
uccucuuuucgaacgcc

SEQ ID NO: 1738064 - RNA, 19 nt, Salmonella enterica enterica serovar Typhi Ty2
uccugcgguacggccagcg

SEQ ID NO: 1738065 - RNA, 21 nt, Salmonella enterica enterica serovar Typhi Ty2
uccugcggccuugccgccagc

SEQ ID NO: 1738066 - RNA, 21 nt, Salmonella enterica enterica serovar Typhi Ty2
uccugcuugcgguuacgcagc

SEQ ID NO: 1738067 - RNA, 11 nt, Salmonella enterica enterica serovar Typhi Ty2
uccugccagac

SEQ ID NO: 1738068 - RNA, 14 nt, Salmonella enterica enterica serovar Typhi Ty2
uccugcgccagccg

SEQ ID NO: 1738069 - RNA, 18 nt, Salmonella enterica enterica serovar Typhi Ty2
uccugcgccggacgccac

SEQ ID NO: 1738070 - RNA, 18 nt, Salmonella enterica enterica serovar Typhi Ty2
uccugcgcugucaccagc

SEQ ID NO: 1738071 - RNA, 15 nt, Salmonella enterica enterica serovar Typhi Ty2
uccugauccggcugu

SEQ ID NO: 1738072 - RNA, 17 nt, Salmonella enterica enterica serovar Typhi Ty2
uccugauauucccguuc

SEQ ID NO: 1738073 - RNA, 24 nt, Salmonella enterica enterica serovar Typhi Ty2
uccugcauaauccaacgaaacgca

SEQ ID NO: 1738074 - RNA, 19 nt, Salmonella enterica enterica serovar Typhi Ty2
ucgacagagaauuucaccg

SEQ ID NO: 1738075 - RNA, 17 nt, Salmonella enterica enterica serovar Typhi Ty2
ucgacaguucccggcaa

SEQ ID NO: 1738076 - RNA, 21 nt, Salmonella enterica enterica serovar Typhi Ty2
ucgaaugaggacggcccgcug

SEQ ID NO: 1738077 - RNA, 16 nt, Salmonella enterica enterica serovar Typhi Ty2
ucgacaauguccgcca

SEQ ID NO: 1738078 - RNA, 15 nt, Salmonella enterica enterica serovar Typhi Ty2
ucgacaauccgccac

SEQ ID NO: 1738079 - RNA, 22 nt, Salmonella enterica enterica serovar Typhi Ty2
ucgacaagcuaauccccagcgc

SEQ ID NO: 1738080 - RNA, 19 nt, Salmonella enterica enterica serovar Typhi Ty2
ucgaacgccgccugcgcca

SEQ ID NO: 1738081 - RNA, 19 nt, Salmonella enterica enterica serovar Typhi Ty2
ucgacauuagcaucccgca

SEQ ID NO: 1738082 - RNA, 13 nt, Salmonella enterica enterica serovar Typhi Ty2
ucgacaucuucau

SEQ ID NO: 1738083 - RNA, 20 nt, Salmonella enterica enterica serovar Typhi Ty2
ucgacauuaacaaugccuua

SEQ ID NO: 1738084 - RNA, 17 nt, Salmonella enterica enterica serovar Typhi Ty2
uccggugaagguaauuu

SEQ ID NO: 1738085 - RNA, 16 nt, Salmonella enterica enterica serovar Typhi Ty2
uccggugugaccagcg

SEQ ID NO: 1738086 - RNA, 22 nt, Salmonella enterica enterica serovar Typhi Ty2
uccgguggcgcaguauggcgac

SEQ ID NO: 1738087 - RNA, 17 nt, Salmonella enterica enterica serovar Typhi Ty2
uccgugccgccgcgaaa

SEQ ID NO: 1738088 - RNA, 16 nt, Salmonella enterica enterica serovar Typhi Ty2
uccguugugaacagcg

SEQ ID NO: 1738089 - RNA, 14 nt, Salmonella enterica enterica serovar Typhi Ty2
uccucccaucgagc

SEQ ID NO: 1738090 - RNA, 15 nt, Salmonella enterica enterica serovar Typhi Ty2
uccgguagcgccugu

SEQ ID NO: 1738091 - RNA, 18 nt, Salmonella enterica enterica serovar Typhi Ty2
uccgguaucaugcugaug

SEQ ID NO: 1738092 - RNA, 16 nt, Salmonella enterica enterica serovar Typhi Ty2
uccggcgcuuccugca

SEQ ID NO: 1738093 - RNA, 16 nt, Salmonella enterica enterica serovar Typhi Ty2
uccggcucgccguguc

SEQ ID NO: 1738094 - RNA, 22 nt, Salmonella enterica enterica serovar Typhi Ty2
uccggcuuaaugcauggcagau

SEQ ID NO: 1738095 - RNA, 19 nt, Salmonella enterica enterica serovar Typhi Ty2
uccggcuuauccggccugc

SEQ ID NO: 1738096 - RNA, 17 nt, Salmonella enterica enterica serovar Typhi Ty2
uccggcccgugccagcu

SEQ ID NO: 1738097 - RNA, 20 nt, Salmonella enterica enterica serovar Typhi Ty2
uccggcgcgaucaucgcauu

SEQ ID NO: 1738098 - RNA, 19 nt, Salmonella enterica enterica serovar Typhi Ty2
uccggcgcggcgcgcaugc

SEQ ID NO: 1738099 - RNA, 15 nt, Salmonella enterica enterica serovar Typhi Ty2
uccgcuguuaugcac

SEQ ID NO: 1738100 - RNA, 18 nt, Salmonella enterica enterica serovar Typhi Ty2
uccgcgcaaauacugaaa

SEQ ID NO: 1738101 - RNA, 19 nt, Salmonella enterica enterica serovar Typhi Ty2
uccgcuuuuccugccagca

SEQ ID NO: 1738102 - RNA, 20 nt, Salmonella enterica enterica serovar Typhi Ty2
uccgcuucaccuuucgccgc

SEQ ID NO: 1738103 - RNA, 15 nt, Salmonella enterica enterica serovar Typhi Ty2
uccgcuuuuccugcc

SEQ ID NO: 1738104 - RNA, 19 nt, Salmonella enterica enterica serovar Typhi Ty2
uccggcaucucaaggucug

SEQ ID NO: 1738105 - RNA, 16 nt, Salmonella enterica enterica serovar Typhi Ty2
uccggccagcgccagc

SEQ ID NO: 1738106 - RNA, 18 nt, Salmonella enterica enterica serovar Typhi Ty2
uccggcacgccaucgccu

SEQ ID NO: 1738107 - RNA, 21 nt, Salmonella enterica enterica serovar Typhi Ty2
uccaugaugaagauauucacu

SEQ ID NO: 1738108 - RNA, 21 nt, Salmonella enterica enterica serovar Typhi Ty2
uccaugccggcuuuccgcacc

SEQ ID NO: 1738109 - RNA, 20 nt, Salmonella enterica enterica serovar Typhi Ty2
uccauggcaaaauucguauu

SEQ ID NO: 1738110 - RNA, 20 nt, Salmonella enterica enterica serovar Typhi Ty2
ucccgcacgcgacgcgccag

SEQ ID NO: 1738111 - RNA, 20 nt, Salmonella enterica enterica serovar Typhi Ty2
ucccgcaaaaugaggacaca

SEQ ID NO: 1738112 - RNA, 13 nt, Salmonella enterica enterica serovar Typhi Ty2
ucccgcccgcgua

SEQ ID NO: 1738113 - RNA, 15 nt, Salmonella enterica enterica serovar Typhi Ty2
ucccgccgguucaau

SEQ ID NO: 1738114 - RNA, 17 nt, Salmonella enterica enterica serovar Typhi Ty2
ucccguuucagccccuu

SEQ ID NO: 1738115 - RNA, 18 nt, Salmonella enterica enterica serovar Typhi Ty2
ucccguuccagcuugaau

SEQ ID NO: 1738116 - RNA, 22 nt, Salmonella enterica enterica serovar Typhi Ty2
ucccgucccaccacgcagccau

SEQ ID NO: 1738117 - RNA, 20 nt, Salmonella enterica enterica serovar Typhi Ty2
ucccgcgcagugcagcggau

SEQ ID NO: 1738118 - RNA, 19 nt, Salmonella enterica enterica serovar Typhi Ty2
ucccgccuugcggcgccag

SEQ ID NO: 1738119 - RNA, 17 nt, Salmonella enterica enterica serovar Typhi Ty2
ucccgccaucguccagc

SEQ ID NO: 1738120 - RNA, 12 nt, Salmonella enterica enterica serovar Typhi Ty2
ucccggcgugug

SEQ ID NO: 1738121 - RNA, 18 nt, Salmonella enterica enterica serovar Typhi Ty2
ucccggcguagcgcguuc

SEQ ID NO: 1738122 - RNA, 15 nt, Salmonella enterica enterica serovar Typhi Ty2
ucccguagcgucaac

SEQ ID NO: 1738123 - RNA, 21 nt, Salmonella enterica enterica serovar Typhi Ty2
ucccggcgccgaucaucccgc

SEQ ID NO: 1738124 - RNA, 22 nt, Salmonella enterica enterica serovar Typhi Ty2
ucccggcgccaaucaccgccag

SEQ ID NO: 1738125 - RNA, 16 nt, Salmonella enterica enterica serovar Typhi Ty2
uccgccgccgccaucg

SEQ ID NO: 1738126 - RNA, 16 nt, Salmonella enterica enterica serovar Typhi Ty2
uccgccgcaauagcca

SEQ ID NO: 1738127 - RNA, 15 nt, Salmonella enterica enterica serovar Typhi Ty2
uccgccuuugacgcc

SEQ ID NO: 1738128 - RNA, 14 nt, Salmonella enterica enterica serovar Typhi Ty2
uccgccugcugcgc

SEQ ID NO: 1738129 - RNA, 15 nt, Salmonella enterica enterica serovar Typhi Ty2
uccgcauagcgcaac

SEQ ID NO: 1738130 - RNA, 15 nt, Salmonella enterica enterica serovar Typhi Ty2
uccgcaggagagcca

SEQ ID NO: 1738131 - RNA, 22 nt, Salmonella enterica enterica serovar Typhi Ty2
uccgcagauccagcacggccuu

SEQ ID NO: 1738132 - RNA, 20 nt, Salmonella enterica enterica serovar Typhi Ty2
uccgaaacaaucaccugaug

SEQ ID NO: 1738133 - RNA, 15 nt, Salmonella enterica enterica serovar Typhi Ty2
uccagguuaacccac

SEQ ID NO: 1738134 - RNA, 16 nt, Salmonella enterica enterica serovar Typhi Ty2
uccaggugucacucau

SEQ ID NO: 1738135 - RNA, 22 nt, Salmonella enterica enterica serovar Typhi Ty2
uccaucggcccacgcgcagaga

SEQ ID NO: 1738136 - RNA, 22 nt, Salmonella enterica enterica serovar Typhi Ty2
uccaggcgaccagaugcagcaa

SEQ ID NO: 1738137 - RNA, 15 nt, Salmonella enterica enterica serovar Typhi Ty2
uccagcgggccgacg

SEQ ID NO: 1738138 - RNA, 16 nt, Salmonella enterica enterica serovar Typhi Ty2
uccagcgggccgacga

SEQ ID NO: 1738139 - RNA, 22 nt, Salmonella enterica enterica serovar Typhi Ty2
uccagcaguucuacgcugccau

SEQ ID NO: 1738140 - RNA, 22 nt, Salmonella enterica enterica serovar Typhi Ty2
uccagcccgccaauauccggca

SEQ ID NO: 1738141 - RNA, 21 nt, Salmonella enterica enterica serovar Typhi Ty2
uccaccguaugugcgccgugc

SEQ ID NO: 1738142 - RNA, 23 nt, Salmonella enterica enterica serovar Typhi Ty2
uccacgccgucgaugauggcggc

SEQ ID NO: 1738143 - RNA, 23 nt, Salmonella enterica enterica serovar Typhi Ty2
uccacauaggcguugauggcgua

SEQ ID NO: 1738144 - RNA, 12 nt, Salmonella enterica enterica serovar Typhi Ty2
uccacauccagc

SEQ ID NO: 1738145 - RNA, 15 nt, Salmonella enterica enterica serovar Typhi Ty2
uccacaaucccggca

SEQ ID NO: 1738146 - RNA, 20 nt, Salmonella enterica enterica serovar Typhi Ty2
uccacgcuauaaaguagcca

SEQ ID NO: 1738147 - RNA, 14 nt, Salmonella enterica enterica serovar Typhi Ty2
uccacgcgcaccau

SEQ ID NO: 1738148 - RNA, 17 nt, Salmonella enterica enterica serovar Typhi Ty2
uccagcacauccucaau

SEQ ID NO: 1738149 - RNA, 13 nt, Salmonella enterica enterica serovar Typhi Ty2
uccagaucgccac

SEQ ID NO: 1738150 - RNA, 19 nt, Salmonella enterica enterica serovar Typhi Ty2
uccacuuuugucggccugu

SEQ ID NO: 1738151 - RNA, 18 nt, Salmonella enterica enterica serovar Typhi Ty2
uccacucggcgcugucgu

SEQ ID NO: 1738152 - RNA, 15 nt, Salmonella enterica enterica serovar Typhi Ty2
ucaggccugccugau

SEQ ID NO: 1738153 - RNA, 17 nt, Salmonella enterica enterica serovar Typhi Ty2
ucaggccuacauccggc

SEQ ID NO: 1738154 - RNA, 16 nt, Salmonella enterica enterica serovar Typhi Ty2
ucaggcgaucccggcc

SEQ ID NO: 1738155 - RNA, 18 nt, Salmonella enterica enterica serovar Typhi Ty2
ucaggguuuucuaccgca

SEQ ID NO: 1738156 - RNA, 15 nt, Salmonella enterica enterica serovar Typhi Ty2
ucaucauaauucagc

SEQ ID NO: 1738157 - RNA, 21 nt, Salmonella enterica enterica serovar Typhi Ty2
ucaucagggcguaagcgcguu

SEQ ID NO: 1738158 - RNA, 18 nt, Salmonella enterica enterica serovar Typhi Ty2
ucaucaguuugcgauaag

SEQ ID NO: 1738159 - RNA, 14 nt, Salmonella enterica enterica serovar Typhi Ty2
ucaucagccgacca

SEQ ID NO: 1738160 - RNA, 13 nt, Salmonella enterica enterica serovar Typhi Ty2
ucaucaguaacug

SEQ ID NO: 1738161 - RNA, 10 nt, Salmonella enterica enterica serovar Typhi Ty2
ucaucagcac

SEQ ID NO: 1738162 - RNA, 13 nt, Salmonella enterica enterica serovar Typhi Ty2
ucauaauaagcgc

SEQ ID NO: 1738163 - RNA, 17 nt, Salmonella enterica enterica serovar Typhi Ty2
ucauaaaugcugucgcc

SEQ ID NO: 1738164 - RNA, 14 nt, Salmonella enterica enterica serovar Typhi Ty2
ucauaacaccaaua

SEQ ID NO: 1738165 - RNA, 21 nt, Salmonella enterica enterica serovar Typhi Ty2
ucauaacgccgaugccgccga

SEQ ID NO: 1738166 - RNA, 21 nt, Salmonella enterica enterica serovar Typhi Ty2
ucaguucggagaucagcggau

SEQ ID NO: 1738167 - RNA, 17 nt, Salmonella enterica enterica serovar Typhi Ty2
ucaguucggcgcgccag

SEQ ID NO: 1738168 - RNA, 16 nt, Salmonella enterica enterica serovar Typhi Ty2
ucaguucauagccgug

SEQ ID NO: 1738169 - RNA, 14 nt, Salmonella enterica enterica serovar Typhi Ty2
ucaucguaccaaua

SEQ ID NO: 1738170 - RNA, 23 nt, Salmonella enterica enterica serovar Typhi Ty2
ucaugaaugccccagcgcugcug

SEQ ID NO: 1738171 - RNA, 14 nt, Salmonella enterica enterica serovar Typhi Ty2
ucaugaaccacgcc

SEQ ID NO: 1738172 - RNA, 20 nt, Salmonella enterica enterica serovar Typhi Ty2
ucaugagucgcgcgcgccag

SEQ ID NO: 1738173 - RNA, 17 nt, Salmonella enterica enterica serovar Typhi Ty2
ucaugauacccagcguc

SEQ ID NO: 1738174 - RNA, 23 nt, Salmonella enterica enterica serovar Typhi Ty2
ucaugauuucuugagcggcauca

SEQ ID NO: 1738175 - RNA, 12 nt, Salmonella enterica enterica serovar Typhi Ty2
ucaucgcgcuga

SEQ ID NO: 1738176 - RNA, 16 nt, Salmonella enterica enterica serovar Typhi Ty2
ucauccacagcgccag

SEQ ID NO: 1738177 - RNA, 14 nt, Salmonella enterica enterica serovar Typhi Ty2
ucaucggccagaua

SEQ ID NO: 1738178 - RNA, 13 nt, Salmonella enterica enterica serovar Typhi Ty2
ucauucagcaacu

SEQ ID NO: 1738179 - RNA, 19 nt, Salmonella enterica enterica serovar Typhi Ty2
ucauuauucaggccuccug

SEQ ID NO: 1738180 - RNA, 14 nt, Salmonella enterica enterica serovar Typhi Ty2
ucauuaucaauagc

SEQ ID NO: 1738181 - RNA, 14 nt, Salmonella enterica enterica serovar Typhi Ty2
ucauucccauacug

SEQ ID NO: 1738182 - RNA, 15 nt, Salmonella enterica enterica serovar Typhi Ty2
uccaacagcgacgcc

SEQ ID NO: 1738183 - RNA, 14 nt, Salmonella enterica enterica serovar Typhi Ty2
ucaccuguggcaga

SEQ ID NO: 1738184 - RNA, 23 nt, Salmonella enterica enterica serovar Typhi Ty2
ucacgaccggcgaacguuggcug

SEQ ID NO: 1738185 - RNA, 19 nt, Salmonella enterica enterica serovar Typhi Ty2
ucacgauaguuugccagag

SEQ ID NO: 1738186 - RNA, 12 nt, Salmonella enterica enterica serovar Typhi Ty2
ucacgaucgcgg

SEQ ID NO: 1738187 - RNA, 18 nt, Salmonella enterica enterica serovar Typhi Ty2
ucacgaucgagucaggcg

SEQ ID NO: 1738188 - RNA, 19 nt, Salmonella enterica enterica serovar Typhi Ty2
uauuugguaccgccaucgg

SEQ ID NO: 1738189 - RNA, 17 nt, Salmonella enterica enterica serovar Typhi Ty2
uauuucuaucgcuaucg

SEQ ID NO: 1738190 - RNA, 13 nt, Salmonella enterica enterica serovar Typhi Ty2
uauuuaacgccag

SEQ ID NO: 1738191 - RNA, 19 nt, Salmonella enterica enterica serovar Typhi Ty2
ucacggagagucgcaccgc

SEQ ID NO: 1738192 - RNA, 16 nt, Salmonella enterica enterica serovar Typhi Ty2
ucacggcacgcccuuc

SEQ ID NO: 1738193 - RNA, 16 nt, Salmonella enterica enterica serovar Typhi Ty2
ucacggauccagaacu

SEQ ID NO: 1738194 - RNA, 19 nt, Salmonella enterica enterica serovar Typhi Ty2
ucacguccugguuaccgcg

SEQ ID NO: 1738195 - RNA, 22 nt, Salmonella enterica enterica serovar Typhi Ty2
ucacgcccgccgaaggcaacgc

SEQ ID NO: 1738196 - RNA, 17 nt, Salmonella enterica enterica serovar Typhi Ty2
ucacgcucgcggaagcg

SEQ ID NO: 1738197 - RNA, 14 nt, Salmonella enterica enterica serovar Typhi Ty2
ucacgccaucaggg

SEQ ID NO: 1738198 - RNA, 18 nt, Salmonella enterica enterica serovar Typhi Ty2
ucacuguuaucgccauua

SEQ ID NO: 1738199 - RNA, 18 nt, Salmonella enterica enterica serovar Typhi Ty2
ucacugccgacgcccuca

SEQ ID NO: 1738200 - RNA, 19 nt, Salmonella enterica enterica serovar Typhi Ty2
ucagaccagucggacagcg

SEQ ID NO: 1738201 - RNA, 16 nt, Salmonella enterica enterica serovar Typhi Ty2
ucacuuuccgaaucag

SEQ ID NO: 1738202 - RNA, 19 nt, Salmonella enterica enterica serovar Typhi Ty2
ucacuuuccgaaucaggcg

SEQ ID NO: 1738203 - RNA, 18 nt, Salmonella enterica enterica serovar Typhi Ty2
ucagacguagcgccauca

SEQ ID NO: 1738204 - RNA, 15 nt, Salmonella enterica enterica serovar Typhi Ty2
ucagacggcuccagc

SEQ ID NO: 1738205 - RNA, 15 nt, Salmonella enterica enterica serovar Typhi Ty2
ucagacgcaucagga

SEQ ID NO: 1738206 - RNA, 18 nt, Salmonella enterica enterica serovar Typhi Ty2
ucagaccgccaagcgcgg

SEQ ID NO: 1738207 - RNA, 16 nt, Salmonella enterica enterica serovar Typhi Ty2
ucagacgaccauccac

SEQ ID NO: 1738208 - RNA, 17 nt, Salmonella enterica enterica serovar Typhi Ty2
ucagcaaaauaccggca

SEQ ID NO: 1738209 - RNA, 17 nt, Salmonella enterica enterica serovar Typhi Ty2
ucagcaaaauggcaauu

SEQ ID NO: 1738210 - RNA, 13 nt, Salmonella enterica enterica serovar Typhi Ty2
ucagcgcggcaag

SEQ ID NO: 1738211 - RNA, 19 nt, Salmonella enterica enterica serovar Typhi Ty2
ucagcgcgccgcgcagcau

SEQ ID NO: 1738212 - RNA, 18 nt, Salmonella enterica enterica serovar Typhi Ty2
ucagccagcguaccagcg

SEQ ID NO: 1738213 - RNA, 19 nt, Salmonella enterica enterica serovar Typhi Ty2
ucagccacuucuuccagcg

SEQ ID NO: 1738214 - RNA, 18 nt, Salmonella enterica enterica serovar Typhi Ty2
ucagccacuucuuccagc

SEQ ID NO: 1738215 - RNA, 19 nt, Salmonella enterica enterica serovar Typhi Ty2
ucagccacgguucacggcc

SEQ ID NO: 1738216 - RNA, 14 nt, Salmonella enterica enterica serovar Typhi Ty2
ucagcgaugacgcc

SEQ ID NO: 1738217 - RNA, 21 nt, Salmonella enterica enterica serovar Typhi Ty2
ucagcguaauuaagccgggua

SEQ ID NO: 1738218 - RNA, 23 nt, Salmonella enterica enterica serovar Typhi Ty2
ucagcgguccaauaaacgccagg

SEQ ID NO: 1738219 - RNA, 16 nt, Salmonella enterica enterica serovar Typhi Ty2
ucagcucgauccggca

SEQ ID NO: 1738220 - RNA, 20 nt, Salmonella enterica enterica serovar Typhi Ty2
ucagcucgcugccgaucaga

SEQ ID NO: 1738221 - RNA, 17 nt, Salmonella enterica enterica serovar Typhi Ty2
ucagcucacgcgccagc

SEQ ID NO: 1738222 - RNA, 19 nt, Salmonella enterica enterica serovar Typhi Ty2
ucagcuaaaaacagcgcaa

SEQ ID NO: 1738223 - RNA, 20 nt, Salmonella enterica enterica serovar Typhi Ty2
ucagcuaaaaacagcgcaau

SEQ ID NO: 1738224 - RNA, 19 nt, Salmonella enterica enterica serovar Typhi Ty2
ucaggcaguuuauccggcg

SEQ ID NO: 1738225 - RNA, 22 nt, Salmonella enterica enterica serovar Typhi Ty2
ucaggcaauaaacaucagccau

SEQ ID NO: 1738226 - RNA, 18 nt, Salmonella enterica enterica serovar Typhi Ty2
ucaggccgccgcacaggc

SEQ ID NO: 1738227 - RNA, 18 nt, Salmonella enterica enterica serovar Typhi Ty2
ucaggauaaaauccugca

SEQ ID NO: 1738228 - RNA, 18 nt, Salmonella enterica enterica serovar Typhi Ty2
ucaggaucaaaaucgcgc

SEQ ID NO: 1738229 - RNA, 16 nt, Salmonella enterica enterica serovar Typhi Ty2
ugcucaaaggcgcuga

SEQ ID NO: 1738230 - RNA, 16 nt, Salmonella enterica enterica serovar Typhi Ty2
ugcuauccgccgccag

SEQ ID NO: 1738231 - RNA, 18 nt, Salmonella enterica enterica serovar Typhi Ty2
ugcucaugcgagguauac

SEQ ID NO: 1738232 - RNA, 17 nt, Salmonella enterica enterica serovar Typhi Ty2
ugcucaauaagccaugu

SEQ ID NO: 1738233 - RNA, 13 nt, Salmonella enterica enterica serovar Typhi Ty2
ugcuccggcuuaa

SEQ ID NO: 1738234 - RNA, 19 nt, Salmonella enterica enterica serovar Typhi Ty2
ugcuccauugcagcguggu

SEQ ID NO: 1738235 - RNA, 17 nt, Salmonella enterica enterica serovar Typhi Ty2
ugcuccugcggcgugga

SEQ ID NO: 1738236 - RNA, 21 nt, Salmonella enterica enterica serovar Typhi Ty2
ugcgguggccgacuuaucgac

SEQ ID NO: 1738237 - RNA, 13 nt, Salmonella enterica enterica serovar Typhi Ty2
ugcgucaguaccu

SEQ ID NO: 1738238 - RNA, 17 nt, Salmonella enterica enterica serovar Typhi Ty2
ugcgucaggcgauagcc

SEQ ID NO: 1738239 - RNA, 20 nt, Salmonella enterica enterica serovar Typhi Ty2
ugcguaggggcgaccgggcg

SEQ ID NO: 1738240 - RNA, 16 nt, Salmonella enterica enterica serovar Typhi Ty2
ugcguaaaaucgcagu

SEQ ID NO: 1738241 - RNA, 20 nt, Salmonella enterica enterica serovar Typhi Ty2
ugcguagaucauuuacggcg

SEQ ID NO: 1738242 - RNA, 23 nt, Salmonella enterica enterica serovar Typhi Ty2
ugcgguuuacgccaugcaucaau

SEQ ID NO: 1738243 - RNA, 20 nt, Salmonella enterica enterica serovar Typhi Ty2
ugcgucgcguaccagcgccc

SEQ ID NO: 1738244 - RNA, 17 nt, Salmonella enterica enterica serovar Typhi Ty2
ugcgucgccccaaucgc

SEQ ID NO: 1738245 - RNA, 19 nt, Salmonella enterica enterica serovar Typhi Ty2
ugcguuaacccgcuuacaa

SEQ ID NO: 1738246 - RNA, 14 nt, Salmonella enterica enterica serovar Typhi Ty2
ugcgugucaucaaa

SEQ ID NO: 1738247 - RNA, 16 nt, Salmonella enterica enterica serovar Typhi Ty2
ugcucuucguggaacu

SEQ ID NO: 1738248 - RNA, 20 nt, Salmonella enterica enterica serovar Typhi Ty2
ugcucuccacgccgcaagga

SEQ ID NO: 1738249 - RNA, 17 nt, Salmonella enterica enterica serovar Typhi Ty2
ugcugcucgcuaugaaa

SEQ ID NO: 1738250 - RNA, 13 nt, Salmonella enterica enterica serovar Typhi Ty2
ugcugauccugua

SEQ ID NO: 1738251 - RNA, 16 nt, Salmonella enterica enterica serovar Typhi Ty2
ugcugcaacgacgcgg

SEQ ID NO: 1738252 - RNA, 14 nt, Salmonella enterica enterica serovar Typhi Ty2
ugcugccagcgccg

SEQ ID NO: 1738253 - RNA, 20 nt, Salmonella enterica enterica serovar Typhi Ty2
ugcuggcgaaccaccagccg

SEQ ID NO: 1738254 - RNA, 22 nt, Salmonella enterica enterica serovar Typhi Ty2
ugcuguggauuuauggcgucac

SEQ ID NO: 1738255 - RNA, 15 nt, Salmonella enterica enterica serovar Typhi Ty2
ugcugguugucucaa

SEQ ID NO: 1738256 - RNA, 13 nt, Salmonella enterica enterica serovar Typhi Ty2
ugcuggcggccgu

SEQ ID NO: 1738257 - RNA, 14 nt, Salmonella enterica enterica serovar Typhi Ty2
ugcuggugcaucug

SEQ ID NO: 1738258 - RNA, 20 nt, Salmonella enterica enterica serovar Typhi Ty2
ugcuuaccuuguucuuccau

SEQ ID NO: 1738259 - RNA, 21 nt, Salmonella enterica enterica serovar Typhi Ty2
ugcuuaauauccaguugcgcc

SEQ ID NO: 1738260 - RNA, 20 nt, Salmonella enterica enterica serovar Typhi Ty2
ugcgcaacguuucuuucauc

SEQ ID NO: 1738261 - RNA, 13 nt, Salmonella enterica enterica serovar Typhi Ty2
ugcgcacgccagc

SEQ ID NO: 1738262 - RNA, 22 nt, Salmonella enterica enterica serovar Typhi Ty2
ugcgcacgccagcggucgcgga

SEQ ID NO: 1738263 - RNA, 18 nt, Salmonella enterica enterica serovar Typhi Ty2
ugcgauagcccggcaugu

SEQ ID NO: 1738264 - RNA, 21 nt, Salmonella enterica enterica serovar Typhi Ty2
ugcgcaacaugccugauggcg

SEQ ID NO: 1738265 - RNA, 23 nt, Salmonella enterica enterica serovar Typhi Ty2
ugcgaagcgcccggaaagugggc

SEQ ID NO: 1738266 - RNA, 13 nt, Salmonella enterica enterica serovar Typhi Ty2
ugcgccacggaug

SEQ ID NO: 1738267 - RNA, 13 nt, Salmonella enterica enterica serovar Typhi Ty2
ugcgccaccagcg

SEQ ID NO: 1738268 - RNA, 16 nt, Salmonella enterica enterica serovar Typhi Ty2
ugcgcauuaacgccau

SEQ ID NO: 1738269 - RNA, 19 nt, Salmonella enterica enterica serovar Typhi Ty2
ugcgcaugugagcaucggc

SEQ ID NO: 1738270 - RNA, 20 nt, Salmonella enterica enterica serovar Typhi Ty2
ugcgcagcaugaucggcugg

SEQ ID NO: 1738271 - RNA, 18 nt, Salmonella enterica enterica serovar Typhi Ty2
ugcgccauccaccaggca

SEQ ID NO: 1738272 - RNA, 15 nt, Salmonella enterica enterica serovar Typhi Ty2
ugcgcccaucaucau

SEQ ID NO: 1738273 - RNA, 20 nt, Salmonella enterica enterica serovar Typhi Ty2
ugcgccacguucggcgugua

SEQ ID NO: 1738274 - RNA, 19 nt, Salmonella enterica enterica serovar Typhi Ty2
ugcgccaucauccggcaac

SEQ ID NO: 1738275 - RNA, 16 nt, Salmonella enterica enterica serovar Typhi Ty2
ugcgccaucauccggc

SEQ ID NO: 1738276 - RNA, 17 nt, Salmonella enterica enterica serovar Typhi Ty2
ugccuuuuuuaccaauu

SEQ ID NO: 1738277 - RNA, 20 nt, Salmonella enterica enterica serovar Typhi Ty2
ugcgaacagcgcuccacgcg

SEQ ID NO: 1738278 - RNA, 19 nt, Salmonella enterica enterica serovar Typhi Ty2
ugcgaaagccucuuccgcc

SEQ ID NO: 1738279 - RNA, 10 nt, Salmonella enterica enterica serovar Typhi Ty2
ugccuucgau

SEQ ID NO: 1738280 - RNA, 17 nt, Salmonella enterica enterica serovar Typhi Ty2
ugccuuccaggcgguga

SEQ ID NO: 1738281 - RNA, 18 nt, Salmonella enterica enterica serovar Typhi Ty2
ugccuguuuacggcaggc

SEQ ID NO: 1738282 - RNA, 19 nt, Salmonella enterica enterica serovar Typhi Ty2
ugccguuuuucucaucaag

SEQ ID NO: 1738283 - RNA, 16 nt, Salmonella enterica enterica serovar Typhi Ty2
ugccguuuaugcagga

SEQ ID NO: 1738284 - RNA, 15 nt, Salmonella enterica enterica serovar Typhi Ty2
ugcgguaccgcguua

SEQ ID NO: 1738285 - RNA, 18 nt, Salmonella enterica enterica serovar Typhi Ty2
ugcggccgaugccguaag

SEQ ID NO: 1738286 - RNA, 22 nt, Salmonella enterica enterica serovar Typhi Ty2
ugcggcgaaacagaguaacccg

SEQ ID NO: 1738287 - RNA, 20 nt, Salmonella enterica enterica serovar Typhi Ty2
ugcgcuuaccgggccuacaa

SEQ ID NO: 1738288 - RNA, 13 nt, Salmonella enterica enterica serovar Typhi Ty2
ugcgcuucggcga

SEQ ID NO: 1738289 - RNA, 22 nt, Salmonella enterica enterica serovar Typhi Ty2
ugcgccccgcaacgccgauaag

SEQ ID NO: 1738290 - RNA, 14 nt, Salmonella enterica enterica serovar Typhi Ty2
ugcgcgauaucugc

SEQ ID NO: 1738291 - RNA, 20 nt, Salmonella enterica enterica serovar Typhi Ty2
ugcgcuuaccgggccuacag

SEQ ID NO: 1738292 - RNA, 20 nt, Salmonella enterica enterica serovar Typhi Ty2
ugcgcuuaucaggccuacaa

SEQ ID NO: 1738293 - RNA, 19 nt, Salmonella enterica enterica serovar Typhi Ty2
ugcgcuuauccggccuacg

SEQ ID NO: 1738294 - RNA, 17 nt, Salmonella enterica enterica serovar Typhi Ty2
ugcgcucucauagccga

SEQ ID NO: 1738295 - RNA, 22 nt, Salmonella enterica enterica serovar Typhi Ty2
ugcgcgccgggcuucauaccgu

SEQ ID NO: 1738296 - RNA, 22 nt, Salmonella enterica enterica serovar Typhi Ty2
ugccgaccagcgguugcauaaa

SEQ ID NO: 1738297 - RNA, 19 nt, Salmonella enterica enterica serovar Typhi Ty2
ugccauauuuuuccagcgc

SEQ ID NO: 1738298 - RNA, 21 nt, Salmonella enterica enterica serovar Typhi Ty2
ugccaucaggcaguuuauccg

SEQ ID NO: 1738299 - RNA, 19 nt, Salmonella enterica enterica serovar Typhi Ty2
ugccaucgacgcgcaucac

SEQ ID NO: 1738300 - RNA, 12 nt, Salmonella enterica enterica serovar Typhi Ty2
ugccaucgacgc

SEQ ID NO: 1738301 - RNA, 19 nt, Salmonella enterica enterica serovar Typhi Ty2
ugccaucggccagcaggcg

SEQ ID NO: 1738302 - RNA, 16 nt, Salmonella enterica enterica serovar Typhi Ty2
ugccauucgcccaguc

SEQ ID NO: 1738303 - RNA, 18 nt, Salmonella enterica enterica serovar Typhi Ty2
ugccauuguuccggcgac

SEQ ID NO: 1738304 - RNA, 20 nt, Salmonella enterica enterica serovar Typhi Ty2
ugcccuucuuuaauacgcgu

SEQ ID NO: 1738305 - RNA, 16 nt, Salmonella enterica enterica serovar Typhi Ty2
ugcagcaagcggcugu

SEQ ID NO: 1738306 - RNA, 15 nt, Salmonella enterica enterica serovar Typhi Ty2
ugcagauuaugccgu

SEQ ID NO: 1738307 - RNA, 18 nt, Salmonella enterica enterica serovar Typhi Ty2
ugcagcgucaggaacgcg

SEQ ID NO: 1738308 - RNA, 22 nt, Salmonella enterica enterica serovar Typhi Ty2
ugcaggcucccuuauacaggcg

SEQ ID NO: 1738309 - RNA, 22 nt, Salmonella enterica enterica serovar Typhi Ty2
ugcagggauaugcugaucuggc

SEQ ID NO: 1738310 - RNA, 18 nt, Salmonella enterica enterica serovar Typhi Ty2
ugcaggcaggucuccagc

SEQ ID NO: 1738311 - RNA, 22 nt, Salmonella enterica enterica serovar Typhi Ty2
ugcaggaugucgauaauacagc

SEQ ID NO: 1738312 - RNA, 17 nt, Salmonella enterica enterica serovar Typhi Ty2
ugccauacacgcggcga

SEQ ID NO: 1738313 - RNA, 17 nt, Salmonella enterica enterica serovar Typhi Ty2
ugccauacuccugccug

SEQ ID NO: 1738314 - RNA, 14 nt, Salmonella enterica enterica serovar Typhi Ty2
ugccacuacgcagc

SEQ ID NO: 1738315 - RNA, 19 nt, Salmonella enterica enterica serovar Typhi Ty2
ugccaggcgcuaucuucaa

SEQ ID NO: 1738316 - RNA, 16 nt, Salmonella enterica enterica serovar Typhi Ty2
ugccagcucaaaugac

SEQ ID NO: 1738317 - RNA, 18 nt, Salmonella enterica enterica serovar Typhi Ty2
ugcaugggauacgccagc

SEQ ID NO: 1738318 - RNA, 18 nt, Salmonella enterica enterica serovar Typhi Ty2
ugauauccacgcgcacca

SEQ ID NO: 1738319 - RNA, 14 nt, Salmonella enterica enterica serovar Typhi Ty2
ugauauggaaagug

SEQ ID NO: 1738320 - RNA, 19 nt, Salmonella enterica enterica serovar Typhi Ty2
ugauauucuuugguauuga

SEQ ID NO: 1738321 - RNA, 21 nt, Salmonella enterica enterica serovar Typhi Ty2
ugauauugaccaucucuuccg

SEQ ID NO: 1738322 - RNA, 14 nt, Salmonella enterica enterica serovar Typhi Ty2
ugauauagcgccau

SEQ ID NO: 1738323 - RNA, 18 nt, Salmonella enterica enterica serovar Typhi Ty2
ugauacagaaaaccggca

SEQ ID NO: 1738324 - RNA, 18 nt, Salmonella enterica enterica serovar Typhi Ty2
ugauaagcauagcgccau

SEQ ID NO: 1738325 - RNA, 23 nt, Salmonella enterica enterica serovar Typhi Ty2
ugauaaugguuuacccaggaaga

SEQ ID NO: 1738326 - RNA, 18 nt, Salmonella enterica enterica serovar Typhi Ty2
ugauaagcguagcgccau

SEQ ID NO: 1738327 - RNA, 23 nt, Salmonella enterica enterica serovar Typhi Ty2
ugauaauaguggugcgcauccgg

SEQ ID NO: 1738328 - RNA, 18 nt, Salmonella enterica enterica serovar Typhi Ty2
ugauaagcgcagcgccau

SEQ ID NO: 1738329 - RNA, 12 nt, Salmonella enterica enterica serovar Typhi Ty2
ugagcgaacagg

SEQ ID NO: 1738330 - RNA, 21 nt, Salmonella enterica enterica serovar Typhi Ty2
ugagccuaaaacauuaaucgc

SEQ ID NO: 1738331 - RNA, 20 nt, Salmonella enterica enterica serovar Typhi Ty2
ugaguauuaacgugauggcg

SEQ ID NO: 1738332 - RNA, 13 nt, Salmonella enterica enterica serovar Typhi Ty2
ugaacucccggcg

SEQ ID NO: 1738333 - RNA, 18 nt, Salmonella enterica enterica serovar Typhi Ty2
ugaagcaucaauaucugc

SEQ ID NO: 1738334 - RNA, 15 nt, Salmonella enterica enterica serovar Typhi Ty2
ugaagcguaacagcg

SEQ ID NO: 1738335 - RNA, 19 nt, Salmonella enterica enterica serovar Typhi Ty2
ugaagcgcaucggugacaa

SEQ ID NO: 1738336 - RNA, 17 nt, Salmonella enterica enterica serovar Typhi Ty2
ugacuuuccugguaauc

SEQ ID NO: 1738337 - RNA, 18 nt, Salmonella enterica enterica serovar Typhi Ty2
ugagaaacgcgccacgcg

SEQ ID NO: 1738338 - RNA, 16 nt, Salmonella enterica enterica serovar Typhi Ty2
ugagcccuccuccagc

SEQ ID NO: 1738339 - RNA, 22 nt, Salmonella enterica enterica serovar Typhi Ty2
ugcagacaauuuccgccgccag

SEQ ID NO: 1738340 - RNA, 23 nt, Salmonella enterica enterica serovar Typhi Ty2
ugcagacgugcaauaucgcggca

SEQ ID NO: 1738341 - RNA, 16 nt, Salmonella enterica enterica serovar Typhi Ty2
ugcaacaugcccaguu

SEQ ID NO: 1738342 - RNA, 14 nt, Salmonella enterica enterica serovar Typhi Ty2
ugauugccaucgcu

SEQ ID NO: 1738343 - RNA, 16 nt, Salmonella enterica enterica serovar Typhi Ty2
ugcacauugucgggca

SEQ ID NO: 1738344 - RNA, 22 nt, Salmonella enterica enterica serovar Typhi Ty2
ugcaccacccgguuauaacgcg

SEQ ID NO: 1738345 - RNA, 13 nt, Salmonella enterica enterica serovar Typhi Ty2
ugaugaucuucag

SEQ ID NO: 1738346 - RNA, 17 nt, Salmonella enterica enterica serovar Typhi Ty2
ugaugaucaauaacgcc

SEQ ID NO: 1738347 - RNA, 19 nt, Salmonella enterica enterica serovar Typhi Ty2
ugaugagauacgucaucau

SEQ ID NO: 1738348 - RNA, 19 nt, Salmonella enterica enterica serovar Typhi Ty2
ugaucaggaaaucuuccag

SEQ ID NO: 1738349 - RNA, 16 nt, Salmonella enterica enterica serovar Typhi Ty2
ugaucacuuccgccac

SEQ ID NO: 1738350 - RNA, 18 nt, Salmonella enterica enterica serovar Typhi Ty2
ugaucaccaucuucacau

SEQ ID NO: 1738351 - RNA, 17 nt, Salmonella enterica enterica serovar Typhi Ty2
ugaucagaccaucggcc

SEQ ID NO: 1738352 - RNA, 13 nt, Salmonella enterica enterica serovar Typhi Ty2
ugauggucuccag

SEQ ID NO: 1738353 - RNA, 20 nt, Salmonella enterica enterica serovar Typhi Ty2
ugaugggcgcacagcgccau

SEQ ID NO: 1738354 - RNA, 17 nt, Salmonella enterica enterica serovar Typhi Ty2
ugauggcguaauccgga

SEQ ID NO: 1738355 - RNA, 19 nt, Salmonella enterica enterica serovar Typhi Ty2
ugauggcgaucagcgccac

SEQ ID NO: 1738356 - RNA, 14 nt, Salmonella enterica enterica serovar Typhi Ty2
ugauugcaagaaua

SEQ ID NO: 1738357 - RNA, 18 nt, Salmonella enterica enterica serovar Typhi Ty2
ugauucugugaugaugcg

SEQ ID NO: 1738358 - RNA, 20 nt, Salmonella enterica enterica serovar Typhi Ty2
ugaugugauuaaacgcaacg

SEQ ID NO: 1738359 - RNA, 21 nt, Salmonella enterica enterica serovar Typhi Ty2
ugaacauggguuucuugccgg

SEQ ID NO: 1738360 - RNA, 17 nt, Salmonella enterica enterica serovar Typhi Ty2
ugaacagcgucauccag

SEQ ID NO: 1738361 - RNA, 13 nt, Salmonella enterica enterica serovar Typhi Ty2
ugaaaaacgggag

SEQ ID NO: 1738362 - RNA, 17 nt, Salmonella enterica enterica serovar Typhi Ty2
ugaaaacucacgcccgc

SEQ ID NO: 1738363 - RNA, 12 nt, Salmonella enterica enterica serovar Typhi Ty2
ugaaacccgcca

SEQ ID NO: 1738364 - RNA, 19 nt, Salmonella enterica enterica serovar Typhi Ty2
ugaaaauuuguacuucaga

SEQ ID NO: 1738365 - RNA, 11 nt, Salmonella enterica enterica serovar Typhi Ty2
ugaaacgccga

SEQ ID NO: 1738366 - RNA, 22 nt, Salmonella enterica enterica serovar Typhi Ty2
ucuuuacacucgcggauaaugu

SEQ ID NO: 1738367 - RNA, 18 nt, Salmonella enterica enterica serovar Typhi Ty2
ucuuuacgcuaucgggcg

SEQ ID NO: 1738368 - RNA, 22 nt, Salmonella enterica enterica serovar Typhi Ty2
ucuuuucguuucuugauguguc

SEQ ID NO: 1738369 - RNA, 14 nt, Salmonella enterica enterica serovar Typhi Ty2
ucuuuacacucgcg

SEQ ID NO: 1738370 - RNA, 14 nt, Salmonella enterica enterica serovar Typhi Ty2
ucuuuaauacgcgu

SEQ ID NO: 1738371 - RNA, 20 nt, Salmonella enterica enterica serovar Typhi Ty2
ucuuuaaaaucgcgcauggc

SEQ ID NO: 1738372 - RNA, 13 nt, Salmonella enterica enterica serovar Typhi Ty2
ucuugcguuaugu

SEQ ID NO: 1738373 - RNA, 21 nt, Salmonella enterica enterica serovar Typhi Ty2
ucuugccacuggccucccagu

SEQ ID NO: 1738374 - RNA, 14 nt, Salmonella enterica enterica serovar Typhi Ty2
ucuugccgccaucu

SEQ ID NO: 1738375 - RNA, 16 nt, Salmonella enterica enterica serovar Typhi Ty2
ucuugcaacccauauu

SEQ ID NO: 1738376 - RNA, 17 nt, Salmonella enterica enterica serovar Typhi Ty2
ucuucguuagcggcguu

SEQ ID NO: 1738377 - RNA, 20 nt, Salmonella enterica enterica serovar Typhi Ty2
ucuucuccgccugcgguuua

SEQ ID NO: 1738378 - RNA, 15 nt, Salmonella enterica enterica serovar Typhi Ty2
ucuucgcaaccggua

SEQ ID NO: 1738379 - RNA, 15 nt, Salmonella enterica enterica serovar Typhi Ty2
ucuucgccgucauaa

SEQ ID NO: 1738380 - RNA, 15 nt, Salmonella enterica enterica serovar Typhi Ty2
ucuucggcauaacgu

SEQ ID NO: 1738381 - RNA, 18 nt, Salmonella enterica enterica serovar Typhi Ty2
ucuucaucagccagcauc

SEQ ID NO: 1738382 - RNA, 18 nt, Salmonella enterica enterica serovar Typhi Ty2
ucuucaucaaccaugauc

SEQ ID NO: 1738383 - RNA, 11 nt, Salmonella enterica enterica serovar Typhi Ty2
ucuucaugguc

SEQ ID NO: 1738384 - RNA, 18 nt, Salmonella enterica enterica serovar Typhi Ty2
ucuucacuaaaaacaggc

SEQ ID NO: 1738385 - RNA, 15 nt, Salmonella enterica enterica serovar Typhi Ty2
ucuuauccggccugc

SEQ ID NO: 1738386 - RNA, 13 nt, Salmonella enterica enterica serovar Typhi Ty2
ucuucaaacggca

SEQ ID NO: 1738387 - RNA, 18 nt, Salmonella enterica enterica serovar Typhi Ty2
ucuuccaucagccaggcg

SEQ ID NO: 1738388 - RNA, 15 nt, Salmonella enterica enterica serovar Typhi Ty2
ucuuccaucagccag

SEQ ID NO: 1738389 - RNA, 15 nt, Salmonella enterica enterica serovar Typhi Ty2
ucuuccauucccacc

SEQ ID NO: 1738390 - RNA, 12 nt, Salmonella enterica enterica serovar Typhi Ty2
ucuuccagcauc

SEQ ID NO: 1738391 - RNA, 14 nt, Salmonella enterica enterica serovar Typhi Ty2
ucuuccagcggcag

SEQ ID NO: 1738392 - RNA, 14 nt, Salmonella enterica enterica serovar Typhi Ty2
ucuuccugcgguaa

SEQ ID NO: 1738393 - RNA, 17 nt, Salmonella enterica enterica serovar Typhi Ty2
ucuuccugcugcgccag

SEQ ID NO: 1738394 - RNA, 22 nt, Salmonella enterica enterica serovar Typhi Ty2
ucuucccuccccugcgccuuaa

SEQ ID NO: 1738395 - RNA, 14 nt, Salmonella enterica enterica serovar Typhi Ty2
ucuucccgcagaua

SEQ ID NO: 1738396 - RNA, 16 nt, Salmonella enterica enterica serovar Typhi Ty2
ucuucgaccgccauaa

SEQ ID NO: 1738397 - RNA, 18 nt, Salmonella enterica enterica serovar Typhi Ty2
ucuggcgacuaaccagcg

SEQ ID NO: 1738398 - RNA, 20 nt, Salmonella enterica enterica serovar Typhi Ty2
ucuggcgugccgggcuggcg

SEQ ID NO: 1738399 - RNA, 18 nt, Salmonella enterica enterica serovar Typhi Ty2
ucuggcucccgcagccac

SEQ ID NO: 1738400 - RNA, 23 nt, Salmonella enterica enterica serovar Typhi Ty2
ucuggcgcagauacgcgucaaag

SEQ ID NO: 1738401 - RNA, 13 nt, Salmonella enterica enterica serovar Typhi Ty2
ucugcguugcgcg

SEQ ID NO: 1738402 - RNA, 14 nt, Salmonella enterica enterica serovar Typhi Ty2
ucugcuuucggugc

SEQ ID NO: 1738403 - RNA, 17 nt, Salmonella enterica enterica serovar Typhi Ty2
ucuggguuugcagcaga

SEQ ID NO: 1738404 - RNA, 20 nt, Salmonella enterica enterica serovar Typhi Ty2
ucuguaggccugauaagcgc

SEQ ID NO: 1738405 - RNA, 21 nt, Salmonella enterica enterica serovar Typhi Ty2
ucuguaggucggauaaggcgu

SEQ ID NO: 1738406 - RNA, 16 nt, Salmonella enterica enterica serovar Typhi Ty2
ucuuaaugccagcggc

SEQ ID NO: 1738407 - RNA, 17 nt, Salmonella enterica enterica serovar Typhi Ty2
ucuguuuuagcaugaca

SEQ ID NO: 1738408 - RNA, 19 nt, Salmonella enterica enterica serovar Typhi Ty2
ucugcgccaccagcgcagu

SEQ ID NO: 1738409 - RNA, 19 nt, Salmonella enterica enterica serovar Typhi Ty2
ucugcgcaacgcuuccacc

SEQ ID NO: 1738410 - RNA, 22 nt, Salmonella enterica enterica serovar Typhi Ty2
ucugcgcuggguuuuuccgcuu

SEQ ID NO: 1738411 - RNA, 20 nt, Salmonella enterica enterica serovar Typhi Ty2
ucugccuguagcagcgccag

SEQ ID NO: 1738412 - RNA, 13 nt, Salmonella enterica enterica serovar Typhi Ty2
ucugcgacgccag

SEQ ID NO: 1738413 - RNA, 14 nt, Salmonella enterica enterica serovar Typhi Ty2
ucugccugcagacc

SEQ ID NO: 1738414 - RNA, 22 nt, Salmonella enterica enterica serovar Typhi Ty2
ucugccagcgcccuauccagcg

SEQ ID NO: 1738415 - RNA, 16 nt, Salmonella enterica enterica serovar Typhi Ty2
ucucuuccgccagcgc

SEQ ID NO: 1738416 - RNA, 14 nt, Salmonella enterica enterica serovar Typhi Ty2
ucucuucccagcgc

SEQ ID NO: 1738417 - RNA, 17 nt, Salmonella enterica enterica serovar Typhi Ty2
ucucuuucugccuacag

SEQ ID NO: 1738418 - RNA, 20 nt, Salmonella enterica enterica serovar Typhi Ty2
ucugaaacgcuucaccggcg

SEQ ID NO: 1738419 - RNA, 19 nt, Salmonella enterica enterica serovar Typhi Ty2
ucugaagcuaaccgcgcaa

SEQ ID NO: 1738420 - RNA, 12 nt, Salmonella enterica enterica serovar Typhi Ty2
ucugauccagcg

SEQ ID NO: 1738421 - RNA, 13 nt, Salmonella enterica enterica serovar Typhi Ty2
ucugacugcguga

SEQ ID NO: 1738422 - RNA, 16 nt, Salmonella enterica enterica serovar Typhi Ty2
ucucuacacaacgcga

SEQ ID NO: 1738423 - RNA, 22 nt, Salmonella enterica enterica serovar Typhi Ty2
ucucgcugccggaaagccccag

SEQ ID NO: 1738424 - RNA, 13 nt, Salmonella enterica enterica serovar Typhi Ty2
ucuccugcgccag

SEQ ID NO: 1738425 - RNA, 15 nt, Salmonella enterica enterica serovar Typhi Ty2
ucucgaaacaauagc

SEQ ID NO: 1738426 - RNA, 24 nt, Salmonella enterica enterica serovar Typhi Ty2
ucuauuuuucccggaucgcuaauu

SEQ ID NO: 1738427 - RNA, 14 nt, Salmonella enterica enterica serovar Typhi Ty2
ucucagauaauagc

SEQ ID NO: 1738428 - RNA, 14 nt, Salmonella enterica enterica serovar Typhi Ty2
ucuaucgccagcgc

SEQ ID NO: 1738429 - RNA, 14 nt, Salmonella enterica enterica serovar Typhi Ty2
ucguugccagcggc

SEQ ID NO: 1738430 - RNA, 17 nt, Salmonella enterica enterica serovar Typhi Ty2
ucguugauaucgcugug

SEQ ID NO: 1738431 - RNA, 21 nt, Salmonella enterica enterica serovar Typhi Ty2
ucguucaacggcaaaucgcgg

SEQ ID NO: 1738432 - RNA, 14 nt, Salmonella enterica enterica serovar Typhi Ty2
ucguucacgccaaa

SEQ ID NO: 1738433 - RNA, 23 nt, Salmonella enterica enterica serovar Typhi Ty2
ucguuaaaaucggggucuuccag

SEQ ID NO: 1738434 - RNA, 17 nt, Salmonella enterica enterica serovar Typhi Ty2
ucguucugcgucgcgca

SEQ ID NO: 1738435 - RNA, 22 nt, Salmonella enterica enterica serovar Typhi Ty2
ucguucgcccuucaucuuccag

SEQ ID NO: 1738436 - RNA, 16 nt, Salmonella enterica enterica serovar Typhi Ty2
ucggcgucgcggcaau

SEQ ID NO: 1738437 - RNA, 15 nt, Salmonella enterica enterica serovar Typhi Ty2
ucggucagauucaga

SEQ ID NO: 1738438 - RNA, 17 nt, Salmonella enterica enterica serovar Typhi Ty2
ucgguggcgguaucaau

SEQ ID NO: 1738439 - RNA, 16 nt, Salmonella enterica enterica serovar Typhi Ty2
ucguaauggccuacac

SEQ ID NO: 1738440 - RNA, 12 nt, Salmonella enterica enterica serovar Typhi Ty2
ucguaauucagc

SEQ ID NO: 1738441 - RNA, 22 nt, Salmonella enterica enterica serovar Typhi Ty2
ucguacauguccagaucuucac

SEQ ID NO: 1738442 - RNA, 13 nt, Salmonella enterica enterica serovar Typhi Ty2
ucguccguugcca

SEQ ID NO: 1738443 - RNA, 20 nt, Salmonella enterica enterica serovar Typhi Ty2
ucggccacguccguuacccc

SEQ ID NO: 1738444 - RNA, 18 nt, Salmonella enterica enterica serovar Typhi Ty2
ucggccggauagggcgua

SEQ ID NO: 1738445 - RNA, 23 nt, Salmonella enterica enterica serovar Typhi Ty2
ucggcgcccggacgaaccuggcg

SEQ ID NO: 1738446 - RNA, 22 nt, Salmonella enterica enterica serovar Typhi Ty2
ucggccucgcuggucagcgcaa

SEQ ID NO: 1738447 - RNA, 13 nt, Salmonella enterica enterica serovar Typhi Ty2
ucggcgucauccc

SEQ ID NO: 1738448 - RNA, 17 nt, Salmonella enterica enterica serovar Typhi Ty2
ucggcggucgcggcaau

SEQ ID NO: 1738449 - RNA, 23 nt, Salmonella enterica enterica serovar Typhi Ty2
ucggcgggcguaucucauugaug

SEQ ID NO: 1738450 - RNA, 16 nt, Salmonella enterica enterica serovar Typhi Ty2
ucgcgucgccaucagg

SEQ ID NO: 1738451 - RNA, 16 nt, Salmonella enterica enterica serovar Typhi Ty2
ucgcgucuacgucagg

SEQ ID NO: 1738452 - RNA, 18 nt, Salmonella enterica enterica serovar Typhi Ty2
ucgcgguugccgucaaac

SEQ ID NO: 1738453 - RNA, 17 nt, Salmonella enterica enterica serovar Typhi Ty2
ucgcgguugacgcugcu

SEQ ID NO: 1738454 - RNA, 16 nt, Salmonella enterica enterica serovar Typhi Ty2
ucgcguacagcgccau

SEQ ID NO: 1738455 - RNA, 13 nt, Salmonella enterica enterica serovar Typhi Ty2
ucgcggugaaaga

SEQ ID NO: 1738456 - RNA, 21 nt, Salmonella enterica enterica serovar Typhi Ty2
ucgcuccucagcgcuuaccac

SEQ ID NO: 1738457 - RNA, 16 nt, Salmonella enterica enterica serovar Typhi Ty2
ucgcuccggaacgcga

SEQ ID NO: 1738458 - RNA, 18 nt, Salmonella enterica enterica serovar Typhi Ty2
ucgcuggucagcgcaauc

SEQ ID NO: 1738459 - RNA, 15 nt, Salmonella enterica enterica serovar Typhi Ty2
ucgcuguagcgccaa

SEQ ID NO: 1738460 - RNA, 12 nt, Salmonella enterica enterica serovar Typhi Ty2
ucgcguuacggc

SEQ ID NO: 1738461 - RNA, 22 nt, Salmonella enterica enterica serovar Typhi Ty2
ucgcuaccacagaaaucgccgg

SEQ ID NO: 1738462 - RNA, 21 nt, Salmonella enterica enterica serovar Typhi Ty2
ucgcuacacgcguaaacuucc

SEQ ID NO: 1738463 - RNA, 15 nt, Salmonella enterica enterica serovar Typhi Ty2
ucgcguuguaaucgc

SEQ ID NO: 1738464 - RNA, 13 nt, Salmonella enterica enterica serovar Typhi Ty2
ucggaaccggcaa

SEQ ID NO: 1738465 - RNA, 18 nt, Salmonella enterica enterica serovar Typhi Ty2
ucgcuuauuccuccgccg

SEQ ID NO: 1738466 - RNA, 23 nt, Salmonella enterica enterica serovar Typhi Ty2
ucgcuucugccgccaguugcuca

SEQ ID NO: 1738467 - RNA, 15 nt, Salmonella enterica enterica serovar Typhi Ty2
ucggaacgcuguaug

SEQ ID NO: 1738468 - RNA, 19 nt, Salmonella enterica enterica serovar Typhi Ty2
ucggauaaacgcugcgcaa

SEQ ID NO: 1738469 - RNA, 15 nt, Salmonella enterica enterica serovar Typhi Ty2
ucggaucaaacgugc

SEQ ID NO: 1738470 - RNA, 18 nt, Salmonella enterica enterica serovar Typhi Ty2
ucggcaaacauagccuca

SEQ ID NO: 1738471 - RNA, 21 nt, Salmonella enterica enterica serovar Typhi Ty2
ucggcaauuuccggcgacgua

SEQ ID NO: 1738472 - RNA, 20 nt, Salmonella enterica enterica serovar Typhi Ty2
ucggcaggcggucaucgccc

SEQ ID NO: 1738473 - RNA, 17 nt, Salmonella enterica enterica serovar Typhi Ty2
ucgccggauggcggcga

SEQ ID NO: 1738474 - RNA, 16 nt, Salmonella enterica enterica serovar Typhi Ty2
ucgccggcgucaucgg

SEQ ID NO: 1738475 - RNA, 13 nt, Salmonella enterica enterica serovar Typhi Ty2
ucgccggauggcg

SEQ ID NO: 1738476 - RNA, 23 nt, Salmonella enterica enterica serovar Typhi Ty2
ucgccgcgccggacuccagcaac

SEQ ID NO: 1738477 - RNA, 16 nt, Salmonella enterica enterica serovar Typhi Ty2
ucgccgaccauccaga

SEQ ID NO: 1738478 - RNA, 20 nt, Salmonella enterica enterica serovar Typhi Ty2
ucgccgcgccggacuccagc

SEQ ID NO: 1738479 - RNA, 15 nt, Salmonella enterica enterica serovar Typhi Ty2
ucgccauucccgcga

SEQ ID NO: 1738480 - RNA, 17 nt, Salmonella enterica enterica serovar Typhi Ty2
ucgccaugcaccacgac

SEQ ID NO: 1738481 - RNA, 19 nt, Salmonella enterica enterica serovar Typhi Ty2
ucgccauuaaacucaucgc

SEQ ID NO: 1738482 - RNA, 12 nt, Salmonella enterica enterica serovar Typhi Ty2
ucgcccagaugg

SEQ ID NO: 1738483 - RNA, 13 nt, Salmonella enterica enterica serovar Typhi Ty2
ucgccauccagau

SEQ ID NO: 1738484 - RNA, 20 nt, Salmonella enterica enterica serovar Typhi Ty2
ucgacgcgcaucacaaugac

SEQ ID NO: 1738485 - RNA, 16 nt, Salmonella enterica enterica serovar Typhi Ty2
ucgcccgcaccgccga

SEQ ID NO: 1738486 - RNA, 16 nt, Salmonella enterica enterica serovar Typhi Ty2
ucgcccggcaugacau

SEQ ID NO: 1738487 - RNA, 15 nt, Salmonella enterica enterica serovar Typhi Ty2
ucgcccugcgguagc

SEQ ID NO: 1738488 - RNA, 14 nt, Salmonella enterica enterica serovar Typhi Ty2
ucgcccugcgucgc

SEQ ID NO: 1738489 - RNA, 19 nt, Salmonella enterica enterica serovar Typhi Ty2
ucgcccuucaucuuccagu

SEQ ID NO: 1738490 - RNA, 15 nt, Salmonella enterica enterica serovar Typhi Ty2
ucgccgaagcggcag

SEQ ID NO: 1738491 - RNA, 19 nt, Salmonella enterica enterica serovar Typhi Ty2
ucgcggcauuaaaugcgcc

SEQ ID NO: 1738492 - RNA, 13 nt, Salmonella enterica enterica serovar Typhi Ty2
ucgcggccagaua

SEQ ID NO: 1738493 - RNA, 12 nt, Salmonella enterica enterica serovar Typhi Ty2
ucgcgcagcagg

SEQ ID NO: 1738494 - RNA, 19 nt, Salmonella enterica enterica serovar Typhi Ty2
ucgcgauuaaucucauccg

SEQ ID NO: 1738495 - RNA, 17 nt, Salmonella enterica enterica serovar Typhi Ty2
ucgcgcagcaaaucagc

SEQ ID NO: 1738496 - RNA, 19 nt, Salmonella enterica enterica serovar Typhi Ty2
ucgcgccaccugcacggcg

SEQ ID NO: 1738497 - RNA, 22 nt, Salmonella enterica enterica serovar Typhi Ty2
ucgcgcgccgcuuccggcaggu

SEQ ID NO: 1738498 - RNA, 14 nt, Salmonella enterica enterica serovar Typhi Ty2
ucgcgauccgccag

SEQ ID NO: 1738499 - RNA, 17 nt, Salmonella enterica enterica serovar Typhi Ty2
ucgcgacguccgccaac

SEQ ID NO: 1738500 - RNA, 21 nt, Salmonella enterica enterica serovar Typhi Ty2
ucgccgggaugcuuuccgguu

SEQ ID NO: 1738501 - RNA, 20 nt, Salmonella enterica enterica serovar Typhi Ty2
ucgcgaaucgcuucacggcg

SEQ ID NO: 1738502 - RNA, 12 nt, Salmonella enterica enterica serovar Typhi Ty2
gcuuuugccugc

SEQ ID NO: 1738503 - RNA, 21 nt, Salmonella enterica enterica serovar Typhi Ty2
gcuuuugaauuugaaggacug

SEQ ID NO: 1738504 - RNA, 23 nt, Salmonella enterica enterica serovar Typhi Ty2
gcuuuucgcuuaaacauauacug

SEQ ID NO: 1738505 - RNA, 18 nt, Salmonella enterica enterica serovar Typhi Ty2
gcuuucacaccguuaucc

SEQ ID NO: 1738506 - RNA, 21 nt, Salmonella enterica enterica serovar Typhi Ty2
gcuuucauccaauaacguaac

SEQ ID NO: 1738507 - RNA, 17 nt, Salmonella enterica enterica serovar Typhi Ty2
gcuuuccacguucccgg

SEQ ID NO: 1738508 - RNA, 20 nt, Salmonella enterica enterica serovar Typhi Ty2
gcuugcgccaucauccggca

SEQ ID NO: 1738509 - RNA, 19 nt, Salmonella enterica enterica serovar Typhi Ty2
gcuugccgggccguagugc

SEQ ID NO: 1738510 - RNA, 20 nt, Salmonella enterica enterica serovar Typhi Ty2
gcuugcaggaugucgauaau

SEQ ID NO: 1738511 - RNA, 22 nt, Salmonella enterica enterica serovar Typhi Ty2
gcuguugguuuauugauaggcc

SEQ ID NO: 1738512 - RNA, 19 nt, Salmonella enterica enterica serovar Typhi Ty2
gcuguuguugcucggcguc

SEQ ID NO: 1738513 - RNA, 15 nt, Salmonella enterica enterica serovar Typhi Ty2
gcuguuuauggcgcu

SEQ ID NO: 1738514 - RNA, 13 nt, Salmonella enterica enterica serovar Typhi Ty2
gcuguuucucgau

SEQ ID NO: 1738515 - RNA, 13 nt, Salmonella enterica enterica serovar Typhi Ty2
gcuguuuuccgcu

SEQ ID NO: 1738516 - RNA, 19 nt, Salmonella enterica enterica serovar Typhi Ty2
gcuugaguuuuccgccauu

SEQ ID NO: 1738517 - RNA, 15 nt, Salmonella enterica enterica serovar Typhi Ty2
gcuugagccagcgcu

SEQ ID NO: 1738518 - RNA, 22 nt, Salmonella enterica enterica serovar Typhi Ty2
ggaaucgaccaugguuucgaac

SEQ ID NO: 1738519 - RNA, 21 nt, Salmonella enterica enterica serovar Typhi Ty2
ggaacguccaguugucaucgu

SEQ ID NO: 1738520 - RNA, 22 nt, Salmonella enterica enterica serovar Typhi Ty2
ggaacuaacccgcagccggaau

SEQ ID NO: 1738521 - RNA, 20 nt, Salmonella enterica enterica serovar Typhi Ty2
ggaaaacgcgcugauaccgu

SEQ ID NO: 1738522 - RNA, 22 nt, Salmonella enterica enterica serovar Typhi Ty2
ggaaaaaagcgcccagcgccgg

SEQ ID NO: 1738523 - RNA, 19 nt, Salmonella enterica enterica serovar Typhi Ty2
ggaaaaaaugggcuggaaa

SEQ ID NO: 1738524 - RNA, 12 nt, Salmonella enterica enterica serovar Typhi Ty2
ggaccguacuca

SEQ ID NO: 1738525 - RNA, 17 nt, Salmonella enterica enterica serovar Typhi Ty2
ggacaugguaauaacgc

SEQ ID NO: 1738526 - RNA, 21 nt, Salmonella enterica enterica serovar Typhi Ty2
ggagagcggauaauccgccac

SEQ ID NO: 1738527 - RNA, 20 nt, Salmonella enterica enterica serovar Typhi Ty2
ggagagcggauaauccgcca

SEQ ID NO: 1738528 - RNA, 20 nt, Salmonella enterica enterica serovar Typhi Ty2
ggagcaaaauagcauucgcg

SEQ ID NO: 1738529 - RNA, 19 nt, Salmonella enterica enterica serovar Typhi Ty2
ggagaggccaccagcgcca

SEQ ID NO: 1738530 - RNA, 15 nt, Salmonella enterica enterica serovar Typhi Ty2
ggacgccguccaggc

SEQ ID NO: 1738531 - RNA, 18 nt, Salmonella enterica enterica serovar Typhi Ty2
ggagcagacuguaaaucu

SEQ ID NO: 1738532 - RNA, 21 nt, Salmonella enterica enterica serovar Typhi Ty2
ggagccugggauugcaucauc

SEQ ID NO: 1738533 - RNA, 23 nt, Salmonella enterica enterica serovar Typhi Ty2
ggauaaggcguucacgccgccau

SEQ ID NO: 1738534 - RNA, 14 nt, Salmonella enterica enterica serovar Typhi Ty2
ggauaaggcgugag

SEQ ID NO: 1738535 - RNA, 23 nt, Salmonella enterica enterica serovar Typhi Ty2
ggauaaggcguuuacgccgccau

SEQ ID NO: 1738536 - RNA, 23 nt, Salmonella enterica enterica serovar Typhi Ty2
ggauaagguguuuacgccgccau

SEQ ID NO: 1738537 - RNA, 15 nt, Salmonella enterica enterica serovar Typhi Ty2
ggauaccacgcacau

SEQ ID NO: 1738538 - RNA, 20 nt, Salmonella enterica enterica serovar Typhi Ty2
ggauaaggcgcuagccgcau

SEQ ID NO: 1738539 - RNA, 16 nt, Salmonella enterica enterica serovar Typhi Ty2
ggauaauccgccacuu

SEQ ID NO: 1738540 - RNA, 16 nt, Salmonella enterica enterica serovar Typhi Ty2
ggauagagaucuuccg

SEQ ID NO: 1738541 - RNA, 17 nt, Salmonella enterica enterica serovar Typhi Ty2
ggauagcguagcgccau

SEQ ID NO: 1738542 - RNA, 17 nt, Salmonella enterica enterica serovar Typhi Ty2
ggauacgccagcagaca

SEQ ID NO: 1738543 - RNA, 20 nt, Salmonella enterica enterica serovar Typhi Ty2
ggauaaggcgcagccgccau

SEQ ID NO: 1738544 - RNA, 20 nt, Salmonella enterica enterica serovar Typhi Ty2
ggauaaggccacgccgccau

SEQ ID NO: 1738545 - RNA, 21 nt, Salmonella enterica enterica serovar Typhi Ty2
ggauaaggccacgccgccauc

SEQ ID NO: 1738546 - RNA, 22 nt, Salmonella enterica enterica serovar Typhi Ty2
ggauaaggcauuucgccgccau

SEQ ID NO: 1738547 - RNA, 23 nt, Salmonella enterica enterica serovar Typhi Ty2
ggauaaggcauucacgccaccau

SEQ ID NO: 1738548 - RNA, 13 nt, Salmonella enterica enterica serovar Typhi Ty2
ggauaagcguagc

SEQ ID NO: 1738549 - RNA, 18 nt, Salmonella enterica enterica serovar Typhi Ty2
ggauaagcggcagcgcca

SEQ ID NO: 1738550 - RNA, 14 nt, Salmonella enterica enterica serovar Typhi Ty2
ggauaagcggcagc

SEQ ID NO: 1738551 - RNA, 18 nt, Salmonella enterica enterica serovar Typhi Ty2
ggauaagcaacgcgccau

SEQ ID NO: 1738552 - RNA, 18 nt, Salmonella enterica enterica serovar Typhi Ty2
ggauaagcgcagcgccau

SEQ ID NO: 1738553 - RNA, 19 nt, Salmonella enterica enterica serovar Typhi Ty2
ggauaagcauuagcgccau

SEQ ID NO: 1738554 - RNA, 17 nt, Salmonella enterica enterica serovar Typhi Ty2
ggauaagcgcagcgcca

SEQ ID NO: 1738555 - RNA, 23 nt, Salmonella enterica enterica serovar Typhi Ty2
ggauaaagccaauggugcucagc

SEQ ID NO: 1738556 - RNA, 16 nt, Salmonella enterica enterica serovar Typhi Ty2
ggauaaacaccggaau

SEQ ID NO: 1738557 - RNA, 20 nt, Salmonella enterica enterica serovar Typhi Ty2
ggaguggguaccucaugccg

SEQ ID NO: 1738558 - RNA, 20 nt, Salmonella enterica enterica serovar Typhi Ty2
ggagcuuuacucaacgguca

SEQ ID NO: 1738559 - RNA, 15 nt, Salmonella enterica enterica serovar Typhi Ty2
ggaggcagugaaauc

SEQ ID NO: 1738560 - RNA, 22 nt, Salmonella enterica enterica serovar Typhi Ty2
ggagguucaccaccacccagug

SEQ ID NO: 1738561 - RNA, 17 nt, Salmonella enterica enterica serovar Typhi Ty2
ggaucggcacacagcca

SEQ ID NO: 1738562 - RNA, 17 nt, Salmonella enterica enterica serovar Typhi Ty2
ggauccguucaucggca

SEQ ID NO: 1738563 - RNA, 19 nt, Salmonella enterica enterica serovar Typhi Ty2
ggaucaucggcucagcaau

SEQ ID NO: 1738564 - RNA, 21 nt, Salmonella enterica enterica serovar Typhi Ty2
ggauauucugcacgcacgaca

SEQ ID NO: 1738565 - RNA, 23 nt, Salmonella enterica enterica serovar Typhi Ty2
ggaucaaccaccuucaccggaua

SEQ ID NO: 1738566 - RNA, 21 nt, Salmonella enterica enterica serovar Typhi Ty2
ggaucaauaugccagauauuu

SEQ ID NO: 1738567 - RNA, 20 nt, Salmonella enterica enterica serovar Typhi Ty2
ggauagugauauagcgccau

SEQ ID NO: 1738568 - RNA, 16 nt, Salmonella enterica enterica serovar Typhi Ty2
ggaugccccaucacgg

SEQ ID NO: 1738569 - RNA, 18 nt, Salmonella enterica enterica serovar Typhi Ty2
ggaugccugcgcauccuc

SEQ ID NO: 1738570 - RNA, 16 nt, Salmonella enterica enterica serovar Typhi Ty2
ggauggccucugccag

SEQ ID NO: 1738571 - RNA, 17 nt, Salmonella enterica enterica serovar Typhi Ty2
ggaugcgcugaauagcg

SEQ ID NO: 1738572 - RNA, 16 nt, Salmonella enterica enterica serovar Typhi Ty2
ggaucguacaacggau

SEQ ID NO: 1738573 - RNA, 20 nt, Salmonella enterica enterica serovar Typhi Ty2
ggaugaggcgcagccgccau

SEQ ID NO: 1738574 - RNA, 20 nt, Salmonella enterica enterica serovar Typhi Ty2
gcugucagugaaaaaccgau

SEQ ID NO: 1738575 - RNA, 12 nt, Salmonella enterica enterica serovar Typhi Ty2
gcugucguuuca

SEQ ID NO: 1738576 - RNA, 14 nt, Salmonella enterica enterica serovar Typhi Ty2
gcugucugccaugc

SEQ ID NO: 1738577 - RNA, 23 nt, Salmonella enterica enterica serovar Typhi Ty2
gcugugcaacaucuuaccggugc

SEQ ID NO: 1738578 - RNA, 18 nt, Salmonella enterica enterica serovar Typhi Ty2
gcugugcauaucuggcga

SEQ ID NO: 1738579 - RNA, 17 nt, Salmonella enterica enterica serovar Typhi Ty2
gcuguagcugcccggau

SEQ ID NO: 1738580 - RNA, 17 nt, Salmonella enterica enterica serovar Typhi Ty2
gcuggugcuuggcguga

SEQ ID NO: 1738581 - RNA, 22 nt, Salmonella enterica enterica serovar Typhi Ty2
gcuggugaaacguguuuauccc

SEQ ID NO: 1738582 - RNA, 19 nt, Salmonella enterica enterica serovar Typhi Ty2
gcuggguaaaaucagcgcg

SEQ ID NO: 1738583 - RNA, 15 nt, Salmonella enterica enterica serovar Typhi Ty2
gcuggcgaaucgcau

SEQ ID NO: 1738584 - RNA, 15 nt, Salmonella enterica enterica serovar Typhi Ty2
gcuggcguacgccau

SEQ ID NO: 1738585 - RNA, 17 nt, Salmonella enterica enterica serovar Typhi Ty2
gcugggccugcuccgua

SEQ ID NO: 1738586 - RNA, 16 nt, Salmonella enterica enterica serovar Typhi Ty2
gcugggccgggccuga

SEQ ID NO: 1738587 - RNA, 18 nt, Salmonella enterica enterica serovar Typhi Ty2
gcugcucggguaaggcau

SEQ ID NO: 1738588 - RNA, 20 nt, Salmonella enterica enterica serovar Typhi Ty2
gcugcuguggauuuauggcg

SEQ ID NO: 1738589 - RNA, 17 nt, Salmonella enterica enterica serovar Typhi Ty2
gcugcuuaccauacuga

SEQ ID NO: 1738590 - RNA, 19 nt, Salmonella enterica enterica serovar Typhi Ty2
gcuggccaaacugcggaau

SEQ ID NO: 1738591 - RNA, 16 nt, Salmonella enterica enterica serovar Typhi Ty2
gcuggauaccgcgcca

SEQ ID NO: 1738592 - RNA, 15 nt, Salmonella enterica enterica serovar Typhi Ty2
gcuggaugcgcaaau

SEQ ID NO: 1738593 - RNA, 16 nt, Salmonella enterica enterica serovar Typhi Ty2
gcuggauucucuccca

SEQ ID NO: 1738594 - RNA, 22 nt, Salmonella enterica enterica serovar Typhi Ty2
gcuggcaaaacgcauccagcgc

SEQ ID NO: 1738595 - RNA, 13 nt, Salmonella enterica enterica serovar Typhi Ty2
gcuggcaaacagg

SEQ ID NO: 1738596 - RNA, 20 nt, Salmonella enterica enterica serovar Typhi Ty2
gcuggcacgcgaugucggga

SEQ ID NO: 1738597 - RNA, 16 nt, Salmonella enterica enterica serovar Typhi Ty2
gcuggccaaucagcgg

SEQ ID NO: 1738598 - RNA, 18 nt, Salmonella enterica enterica serovar Typhi Ty2
gcucguaaagcaucagac

SEQ ID NO: 1738599 - RNA, 21 nt, Salmonella enterica enterica serovar Typhi Ty2
gcucgucgccuuccagcgacu

SEQ ID NO: 1738600 - RNA, 23 nt, Salmonella enterica enterica serovar Typhi Ty2
gcucucuuucaccagcgccagaa

SEQ ID NO: 1738601 - RNA, 20 nt, Salmonella enterica enterica serovar Typhi Ty2
gcucuucaggcguauauucg

SEQ ID NO: 1738602 - RNA, 15 nt, Salmonella enterica enterica serovar Typhi Ty2
gcucuucuuccggcg

SEQ ID NO: 1738603 - RNA, 22 nt, Salmonella enterica enterica serovar Typhi Ty2
gcugcaucuuacugaccggccc

SEQ ID NO: 1738604 - RNA, 20 nt, Salmonella enterica enterica serovar Typhi Ty2
gcugcaucguuugcaguucc

SEQ ID NO: 1738605 - RNA, 13 nt, Salmonella enterica enterica serovar Typhi Ty2
gcugcccugcggu

SEQ ID NO: 1738606 - RNA, 22 nt, Salmonella enterica enterica serovar Typhi Ty2
gcugccgacaacgccuccugcc

SEQ ID NO: 1738607 - RNA, 13 nt, Salmonella enterica enterica serovar Typhi Ty2
gcugccagcgccg

SEQ ID NO: 1738608 - RNA, 17 nt, Salmonella enterica enterica serovar Typhi Ty2
gcugcaaaucaccacau

SEQ ID NO: 1738609 - RNA, 16 nt, Salmonella enterica enterica serovar Typhi Ty2
gcugauuaaugcgccc

SEQ ID NO: 1738610 - RNA, 12 nt, Salmonella enterica enterica serovar Typhi Ty2
gcugaauaaccc

SEQ ID NO: 1738611 - RNA, 21 nt, Salmonella enterica enterica serovar Typhi Ty2
gcugacgcgccuggaucugcg

SEQ ID NO: 1738612 - RNA, 15 nt, Salmonella enterica enterica serovar Typhi Ty2
gcugacggauacgcu

SEQ ID NO: 1738613 - RNA, 21 nt, Salmonella enterica enterica serovar Typhi Ty2
gcugacggauacgcugcguca

SEQ ID NO: 1738614 - RNA, 13 nt, Salmonella enterica enterica serovar Typhi Ty2
gcugaaagcgccu

SEQ ID NO: 1738615 - RNA, 19 nt, Salmonella enterica enterica serovar Typhi Ty2
gcugaaaaucaaaucggcg

SEQ ID NO: 1738616 - RNA, 18 nt, Salmonella enterica enterica serovar Typhi Ty2
gcucuuuuccacggcgcu

SEQ ID NO: 1738617 - RNA, 23 nt, Salmonella enterica enterica serovar Typhi Ty2
gcugaaaacggcaucaagcccau

SEQ ID NO: 1738618 - RNA, 20 nt, Salmonella enterica enterica serovar Typhi Ty2
gcucuuucauuucugccugc

SEQ ID NO: 1738619 - RNA, 22 nt, Salmonella enterica enterica serovar Typhi Ty2
gcugaagccugcuucaccgcgc

SEQ ID NO: 1738620 - RNA, 16 nt, Salmonella enterica enterica serovar Typhi Ty2
gcuauacgcggcguac

SEQ ID NO: 1738621 - RNA, 21 nt, Salmonella enterica enterica serovar Typhi Ty2
gcuagcgccuuauccggccua

SEQ ID NO: 1738622 - RNA, 20 nt, Salmonella enterica enterica serovar Typhi Ty2
gcuaggcaaccugucaguac

SEQ ID NO: 1738623 - RNA, 16 nt, Salmonella enterica enterica serovar Typhi Ty2
gcuaucaggccuacaa

SEQ ID NO: 1738624 - RNA, 14 nt, Salmonella enterica enterica serovar Typhi Ty2
gcuaucccgaugcu

SEQ ID NO: 1738625 - RNA, 14 nt, Salmonella enterica enterica serovar Typhi Ty2
gcuaucgaccagca

SEQ ID NO: 1738626 - RNA, 15 nt, Salmonella enterica enterica serovar Typhi Ty2
gcuaucagaauaucc

SEQ ID NO: 1738627 - RNA, 20 nt, Salmonella enterica enterica serovar Typhi Ty2
gcuaucacacauaucgccag

SEQ ID NO: 1738628 - RNA, 14 nt, Salmonella enterica enterica serovar Typhi Ty2
gcuauagaaugcaa

SEQ ID NO: 1738629 - RNA, 15 nt, Salmonella enterica enterica serovar Typhi Ty2
gcuauccaucgccgc

SEQ ID NO: 1738630 - RNA, 14 nt, Salmonella enterica enterica serovar Typhi Ty2
gcuaucgcggauaa

SEQ ID NO: 1738631 - RNA, 23 nt, Salmonella enterica enterica serovar Typhi Ty2
gcuaucgcccaaauaguccagca

SEQ ID NO: 1738632 - RNA, 18 nt, Salmonella enterica enterica serovar Typhi Ty2
gcuaucucuuccagcguc

SEQ ID NO: 1738633 - RNA, 23 nt, Salmonella enterica enterica serovar Typhi Ty2
gcuaugcuccaguuguuccagca

SEQ ID NO: 1738634 - RNA, 21 nt, Salmonella enterica enterica serovar Typhi Ty2
gcucacauucauugccgccag

SEQ ID NO: 1738635 - RNA, 19 nt, Salmonella enterica enterica serovar Typhi Ty2
gcuauuuucucuugcucac

SEQ ID NO: 1738636 - RNA, 15 nt, Salmonella enterica enterica serovar Typhi Ty2
gcuauugaucgccau

SEQ ID NO: 1738637 - RNA, 13 nt, Salmonella enterica enterica serovar Typhi Ty2
gcuauucaugccg

SEQ ID NO: 1738638 - RNA, 14 nt, Salmonella enterica enterica serovar Typhi Ty2
gcuaccgcgcgaac

SEQ ID NO: 1738639 - RNA, 17 nt, Salmonella enterica enterica serovar Typhi Ty2
gcuacccgcaauaccaa

SEQ ID NO: 1738640 - RNA, 17 nt, Salmonella enterica enterica serovar Typhi Ty2
gcuacugagcgucacgc

SEQ ID NO: 1738641 - RNA, 17 nt, Salmonella enterica enterica serovar Typhi Ty2
gcuagcgccuuauccgg

SEQ ID NO: 1738642 - RNA, 21 nt, Salmonella enterica enterica serovar Typhi Ty2
gcuacgcgucgccauccggcg

SEQ ID NO: 1738643 - RNA, 20 nt, Salmonella enterica enterica serovar Typhi Ty2
gcuacgccuuauccggccua

SEQ ID NO: 1738644 - RNA, 18 nt, Salmonella enterica enterica serovar Typhi Ty2
gcuacgccuuauccggcc

SEQ ID NO: 1738645 - RNA, 17 nt, Salmonella enterica enterica serovar Typhi Ty2
gcuacgcuuauccggcu

SEQ ID NO: 1738646 - RNA, 16 nt, Salmonella enterica enterica serovar Typhi Ty2
gcuacgcuuauccggc

SEQ ID NO: 1738647 - RNA, 15 nt, Salmonella enterica enterica serovar Typhi Ty2
gcucagaaauauuca

SEQ ID NO: 1738648 - RNA, 14 nt, Salmonella enterica enterica serovar Typhi Ty2
gcucaccugguaag

SEQ ID NO: 1738649 - RNA, 21 nt, Salmonella enterica enterica serovar Typhi Ty2
gcucaggguuuucuaccgcag

SEQ ID NO: 1738650 - RNA, 16 nt, Salmonella enterica enterica serovar Typhi Ty2
gcucagguuauacugu

SEQ ID NO: 1738651 - RNA, 18 nt, Salmonella enterica enterica serovar Typhi Ty2
gcucagcgccacgcccaa

SEQ ID NO: 1738652 - RNA, 13 nt, Salmonella enterica enterica serovar Typhi Ty2
gcucagcggcaau

SEQ ID NO: 1738653 - RNA, 15 nt, Salmonella enterica enterica serovar Typhi Ty2
gcuccagcaucacau

SEQ ID NO: 1738654 - RNA, 12 nt, Salmonella enterica enterica serovar Typhi Ty2
gcuccagcaguu

SEQ ID NO: 1738655 - RNA, 16 nt, Salmonella enterica enterica serovar Typhi Ty2
gcuccaaguauugaua

SEQ ID NO: 1738656 - RNA, 20 nt, Salmonella enterica enterica serovar Typhi Ty2
gcuccagaccaccagcgaca

SEQ ID NO: 1738657 - RNA, 21 nt, Salmonella enterica enterica serovar Typhi Ty2
gcucaugauagggcagcaguu

SEQ ID NO: 1738658 - RNA, 21 nt, Salmonella enterica enterica serovar Typhi Ty2
gcucauauacccugcggcgaa

SEQ ID NO: 1738659 - RNA, 21 nt, Salmonella enterica enterica serovar Typhi Ty2
gcucauagccgcuuuccgccg

SEQ ID NO: 1738660 - RNA, 12 nt, Salmonella enterica enterica serovar Typhi Ty2
gcucauccagcg

SEQ ID NO: 1738661 - RNA, 16 nt, Salmonella enterica enterica serovar Typhi Ty2
gcucaucagcgccauu

SEQ ID NO: 1738662 - RNA, 21 nt, Salmonella enterica enterica serovar Typhi Ty2
gcucaguugguuagagcacau

SEQ ID NO: 1738663 - RNA, 15 nt, Salmonella enterica enterica serovar Typhi Ty2
gcgucgcugauugcc

SEQ ID NO: 1738664 - RNA, 16 nt, Salmonella enterica enterica serovar Typhi Ty2
gcgucgcguucagcgc

SEQ ID NO: 1738665 - RNA, 14 nt, Salmonella enterica enterica serovar Typhi Ty2
gcgucgcagugcgc

SEQ ID NO: 1738666 - RNA, 15 nt, Salmonella enterica enterica serovar Typhi Ty2
gcgucgccaucaggc

SEQ ID NO: 1738667 - RNA, 15 nt, Salmonella enterica enterica serovar Typhi Ty2
gcgucgccauccggc

SEQ ID NO: 1738668 - RNA, 14 nt, Salmonella enterica enterica serovar Typhi Ty2
gcgguuuacgccau

SEQ ID NO: 1738669 - RNA, 18 nt, Salmonella enterica enterica serovar Typhi Ty2
gcgguuucguggcgcugu

SEQ ID NO: 1738670 - RNA, 13 nt, Salmonella enterica enterica serovar Typhi Ty2
gcgguuuacgcca

SEQ ID NO: 1738671 - RNA, 15 nt, Salmonella enterica enterica serovar Typhi Ty2
gcguaaaucaggcca

SEQ ID NO: 1738672 - RNA, 22 nt, Salmonella enterica enterica serovar Typhi Ty2
gcgugguaucgcgacagcgcug

SEQ ID NO: 1738673 - RNA, 23 nt, Salmonella enterica enterica serovar Typhi Ty2
gcguggugucucgucgccagggc

SEQ ID NO: 1738674 - RNA, 20 nt, Salmonella enterica enterica serovar Typhi Ty2
gcgugucagggcggaacagc

SEQ ID NO: 1738675 - RNA, 20 nt, Salmonella enterica enterica serovar Typhi Ty2
gcguuaauauccuucagcgu

SEQ ID NO: 1738676 - RNA, 20 nt, Salmonella enterica enterica serovar Typhi Ty2
gcguuacuggcgaccggcag

SEQ ID NO: 1738677 - RNA, 22 nt, Salmonella enterica enterica serovar Typhi Ty2
gcguuaccuauuuguuccggca

SEQ ID NO: 1738678 - RNA, 16 nt, Salmonella enterica enterica serovar Typhi Ty2
gcguuacuggccuucu

SEQ ID NO: 1738679 - RNA, 18 nt, Salmonella enterica enterica serovar Typhi Ty2
gcgugacgacuaccgccg

SEQ ID NO: 1738680 - RNA, 23 nt, Salmonella enterica enterica serovar Typhi Ty2
gcgucugcaccgguacacacgcg

SEQ ID NO: 1738681 - RNA, 14 nt, Salmonella enterica enterica serovar Typhi Ty2
gcgugaccgguaag

SEQ ID NO: 1738682 - RNA, 16 nt, Salmonella enterica enterica serovar Typhi Ty2
gcgucugaaugacgcc

SEQ ID NO: 1738683 - RNA, 21 nt, Salmonella enterica enterica serovar Typhi Ty2
gcgucucucccucaaccaggg

SEQ ID NO: 1738684 - RNA, 21 nt, Salmonella enterica enterica serovar Typhi Ty2
gcgugacgccaagcagcggcg

SEQ ID NO: 1738685 - RNA, 21 nt, Salmonella enterica enterica serovar Typhi Ty2
gcgugcuaagcuggauaccgc

SEQ ID NO: 1738686 - RNA, 16 nt, Salmonella enterica enterica serovar Typhi Ty2
gcgugcguucauggcg

SEQ ID NO: 1738687 - RNA, 19 nt, Salmonella enterica enterica serovar Typhi Ty2
gcgugcguucauggcgcga

SEQ ID NO: 1738688 - RNA, 19 nt, Salmonella enterica enterica serovar Typhi Ty2
gcggcgccuuguccggcgu

SEQ ID NO: 1738689 - RNA, 17 nt, Salmonella enterica enterica serovar Typhi Ty2
gcggcgcuauccggcau

SEQ ID NO: 1738690 - RNA, 15 nt, Salmonella enterica enterica serovar Typhi Ty2
gcggcgcuauccggc

SEQ ID NO: 1738691 - RNA, 18 nt, Salmonella enterica enterica serovar Typhi Ty2
gcggcgccgaagcaggcg

SEQ ID NO: 1738692 - RNA, 14 nt, Salmonella enterica enterica serovar Typhi Ty2
gcggcgaaccggca

SEQ ID NO: 1738693 - RNA, 19 nt, Salmonella enterica enterica serovar Typhi Ty2
gcggcgaagcaucuuuccg

SEQ ID NO: 1738694 - RNA, 16 nt, Salmonella enterica enterica serovar Typhi Ty2
gcggcucauccagcaa

SEQ ID NO: 1738695 - RNA, 19 nt, Salmonella enterica enterica serovar Typhi Ty2
gcggcuagcgccuuauccg

SEQ ID NO: 1738696 - RNA, 23 nt, Salmonella enterica enterica serovar Typhi Ty2
gcggcuacugccagcgucgcuga

SEQ ID NO: 1738697 - RNA, 22 nt, Salmonella enterica enterica serovar Typhi Ty2
gcggcggacaacgcuccagcag

SEQ ID NO: 1738698 - RNA, 15 nt, Salmonella enterica enterica serovar Typhi Ty2
gcggcggacaacgcu

SEQ ID NO: 1738699 - RNA, 14 nt, Salmonella enterica enterica serovar Typhi Ty2
gcggcgguuauccg

SEQ ID NO: 1738700 - RNA, 16 nt, Salmonella enterica enterica serovar Typhi Ty2
gcggcgguuauccgcc

SEQ ID NO: 1738701 - RNA, 16 nt, Salmonella enterica enterica serovar Typhi Ty2
gcggcuuuacccggcg

SEQ ID NO: 1738702 - RNA, 18 nt, Salmonella enterica enterica serovar Typhi Ty2
gcggcuguguccgccaug

SEQ ID NO: 1738703 - RNA, 15 nt, Salmonella enterica enterica serovar Typhi Ty2
gcggcugguaagaga

SEQ ID NO: 1738704 - RNA, 20 nt, Salmonella enterica enterica serovar Typhi Ty2
gcgggaaauaccauccgcgc

SEQ ID NO: 1738705 - RNA, 18 nt, Salmonella enterica enterica serovar Typhi Ty2
gcgggaaauaccauccgc

SEQ ID NO: 1738706 - RNA, 14 nt, Salmonella enterica enterica serovar Typhi Ty2
gcgggaaauaccaa

SEQ ID NO: 1738707 - RNA, 17 nt, Salmonella enterica enterica serovar Typhi Ty2
gcgggaucugcgccauu

SEQ ID NO: 1738708 - RNA, 19 nt, Salmonella enterica enterica serovar Typhi Ty2
gcgggauauaacgcaacgu

SEQ ID NO: 1738709 - RNA, 23 nt, Salmonella enterica enterica serovar Typhi Ty2
gcgggcaaugccaccagcgccau

SEQ ID NO: 1738710 - RNA, 17 nt, Salmonella enterica enterica serovar Typhi Ty2
gcgggguaaacgguaau

SEQ ID NO: 1738711 - RNA, 21 nt, Salmonella enterica enterica serovar Typhi Ty2
gcggguaaacucacccaggcg

SEQ ID NO: 1738712 - RNA, 19 nt, Salmonella enterica enterica serovar Typhi Ty2
gcgguaaacaccaccgguu

SEQ ID NO: 1738713 - RNA, 15 nt, Salmonella enterica enterica serovar Typhi Ty2
gcgguaaauuccgca

SEQ ID NO: 1738714 - RNA, 17 nt, Salmonella enterica enterica serovar Typhi Ty2
gcgguaaggcaccgguu

SEQ ID NO: 1738715 - RNA, 13 nt, Salmonella enterica enterica serovar Typhi Ty2
gcgguaaucgcgc

SEQ ID NO: 1738716 - RNA, 13 nt, Salmonella enterica enterica serovar Typhi Ty2
gcgguaaucgcga

SEQ ID NO: 1738717 - RNA, 18 nt, Salmonella enterica enterica serovar Typhi Ty2
gcgguucaaucacgcgua

SEQ ID NO: 1738718 - RNA, 19 nt, Salmonella enterica enterica serovar Typhi Ty2
gcgguuaugcgggauauaa

SEQ ID NO: 1738719 - RNA, 16 nt, Salmonella enterica enterica serovar Typhi Ty2
gcgguuaacagccgcu

SEQ ID NO: 1738720 - RNA, 17 nt, Salmonella enterica enterica serovar Typhi Ty2
gcgguggguagcggcaa

SEQ ID NO: 1738721 - RNA, 16 nt, Salmonella enterica enterica serovar Typhi Ty2
gcgguauaucacgcca

SEQ ID NO: 1738722 - RNA, 23 nt, Salmonella enterica enterica serovar Typhi Ty2
gcgguaugcaccucuuuaugcgg

SEQ ID NO: 1738723 - RNA, 15 nt, Salmonella enterica enterica serovar Typhi Ty2
gcgguaugauacagu

SEQ ID NO: 1738724 - RNA, 16 nt, Salmonella enterica enterica serovar Typhi Ty2
gcgguauuucgccgcc

SEQ ID NO: 1738725 - RNA, 22 nt, Salmonella enterica enterica serovar Typhi Ty2
gcgguauugauacaggcgcugu

SEQ ID NO: 1738726 - RNA, 14 nt, Salmonella enterica enterica serovar Typhi Ty2
gcgguauacaccag

SEQ ID NO: 1738727 - RNA, 20 nt, Salmonella enterica enterica serovar Typhi Ty2
gcgguacucuuuuuccgcga

SEQ ID NO: 1738728 - RNA, 13 nt, Salmonella enterica enterica serovar Typhi Ty2
gcgguagcgccga

SEQ ID NO: 1738729 - RNA, 16 nt, Salmonella enterica enterica serovar Typhi Ty2
gcgguacgaccggauu

SEQ ID NO: 1738730 - RNA, 20 nt, Salmonella enterica enterica serovar Typhi Ty2
gcgcggucauucguacguuu

SEQ ID NO: 1738731 - RNA, 17 nt, Salmonella enterica enterica serovar Typhi Ty2
gcgcgguuuauccccgc

SEQ ID NO: 1738732 - RNA, 20 nt, Salmonella enterica enterica serovar Typhi Ty2
gcgcgucacaacagccggaa

SEQ ID NO: 1738733 - RNA, 16 nt, Salmonella enterica enterica serovar Typhi Ty2
gcgcggccccaucagc

SEQ ID NO: 1738734 - RNA, 19 nt, Salmonella enterica enterica serovar Typhi Ty2
gcgcggcaguucaggcucg

SEQ ID NO: 1738735 - RNA, 22 nt, Salmonella enterica enterica serovar Typhi Ty2
gcgcgccaucgucccaucgucg

SEQ ID NO: 1738736 - RNA, 14 nt, Salmonella enterica enterica serovar Typhi Ty2
gcgcguccacggcg

SEQ ID NO: 1738737 - RNA, 15 nt, Salmonella enterica enterica serovar Typhi Ty2
gcgcuacauccgcca

SEQ ID NO: 1738738 - RNA, 22 nt, Salmonella enterica enterica serovar Typhi Ty2
gcgcguuaucguagugccacaa

SEQ ID NO: 1738739 - RNA, 12 nt, Salmonella enterica enterica serovar Typhi Ty2
gcgcuaucaggc

SEQ ID NO: 1738740 - RNA, 13 nt, Salmonella enterica enterica serovar Typhi Ty2
gcgcuaucaacgc

SEQ ID NO: 1738741 - RNA, 19 nt, Salmonella enterica enterica serovar Typhi Ty2
gcgcuagccgcauccggca

SEQ ID NO: 1738742 - RNA, 18 nt, Salmonella enterica enterica serovar Typhi Ty2
gcgcuacgcuuaucaggc

SEQ ID NO: 1738743 - RNA, 19 nt, Salmonella enterica enterica serovar Typhi Ty2
gcgcuccaccaaccaggca

SEQ ID NO: 1738744 - RNA, 13 nt, Salmonella enterica enterica serovar Typhi Ty2
gcgcucaucaggc

SEQ ID NO: 1738745 - RNA, 17 nt, Salmonella enterica enterica serovar Typhi Ty2
gcgcucaugcgccuggc

SEQ ID NO: 1738746 - RNA, 16 nt, Salmonella enterica enterica serovar Typhi Ty2
gcgcugcggcuacacg

SEQ ID NO: 1738747 - RNA, 20 nt, Salmonella enterica enterica serovar Typhi Ty2
gcgcugcgcuuaucaggccu

SEQ ID NO: 1738748 - RNA, 20 nt, Salmonella enterica enterica serovar Typhi Ty2
gcgcugcguuuaucaggccu

SEQ ID NO: 1738749 - RNA, 13 nt, Salmonella enterica enterica serovar Typhi Ty2
gcgcucuccggca

SEQ ID NO: 1738750 - RNA, 15 nt, Salmonella enterica enterica serovar Typhi Ty2
gcgcucuaucaccgc

SEQ ID NO: 1738751 - RNA, 20 nt, Salmonella enterica enterica serovar Typhi Ty2
gcggcaccagcgaugcgcgc

SEQ ID NO: 1738752 - RNA, 15 nt, Salmonella enterica enterica serovar Typhi Ty2
gcggcaauuuguagc

SEQ ID NO: 1738753 - RNA, 20 nt, Salmonella enterica enterica serovar Typhi Ty2
gcggcacacuuucaucagcc

SEQ ID NO: 1738754 - RNA, 22 nt, Salmonella enterica enterica serovar Typhi Ty2
gcggcaauggccgcagcgccau

SEQ ID NO: 1738755 - RNA, 20 nt, Salmonella enterica enterica serovar Typhi Ty2
gcggcaaaaaauauagccau

SEQ ID NO: 1738756 - RNA, 20 nt, Salmonella enterica enterica serovar Typhi Ty2
gcggaucgugauaacgcgau

SEQ ID NO: 1738757 - RNA, 19 nt, Salmonella enterica enterica serovar Typhi Ty2
gcggaugucggucaucagg

SEQ ID NO: 1738758 - RNA, 17 nt, Salmonella enterica enterica serovar Typhi Ty2
gcggauuaagcgaaucc

SEQ ID NO: 1738759 - RNA, 16 nt, Salmonella enterica enterica serovar Typhi Ty2
gcggaucagcaaacga

SEQ ID NO: 1738760 - RNA, 19 nt, Salmonella enterica enterica serovar Typhi Ty2
gcggauaagcgcagcgcca

SEQ ID NO: 1738761 - RNA, 23 nt, Salmonella enterica enterica serovar Typhi Ty2
gcggauaacgcggguuagcgccg

SEQ ID NO: 1738762 - RNA, 23 nt, Salmonella enterica enterica serovar Typhi Ty2
gcggauaacguucgugaauauga

SEQ ID NO: 1738763 - RNA, 22 nt, Salmonella enterica enterica serovar Typhi Ty2
gcggauauauggcgggaaauca

SEQ ID NO: 1738764 - RNA, 15 nt, Salmonella enterica enterica serovar Typhi Ty2
gcggauaugcagcag

SEQ ID NO: 1738765 - RNA, 21 nt, Salmonella enterica enterica serovar Typhi Ty2
gcggacguagcggcgccggga

SEQ ID NO: 1738766 - RNA, 20 nt, Salmonella enterica enterica serovar Typhi Ty2
gcggaggccggcccugcggu

SEQ ID NO: 1738767 - RNA, 14 nt, Salmonella enterica enterica serovar Typhi Ty2
gcggacaugcgcau

SEQ ID NO: 1738768 - RNA, 15 nt, Salmonella enterica enterica serovar Typhi Ty2
gcggaaccuguccug

SEQ ID NO: 1738769 - RNA, 17 nt, Salmonella enterica enterica serovar Typhi Ty2
gcgcuggcuugaccgcu

SEQ ID NO: 1738770 - RNA, 22 nt, Salmonella enterica enterica serovar Typhi Ty2
gcggaauaaucagucgcagcgg

SEQ ID NO: 1738771 - RNA, 14 nt, Salmonella enterica enterica serovar Typhi Ty2
gcggaacgcguucc

SEQ ID NO: 1738772 - RNA, 16 nt, Salmonella enterica enterica serovar Typhi Ty2
gcgccgccauccggca

SEQ ID NO: 1738773 - RNA, 19 nt, Salmonella enterica enterica serovar Typhi Ty2
gcgccgccauccggcacaa

SEQ ID NO: 1738774 - RNA, 21 nt, Salmonella enterica enterica serovar Typhi Ty2
gcgccauguucauaccggaua

SEQ ID NO: 1738775 - RNA, 12 nt, Salmonella enterica enterica serovar Typhi Ty2
gcgccaucggcu

SEQ ID NO: 1738776 - RNA, 12 nt, Salmonella enterica enterica serovar Typhi Ty2
gcgcccgccauc

SEQ ID NO: 1738777 - RNA, 15 nt, Salmonella enterica enterica serovar Typhi Ty2
gcgccagcugcguca

SEQ ID NO: 1738778 - RNA, 22 nt, Salmonella enterica enterica serovar Typhi Ty2
gcgccagcugcgucaugucguu

SEQ ID NO: 1738779 - RNA, 13 nt, Salmonella enterica enterica serovar Typhi Ty2
gcgccaucaggca

SEQ ID NO: 1738780 - RNA, 16 nt, Salmonella enterica enterica serovar Typhi Ty2
gcgccauccaccaggc

SEQ ID NO: 1738781 - RNA, 14 nt, Salmonella enterica enterica serovar Typhi Ty2
gcgccauccacggc

SEQ ID NO: 1738782 - RNA, 19 nt, Salmonella enterica enterica serovar Typhi Ty2
gcgccauaguccauuacgc

SEQ ID NO: 1738783 - RNA, 19 nt, Salmonella enterica enterica serovar Typhi Ty2
gcgccaggucucauagcgc

SEQ ID NO: 1738784 - RNA, 15 nt, Salmonella enterica enterica serovar Typhi Ty2
gcgccaggugacgaa

SEQ ID NO: 1738785 - RNA, 22 nt, Salmonella enterica enterica serovar Typhi Ty2
gcgccagccagucgccaggcaa

SEQ ID NO: 1738786 - RNA, 15 nt, Salmonella enterica enterica serovar Typhi Ty2
gcgccagcccggcga

SEQ ID NO: 1738787 - RNA, 22 nt, Salmonella enterica enterica serovar Typhi Ty2
gcgccagccauagcagcaaauu

SEQ ID NO: 1738788 - RNA, 23 nt, Salmonella enterica enterica serovar Typhi Ty2
gcgccaccuuaaucgacuucaug

SEQ ID NO: 1738789 - RNA, 18 nt, Salmonella enterica enterica serovar Typhi Ty2
gcgccaccugcacggcgu

SEQ ID NO: 1738790 - RNA, 18 nt, Salmonella enterica enterica serovar Typhi Ty2
gcgcaugagcaaacugcu

SEQ ID NO: 1738791 - RNA, 21 nt, Salmonella enterica enterica serovar Typhi Ty2
gcgcaugugagcaucggcgau

SEQ ID NO: 1738792 - RNA, 14 nt, Salmonella enterica enterica serovar Typhi Ty2
gcgcauuaacgcca

SEQ ID NO: 1738793 - RNA, 22 nt, Salmonella enterica enterica serovar Typhi Ty2
gcgcauuaauaugcgcaaucac

SEQ ID NO: 1738794 - RNA, 16 nt, Salmonella enterica enterica serovar Typhi Ty2
gcgccaagaccgccua

SEQ ID NO: 1738795 - RNA, 14 nt, Salmonella enterica enterica serovar Typhi Ty2
gcgccaaucaccgc

SEQ ID NO: 1738796 - RNA, 20 nt, Salmonella enterica enterica serovar Typhi Ty2
gcgccaacgccacugccaua

SEQ ID NO: 1738797 - RNA, 20 nt, Salmonella enterica enterica serovar Typhi Ty2
gcgccguccauaaugacgcu

SEQ ID NO: 1738798 - RNA, 12 nt, Salmonella enterica enterica serovar Typhi Ty2
gcgccggcagca

SEQ ID NO: 1738799 - RNA, 15 nt, Salmonella enterica enterica serovar Typhi Ty2
gcgccggcagcaguu

SEQ ID NO: 1738800 - RNA, 15 nt, Salmonella enterica enterica serovar Typhi Ty2
gcgccgccgaacaga

SEQ ID NO: 1738801 - RNA, 21 nt, Salmonella enterica enterica serovar Typhi Ty2
gcgcgcagaccacgaaucagg

SEQ ID NO: 1738802 - RNA, 19 nt, Salmonella enterica enterica serovar Typhi Ty2
gcgcgcagaguguaggccu

SEQ ID NO: 1738803 - RNA, 17 nt, Salmonella enterica enterica serovar Typhi Ty2
gcgcgauuuucucgcua

SEQ ID NO: 1738804 - RNA, 13 nt, Salmonella enterica enterica serovar Typhi Ty2
gcgcgccagcgau

SEQ ID NO: 1738805 - RNA, 12 nt, Salmonella enterica enterica serovar Typhi Ty2
gcgcgcagcgcu

SEQ ID NO: 1738806 - RNA, 16 nt, Salmonella enterica enterica serovar Typhi Ty2
gcgcgaucaaucacgc

SEQ ID NO: 1738807 - RNA, 13 nt, Salmonella enterica enterica serovar Typhi Ty2
gcgcgacauccgc

SEQ ID NO: 1738808 - RNA, 16 nt, Salmonella enterica enterica serovar Typhi Ty2
gcgccugaccgcgauc

SEQ ID NO: 1738809 - RNA, 19 nt, Salmonella enterica enterica serovar Typhi Ty2
gcgaccgcgccacggccaa

SEQ ID NO: 1738810 - RNA, 11 nt, Salmonella enterica enterica serovar Typhi Ty2
gcgaccggcac

SEQ ID NO: 1738811 - RNA, 13 nt, Salmonella enterica enterica serovar Typhi Ty2
gcgaccggcagcc

SEQ ID NO: 1738812 - RNA, 21 nt, Salmonella enterica enterica serovar Typhi Ty2
gcgaccagcagcgcggcguac

SEQ ID NO: 1738813 - RNA, 18 nt, Salmonella enterica enterica serovar Typhi Ty2
gcgaccagcgucagccag

SEQ ID NO: 1738814 - RNA, 17 nt, Salmonella enterica enterica serovar Typhi Ty2
gcgaccacuccggcaua

SEQ ID NO: 1738815 - RNA, 24 nt, Salmonella enterica enterica serovar Typhi Ty2
gcgacauggcccauuucaugaccg

SEQ ID NO: 1738816 - RNA, 15 nt, Salmonella enterica enterica serovar Typhi Ty2
gcgacagcccggcgu

SEQ ID NO: 1738817 - RNA, 14 nt, Salmonella enterica enterica serovar Typhi Ty2
gcgacacuccgcgc

SEQ ID NO: 1738818 - RNA, 19 nt, Salmonella enterica enterica serovar Typhi Ty2
gcgacaacgccaucagccg

SEQ ID NO: 1738819 - RNA, 18 nt, Salmonella enterica enterica serovar Typhi Ty2
gcgacaacgcuuccggcg

SEQ ID NO: 1738820 - RNA, 17 nt, Salmonella enterica enterica serovar Typhi Ty2
gcgaauuacuaaucugu

SEQ ID NO: 1738821 - RNA, 16 nt, Salmonella enterica enterica serovar Typhi Ty2
gcgacaaacagcgccc

SEQ ID NO: 1738822 - RNA, 14 nt, Salmonella enterica enterica serovar Typhi Ty2
gcgaauuucaacgc

SEQ ID NO: 1738823 - RNA, 20 nt, Salmonella enterica enterica serovar Typhi Ty2
gcgaauugccgucgccggaa

SEQ ID NO: 1738824 - RNA, 20 nt, Salmonella enterica enterica serovar Typhi Ty2
gcgaaucucgugaucgccaa

SEQ ID NO: 1738825 - RNA, 15 nt, Salmonella enterica enterica serovar Typhi Ty2
gcgaaugcaggccga

SEQ ID NO: 1738826 - RNA, 23 nt, Salmonella enterica enterica serovar Typhi Ty2
gcgaaucacauccgccagcgccu

SEQ ID NO: 1738827 - RNA, 20 nt, Salmonella enterica enterica serovar Typhi Ty2
gcgaauagugauaccagucg

SEQ ID NO: 1738828 - RNA, 20 nt, Salmonella enterica enterica serovar Typhi Ty2
gcgaaucgacaauccgccac

SEQ ID NO: 1738829 - RNA, 17 nt, Salmonella enterica enterica serovar Typhi Ty2
gcgaauccagaucgccc

SEQ ID NO: 1738830 - RNA, 15 nt, Salmonella enterica enterica serovar Typhi Ty2
gcgaauccagcgccg

SEQ ID NO: 1738831 - RNA, 19 nt, Salmonella enterica enterica serovar Typhi Ty2
gcgaauaaaauucagcgca

SEQ ID NO: 1738832 - RNA, 17 nt, Salmonella enterica enterica serovar Typhi Ty2
gcgaauaacaucauccg

SEQ ID NO: 1738833 - RNA, 20 nt, Salmonella enterica enterica serovar Typhi Ty2
gcgaauaaucccggcgccaa

SEQ ID NO: 1738834 - RNA, 14 nt, Salmonella enterica enterica serovar Typhi Ty2
gcgaagugcagcgu

SEQ ID NO: 1738835 - RNA, 19 nt, Salmonella enterica enterica serovar Typhi Ty2
gccuuuacccuuacggcca

SEQ ID NO: 1738836 - RNA, 14 nt, Salmonella enterica enterica serovar Typhi Ty2
gccuuuauccagcg

SEQ ID NO: 1738837 - RNA, 16 nt, Salmonella enterica enterica serovar Typhi Ty2
gcgacggagcgugcug

SEQ ID NO: 1738838 - RNA, 18 nt, Salmonella enterica enterica serovar Typhi Ty2
gcgacggcguauucggca

SEQ ID NO: 1738839 - RNA, 20 nt, Salmonella enterica enterica serovar Typhi Ty2
gcgacggcguaagcgcuaug

SEQ ID NO: 1738840 - RNA, 17 nt, Salmonella enterica enterica serovar Typhi Ty2
gcgacggcguaagcgcu

SEQ ID NO: 1738841 - RNA, 12 nt, Salmonella enterica enterica serovar Typhi Ty2
gcgacguuaucu

SEQ ID NO: 1738842 - RNA, 18 nt, Salmonella enterica enterica serovar Typhi Ty2
gcgacgugacggugaccu

SEQ ID NO: 1738843 - RNA, 17 nt, Salmonella enterica enterica serovar Typhi Ty2
gcgacuaaccagcgcaa

SEQ ID NO: 1738844 - RNA, 21 nt, Salmonella enterica enterica serovar Typhi Ty2
gcgacuaacgucuuauccggc

SEQ ID NO: 1738845 - RNA, 22 nt, Salmonella enterica enterica serovar Typhi Ty2
gcgacuaccguucacggcgaua

SEQ ID NO: 1738846 - RNA, 20 nt, Salmonella enterica enterica serovar Typhi Ty2
gcgacuaccucuuauccggc

SEQ ID NO: 1738847 - RNA, 15 nt, Salmonella enterica enterica serovar Typhi Ty2
gcgacuaaccagcgc

SEQ ID NO: 1738848 - RNA, 19 nt, Salmonella enterica enterica serovar Typhi Ty2
gcgagauuacugcgugcug

SEQ ID NO: 1738849 - RNA, 22 nt, Salmonella enterica enterica serovar Typhi Ty2
gcgagcaacuuuuucugcgcgg

SEQ ID NO: 1738850 - RNA, 17 nt, Salmonella enterica enterica serovar Typhi Ty2
gcgaggccacgcaccgu

SEQ ID NO: 1738851 - RNA, 20 nt, Salmonella enterica enterica serovar Typhi Ty2
gcgauguucuugccgccauc

SEQ ID NO: 1738852 - RNA, 15 nt, Salmonella enterica enterica serovar Typhi Ty2
gcgauguuggcgccc

SEQ ID NO: 1738853 - RNA, 21 nt, Salmonella enterica enterica serovar Typhi Ty2
gcgauuaacgcauagauauaa

SEQ ID NO: 1738854 - RNA, 20 nt, Salmonella enterica enterica serovar Typhi Ty2
gcgauuagcuggcugcgcgg

SEQ ID NO: 1738855 - RNA, 18 nt, Salmonella enterica enterica serovar Typhi Ty2
gcgauuccgguuccggcg

SEQ ID NO: 1738856 - RNA, 16 nt, Salmonella enterica enterica serovar Typhi Ty2
gcgauuuccuguguua

SEQ ID NO: 1738857 - RNA, 18 nt, Salmonella enterica enterica serovar Typhi Ty2
gcgauugauucaccgaca

SEQ ID NO: 1738858 - RNA, 15 nt, Salmonella enterica enterica serovar Typhi Ty2
gcgauugcgccagac

SEQ ID NO: 1738859 - RNA, 18 nt, Salmonella enterica enterica serovar Typhi Ty2
gcgauuuguccgcugcug

SEQ ID NO: 1738860 - RNA, 14 nt, Salmonella enterica enterica serovar Typhi Ty2
gcgauuuucagcac

SEQ ID NO: 1738861 - RNA, 14 nt, Salmonella enterica enterica serovar Typhi Ty2
gcgcaaaagcgcgc

SEQ ID NO: 1738862 - RNA, 18 nt, Salmonella enterica enterica serovar Typhi Ty2
gcgcaaaaucgcaaacgc

SEQ ID NO: 1738863 - RNA, 20 nt, Salmonella enterica enterica serovar Typhi Ty2
gcgaugugcccgagugacug

SEQ ID NO: 1738864 - RNA, 19 nt, Salmonella enterica enterica serovar Typhi Ty2
gcgauguauuuauccacgc

SEQ ID NO: 1738865 - RNA, 13 nt, Salmonella enterica enterica serovar Typhi Ty2
gcgcaaccggcgu

SEQ ID NO: 1738866 - RNA, 15 nt, Salmonella enterica enterica serovar Typhi Ty2
gcgcaaccgcaucac

SEQ ID NO: 1738867 - RNA, 15 nt, Salmonella enterica enterica serovar Typhi Ty2
gcgcaaacaacccgg

SEQ ID NO: 1738868 - RNA, 21 nt, Salmonella enterica enterica serovar Typhi Ty2
gcgcaacgucgccauccggca

SEQ ID NO: 1738869 - RNA, 16 nt, Salmonella enterica enterica serovar Typhi Ty2
gcgcacaggccuucau

SEQ ID NO: 1738870 - RNA, 19 nt, Salmonella enterica enterica serovar Typhi Ty2
gcgcacacaauagcaaucu

SEQ ID NO: 1738871 - RNA, 19 nt, Salmonella enterica enterica serovar Typhi Ty2
gcgcaauuuuguugcgccc

SEQ ID NO: 1738872 - RNA, 15 nt, Salmonella enterica enterica serovar Typhi Ty2
gcgcaauaugcggcg

SEQ ID NO: 1738873 - RNA, 22 nt, Salmonella enterica enterica serovar Typhi Ty2
gcgcaauauuguuaaccaggcc

SEQ ID NO: 1738874 - RNA, 19 nt, Salmonella enterica enterica serovar Typhi Ty2
gcgaucacuucgacaugcg

SEQ ID NO: 1738875 - RNA, 15 nt, Salmonella enterica enterica serovar Typhi Ty2
gcgaucacuaccgcc

SEQ ID NO: 1738876 - RNA, 22 nt, Salmonella enterica enterica serovar Typhi Ty2
gcgaggugcuggugaccgccuu

SEQ ID NO: 1738877 - RNA, 20 nt, Salmonella enterica enterica serovar Typhi Ty2
gcgauccagccccagcgcca

SEQ ID NO: 1738878 - RNA, 15 nt, Salmonella enterica enterica serovar Typhi Ty2
gcgaucaggcgucag

SEQ ID NO: 1738879 - RNA, 11 nt, Salmonella enterica enterica serovar Typhi Ty2
gcgaucagcgc

SEQ ID NO: 1738880 - RNA, 22 nt, Salmonella enterica enterica serovar Typhi Ty2
gcgaucgccgucguucagccag

SEQ ID NO: 1738881 - RNA, 20 nt, Salmonella enterica enterica serovar Typhi Ty2
gcgaucgcgccggucgccag

SEQ ID NO: 1738882 - RNA, 20 nt, Salmonella enterica enterica serovar Typhi Ty2
gcgaucccaguugaucggcc

SEQ ID NO: 1738883 - RNA, 14 nt, Salmonella enterica enterica serovar Typhi Ty2
gcgaucugucgccg

SEQ ID NO: 1738884 - RNA, 13 nt, Salmonella enterica enterica serovar Typhi Ty2
gcgaugagcgcca

SEQ ID NO: 1738885 - RNA, 19 nt, Salmonella enterica enterica serovar Typhi Ty2
gcgaugagcgccagcaaca

SEQ ID NO: 1738886 - RNA, 20 nt, Salmonella enterica enterica serovar Typhi Ty2
gcgaugacggcgcguuaucg

SEQ ID NO: 1738887 - RNA, 22 nt, Salmonella enterica enterica serovar Typhi Ty2
gcgaucugugucguccaggccu

SEQ ID NO: 1738888 - RNA, 20 nt, Salmonella enterica enterica serovar Typhi Ty2
gcgaucugugucguccaggc

SEQ ID NO: 1738889 - RNA, 19 nt, Salmonella enterica enterica serovar Typhi Ty2
gcgaugccuuauccggccu

SEQ ID NO: 1738890 - RNA, 19 nt, Salmonella enterica enterica serovar Typhi Ty2
gcgaugcgcuuuuccaggc

SEQ ID NO: 1738891 - RNA, 18 nt, Salmonella enterica enterica serovar Typhi Ty2
gccuggagaucagcaugg

SEQ ID NO: 1738892 - RNA, 18 nt, Salmonella enterica enterica serovar Typhi Ty2
gccuggagcguaagcgcg

SEQ ID NO: 1738893 - RNA, 18 nt, Salmonella enterica enterica serovar Typhi Ty2
gccuggcaacaugaccag

SEQ ID NO: 1738894 - RNA, 14 nt, Salmonella enterica enterica serovar Typhi Ty2
gccugcucaucagg

SEQ ID NO: 1738895 - RNA, 18 nt, Salmonella enterica enterica serovar Typhi Ty2
gccugccauagcaucacc

SEQ ID NO: 1738896 - RNA, 17 nt, Salmonella enterica enterica serovar Typhi Ty2
gccugcauuugcuggcg

SEQ ID NO: 1738897 - RNA, 13 nt, Salmonella enterica enterica serovar Typhi Ty2
gccuucggccuga

SEQ ID NO: 1738898 - RNA, 21 nt, Salmonella enterica enterica serovar Typhi Ty2
gccuugcgggauacaugcccg

SEQ ID NO: 1738899 - RNA, 15 nt, Salmonella enterica enterica serovar Typhi Ty2
gccuuacaggcgcau

SEQ ID NO: 1738900 - RNA, 19 nt, Salmonella enterica enterica serovar Typhi Ty2
gccuuacccauacaguaca

SEQ ID NO: 1738901 - RNA, 17 nt, Salmonella enterica enterica serovar Typhi Ty2
gccuuaccgggccuacg

SEQ ID NO: 1738902 - RNA, 12 nt, Salmonella enterica enterica serovar Typhi Ty2
gccuuagcgccc

SEQ ID NO: 1738903 - RNA, 19 nt, Salmonella enterica enterica serovar Typhi Ty2
gccuuauccgaccuacaga

SEQ ID NO: 1738904 - RNA, 18 nt, Salmonella enterica enterica serovar Typhi Ty2
gccuuauccggccuacac

SEQ ID NO: 1738905 - RNA, 22 nt, Salmonella enterica enterica serovar Typhi Ty2
gccuuccuccagcaucaggugg

SEQ ID NO: 1738906 - RNA, 22 nt, Salmonella enterica enterica serovar Typhi Ty2
gccuuaaaaaggacaagcugau

SEQ ID NO: 1738907 - RNA, 20 nt, Salmonella enterica enterica serovar Typhi Ty2
gccugguaagcguagcgcca

SEQ ID NO: 1738908 - RNA, 17 nt, Salmonella enterica enterica serovar Typhi Ty2
gccucccccucaaucgg

SEQ ID NO: 1738909 - RNA, 20 nt, Salmonella enterica enterica serovar Typhi Ty2
gccucguucccagcgggaac

SEQ ID NO: 1738910 - RNA, 22 nt, Salmonella enterica enterica serovar Typhi Ty2
gccucguguaaggcuuccggca

SEQ ID NO: 1738911 - RNA, 16 nt, Salmonella enterica enterica serovar Typhi Ty2
gccucuuuugucgucc

SEQ ID NO: 1738912 - RNA, 14 nt, Salmonella enterica enterica serovar Typhi Ty2
gccucguccugcaa

SEQ ID NO: 1738913 - RNA, 17 nt, Salmonella enterica enterica serovar Typhi Ty2
gccugacuccggguaac

SEQ ID NO: 1738914 - RNA, 15 nt, Salmonella enterica enterica serovar Typhi Ty2
gccugagguuucgcc

SEQ ID NO: 1738915 - RNA, 16 nt, Salmonella enterica enterica serovar Typhi Ty2
gccugaauaaugaccu

SEQ ID NO: 1738916 - RNA, 21 nt, Salmonella enterica enterica serovar Typhi Ty2
gccugaaguaucgacgcagac

SEQ ID NO: 1738917 - RNA, 23 nt, Salmonella enterica enterica serovar Typhi Ty2
gccugacgaaagucauccaguac

SEQ ID NO: 1738918 - RNA, 13 nt, Salmonella enterica enterica serovar Typhi Ty2
gccugaugaccgc

SEQ ID NO: 1738919 - RNA, 16 nt, Salmonella enterica enterica serovar Typhi Ty2
gccugaugacgcuacg

SEQ ID NO: 1738920 - RNA, 23 nt, Salmonella enterica enterica serovar Typhi Ty2
gccugaugagguuacguucauca

SEQ ID NO: 1738921 - RNA, 15 nt, Salmonella enterica enterica serovar Typhi Ty2
gccugauaagcgcag

SEQ ID NO: 1738922 - RNA, 20 nt, Salmonella enterica enterica serovar Typhi Ty2
gccugauaagcgaagcgcca

SEQ ID NO: 1738923 - RNA, 17 nt, Salmonella enterica enterica serovar Typhi Ty2
gccugauaagcgaagcg

SEQ ID NO: 1738924 - RNA, 20 nt, Salmonella enterica enterica serovar Typhi Ty2
gccugauaagcauagcgcca

SEQ ID NO: 1738925 - RNA, 20 nt, Salmonella enterica enterica serovar Typhi Ty2
gccugauaaacguagcguca

SEQ ID NO: 1738926 - RNA, 20 nt, Salmonella enterica enterica serovar Typhi Ty2
gccugauaagcguagcgcca

SEQ ID NO: 1738927 - RNA, 16 nt, Salmonella enterica enterica serovar Typhi Ty2
gccugcauacguuuca

SEQ ID NO: 1738928 - RNA, 23 nt, Salmonella enterica enterica serovar Typhi Ty2
gccugauggcgcuacgcuuauca

SEQ ID NO: 1738929 - RNA, 19 nt, Salmonella enterica enterica serovar Typhi Ty2
gccugauggcgcuacgcca

SEQ ID NO: 1738930 - RNA, 20 nt, Salmonella enterica enterica serovar Typhi Ty2
gccugaugcugcgcauccgc

SEQ ID NO: 1738931 - RNA, 19 nt, Salmonella enterica enterica serovar Typhi Ty2
gccugauggcguagcgcca

SEQ ID NO: 1738932 - RNA, 23 nt, Salmonella enterica enterica serovar Typhi Ty2
gccugauggcgcuucgcuuauca

SEQ ID NO: 1738933 - RNA, 20 nt, Salmonella enterica enterica serovar Typhi Ty2
gccugauucaccaacugcug

SEQ ID NO: 1738934 - RNA, 15 nt, Salmonella enterica enterica serovar Typhi Ty2
gccgucauccgcgua

SEQ ID NO: 1738935 - RNA, 16 nt, Salmonella enterica enterica serovar Typhi Ty2
gccguauaauccagcu

SEQ ID NO: 1738936 - RNA, 20 nt, Salmonella enterica enterica serovar Typhi Ty2
gccgucauccgcguaaucgc

SEQ ID NO: 1738937 - RNA, 18 nt, Salmonella enterica enterica serovar Typhi Ty2
gccgucgccgaauaccac

SEQ ID NO: 1738938 - RNA, 22 nt, Salmonella enterica enterica serovar Typhi Ty2
gccgguugccagggaaugccau

SEQ ID NO: 1738939 - RNA, 18 nt, Salmonella enterica enterica serovar Typhi Ty2
gccgguugggcgcuuaac

SEQ ID NO: 1738940 - RNA, 20 nt, Salmonella enterica enterica serovar Typhi Ty2
gccgguuucuccagccucgc

SEQ ID NO: 1738941 - RNA, 21 nt, Salmonella enterica enterica serovar Typhi Ty2
gccgguuuuagcguauccggc

SEQ ID NO: 1738942 - RNA, 14 nt, Salmonella enterica enterica serovar Typhi Ty2
gccguagcagaaga

SEQ ID NO: 1738943 - RNA, 23 nt, Salmonella enterica enterica serovar Typhi Ty2
gccuacggucgguuucauaacgc

SEQ ID NO: 1738944 - RNA, 13 nt, Salmonella enterica enterica serovar Typhi Ty2
gccuacauccggc

SEQ ID NO: 1738945 - RNA, 14 nt, Salmonella enterica enterica serovar Typhi Ty2
gccuaccaucgcgc

SEQ ID NO: 1738946 - RNA, 14 nt, Salmonella enterica enterica serovar Typhi Ty2
gccuaccagcacau

SEQ ID NO: 1738947 - RNA, 19 nt, Salmonella enterica enterica serovar Typhi Ty2
gccucauccgcauagcgca

SEQ ID NO: 1738948 - RNA, 16 nt, Salmonella enterica enterica serovar Typhi Ty2
gccguuaucggccugc

SEQ ID NO: 1738949 - RNA, 13 nt, Salmonella enterica enterica serovar Typhi Ty2
gccguucaaacgg

SEQ ID NO: 1738950 - RNA, 18 nt, Salmonella enterica enterica serovar Typhi Ty2
gccguuccguucgcguca

SEQ ID NO: 1738951 - RNA, 13 nt, Salmonella enterica enterica serovar Typhi Ty2
gccguuuuccggu

SEQ ID NO: 1738952 - RNA, 18 nt, Salmonella enterica enterica serovar Typhi Ty2
gccguuuuggcagcgccc

SEQ ID NO: 1738953 - RNA, 14 nt, Salmonella enterica enterica serovar Typhi Ty2
gccuaacagcgccg

SEQ ID NO: 1738954 - RNA, 15 nt, Salmonella enterica enterica serovar Typhi Ty2
gccuaacagcgccgc

SEQ ID NO: 1738955 - RNA, 20 nt, Salmonella enterica enterica serovar Typhi Ty2
gccguuuuuaacgccggcaa

SEQ ID NO: 1738956 - RNA, 14 nt, Salmonella enterica enterica serovar Typhi Ty2
gccuaagaccagca

SEQ ID NO: 1738957 - RNA, 24 nt, Salmonella enterica enterica serovar Typhi Ty2
gccuaagaucggguggccuaacgc

SEQ ID NO: 1738958 - RNA, 13 nt, Salmonella enterica enterica serovar Typhi Ty2
gccguuagcgccu

SEQ ID NO: 1738959 - RNA, 19 nt, Salmonella enterica enterica serovar Typhi Ty2
gccguuaaucuggccuacg

SEQ ID NO: 1738960 - RNA, 19 nt, Salmonella enterica enterica serovar Typhi Ty2
gccguuaaucgauaagcca

SEQ ID NO: 1738961 - RNA, 15 nt, Salmonella enterica enterica serovar Typhi Ty2
gggccauucgccaua

SEQ ID NO: 1738962 - RNA, 19 nt, Salmonella enterica enterica serovar Typhi Ty2
gggccagcagcgcaucauc

SEQ ID NO: 1738963 - RNA, 19 nt, Salmonella enterica enterica serovar Typhi Ty2
gggcaugauuacagauauc

SEQ ID NO: 1738964 - RNA, 17 nt, Salmonella enterica enterica serovar Typhi Ty2
gggcauuuuccggcgac

SEQ ID NO: 1738965 - RNA, 15 nt, Salmonella enterica enterica serovar Typhi Ty2
gggcgaacuggcggu

SEQ ID NO: 1738966 - RNA, 15 nt, Salmonella enterica enterica serovar Typhi Ty2
ggcugugggcguguc

SEQ ID NO: 1738967 - RNA, 22 nt, Salmonella enterica enterica serovar Typhi Ty2
ggcuguccuugcgccaucggcg

SEQ ID NO: 1738968 - RNA, 15 nt, Salmonella enterica enterica serovar Typhi Ty2
ggcuuagcgccagau

SEQ ID NO: 1738969 - RNA, 23 nt, Salmonella enterica enterica serovar Typhi Ty2
ggcuuaucucuacuuuccugaag

SEQ ID NO: 1738970 - RNA, 15 nt, Salmonella enterica enterica serovar Typhi Ty2
ggcuucaaccuccug

SEQ ID NO: 1738971 - RNA, 22 nt, Salmonella enterica enterica serovar Typhi Ty2
ggcuucaaucgucguuccgcca

SEQ ID NO: 1738972 - RNA, 17 nt, Salmonella enterica enterica serovar Typhi Ty2
gggagaaaacgcggccu

SEQ ID NO: 1738973 - RNA, 14 nt, Salmonella enterica enterica serovar Typhi Ty2
gggagaacucaucu

SEQ ID NO: 1738974 - RNA, 16 nt, Salmonella enterica enterica serovar Typhi Ty2
gggaggugcugguggu

SEQ ID NO: 1738975 - RNA, 18 nt, Salmonella enterica enterica serovar Typhi Ty2
gggaucuuaucuuucagc

SEQ ID NO: 1738976 - RNA, 20 nt, Salmonella enterica enterica serovar Typhi Ty2
gggauauuuccgcgauuugc

SEQ ID NO: 1738977 - RNA, 16 nt, Salmonella enterica enterica serovar Typhi Ty2
gggaucuucaaugaac

SEQ ID NO: 1738978 - RNA, 15 nt, Salmonella enterica enterica serovar Typhi Ty2
gggucagcguaucca

SEQ ID NO: 1738979 - RNA, 17 nt, Salmonella enterica enterica serovar Typhi Ty2
gggucagugauaacgcg

SEQ ID NO: 1738980 - RNA, 17 nt, Salmonella enterica enterica serovar Typhi Ty2
gggggaacggcagacag

SEQ ID NO: 1738981 - RNA, 14 nt, Salmonella enterica enterica serovar Typhi Ty2
ggguaauggucagc

SEQ ID NO: 1738982 - RNA, 15 nt, Salmonella enterica enterica serovar Typhi Ty2
ggguaaaaucagcgc

SEQ ID NO: 1738983 - RNA, 21 nt, Salmonella enterica enterica serovar Typhi Ty2
gggcguugcugcacgucgcgc

SEQ ID NO: 1738984 - RNA, 16 nt, Salmonella enterica enterica serovar Typhi Ty2
gggcuaaagcaucggg

SEQ ID NO: 1738985 - RNA, 15 nt, Salmonella enterica enterica serovar Typhi Ty2
gggcuuaaugcgcac

SEQ ID NO: 1738986 - RNA, 20 nt, Salmonella enterica enterica serovar Typhi Ty2
gggcuuccucgccaccggca

SEQ ID NO: 1738987 - RNA, 17 nt, Salmonella enterica enterica serovar Typhi Ty2
gggcuggcggcgauggc

SEQ ID NO: 1738988 - RNA, 15 nt, Salmonella enterica enterica serovar Typhi Ty2
ggggauucugccauc

SEQ ID NO: 1738989 - RNA, 13 nt, Salmonella enterica enterica serovar Typhi Ty2
gggcuuuauccug

SEQ ID NO: 1738990 - RNA, 15 nt, Salmonella enterica enterica serovar Typhi Ty2
gggcuuuuagccgcg

SEQ ID NO: 1738991 - RNA, 14 nt, Salmonella enterica enterica serovar Typhi Ty2
ggggcauuuuccgg

SEQ ID NO: 1738992 - RNA, 13 nt, Salmonella enterica enterica serovar Typhi Ty2
ggcguauagccgc

SEQ ID NO: 1738993 - RNA, 21 nt, Salmonella enterica enterica serovar Typhi Ty2
ggcgucaacguuuuucagccg

SEQ ID NO: 1738994 - RNA, 15 nt, Salmonella enterica enterica serovar Typhi Ty2
ggcgucauccugcag

SEQ ID NO: 1738995 - RNA, 12 nt, Salmonella enterica enterica serovar Typhi Ty2
ggcgucaucggg

SEQ ID NO: 1738996 - RNA, 16 nt, Salmonella enterica enterica serovar Typhi Ty2
ggcgggcgucaccguc

SEQ ID NO: 1738997 - RNA, 18 nt, Salmonella enterica enterica serovar Typhi Ty2
ggcguacacuucauccgg

SEQ ID NO: 1738998 - RNA, 12 nt, Salmonella enterica enterica serovar Typhi Ty2
ggcguaccgccu

SEQ ID NO: 1738999 - RNA, 14 nt, Salmonella enterica enterica serovar Typhi Ty2
ggcguaaaucaggc

SEQ ID NO: 1739000 - RNA, 20 nt, Salmonella enterica enterica serovar Typhi Ty2
ggcuccuguugguuauacgg

SEQ ID NO: 1739001 - RNA, 18 nt, Salmonella enterica enterica serovar Typhi Ty2
ggcucagcauagcgcuga

SEQ ID NO: 1739002 - RNA, 21 nt, Salmonella enterica enterica serovar Typhi Ty2
ggcuaccgggcaaacauuagc

SEQ ID NO: 1739003 - RNA, 15 nt, Salmonella enterica enterica serovar Typhi Ty2
ggcucaucagcgcca

SEQ ID NO: 1739004 - RNA, 21 nt, Salmonella enterica enterica serovar Typhi Ty2
ggcuaaccuguaucugcugac

SEQ ID NO: 1739005 - RNA, 20 nt, Salmonella enterica enterica serovar Typhi Ty2
ggcuacccagacaagcacau

SEQ ID NO: 1739006 - RNA, 15 nt, Salmonella enterica enterica serovar Typhi Ty2
ggcguuggcuaucgc

SEQ ID NO: 1739007 - RNA, 15 nt, Salmonella enterica enterica serovar Typhi Ty2
ggcgcgcuuaucugg

SEQ ID NO: 1739008 - RNA, 13 nt, Salmonella enterica enterica serovar Typhi Ty2
ggcgcgcagcugc

SEQ ID NO: 1739009 - RNA, 17 nt, Salmonella enterica enterica serovar Typhi Ty2
ggcgcuacgcuuauccg

SEQ ID NO: 1739010 - RNA, 20 nt, Salmonella enterica enterica serovar Typhi Ty2
ggcgcuacgcuuaucgggcc

SEQ ID NO: 1739011 - RNA, 19 nt, Salmonella enterica enterica serovar Typhi Ty2
ggcgcuacgcuuaucaggc

SEQ ID NO: 1739012 - RNA, 19 nt, Salmonella enterica enterica serovar Typhi Ty2
ggcgcugccgcuuauccgg

SEQ ID NO: 1739013 - RNA, 18 nt, Salmonella enterica enterica serovar Typhi Ty2
ggcgcugcgcgcaucggg

SEQ ID NO: 1739014 - RNA, 21 nt, Salmonella enterica enterica serovar Typhi Ty2
ggcgcugaguuucucccgcca

SEQ ID NO: 1739015 - RNA, 19 nt, Salmonella enterica enterica serovar Typhi Ty2
ggcgcuggugacaucgccg

SEQ ID NO: 1739016 - RNA, 22 nt, Salmonella enterica enterica serovar Typhi Ty2
ggcgcuggcguacgcauccgcg

SEQ ID NO: 1739017 - RNA, 22 nt, Salmonella enterica enterica serovar Typhi Ty2
ggcgcuguacgccucuuucagc

SEQ ID NO: 1739018 - RNA, 15 nt, Salmonella enterica enterica serovar Typhi Ty2
ggcgcuguaauagau

SEQ ID NO: 1739019 - RNA, 19 nt, Salmonella enterica enterica serovar Typhi Ty2
ggcgcuuugcuuauccggc

SEQ ID NO: 1739020 - RNA, 19 nt, Salmonella enterica enterica serovar Typhi Ty2
ggcggccaaccccggcaaa

SEQ ID NO: 1739021 - RNA, 12 nt, Salmonella enterica enterica serovar Typhi Ty2
ggcggcacgcca

SEQ ID NO: 1739022 - RNA, 14 nt, Salmonella enterica enterica serovar Typhi Ty2
ggcggcacaucgcg

SEQ ID NO: 1739023 - RNA, 23 nt, Salmonella enterica enterica serovar Typhi Ty2
ggcggcgcgaacgccuuauccgg

SEQ ID NO: 1739024 - RNA, 23 nt, Salmonella enterica enterica serovar Typhi Ty2
ggcggcgugaacgucuuauccgg

SEQ ID NO: 1739025 - RNA, 15 nt, Salmonella enterica enterica serovar Typhi Ty2
ggcggcguuuuccgg

SEQ ID NO: 1739026 - RNA, 16 nt, Salmonella enterica enterica serovar Typhi Ty2
ggcggcuuucagcgua

SEQ ID NO: 1739027 - RNA, 19 nt, Salmonella enterica enterica serovar Typhi Ty2
ggccgagaguccagcgcca

SEQ ID NO: 1739028 - RNA, 14 nt, Salmonella enterica enterica serovar Typhi Ty2
ggccgacggcauaa

SEQ ID NO: 1739029 - RNA, 22 nt, Salmonella enterica enterica serovar Typhi Ty2
ggcccggacgccguccaggcuc

SEQ ID NO: 1739030 - RNA, 18 nt, Salmonella enterica enterica serovar Typhi Ty2
ggcccgacauguucgaac

SEQ ID NO: 1739031 - RNA, 20 nt, Salmonella enterica enterica serovar Typhi Ty2
ggccaguaucgcgccgccaa

SEQ ID NO: 1739032 - RNA, 23 nt, Salmonella enterica enterica serovar Typhi Ty2
ggccagugguaaaaaagucacuu

SEQ ID NO: 1739033 - RNA, 15 nt, Salmonella enterica enterica serovar Typhi Ty2
ggccauuaccgcccu

SEQ ID NO: 1739034 - RNA, 18 nt, Salmonella enterica enterica serovar Typhi Ty2
ggccauuuucggcguugc

SEQ ID NO: 1739035 - RNA, 18 nt, Salmonella enterica enterica serovar Typhi Ty2
ggccaucuuccagcauca

SEQ ID NO: 1739036 - RNA, 18 nt, Salmonella enterica enterica serovar Typhi Ty2
ggccaugaucgccgccau

SEQ ID NO: 1739037 - RNA, 23 nt, Salmonella enterica enterica serovar Typhi Ty2
ggccaugaucgccgccaucggcg

SEQ ID NO: 1739038 - RNA, 14 nt, Salmonella enterica enterica serovar Typhi Ty2
ggccaccagcgcca

SEQ ID NO: 1739039 - RNA, 19 nt, Salmonella enterica enterica serovar Typhi Ty2
ggccaccauaucuuccagg

SEQ ID NO: 1739040 - RNA, 14 nt, Salmonella enterica enterica serovar Typhi Ty2
ggcauucacgccac

SEQ ID NO: 1739041 - RNA, 18 nt, Salmonella enterica enterica serovar Typhi Ty2
ggcauuaugggcgugcug

SEQ ID NO: 1739042 - RNA, 17 nt, Salmonella enterica enterica serovar Typhi Ty2
ggcauuacccaguacca

SEQ ID NO: 1739043 - RNA, 16 nt, Salmonella enterica enterica serovar Typhi Ty2
ggcauguucacaucgc

SEQ ID NO: 1739044 - RNA, 19 nt, Salmonella enterica enterica serovar Typhi Ty2
ggcauggccuucaaucagc

SEQ ID NO: 1739045 - RNA, 23 nt, Salmonella enterica enterica serovar Typhi Ty2
ggcauauggauauucaucgccgu

SEQ ID NO: 1739046 - RNA, 13 nt, Salmonella enterica enterica serovar Typhi Ty2
ggccacagcgcca

SEQ ID NO: 1739047 - RNA, 21 nt, Salmonella enterica enterica serovar Typhi Ty2
ggccaauuccgccauaacggc

SEQ ID NO: 1739048 - RNA, 15 nt, Salmonella enterica enterica serovar Typhi Ty2
ggccaagcagcgcca

SEQ ID NO: 1739049 - RNA, 16 nt, Salmonella enterica enterica serovar Typhi Ty2
ggccaaccugccgaug

SEQ ID NO: 1739050 - RNA, 16 nt, Salmonella enterica enterica serovar Typhi Ty2
ggcagccguuuuccgg

SEQ ID NO: 1739051 - RNA, 14 nt, Salmonella enterica enterica serovar Typhi Ty2
ggcaggagcggaag

SEQ ID NO: 1739052 - RNA, 13 nt, Salmonella enterica enterica serovar Typhi Ty2
ggcagugcauaaa

SEQ ID NO: 1739053 - RNA, 13 nt, Salmonella enterica enterica serovar Typhi Ty2
ggcaggcaaaucu

SEQ ID NO: 1739054 - RNA, 19 nt, Salmonella enterica enterica serovar Typhi Ty2
ggccuauagcuaauggcuu

SEQ ID NO: 1739055 - RNA, 13 nt, Salmonella enterica enterica serovar Typhi Ty2
ggccuaucagcga

SEQ ID NO: 1739056 - RNA, 14 nt, Salmonella enterica enterica serovar Typhi Ty2
ggccuaccaucgcg

SEQ ID NO: 1739057 - RNA, 23 nt, Salmonella enterica enterica serovar Typhi Ty2
ggccuacgcucgaaagcaucauu

SEQ ID NO: 1739058 - RNA, 16 nt, Salmonella enterica enterica serovar Typhi Ty2
ggccuuauuuuucagc

SEQ ID NO: 1739059 - RNA, 14 nt, Salmonella enterica enterica serovar Typhi Ty2
ggccuuauccggcc

SEQ ID NO: 1739060 - RNA, 23 nt, Salmonella enterica enterica serovar Typhi Ty2
ggccuugaaguuauccagcgccc

SEQ ID NO: 1739061 - RNA, 18 nt, Salmonella enterica enterica serovar Typhi Ty2
ggccuugaaguuauccag

SEQ ID NO: 1739062 - RNA, 21 nt, Salmonella enterica enterica serovar Typhi Ty2
ggccugauaagcgcagcgcca

SEQ ID NO: 1739063 - RNA, 23 nt, Salmonella enterica enterica serovar Typhi Ty2
ggccugaugcgcguuuagcgcca

SEQ ID NO: 1739064 - RNA, 20 nt, Salmonella enterica enterica serovar Typhi Ty2
ggccugauaagcgaagcgcc

SEQ ID NO: 1739065 - RNA, 20 nt, Salmonella enterica enterica serovar Typhi Ty2
ggccggauagggcguaacac

SEQ ID NO: 1739066 - RNA, 19 nt, Salmonella enterica enterica serovar Typhi Ty2
ggccggauaaggcguaacc

SEQ ID NO: 1739067 - RNA, 14 nt, Salmonella enterica enterica serovar Typhi Ty2
ggccgcguuaucgg

SEQ ID NO: 1739068 - RNA, 20 nt, Salmonella enterica enterica serovar Typhi Ty2
ggccggguauaccaucggcu

SEQ ID NO: 1739069 - RNA, 11 nt, Salmonella enterica enterica serovar Typhi Ty2
ggcgcaaaucg

SEQ ID NO: 1739070 - RNA, 19 nt, Salmonella enterica enterica serovar Typhi Ty2
ggcgcaaaggccuuauccg

SEQ ID NO: 1739071 - RNA, 21 nt, Salmonella enterica enterica serovar Typhi Ty2
ggcgcaaaggccuuauccggc

SEQ ID NO: 1739072 - RNA, 17 nt, Salmonella enterica enterica serovar Typhi Ty2
ggcgcacauuuacgcca

SEQ ID NO: 1739073 - RNA, 23 nt, Salmonella enterica enterica serovar Typhi Ty2
ggcgcacauugcugccuuauccg

SEQ ID NO: 1739074 - RNA, 13 nt, Salmonella enterica enterica serovar Typhi Ty2
ggcgauuuucacc

SEQ ID NO: 1739075 - RNA, 17 nt, Salmonella enterica enterica serovar Typhi Ty2
ggcgauuuccagcgccg

SEQ ID NO: 1739076 - RNA, 12 nt, Salmonella enterica enterica serovar Typhi Ty2
ggcgaucgcaca

SEQ ID NO: 1739077 - RNA, 12 nt, Salmonella enterica enterica serovar Typhi Ty2
ggcgaucggcgu

SEQ ID NO: 1739078 - RNA, 18 nt, Salmonella enterica enterica serovar Typhi Ty2
ggcgauaaccucucaccg

SEQ ID NO: 1739079 - RNA, 18 nt, Salmonella enterica enterica serovar Typhi Ty2
ggcgauaaaccagcccca

SEQ ID NO: 1739080 - RNA, 22 nt, Salmonella enterica enterica serovar Typhi Ty2
ggcgaguuucugcucgaccguc

SEQ ID NO: 1739081 - RNA, 16 nt, Salmonella enterica enterica serovar Typhi Ty2
ggcgagcuuuucgccg

SEQ ID NO: 1739082 - RNA, 14 nt, Salmonella enterica enterica serovar Typhi Ty2
ggcgaacagcccca

SEQ ID NO: 1739083 - RNA, 20 nt, Salmonella enterica enterica serovar Typhi Ty2
ggcgaacaggcucagcgcca

SEQ ID NO: 1739084 - RNA, 13 nt, Salmonella enterica enterica serovar Typhi Ty2
ggcgacaucgcca

SEQ ID NO: 1739085 - RNA, 20 nt, Salmonella enterica enterica serovar Typhi Ty2
ggcgaccuucacgccgccaa

SEQ ID NO: 1739086 - RNA, 17 nt, Salmonella enterica enterica serovar Typhi Ty2
ggcgaccaguuauucgg

SEQ ID NO: 1739087 - RNA, 14 nt, Salmonella enterica enterica serovar Typhi Ty2
ggcgaccagcagau

SEQ ID NO: 1739088 - RNA, 20 nt, Salmonella enterica enterica serovar Typhi Ty2
ggcgaccaggaauuuaccgg

SEQ ID NO: 1739089 - RNA, 15 nt, Salmonella enterica enterica serovar Typhi Ty2
ggcgacgcuuucacc

SEQ ID NO: 1739090 - RNA, 17 nt, Salmonella enterica enterica serovar Typhi Ty2
ggcgacgaucagcgcca

SEQ ID NO: 1739091 - RNA, 23 nt, Salmonella enterica enterica serovar Typhi Ty2
ggcgacuaacgucuuauccggcc

SEQ ID NO: 1739092 - RNA, 17 nt, Salmonella enterica enterica serovar Typhi Ty2
ggcgacuggaacaggcc

SEQ ID NO: 1739093 - RNA, 19 nt, Salmonella enterica enterica serovar Typhi Ty2
ggcgacuaccucuuauccg

SEQ ID NO: 1739094 - RNA, 22 nt, Salmonella enterica enterica serovar Typhi Ty2
ggcgagaacucgucuuauccga

SEQ ID NO: 1739095 - RNA, 21 nt, Salmonella enterica enterica serovar Typhi Ty2
ggcgagaacucgucuuauccg

SEQ ID NO: 1739096 - RNA, 14 nt, Salmonella enterica enterica serovar Typhi Ty2
ggcgacuuucacga

SEQ ID NO: 1739097 - RNA, 17 nt, Salmonella enterica enterica serovar Typhi Ty2
ggucauuauucaggccu

SEQ ID NO: 1739098 - RNA, 12 nt, Salmonella enterica enterica serovar Typhi Ty2
ggucccaucgcg

SEQ ID NO: 1739099 - RNA, 19 nt, Salmonella enterica enterica serovar Typhi Ty2
ggucagcucacgcgccagc

SEQ ID NO: 1739100 - RNA, 11 nt, Salmonella enterica enterica serovar Typhi Ty2
gggugaaauca

SEQ ID NO: 1739101 - RNA, 15 nt, Salmonella enterica enterica serovar Typhi Ty2
ggugcauuccgcgca

SEQ ID NO: 1739102 - RNA, 23 nt, Salmonella enterica enterica serovar Typhi Ty2
ggugcaagcaccuuauccggccu

SEQ ID NO: 1739103 - RNA, 14 nt, Salmonella enterica enterica serovar Typhi Ty2
ggugaucugcgccg

SEQ ID NO: 1739104 - RNA, 23 nt, Salmonella enterica enterica serovar Typhi Ty2
ggugaugacgcgcaggccgucaa

SEQ ID NO: 1739105 - RNA, 19 nt, Salmonella enterica enterica serovar Typhi Ty2
ggugaugaaagcggcacaa

SEQ ID NO: 1739106 - RNA, 22 nt, Salmonella enterica enterica serovar Typhi Ty2
ggugaaaaaagccggacgggcg

SEQ ID NO: 1739107 - RNA, 22 nt, Salmonella enterica enterica serovar Typhi Ty2
ggucggcguugcgcccaggcca

SEQ ID NO: 1739108 - RNA, 21 nt, Salmonella enterica enterica serovar Typhi Ty2
ggucugauaagcgcagcgcca

SEQ ID NO: 1739109 - RNA, 16 nt, Salmonella enterica enterica serovar Typhi Ty2
gguugcaauuccgcca

SEQ ID NO: 1739110 - RNA, 20 nt, Salmonella enterica enterica serovar Typhi Ty2
gguucugcgaggugauagcc

SEQ ID NO: 1739111 - RNA, 23 nt, Salmonella enterica enterica serovar Typhi Ty2
ggugugguacggcuuucacaccg

SEQ ID NO: 1739112 - RNA, 19 nt, Salmonella enterica enterica serovar Typhi Ty2
gguuauucgccuuucacgc

SEQ ID NO: 1739113 - RNA, 23 nt, Salmonella enterica enterica serovar Typhi Ty2
gguuaucgcuugguauggcgcua

SEQ ID NO: 1739114 - RNA, 15 nt, Salmonella enterica enterica serovar Typhi Ty2
gguucaagcuggaau

SEQ ID NO: 1739115 - RNA, 21 nt, Salmonella enterica enterica serovar Typhi Ty2
guaaaccucuuuggcgcgaac

SEQ ID NO: 1739116 - RNA, 19 nt, Salmonella enterica enterica serovar Typhi Ty2
guaaacucacccaggcgau

SEQ ID NO: 1739117 - RNA, 22 nt, Salmonella enterica enterica serovar Typhi Ty2
guaaagauuuguuucaucgccu

SEQ ID NO: 1739118 - RNA, 16 nt, Salmonella enterica enterica serovar Typhi Ty2
guaaacacucaggcag

SEQ ID NO: 1739119 - RNA, 19 nt, Salmonella enterica enterica serovar Typhi Ty2
guaaacaccuuauccggcc

SEQ ID NO: 1739120 - RNA, 12 nt, Salmonella enterica enterica serovar Typhi Ty2
guaaaaucagcg

SEQ ID NO: 1739121 - RNA, 19 nt, Salmonella enterica enterica serovar Typhi Ty2
guaaccgcuuuuuuaucgc

SEQ ID NO: 1739122 - RNA, 17 nt, Salmonella enterica enterica serovar Typhi Ty2
guaacaucaaguacagc

SEQ ID NO: 1739123 - RNA, 16 nt, Salmonella enterica enterica serovar Typhi Ty2
guaacacaaucaggcg

SEQ ID NO: 1739124 - RNA, 16 nt, Salmonella enterica enterica serovar Typhi Ty2
guaaauuuaugguucc

SEQ ID NO: 1739125 - RNA, 20 nt, Salmonella enterica enterica serovar Typhi Ty2
gguugcgcccuuccgucagc

SEQ ID NO: 1739126 - RNA, 20 nt, Salmonella enterica enterica serovar Typhi Ty2
guaaaaaguugacguaacgc

SEQ ID NO: 1739127 - RNA, 15 nt, Salmonella enterica enterica serovar Typhi Ty2
ggugcgacaccacgc

SEQ ID NO: 1739128 - RNA, 20 nt, Salmonella enterica enterica serovar Typhi Ty2
ggugcgauacggcuuccucg

SEQ ID NO: 1739129 - RNA, 20 nt, Salmonella enterica enterica serovar Typhi Ty2
ggugcuuagcuggccaauca

SEQ ID NO: 1739130 - RNA, 15 nt, Salmonella enterica enterica serovar Typhi Ty2
ggugguugcaucauc

SEQ ID NO: 1739131 - RNA, 18 nt, Salmonella enterica enterica serovar Typhi Ty2
gguggguagcggcaauua

SEQ ID NO: 1739132 - RNA, 14 nt, Salmonella enterica enterica serovar Typhi Ty2
guagaccgcaucga

SEQ ID NO: 1739133 - RNA, 18 nt, Salmonella enterica enterica serovar Typhi Ty2
guaaucaauagcguuaua

SEQ ID NO: 1739134 - RNA, 13 nt, Salmonella enterica enterica serovar Typhi Ty2
guaaggcagcgau

SEQ ID NO: 1739135 - RNA, 15 nt, Salmonella enterica enterica serovar Typhi Ty2
guaagcgcagcgcca

SEQ ID NO: 1739136 - RNA, 20 nt, Salmonella enterica enterica serovar Typhi Ty2
guaaucaucgcgaucgccaa

SEQ ID NO: 1739137 - RNA, 11 nt, Salmonella enterica enterica serovar Typhi Ty2
guaauccggca

SEQ ID NO: 1739138 - RNA, 14 nt, Salmonella enterica enterica serovar Typhi Ty2
guacgcggcgacca

SEQ ID NO: 1739139 - RNA, 13 nt, Salmonella enterica enterica serovar Typhi Ty2
guacggcgcgaau

SEQ ID NO: 1739140 - RNA, 14 nt, Salmonella enterica enterica serovar Typhi Ty2
guacggccaccagg

SEQ ID NO: 1739141 - RNA, 16 nt, Salmonella enterica enterica serovar Typhi Ty2
guacgggcaaagcgac

SEQ ID NO: 1739142 - RNA, 18 nt, Salmonella enterica enterica serovar Typhi Ty2
guaggccggauaaggcgu

SEQ ID NO: 1739143 - RNA, 18 nt, Salmonella enterica enterica serovar Typhi Ty2
guaggccggauaaggcau

SEQ ID NO: 1739144 - RNA, 20 nt, Salmonella enterica enterica serovar Typhi Ty2
guaggccggauaaggcguuu

SEQ ID NO: 1739145 - RNA, 15 nt, Salmonella enterica enterica serovar Typhi Ty2
guaggccggaucagg

SEQ ID NO: 1739146 - RNA, 20 nt, Salmonella enterica enterica serovar Typhi Ty2
guaggccggauaagacgcgc

SEQ ID NO: 1739147 - RNA, 16 nt, Salmonella enterica enterica serovar Typhi Ty2
guagcugagcgucagg

SEQ ID NO: 1739148 - RNA, 12 nt, Salmonella enterica enterica serovar Typhi Ty2
guagcguaucag

SEQ ID NO: 1739149 - RNA, 13 nt, Salmonella enterica enterica serovar Typhi Ty2
guagcgucaauga

SEQ ID NO: 1739150 - RNA, 17 nt, Salmonella enterica enterica serovar Typhi Ty2
guagccgacggccauaa

SEQ ID NO: 1739151 - RNA, 14 nt, Salmonella enterica enterica serovar Typhi Ty2
guagauggcgcuaa

SEQ ID NO: 1739152 - RNA, 15 nt, Salmonella enterica enterica serovar Typhi Ty2
guagauggcgcuaaa

SEQ ID NO: 1739153 - RNA, 13 nt, Salmonella enterica enterica serovar Typhi Ty2
gucagcgcaaagc

SEQ ID NO: 1739154 - RNA, 20 nt, Salmonella enterica enterica serovar Typhi Ty2
gucacugaccggcguuuuua

SEQ ID NO: 1739155 - RNA, 14 nt, Salmonella enterica enterica serovar Typhi Ty2
gucagcagcaccgg

SEQ ID NO: 1739156 - RNA, 20 nt, Salmonella enterica enterica serovar Typhi Ty2
gucagacaccgggcuauuug

SEQ ID NO: 1739157 - RNA, 19 nt, Salmonella enterica enterica serovar Typhi Ty2
gucaccugauagcggguaa

SEQ ID NO: 1739158 - RNA, 17 nt, Salmonella enterica enterica serovar Typhi Ty2
gucaccucuuucgccgc

SEQ ID NO: 1739159 - RNA, 15 nt, Salmonella enterica enterica serovar Typhi Ty2
gucaccauguuaucg

SEQ ID NO: 1739160 - RNA, 17 nt, Salmonella enterica enterica serovar Typhi Ty2
gucaaugccuggcagac

SEQ ID NO: 1739161 - RNA, 13 nt, Salmonella enterica enterica serovar Typhi Ty2
gucaauaaagccg

SEQ ID NO: 1739162 - RNA, 12 nt, Salmonella enterica enterica serovar Typhi Ty2
gucaaucaucag

SEQ ID NO: 1739163 - RNA, 20 nt, Salmonella enterica enterica serovar Typhi Ty2
gucaauaagauauccugcuu

SEQ ID NO: 1739164 - RNA, 16 nt, Salmonella enterica enterica serovar Typhi Ty2
guauuucgcagcgguc

SEQ ID NO: 1739165 - RNA, 16 nt, Salmonella enterica enterica serovar Typhi Ty2
guauuuuuuagcgcca

SEQ ID NO: 1739166 - RNA, 20 nt, Salmonella enterica enterica serovar Typhi Ty2
gucaaaaccaaacagcgaca

SEQ ID NO: 1739167 - RNA, 22 nt, Salmonella enterica enterica serovar Typhi Ty2
gucaaacaguuccugugcggaa

SEQ ID NO: 1739168 - RNA, 21 nt, Salmonella enterica enterica serovar Typhi Ty2
guagggcugccaucaggcagu

SEQ ID NO: 1739169 - RNA, 15 nt, Salmonella enterica enterica serovar Typhi Ty2
guaucgcgccgccaa

SEQ ID NO: 1739170 - RNA, 16 nt, Salmonella enterica enterica serovar Typhi Ty2
guauuaaggcagccau

SEQ ID NO: 1739171 - RNA, 15 nt, Salmonella enterica enterica serovar Typhi Ty2
guauuaacccagaua

SEQ ID NO: 1739172 - RNA, 19 nt, Salmonella enterica enterica serovar Typhi Ty2
guaucgucaauacgcgaca

SEQ ID NO: 1739173 - RNA, 20 nt, Salmonella enterica enterica serovar Typhi Ty2
gucccaccagcgcggcacac

SEQ ID NO: 1739174 - RNA, 16 nt, Salmonella enterica enterica serovar Typhi Ty2
guccauuggcggacga

SEQ ID NO: 1739175 - RNA, 20 nt, Salmonella enterica enterica serovar Typhi Ty2
guccaugcccaacaucaguu

SEQ ID NO: 1739176 - RNA, 21 nt, Salmonella enterica enterica serovar Typhi Ty2
gucccaucguaacgccgucga

SEQ ID NO: 1739177 - RNA, 17 nt, Salmonella enterica enterica serovar Typhi Ty2
guccacauccagcgcca

SEQ ID NO: 1739178 - RNA, 20 nt, Salmonella enterica enterica serovar Typhi Ty2
guccaacuggcuuucaucca

SEQ ID NO: 1739179 - RNA, 17 nt, Salmonella enterica enterica serovar Typhi Ty2
guccaacuuguuuccug

SEQ ID NO: 1739180 - RNA, 21 nt, Salmonella enterica enterica serovar Typhi Ty2
gucagggcgcggcgcaacuuu

SEQ ID NO: 1739181 - RNA, 19 nt, Salmonella enterica enterica serovar Typhi Ty2
gucaggauacagccgacua

SEQ ID NO: 1739182 - RNA, 13 nt, Salmonella enterica enterica serovar Typhi Ty2
gucaucggcguug

SEQ ID NO: 1739183 - RNA, 17 nt, Salmonella enterica enterica serovar Typhi Ty2
gucauuuucuuucauca

SEQ ID NO: 1739184 - RNA, 20 nt, Salmonella enterica enterica serovar Typhi Ty2
gucauuaacgaggcgcuugc

SEQ ID NO: 1739185 - RNA, 16 nt, Salmonella enterica enterica serovar Typhi Ty2
gucaucgcaaauucug

SEQ ID NO: 1739186 - RNA, 16 nt, Salmonella enterica enterica serovar Typhi Ty2
gucauccggcaagcgc

SEQ ID NO: 1739187 - RNA, 17 nt, Salmonella enterica enterica serovar Typhi Ty2
gucauccgguucaccca

SEQ ID NO: 1739188 - RNA, 18 nt, Salmonella enterica enterica serovar Typhi Ty2
gucaucaucaaguaccgu

SEQ ID NO: 1739189 - RNA, 20 nt, Salmonella enterica enterica serovar Typhi Ty2
gucauaucugaugcucgccg

SEQ ID NO: 1739190 - RNA, 15 nt, Salmonella enterica enterica serovar Typhi Ty2
gucaucaaaaucggg

SEQ ID NO: 1739191 - RNA, 16 nt, Salmonella enterica enterica serovar Typhi Ty2
gucaucaccuccagca

SEQ ID NO: 1739192 - RNA, 22 nt, Salmonella enterica enterica serovar Typhi Ty2
gugcaugggauacgccagcaga

SEQ ID NO: 1739193 - RNA, 11 nt, Salmonella enterica enterica serovar Typhi Ty2
gugcaucggca

SEQ ID NO: 1739194 - RNA, 15 nt, Salmonella enterica enterica serovar Typhi Ty2
gugcauaaccgcgcc

SEQ ID NO: 1739195 - RNA, 14 nt, Salmonella enterica enterica serovar Typhi Ty2
gugaaccagcaucc

SEQ ID NO: 1739196 - RNA, 13 nt, Salmonella enterica enterica serovar Typhi Ty2
gugaaccgguaaa

SEQ ID NO: 1739197 - RNA, 16 nt, Salmonella enterica enterica serovar Typhi Ty2
gugaaccauggcaaca

SEQ ID NO: 1739198 - RNA, 23 nt, Salmonella enterica enterica serovar Typhi Ty2
gugaacgucuuauccggccugca

SEQ ID NO: 1739199 - RNA, 13 nt, Salmonella enterica enterica serovar Typhi Ty2
gugagcgucaucg

SEQ ID NO: 1739200 - RNA, 19 nt, Salmonella enterica enterica serovar Typhi Ty2
gugaugcgacgcgcucacc

SEQ ID NO: 1739201 - RNA, 20 nt, Salmonella enterica enterica serovar Typhi Ty2
gugcggugguauagaauacu

SEQ ID NO: 1739202 - RNA, 18 nt, Salmonella enterica enterica serovar Typhi Ty2
gugcgccagccuuauccc

SEQ ID NO: 1739203 - RNA, 15 nt, Salmonella enterica enterica serovar Typhi Ty2
gugccggauggcguu

SEQ ID NO: 1739204 - RNA, 17 nt, Salmonella enterica enterica serovar Typhi Ty2
gugccguugaccagcug

SEQ ID NO: 1739205 - RNA, 18 nt, Salmonella enterica enterica serovar Typhi Ty2
guggucaucgcggccagc

SEQ ID NO: 1739206 - RNA, 17 nt, Salmonella enterica enterica serovar Typhi Ty2
guggucaggcgaccaau

SEQ ID NO: 1739207 - RNA, 21 nt, Salmonella enterica enterica serovar Typhi Ty2
guggucauuuuacugcguaau

SEQ ID NO: 1739208 - RNA, 20 nt, Salmonella enterica enterica serovar Typhi Ty2
guggucgucagccgugagca

SEQ ID NO: 1739209 - RNA, 17 nt, Salmonella enterica enterica serovar Typhi Ty2
gugguaggcuucaaccg

SEQ ID NO: 1739210 - RNA, 12 nt, Salmonella enterica enterica serovar Typhi Ty2
gugggccguucc

SEQ ID NO: 1739211 - RNA, 18 nt, Salmonella enterica enterica serovar Typhi Ty2
guggcgcaaccgauagcu

SEQ ID NO: 1739212 - RNA, 23 nt, Salmonella enterica enterica serovar Typhi Ty2
guggcgcugcgcuuaccgggccu

SEQ ID NO: 1739213 - RNA, 20 nt, Salmonella enterica enterica serovar Typhi Ty2
guggcugaggccgcucgcca

SEQ ID NO: 1739214 - RNA, 15 nt, Salmonella enterica enterica serovar Typhi Ty2
guggcgggcguuugc

SEQ ID NO: 1739215 - RNA, 18 nt, Salmonella enterica enterica serovar Typhi Ty2
guggccaaaaaaucgcug

SEQ ID NO: 1739216 - RNA, 22 nt, Salmonella enterica enterica serovar Typhi Ty2
guggcgacgccuauucucgccg

SEQ ID NO: 1739217 - RNA, 21 nt, Salmonella enterica enterica serovar Typhi Ty2
guggcgagauaagccgucaua

SEQ ID NO: 1739218 - RNA, 20 nt, Salmonella enterica enterica serovar Typhi Ty2
guggcgaauacuguuccagg

SEQ ID NO: 1739219 - RNA, 13 nt, Salmonella enterica enterica serovar Typhi Ty2
guggaaggcauua

SEQ ID NO: 1739220 - RNA, 18 nt, Salmonella enterica enterica serovar Typhi Ty2
gugcuuauggguuuccuc

SEQ ID NO: 1739221 - RNA, 22 nt, Salmonella enterica enterica serovar Typhi Ty2
guggcaacgcuggcggcguccg

SEQ ID NO: 1739222 - RNA, 16 nt, Salmonella enterica enterica serovar Typhi Ty2
gucuucgaccgccaua

SEQ ID NO: 1739223 - RNA, 17 nt, Salmonella enterica enterica serovar Typhi Ty2
gucuuauccggccucca

SEQ ID NO: 1739224 - RNA, 16 nt, Salmonella enterica enterica serovar Typhi Ty2
gugaaacguguuuauc

SEQ ID NO: 1739225 - RNA, 22 nt, Salmonella enterica enterica serovar Typhi Ty2
gugaaaugguugcguuucggca

SEQ ID NO: 1739226 - RNA, 17 nt, Salmonella enterica enterica serovar Typhi Ty2
gucuuuguugccuucga

SEQ ID NO: 1739227 - RNA, 16 nt, Salmonella enterica enterica serovar Typhi Ty2
gucugaaaacucacgc

SEQ ID NO: 1739228 - RNA, 15 nt, Salmonella enterica enterica serovar Typhi Ty2
gucugagcaggcggu

SEQ ID NO: 1739229 - RNA, 15 nt, Salmonella enterica enterica serovar Typhi Ty2
gucuccucagcaggc

SEQ ID NO: 1739230 - RNA, 22 nt, Salmonella enterica enterica serovar Typhi Ty2
gucucccgugacguuuugcgcg

SEQ ID NO: 1739231 - RNA, 14 nt, Salmonella enterica enterica serovar Typhi Ty2
gucguuucuacaau

SEQ ID NO: 1739232 - RNA, 19 nt, Salmonella enterica enterica serovar Typhi Ty2
gucguuguaguuaucgccg

SEQ ID NO: 1739233 - RNA, 17 nt, Salmonella enterica enterica serovar Typhi Ty2
gucguccucaggccgga

SEQ ID NO: 1739234 - RNA, 22 nt, Salmonella enterica enterica serovar Typhi Ty2
gucgggauaagcgaugcgcgga

SEQ ID NO: 1739235 - RNA, 15 nt, Salmonella enterica enterica serovar Typhi Ty2
gucgggccaaucgga

SEQ ID NO: 1739236 - RNA, 22 nt, Salmonella enterica enterica serovar Typhi Ty2
gucggcgccggcgucgaucagc

SEQ ID NO: 1739237 - RNA, 18 nt, Salmonella enterica enterica serovar Typhi Ty2
gucggcgauugucaucau

SEQ ID NO: 1739238 - RNA, 22 nt, Salmonella enterica enterica serovar Typhi Ty2
gucggcgcaaccauuaccgcua

SEQ ID NO: 1739239 - RNA, 19 nt, Salmonella enterica enterica serovar Typhi Ty2
gucggcgauauagcgcuga

SEQ ID NO: 1739240 - RNA, 20 nt, Salmonella enterica enterica serovar Typhi Ty2
gucgcgccauguugcguaaa

SEQ ID NO: 1739241 - RNA, 19 nt, Salmonella enterica enterica serovar Typhi Ty2
gucgcggauaugcagcagc

SEQ ID NO: 1739242 - RNA, 23 nt, Salmonella enterica enterica serovar Typhi Ty2
gucggcaauuaacauuucacgau

SEQ ID NO: 1739243 - RNA, 22 nt, Salmonella enterica enterica serovar Typhi Ty2
gucggaaccggcaauauccgga

SEQ ID NO: 1739244 - RNA, 17 nt, Salmonella enterica enterica serovar Typhi Ty2
gucgaugauuuucaagc

SEQ ID NO: 1739245 - RNA, 19 nt, Salmonella enterica enterica serovar Typhi Ty2
gucgccauauguuccaccg

SEQ ID NO: 1739246 - RNA, 20 nt, Salmonella enterica enterica serovar Typhi Ty2
gucgcaagacgaaaaaugaa

SEQ ID NO: 1739247 - RNA, 15 nt, Salmonella enterica enterica serovar Typhi Ty2
guccgccagaugcac

SEQ ID NO: 1739248 - RNA, 21 nt, Salmonella enterica enterica serovar Typhi Ty2
cggcggcuugccuucauccgc

SEQ ID NO: 1739249 - RNA, 22 nt, Salmonella enterica enterica serovar Typhi Ty2
cggcgucuucauccucgccaua

SEQ ID NO: 1739250 - RNA, 13 nt, Salmonella enterica enterica serovar Typhi Ty2
cggcgucuggcga

SEQ ID NO: 1739251 - RNA, 16 nt, Salmonella enterica enterica serovar Typhi Ty2
cggcguagcucgccca

SEQ ID NO: 1739252 - RNA, 18 nt, Salmonella enterica enterica serovar Typhi Ty2
cggcuacggaguucgccg

SEQ ID NO: 1739253 - RNA, 15 nt, Salmonella enterica enterica serovar Typhi Ty2
cggcuacgccuuacc

SEQ ID NO: 1739254 - RNA, 21 nt, Salmonella enterica enterica serovar Typhi Ty2
cggcguucucccgggccgcgu

SEQ ID NO: 1739255 - RNA, 20 nt, Salmonella enterica enterica serovar Typhi Ty2
cggcucgcuguucgccagac

SEQ ID NO: 1739256 - RNA, 23 nt, Salmonella enterica enterica serovar Typhi Ty2
cggcucgccuugcgguugcagca

SEQ ID NO: 1739257 - RNA, 20 nt, Salmonella enterica enterica serovar Typhi Ty2
cggcucgcacauaucgcaau

SEQ ID NO: 1739258 - RNA, 14 nt, Salmonella enterica enterica serovar Typhi Ty2
cgggcaauacgcug

SEQ ID NO: 1739259 - RNA, 15 nt, Salmonella enterica enterica serovar Typhi Ty2
cgggcagcagcaggc

SEQ ID NO: 1739260 - RNA, 18 nt, Salmonella enterica enterica serovar Typhi Ty2
cgggaugggaacacagca

SEQ ID NO: 1739261 - RNA, 14 nt, Salmonella enterica enterica serovar Typhi Ty2
cgggcauaaccucu

SEQ ID NO: 1739262 - RNA, 14 nt, Salmonella enterica enterica serovar Typhi Ty2
cgggccugccaggu

SEQ ID NO: 1739263 - RNA, 21 nt, Salmonella enterica enterica serovar Typhi Ty2
cgggaucgauauaucgcguca

SEQ ID NO: 1739264 - RNA, 17 nt, Salmonella enterica enterica serovar Typhi Ty2
cgggauaauauugccau

SEQ ID NO: 1739265 - RNA, 17 nt, Salmonella enterica enterica serovar Typhi Ty2
cgggacggcggccagca

SEQ ID NO: 1739266 - RNA, 21 nt, Salmonella enterica enterica serovar Typhi Ty2
cgggagauuaggguucacggc

SEQ ID NO: 1739267 - RNA, 22 nt, Salmonella enterica enterica serovar Typhi Ty2
cgggagagcguauccagcaccu

SEQ ID NO: 1739268 - RNA, 15 nt, Salmonella enterica enterica serovar Typhi Ty2
cggcuucuccaccau

SEQ ID NO: 1739269 - RNA, 17 nt, Salmonella enterica enterica serovar Typhi Ty2
cggcugaccugaacgcc

SEQ ID NO: 1739270 - RNA, 16 nt, Salmonella enterica enterica serovar Typhi Ty2
cggcugacgcccauca

SEQ ID NO: 1739271 - RNA, 19 nt, Salmonella enterica enterica serovar Typhi Ty2
cggcugacgcccaucagca

SEQ ID NO: 1739272 - RNA, 21 nt, Salmonella enterica enterica serovar Typhi Ty2
cgggacauguucagcgcagaa

SEQ ID NO: 1739273 - RNA, 15 nt, Salmonella enterica enterica serovar Typhi Ty2
cggucuggcgcauaa

SEQ ID NO: 1739274 - RNA, 15 nt, Salmonella enterica enterica serovar Typhi Ty2
cggucugucgguaaa

SEQ ID NO: 1739275 - RNA, 16 nt, Salmonella enterica enterica serovar Typhi Ty2
cggucgucaucggcga

SEQ ID NO: 1739276 - RNA, 23 nt, Salmonella enterica enterica serovar Typhi Ty2
cggucgacagccacacgccacaa

SEQ ID NO: 1739277 - RNA, 14 nt, Salmonella enterica enterica serovar Typhi Ty2
cggucaguacgccc

SEQ ID NO: 1739278 - RNA, 15 nt, Salmonella enterica enterica serovar Typhi Ty2
cggucauccagcggu

SEQ ID NO: 1739279 - RNA, 18 nt, Salmonella enterica enterica serovar Typhi Ty2
cggucauaaccggccgau

SEQ ID NO: 1739280 - RNA, 19 nt, Salmonella enterica enterica serovar Typhi Ty2
cggucaggggucagcguau

SEQ ID NO: 1739281 - RNA, 16 nt, Salmonella enterica enterica serovar Typhi Ty2
cggucagcggcggaaa

SEQ ID NO: 1739282 - RNA, 19 nt, Salmonella enterica enterica serovar Typhi Ty2
cgguaccaaagucaucaau

SEQ ID NO: 1739283 - RNA, 16 nt, Salmonella enterica enterica serovar Typhi Ty2
cgguaaucccuucacg

SEQ ID NO: 1739284 - RNA, 15 nt, Salmonella enterica enterica serovar Typhi Ty2
cgguaaucgccgcga

SEQ ID NO: 1739285 - RNA, 16 nt, Salmonella enterica enterica serovar Typhi Ty2
cgguaagagcguuacc

SEQ ID NO: 1739286 - RNA, 16 nt, Salmonella enterica enterica serovar Typhi Ty2
cgguaaauuucaaccc

SEQ ID NO: 1739287 - RNA, 16 nt, Salmonella enterica enterica serovar Typhi Ty2
cgguaaauacgcggca

SEQ ID NO: 1739288 - RNA, 21 nt, Salmonella enterica enterica serovar Typhi Ty2
cgguaaaccuguuuguuuauu

SEQ ID NO: 1739289 - RNA, 19 nt, Salmonella enterica enterica serovar Typhi Ty2
cggguuuuuuuugcgcuua

SEQ ID NO: 1739290 - RNA, 22 nt, Salmonella enterica enterica serovar Typhi Ty2
cggguuucugaauagaaagucg

SEQ ID NO: 1739291 - RNA, 15 nt, Salmonella enterica enterica serovar Typhi Ty2
cggguccugaucggc

SEQ ID NO: 1739292 - RNA, 14 nt, Salmonella enterica enterica serovar Typhi Ty2
cgggugcagcguca

SEQ ID NO: 1739293 - RNA, 20 nt, Salmonella enterica enterica serovar Typhi Ty2
cgggucgcagaacaucgcga

SEQ ID NO: 1739294 - RNA, 20 nt, Salmonella enterica enterica serovar Typhi Ty2
cgggggcgaucagcagguca

SEQ ID NO: 1739295 - RNA, 16 nt, Salmonella enterica enterica serovar Typhi Ty2
cggggaucgguuuauc

SEQ ID NO: 1739296 - RNA, 20 nt, Salmonella enterica enterica serovar Typhi Ty2
cgggcuggccggcgcaaugu

SEQ ID NO: 1739297 - RNA, 17 nt, Salmonella enterica enterica serovar Typhi Ty2
cgggccugugccugaca

SEQ ID NO: 1739298 - RNA, 21 nt, Salmonella enterica enterica serovar Typhi Ty2
cggggacagauuaucagcgag

SEQ ID NO: 1739299 - RNA, 17 nt, Salmonella enterica enterica serovar Typhi Ty2
cgggcuguuauucagca

SEQ ID NO: 1739300 - RNA, 14 nt, Salmonella enterica enterica serovar Typhi Ty2
cggaugauuaucau

SEQ ID NO: 1739301 - RNA, 22 nt, Salmonella enterica enterica serovar Typhi Ty2
cggauggcggcuaacgccugau

SEQ ID NO: 1739302 - RNA, 19 nt, Salmonella enterica enterica serovar Typhi Ty2
cggauggcgcugccgcuua

SEQ ID NO: 1739303 - RNA, 16 nt, Salmonella enterica enterica serovar Typhi Ty2
cggauuaucguccggc

SEQ ID NO: 1739304 - RNA, 18 nt, Salmonella enterica enterica serovar Typhi Ty2
cggauuuagcggcagcca

SEQ ID NO: 1739305 - RNA, 17 nt, Salmonella enterica enterica serovar Typhi Ty2
cggauugugaaauucga

SEQ ID NO: 1739306 - RNA, 18 nt, Salmonella enterica enterica serovar Typhi Ty2
cggcaaaacgccgcagaa

SEQ ID NO: 1739307 - RNA, 15 nt, Salmonella enterica enterica serovar Typhi Ty2
cggcaaaaaucagcc

SEQ ID NO: 1739308 - RNA, 15 nt, Salmonella enterica enterica serovar Typhi Ty2
cggcaaaaacgccgg

SEQ ID NO: 1739309 - RNA, 23 nt, Salmonella enterica enterica serovar Typhi Ty2
cggcaaaauuaccaggcgguaug

SEQ ID NO: 1739310 - RNA, 18 nt, Salmonella enterica enterica serovar Typhi Ty2
cggcaaaccuaccggcau

SEQ ID NO: 1739311 - RNA, 19 nt, Salmonella enterica enterica serovar Typhi Ty2
cggcaaagauaaucugaau

SEQ ID NO: 1739312 - RNA, 18 nt, Salmonella enterica enterica serovar Typhi Ty2
cggcaaagccaucaaucc

SEQ ID NO: 1739313 - RNA, 17 nt, Salmonella enterica enterica serovar Typhi Ty2
cggcaaacucagcggcu

SEQ ID NO: 1739314 - RNA, 13 nt, Salmonella enterica enterica serovar Typhi Ty2
cggcaacaguacc

SEQ ID NO: 1739315 - RNA, 16 nt, Salmonella enterica enterica serovar Typhi Ty2
cggauccggcgcagac

SEQ ID NO: 1739316 - RNA, 19 nt, Salmonella enterica enterica serovar Typhi Ty2
cggauaccggcgcagcauc

SEQ ID NO: 1739317 - RNA, 18 nt, Salmonella enterica enterica serovar Typhi Ty2
cggauacugcuauuagcg

SEQ ID NO: 1739318 - RNA, 21 nt, Salmonella enterica enterica serovar Typhi Ty2
cggaucaggcguuagccgcca

SEQ ID NO: 1739319 - RNA, 22 nt, Salmonella enterica enterica serovar Typhi Ty2
cggauacaagguauccgccaua

SEQ ID NO: 1739320 - RNA, 18 nt, Salmonella enterica enterica serovar Typhi Ty2
cggaguagacccacauau

SEQ ID NO: 1739321 - RNA, 22 nt, Salmonella enterica enterica serovar Typhi Ty2
cggagucgacggcguaucaauc

SEQ ID NO: 1739322 - RNA, 15 nt, Salmonella enterica enterica serovar Typhi Ty2
cggcagccagcguau

SEQ ID NO: 1739323 - RNA, 16 nt, Salmonella enterica enterica serovar Typhi Ty2
cggcagccaauuuagg

SEQ ID NO: 1739324 - RNA, 21 nt, Salmonella enterica enterica serovar Typhi Ty2
cggcacauugucagcugaaca

SEQ ID NO: 1739325 - RNA, 21 nt, Salmonella enterica enterica serovar Typhi Ty2
cggcacauauuccggcgcugg

SEQ ID NO: 1739326 - RNA, 20 nt, Salmonella enterica enterica serovar Typhi Ty2
cggcaauuaccgccagcggc

SEQ ID NO: 1739327 - RNA, 21 nt, Salmonella enterica enterica serovar Typhi Ty2
cggcaauggccgcagcgccau

SEQ ID NO: 1739328 - RNA, 17 nt, Salmonella enterica enterica serovar Typhi Ty2
cggcaauuuccggcgac

SEQ ID NO: 1739329 - RNA, 12 nt, Salmonella enterica enterica serovar Typhi Ty2
cggccagcgcag

SEQ ID NO: 1739330 - RNA, 20 nt, Salmonella enterica enterica serovar Typhi Ty2
cggccagcgaaaaccagcgc

SEQ ID NO: 1739331 - RNA, 22 nt, Salmonella enterica enterica serovar Typhi Ty2
cggccaggcaaagauccaccag

SEQ ID NO: 1739332 - RNA, 16 nt, Salmonella enterica enterica serovar Typhi Ty2
cggccauuaccaguac

SEQ ID NO: 1739333 - RNA, 15 nt, Salmonella enterica enterica serovar Typhi Ty2
cggccacgcgcguca

SEQ ID NO: 1739334 - RNA, 14 nt, Salmonella enterica enterica serovar Typhi Ty2
cggccagcagccau

SEQ ID NO: 1739335 - RNA, 12 nt, Salmonella enterica enterica serovar Typhi Ty2
cggccagcauau

SEQ ID NO: 1739336 - RNA, 18 nt, Salmonella enterica enterica serovar Typhi Ty2
cggccagauaacgcgcau

SEQ ID NO: 1739337 - RNA, 17 nt, Salmonella enterica enterica serovar Typhi Ty2
cggcaucggcagcguca

SEQ ID NO: 1739338 - RNA, 15 nt, Salmonella enterica enterica serovar Typhi Ty2
cggcaucggcagcgu

SEQ ID NO: 1739339 - RNA, 17 nt, Salmonella enterica enterica serovar Typhi Ty2
cggcagggauucgcuca

SEQ ID NO: 1739340 - RNA, 23 nt, Salmonella enterica enterica serovar Typhi Ty2
cggcauuaugcaggcgucgggca

SEQ ID NO: 1739341 - RNA, 15 nt, Salmonella enterica enterica serovar Typhi Ty2
cggcauuauaagcgc

SEQ ID NO: 1739342 - RNA, 12 nt, Salmonella enterica enterica serovar Typhi Ty2
cggccacagcgc

SEQ ID NO: 1739343 - RNA, 15 nt, Salmonella enterica enterica serovar Typhi Ty2
cggccacaggcgucg

SEQ ID NO: 1739344 - RNA, 23 nt, Salmonella enterica enterica serovar Typhi Ty2
cggcauguucacaucgcucagaa

SEQ ID NO: 1739345 - RNA, 16 nt, Salmonella enterica enterica serovar Typhi Ty2
cggccugcucaaggca

SEQ ID NO: 1739346 - RNA, 19 nt, Salmonella enterica enterica serovar Typhi Ty2
cggccucgcuggucagcgc

SEQ ID NO: 1739347 - RNA, 16 nt, Salmonella enterica enterica serovar Typhi Ty2
cggccuucuuccguca

SEQ ID NO: 1739348 - RNA, 22 nt, Salmonella enterica enterica serovar Typhi Ty2
cggccuugaaguuauccagcgc

SEQ ID NO: 1739349 - RNA, 17 nt, Salmonella enterica enterica serovar Typhi Ty2
cggcgaaauauuaucgc

SEQ ID NO: 1739350 - RNA, 18 nt, Salmonella enterica enterica serovar Typhi Ty2
cggcgaaagaagcgcugg

SEQ ID NO: 1739351 - RNA, 16 nt, Salmonella enterica enterica serovar Typhi Ty2
cggcgacaucgccaaa

SEQ ID NO: 1739352 - RNA, 11 nt, Salmonella enterica enterica serovar Typhi Ty2
cggcgaaucgc

SEQ ID NO: 1739353 - RNA, 21 nt, Salmonella enterica enterica serovar Typhi Ty2
cggcgacggacucgcgcagaa

SEQ ID NO: 1739354 - RNA, 15 nt, Salmonella enterica enterica serovar Typhi Ty2
cggcgcgcgcgguuc

SEQ ID NO: 1739355 - RNA, 17 nt, Salmonella enterica enterica serovar Typhi Ty2
cggcgcgcucuacguug

SEQ ID NO: 1739356 - RNA, 17 nt, Salmonella enterica enterica serovar Typhi Ty2
cggcgcgccgcuggcga

SEQ ID NO: 1739357 - RNA, 17 nt, Salmonella enterica enterica serovar Typhi Ty2
cggcgcgccaaacggca

SEQ ID NO: 1739358 - RNA, 13 nt, Salmonella enterica enterica serovar Typhi Ty2
cggcgccagccac

SEQ ID NO: 1739359 - RNA, 16 nt, Salmonella enterica enterica serovar Typhi Ty2
cgcuggguuuuuccgc

SEQ ID NO: 1739360 - RNA, 22 nt, Salmonella enterica enterica serovar Typhi Ty2
cgcuggguaauagaugcgucgc

SEQ ID NO: 1739361 - RNA, 18 nt, Salmonella enterica enterica serovar Typhi Ty2
cgcugucguuccacacgu

SEQ ID NO: 1739362 - RNA, 18 nt, Salmonella enterica enterica serovar Typhi Ty2
cgcuguccagauagggcc

SEQ ID NO: 1739363 - RNA, 20 nt, Salmonella enterica enterica serovar Typhi Ty2
cgcugucagugaaaaaccga

SEQ ID NO: 1739364 - RNA, 13 nt, Salmonella enterica enterica serovar Typhi Ty2
cgcugucagugaa

SEQ ID NO: 1739365 - RNA, 13 nt, Salmonella enterica enterica serovar Typhi Ty2
cgcugucaaucga

SEQ ID NO: 1739366 - RNA, 17 nt, Salmonella enterica enterica serovar Typhi Ty2
cgcuggcgccaccgcug

SEQ ID NO: 1739367 - RNA, 14 nt, Salmonella enterica enterica serovar Typhi Ty2
cgcugcgccagauc

SEQ ID NO: 1739368 - RNA, 15 nt, Salmonella enterica enterica serovar Typhi Ty2
cgcugcgcaccugca

SEQ ID NO: 1739369 - RNA, 18 nt, Salmonella enterica enterica serovar Typhi Ty2
cgcuucccgaugccagca

SEQ ID NO: 1739370 - RNA, 23 nt, Salmonella enterica enterica serovar Typhi Ty2
cgcuucacgcgcggcuacugcca

SEQ ID NO: 1739371 - RNA, 19 nt, Salmonella enterica enterica serovar Typhi Ty2
cgcuuauuccuccgccgau

SEQ ID NO: 1739372 - RNA, 16 nt, Salmonella enterica enterica serovar Typhi Ty2
cgcuucacgucagcga

SEQ ID NO: 1739373 - RNA, 19 nt, Salmonella enterica enterica serovar Typhi Ty2
cgcuucacgucagcgacca

SEQ ID NO: 1739374 - RNA, 20 nt, Salmonella enterica enterica serovar Typhi Ty2
cgcuucgcuuaccaggccua

SEQ ID NO: 1739375 - RNA, 20 nt, Salmonella enterica enterica serovar Typhi Ty2
cgcuucgcuuaucuggccua

SEQ ID NO: 1739376 - RNA, 20 nt, Salmonella enterica enterica serovar Typhi Ty2
cgcuucgcuuauccggccua

SEQ ID NO: 1739377 - RNA, 20 nt, Salmonella enterica enterica serovar Typhi Ty2
cgcuucgcuugcccggccua

SEQ ID NO: 1739378 - RNA, 16 nt, Salmonella enterica enterica serovar Typhi Ty2
cgcuucgaugcguuca

SEQ ID NO: 1739379 - RNA, 17 nt, Salmonella enterica enterica serovar Typhi Ty2
cgcuuaacuccggcgac

SEQ ID NO: 1739380 - RNA, 21 nt, Salmonella enterica enterica serovar Typhi Ty2
cgcuuaaagcguuccacgucg

SEQ ID NO: 1739381 - RNA, 13 nt, Salmonella enterica enterica serovar Typhi Ty2
cgcuuacccagca

SEQ ID NO: 1739382 - RNA, 23 nt, Salmonella enterica enterica serovar Typhi Ty2
cgcuuaauaauaagcggccuaua

SEQ ID NO: 1739383 - RNA, 13 nt, Salmonella enterica enterica serovar Typhi Ty2
cgcuguuucucga

SEQ ID NO: 1739384 - RNA, 17 nt, Salmonella enterica enterica serovar Typhi Ty2
cgcuuaucaggccuacg

SEQ ID NO: 1739385 - RNA, 21 nt, Salmonella enterica enterica serovar Typhi Ty2
cgcuuaucaggccuacauccg

SEQ ID NO: 1739386 - RNA, 20 nt, Salmonella enterica enterica serovar Typhi Ty2
cgcuuaucaggccuacaacg

SEQ ID NO: 1739387 - RNA, 19 nt, Salmonella enterica enterica serovar Typhi Ty2
cgcuuauccggccuacaga

SEQ ID NO: 1739388 - RNA, 12 nt, Salmonella enterica enterica serovar Typhi Ty2
cgcuuauccgcu

SEQ ID NO: 1739389 - RNA, 17 nt, Salmonella enterica enterica serovar Typhi Ty2
cgcuuacugugccgccg

SEQ ID NO: 1739390 - RNA, 19 nt, Salmonella enterica enterica serovar Typhi Ty2
cgcuuacgaagaucgucga

SEQ ID NO: 1739391 - RNA, 17 nt, Salmonella enterica enterica serovar Typhi Ty2
cgcuuaucaggccuaca

SEQ ID NO: 1739392 - RNA, 19 nt, Salmonella enterica enterica serovar Typhi Ty2
cgcuuaucaggccuacaac

SEQ ID NO: 1739393 - RNA, 15 nt, Salmonella enterica enterica serovar Typhi Ty2
cgcuguuaugcacgc

SEQ ID NO: 1739394 - RNA, 20 nt, Salmonella enterica enterica serovar Typhi Ty2
cggaaagacggcagcgccau

SEQ ID NO: 1739395 - RNA, 23 nt, Salmonella enterica enterica serovar Typhi Ty2
cggaaagaagcaggguauugacg

SEQ ID NO: 1739396 - RNA, 20 nt, Salmonella enterica enterica serovar Typhi Ty2
cggaaagaaacgccgcgcaa

SEQ ID NO: 1739397 - RNA, 14 nt, Salmonella enterica enterica serovar Typhi Ty2
cggaaaccaguuca

SEQ ID NO: 1739398 - RNA, 18 nt, Salmonella enterica enterica serovar Typhi Ty2
cggaaaccaguucacgcg

SEQ ID NO: 1739399 - RNA, 16 nt, Salmonella enterica enterica serovar Typhi Ty2
cggaaaccccagguca

SEQ ID NO: 1739400 - RNA, 20 nt, Salmonella enterica enterica serovar Typhi Ty2
cgcuuuuuuaaacgccugau

SEQ ID NO: 1739401 - RNA, 22 nt, Salmonella enterica enterica serovar Typhi Ty2
cggaaaugaucagacgcaucag

SEQ ID NO: 1739402 - RNA, 20 nt, Salmonella enterica enterica serovar Typhi Ty2
cggaaccgcguuugcgucgu

SEQ ID NO: 1739403 - RNA, 17 nt, Salmonella enterica enterica serovar Typhi Ty2
cggaacagggccgcauc

SEQ ID NO: 1739404 - RNA, 21 nt, Salmonella enterica enterica serovar Typhi Ty2
cggaacuuuaucaccagcgau

SEQ ID NO: 1739405 - RNA, 16 nt, Salmonella enterica enterica serovar Typhi Ty2
cggaaguauacaucca

SEQ ID NO: 1739406 - RNA, 18 nt, Salmonella enterica enterica serovar Typhi Ty2
cgcuuuccaguugcggca

SEQ ID NO: 1739407 - RNA, 15 nt, Salmonella enterica enterica serovar Typhi Ty2
cgcuuuucagcgucu

SEQ ID NO: 1739408 - RNA, 22 nt, Salmonella enterica enterica serovar Typhi Ty2
cgcuuuuagggccgauaccggc

SEQ ID NO: 1739409 - RNA, 22 nt, Salmonella enterica enterica serovar Typhi Ty2
cgcuuugcuuauccggccuaca

SEQ ID NO: 1739410 - RNA, 20 nt, Salmonella enterica enterica serovar Typhi Ty2
cgcuuugcuuauccggccua

SEQ ID NO: 1739411 - RNA, 14 nt, Salmonella enterica enterica serovar Typhi Ty2
cgcuucugccgcca

SEQ ID NO: 1739412 - RNA, 23 nt, Salmonella enterica enterica serovar Typhi Ty2
cgcuucuucggcagcuuccagca

SEQ ID NO: 1739413 - RNA, 17 nt, Salmonella enterica enterica serovar Typhi Ty2
cgcuucuucaugggcgu

SEQ ID NO: 1739414 - RNA, 18 nt, Salmonella enterica enterica serovar Typhi Ty2
cgcuacgcuuaucgggcc

SEQ ID NO: 1739415 - RNA, 20 nt, Salmonella enterica enterica serovar Typhi Ty2
cgcuacgcuuaucaggccua

SEQ ID NO: 1739416 - RNA, 14 nt, Salmonella enterica enterica serovar Typhi Ty2
cgcuacccggcaca

SEQ ID NO: 1739417 - RNA, 22 nt, Salmonella enterica enterica serovar Typhi Ty2
cgcuacugugggccguuccgca

SEQ ID NO: 1739418 - RNA, 18 nt, Salmonella enterica enterica serovar Typhi Ty2
cgcuacuccgcccuaauc

SEQ ID NO: 1739419 - RNA, 15 nt, Salmonella enterica enterica serovar Typhi Ty2
cgcuacggcguuuca

SEQ ID NO: 1739420 - RNA, 19 nt, Salmonella enterica enterica serovar Typhi Ty2
cgcuauccggcgcgcuggu

SEQ ID NO: 1739421 - RNA, 13 nt, Salmonella enterica enterica serovar Typhi Ty2
cgcuaucgcccaa

SEQ ID NO: 1739422 - RNA, 18 nt, Salmonella enterica enterica serovar Typhi Ty2
cgcuauggugcgggguuu

SEQ ID NO: 1739423 - RNA, 18 nt, Salmonella enterica enterica serovar Typhi Ty2
cgcuaugcuuaccaucug

SEQ ID NO: 1739424 - RNA, 16 nt, Salmonella enterica enterica serovar Typhi Ty2
cgcuaucugacagcca

SEQ ID NO: 1739425 - RNA, 19 nt, Salmonella enterica enterica serovar Typhi Ty2
cgcuagcuuaucgggccua

SEQ ID NO: 1739426 - RNA, 14 nt, Salmonella enterica enterica serovar Typhi Ty2
cgcuagugccgcca

SEQ ID NO: 1739427 - RNA, 15 nt, Salmonella enterica enterica serovar Typhi Ty2
cgcucagcaucgcau

SEQ ID NO: 1739428 - RNA, 12 nt, Salmonella enterica enterica serovar Typhi Ty2
cgcucaaucaga

SEQ ID NO: 1739429 - RNA, 21 nt, Salmonella enterica enterica serovar Typhi Ty2
cgcuauuaccccgcggcaugg

SEQ ID NO: 1739430 - RNA, 12 nt, Salmonella enterica enterica serovar Typhi Ty2
cgcucaaccggu

SEQ ID NO: 1739431 - RNA, 13 nt, Salmonella enterica enterica serovar Typhi Ty2
cgcguggcaucuu

SEQ ID NO: 1739432 - RNA, 13 nt, Salmonella enterica enterica serovar Typhi Ty2
cgcuaaaccggcg

SEQ ID NO: 1739433 - RNA, 15 nt, Salmonella enterica enterica serovar Typhi Ty2
cgcuaagccagccaa

SEQ ID NO: 1739434 - RNA, 13 nt, Salmonella enterica enterica serovar Typhi Ty2
cgcuaaagcgcug

SEQ ID NO: 1739435 - RNA, 14 nt, Salmonella enterica enterica serovar Typhi Ty2
cgcuaaagcgcugg

SEQ ID NO: 1739436 - RNA, 15 nt, Salmonella enterica enterica serovar Typhi Ty2
cgcuaaaugcauagc

SEQ ID NO: 1739437 - RNA, 21 nt, Salmonella enterica enterica serovar Typhi Ty2
cgcuacauccgccagccgcca

SEQ ID NO: 1739438 - RNA, 13 nt, Salmonella enterica enterica serovar Typhi Ty2
cgcuacagggcgu

SEQ ID NO: 1739439 - RNA, 15 nt, Salmonella enterica enterica serovar Typhi Ty2
cgcuacaauccagga

SEQ ID NO: 1739440 - RNA, 14 nt, Salmonella enterica enterica serovar Typhi Ty2
cgcuaaguacggcg

SEQ ID NO: 1739441 - RNA, 21 nt, Salmonella enterica enterica serovar Typhi Ty2
cgcugaaaacggcaucaagcc

SEQ ID NO: 1739442 - RNA, 22 nt, Salmonella enterica enterica serovar Typhi Ty2
cgcucucuucgugacccgccag

SEQ ID NO: 1739443 - RNA, 14 nt, Salmonella enterica enterica serovar Typhi Ty2
cgcucucagcgucg

SEQ ID NO: 1739444 - RNA, 19 nt, Salmonella enterica enterica serovar Typhi Ty2
cgcucuaucgccuggagcu

SEQ ID NO: 1739445 - RNA, 14 nt, Salmonella enterica enterica serovar Typhi Ty2
cgcucgcuggugcc

SEQ ID NO: 1739446 - RNA, 22 nt, Salmonella enterica enterica serovar Typhi Ty2
cgcucgcucaucacaucgcgca

SEQ ID NO: 1739447 - RNA, 19 nt, Salmonella enterica enterica serovar Typhi Ty2
cgcucgcugauggcgagaa

SEQ ID NO: 1739448 - RNA, 23 nt, Salmonella enterica enterica serovar Typhi Ty2
cgcugcauccuguaccaccacgc

SEQ ID NO: 1739449 - RNA, 15 nt, Salmonella enterica enterica serovar Typhi Ty2
cgcugccacaauggc

SEQ ID NO: 1739450 - RNA, 19 nt, Salmonella enterica enterica serovar Typhi Ty2
cgcugaugacgcgccggau

SEQ ID NO: 1739451 - RNA, 22 nt, Salmonella enterica enterica serovar Typhi Ty2
cgcugaugguuucggcaugcca

SEQ ID NO: 1739452 - RNA, 15 nt, Salmonella enterica enterica serovar Typhi Ty2
cgcugauugccgcca

SEQ ID NO: 1739453 - RNA, 16 nt, Salmonella enterica enterica serovar Typhi Ty2
cgcggcugccgucgau

SEQ ID NO: 1739454 - RNA, 19 nt, Salmonella enterica enterica serovar Typhi Ty2
cgcggcuucaucaccaucg

SEQ ID NO: 1739455 - RNA, 21 nt, Salmonella enterica enterica serovar Typhi Ty2
cgcgggcgauuaucucgauau

SEQ ID NO: 1739456 - RNA, 23 nt, Salmonella enterica enterica serovar Typhi Ty2
cgcggcgcaacuuuuucgaugau

SEQ ID NO: 1739457 - RNA, 22 nt, Salmonella enterica enterica serovar Typhi Ty2
cgcggcccauucaacgggcgau

SEQ ID NO: 1739458 - RNA, 21 nt, Salmonella enterica enterica serovar Typhi Ty2
cgcggcgugaugccagccaua

SEQ ID NO: 1739459 - RNA, 18 nt, Salmonella enterica enterica serovar Typhi Ty2
cgcggaagcgaccggcgu

SEQ ID NO: 1739460 - RNA, 19 nt, Salmonella enterica enterica serovar Typhi Ty2
cgcggaagaaauagaacag

SEQ ID NO: 1739461 - RNA, 17 nt, Salmonella enterica enterica serovar Typhi Ty2
cgcgcuguauaaucccg

SEQ ID NO: 1739462 - RNA, 12 nt, Salmonella enterica enterica serovar Typhi Ty2
cgcgcuggcuga

SEQ ID NO: 1739463 - RNA, 12 nt, Salmonella enterica enterica serovar Typhi Ty2
cgcgcuggcgga

SEQ ID NO: 1739464 - RNA, 14 nt, Salmonella enterica enterica serovar Typhi Ty2
cgcggacgccacca

SEQ ID NO: 1739465 - RNA, 13 nt, Salmonella enterica enterica serovar Typhi Ty2
cgcggaaucguca

SEQ ID NO: 1739466 - RNA, 17 nt, Salmonella enterica enterica serovar Typhi Ty2
cgcggauaugcagcagc

SEQ ID NO: 1739467 - RNA, 16 nt, Salmonella enterica enterica serovar Typhi Ty2
cgcggauagucauaau

SEQ ID NO: 1739468 - RNA, 14 nt, Salmonella enterica enterica serovar Typhi Ty2
cgcggaucggcaca

SEQ ID NO: 1739469 - RNA, 16 nt, Salmonella enterica enterica serovar Typhi Ty2
cgcgcuauuccaguuu

SEQ ID NO: 1739470 - RNA, 21 nt, Salmonella enterica enterica serovar Typhi Ty2
cgcgcucuuccgccagcgcca

SEQ ID NO: 1739471 - RNA, 14 nt, Salmonella enterica enterica serovar Typhi Ty2
cgcgcuaaacguga

SEQ ID NO: 1739472 - RNA, 13 nt, Salmonella enterica enterica serovar Typhi Ty2
cgcgcgccgauaa

SEQ ID NO: 1739473 - RNA, 15 nt, Salmonella enterica enterica serovar Typhi Ty2
cgcgcgauauccacc

SEQ ID NO: 1739474 - RNA, 19 nt, Salmonella enterica enterica serovar Typhi Ty2
cgcgccuggaucugcgcau

SEQ ID NO: 1739475 - RNA, 15 nt, Salmonella enterica enterica serovar Typhi Ty2
cgccguccagcacca

SEQ ID NO: 1739476 - RNA, 16 nt, Salmonella enterica enterica serovar Typhi Ty2
cgccguagcugcgcgc

SEQ ID NO: 1739477 - RNA, 21 nt, Salmonella enterica enterica serovar Typhi Ty2
cgccguagcugcgcgccgcaa

SEQ ID NO: 1739478 - RNA, 20 nt, Salmonella enterica enterica serovar Typhi Ty2
cgccgucacaaagcccaccg

SEQ ID NO: 1739479 - RNA, 23 nt, Salmonella enterica enterica serovar Typhi Ty2
cgccguacacguauaaacgccgc

SEQ ID NO: 1739480 - RNA, 22 nt, Salmonella enterica enterica serovar Typhi Ty2
cgccguaaaacaacagcggcgu

SEQ ID NO: 1739481 - RNA, 15 nt, Salmonella enterica enterica serovar Typhi Ty2
cgccguaacgaacgc

SEQ ID NO: 1739482 - RNA, 14 nt, Salmonella enterica enterica serovar Typhi Ty2
cgccgguuuauccc

SEQ ID NO: 1739483 - RNA, 17 nt, Salmonella enterica enterica serovar Typhi Ty2
cgccggugaucccacca

SEQ ID NO: 1739484 - RNA, 22 nt, Salmonella enterica enterica serovar Typhi Ty2
cgccggcaguccuugcagccag

SEQ ID NO: 1739485 - RNA, 17 nt, Salmonella enterica enterica serovar Typhi Ty2
cgccgguagccagccaa

SEQ ID NO: 1739486 - RNA, 21 nt, Salmonella enterica enterica serovar Typhi Ty2
cgccgugcucacuaggcguua

SEQ ID NO: 1739487 - RNA, 22 nt, Salmonella enterica enterica serovar Typhi Ty2
cgccuaagaucggguggccuaa

SEQ ID NO: 1739488 - RNA, 21 nt, Salmonella enterica enterica serovar Typhi Ty2
cgccuaggccagugccaagca

SEQ ID NO: 1739489 - RNA, 17 nt, Salmonella enterica enterica serovar Typhi Ty2
cgccuaccagcacauga

SEQ ID NO: 1739490 - RNA, 19 nt, Salmonella enterica enterica serovar Typhi Ty2
cgccgugauaaauacgcug

SEQ ID NO: 1739491 - RNA, 24 nt, Salmonella enterica enterica serovar Typhi Ty2
cgccgucucgcuuaauccgugaau

SEQ ID NO: 1739492 - RNA, 13 nt, Salmonella enterica enterica serovar Typhi Ty2
cgccucaucgaca

SEQ ID NO: 1739493 - RNA, 20 nt, Salmonella enterica enterica serovar Typhi Ty2
cgccucgaccccuucgcccu

SEQ ID NO: 1739494 - RNA, 11 nt, Salmonella enterica enterica serovar Typhi Ty2
cgccugcugca

SEQ ID NO: 1739495 - RNA, 18 nt, Salmonella enterica enterica serovar Typhi Ty2
cgccugcuccguccacgc

SEQ ID NO: 1739496 - RNA, 20 nt, Salmonella enterica enterica serovar Typhi Ty2
cgccugauccggccuacaag

SEQ ID NO: 1739497 - RNA, 18 nt, Salmonella enterica enterica serovar Typhi Ty2
cgccugaauaaucggcgu

SEQ ID NO: 1739498 - RNA, 14 nt, Salmonella enterica enterica serovar Typhi Ty2
cgcgacauggcggu

SEQ ID NO: 1739499 - RNA, 22 nt, Salmonella enterica enterica serovar Typhi Ty2
cgcgacaucguuuccagcgaau

SEQ ID NO: 1739500 - RNA, 21 nt, Salmonella enterica enterica serovar Typhi Ty2
cgcgacgacgccagccagcca

SEQ ID NO: 1739501 - RNA, 13 nt, Salmonella enterica enterica serovar Typhi Ty2
cgcgacgcccaug

SEQ ID NO: 1739502 - RNA, 14 nt, Salmonella enterica enterica serovar Typhi Ty2
cgcgacguccgcca

SEQ ID NO: 1739503 - RNA, 12 nt, Salmonella enterica enterica serovar Typhi Ty2
cgcgacagcgcu

SEQ ID NO: 1739504 - RNA, 18 nt, Salmonella enterica enterica serovar Typhi Ty2
cgcgaaucgcuucacggc

SEQ ID NO: 1739505 - RNA, 16 nt, Salmonella enterica enterica serovar Typhi Ty2
cgcgaauaaucuguuu

SEQ ID NO: 1739506 - RNA, 17 nt, Salmonella enterica enterica serovar Typhi Ty2
cgcgaauaguggcgcgc

SEQ ID NO: 1739507 - RNA, 23 nt, Salmonella enterica enterica serovar Typhi Ty2
cgccuuucagacuucaacgccgc

SEQ ID NO: 1739508 - RNA, 17 nt, Salmonella enterica enterica serovar Typhi Ty2
cgccuuucuccaugguc

SEQ ID NO: 1739509 - RNA, 15 nt, Salmonella enterica enterica serovar Typhi Ty2
cgccugcuucacgua

SEQ ID NO: 1739510 - RNA, 18 nt, Salmonella enterica enterica serovar Typhi Ty2
cgcgaaacugcugccgca

SEQ ID NO: 1739511 - RNA, 19 nt, Salmonella enterica enterica serovar Typhi Ty2
cgccuuuuaacggacgauu

SEQ ID NO: 1739512 - RNA, 15 nt, Salmonella enterica enterica serovar Typhi Ty2
cgcgaaacaggucgg

SEQ ID NO: 1739513 - RNA, 13 nt, Salmonella enterica enterica serovar Typhi Ty2
cgcgaaaaaagau

SEQ ID NO: 1739514 - RNA, 13 nt, Salmonella enterica enterica serovar Typhi Ty2
cgcgaaaaacgau

SEQ ID NO: 1739515 - RNA, 16 nt, Salmonella enterica enterica serovar Typhi Ty2
cgcgauacugccgccc

SEQ ID NO: 1739516 - RNA, 18 nt, Salmonella enterica enterica serovar Typhi Ty2
cgcgauaaauucaaugag

SEQ ID NO: 1739517 - RNA, 17 nt, Salmonella enterica enterica serovar Typhi Ty2
cgcgauacccgcgauca

SEQ ID NO: 1739518 - RNA, 20 nt, Salmonella enterica enterica serovar Typhi Ty2
cgcgauagaccacgccauca

SEQ ID NO: 1739519 - RNA, 20 nt, Salmonella enterica enterica serovar Typhi Ty2
cgcgauauccaccaccugau

SEQ ID NO: 1739520 - RNA, 19 nt, Salmonella enterica enterica serovar Typhi Ty2
cgcgaucaaucacgccgau

SEQ ID NO: 1739521 - RNA, 18 nt, Salmonella enterica enterica serovar Typhi Ty2
cgcgauaugucucuccag

SEQ ID NO: 1739522 - RNA, 19 nt, Salmonella enterica enterica serovar Typhi Ty2
cgcgauaacguuaccgcag

SEQ ID NO: 1739523 - RNA, 18 nt, Salmonella enterica enterica serovar Typhi Ty2
cgcgagugucauccugcg

SEQ ID NO: 1739524 - RNA, 12 nt, Salmonella enterica enterica serovar Typhi Ty2
cgcgagcagcca

SEQ ID NO: 1739525 - RNA, 21 nt, Salmonella enterica enterica serovar Typhi Ty2
cgcgauccagccccagcgcca

SEQ ID NO: 1739526 - RNA, 12 nt, Salmonella enterica enterica serovar Typhi Ty2
cgcgauccgcca

SEQ ID NO: 1739527 - RNA, 19 nt, Salmonella enterica enterica serovar Typhi Ty2
cgcgcaaagccuuuccgca

SEQ ID NO: 1739528 - RNA, 12 nt, Salmonella enterica enterica serovar Typhi Ty2
cgcgcaaacgcu

SEQ ID NO: 1739529 - RNA, 20 nt, Salmonella enterica enterica serovar Typhi Ty2
cgcgauucgcccacggauga

SEQ ID NO: 1739530 - RNA, 21 nt, Salmonella enterica enterica serovar Typhi Ty2
cgccgcauugguaaagccggu

SEQ ID NO: 1739531 - RNA, 17 nt, Salmonella enterica enterica serovar Typhi Ty2
cgccgcaucuuccacgc

SEQ ID NO: 1739532 - RNA, 13 nt, Salmonella enterica enterica serovar Typhi Ty2
cgccgcaucgcgg

SEQ ID NO: 1739533 - RNA, 13 nt, Salmonella enterica enterica serovar Typhi Ty2
cgccgaucggcgu

SEQ ID NO: 1739534 - RNA, 21 nt, Salmonella enterica enterica serovar Typhi Ty2
cgccgccaagauuaagaccgu

SEQ ID NO: 1739535 - RNA, 14 nt, Salmonella enterica enterica serovar Typhi Ty2
cgccgccacauugc

SEQ ID NO: 1739536 - RNA, 18 nt, Salmonella enterica enterica serovar Typhi Ty2
cgccgccauccgacaacc

SEQ ID NO: 1739537 - RNA, 21 nt, Salmonella enterica enterica serovar Typhi Ty2
cgccgccauccgacaaccggc

SEQ ID NO: 1739538 - RNA, 14 nt, Salmonella enterica enterica serovar Typhi Ty2
cgccgccagcaaua

SEQ ID NO: 1739539 - RNA, 20 nt, Salmonella enterica enterica serovar Typhi Ty2
cgccgcccaacgcggcuuua

SEQ ID NO: 1739540 - RNA, 20 nt, Salmonella enterica enterica serovar Typhi Ty2
cgccgccauccggcacgguc

SEQ ID NO: 1739541 - RNA, 21 nt, Salmonella enterica enterica serovar Typhi Ty2
cgccgcgcaguuuuuauccuc

SEQ ID NO: 1739542 - RNA, 15 nt, Salmonella enterica enterica serovar Typhi Ty2
cgccgcgacgcgcga

SEQ ID NO: 1739543 - RNA, 15 nt, Salmonella enterica enterica serovar Typhi Ty2
cgccgccuugcggcg

SEQ ID NO: 1739544 - RNA, 18 nt, Salmonella enterica enterica serovar Typhi Ty2
cgccgccgggccgccgau

SEQ ID NO: 1739545 - RNA, 20 nt, Salmonella enterica enterica serovar Typhi Ty2
cgccggcaaagguugccgca

SEQ ID NO: 1739546 - RNA, 15 nt, Salmonella enterica enterica serovar Typhi Ty2
cgccggacuccagca

SEQ ID NO: 1739547 - RNA, 15 nt, Salmonella enterica enterica serovar Typhi Ty2
cgccggaaucgcgau

SEQ ID NO: 1739548 - RNA, 14 nt, Salmonella enterica enterica serovar Typhi Ty2
cgccgcggcgguua

SEQ ID NO: 1739549 - RNA, 12 nt, Salmonella enterica enterica serovar Typhi Ty2
cgcccguacaga

SEQ ID NO: 1739550 - RNA, 18 nt, Salmonella enterica enterica serovar Typhi Ty2
cgcccggaucacggccuu

SEQ ID NO: 1739551 - RNA, 21 nt, Salmonella enterica enterica serovar Typhi Ty2
cgcccgcggcaugauccacca

SEQ ID NO: 1739552 - RNA, 15 nt, Salmonella enterica enterica serovar Typhi Ty2
cgcccucgccagcaa

SEQ ID NO: 1739553 - RNA, 15 nt, Salmonella enterica enterica serovar Typhi Ty2
cgcccucaucggcaa

SEQ ID NO: 1739554 - RNA, 22 nt, Salmonella enterica enterica serovar Typhi Ty2
cgccaugccaucggccagcagg

SEQ ID NO: 1739555 - RNA, 12 nt, Salmonella enterica enterica serovar Typhi Ty2
cgcccugaaagc

SEQ ID NO: 1739556 - RNA, 15 nt, Salmonella enterica enterica serovar Typhi Ty2
cgcccugacgccgcu

SEQ ID NO: 1739557 - RNA, 20 nt, Salmonella enterica enterica serovar Typhi Ty2
cgcccuguauacaggcaugg

SEQ ID NO: 1739558 - RNA, 20 nt, Salmonella enterica enterica serovar Typhi Ty2
cgcccuucacaaccaucguc

SEQ ID NO: 1739559 - RNA, 23 nt, Salmonella enterica enterica serovar Typhi Ty2
cgccgaauagaguaauacaucca

SEQ ID NO: 1739560 - RNA, 18 nt, Salmonella enterica enterica serovar Typhi Ty2
ccgucggggauggcggau

SEQ ID NO: 1739561 - RNA, 13 nt, Salmonella enterica enterica serovar Typhi Ty2
ccgucgcgcuuac

SEQ ID NO: 1739562 - RNA, 18 nt, Salmonella enterica enterica serovar Typhi Ty2
ccguggugaccgccagau

SEQ ID NO: 1739563 - RNA, 16 nt, Salmonella enterica enterica serovar Typhi Ty2
ccgugccguguaaggc

SEQ ID NO: 1739564 - RNA, 16 nt, Salmonella enterica enterica serovar Typhi Ty2
ccgugauaaauacgcu

SEQ ID NO: 1739565 - RNA, 18 nt, Salmonella enterica enterica serovar Typhi Ty2
ccgugagaaucgaucagc

SEQ ID NO: 1739566 - RNA, 16 nt, Salmonella enterica enterica serovar Typhi Ty2
ccgucgugccugcggu

SEQ ID NO: 1739567 - RNA, 19 nt, Salmonella enterica enterica serovar Typhi Ty2
ccgucguuaaucagcgcgg

SEQ ID NO: 1739568 - RNA, 22 nt, Salmonella enterica enterica serovar Typhi Ty2
ccgucguuaacaucaucaggcc

SEQ ID NO: 1739569 - RNA, 22 nt, Salmonella enterica enterica serovar Typhi Ty2
ccucccguuucagugacgcguu

SEQ ID NO: 1739570 - RNA, 15 nt, Salmonella enterica enterica serovar Typhi Ty2
ccucacaaacggcau

SEQ ID NO: 1739571 - RNA, 11 nt, Salmonella enterica enterica serovar Typhi Ty2
ccucaauccgu

SEQ ID NO: 1739572 - RNA, 23 nt, Salmonella enterica enterica serovar Typhi Ty2
ccuauuuuaaauucccagcguac

SEQ ID NO: 1739573 - RNA, 13 nt, Salmonella enterica enterica serovar Typhi Ty2
ccucaaccaacgg

SEQ ID NO: 1739574 - RNA, 23 nt, Salmonella enterica enterica serovar Typhi Ty2
ccuaagccggcaggcagcgccag

SEQ ID NO: 1739575 - RNA, 22 nt, Salmonella enterica enterica serovar Typhi Ty2
ccuaacuggaaaaagaccaaua

SEQ ID NO: 1739576 - RNA, 21 nt, Salmonella enterica enterica serovar Typhi Ty2
ccuaaggucacgccggaaauc

SEQ ID NO: 1739577 - RNA, 20 nt, Salmonella enterica enterica serovar Typhi Ty2
ccuaaugaagcgcguucguc

SEQ ID NO: 1739578 - RNA, 15 nt, Salmonella enterica enterica serovar Typhi Ty2
ccuaaugagccagau

SEQ ID NO: 1739579 - RNA, 17 nt, Salmonella enterica enterica serovar Typhi Ty2
ccuaaugagccagaugg

SEQ ID NO: 1739580 - RNA, 23 nt, Salmonella enterica enterica serovar Typhi Ty2
ccuaucaggaucaaaaucgcgcc

SEQ ID NO: 1739581 - RNA, 16 nt, Salmonella enterica enterica serovar Typhi Ty2
ccuacaaaaucgccca

SEQ ID NO: 1739582 - RNA, 17 nt, Salmonella enterica enterica serovar Typhi Ty2
ccguuugcagccagaua

SEQ ID NO: 1739583 - RNA, 14 nt, Salmonella enterica enterica serovar Typhi Ty2
ccguuucagaaaga

SEQ ID NO: 1739584 - RNA, 17 nt, Salmonella enterica enterica serovar Typhi Ty2
ccguuuaaaagcggaua

SEQ ID NO: 1739585 - RNA, 15 nt, Salmonella enterica enterica serovar Typhi Ty2
ccguugaccagcuga

SEQ ID NO: 1739586 - RNA, 14 nt, Salmonella enterica enterica serovar Typhi Ty2
ccguucuccagcgu

SEQ ID NO: 1739587 - RNA, 15 nt, Salmonella enterica enterica serovar Typhi Ty2
ccugcgguagcgccg

SEQ ID NO: 1739588 - RNA, 12 nt, Salmonella enterica enterica serovar Typhi Ty2
ccugcgccagcg

SEQ ID NO: 1739589 - RNA, 20 nt, Salmonella enterica enterica serovar Typhi Ty2
ccugcgccaggauaucgccc

SEQ ID NO: 1739590 - RNA, 14 nt, Salmonella enterica enterica serovar Typhi Ty2
ccugcgccguuucu

SEQ ID NO: 1739591 - RNA, 22 nt, Salmonella enterica enterica serovar Typhi Ty2
ccugcauaauugcugacagcau

SEQ ID NO: 1739592 - RNA, 18 nt, Salmonella enterica enterica serovar Typhi Ty2
ccuggaggaacagcgccg

SEQ ID NO: 1739593 - RNA, 18 nt, Salmonella enterica enterica serovar Typhi Ty2
ccuggagagcagcgccag

SEQ ID NO: 1739594 - RNA, 24 nt, Salmonella enterica enterica serovar Typhi Ty2
ccuggagugacuaaaagacgccau

SEQ ID NO: 1739595 - RNA, 17 nt, Salmonella enterica enterica serovar Typhi Ty2
ccuggauagcaauuuca

SEQ ID NO: 1739596 - RNA, 14 nt, Salmonella enterica enterica serovar Typhi Ty2
ccuggaugcgcuga

SEQ ID NO: 1739597 - RNA, 16 nt, Salmonella enterica enterica serovar Typhi Ty2
ccugcuugucgaucau

SEQ ID NO: 1739598 - RNA, 18 nt, Salmonella enterica enterica serovar Typhi Ty2
ccugcugcgccagcgcau

SEQ ID NO: 1739599 - RNA, 22 nt, Salmonella enterica enterica serovar Typhi Ty2
ccugcuucagacaacgccgccu

SEQ ID NO: 1739600 - RNA, 16 nt, Salmonella enterica enterica serovar Typhi Ty2
ccugcguuugcggauc

SEQ ID NO: 1739601 - RNA, 15 nt, Salmonella enterica enterica serovar Typhi Ty2
ccugcucccagauua

SEQ ID NO: 1739602 - RNA, 21 nt, Salmonella enterica enterica serovar Typhi Ty2
ccugcaaaauaccgcccaucg

SEQ ID NO: 1739603 - RNA, 12 nt, Salmonella enterica enterica serovar Typhi Ty2
ccugagcgcgca

SEQ ID NO: 1739604 - RNA, 15 nt, Salmonella enterica enterica serovar Typhi Ty2
ccugcaacagcacca

SEQ ID NO: 1739605 - RNA, 23 nt, Salmonella enterica enterica serovar Typhi Ty2
ccugcaacgcuuuagugccgcca

SEQ ID NO: 1739606 - RNA, 19 nt, Salmonella enterica enterica serovar Typhi Ty2
ccugacgcugcgccuggau

SEQ ID NO: 1739607 - RNA, 17 nt, Salmonella enterica enterica serovar Typhi Ty2
ccugaccgggcucacgc

SEQ ID NO: 1739608 - RNA, 14 nt, Salmonella enterica enterica serovar Typhi Ty2
ccucguucggcgca

SEQ ID NO: 1739609 - RNA, 17 nt, Salmonella enterica enterica serovar Typhi Ty2
ccucgucauaucugaug

SEQ ID NO: 1739610 - RNA, 16 nt, Salmonella enterica enterica serovar Typhi Ty2
ccggcggcaaggucug

SEQ ID NO: 1739611 - RNA, 12 nt, Salmonella enterica enterica serovar Typhi Ty2
ccggcgguugag

SEQ ID NO: 1739612 - RNA, 15 nt, Salmonella enterica enterica serovar Typhi Ty2
ccggcgcuaaccagc

SEQ ID NO: 1739613 - RNA, 19 nt, Salmonella enterica enterica serovar Typhi Ty2
ccggcgcucagccagaaac

SEQ ID NO: 1739614 - RNA, 19 nt, Salmonella enterica enterica serovar Typhi Ty2
ccggcgcguuaauaccgug

SEQ ID NO: 1739615 - RNA, 20 nt, Salmonella enterica enterica serovar Typhi Ty2
ccggcggaaaaaagcagcau

SEQ ID NO: 1739616 - RNA, 21 nt, Salmonella enterica enterica serovar Typhi Ty2
ccggcgccuguuaauaccgug

SEQ ID NO: 1739617 - RNA, 14 nt, Salmonella enterica enterica serovar Typhi Ty2
ccggcgccagaagc

SEQ ID NO: 1739618 - RNA, 23 nt, Salmonella enterica enterica serovar Typhi Ty2
ccggcgugaaagcgcuugauaau

SEQ ID NO: 1739619 - RNA, 18 nt, Salmonella enterica enterica serovar Typhi Ty2
ccggcgugaaagcgcuug

SEQ ID NO: 1739620 - RNA, 23 nt, Salmonella enterica enterica serovar Typhi Ty2
ccggcuccgaccaucgccgcgaa

SEQ ID NO: 1739621 - RNA, 23 nt, Salmonella enterica enterica serovar Typhi Ty2
ccggcugaagccccaacagaccg

SEQ ID NO: 1739622 - RNA, 15 nt, Salmonella enterica enterica serovar Typhi Ty2
ccgggauaaucaggu

SEQ ID NO: 1739623 - RNA, 17 nt, Salmonella enterica enterica serovar Typhi Ty2
ccgguagcauccgcgau

SEQ ID NO: 1739624 - RNA, 13 nt, Salmonella enterica enterica serovar Typhi Ty2
ccgguagcguggu

SEQ ID NO: 1739625 - RNA, 20 nt, Salmonella enterica enterica serovar Typhi Ty2
ccgguacacuucagccagac

SEQ ID NO: 1739626 - RNA, 19 nt, Salmonella enterica enterica serovar Typhi Ty2
ccgguaagcgcagcgccac

SEQ ID NO: 1739627 - RNA, 14 nt, Salmonella enterica enterica serovar Typhi Ty2
ccggguuaaaucgc

SEQ ID NO: 1739628 - RNA, 14 nt, Salmonella enterica enterica serovar Typhi Ty2
ccggucaagcgcaa

SEQ ID NO: 1739629 - RNA, 20 nt, Salmonella enterica enterica serovar Typhi Ty2
ccggucaacgcgccgccaac

SEQ ID NO: 1739630 - RNA, 14 nt, Salmonella enterica enterica serovar Typhi Ty2
ccggucgcgccagc

SEQ ID NO: 1739631 - RNA, 19 nt, Salmonella enterica enterica serovar Typhi Ty2
ccgguuauaccgccauccg

SEQ ID NO: 1739632 - RNA, 23 nt, Salmonella enterica enterica serovar Typhi Ty2
ccgguggucuguucgagggcgau

SEQ ID NO: 1739633 - RNA, 14 nt, Salmonella enterica enterica serovar Typhi Ty2
ccggucuggcucac

SEQ ID NO: 1739634 - RNA, 20 nt, Salmonella enterica enterica serovar Typhi Ty2
ccggucuacaagugauacgg

SEQ ID NO: 1739635 - RNA, 16 nt, Salmonella enterica enterica serovar Typhi Ty2
ccgucacccgcguauc

SEQ ID NO: 1739636 - RNA, 19 nt, Salmonella enterica enterica serovar Typhi Ty2
ccguaggccggauaagacg

SEQ ID NO: 1739637 - RNA, 22 nt, Salmonella enterica enterica serovar Typhi Ty2
ccguagucugauugccggauga

SEQ ID NO: 1739638 - RNA, 15 nt, Salmonella enterica enterica serovar Typhi Ty2
ccguagcgacgccau

SEQ ID NO: 1739639 - RNA, 18 nt, Salmonella enterica enterica serovar Typhi Ty2
ccguccggcuuuuuucac

SEQ ID NO: 1739640 - RNA, 22 nt, Salmonella enterica enterica serovar Typhi Ty2
ccgcgaugaucgucgcgaucgc

SEQ ID NO: 1739641 - RNA, 13 nt, Salmonella enterica enterica serovar Typhi Ty2
ccgcgccagcgau

SEQ ID NO: 1739642 - RNA, 18 nt, Salmonella enterica enterica serovar Typhi Ty2
ccgcgagagucgccagga

SEQ ID NO: 1739643 - RNA, 14 nt, Salmonella enterica enterica serovar Typhi Ty2
ccgccgucaggcua

SEQ ID NO: 1739644 - RNA, 12 nt, Salmonella enterica enterica serovar Typhi Ty2
ccgccgcgguga

SEQ ID NO: 1739645 - RNA, 16 nt, Salmonella enterica enterica serovar Typhi Ty2
ccgccgacaugacggu

SEQ ID NO: 1739646 - RNA, 12 nt, Salmonella enterica enterica serovar Typhi Ty2
ccgccccgcugg

SEQ ID NO: 1739647 - RNA, 13 nt, Salmonella enterica enterica serovar Typhi Ty2
ccgcccaggccug

SEQ ID NO: 1739648 - RNA, 23 nt, Salmonella enterica enterica serovar Typhi Ty2
ccgcccaucgggccgcucagcau

SEQ ID NO: 1739649 - RNA, 13 nt, Salmonella enterica enterica serovar Typhi Ty2
ccgcccagaacgg

SEQ ID NO: 1739650 - RNA, 17 nt, Salmonella enterica enterica serovar Typhi Ty2
ccgcccagagaauauug

SEQ ID NO: 1739651 - RNA, 20 nt, Salmonella enterica enterica serovar Typhi Ty2
ccgcccagaaagaucagcag

SEQ ID NO: 1739652 - RNA, 22 nt, Salmonella enterica enterica serovar Typhi Ty2
ccgccaguuguucaacauagua

SEQ ID NO: 1739653 - RNA, 20 nt, Salmonella enterica enterica serovar Typhi Ty2
ccgccauagccggcgauagc

SEQ ID NO: 1739654 - RNA, 15 nt, Salmonella enterica enterica serovar Typhi Ty2
ccgccaccaccgauc

SEQ ID NO: 1739655 - RNA, 14 nt, Salmonella enterica enterica serovar Typhi Ty2
ccgccaaugaccau

SEQ ID NO: 1739656 - RNA, 13 nt, Salmonella enterica enterica serovar Typhi Ty2
ccgccaagcgcgg

SEQ ID NO: 1739657 - RNA, 15 nt, Salmonella enterica enterica serovar Typhi Ty2
ccgccaccaucgcau

SEQ ID NO: 1739658 - RNA, 15 nt, Salmonella enterica enterica serovar Typhi Ty2
ccgccaccauccggc

SEQ ID NO: 1739659 - RNA, 13 nt, Salmonella enterica enterica serovar Typhi Ty2
ccgccaacgccaa

SEQ ID NO: 1739660 - RNA, 13 nt, Salmonella enterica enterica serovar Typhi Ty2
ccgcagcgccaua

SEQ ID NO: 1739661 - RNA, 23 nt, Salmonella enterica enterica serovar Typhi Ty2
ccgcagcgccugcgccgcaggaa

SEQ ID NO: 1739662 - RNA, 16 nt, Salmonella enterica enterica serovar Typhi Ty2
ccgcaauaacgccgau

SEQ ID NO: 1739663 - RNA, 23 nt, Salmonella enterica enterica serovar Typhi Ty2
ccgcaauaacgccgauaaccagc

SEQ ID NO: 1739664 - RNA, 14 nt, Salmonella enterica enterica serovar Typhi Ty2
ccgcagccgacgca

SEQ ID NO: 1739665 - RNA, 19 nt, Salmonella enterica enterica serovar Typhi Ty2
ccgacgauaaacagauaug

SEQ ID NO: 1739666 - RNA, 12 nt, Salmonella enterica enterica serovar Typhi Ty2
ccgaugccgccg

SEQ ID NO: 1739667 - RNA, 22 nt, Salmonella enterica enterica serovar Typhi Ty2
ccgcaaacgccgugaacgccaa

SEQ ID NO: 1739668 - RNA, 18 nt, Salmonella enterica enterica serovar Typhi Ty2
ccgcaaacgccugcuccg

SEQ ID NO: 1739669 - RNA, 15 nt, Salmonella enterica enterica serovar Typhi Ty2
ccgcaaacuggccac

SEQ ID NO: 1739670 - RNA, 18 nt, Salmonella enterica enterica serovar Typhi Ty2
ccgcaaauuccaccacgu

SEQ ID NO: 1739671 - RNA, 20 nt, Salmonella enterica enterica serovar Typhi Ty2
ccggacguugaaaaaacggg

SEQ ID NO: 1739672 - RNA, 15 nt, Salmonella enterica enterica serovar Typhi Ty2
ccggagaccggcgaa

SEQ ID NO: 1739673 - RNA, 18 nt, Salmonella enterica enterica serovar Typhi Ty2
ccggagaccggcgaaauc

SEQ ID NO: 1739674 - RNA, 23 nt, Salmonella enterica enterica serovar Typhi Ty2
ccggagaucugucgccgauaauc

SEQ ID NO: 1739675 - RNA, 23 nt, Salmonella enterica enterica serovar Typhi Ty2
ccggaggcagaggucucagguuc

SEQ ID NO: 1739676 - RNA, 14 nt, Salmonella enterica enterica serovar Typhi Ty2
ccggaccagacgac

SEQ ID NO: 1739677 - RNA, 11 nt, Salmonella enterica enterica serovar Typhi Ty2
ccggaccugcg

SEQ ID NO: 1739678 - RNA, 22 nt, Salmonella enterica enterica serovar Typhi Ty2
ccggaugaggcgcagccgccau

SEQ ID NO: 1739679 - RNA, 20 nt, Salmonella enterica enterica serovar Typhi Ty2
ccggaugacggcagcgcguu

SEQ ID NO: 1739680 - RNA, 20 nt, Salmonella enterica enterica serovar Typhi Ty2
ccggaugccagucaauaagc

SEQ ID NO: 1739681 - RNA, 23 nt, Salmonella enterica enterica serovar Typhi Ty2
ccggauggcggcgugaacgccuu

SEQ ID NO: 1739682 - RNA, 22 nt, Salmonella enterica enterica serovar Typhi Ty2
ccggauggcgacguugcgccuu

SEQ ID NO: 1739683 - RNA, 17 nt, Salmonella enterica enterica serovar Typhi Ty2
ccggcaaaaaucagccc

SEQ ID NO: 1739684 - RNA, 22 nt, Salmonella enterica enterica serovar Typhi Ty2
ccggauggcggcugcgccuuau

SEQ ID NO: 1739685 - RNA, 13 nt, Salmonella enterica enterica serovar Typhi Ty2
ccggaucgcguuu

SEQ ID NO: 1739686 - RNA, 19 nt, Salmonella enterica enterica serovar Typhi Ty2
ccggaucgaucccggcaaa

SEQ ID NO: 1739687 - RNA, 15 nt, Salmonella enterica enterica serovar Typhi Ty2
ccggaucaccggcau

SEQ ID NO: 1739688 - RNA, 19 nt, Salmonella enterica enterica serovar Typhi Ty2
ccggauagcguagcgccau

SEQ ID NO: 1739689 - RNA, 20 nt, Salmonella enterica enterica serovar Typhi Ty2
ccggauaagcgugagcgcau

SEQ ID NO: 1739690 - RNA, 20 nt, Salmonella enterica enterica serovar Typhi Ty2
ccggauaagcguagcgccau

SEQ ID NO: 1739691 - RNA, 20 nt, Salmonella enterica enterica serovar Typhi Ty2
ccggauaagcgcagcgccau

SEQ ID NO: 1739692 - RNA, 21 nt, Salmonella enterica enterica serovar Typhi Ty2
ccggauaagcauuagcgccau

SEQ ID NO: 1739693 - RNA, 22 nt, Salmonella enterica enterica serovar Typhi Ty2
ccggauaaggcgcuugcgccau

SEQ ID NO: 1739694 - RNA, 22 nt, Salmonella enterica enterica serovar Typhi Ty2
ccggauaacggcgcgaaagcgc

SEQ ID NO: 1739695 - RNA, 19 nt, Salmonella enterica enterica serovar Typhi Ty2
ccggcaggcucaccagccc

SEQ ID NO: 1739696 - RNA, 16 nt, Salmonella enterica enterica serovar Typhi Ty2
ccggcagcgcauaagc

SEQ ID NO: 1739697 - RNA, 16 nt, Salmonella enterica enterica serovar Typhi Ty2
ccggcagccgcugaua

SEQ ID NO: 1739698 - RNA, 14 nt, Salmonella enterica enterica serovar Typhi Ty2
ccggcaaaggaauu

SEQ ID NO: 1739699 - RNA, 23 nt, Salmonella enterica enterica serovar Typhi Ty2
ccggcaaaggaauuacgggcgau

SEQ ID NO: 1739700 - RNA, 17 nt, Salmonella enterica enterica serovar Typhi Ty2
ccggcaaaccuaccggc

SEQ ID NO: 1739701 - RNA, 18 nt, Salmonella enterica enterica serovar Typhi Ty2
ccggcaaacguaaaacgc

SEQ ID NO: 1739702 - RNA, 20 nt, Salmonella enterica enterica serovar Typhi Ty2
ccggcaaacccuuaacuggc

SEQ ID NO: 1739703 - RNA, 19 nt, Salmonella enterica enterica serovar Typhi Ty2
ccggcacaaugcccggcau

SEQ ID NO: 1739704 - RNA, 19 nt, Salmonella enterica enterica serovar Typhi Ty2
ccggcaauuaaccgauaac

SEQ ID NO: 1739705 - RNA, 15 nt, Salmonella enterica enterica serovar Typhi Ty2
ccggcagacgauagc

SEQ ID NO: 1739706 - RNA, 14 nt, Salmonella enterica enterica serovar Typhi Ty2
ccgcgcccugcgga

SEQ ID NO: 1739707 - RNA, 14 nt, Salmonella enterica enterica serovar Typhi Ty2
ccgcguaaucgcga

SEQ ID NO: 1739708 - RNA, 13 nt, Salmonella enterica enterica serovar Typhi Ty2
ccgcuauuaccag

SEQ ID NO: 1739709 - RNA, 20 nt, Salmonella enterica enterica serovar Typhi Ty2
ccgcucaggguaaucaccau

SEQ ID NO: 1739710 - RNA, 13 nt, Salmonella enterica enterica serovar Typhi Ty2
ccgcuccagaagc

SEQ ID NO: 1739711 - RNA, 18 nt, Salmonella enterica enterica serovar Typhi Ty2
ccggaacaaaagaaagca

SEQ ID NO: 1739712 - RNA, 22 nt, Salmonella enterica enterica serovar Typhi Ty2
ccggaaaggauauaagcgccau

SEQ ID NO: 1739713 - RNA, 21 nt, Salmonella enterica enterica serovar Typhi Ty2
ccggaaagacggcagcgccau

SEQ ID NO: 1739714 - RNA, 11 nt, Salmonella enterica enterica serovar Typhi Ty2
ccgcugcggaa

SEQ ID NO: 1739715 - RNA, 21 nt, Salmonella enterica enterica serovar Typhi Ty2
ccgcugucgccagaauguuau

SEQ ID NO: 1739716 - RNA, 21 nt, Salmonella enterica enterica serovar Typhi Ty2
ccgcuuauuugccuaacgggc

SEQ ID NO: 1739717 - RNA, 13 nt, Salmonella enterica enterica serovar Typhi Ty2
cgaugagcgccag

SEQ ID NO: 1739718 - RNA, 18 nt, Salmonella enterica enterica serovar Typhi Ty2
cgaugauauccagcacgc

SEQ ID NO: 1739719 - RNA, 16 nt, Salmonella enterica enterica serovar Typhi Ty2
cgaugaaugacgagca

SEQ ID NO: 1739720 - RNA, 23 nt, Salmonella enterica enterica serovar Typhi Ty2
cgaugacagcaggaacggcagga

SEQ ID NO: 1739721 - RNA, 13 nt, Salmonella enterica enterica serovar Typhi Ty2
cgaugacagcagg

SEQ ID NO: 1739722 - RNA, 17 nt, Salmonella enterica enterica serovar Typhi Ty2
cgaugaacaucgacaag

SEQ ID NO: 1739723 - RNA, 15 nt, Salmonella enterica enterica serovar Typhi Ty2
cgaucgcuaaucagg

SEQ ID NO: 1739724 - RNA, 20 nt, Salmonella enterica enterica serovar Typhi Ty2
cgaucgcucaacuccugcau

SEQ ID NO: 1739725 - RNA, 23 nt, Salmonella enterica enterica serovar Typhi Ty2
cgaucgcgauucgcccacggaug

SEQ ID NO: 1739726 - RNA, 20 nt, Salmonella enterica enterica serovar Typhi Ty2
cgaucgccagcuacgacaag

SEQ ID NO: 1739727 - RNA, 20 nt, Salmonella enterica enterica serovar Typhi Ty2
cgaucggcuuguuaugcgga

SEQ ID NO: 1739728 - RNA, 14 nt, Salmonella enterica enterica serovar Typhi Ty2
cgaucgguuaucac

SEQ ID NO: 1739729 - RNA, 14 nt, Salmonella enterica enterica serovar Typhi Ty2
cgaucaccagcgca

SEQ ID NO: 1739730 - RNA, 20 nt, Salmonella enterica enterica serovar Typhi Ty2
cgaucacggcgaaucgccug

SEQ ID NO: 1739731 - RNA, 13 nt, Salmonella enterica enterica serovar Typhi Ty2
cgaucagcgccac

SEQ ID NO: 1739732 - RNA, 20 nt, Salmonella enterica enterica serovar Typhi Ty2
cgaucaucccgcccagcaac

SEQ ID NO: 1739733 - RNA, 14 nt, Salmonella enterica enterica serovar Typhi Ty2
cgaucaucauuccg

SEQ ID NO: 1739734 - RNA, 16 nt, Salmonella enterica enterica serovar Typhi Ty2
cgaucaucagaacgcc

SEQ ID NO: 1739735 - RNA, 18 nt, Salmonella enterica enterica serovar Typhi Ty2
cgaucccaguugaucggc

SEQ ID NO: 1739736 - RNA, 14 nt, Salmonella enterica enterica serovar Typhi Ty2
cgauaauacgcgcg

SEQ ID NO: 1739737 - RNA, 22 nt, Salmonella enterica enterica serovar Typhi Ty2
cgauaauacgcgcgauuacgcg

SEQ ID NO: 1739738 - RNA, 13 nt, Salmonella enterica enterica serovar Typhi Ty2
cgauaaucggcga

SEQ ID NO: 1739739 - RNA, 18 nt, Salmonella enterica enterica serovar Typhi Ty2
cgauaaucaccagcccga

SEQ ID NO: 1739740 - RNA, 18 nt, Salmonella enterica enterica serovar Typhi Ty2
cgauaagcuuccgccaug

SEQ ID NO: 1739741 - RNA, 15 nt, Salmonella enterica enterica serovar Typhi Ty2
cgauaagcaagcgcc

SEQ ID NO: 1739742 - RNA, 16 nt, Salmonella enterica enterica serovar Typhi Ty2
cgauaagcaagcgcca

SEQ ID NO: 1739743 - RNA, 16 nt, Salmonella enterica enterica serovar Typhi Ty2
cgauaaauaccguaau

SEQ ID NO: 1739744 - RNA, 16 nt, Salmonella enterica enterica serovar Typhi Ty2
cgauaaagaacgcgcc

SEQ ID NO: 1739745 - RNA, 18 nt, Salmonella enterica enterica serovar Typhi Ty2
cgauaaagaacgcgccga

SEQ ID NO: 1739746 - RNA, 23 nt, Salmonella enterica enterica serovar Typhi Ty2
cgauaaagaacgcgccgaccauu

SEQ ID NO: 1739747 - RNA, 19 nt, Salmonella enterica enterica serovar Typhi Ty2
cgauaaacucaaucaggcu

SEQ ID NO: 1739748 - RNA, 17 nt, Salmonella enterica enterica serovar Typhi Ty2
cgauaaccaccagcgga

SEQ ID NO: 1739749 - RNA, 15 nt, Salmonella enterica enterica serovar Typhi Ty2
cgauaaccaugcuca

SEQ ID NO: 1739750 - RNA, 20 nt, Salmonella enterica enterica serovar Typhi Ty2
cgauaacacggcuggcaaug

SEQ ID NO: 1739751 - RNA, 22 nt, Salmonella enterica enterica serovar Typhi Ty2
cgauaaccuucuucguuaugaa

SEQ ID NO: 1739752 - RNA, 13 nt, Salmonella enterica enterica serovar Typhi Ty2
cgauaaccgccga

SEQ ID NO: 1739753 - RNA, 16 nt, Salmonella enterica enterica serovar Typhi Ty2
cgauaaaccgcugcca

SEQ ID NO: 1739754 - RNA, 12 nt, Salmonella enterica enterica serovar Typhi Ty2
cgauaaacgauc

SEQ ID NO: 1739755 - RNA, 22 nt, Salmonella enterica enterica serovar Typhi Ty2
cgauaaacaguuugugccgcca

SEQ ID NO: 1739756 - RNA, 21 nt, Salmonella enterica enterica serovar Typhi Ty2
cgauauagcgcauagcggcca

SEQ ID NO: 1739757 - RNA, 13 nt, Salmonella enterica enterica serovar Typhi Ty2
cgauauaagcgcc

SEQ ID NO: 1739758 - RNA, 22 nt, Salmonella enterica enterica serovar Typhi Ty2
cgauauaagcgccgucauccgc

SEQ ID NO: 1739759 - RNA, 17 nt, Salmonella enterica enterica serovar Typhi Ty2
cgauauccgugccgccg

SEQ ID NO: 1739760 - RNA, 13 nt, Salmonella enterica enterica serovar Typhi Ty2
cgauaucgauaau

SEQ ID NO: 1739761 - RNA, 22 nt, Salmonella enterica enterica serovar Typhi Ty2
cgauaucgccuggugugaacau

SEQ ID NO: 1739762 - RNA, 19 nt, Salmonella enterica enterica serovar Typhi Ty2
cgauaguguaaacgcgcca

SEQ ID NO: 1739763 - RNA, 12 nt, Salmonella enterica enterica serovar Typhi Ty2
cgauagcgccgc

SEQ ID NO: 1739764 - RNA, 22 nt, Salmonella enterica enterica serovar Typhi Ty2
cgauaauuuuaccuucgcguuu

SEQ ID NO: 1739765 - RNA, 16 nt, Salmonella enterica enterica serovar Typhi Ty2
cgauagcaucggucaa

SEQ ID NO: 1739766 - RNA, 22 nt, Salmonella enterica enterica serovar Typhi Ty2
cgaugcuggugaagacgcugca

SEQ ID NO: 1739767 - RNA, 16 nt, Salmonella enterica enterica serovar Typhi Ty2
cgauucgcaugaauuc

SEQ ID NO: 1739768 - RNA, 19 nt, Salmonella enterica enterica serovar Typhi Ty2
cgauucgagcgcagcgaga

SEQ ID NO: 1739769 - RNA, 16 nt, Salmonella enterica enterica serovar Typhi Ty2
cgauugcggaggccgg

SEQ ID NO: 1739770 - RNA, 18 nt, Salmonella enterica enterica serovar Typhi Ty2
cgauuguguguuaauggc

SEQ ID NO: 1739771 - RNA, 14 nt, Salmonella enterica enterica serovar Typhi Ty2
cgcaaaaccuucau

SEQ ID NO: 1739772 - RNA, 20 nt, Salmonella enterica enterica serovar Typhi Ty2
cgcaaacagagcgccggcaa

SEQ ID NO: 1739773 - RNA, 13 nt, Salmonella enterica enterica serovar Typhi Ty2
cgcaaacaguuca

SEQ ID NO: 1739774 - RNA, 22 nt, Salmonella enterica enterica serovar Typhi Ty2
cgcaaaccgcuuucaucauauc

SEQ ID NO: 1739775 - RNA, 11 nt, Salmonella enterica enterica serovar Typhi Ty2
cgcaaacugcc

SEQ ID NO: 1739776 - RNA, 15 nt, Salmonella enterica enterica serovar Typhi Ty2
cgcaacgucagcgau

SEQ ID NO: 1739777 - RNA, 20 nt, Salmonella enterica enterica serovar Typhi Ty2
cgcaacuucugcuggcggaa

SEQ ID NO: 1739778 - RNA, 16 nt, Salmonella enterica enterica serovar Typhi Ty2
cgcaauaacgccgaua

SEQ ID NO: 1739779 - RNA, 22 nt, Salmonella enterica enterica serovar Typhi Ty2
cgcaauaacugacucugccuca

SEQ ID NO: 1739780 - RNA, 20 nt, Salmonella enterica enterica serovar Typhi Ty2
cgcaauacagcccgccagca

SEQ ID NO: 1739781 - RNA, 23 nt, Salmonella enterica enterica serovar Typhi Ty2
cgcaauacguuugguaccgcugg

SEQ ID NO: 1739782 - RNA, 16 nt, Salmonella enterica enterica serovar Typhi Ty2
cgcaauagaguaauga

SEQ ID NO: 1739783 - RNA, 12 nt, Salmonella enterica enterica serovar Typhi Ty2
cgcaauccgcgc

SEQ ID NO: 1739784 - RNA, 18 nt, Salmonella enterica enterica serovar Typhi Ty2
cgcaaucugcucgacgcg

SEQ ID NO: 1739785 - RNA, 15 nt, Salmonella enterica enterica serovar Typhi Ty2
cgcacaccagcgcau

SEQ ID NO: 1739786 - RNA, 12 nt, Salmonella enterica enterica serovar Typhi Ty2
cgcacaaacgcu

SEQ ID NO: 1739787 - RNA, 19 nt, Salmonella enterica enterica serovar Typhi Ty2
cgcaaugccugaccaacgu

SEQ ID NO: 1739788 - RNA, 17 nt, Salmonella enterica enterica serovar Typhi Ty2
cgcaaugcugacgacau

SEQ ID NO: 1739789 - RNA, 17 nt, Salmonella enterica enterica serovar Typhi Ty2
cgcaaucuggcggacaa

SEQ ID NO: 1739790 - RNA, 17 nt, Salmonella enterica enterica serovar Typhi Ty2
cgcaaucuuugccgcaa

SEQ ID NO: 1739791 - RNA, 15 nt, Salmonella enterica enterica serovar Typhi Ty2
cgcacauaaucaccg

SEQ ID NO: 1739792 - RNA, 23 nt, Salmonella enterica enterica serovar Typhi Ty2
cgcacauguuaaauacgccgcca

SEQ ID NO: 1739793 - RNA, 17 nt, Salmonella enterica enterica serovar Typhi Ty2
cgcagccgcaaucagcg

SEQ ID NO: 1739794 - RNA, 13 nt, Salmonella enterica enterica serovar Typhi Ty2
cgcagcauaucgc

SEQ ID NO: 1739795 - RNA, 21 nt, Salmonella enterica enterica serovar Typhi Ty2
cgcagauaucuuccagcgcgu

SEQ ID NO: 1739796 - RNA, 18 nt, Salmonella enterica enterica serovar Typhi Ty2
cgcagaucguauccagcg

SEQ ID NO: 1739797 - RNA, 19 nt, Salmonella enterica enterica serovar Typhi Ty2
cgcagacaauuuucuucau

SEQ ID NO: 1739798 - RNA, 15 nt, Salmonella enterica enterica serovar Typhi Ty2
cgcagaaucagcgug

SEQ ID NO: 1739799 - RNA, 14 nt, Salmonella enterica enterica serovar Typhi Ty2
cgcagcugguugau

SEQ ID NO: 1739800 - RNA, 13 nt, Salmonella enterica enterica serovar Typhi Ty2
cgcaggcgauagc

SEQ ID NO: 1739801 - RNA, 23 nt, Salmonella enterica enterica serovar Typhi Ty2
cgcaguccaacaaggauauccgc

SEQ ID NO: 1739802 - RNA, 17 nt, Salmonella enterica enterica serovar Typhi Ty2
cgcagucaaaacgacau

SEQ ID NO: 1739803 - RNA, 15 nt, Salmonella enterica enterica serovar Typhi Ty2
cgcaguuaugcgcau

SEQ ID NO: 1739804 - RNA, 17 nt, Salmonella enterica enterica serovar Typhi Ty2
cgcagugaccagcauca

SEQ ID NO: 1739805 - RNA, 14 nt, Salmonella enterica enterica serovar Typhi Ty2
cgcaguacggcgca

SEQ ID NO: 1739806 - RNA, 14 nt, Salmonella enterica enterica serovar Typhi Ty2
cgcauaucccacug

SEQ ID NO: 1739807 - RNA, 20 nt, Salmonella enterica enterica serovar Typhi Ty2
cgcaucaaugcccagcgcaa

SEQ ID NO: 1739808 - RNA, 22 nt, Salmonella enterica enterica serovar Typhi Ty2
cgcauacgccccgguggcggua

SEQ ID NO: 1739809 - RNA, 14 nt, Salmonella enterica enterica serovar Typhi Ty2
cgcauaccagccau

SEQ ID NO: 1739810 - RNA, 15 nt, Salmonella enterica enterica serovar Typhi Ty2
cgcauacuaccgcug

SEQ ID NO: 1739811 - RNA, 13 nt, Salmonella enterica enterica serovar Typhi Ty2
cgcauagcggcca

SEQ ID NO: 1739812 - RNA, 13 nt, Salmonella enterica enterica serovar Typhi Ty2
cgcauagcugccc

SEQ ID NO: 1739813 - RNA, 14 nt, Salmonella enterica enterica serovar Typhi Ty2
cgcaguuuacgcag

SEQ ID NO: 1739814 - RNA, 16 nt, Salmonella enterica enterica serovar Typhi Ty2
cgcaguuuacgcagcg

SEQ ID NO: 1739815 - RNA, 18 nt, Salmonella enterica enterica serovar Typhi Ty2
cgcauaccgaacagaaaa

SEQ ID NO: 1739816 - RNA, 13 nt, Salmonella enterica enterica serovar Typhi Ty2
cgcauaccagcca

SEQ ID NO: 1739817 - RNA, 18 nt, Salmonella enterica enterica serovar Typhi Ty2
cgcauaaugagcgcuuga

SEQ ID NO: 1739818 - RNA, 22 nt, Salmonella enterica enterica serovar Typhi Ty2
cgcaucacgcgaagcggcguca

SEQ ID NO: 1739819 - RNA, 18 nt, Salmonella enterica enterica serovar Typhi Ty2
cgcaucagaccuccgcca

SEQ ID NO: 1739820 - RNA, 14 nt, Salmonella enterica enterica serovar Typhi Ty2
cgcauccagggagu

SEQ ID NO: 1739821 - RNA, 23 nt, Salmonella enterica enterica serovar Typhi Ty2
cgccaaccucccaaccaguauga

SEQ ID NO: 1739822 - RNA, 12 nt, Salmonella enterica enterica serovar Typhi Ty2
cgccaacgccaa

SEQ ID NO: 1739823 - RNA, 17 nt, Salmonella enterica enterica serovar Typhi Ty2
cgccaacgccagcagcg

SEQ ID NO: 1739824 - RNA, 18 nt, Salmonella enterica enterica serovar Typhi Ty2
cgccaaaguuaaucagcg

SEQ ID NO: 1739825 - RNA, 23 nt, Salmonella enterica enterica serovar Typhi Ty2
cgccaaagcaaucgccagcgccu

SEQ ID NO: 1739826 - RNA, 17 nt, Salmonella enterica enterica serovar Typhi Ty2
cgccaaaguuaaucagc

SEQ ID NO: 1739827 - RNA, 17 nt, Salmonella enterica enterica serovar Typhi Ty2
cgcauucucgccgugac

SEQ ID NO: 1739828 - RNA, 21 nt, Salmonella enterica enterica serovar Typhi Ty2
cgccaaacgggcaagccagca

SEQ ID NO: 1739829 - RNA, 12 nt, Salmonella enterica enterica serovar Typhi Ty2
cgccaaacccga

SEQ ID NO: 1739830 - RNA, 15 nt, Salmonella enterica enterica serovar Typhi Ty2
cgccaaaccagaccc

SEQ ID NO: 1739831 - RNA, 12 nt, Salmonella enterica enterica serovar Typhi Ty2
cgccagccggaa

SEQ ID NO: 1739832 - RNA, 15 nt, Salmonella enterica enterica serovar Typhi Ty2
cgccagccagcgcca

SEQ ID NO: 1739833 - RNA, 18 nt, Salmonella enterica enterica serovar Typhi Ty2
cgccagccacugggugau

SEQ ID NO: 1739834 - RNA, 20 nt, Salmonella enterica enterica serovar Typhi Ty2
cgccagcaucggcagcgcca

SEQ ID NO: 1739835 - RNA, 20 nt, Salmonella enterica enterica serovar Typhi Ty2
cgccaggccagauggcuuua

SEQ ID NO: 1739836 - RNA, 15 nt, Salmonella enterica enterica serovar Typhi Ty2
cgccaggccagaugg

SEQ ID NO: 1739837 - RNA, 18 nt, Salmonella enterica enterica serovar Typhi Ty2
cgccagcgucucagcagg

SEQ ID NO: 1739838 - RNA, 15 nt, Salmonella enterica enterica serovar Typhi Ty2
cgccagcuacgacaa

SEQ ID NO: 1739839 - RNA, 15 nt, Salmonella enterica enterica serovar Typhi Ty2
cgccagcucaacgcc

SEQ ID NO: 1739840 - RNA, 16 nt, Salmonella enterica enterica serovar Typhi Ty2
cgccagccuaucgcca

SEQ ID NO: 1739841 - RNA, 16 nt, Salmonella enterica enterica serovar Typhi Ty2
cgccagacucagccag

SEQ ID NO: 1739842 - RNA, 22 nt, Salmonella enterica enterica serovar Typhi Ty2
cgccagaggcgugcaugggcag

SEQ ID NO: 1739843 - RNA, 15 nt, Salmonella enterica enterica serovar Typhi Ty2
cgccagaggcgugca

SEQ ID NO: 1739844 - RNA, 14 nt, Salmonella enterica enterica serovar Typhi Ty2
cgccagacgcgcau

SEQ ID NO: 1739845 - RNA, 18 nt, Salmonella enterica enterica serovar Typhi Ty2
cgccagcaacagguaccc

SEQ ID NO: 1739846 - RNA, 16 nt, Salmonella enterica enterica serovar Typhi Ty2
cgccagaauagcgcag

SEQ ID NO: 1739847 - RNA, 14 nt, Salmonella enterica enterica serovar Typhi Ty2
cgccacgucggaua

SEQ ID NO: 1739848 - RNA, 22 nt, Salmonella enterica enterica serovar Typhi Ty2
cgccaaucggcgucuugccgca

SEQ ID NO: 1739849 - RNA, 23 nt, Salmonella enterica enterica serovar Typhi Ty2
cgccaaucggcgucuugccgcaa

SEQ ID NO: 1739850 - RNA, 19 nt, Salmonella enterica enterica serovar Typhi Ty2
cgccaccucgcgacgguga

SEQ ID NO: 1739851 - RNA, 12 nt, Salmonella enterica enterica serovar Typhi Ty2
cgccaaucggcg

SEQ ID NO: 1739852 - RNA, 18 nt, Salmonella enterica enterica serovar Typhi Ty2
cgccaaucaccgccagca

SEQ ID NO: 1739853 - RNA, 18 nt, Salmonella enterica enterica serovar Typhi Ty2
cgccaauaauauugaacg

SEQ ID NO: 1739854 - RNA, 17 nt, Salmonella enterica enterica serovar Typhi Ty2
cgccaauaaugccgccg

SEQ ID NO: 1739855 - RNA, 12 nt, Salmonella enterica enterica serovar Typhi Ty2
cgccaaucagca

SEQ ID NO: 1739856 - RNA, 18 nt, Salmonella enterica enterica serovar Typhi Ty2
cgccaaucaacgccgcca

SEQ ID NO: 1739857 - RNA, 18 nt, Salmonella enterica enterica serovar Typhi Ty2
cgccaccuuaaucgacuu

SEQ ID NO: 1739858 - RNA, 16 nt, Salmonella enterica enterica serovar Typhi Ty2
cgccacgccuaaacug

SEQ ID NO: 1739859 - RNA, 21 nt, Salmonella enterica enterica serovar Typhi Ty2
cgccacgcuccuucuucgccg

SEQ ID NO: 1739860 - RNA, 15 nt, Salmonella enterica enterica serovar Typhi Ty2
cgccagucaggcgau

SEQ ID NO: 1739861 - RNA, 18 nt, Salmonella enterica enterica serovar Typhi Ty2
cgccagucaucgccgcua

SEQ ID NO: 1739862 - RNA, 19 nt, Salmonella enterica enterica serovar Typhi Ty2
cgccaggucucauagcgcc

SEQ ID NO: 1739863 - RNA, 20 nt, Salmonella enterica enterica serovar Typhi Ty2
cgccaguucccacagcuuca

SEQ ID NO: 1739864 - RNA, 20 nt, Salmonella enterica enterica serovar Typhi Ty2
cgccagugacgccaguuccc

SEQ ID NO: 1739865 - RNA, 13 nt, Salmonella enterica enterica serovar Typhi Ty2
cgccauccggcau

SEQ ID NO: 1739866 - RNA, 17 nt, Salmonella enterica enterica serovar Typhi Ty2
cgccauccggcauuacc

SEQ ID NO: 1739867 - RNA, 17 nt, Salmonella enterica enterica serovar Typhi Ty2
cgccauccggcaaugau

SEQ ID NO: 1739868 - RNA, 14 nt, Salmonella enterica enterica serovar Typhi Ty2
cgccauccggcgag

SEQ ID NO: 1739869 - RNA, 13 nt, Salmonella enterica enterica serovar Typhi Ty2
cgccauccggcga

SEQ ID NO: 1739870 - RNA, 15 nt, Salmonella enterica enterica serovar Typhi Ty2
cgccauccggcauuu

SEQ ID NO: 1739871 - RNA, 15 nt, Salmonella enterica enterica serovar Typhi Ty2
cgccauccugccgca

SEQ ID NO: 1739872 - RNA, 17 nt, Salmonella enterica enterica serovar Typhi Ty2
cgccauccggcggugca

SEQ ID NO: 1739873 - RNA, 22 nt, Salmonella enterica enterica serovar Typhi Ty2
cgccaucgcccggccuccggug

SEQ ID NO: 1739874 - RNA, 17 nt, Salmonella enterica enterica serovar Typhi Ty2
cgccaucuuccucacag

SEQ ID NO: 1739875 - RNA, 13 nt, Salmonella enterica enterica serovar Typhi Ty2
cgccaucggcuuu

SEQ ID NO: 1739876 - RNA, 20 nt, Salmonella enterica enterica serovar Typhi Ty2
cgccaucggcgcguaaguuu

SEQ ID NO: 1739877 - RNA, 16 nt, Salmonella enterica enterica serovar Typhi Ty2
cgccaucgcggcgcaa

SEQ ID NO: 1739878 - RNA, 20 nt, Salmonella enterica enterica serovar Typhi Ty2
cgccaguuugcgauccagua

SEQ ID NO: 1739879 - RNA, 14 nt, Salmonella enterica enterica serovar Typhi Ty2
cgccauaacgccgg

SEQ ID NO: 1739880 - RNA, 15 nt, Salmonella enterica enterica serovar Typhi Ty2
cgccauagcaucgac

SEQ ID NO: 1739881 - RNA, 21 nt, Salmonella enterica enterica serovar Typhi Ty2
cgccauaauacuuaauucaua

SEQ ID NO: 1739882 - RNA, 17 nt, Salmonella enterica enterica serovar Typhi Ty2
cgccauccaccaggcau

SEQ ID NO: 1739883 - RNA, 15 nt, Salmonella enterica enterica serovar Typhi Ty2
cgccaucaggcacgg

SEQ ID NO: 1739884 - RNA, 15 nt, Salmonella enterica enterica serovar Typhi Ty2
cgccaucaggcaugg

SEQ ID NO: 1739885 - RNA, 21 nt, Salmonella enterica enterica serovar Typhi Ty2
cgccaucaggcauguugcgca

SEQ ID NO: 1739886 - RNA, 16 nt, Salmonella enterica enterica serovar Typhi Ty2
cgccauaucgccgcca

SEQ ID NO: 1739887 - RNA, 22 nt, Salmonella enterica enterica serovar Typhi Ty2
cgccaucaacuccuccggcgag

SEQ ID NO: 1739888 - RNA, 17 nt, Salmonella enterica enterica serovar Typhi Ty2
cgccaucacguccugau

SEQ ID NO: 1739889 - RNA, 22 nt, Salmonella enterica enterica serovar Typhi Ty2
cgacgauugaccggggcgcaau

SEQ ID NO: 1739890 - RNA, 17 nt, Salmonella enterica enterica serovar Typhi Ty2
cgacgcagacaauaaac

SEQ ID NO: 1739891 - RNA, 17 nt, Salmonella enterica enterica serovar Typhi Ty2
cgacgcacuccagaugc

SEQ ID NO: 1739892 - RNA, 16 nt, Salmonella enterica enterica serovar Typhi Ty2
cgacgccaaucggcgu

SEQ ID NO: 1739893 - RNA, 23 nt, Salmonella enterica enterica serovar Typhi Ty2
cgacgccaaucggcgucuugccg

SEQ ID NO: 1739894 - RNA, 19 nt, Salmonella enterica enterica serovar Typhi Ty2
cgaccucuucguucauccg

SEQ ID NO: 1739895 - RNA, 19 nt, Salmonella enterica enterica serovar Typhi Ty2
cgaccaugguuucgaacgc

SEQ ID NO: 1739896 - RNA, 15 nt, Salmonella enterica enterica serovar Typhi Ty2
cgacgcgcggcguca

SEQ ID NO: 1739897 - RNA, 21 nt, Salmonella enterica enterica serovar Typhi Ty2
cgacggccucuucacgcagcg

SEQ ID NO: 1739898 - RNA, 17 nt, Salmonella enterica enterica serovar Typhi Ty2
cgacggcguauucggca

SEQ ID NO: 1739899 - RNA, 12 nt, Salmonella enterica enterica serovar Typhi Ty2
cgacgucaacgg

SEQ ID NO: 1739900 - RNA, 20 nt, Salmonella enterica enterica serovar Typhi Ty2
cgacguuaucgccgacaaac

SEQ ID NO: 1739901 - RNA, 14 nt, Salmonella enterica enterica serovar Typhi Ty2
cgacguucaugccg

SEQ ID NO: 1739902 - RNA, 15 nt, Salmonella enterica enterica serovar Typhi Ty2
cgacgugucgcguaa

SEQ ID NO: 1739903 - RNA, 17 nt, Salmonella enterica enterica serovar Typhi Ty2
cgagcuuuucgccggaa

SEQ ID NO: 1739904 - RNA, 21 nt, Salmonella enterica enterica serovar Typhi Ty2
cgaggaaaaaugagacgccga

SEQ ID NO: 1739905 - RNA, 16 nt, Salmonella enterica enterica serovar Typhi Ty2
cgaggaacaucagcca

SEQ ID NO: 1739906 - RNA, 18 nt, Salmonella enterica enterica serovar Typhi Ty2
cgaggaagcugcgcagca

SEQ ID NO: 1739907 - RNA, 18 nt, Salmonella enterica enterica serovar Typhi Ty2
cgaggcgaaacggcggaa

SEQ ID NO: 1739908 - RNA, 19 nt, Salmonella enterica enterica serovar Typhi Ty2
cgagcuauguuuaagccag

SEQ ID NO: 1739909 - RNA, 18 nt, Salmonella enterica enterica serovar Typhi Ty2
cgagcuauguuuaagcca

SEQ ID NO: 1739910 - RNA, 14 nt, Salmonella enterica enterica serovar Typhi Ty2
cgagcuguaccguc

SEQ ID NO: 1739911 - RNA, 18 nt, Salmonella enterica enterica serovar Typhi Ty2
cgagccgucgccggccug

SEQ ID NO: 1739912 - RNA, 18 nt, Salmonella enterica enterica serovar Typhi Ty2
cgagcauuuccgcagcca

SEQ ID NO: 1739913 - RNA, 13 nt, Salmonella enterica enterica serovar Typhi Ty2
cgagacgguguuu

SEQ ID NO: 1739914 - RNA, 17 nt, Salmonella enterica enterica serovar Typhi Ty2
cgaagaggaugaaaagu

SEQ ID NO: 1739915 - RNA, 19 nt, Salmonella enterica enterica serovar Typhi Ty2
cgaagagcauaugcgcugc

SEQ ID NO: 1739916 - RNA, 19 nt, Salmonella enterica enterica serovar Typhi Ty2
cgaagauccgcucacgcca

SEQ ID NO: 1739917 - RNA, 18 nt, Salmonella enterica enterica serovar Typhi Ty2
cgaacauuacauccucaa

SEQ ID NO: 1739918 - RNA, 17 nt, Salmonella enterica enterica serovar Typhi Ty2
cgaacauuucagcgcca

SEQ ID NO: 1739919 - RNA, 21 nt, Salmonella enterica enterica serovar Typhi Ty2
cgaaccaccguuuaaucgccc

SEQ ID NO: 1739920 - RNA, 11 nt, Salmonella enterica enterica serovar Typhi Ty2
cgaacagcgca

SEQ ID NO: 1739921 - RNA, 12 nt, Salmonella enterica enterica serovar Typhi Ty2
cgaaagccggua

SEQ ID NO: 1739922 - RNA, 19 nt, Salmonella enterica enterica serovar Typhi Ty2
cgaaacuccagcgauaaac

SEQ ID NO: 1739923 - RNA, 17 nt, Salmonella enterica enterica serovar Typhi Ty2
ccuucuuccauucccac

SEQ ID NO: 1739924 - RNA, 17 nt, Salmonella enterica enterica serovar Typhi Ty2
ccuucucuuuaugcguc

SEQ ID NO: 1739925 - RNA, 17 nt, Salmonella enterica enterica serovar Typhi Ty2
ccuucugcuaucaggau

SEQ ID NO: 1739926 - RNA, 18 nt, Salmonella enterica enterica serovar Typhi Ty2
ccugucuccucagcaggc

SEQ ID NO: 1739927 - RNA, 23 nt, Salmonella enterica enterica serovar Typhi Ty2
ccuggaugcgcugaauagcgcug

SEQ ID NO: 1739928 - RNA, 14 nt, Salmonella enterica enterica serovar Typhi Ty2
ccuuaucaggccug

SEQ ID NO: 1739929 - RNA, 20 nt, Salmonella enterica enterica serovar Typhi Ty2
ccuuacgaauuuuaucuucc

SEQ ID NO: 1739930 - RNA, 17 nt, Salmonella enterica enterica serovar Typhi Ty2
ccuuauccggcguguaa

SEQ ID NO: 1739931 - RNA, 16 nt, Salmonella enterica enterica serovar Typhi Ty2
ccuuauccggcgugua

SEQ ID NO: 1739932 - RNA, 20 nt, Salmonella enterica enterica serovar Typhi Ty2
ccuuaugggucacauccaga

SEQ ID NO: 1739933 - RNA, 21 nt, Salmonella enterica enterica serovar Typhi Ty2
ccuuauccggccugcaggcaa

SEQ ID NO: 1739934 - RNA, 15 nt, Salmonella enterica enterica serovar Typhi Ty2
ccuuaaugucaucau

SEQ ID NO: 1739935 - RNA, 22 nt, Salmonella enterica enterica serovar Typhi Ty2
ccuuaugggucacauccagaca

SEQ ID NO: 1739936 - RNA, 12 nt, Salmonella enterica enterica serovar Typhi Ty2
ccuucaaucagc

SEQ ID NO: 1739937 - RNA, 20 nt, Salmonella enterica enterica serovar Typhi Ty2
ccuucaaucgguacgccaag

SEQ ID NO: 1739938 - RNA, 13 nt, Salmonella enterica enterica serovar Typhi Ty2
ccuuccaucgcau

SEQ ID NO: 1739939 - RNA, 21 nt, Salmonella enterica enterica serovar Typhi Ty2
ccuucgacgagguuuccggcg

SEQ ID NO: 1739940 - RNA, 18 nt, Salmonella enterica enterica serovar Typhi Ty2
ccuucguuauaaggccug

SEQ ID NO: 1739941 - RNA, 22 nt, Salmonella enterica enterica serovar Typhi Ty2
ccuucuaauuccaggaugacca

SEQ ID NO: 1739942 - RNA, 14 nt, Salmonella enterica enterica serovar Typhi Ty2
cgacaccagcgucg

SEQ ID NO: 1739943 - RNA, 16 nt, Salmonella enterica enterica serovar Typhi Ty2
cgaaugcgccagcgag

SEQ ID NO: 1739944 - RNA, 19 nt, Salmonella enterica enterica serovar Typhi Ty2
cgaagaucguuauccagca

SEQ ID NO: 1739945 - RNA, 16 nt, Salmonella enterica enterica serovar Typhi Ty2
cgaaguucucaaugaa

SEQ ID NO: 1739946 - RNA, 23 nt, Salmonella enterica enterica serovar Typhi Ty2
cgaauccgccauagccggcgaua

SEQ ID NO: 1739947 - RNA, 22 nt, Salmonella enterica enterica serovar Typhi Ty2
cgaaucgacaauccgccacgcu

SEQ ID NO: 1739948 - RNA, 19 nt, Salmonella enterica enterica serovar Typhi Ty2
cgaauccguugaucgucca

SEQ ID NO: 1739949 - RNA, 15 nt, Salmonella enterica enterica serovar Typhi Ty2
cgaaucuaccagauc

SEQ ID NO: 1739950 - RNA, 12 nt, Salmonella enterica enterica serovar Typhi Ty2
cgaccaggaauu

SEQ ID NO: 1739951 - RNA, 18 nt, Salmonella enterica enterica serovar Typhi Ty2
cgaccaugguucccgcca

SEQ ID NO: 1739952 - RNA, 16 nt, Salmonella enterica enterica serovar Typhi Ty2
cgaccaucgccgcgaa

SEQ ID NO: 1739953 - RNA, 14 nt, Salmonella enterica enterica serovar Typhi Ty2
cgaccagugaacgu

SEQ ID NO: 1739954 - RNA, 21 nt, Salmonella enterica enterica serovar Typhi Ty2
cgacaugguuaaccaccagcg

SEQ ID NO: 1739955 - RNA, 20 nt, Salmonella enterica enterica serovar Typhi Ty2
cgacauguucgaacaugccg

SEQ ID NO: 1739956 - RNA, 19 nt, Salmonella enterica enterica serovar Typhi Ty2
cgacauggcgguaaucgcg

SEQ ID NO: 1739957 - RNA, 23 nt, Salmonella enterica enterica serovar Typhi Ty2
cuuuucuuuaaacaacgccauaa

SEQ ID NO: 1739958 - RNA, 22 nt, Salmonella enterica enterica serovar Typhi Ty2
cuuuucaucaccaucugaccgu

SEQ ID NO: 1739959 - RNA, 14 nt, Salmonella enterica enterica serovar Typhi Ty2
cuuuuccggcaccu

SEQ ID NO: 1739960 - RNA, 16 nt, Salmonella enterica enterica serovar Typhi Ty2
cuuuuaguuacgcacg

SEQ ID NO: 1739961 - RNA, 16 nt, Salmonella enterica enterica serovar Typhi Ty2
cuuuuaccgcgucgcu

SEQ ID NO: 1739962 - RNA, 20 nt, Salmonella enterica enterica serovar Typhi Ty2
cuuuauuuuuaauugcugaa

SEQ ID NO: 1739963 - RNA, 22 nt, Salmonella enterica enterica serovar Typhi Ty2
cuuuauugaaaagcagccagac

SEQ ID NO: 1739964 - RNA, 15 nt, Salmonella enterica enterica serovar Typhi Ty2
cuuuaugucaguaau

SEQ ID NO: 1739965 - RNA, 18 nt, Salmonella enterica enterica serovar Typhi Ty2
cuuuauccggucugcgcg

SEQ ID NO: 1739966 - RNA, 17 nt, Salmonella enterica enterica serovar Typhi Ty2
cuuuuuccuccugcgga

SEQ ID NO: 1739967 - RNA, 13 nt, Salmonella enterica enterica serovar Typhi Ty2
cuuuuugagcggc

SEQ ID NO: 1739968 - RNA, 20 nt, Salmonella enterica enterica serovar Typhi Ty2
cuuuuugcagauccuuaacg

SEQ ID NO: 1739969 - RNA, 13 nt, Salmonella enterica enterica serovar Typhi Ty2
gaaaaccgaugcc

SEQ ID NO: 1739970 - RNA, 16 nt, Salmonella enterica enterica serovar Typhi Ty2
gaaaacuccagcagac

SEQ ID NO: 1739971 - RNA, 23 nt, Salmonella enterica enterica serovar Typhi Ty2
gaaaaugcccgacgcgccgccag

SEQ ID NO: 1739972 - RNA, 19 nt, Salmonella enterica enterica serovar Typhi Ty2
gaaaauuauuuucacgcuc

SEQ ID NO: 1739973 - RNA, 18 nt, Salmonella enterica enterica serovar Typhi Ty2
gaaagaaaacuuuccaac

SEQ ID NO: 1739974 - RNA, 15 nt, Salmonella enterica enterica serovar Typhi Ty2
gaaagaagaaaccau

SEQ ID NO: 1739975 - RNA, 17 nt, Salmonella enterica enterica serovar Typhi Ty2
gaaacaauagcugugag

SEQ ID NO: 1739976 - RNA, 17 nt, Salmonella enterica enterica serovar Typhi Ty2
gaaauagccccgucaug

SEQ ID NO: 1739977 - RNA, 20 nt, Salmonella enterica enterica serovar Typhi Ty2
gaaauagcggaacugcguuu

SEQ ID NO: 1739978 - RNA, 22 nt, Salmonella enterica enterica serovar Typhi Ty2
gaaauaaucaggugaauaccaa

SEQ ID NO: 1739979 - RNA, 16 nt, Salmonella enterica enterica serovar Typhi Ty2
gaaaucaucaaucgcu

SEQ ID NO: 1739980 - RNA, 14 nt, Salmonella enterica enterica serovar Typhi Ty2
gaaaguuucaggau

SEQ ID NO: 1739981 - RNA, 14 nt, Salmonella enterica enterica serovar Typhi Ty2
gaaagucuguucgu

SEQ ID NO: 1739982 - RNA, 19 nt, Salmonella enterica enterica serovar Typhi Ty2
gaaaggcgcaacgucgcca

SEQ ID NO: 1739983 - RNA, 17 nt, Salmonella enterica enterica serovar Typhi Ty2
cuugcgcaucgcaucag

SEQ ID NO: 1739984 - RNA, 15 nt, Salmonella enterica enterica serovar Typhi Ty2
cuugcugcugcugau

SEQ ID NO: 1739985 - RNA, 18 nt, Salmonella enterica enterica serovar Typhi Ty2
cuugcuuuagcuugugau

SEQ ID NO: 1739986 - RNA, 14 nt, Salmonella enterica enterica serovar Typhi Ty2
cuucgucagcgcau

SEQ ID NO: 1739987 - RNA, 15 nt, Salmonella enterica enterica serovar Typhi Ty2
cuucguuauaaggcc

SEQ ID NO: 1739988 - RNA, 20 nt, Salmonella enterica enterica serovar Typhi Ty2
cuucguuauuuuccugaaaa

SEQ ID NO: 1739989 - RNA, 20 nt, Salmonella enterica enterica serovar Typhi Ty2
cuucuaccacgcugccgccg

SEQ ID NO: 1739990 - RNA, 18 nt, Salmonella enterica enterica serovar Typhi Ty2
cuugcgaccacuccggca

SEQ ID NO: 1739991 - RNA, 22 nt, Salmonella enterica enterica serovar Typhi Ty2
cuuuaagaugccggagcgaugu

SEQ ID NO: 1739992 - RNA, 17 nt, Salmonella enterica enterica serovar Typhi Ty2
cuuuaacgcugcaaagu

SEQ ID NO: 1739993 - RNA, 13 nt, Salmonella enterica enterica serovar Typhi Ty2
cuuuaacgcuggc

SEQ ID NO: 1739994 - RNA, 22 nt, Salmonella enterica enterica serovar Typhi Ty2
cuuuaaacgccagccugugauc

SEQ ID NO: 1739995 - RNA, 14 nt, Salmonella enterica enterica serovar Typhi Ty2
cuuuaaucaccaug

SEQ ID NO: 1739996 - RNA, 14 nt, Salmonella enterica enterica serovar Typhi Ty2
cuuuagugccgcca

SEQ ID NO: 1739997 - RNA, 15 nt, Salmonella enterica enterica serovar Typhi Ty2
gaaaugguugcguuu

SEQ ID NO: 1739998 - RNA, 19 nt, Salmonella enterica enterica serovar Typhi Ty2
gaaaugcguggcauuaaca

SEQ ID NO: 1739999 - RNA, 17 nt, Salmonella enterica enterica serovar Typhi Ty2
gaaauggguaucuucau

SEQ ID NO: 1740000 - RNA, 18 nt, Salmonella enterica enterica serovar Typhi Ty2
gaaauggguaucuucauc

SEQ ID NO: 1740001 - RNA, 20 nt, Salmonella enterica enterica serovar Typhi Ty2
gaaauuauuccuuaucacau

SEQ ID NO: 1740002 - RNA, 14 nt, Salmonella enterica enterica serovar Typhi Ty2
gaaauucucagaaa

SEQ ID NO: 1740003 - RNA, 17 nt, Salmonella enterica enterica serovar Typhi Ty2
gaaaucugaaugguucc

SEQ ID NO: 1740004 - RNA, 22 nt, Salmonella enterica enterica serovar Typhi Ty2
gaaaucgccgggcuauccggcu

SEQ ID NO: 1740005 - RNA, 15 nt, Salmonella enterica enterica serovar Typhi Ty2
gaaaucgcggcgaug

SEQ ID NO: 1740006 - RNA, 15 nt, Salmonella enterica enterica serovar Typhi Ty2
gaaaucaucaaucgc

SEQ ID NO: 1740007 - RNA, 20 nt, Salmonella enterica enterica serovar Typhi Ty2
gaacaaacagaccgccaugc

SEQ ID NO: 1740008 - RNA, 13 nt, Salmonella enterica enterica serovar Typhi Ty2
gaacaaucaguau

SEQ ID NO: 1740009 - RNA, 15 nt, Salmonella enterica enterica serovar Typhi Ty2
gaacaguuucgccag

SEQ ID NO: 1740010 - RNA, 15 nt, Salmonella enterica enterica serovar Typhi Ty2
gaacaucaagcggua

SEQ ID NO: 1740011 - RNA, 19 nt, Salmonella enterica enterica serovar Typhi Ty2
gaacaucgguuuguucaua

SEQ ID NO: 1740012 - RNA, 13 nt, Salmonella enterica enterica serovar Typhi Ty2
gaacaucagccag

SEQ ID NO: 1740013 - RNA, 17 nt, Salmonella enterica enterica serovar Typhi Ty2
gaacauccuugcacgcc

SEQ ID NO: 1740014 - RNA, 14 nt, Salmonella enterica enterica serovar Typhi Ty2
gaacaugacggcag

SEQ ID NO: 1740015 - RNA, 16 nt, Salmonella enterica enterica serovar Typhi Ty2
gaacagcgucauccag

SEQ ID NO: 1740016 - RNA, 14 nt, Salmonella enterica enterica serovar Typhi Ty2
gaacccaucaggga

SEQ ID NO: 1740017 - RNA, 18 nt, Salmonella enterica enterica serovar Typhi Ty2
gaaccacgcaaaggcguu

SEQ ID NO: 1740018 - RNA, 15 nt, Salmonella enterica enterica serovar Typhi Ty2
gaaccagcggcacca

SEQ ID NO: 1740019 - RNA, 14 nt, Salmonella enterica enterica serovar Typhi Ty2
gaaccgucaucagc

SEQ ID NO: 1740020 - RNA, 19 nt, Salmonella enterica enterica serovar Typhi Ty2
gaaccguaaacgccugcac

SEQ ID NO: 1740021 - RNA, 23 nt, Salmonella enterica enterica serovar Typhi Ty2
gaaccgacggugcucaugacauc

SEQ ID NO: 1740022 - RNA, 17 nt, Salmonella enterica enterica serovar Typhi Ty2
gaaccgaauaacgccag

SEQ ID NO: 1740023 - RNA, 20 nt, Salmonella enterica enterica serovar Typhi Ty2
gaaccgcccaucaacaccag

SEQ ID NO: 1740024 - RNA, 17 nt, Salmonella enterica enterica serovar Typhi Ty2
gaaccgcuuuuccugcu

SEQ ID NO: 1740025 - RNA, 17 nt, Salmonella enterica enterica serovar Typhi Ty2
gaacgccuuauccggcc

SEQ ID NO: 1740026 - RNA, 16 nt, Salmonella enterica enterica serovar Typhi Ty2
gaacgccuuauccggc

SEQ ID NO: 1740027 - RNA, 17 nt, Salmonella enterica enterica serovar Typhi Ty2
gaacgccgcuagcggcg

SEQ ID NO: 1740028 - RNA, 13 nt, Salmonella enterica enterica serovar Typhi Ty2
gaaccuucacgcu

SEQ ID NO: 1740029 - RNA, 14 nt, Salmonella enterica enterica serovar Typhi Ty2
gaaccuggcgguaa

SEQ ID NO: 1740030 - RNA, 16 nt, Salmonella enterica enterica serovar Typhi Ty2
gaaccuguucaugcca

SEQ ID NO: 1740031 - RNA, 13 nt, Salmonella enterica enterica serovar Typhi Ty2
gaacgacgcugau

SEQ ID NO: 1740032 - RNA, 19 nt, Salmonella enterica enterica serovar Typhi Ty2
cugguggcgagauaagccg

SEQ ID NO: 1740033 - RNA, 17 nt, Salmonella enterica enterica serovar Typhi Ty2
cuggugcaggcggucga

SEQ ID NO: 1740034 - RNA, 20 nt, Salmonella enterica enterica serovar Typhi Ty2
cuggugagguuucagcaccu

SEQ ID NO: 1740035 - RNA, 14 nt, Salmonella enterica enterica serovar Typhi Ty2
cugguaagagagcc

SEQ ID NO: 1740036 - RNA, 14 nt, Salmonella enterica enterica serovar Typhi Ty2
cuggcuugccggca

SEQ ID NO: 1740037 - RNA, 14 nt, Salmonella enterica enterica serovar Typhi Ty2
cuggcuugccgggc

SEQ ID NO: 1740038 - RNA, 19 nt, Salmonella enterica enterica serovar Typhi Ty2
cugguaacggcacugcuuu

SEQ ID NO: 1740039 - RNA, 15 nt, Salmonella enterica enterica serovar Typhi Ty2
cugggcugauaggcc

SEQ ID NO: 1740040 - RNA, 19 nt, Salmonella enterica enterica serovar Typhi Ty2
cuggcgaucguucgauagu

SEQ ID NO: 1740041 - RNA, 13 nt, Salmonella enterica enterica serovar Typhi Ty2
cuggcgcagcgcu

SEQ ID NO: 1740042 - RNA, 15 nt, Salmonella enterica enterica serovar Typhi Ty2
cuggauaauaagacg

SEQ ID NO: 1740043 - RNA, 19 nt, Salmonella enterica enterica serovar Typhi Ty2
cuggauagcaccauaaacg

SEQ ID NO: 1740044 - RNA, 20 nt, Salmonella enterica enterica serovar Typhi Ty2
cuggagagcagcgccagcga

SEQ ID NO: 1740045 - RNA, 17 nt, Salmonella enterica enterica serovar Typhi Ty2
cuggagagcaacgccau

SEQ ID NO: 1740046 - RNA, 16 nt, Salmonella enterica enterica serovar Typhi Ty2
cuggaucugcgcauua

SEQ ID NO: 1740047 - RNA, 21 nt, Salmonella enterica enterica serovar Typhi Ty2
cuggcagguauuaauccugcg

SEQ ID NO: 1740048 - RNA, 20 nt, Salmonella enterica enterica serovar Typhi Ty2
cuggcagcgcugaaucgcaa

SEQ ID NO: 1740049 - RNA, 22 nt, Salmonella enterica enterica serovar Typhi Ty2
cuuccagcgcgucggccggcac

SEQ ID NO: 1740050 - RNA, 13 nt, Salmonella enterica enterica serovar Typhi Ty2
cuucaucagccag

SEQ ID NO: 1740051 - RNA, 21 nt, Salmonella enterica enterica serovar Typhi Ty2
cuucaugaguaaaugaacguu

SEQ ID NO: 1740052 - RNA, 13 nt, Salmonella enterica enterica serovar Typhi Ty2
cuucaugcgcuuu

SEQ ID NO: 1740053 - RNA, 13 nt, Salmonella enterica enterica serovar Typhi Ty2
cuucaggcuguug

SEQ ID NO: 1740054 - RNA, 21 nt, Salmonella enterica enterica serovar Typhi Ty2
cuucagccugugcaaccagcu

SEQ ID NO: 1740055 - RNA, 17 nt, Salmonella enterica enterica serovar Typhi Ty2
cuucagcgacaucguca

SEQ ID NO: 1740056 - RNA, 19 nt, Salmonella enterica enterica serovar Typhi Ty2
cuucaguaauuucgaugau

SEQ ID NO: 1740057 - RNA, 20 nt, Salmonella enterica enterica serovar Typhi Ty2
cuucauauuaaauuccggcu

SEQ ID NO: 1740058 - RNA, 22 nt, Salmonella enterica enterica serovar Typhi Ty2
cuucaccuucggugaaaucacg

SEQ ID NO: 1740059 - RNA, 19 nt, Salmonella enterica enterica serovar Typhi Ty2
cuucaccuugcugcgcagg

SEQ ID NO: 1740060 - RNA, 19 nt, Salmonella enterica enterica serovar Typhi Ty2
cuucaccggcgugcgcuua

SEQ ID NO: 1740061 - RNA, 15 nt, Salmonella enterica enterica serovar Typhi Ty2
cuuaucaaaccagcu

SEQ ID NO: 1740062 - RNA, 15 nt, Salmonella enterica enterica serovar Typhi Ty2
cuuaucaaguaacgu

SEQ ID NO: 1740063 - RNA, 23 nt, Salmonella enterica enterica serovar Typhi Ty2
cuucacccuucuucuggcucaga

SEQ ID NO: 1740064 - RNA, 22 nt, Salmonella enterica enterica serovar Typhi Ty2
cuucagcggcgcguugccgccg

SEQ ID NO: 1740065 - RNA, 18 nt, Salmonella enterica enterica serovar Typhi Ty2
cuucacuguuaucgccau

SEQ ID NO: 1740066 - RNA, 22 nt, Salmonella enterica enterica serovar Typhi Ty2
cuucggaaugacaaacgccacc

SEQ ID NO: 1740067 - RNA, 22 nt, Salmonella enterica enterica serovar Typhi Ty2
cuucggcgcgccgcuggcgaug

SEQ ID NO: 1740068 - RNA, 13 nt, Salmonella enterica enterica serovar Typhi Ty2
cuucgcaaccggu

SEQ ID NO: 1740069 - RNA, 16 nt, Salmonella enterica enterica serovar Typhi Ty2
cuucgccuucacgcau

SEQ ID NO: 1740070 - RNA, 23 nt, Salmonella enterica enterica serovar Typhi Ty2
cuuccugccgcgaucgcggcaac

SEQ ID NO: 1740071 - RNA, 17 nt, Salmonella enterica enterica serovar Typhi Ty2
cuuccugcauuaccggg

SEQ ID NO: 1740072 - RNA, 21 nt, Salmonella enterica enterica serovar Typhi Ty2
cuuccugcugcgccagcgcau

SEQ ID NO: 1740073 - RNA, 12 nt, Salmonella enterica enterica serovar Typhi Ty2
cuuccgucagcg

SEQ ID NO: 1740074 - RNA, 16 nt, Salmonella enterica enterica serovar Typhi Ty2
cuguaacacugccgaa

SEQ ID NO: 1740075 - RNA, 17 nt, Salmonella enterica enterica serovar Typhi Ty2
cuguaacuucacgccau

SEQ ID NO: 1740076 - RNA, 16 nt, Salmonella enterica enterica serovar Typhi Ty2
cuguaaccccugcgcg

SEQ ID NO: 1740077 - RNA, 21 nt, Salmonella enterica enterica serovar Typhi Ty2
cuguaccaccagaaucgccag

SEQ ID NO: 1740078 - RNA, 22 nt, Salmonella enterica enterica serovar Typhi Ty2
cuguaauggcgcucuuuuccag

SEQ ID NO: 1740079 - RNA, 14 nt, Salmonella enterica enterica serovar Typhi Ty2
cuggugucgccgug

SEQ ID NO: 1740080 - RNA, 19 nt, Salmonella enterica enterica serovar Typhi Ty2
cugguuaacgccgccauca

SEQ ID NO: 1740081 - RNA, 13 nt, Salmonella enterica enterica serovar Typhi Ty2
cugguugcagcgc

SEQ ID NO: 1740082 - RNA, 15 nt, Salmonella enterica enterica serovar Typhi Ty2
cuguagauugcgcgc

SEQ ID NO: 1740083 - RNA, 17 nt, Salmonella enterica enterica serovar Typhi Ty2
cuguaguaaucauacgc

SEQ ID NO: 1740084 - RNA, 14 nt, Salmonella enterica enterica serovar Typhi Ty2
cugucgaucgguga

SEQ ID NO: 1740085 - RNA, 15 nt, Salmonella enterica enterica serovar Typhi Ty2
cuguugauuacgcuc

SEQ ID NO: 1740086 - RNA, 14 nt, Salmonella enterica enterica serovar Typhi Ty2
cuuaaaugccgccg

SEQ ID NO: 1740087 - RNA, 21 nt, Salmonella enterica enterica serovar Typhi Ty2
cuuaaaacgauuuggucggcg

SEQ ID NO: 1740088 - RNA, 14 nt, Salmonella enterica enterica serovar Typhi Ty2
cuguuuugccuugc

SEQ ID NO: 1740089 - RNA, 19 nt, Salmonella enterica enterica serovar Typhi Ty2
cuuaacagaauugcgccac

SEQ ID NO: 1740090 - RNA, 22 nt, Salmonella enterica enterica serovar Typhi Ty2
cuuaacccugccguuugcgcca

SEQ ID NO: 1740091 - RNA, 17 nt, Salmonella enterica enterica serovar Typhi Ty2
cuuaguuuucguagggc

SEQ ID NO: 1740092 - RNA, 19 nt, Salmonella enterica enterica serovar Typhi Ty2
cuuagcuggccaaucagcg

SEQ ID NO: 1740093 - RNA, 16 nt, Salmonella enterica enterica serovar Typhi Ty2
cugugccgcuggugcu

SEQ ID NO: 1740094 - RNA, 23 nt, Salmonella enterica enterica serovar Typhi Ty2
cugugccgccgguguuuccguca

SEQ ID NO: 1740095 - RNA, 16 nt, Salmonella enterica enterica serovar Typhi Ty2
cuguucaucaaagaaa

SEQ ID NO: 1740096 - RNA, 12 nt, Salmonella enterica enterica serovar Typhi Ty2
gacuucaacgcc

SEQ ID NO: 1740097 - RNA, 22 nt, Salmonella enterica enterica serovar Typhi Ty2
gagaaaauuacgcccaucagcc

SEQ ID NO: 1740098 - RNA, 18 nt, Salmonella enterica enterica serovar Typhi Ty2
gagaaaacgcggccugga

SEQ ID NO: 1740099 - RNA, 22 nt, Salmonella enterica enterica serovar Typhi Ty2
gacuuuaaacuuauccgccauc

SEQ ID NO: 1740100 - RNA, 15 nt, Salmonella enterica enterica serovar Typhi Ty2
gacuggaacaggcca

SEQ ID NO: 1740101 - RNA, 13 nt, Salmonella enterica enterica serovar Typhi Ty2
gacugugauggcg

SEQ ID NO: 1740102 - RNA, 22 nt, Salmonella enterica enterica serovar Typhi Ty2
gacuguuucauuacucguccuu

SEQ ID NO: 1740103 - RNA, 22 nt, Salmonella enterica enterica serovar Typhi Ty2
gacugguggcgagauaagccgu

SEQ ID NO: 1740104 - RNA, 10 nt, Salmonella enterica enterica serovar Typhi Ty2
gacuccguca

SEQ ID NO: 1740105 - RNA, 12 nt, Salmonella enterica enterica serovar Typhi Ty2
gacucagccagg

SEQ ID NO: 1740106 - RNA, 15 nt, Salmonella enterica enterica serovar Typhi Ty2
gacucagcagcgcau

SEQ ID NO: 1740107 - RNA, 14 nt, Salmonella enterica enterica serovar Typhi Ty2
gacuaucgucaccc

SEQ ID NO: 1740108 - RNA, 15 nt, Salmonella enterica enterica serovar Typhi Ty2
gacuacccaucacgc

SEQ ID NO: 1740109 - RNA, 16 nt, Salmonella enterica enterica serovar Typhi Ty2
gacuacguucaucagg

SEQ ID NO: 1740110 - RNA, 18 nt, Salmonella enterica enterica serovar Typhi Ty2
gacuacguucaucaggca

SEQ ID NO: 1740111 - RNA, 15 nt, Salmonella enterica enterica serovar Typhi Ty2
gacuaaaaagcgcgu

SEQ ID NO: 1740112 - RNA, 14 nt, Salmonella enterica enterica serovar Typhi Ty2
gacugauaccgcgu

SEQ ID NO: 1740113 - RNA, 16 nt, Salmonella enterica enterica serovar Typhi Ty2
gacugcacuuccugcg

SEQ ID NO: 1740114 - RNA, 18 nt, Salmonella enterica enterica serovar Typhi Ty2
gacucuuuuuucagaaua

SEQ ID NO: 1740115 - RNA, 12 nt, Salmonella enterica enterica serovar Typhi Ty2
gagaccaucgcg

SEQ ID NO: 1740116 - RNA, 22 nt, Salmonella enterica enterica serovar Typhi Ty2
gagaagcccggccacagcgcca

SEQ ID NO: 1740117 - RNA, 16 nt, Salmonella enterica enterica serovar Typhi Ty2
gagaauuauucguguu

SEQ ID NO: 1740118 - RNA, 21 nt, Salmonella enterica enterica serovar Typhi Ty2
gagaagcccggccacagcgcc

SEQ ID NO: 1740119 - RNA, 22 nt, Salmonella enterica enterica serovar Typhi Ty2
gagaacggaccggcaaucgccu

SEQ ID NO: 1740120 - RNA, 15 nt, Salmonella enterica enterica serovar Typhi Ty2
gagacuaucuugccg

SEQ ID NO: 1740121 - RNA, 19 nt, Salmonella enterica enterica serovar Typhi Ty2
gagagaguauaagcgccgc

SEQ ID NO: 1740122 - RNA, 17 nt, Salmonella enterica enterica serovar Typhi Ty2
gagagcaacgccaucag

SEQ ID NO: 1740123 - RNA, 18 nt, Salmonella enterica enterica serovar Typhi Ty2
gagagcguauccagcacc

SEQ ID NO: 1740124 - RNA, 16 nt, Salmonella enterica enterica serovar Typhi Ty2
gagagcguauccagca

SEQ ID NO: 1740125 - RNA, 22 nt, Salmonella enterica enterica serovar Typhi Ty2
gagagccuuacaggcgcaucag

SEQ ID NO: 1740126 - RNA, 13 nt, Salmonella enterica enterica serovar Typhi Ty2
gagagcgauaucg

SEQ ID NO: 1740127 - RNA, 15 nt, Salmonella enterica enterica serovar Typhi Ty2
gagagcguauccagc

SEQ ID NO: 1740128 - RNA, 18 nt, Salmonella enterica enterica serovar Typhi Ty2
gagagucgauacgcugaa

SEQ ID NO: 1740129 - RNA, 19 nt, Salmonella enterica enterica serovar Typhi Ty2
gagauaauagcugaacaua

SEQ ID NO: 1740130 - RNA, 23 nt, Salmonella enterica enterica serovar Typhi Ty2
gagcacguaggccugauaagcgc

SEQ ID NO: 1740131 - RNA, 19 nt, Salmonella enterica enterica serovar Typhi Ty2
gagaucgugcauccggacg

SEQ ID NO: 1740132 - RNA, 20 nt, Salmonella enterica enterica serovar Typhi Ty2
gagauuacugcgugcuggcg

SEQ ID NO: 1740133 - RNA, 15 nt, Salmonella enterica enterica serovar Typhi Ty2
gacguuaucucgcca

SEQ ID NO: 1740134 - RNA, 13 nt, Salmonella enterica enterica serovar Typhi Ty2
gacguuccgcgac

SEQ ID NO: 1740135 - RNA, 19 nt, Salmonella enterica enterica serovar Typhi Ty2
gacguugaucgccaucgcg

SEQ ID NO: 1740136 - RNA, 18 nt, Salmonella enterica enterica serovar Typhi Ty2
gacgucgccauauccaag

SEQ ID NO: 1740137 - RNA, 15 nt, Salmonella enterica enterica serovar Typhi Ty2
gacguacccaggcgu

SEQ ID NO: 1740138 - RNA, 22 nt, Salmonella enterica enterica serovar Typhi Ty2
gacgugcaccguaucggcaguc

SEQ ID NO: 1740139 - RNA, 19 nt, Salmonella enterica enterica serovar Typhi Ty2
gacgugccuuccaucggcc

SEQ ID NO: 1740140 - RNA, 22 nt, Salmonella enterica enterica serovar Typhi Ty2
gacggcaacggcgacaagaaua

SEQ ID NO: 1740141 - RNA, 13 nt, Salmonella enterica enterica serovar Typhi Ty2
gacggcggcgaau

SEQ ID NO: 1740142 - RNA, 22 nt, Salmonella enterica enterica serovar Typhi Ty2
gacggcguauucggcauagcgc

SEQ ID NO: 1740143 - RNA, 19 nt, Salmonella enterica enterica serovar Typhi Ty2
gacggcuaauaugccaggc

SEQ ID NO: 1740144 - RNA, 19 nt, Salmonella enterica enterica serovar Typhi Ty2
gacgaaucagcgauugcgc

SEQ ID NO: 1740145 - RNA, 21 nt, Salmonella enterica enterica serovar Typhi Ty2
gacgccaggcagauugaggcg

SEQ ID NO: 1740146 - RNA, 16 nt, Salmonella enterica enterica serovar Typhi Ty2
gacgcaugacccaggc

SEQ ID NO: 1740147 - RNA, 18 nt, Salmonella enterica enterica serovar Typhi Ty2
gacgcgccaccaucgucg

SEQ ID NO: 1740148 - RNA, 23 nt, Salmonella enterica enterica serovar Typhi Ty2
gacgcguagcgucuuauccggcc

SEQ ID NO: 1740149 - RNA, 15 nt, Salmonella enterica enterica serovar Typhi Ty2
gacgcuccaucacgg

SEQ ID NO: 1740150 - RNA, 14 nt, Salmonella enterica enterica serovar Typhi Ty2
gacgcgucagcuga

SEQ ID NO: 1740151 - RNA, 16 nt, Salmonella enterica enterica serovar Typhi Ty2
gacgcgucagcugaga

SEQ ID NO: 1740152 - RNA, 20 nt, Salmonella enterica enterica serovar Typhi Ty2
gacggagauuaacagcgcga

SEQ ID NO: 1740153 - RNA, 21 nt, Salmonella enterica enterica serovar Typhi Ty2
gacgcuuacaucgccauccgg

SEQ ID NO: 1740154 - RNA, 17 nt, Salmonella enterica enterica serovar Typhi Ty2
gacgcuuuucagcgucu

SEQ ID NO: 1740155 - RNA, 14 nt, Salmonella enterica enterica serovar Typhi Ty2
gacgcuuuucagcg

SEQ ID NO: 1740156 - RNA, 20 nt, Salmonella enterica enterica serovar Typhi Ty2
gacgcuucaaagccgguacg

SEQ ID NO: 1740157 - RNA, 15 nt, Salmonella enterica enterica serovar Typhi Ty2
gacgcuuacgaagau

SEQ ID NO: 1740158 - RNA, 13 nt, Salmonella enterica enterica serovar Typhi Ty2
gaccgagaucagg

SEQ ID NO: 1740159 - RNA, 14 nt, Salmonella enterica enterica serovar Typhi Ty2
gaccgauauagcca

SEQ ID NO: 1740160 - RNA, 17 nt, Salmonella enterica enterica serovar Typhi Ty2
gaccaucggccgcuauc

SEQ ID NO: 1740161 - RNA, 14 nt, Salmonella enterica enterica serovar Typhi Ty2
gaccagcaucagaa

SEQ ID NO: 1740162 - RNA, 14 nt, Salmonella enterica enterica serovar Typhi Ty2
gaccgcagcuuauu

SEQ ID NO: 1740163 - RNA, 15 nt, Salmonella enterica enterica serovar Typhi Ty2
gaccgcgcuguauca

SEQ ID NO: 1740164 - RNA, 15 nt, Salmonella enterica enterica serovar Typhi Ty2
gaccgcacagcagac

SEQ ID NO: 1740165 - RNA, 17 nt, Salmonella enterica enterica serovar Typhi Ty2
gaccgggcugcacgcca

SEQ ID NO: 1740166 - RNA, 22 nt, Salmonella enterica enterica serovar Typhi Ty2
gaccgggcugcacgccaucggc

SEQ ID NO: 1740167 - RNA, 14 nt, Salmonella enterica enterica serovar Typhi Ty2
gaccguauccgcca

SEQ ID NO: 1740168 - RNA, 22 nt, Salmonella enterica enterica serovar Typhi Ty2
gacaaggcgguacgccgccauc

SEQ ID NO: 1740169 - RNA, 19 nt, Salmonella enterica enterica serovar Typhi Ty2
gacaacguaaacggcagcc

SEQ ID NO: 1740170 - RNA, 19 nt, Salmonella enterica enterica serovar Typhi Ty2
gacaacgccgccuggcauc

SEQ ID NO: 1740171 - RNA, 23 nt, Salmonella enterica enterica serovar Typhi Ty2
gacaacgccgguacgcagcaggc

SEQ ID NO: 1740172 - RNA, 12 nt, Salmonella enterica enterica serovar Typhi Ty2
gacaacgcccac

SEQ ID NO: 1740173 - RNA, 13 nt, Salmonella enterica enterica serovar Typhi Ty2
gacaaucugcugg

SEQ ID NO: 1740174 - RNA, 13 nt, Salmonella enterica enterica serovar Typhi Ty2
gaauuuccugcgc

SEQ ID NO: 1740175 - RNA, 23 nt, Salmonella enterica enterica serovar Typhi Ty2
gacaaccugccguuuuccagccg

SEQ ID NO: 1740176 - RNA, 15 nt, Salmonella enterica enterica serovar Typhi Ty2
gacaaccgccugcgu

SEQ ID NO: 1740177 - RNA, 20 nt, Salmonella enterica enterica serovar Typhi Ty2
gacaaaccacugcuguacgc

SEQ ID NO: 1740178 - RNA, 20 nt, Salmonella enterica enterica serovar Typhi Ty2
gaauggcgggccuacgcgca

SEQ ID NO: 1740179 - RNA, 21 nt, Salmonella enterica enterica serovar Typhi Ty2
gaaugcuauaugcaggcauaa

SEQ ID NO: 1740180 - RNA, 18 nt, Salmonella enterica enterica serovar Typhi Ty2
gaacugauguuccggcac

SEQ ID NO: 1740181 - RNA, 17 nt, Salmonella enterica enterica serovar Typhi Ty2
gaacucgucuuauccga

SEQ ID NO: 1740182 - RNA, 16 nt, Salmonella enterica enterica serovar Typhi Ty2
gaacucgucuuauccg

SEQ ID NO: 1740183 - RNA, 20 nt, Salmonella enterica enterica serovar Typhi Ty2
gaacucggucaggguaauag

SEQ ID NO: 1740184 - RNA, 12 nt, Salmonella enterica enterica serovar Typhi Ty2
gaauacacaaug

SEQ ID NO: 1740185 - RNA, 17 nt, Salmonella enterica enterica serovar Typhi Ty2
gaauaaucauccgcuuc

SEQ ID NO: 1740186 - RNA, 22 nt, Salmonella enterica enterica serovar Typhi Ty2
gaauaaucaaccauacauccug

SEQ ID NO: 1740187 - RNA, 17 nt, Salmonella enterica enterica serovar Typhi Ty2
gaauaacguguuaugcg

SEQ ID NO: 1740188 - RNA, 14 nt, Salmonella enterica enterica serovar Typhi Ty2
gaaucacguaaucg

SEQ ID NO: 1740189 - RNA, 21 nt, Salmonella enterica enterica serovar Typhi Ty2
gaaucagaugcucaucaacga

SEQ ID NO: 1740190 - RNA, 11 nt, Salmonella enterica enterica serovar Typhi Ty2
gaaucagccag

SEQ ID NO: 1740191 - RNA, 12 nt, Salmonella enterica enterica serovar Typhi Ty2
gaaucaucagaa

SEQ ID NO: 1740192 - RNA, 19 nt, Salmonella enterica enterica serovar Typhi Ty2
gaaucauuaauaaccccag

SEQ ID NO: 1740193 - RNA, 22 nt, Salmonella enterica enterica serovar Typhi Ty2
gaaucaguaacacaaucaggcg

SEQ ID NO: 1740194 - RNA, 20 nt, Salmonella enterica enterica serovar Typhi Ty2
gaauccggcgcucaucagac

SEQ ID NO: 1740195 - RNA, 20 nt, Salmonella enterica enterica serovar Typhi Ty2
gaaucccgccaucguccagc

SEQ ID NO: 1740196 - RNA, 13 nt, Salmonella enterica enterica serovar Typhi Ty2
gaaucccgccauc

SEQ ID NO: 1740197 - RNA, 14 nt, Salmonella enterica enterica serovar Typhi Ty2
gaaucguucgccag

SEQ ID NO: 1740198 - RNA, 20 nt, Salmonella enterica enterica serovar Typhi Ty2
gacaucagccagccgccaaa

SEQ ID NO: 1740199 - RNA, 16 nt, Salmonella enterica enterica serovar Typhi Ty2
gacauccccgccgaga

SEQ ID NO: 1740200 - RNA, 20 nt, Salmonella enterica enterica serovar Typhi Ty2
gacaucgccaccgcauggaa

SEQ ID NO: 1740201 - RNA, 22 nt, Salmonella enterica enterica serovar Typhi Ty2
gaccacggccacagccauccga

SEQ ID NO: 1740202 - RNA, 13 nt, Salmonella enterica enterica serovar Typhi Ty2
gaccacggcguca

SEQ ID NO: 1740203 - RNA, 18 nt, Salmonella enterica enterica serovar Typhi Ty2
gaccacggccacagccau

SEQ ID NO: 1740204 - RNA, 16 nt, Salmonella enterica enterica serovar Typhi Ty2
gacacccgcagccaga

SEQ ID NO: 1740205 - RNA, 13 nt, Salmonella enterica enterica serovar Typhi Ty2
gacaccagccguu

SEQ ID NO: 1740206 - RNA, 23 nt, Salmonella enterica enterica serovar Typhi Ty2
gacagcaauguuaaauucagcau

SEQ ID NO: 1740207 - RNA, 22 nt, Salmonella enterica enterica serovar Typhi Ty2
gacagcaggcuuugcugcugcg

SEQ ID NO: 1740208 - RNA, 11 nt, Salmonella enterica enterica serovar Typhi Ty2
cucauccagcg

SEQ ID NO: 1740209 - RNA, 16 nt, Salmonella enterica enterica serovar Typhi Ty2
cucauccccagcauca

SEQ ID NO: 1740210 - RNA, 20 nt, Salmonella enterica enterica serovar Typhi Ty2
cucauccaacugcgccugaa

SEQ ID NO: 1740211 - RNA, 13 nt, Salmonella enterica enterica serovar Typhi Ty2
cucauccagcaac

SEQ ID NO: 1740212 - RNA, 20 nt, Salmonella enterica enterica serovar Typhi Ty2
cucaucggcaaacauagccu

SEQ ID NO: 1740213 - RNA, 16 nt, Salmonella enterica enterica serovar Typhi Ty2
cucagcggcccaaugg

SEQ ID NO: 1740214 - RNA, 19 nt, Salmonella enterica enterica serovar Typhi Ty2
cucaggguccccauauccc

SEQ ID NO: 1740215 - RNA, 21 nt, Salmonella enterica enterica serovar Typhi Ty2
cucaucaguuugcgauaagcg

SEQ ID NO: 1740216 - RNA, 15 nt, Salmonella enterica enterica serovar Typhi Ty2
cucagcgcggcagcc

SEQ ID NO: 1740217 - RNA, 13 nt, Salmonella enterica enterica serovar Typhi Ty2
cucacgucccguu

SEQ ID NO: 1740218 - RNA, 19 nt, Salmonella enterica enterica serovar Typhi Ty2
cucacauucauugccgcca

SEQ ID NO: 1740219 - RNA, 22 nt, Salmonella enterica enterica serovar Typhi Ty2
cucacacauuggcgcggcagga

SEQ ID NO: 1740220 - RNA, 21 nt, Salmonella enterica enterica serovar Typhi Ty2
cucaccagcugacgcagcagu

SEQ ID NO: 1740221 - RNA, 18 nt, Salmonella enterica enterica serovar Typhi Ty2
cucacauucauaaaagau

SEQ ID NO: 1740222 - RNA, 21 nt, Salmonella enterica enterica serovar Typhi Ty2
cuccagcacgcgcugcgccgc

SEQ ID NO: 1740223 - RNA, 14 nt, Salmonella enterica enterica serovar Typhi Ty2
cuccagcagaccgg

SEQ ID NO: 1740224 - RNA, 17 nt, Salmonella enterica enterica serovar Typhi Ty2
cuccagcccaucagucc

SEQ ID NO: 1740225 - RNA, 11 nt, Salmonella enterica enterica serovar Typhi Ty2
cucccaacaga

SEQ ID NO: 1740226 - RNA, 13 nt, Salmonella enterica enterica serovar Typhi Ty2
cucccggcgcugg

SEQ ID NO: 1740227 - RNA, 14 nt, Salmonella enterica enterica serovar Typhi Ty2
cuaccgcugcgaua

SEQ ID NO: 1740228 - RNA, 17 nt, Salmonella enterica enterica serovar Typhi Ty2
cuacuauuaguucugag

SEQ ID NO: 1740229 - RNA, 23 nt, Salmonella enterica enterica serovar Typhi Ty2
cuaccggcgguucuuuugcuaac

SEQ ID NO: 1740230 - RNA, 21 nt, Salmonella enterica enterica serovar Typhi Ty2
cuaccgcaauacgcuucauau

SEQ ID NO: 1740231 - RNA, 13 nt, Salmonella enterica enterica serovar Typhi Ty2
cuacguucaucag

SEQ ID NO: 1740232 - RNA, 19 nt, Salmonella enterica enterica serovar Typhi Ty2
cguugagaaaaccauauaa

SEQ ID NO: 1740233 - RNA, 24 nt, Salmonella enterica enterica serovar Typhi Ty2
cguucugcauaucgccuugcugcg

SEQ ID NO: 1740234 - RNA, 11 nt, Salmonella enterica enterica serovar Typhi Ty2
cuacagcguca

SEQ ID NO: 1740235 - RNA, 15 nt, Salmonella enterica enterica serovar Typhi Ty2
cucaauuauuaaucu

SEQ ID NO: 1740236 - RNA, 16 nt, Salmonella enterica enterica serovar Typhi Ty2
cucaagcguucucacg

SEQ ID NO: 1740237 - RNA, 21 nt, Salmonella enterica enterica serovar Typhi Ty2
cucaacgcccgcuuucaccau

SEQ ID NO: 1740238 - RNA, 21 nt, Salmonella enterica enterica serovar Typhi Ty2
cucaacgcaucgcugcgcuua

SEQ ID NO: 1740239 - RNA, 17 nt, Salmonella enterica enterica serovar Typhi Ty2
cuaucuuuucaaucagg

SEQ ID NO: 1740240 - RNA, 19 nt, Salmonella enterica enterica serovar Typhi Ty2
cuaugcgccaguuguccgc

SEQ ID NO: 1740241 - RNA, 16 nt, Salmonella enterica enterica serovar Typhi Ty2
cucaacauugccggca

SEQ ID NO: 1740242 - RNA, 17 nt, Salmonella enterica enterica serovar Typhi Ty2
cucaacauacgccgcca

SEQ ID NO: 1740243 - RNA, 19 nt, Salmonella enterica enterica serovar Typhi Ty2
cucaaaguuaccggcauua

SEQ ID NO: 1740244 - RNA, 14 nt, Salmonella enterica enterica serovar Typhi Ty2
cuaucuucgauaaa

SEQ ID NO: 1740245 - RNA, 19 nt, Salmonella enterica enterica serovar Typhi Ty2
cuaucuggauacgauaagc

SEQ ID NO: 1740246 - RNA, 22 nt, Salmonella enterica enterica serovar Typhi Ty2
cuaucauacacaucauuaccau

SEQ ID NO: 1740247 - RNA, 16 nt, Salmonella enterica enterica serovar Typhi Ty2
cuagcgucccggcaau

SEQ ID NO: 1740248 - RNA, 16 nt, Salmonella enterica enterica serovar Typhi Ty2
cuagcgccuuauccgg

SEQ ID NO: 1740249 - RNA, 14 nt, Salmonella enterica enterica serovar Typhi Ty2
cuccuucauccaga

SEQ ID NO: 1740250 - RNA, 17 nt, Salmonella enterica enterica serovar Typhi Ty2
cuccuguaagucaggua

SEQ ID NO: 1740251 - RNA, 20 nt, Salmonella enterica enterica serovar Typhi Ty2
cuccggcagcguauugagcu

SEQ ID NO: 1740252 - RNA, 11 nt, Salmonella enterica enterica serovar Typhi Ty2
cuccggcacca

SEQ ID NO: 1740253 - RNA, 16 nt, Salmonella enterica enterica serovar Typhi Ty2
cuccggccagcgccag

SEQ ID NO: 1740254 - RNA, 15 nt, Salmonella enterica enterica serovar Typhi Ty2
cuccgcguagcccag

SEQ ID NO: 1740255 - RNA, 14 nt, Salmonella enterica enterica serovar Typhi Ty2
cuccgccagggcgg

SEQ ID NO: 1740256 - RNA, 13 nt, Salmonella enterica enterica serovar Typhi Ty2
cuccgccagcaau

SEQ ID NO: 1740257 - RNA, 20 nt, Salmonella enterica enterica serovar Typhi Ty2
cuccgcgacgaccugcauau

SEQ ID NO: 1740258 - RNA, 13 nt, Salmonella enterica enterica serovar Typhi Ty2
cucgccagcccga

SEQ ID NO: 1740259 - RNA, 15 nt, Salmonella enterica enterica serovar Typhi Ty2
cucgaggaacuguuc

SEQ ID NO: 1740260 - RNA, 21 nt, Salmonella enterica enterica serovar Typhi Ty2
cucgcaggccaaacagcggcu

SEQ ID NO: 1740261 - RNA, 15 nt, Salmonella enterica enterica serovar Typhi Ty2
cucgcccgcgaugau

SEQ ID NO: 1740262 - RNA, 20 nt, Salmonella enterica enterica serovar Typhi Ty2
cucgcgacauggcgguaauc

SEQ ID NO: 1740263 - RNA, 14 nt, Salmonella enterica enterica serovar Typhi Ty2
cucgcgaccagaga

SEQ ID NO: 1740264 - RNA, 14 nt, Salmonella enterica enterica serovar Typhi Ty2
cucggaugugcauu

SEQ ID NO: 1740265 - RNA, 23 nt, Salmonella enterica enterica serovar Typhi Ty2
cucggcauacaccgccagcgucu

SEQ ID NO: 1740266 - RNA, 20 nt, Salmonella enterica enterica serovar Typhi Ty2
cugccaguccgcccgccuca

SEQ ID NO: 1740267 - RNA, 16 nt, Salmonella enterica enterica serovar Typhi Ty2
cugccauuaucaccau

SEQ ID NO: 1740268 - RNA, 19 nt, Salmonella enterica enterica serovar Typhi Ty2
cugcccgccgccaccaugu

SEQ ID NO: 1740269 - RNA, 13 nt, Salmonella enterica enterica serovar Typhi Ty2
cugcccggcauau

SEQ ID NO: 1740270 - RNA, 17 nt, Salmonella enterica enterica serovar Typhi Ty2
cugccaccgucgcggca

SEQ ID NO: 1740271 - RNA, 15 nt, Salmonella enterica enterica serovar Typhi Ty2
cugcauccuguacca

SEQ ID NO: 1740272 - RNA, 13 nt, Salmonella enterica enterica serovar Typhi Ty2
cugcaucaugcgc

SEQ ID NO: 1740273 - RNA, 18 nt, Salmonella enterica enterica serovar Typhi Ty2
cugcagggauaugcugau

SEQ ID NO: 1740274 - RNA, 14 nt, Salmonella enterica enterica serovar Typhi Ty2
cugcaggcgacuca

SEQ ID NO: 1740275 - RNA, 17 nt, Salmonella enterica enterica serovar Typhi Ty2
cugcagcccuuacgcuu

SEQ ID NO: 1740276 - RNA, 14 nt, Salmonella enterica enterica serovar Typhi Ty2
cugccgccgcacca

SEQ ID NO: 1740277 - RNA, 12 nt, Salmonella enterica enterica serovar Typhi Ty2
cugcccugcggu

SEQ ID NO: 1740278 - RNA, 18 nt, Salmonella enterica enterica serovar Typhi Ty2
cugcccuuucuucaaugg

SEQ ID NO: 1740279 - RNA, 12 nt, Salmonella enterica enterica serovar Typhi Ty2
cugccgacaacg

SEQ ID NO: 1740280 - RNA, 13 nt, Salmonella enterica enterica serovar Typhi Ty2
cugccgaucagau

SEQ ID NO: 1740281 - RNA, 19 nt, Salmonella enterica enterica serovar Typhi Ty2
cugccgcaccagucggcaa

SEQ ID NO: 1740282 - RNA, 16 nt, Salmonella enterica enterica serovar Typhi Ty2
cugccgucaucgacuu

SEQ ID NO: 1740283 - RNA, 21 nt, Salmonella enterica enterica serovar Typhi Ty2
cugccgugguccggcgucaac

SEQ ID NO: 1740284 - RNA, 22 nt, Salmonella enterica enterica serovar Typhi Ty2
cugccuuuaacaaauuaaaucc

SEQ ID NO: 1740285 - RNA, 16 nt, Salmonella enterica enterica serovar Typhi Ty2
cugccuucggcgcugg

SEQ ID NO: 1740286 - RNA, 16 nt, Salmonella enterica enterica serovar Typhi Ty2
cugccuguuuacggca

SEQ ID NO: 1740287 - RNA, 17 nt, Salmonella enterica enterica serovar Typhi Ty2
cugacguagauucugau

SEQ ID NO: 1740288 - RNA, 13 nt, Salmonella enterica enterica serovar Typhi Ty2
cugaccagcgacg

SEQ ID NO: 1740289 - RNA, 15 nt, Salmonella enterica enterica serovar Typhi Ty2
cugauagcacagcgc

SEQ ID NO: 1740290 - RNA, 17 nt, Salmonella enterica enterica serovar Typhi Ty2
cugauccuguuaaucau

SEQ ID NO: 1740291 - RNA, 22 nt, Salmonella enterica enterica serovar Typhi Ty2
cugcagagcggcaaauucagcg

SEQ ID NO: 1740292 - RNA, 13 nt, Salmonella enterica enterica serovar Typhi Ty2
cugcagaaucucu

SEQ ID NO: 1740293 - RNA, 14 nt, Salmonella enterica enterica serovar Typhi Ty2
cugcaacgccagau

SEQ ID NO: 1740294 - RNA, 15 nt, Salmonella enterica enterica serovar Typhi Ty2
cugcaacgccagaug

SEQ ID NO: 1740295 - RNA, 19 nt, Salmonella enterica enterica serovar Typhi Ty2
cugcaacuccacaaauagc

SEQ ID NO: 1740296 - RNA, 12 nt, Salmonella enterica enterica serovar Typhi Ty2
cugcaacuccug

SEQ ID NO: 1740297 - RNA, 18 nt, Salmonella enterica enterica serovar Typhi Ty2
cugcaaauagcgcugaug

SEQ ID NO: 1740298 - RNA, 19 nt, Salmonella enterica enterica serovar Typhi Ty2
cugaugagauaagcgcuua

SEQ ID NO: 1740299 - RNA, 18 nt, Salmonella enterica enterica serovar Typhi Ty2
cugaugacgcgccggaug

SEQ ID NO: 1740300 - RNA, 18 nt, Salmonella enterica enterica serovar Typhi Ty2
cugaugacgcugcgcuua

SEQ ID NO: 1740301 - RNA, 13 nt, Salmonella enterica enterica serovar Typhi Ty2
cucuaucagcgcc

SEQ ID NO: 1740302 - RNA, 14 nt, Salmonella enterica enterica serovar Typhi Ty2
cucuacucgcggac

SEQ ID NO: 1740303 - RNA, 14 nt, Salmonella enterica enterica serovar Typhi Ty2
cucguugcgucgug

SEQ ID NO: 1740304 - RNA, 19 nt, Salmonella enterica enterica serovar Typhi Ty2
cucuugcuggguuaacgcg

SEQ ID NO: 1740305 - RNA, 20 nt, Salmonella enterica enterica serovar Typhi Ty2
cugaaaaaggguaacgggac

SEQ ID NO: 1740306 - RNA, 15 nt, Salmonella enterica enterica serovar Typhi Ty2
cucuuuugcauuaca

SEQ ID NO: 1740307 - RNA, 16 nt, Salmonella enterica enterica serovar Typhi Ty2
cucugcugugccagua

SEQ ID NO: 1740308 - RNA, 19 nt, Salmonella enterica enterica serovar Typhi Ty2
cucugaaacgcuucaccgg

SEQ ID NO: 1740309 - RNA, 17 nt, Salmonella enterica enterica serovar Typhi Ty2
cugaauaacagcaccau

SEQ ID NO: 1740310 - RNA, 19 nt, Salmonella enterica enterica serovar Typhi Ty2
cugaauaccuugauaacug

SEQ ID NO: 1740311 - RNA, 14 nt, Salmonella enterica enterica serovar Typhi Ty2
cugaaucaguaucc

SEQ ID NO: 1740312 - RNA, 21 nt, Salmonella enterica enterica serovar Typhi Ty2
cugaaucucuucccagcgcac

SEQ ID NO: 1740313 - RNA, 24 nt, Salmonella enterica enterica serovar Typhi Ty2
cugaauauuagaguggccgcgcaa

SEQ ID NO: 1740314 - RNA, 15 nt, Salmonella enterica enterica serovar Typhi Ty2
cugacauucagcgcu

SEQ ID NO: 1740315 - RNA, 14 nt, Salmonella enterica enterica serovar Typhi Ty2
cugacauccaucau

SEQ ID NO: 1740316 - RNA, 16 nt, Salmonella enterica enterica serovar Typhi Ty2
cugacagcgcgcgaau

SEQ ID NO: 1740317 - RNA, 20 nt, Salmonella enterica enterica serovar Typhi Ty2
cugacagaaauagccgguaa

SEQ ID NO: 1740318 - RNA, 14 nt, Salmonella enterica enterica serovar Typhi Ty2
cugacaaucagcac

SEQ ID NO: 1740319 - RNA, 18 nt, Salmonella enterica enterica serovar Typhi Ty2
cugacaaagguugcgcca

SEQ ID NO: 1740320 - RNA, 14 nt, Salmonella enterica enterica serovar Typhi Ty2
cguggcaaucagca

SEQ ID NO: 1740321 - RNA, 13 nt, Salmonella enterica enterica serovar Typhi Ty2
cguggacgcuggg

SEQ ID NO: 1740322 - RNA, 17 nt, Salmonella enterica enterica serovar Typhi Ty2
cguggaacugcagcgcg

SEQ ID NO: 1740323 - RNA, 21 nt, Salmonella enterica enterica serovar Typhi Ty2
cgugcaugggauacgccagca

SEQ ID NO: 1740324 - RNA, 19 nt, Salmonella enterica enterica serovar Typhi Ty2
cgugccaugaccauucaca

SEQ ID NO: 1740325 - RNA, 19 nt, Salmonella enterica enterica serovar Typhi Ty2
cgugagaaguaagcgccag

SEQ ID NO: 1740326 - RNA, 13 nt, Salmonella enterica enterica serovar Typhi Ty2
cgugagcgcaucc

SEQ ID NO: 1740327 - RNA, 17 nt, Salmonella enterica enterica serovar Typhi Ty2
cgucgcgguugccguca

SEQ ID NO: 1740328 - RNA, 14 nt, Salmonella enterica enterica serovar Typhi Ty2
cgucgugccaguga

SEQ ID NO: 1740329 - RNA, 15 nt, Salmonella enterica enterica serovar Typhi Ty2
cgucucgauacgcug

SEQ ID NO: 1740330 - RNA, 21 nt, Salmonella enterica enterica serovar Typhi Ty2
cgucuuccggauaacgcgcug

SEQ ID NO: 1740331 - RNA, 12 nt, Salmonella enterica enterica serovar Typhi Ty2
cgugaccaucgc

SEQ ID NO: 1740332 - RNA, 15 nt, Salmonella enterica enterica serovar Typhi Ty2
cgugacccgccagca

SEQ ID NO: 1740333 - RNA, 23 nt, Salmonella enterica enterica serovar Typhi Ty2
cgucuucaggucauucaggacgg

SEQ ID NO: 1740334 - RNA, 17 nt, Salmonella enterica enterica serovar Typhi Ty2
cgucuguguuuauccgg

SEQ ID NO: 1740335 - RNA, 21 nt, Salmonella enterica enterica serovar Typhi Ty2
cgucucguauaucgcgauaaa

SEQ ID NO: 1740336 - RNA, 16 nt, Salmonella enterica enterica serovar Typhi Ty2
cgucucucauccgcca

SEQ ID NO: 1740337 - RNA, 12 nt, Salmonella enterica enterica serovar Typhi Ty2
cguuauccagca

SEQ ID NO: 1740338 - RNA, 18 nt, Salmonella enterica enterica serovar Typhi Ty2
cguuaucugaccuacagg

SEQ ID NO: 1740339 - RNA, 16 nt, Salmonella enterica enterica serovar Typhi Ty2
cguuaugaaucgcgug

SEQ ID NO: 1740340 - RNA, 23 nt, Salmonella enterica enterica serovar Typhi Ty2
cguuaucguagugccacaacgcc

SEQ ID NO: 1740341 - RNA, 18 nt, Salmonella enterica enterica serovar Typhi Ty2
cguuaucauuaucgccaa

SEQ ID NO: 1740342 - RNA, 15 nt, Salmonella enterica enterica serovar Typhi Ty2
cguuauaauccugau

SEQ ID NO: 1740343 - RNA, 18 nt, Salmonella enterica enterica serovar Typhi Ty2
cguuagcgccauccggca

SEQ ID NO: 1740344 - RNA, 15 nt, Salmonella enterica enterica serovar Typhi Ty2
cguucaaugagcguc

SEQ ID NO: 1740345 - RNA, 19 nt, Salmonella enterica enterica serovar Typhi Ty2
cguucaacggcaaaucgcg

SEQ ID NO: 1740346 - RNA, 20 nt, Salmonella enterica enterica serovar Typhi Ty2
cguuacuguuuuaucaggga

SEQ ID NO: 1740347 - RNA, 19 nt, Salmonella enterica enterica serovar Typhi Ty2
cguuagaaccaaucgagaa

SEQ ID NO: 1740348 - RNA, 19 nt, Salmonella enterica enterica serovar Typhi Ty2
cguuagccgccauccggca

SEQ ID NO: 1740349 - RNA, 23 nt, Salmonella enterica enterica serovar Typhi Ty2
cguuagcgagguucccgccgcca

SEQ ID NO: 1740350 - RNA, 21 nt, Salmonella enterica enterica serovar Typhi Ty2
cguuaccggugauauugccga

SEQ ID NO: 1740351 - RNA, 16 nt, Salmonella enterica enterica serovar Typhi Ty2
cguuaaguagcggaac

SEQ ID NO: 1740352 - RNA, 19 nt, Salmonella enterica enterica serovar Typhi Ty2
cguuaaucuggccuacgga

SEQ ID NO: 1740353 - RNA, 21 nt, Salmonella enterica enterica serovar Typhi Ty2
cguuaaugcgcgcuucuucau

SEQ ID NO: 1740354 - RNA, 16 nt, Salmonella enterica enterica serovar Typhi Ty2
cguuacccaugagcga

SEQ ID NO: 1740355 - RNA, 20 nt, Salmonella enterica enterica serovar Typhi Ty2
cguuaauuuuccccgcacgc

SEQ ID NO: 1740356 - RNA, 15 nt, Salmonella enterica enterica serovar Typhi Ty2
cguuaccaaucugcg

SEQ ID NO: 1740357 - RNA, 15 nt, Salmonella enterica enterica serovar Typhi Ty2
cguuaaauaccagca

SEQ ID NO: 1740358 - RNA, 21 nt, Salmonella enterica enterica serovar Typhi Ty2
cguguugcagcccaccggcga

SEQ ID NO: 1740359 - RNA, 20 nt, Salmonella enterica enterica serovar Typhi Ty2
cgugugucccggacaaugua

SEQ ID NO: 1740360 - RNA, 20 nt, Salmonella enterica enterica serovar Typhi Ty2
cguguuacugacgaccggca

SEQ ID NO: 1740361 - RNA, 15 nt, Salmonella enterica enterica serovar Typhi Ty2
cguuccccaacagcg

SEQ ID NO: 1740362 - RNA, 17 nt, Salmonella enterica enterica serovar Typhi Ty2
cguucgcauauucugcg

SEQ ID NO: 1740363 - RNA, 12 nt, Salmonella enterica enterica serovar Typhi Ty2
cguucgccgcau

SEQ ID NO: 1740364 - RNA, 22 nt, Salmonella enterica enterica serovar Typhi Ty2
cguucgcgaauuucacgcagca

SEQ ID NO: 1740365 - RNA, 16 nt, Salmonella enterica enterica serovar Typhi Ty2
cguucugcacgccggu

SEQ ID NO: 1740366 - RNA, 18 nt, Salmonella enterica enterica serovar Typhi Ty2
cguucaucaggcaauaaa

SEQ ID NO: 1740367 - RNA, 17 nt, Salmonella enterica enterica serovar Typhi Ty2
cguucauccaugauggc

SEQ ID NO: 1740368 - RNA, 15 nt, Salmonella enterica enterica serovar Typhi Ty2
cguucagcaucggga

SEQ ID NO: 1740369 - RNA, 13 nt, Salmonella enterica enterica serovar Typhi Ty2
cguucaucaggca

SEQ ID NO: 1740370 - RNA, 13 nt, Salmonella enterica enterica serovar Typhi Ty2
cguucaggcggca

SEQ ID NO: 1740371 - RNA, 17 nt, Salmonella enterica enterica serovar Typhi Ty2
cgugguuagacaucacg

SEQ ID NO: 1740372 - RNA, 12 nt, Salmonella enterica enterica serovar Typhi Ty2
cguguacggcga

SEQ ID NO: 1740373 - RNA, 19 nt, Salmonella enterica enterica serovar Typhi Ty2
cguguccggauucgcggca

SEQ ID NO: 1740374 - RNA, 14 nt, Salmonella enterica enterica serovar Typhi Ty2
cgugguaucgcgac

SEQ ID NO: 1740375 - RNA, 22 nt, Salmonella enterica enterica serovar Typhi Ty2
cguggcgcgaauuuucgauaau

SEQ ID NO: 1740376 - RNA, 19 nt, Salmonella enterica enterica serovar Typhi Ty2
cgguguuuagacacauuga

SEQ ID NO: 1740377 - RNA, 18 nt, Salmonella enterica enterica serovar Typhi Ty2
cggugaauauuugcgcua

SEQ ID NO: 1740378 - RNA, 17 nt, Salmonella enterica enterica serovar Typhi Ty2
cgguugcgcuucggcga

SEQ ID NO: 1740379 - RNA, 13 nt, Salmonella enterica enterica serovar Typhi Ty2
cgguugcugauaa

SEQ ID NO: 1740380 - RNA, 22 nt, Salmonella enterica enterica serovar Typhi Ty2
cgguugccuuucgccagcauga

SEQ ID NO: 1740381 - RNA, 13 nt, Salmonella enterica enterica serovar Typhi Ty2
cgguuccagcggc

SEQ ID NO: 1740382 - RNA, 18 nt, Salmonella enterica enterica serovar Typhi Ty2
cgguuccagcguggcgau

SEQ ID NO: 1740383 - RNA, 18 nt, Salmonella enterica enterica serovar Typhi Ty2
cgguuggaucggcaaaca

SEQ ID NO: 1740384 - RNA, 22 nt, Salmonella enterica enterica serovar Typhi Ty2
cguaaagggaagaucauuauca

SEQ ID NO: 1740385 - RNA, 15 nt, Salmonella enterica enterica serovar Typhi Ty2
cgguuuaagccgcug

SEQ ID NO: 1740386 - RNA, 12 nt, Salmonella enterica enterica serovar Typhi Ty2
cguaagcgcguu

SEQ ID NO: 1740387 - RNA, 23 nt, Salmonella enterica enterica serovar Typhi Ty2
cguaagcuuucugaauuucacgc

SEQ ID NO: 1740388 - RNA, 14 nt, Salmonella enterica enterica serovar Typhi Ty2
cguaagaccagauu

SEQ ID NO: 1740389 - RNA, 19 nt, Salmonella enterica enterica serovar Typhi Ty2
cguaagaauuauuaccaau

SEQ ID NO: 1740390 - RNA, 20 nt, Salmonella enterica enterica serovar Typhi Ty2
cguaaauccacauuccagac

SEQ ID NO: 1740391 - RNA, 18 nt, Salmonella enterica enterica serovar Typhi Ty2
cguaaauucccuccagau

SEQ ID NO: 1740392 - RNA, 12 nt, Salmonella enterica enterica serovar Typhi Ty2
cguaacccagug

SEQ ID NO: 1740393 - RNA, 19 nt, Salmonella enterica enterica serovar Typhi Ty2
cguaacgccgucgacaaag

SEQ ID NO: 1740394 - RNA, 12 nt, Salmonella enterica enterica serovar Typhi Ty2
cguaacgccaca

SEQ ID NO: 1740395 - RNA, 11 nt, Salmonella enterica enterica serovar Typhi Ty2
cguagcgccau

SEQ ID NO: 1740396 - RNA, 13 nt, Salmonella enterica enterica serovar Typhi Ty2
cguagcgccaaca

SEQ ID NO: 1740397 - RNA, 20 nt, Salmonella enterica enterica serovar Typhi Ty2
cguagcgcguucaggguauc

SEQ ID NO: 1740398 - RNA, 19 nt, Salmonella enterica enterica serovar Typhi Ty2
cguagaucucuaucggcaa

SEQ ID NO: 1740399 - RNA, 20 nt, Salmonella enterica enterica serovar Typhi Ty2
cguacgccuaaaugaacuua

SEQ ID NO: 1740400 - RNA, 18 nt, Salmonella enterica enterica serovar Typhi Ty2
cguaaguuaaaacgccau

SEQ ID NO: 1740401 - RNA, 19 nt, Salmonella enterica enterica serovar Typhi Ty2
cguaaggauacucagcgac

SEQ ID NO: 1740402 - RNA, 15 nt, Salmonella enterica enterica serovar Typhi Ty2
cgucaacgaccagaa

SEQ ID NO: 1740403 - RNA, 16 nt, Salmonella enterica enterica serovar Typhi Ty2
cgucacccgccggcag

SEQ ID NO: 1740404 - RNA, 15 nt, Salmonella enterica enterica serovar Typhi Ty2
cgucacgccaucagg

SEQ ID NO: 1740405 - RNA, 22 nt, Salmonella enterica enterica serovar Typhi Ty2
cguauuaagccaacguugaaaa

SEQ ID NO: 1740406 - RNA, 23 nt, Salmonella enterica enterica serovar Typhi Ty2
cguauuauccacccccgcaacgg

SEQ ID NO: 1740407 - RNA, 12 nt, Salmonella enterica enterica serovar Typhi Ty2
cguauucgcccg

SEQ ID NO: 1740408 - RNA, 18 nt, Salmonella enterica enterica serovar Typhi Ty2
cgucaaaaccaaacagcg

SEQ ID NO: 1740409 - RNA, 13 nt, Salmonella enterica enterica serovar Typhi Ty2
cguaguacgcgcg

SEQ ID NO: 1740410 - RNA, 19 nt, Salmonella enterica enterica serovar Typhi Ty2
cguccucaggccggauaag

SEQ ID NO: 1740411 - RNA, 18 nt, Salmonella enterica enterica serovar Typhi Ty2
cgucgaccauacgcagca

SEQ ID NO: 1740412 - RNA, 13 nt, Salmonella enterica enterica serovar Typhi Ty2
cgucauccuccug

SEQ ID NO: 1740413 - RNA, 19 nt, Salmonella enterica enterica serovar Typhi Ty2
cgucauccggcaagcgcug

SEQ ID NO: 1740414 - RNA, 19 nt, Salmonella enterica enterica serovar Typhi Ty2
cgucauccgcguaaucgcg

SEQ ID NO: 1740415 - RNA, 18 nt, Salmonella enterica enterica serovar Typhi Ty2
cgucagguuuaaucggcg

SEQ ID NO: 1740416 - RNA, 23 nt, Salmonella enterica enterica serovar Typhi Ty2
cgucaucauuaccuuuuccggcg

SEQ ID NO: 1740417 - RNA, 13 nt, Salmonella enterica enterica serovar Typhi Ty2
cgucauccugcag

SEQ ID NO: 1740418 - RNA, 22 nt, Salmonella enterica enterica serovar Typhi Ty2
cgucagcccaagcugacggaua

SEQ ID NO: 1740419 - RNA, 23 nt, Salmonella enterica enterica serovar Typhi Ty2
cgucaggcccauuuucggcauca

SEQ ID NO: 1740420 - RNA, 22 nt, Salmonella enterica enterica serovar Typhi Ty2
cguccacggauauuuaccgccg

SEQ ID NO: 1740421 - RNA, 13 nt, Salmonella enterica enterica serovar Typhi Ty2
cguccagauaaug

SEQ ID NO: 1740422 - RNA, 22 nt, Salmonella enterica enterica serovar Typhi Ty2
cgucaugcuucaccucagcaaa

SEQ ID NO: 1740423 - RNA, 21 nt, Salmonella enterica enterica serovar Typhi Ty2
cgucauggcuaaucgccacga

SEQ ID NO: 1740424 - RNA, 19 nt, Salmonella enterica enterica serovar Typhi Ty2
cgucauuuucuuucaucaa

SEQ ID NO: 1740425 - RNA, 14 nt, Salmonella enterica enterica serovar Typhi Ty2
cgucauuuccggcg

SEQ ID NO: 1740426 - RNA, 24 nt, Salmonella enterica enterica serovar Typhi Ty2
cgucauuaugcauugccaugcgac

SEQ ID NO: 1740427 - RNA, 19 nt, Salmonella enterica enterica serovar Typhi Ty2
cguccaguguccgcuguua

SEQ ID NO: 1740428 - RNA, 13 nt, Salmonella enterica enterica serovar Typhi Ty2
cguccccugcggu

SEQ ID NO: 1740429 - RNA, 14 nt, Salmonella enterica enterica serovar Typhi Ty2
cguccgccaacagc

SEQ ID NO: 1740430 - RNA, 14 nt, Salmonella enterica enterica serovar Typhi Ty2
gcccgcuuuaccga

SEQ ID NO: 1740431 - RNA, 14 nt, Salmonella enterica enterica serovar Typhi Ty2
gcccgcucguuuca

SEQ ID NO: 1740432 - RNA, 15 nt, Salmonella enterica enterica serovar Typhi Ty2
gcccggcaugucgcc

SEQ ID NO: 1740433 - RNA, 14 nt, Salmonella enterica enterica serovar Typhi Ty2
gcccggcaggcugg

SEQ ID NO: 1740434 - RNA, 13 nt, Salmonella enterica enterica serovar Typhi Ty2
gcccggcaaacgg

SEQ ID NO: 1740435 - RNA, 14 nt, Salmonella enterica enterica serovar Typhi Ty2
gcccggcaaccuga

SEQ ID NO: 1740436 - RNA, 20 nt, Salmonella enterica enterica serovar Typhi Ty2
gcccgguaagcgcagcgcca

SEQ ID NO: 1740437 - RNA, 20 nt, Salmonella enterica enterica serovar Typhi Ty2
gcccgucccuuccgccacca

SEQ ID NO: 1740438 - RNA, 11 nt, Salmonella enterica enterica serovar Typhi Ty2
gcccagcgccg

SEQ ID NO: 1740439 - RNA, 15 nt, Salmonella enterica enterica serovar Typhi Ty2
gcccagcgccgcauc

SEQ ID NO: 1740440 - RNA, 14 nt, Salmonella enterica enterica serovar Typhi Ty2
gccccaccgccaga

SEQ ID NO: 1740441 - RNA, 15 nt, Salmonella enterica enterica serovar Typhi Ty2
gccccaccgccagaa

SEQ ID NO: 1740442 - RNA, 21 nt, Salmonella enterica enterica serovar Typhi Ty2
gccccagcgccagcugcguca

SEQ ID NO: 1740443 - RNA, 22 nt, Salmonella enterica enterica serovar Typhi Ty2
gcccgaaagcaauacuguaagc

SEQ ID NO: 1740444 - RNA, 13 nt, Salmonella enterica enterica serovar Typhi Ty2
gcccgcagaucug

SEQ ID NO: 1740445 - RNA, 16 nt, Salmonella enterica enterica serovar Typhi Ty2
gccaacgccggcaaca

SEQ ID NO: 1740446 - RNA, 16 nt, Salmonella enterica enterica serovar Typhi Ty2
gccacgcagcgcagac

SEQ ID NO: 1740447 - RNA, 17 nt, Salmonella enterica enterica serovar Typhi Ty2
gccacgauauagucgcc

SEQ ID NO: 1740448 - RNA, 14 nt, Salmonella enterica enterica serovar Typhi Ty2
gccacguugcgcgc

SEQ ID NO: 1740449 - RNA, 23 nt, Salmonella enterica enterica serovar Typhi Ty2
gccacgucugaugcguggcugaa

SEQ ID NO: 1740450 - RNA, 17 nt, Salmonella enterica enterica serovar Typhi Ty2
gccagaaaucgcucaug

SEQ ID NO: 1740451 - RNA, 16 nt, Salmonella enterica enterica serovar Typhi Ty2
gccacuuuuccggcac

SEQ ID NO: 1740452 - RNA, 22 nt, Salmonella enterica enterica serovar Typhi Ty2
gccagaccaauagagagcgaca

SEQ ID NO: 1740453 - RNA, 18 nt, Salmonella enterica enterica serovar Typhi Ty2
gccagaaugccagcgccg

SEQ ID NO: 1740454 - RNA, 21 nt, Salmonella enterica enterica serovar Typhi Ty2
gccagaauacaccgccuagcg

SEQ ID NO: 1740455 - RNA, 15 nt, Salmonella enterica enterica serovar Typhi Ty2
gccagaacgcuguug

SEQ ID NO: 1740456 - RNA, 15 nt, Salmonella enterica enterica serovar Typhi Ty2
gccagacucagccag

SEQ ID NO: 1740457 - RNA, 19 nt, Salmonella enterica enterica serovar Typhi Ty2
gccagacgcgcagcaccga

SEQ ID NO: 1740458 - RNA, 16 nt, Salmonella enterica enterica serovar Typhi Ty2
gccagacggcgcccag

SEQ ID NO: 1740459 - RNA, 17 nt, Salmonella enterica enterica serovar Typhi Ty2
gccagacccagcgcuaa

SEQ ID NO: 1740460 - RNA, 17 nt, Salmonella enterica enterica serovar Typhi Ty2
gccagacccaauaugcc

SEQ ID NO: 1740461 - RNA, 20 nt, Salmonella enterica enterica serovar Typhi Ty2
gccagaccccaguaauccgg

SEQ ID NO: 1740462 - RNA, 18 nt, Salmonella enterica enterica serovar Typhi Ty2
gccagacucgcuucacgc

SEQ ID NO: 1740463 - RNA, 20 nt, Salmonella enterica enterica serovar Typhi Ty2
gccagauauuuucggcauac

SEQ ID NO: 1740464 - RNA, 14 nt, Salmonella enterica enterica serovar Typhi Ty2
gccagaucaggcgu

SEQ ID NO: 1740465 - RNA, 14 nt, Salmonella enterica enterica serovar Typhi Ty2
gccagaugcagcgg

SEQ ID NO: 1740466 - RNA, 15 nt, Salmonella enterica enterica serovar Typhi Ty2
gccagcauaccgccc

SEQ ID NO: 1740467 - RNA, 21 nt, Salmonella enterica enterica serovar Typhi Ty2
gccagcaucaugggcucauca

SEQ ID NO: 1740468 - RNA, 21 nt, Salmonella enterica enterica serovar Typhi Ty2
gccagccagucgccaggcaag

SEQ ID NO: 1740469 - RNA, 19 nt, Salmonella enterica enterica serovar Typhi Ty2
gccagcauuucaaucgcgc

SEQ ID NO: 1740470 - RNA, 22 nt, Salmonella enterica enterica serovar Typhi Ty2
gccagcgacaacgcuuccggcg

SEQ ID NO: 1740471 - RNA, 17 nt, Salmonella enterica enterica serovar Typhi Ty2
gccagcgacugguguua

SEQ ID NO: 1740472 - RNA, 15 nt, Salmonella enterica enterica serovar Typhi Ty2
gccagcggcgcgaug

SEQ ID NO: 1740473 - RNA, 13 nt, Salmonella enterica enterica serovar Typhi Ty2
gccagcgucauca

SEQ ID NO: 1740474 - RNA, 13 nt, Salmonella enterica enterica serovar Typhi Ty2
gccagcgucaccu

SEQ ID NO: 1740475 - RNA, 12 nt, Salmonella enterica enterica serovar Typhi Ty2
gccagcgugcuu

SEQ ID NO: 1740476 - RNA, 12 nt, Salmonella enterica enterica serovar Typhi Ty2
gccagcgcugag

SEQ ID NO: 1740477 - RNA, 14 nt, Salmonella enterica enterica serovar Typhi Ty2
gccaggcauccggc

SEQ ID NO: 1740478 - RNA, 12 nt, Salmonella enterica enterica serovar Typhi Ty2
gccaggcgcugc

SEQ ID NO: 1740479 - RNA, 19 nt, Salmonella enterica enterica serovar Typhi Ty2
gccaggcuuuaaauucagc

SEQ ID NO: 1740480 - RNA, 16 nt, Salmonella enterica enterica serovar Typhi Ty2
gccagguacaucgcgc

SEQ ID NO: 1740481 - RNA, 21 nt, Salmonella enterica enterica serovar Typhi Ty2
gccaguaucgcgccgccaaua

SEQ ID NO: 1740482 - RNA, 14 nt, Salmonella enterica enterica serovar Typhi Ty2
gcccaacgcaauac

SEQ ID NO: 1740483 - RNA, 15 nt, Salmonella enterica enterica serovar Typhi Ty2
gcccaaccagcccag

SEQ ID NO: 1740484 - RNA, 20 nt, Salmonella enterica enterica serovar Typhi Ty2
gccauuuuaaaaauauccug

SEQ ID NO: 1740485 - RNA, 14 nt, Salmonella enterica enterica serovar Typhi Ty2
gccauuugcauccg

SEQ ID NO: 1740486 - RNA, 15 nt, Salmonella enterica enterica serovar Typhi Ty2
gccauuuacgccaac

SEQ ID NO: 1740487 - RNA, 18 nt, Salmonella enterica enterica serovar Typhi Ty2
gccauugccaguaccgac

SEQ ID NO: 1740488 - RNA, 18 nt, Salmonella enterica enterica serovar Typhi Ty2
gccauuggcaaucaguac

SEQ ID NO: 1740489 - RNA, 13 nt, Salmonella enterica enterica serovar Typhi Ty2
gccauugcgacga

SEQ ID NO: 1740490 - RNA, 21 nt, Salmonella enterica enterica serovar Typhi Ty2
gccaucuuucuuuucgcguuu

SEQ ID NO: 1740491 - RNA, 14 nt, Salmonella enterica enterica serovar Typhi Ty2
gccaucuuugcacc

SEQ ID NO: 1740492 - RNA, 18 nt, Salmonella enterica enterica serovar Typhi Ty2
gccaugaguaaugaccac

SEQ ID NO: 1740493 - RNA, 18 nt, Salmonella enterica enterica serovar Typhi Ty2
gccauuccccacgccauc

SEQ ID NO: 1740494 - RNA, 21 nt, Salmonella enterica enterica serovar Typhi Ty2
gccauuccccacgccaucgcg

SEQ ID NO: 1740495 - RNA, 17 nt, Salmonella enterica enterica serovar Typhi Ty2
gccauuaacgccaugac

SEQ ID NO: 1740496 - RNA, 23 nt, Salmonella enterica enterica serovar Typhi Ty2
gccauuaacgccaugacgccaag

SEQ ID NO: 1740497 - RNA, 16 nt, Salmonella enterica enterica serovar Typhi Ty2
gccauguuaauaccag

SEQ ID NO: 1740498 - RNA, 20 nt, Salmonella enterica enterica serovar Typhi Ty2
gccauauuuuuccagcgccu

SEQ ID NO: 1740499 - RNA, 23 nt, Salmonella enterica enterica serovar Typhi Ty2
gccauauuuaacauagcuaccgc

SEQ ID NO: 1740500 - RNA, 22 nt, Salmonella enterica enterica serovar Typhi Ty2
gccaucagcaaaauaccggcag

SEQ ID NO: 1740501 - RNA, 18 nt, Salmonella enterica enterica serovar Typhi Ty2
gccaucacaccaacgcug

SEQ ID NO: 1740502 - RNA, 14 nt, Salmonella enterica enterica serovar Typhi Ty2
gccauagcgcuaug

SEQ ID NO: 1740503 - RNA, 16 nt, Salmonella enterica enterica serovar Typhi Ty2
gccauacuuacugcug

SEQ ID NO: 1740504 - RNA, 14 nt, Salmonella enterica enterica serovar Typhi Ty2
gccaucgcugacga

SEQ ID NO: 1740505 - RNA, 18 nt, Salmonella enterica enterica serovar Typhi Ty2
gccaucaggcaaucuuua

SEQ ID NO: 1740506 - RNA, 17 nt, Salmonella enterica enterica serovar Typhi Ty2
gccauccaccaggcaug

SEQ ID NO: 1740507 - RNA, 19 nt, Salmonella enterica enterica serovar Typhi Ty2
gccaucauuaauuuacuga

SEQ ID NO: 1740508 - RNA, 14 nt, Salmonella enterica enterica serovar Typhi Ty2
gccaucccggcgac

SEQ ID NO: 1740509 - RNA, 20 nt, Salmonella enterica enterica serovar Typhi Ty2
gccgaauggcgggccuacgc

SEQ ID NO: 1740510 - RNA, 16 nt, Salmonella enterica enterica serovar Typhi Ty2
gcccuauaacagcgcu

SEQ ID NO: 1740511 - RNA, 22 nt, Salmonella enterica enterica serovar Typhi Ty2
gccgaauagcugauaaacagcu

SEQ ID NO: 1740512 - RNA, 14 nt, Salmonella enterica enterica serovar Typhi Ty2
gccgaccaucgcgc

SEQ ID NO: 1740513 - RNA, 14 nt, Salmonella enterica enterica serovar Typhi Ty2
gccgaccuggcggu

SEQ ID NO: 1740514 - RNA, 18 nt, Salmonella enterica enterica serovar Typhi Ty2
gccgagaguccagcgcca

SEQ ID NO: 1740515 - RNA, 19 nt, Salmonella enterica enterica serovar Typhi Ty2
gccgagcauuuccgcagcc

SEQ ID NO: 1740516 - RNA, 21 nt, Salmonella enterica enterica serovar Typhi Ty2
gccgauaacucuucaucgcgc

SEQ ID NO: 1740517 - RNA, 14 nt, Salmonella enterica enterica serovar Typhi Ty2
gccgauaccggcaa

SEQ ID NO: 1740518 - RNA, 14 nt, Salmonella enterica enterica serovar Typhi Ty2
gccgaucagcacca

SEQ ID NO: 1740519 - RNA, 16 nt, Salmonella enterica enterica serovar Typhi Ty2
gccgaucagcgccauu

SEQ ID NO: 1740520 - RNA, 14 nt, Salmonella enterica enterica serovar Typhi Ty2
gccgcaacggucgg

SEQ ID NO: 1740521 - RNA, 15 nt, Salmonella enterica enterica serovar Typhi Ty2
gccgcagcgccauaa

SEQ ID NO: 1740522 - RNA, 17 nt, Salmonella enterica enterica serovar Typhi Ty2
gccgcaaauacuuuggc

SEQ ID NO: 1740523 - RNA, 19 nt, Salmonella enterica enterica serovar Typhi Ty2
gccgcaaacggaauagcgc

SEQ ID NO: 1740524 - RNA, 19 nt, Salmonella enterica enterica serovar Typhi Ty2
gccgcaaacgccugcuccg

SEQ ID NO: 1740525 - RNA, 13 nt, Salmonella enterica enterica serovar Typhi Ty2
gccgauuucacgc

SEQ ID NO: 1740526 - RNA, 19 nt, Salmonella enterica enterica serovar Typhi Ty2
gccgccgguguuuccguca

SEQ ID NO: 1740527 - RNA, 17 nt, Salmonella enterica enterica serovar Typhi Ty2
gccgccggugacggcgg

SEQ ID NO: 1740528 - RNA, 14 nt, Salmonella enterica enterica serovar Typhi Ty2
gccgcgacgcgcga

SEQ ID NO: 1740529 - RNA, 13 nt, Salmonella enterica enterica serovar Typhi Ty2
gccgccggaaauu

SEQ ID NO: 1740530 - RNA, 12 nt, Salmonella enterica enterica serovar Typhi Ty2
gccgccggacca

SEQ ID NO: 1740531 - RNA, 14 nt, Salmonella enterica enterica serovar Typhi Ty2
gccgcccugcauca

SEQ ID NO: 1740532 - RNA, 16 nt, Salmonella enterica enterica serovar Typhi Ty2
gccgcccugcaucaug

SEQ ID NO: 1740533 - RNA, 16 nt, Salmonella enterica enterica serovar Typhi Ty2
gccgcccuccggcaca

SEQ ID NO: 1740534 - RNA, 21 nt, Salmonella enterica enterica serovar Typhi Ty2
gccgccaggcauguuaugaau

SEQ ID NO: 1740535 - RNA, 15 nt, Salmonella enterica enterica serovar Typhi Ty2
gccgccauggcgaau

SEQ ID NO: 1740536 - RNA, 14 nt, Salmonella enterica enterica serovar Typhi Ty2
gccgccauggcgaa

SEQ ID NO: 1740537 - RNA, 15 nt, Salmonella enterica enterica serovar Typhi Ty2
gccgccauuugcgcg

SEQ ID NO: 1740538 - RNA, 16 nt, Salmonella enterica enterica serovar Typhi Ty2
gccgcccaacagggcg

SEQ ID NO: 1740539 - RNA, 14 nt, Salmonella enterica enterica serovar Typhi Ty2
gccgccaaagcgcc

SEQ ID NO: 1740540 - RNA, 22 nt, Salmonella enterica enterica serovar Typhi Ty2
gccgcauggagcaucagcgccg

SEQ ID NO: 1740541 - RNA, 16 nt, Salmonella enterica enterica serovar Typhi Ty2
gccgcaucggcccugu

SEQ ID NO: 1740542 - RNA, 19 nt, Salmonella enterica enterica serovar Typhi Ty2
gccgcauggagcaucagcg

SEQ ID NO: 1740543 - RNA, 23 nt, Salmonella enterica enterica serovar Typhi Ty2
gccgcaucgauaucuuuauucgc

SEQ ID NO: 1740544 - RNA, 23 nt, Salmonella enterica enterica serovar Typhi Ty2
gccgcauaauccagcaggugcgg

SEQ ID NO: 1740545 - RNA, 17 nt, Salmonella enterica enterica serovar Typhi Ty2
gccgcaggacagcgaca

SEQ ID NO: 1740546 - RNA, 14 nt, Salmonella enterica enterica serovar Typhi Ty2
gccggcggcggaau

SEQ ID NO: 1740547 - RNA, 14 nt, Salmonella enterica enterica serovar Typhi Ty2
gccggcguuccgca

SEQ ID NO: 1740548 - RNA, 17 nt, Salmonella enterica enterica serovar Typhi Ty2
gccggcgucaucggcgc

SEQ ID NO: 1740549 - RNA, 21 nt, Salmonella enterica enterica serovar Typhi Ty2
gccggcgucaucggcgccagc

SEQ ID NO: 1740550 - RNA, 15 nt, Salmonella enterica enterica serovar Typhi Ty2
gccggccugauaagc

SEQ ID NO: 1740551 - RNA, 16 nt, Salmonella enterica enterica serovar Typhi Ty2
gccgcgcuuucaguaa

SEQ ID NO: 1740552 - RNA, 22 nt, Salmonella enterica enterica serovar Typhi Ty2
gccgcgcuccaucauaucgcgc

SEQ ID NO: 1740553 - RNA, 21 nt, Salmonella enterica enterica serovar Typhi Ty2
gccgcuacguaauucaugcaa

SEQ ID NO: 1740554 - RNA, 15 nt, Salmonella enterica enterica serovar Typhi Ty2
gccgcguuuuagcaa

SEQ ID NO: 1740555 - RNA, 18 nt, Salmonella enterica enterica serovar Typhi Ty2
gccgcuagcugcagcgcu

SEQ ID NO: 1740556 - RNA, 14 nt, Salmonella enterica enterica serovar Typhi Ty2
gccgcugauccgcc

SEQ ID NO: 1740557 - RNA, 17 nt, Salmonella enterica enterica serovar Typhi Ty2
gccggauggcaacgcca

SEQ ID NO: 1740558 - RNA, 19 nt, Salmonella enterica enterica serovar Typhi Ty2
gccggauagcguagcgcca

SEQ ID NO: 1740559 - RNA, 15 nt, Salmonella enterica enterica serovar Typhi Ty2
gccggauaucgcuau

SEQ ID NO: 1740560 - RNA, 23 nt, Salmonella enterica enterica serovar Typhi Ty2
gccggauagcggcuucgccagau

SEQ ID NO: 1740561 - RNA, 22 nt, Salmonella enterica enterica serovar Typhi Ty2
gccggauuuuacauagcagcaa

SEQ ID NO: 1740562 - RNA, 23 nt, Salmonella enterica enterica serovar Typhi Ty2
gccggauuuaccagcgcuucugu

SEQ ID NO: 1740563 - RNA, 21 nt, Salmonella enterica enterica serovar Typhi Ty2
gccggaaagacggcagcgcca

SEQ ID NO: 1740564 - RNA, 21 nt, Salmonella enterica enterica serovar Typhi Ty2
gccggaaaagcgcuggcuggc

SEQ ID NO: 1740565 - RNA, 14 nt, Salmonella enterica enterica serovar Typhi Ty2
gccgcuuauccggc

SEQ ID NO: 1740566 - RNA, 19 nt, Salmonella enterica enterica serovar Typhi Ty2
gccggagaguucauaacgc

SEQ ID NO: 1740567 - RNA, 21 nt, Salmonella enterica enterica serovar Typhi Ty2
gccggauaagcguagcgccau

SEQ ID NO: 1740568 - RNA, 16 nt, Salmonella enterica enterica serovar Typhi Ty2
gccggagcugauacgg

SEQ ID NO: 1740569 - RNA, 14 nt, Salmonella enterica enterica serovar Typhi Ty2
gccggauaaggcau

SEQ ID NO: 1740570 - RNA, 15 nt, Salmonella enterica enterica serovar Typhi Ty2
gccggaagcgcgaau

SEQ ID NO: 1740571 - RNA, 19 nt, Salmonella enterica enterica serovar Typhi Ty2
gccggaaauuugcagcgcu

SEQ ID NO: 1740572 - RNA, 13 nt, Salmonella enterica enterica serovar Typhi Ty2
gcaucgucugcac

SEQ ID NO: 1740573 - RNA, 22 nt, Salmonella enterica enterica serovar Typhi Ty2
gcaucgugguuaauacaucaac

SEQ ID NO: 1740574 - RNA, 19 nt, Salmonella enterica enterica serovar Typhi Ty2
gcaucugcauaauggcgac

SEQ ID NO: 1740575 - RNA, 19 nt, Salmonella enterica enterica serovar Typhi Ty2
gcaucgcguuauugaccau

SEQ ID NO: 1740576 - RNA, 13 nt, Salmonella enterica enterica serovar Typhi Ty2
gcaucggaaccgg

SEQ ID NO: 1740577 - RNA, 14 nt, Salmonella enterica enterica serovar Typhi Ty2
gcaucguacgggca

SEQ ID NO: 1740578 - RNA, 17 nt, Salmonella enterica enterica serovar Typhi Ty2
gcaucguaagccgcauu

SEQ ID NO: 1740579 - RNA, 15 nt, Salmonella enterica enterica serovar Typhi Ty2
gcaucgguagaauga

SEQ ID NO: 1740580 - RNA, 16 nt, Salmonella enterica enterica serovar Typhi Ty2
gcaugcggggggcaac

SEQ ID NO: 1740581 - RNA, 20 nt, Salmonella enterica enterica serovar Typhi Ty2
gcauggagcaucagcgccgg

SEQ ID NO: 1740582 - RNA, 19 nt, Salmonella enterica enterica serovar Typhi Ty2
gcaugacaauaacggccuc

SEQ ID NO: 1740583 - RNA, 17 nt, Salmonella enterica enterica serovar Typhi Ty2
gcaugagcacgcggaag

SEQ ID NO: 1740584 - RNA, 19 nt, Salmonella enterica enterica serovar Typhi Ty2
gcaugggcagcuugccgcc

SEQ ID NO: 1740585 - RNA, 22 nt, Salmonella enterica enterica serovar Typhi Ty2
gcauguuugccugagcgcgaac

SEQ ID NO: 1740586 - RNA, 17 nt, Salmonella enterica enterica serovar Typhi Ty2
gcauuaaaugcgcccag

SEQ ID NO: 1740587 - RNA, 17 nt, Salmonella enterica enterica serovar Typhi Ty2
gcauugcgauaugcugu

SEQ ID NO: 1740588 - RNA, 17 nt, Salmonella enterica enterica serovar Typhi Ty2
gcauuaucgaugcguau

SEQ ID NO: 1740589 - RNA, 15 nt, Salmonella enterica enterica serovar Typhi Ty2
gcauuaccgcuauuc

SEQ ID NO: 1740590 - RNA, 18 nt, Salmonella enterica enterica serovar Typhi Ty2
gcauuacccccgccauaa

SEQ ID NO: 1740591 - RNA, 15 nt, Salmonella enterica enterica serovar Typhi Ty2
gccaacgccagcagc

SEQ ID NO: 1740592 - RNA, 12 nt, Salmonella enterica enterica serovar Typhi Ty2
gccaacgccaac

SEQ ID NO: 1740593 - RNA, 22 nt, Salmonella enterica enterica serovar Typhi Ty2
gccaacauguaauuacggcaca

SEQ ID NO: 1740594 - RNA, 15 nt, Salmonella enterica enterica serovar Typhi Ty2
gccaacaacaggccg

SEQ ID NO: 1740595 - RNA, 14 nt, Salmonella enterica enterica serovar Typhi Ty2
gccaaauagcgcca

SEQ ID NO: 1740596 - RNA, 18 nt, Salmonella enterica enterica serovar Typhi Ty2
gccaaaguuaaucagcgc

SEQ ID NO: 1740597 - RNA, 20 nt, Salmonella enterica enterica serovar Typhi Ty2
gccaaagucauugcugccag

SEQ ID NO: 1740598 - RNA, 21 nt, Salmonella enterica enterica serovar Typhi Ty2
gccaaagcgauccggcaucca

SEQ ID NO: 1740599 - RNA, 13 nt, Salmonella enterica enterica serovar Typhi Ty2
gccaaaauaugcu

SEQ ID NO: 1740600 - RNA, 19 nt, Salmonella enterica enterica serovar Typhi Ty2
gcauuuuuaucaucugcau

SEQ ID NO: 1740601 - RNA, 22 nt, Salmonella enterica enterica serovar Typhi Ty2
gcauuuuucauggugaacaugg

SEQ ID NO: 1740602 - RNA, 18 nt, Salmonella enterica enterica serovar Typhi Ty2
gccaaaaucgauagcggu

SEQ ID NO: 1740603 - RNA, 17 nt, Salmonella enterica enterica serovar Typhi Ty2
gcauuuaugccgccauc

SEQ ID NO: 1740604 - RNA, 17 nt, Salmonella enterica enterica serovar Typhi Ty2
gcauuggcaucugucau

SEQ ID NO: 1740605 - RNA, 16 nt, Salmonella enterica enterica serovar Typhi Ty2
gcauagccccagcgca

SEQ ID NO: 1740606 - RNA, 18 nt, Salmonella enterica enterica serovar Typhi Ty2
gcauagcgggagauugaa

SEQ ID NO: 1740607 - RNA, 12 nt, Salmonella enterica enterica serovar Typhi Ty2
gcauaagcgcga

SEQ ID NO: 1740608 - RNA, 17 nt, Salmonella enterica enterica serovar Typhi Ty2
gcauaaauuggcucaga

SEQ ID NO: 1740609 - RNA, 16 nt, Salmonella enterica enterica serovar Typhi Ty2
gcauaaugcagccauc

SEQ ID NO: 1740610 - RNA, 22 nt, Salmonella enterica enterica serovar Typhi Ty2
gcauaaaccggcggccuaccag

SEQ ID NO: 1740611 - RNA, 19 nt, Salmonella enterica enterica serovar Typhi Ty2
gcauaaaaccgccgcccau

SEQ ID NO: 1740612 - RNA, 22 nt, Salmonella enterica enterica serovar Typhi Ty2
gcaguuugcgaaaagccggaau

SEQ ID NO: 1740613 - RNA, 24 nt, Salmonella enterica enterica serovar Typhi Ty2
gcaguucugaagcuaaccgcgcaa

SEQ ID NO: 1740614 - RNA, 21 nt, Salmonella enterica enterica serovar Typhi Ty2
gcaguucuucgccguuaucgg

SEQ ID NO: 1740615 - RNA, 16 nt, Salmonella enterica enterica serovar Typhi Ty2
gcaucgacguucagca

SEQ ID NO: 1740616 - RNA, 17 nt, Salmonella enterica enterica serovar Typhi Ty2
gcaucgacguucagcau

SEQ ID NO: 1740617 - RNA, 13 nt, Salmonella enterica enterica serovar Typhi Ty2
gcaucgacgccag

SEQ ID NO: 1740618 - RNA, 15 nt, Salmonella enterica enterica serovar Typhi Ty2
gcaucgauuccgccu

SEQ ID NO: 1740619 - RNA, 14 nt, Salmonella enterica enterica serovar Typhi Ty2
gcaucgccgcccag

SEQ ID NO: 1740620 - RNA, 12 nt, Salmonella enterica enterica serovar Typhi Ty2
gcaucgccgcaa

SEQ ID NO: 1740621 - RNA, 16 nt, Salmonella enterica enterica serovar Typhi Ty2
gcaucccggucaacgu

SEQ ID NO: 1740622 - RNA, 13 nt, Salmonella enterica enterica serovar Typhi Ty2
gcaucccguuaug

SEQ ID NO: 1740623 - RNA, 19 nt, Salmonella enterica enterica serovar Typhi Ty2
gcauagcuggcguagccag

SEQ ID NO: 1740624 - RNA, 16 nt, Salmonella enterica enterica serovar Typhi Ty2
gcauagcuguuccgca

SEQ ID NO: 1740625 - RNA, 18 nt, Salmonella enterica enterica serovar Typhi Ty2
gcaucaaugcccagcgca

SEQ ID NO: 1740626 - RNA, 15 nt, Salmonella enterica enterica serovar Typhi Ty2
gcaucaauggcguca

SEQ ID NO: 1740627 - RNA, 12 nt, Salmonella enterica enterica serovar Typhi Ty2
gcaucaccggau

SEQ ID NO: 1740628 - RNA, 17 nt, Salmonella enterica enterica serovar Typhi Ty2
gcagguaucguauccgg

SEQ ID NO: 1740629 - RNA, 19 nt, Salmonella enterica enterica serovar Typhi Ty2
gcaggcaguuuauucagaa

SEQ ID NO: 1740630 - RNA, 17 nt, Salmonella enterica enterica serovar Typhi Ty2
gcagcggcgguuauccg

SEQ ID NO: 1740631 - RNA, 20 nt, Salmonella enterica enterica serovar Typhi Ty2
gcagcggcgguuauccgcca

SEQ ID NO: 1740632 - RNA, 14 nt, Salmonella enterica enterica serovar Typhi Ty2
gcagcgcugaaucg

SEQ ID NO: 1740633 - RNA, 17 nt, Salmonella enterica enterica serovar Typhi Ty2
gcagcgcgaacaggcug

SEQ ID NO: 1740634 - RNA, 14 nt, Salmonella enterica enterica serovar Typhi Ty2
gcagcgcgauacgc

SEQ ID NO: 1740635 - RNA, 14 nt, Salmonella enterica enterica serovar Typhi Ty2
gcagcgcaucaggc

SEQ ID NO: 1740636 - RNA, 15 nt, Salmonella enterica enterica serovar Typhi Ty2
gcagcgcaucauggu

SEQ ID NO: 1740637 - RNA, 16 nt, Salmonella enterica enterica serovar Typhi Ty2
gcagcgaugacagcag

SEQ ID NO: 1740638 - RNA, 23 nt, Salmonella enterica enterica serovar Typhi Ty2
gcagcccugcgucgcguaccagc

SEQ ID NO: 1740639 - RNA, 13 nt, Salmonella enterica enterica serovar Typhi Ty2
gcagccccggcau

SEQ ID NO: 1740640 - RNA, 14 nt, Salmonella enterica enterica serovar Typhi Ty2
gcagaccggcagcc

SEQ ID NO: 1740641 - RNA, 23 nt, Salmonella enterica enterica serovar Typhi Ty2
gcagacaugaccgcacagcagac

SEQ ID NO: 1740642 - RNA, 13 nt, Salmonella enterica enterica serovar Typhi Ty2
gcagacaucgcgc

SEQ ID NO: 1740643 - RNA, 20 nt, Salmonella enterica enterica serovar Typhi Ty2
gcagaccuguucuguaggcu

SEQ ID NO: 1740644 - RNA, 19 nt, Salmonella enterica enterica serovar Typhi Ty2
gcagacgcucgacgaagcc

SEQ ID NO: 1740645 - RNA, 17 nt, Salmonella enterica enterica serovar Typhi Ty2
gcagaaguaaauccggc

SEQ ID NO: 1740646 - RNA, 22 nt, Salmonella enterica enterica serovar Typhi Ty2
gcagaauuaacucaucacagcc

SEQ ID NO: 1740647 - RNA, 14 nt, Salmonella enterica enterica serovar Typhi Ty2
gcagacagccgauc

SEQ ID NO: 1740648 - RNA, 13 nt, Salmonella enterica enterica serovar Typhi Ty2
gcacuuuuaucgg

SEQ ID NO: 1740649 - RNA, 15 nt, Salmonella enterica enterica serovar Typhi Ty2
gcagcagcgcaaugc

SEQ ID NO: 1740650 - RNA, 18 nt, Salmonella enterica enterica serovar Typhi Ty2
gcagacuaaaaagcgcgu

SEQ ID NO: 1740651 - RNA, 20 nt, Salmonella enterica enterica serovar Typhi Ty2
gcagacgugcaauaucgcgg

SEQ ID NO: 1740652 - RNA, 20 nt, Salmonella enterica enterica serovar Typhi Ty2
gcagacuuucugacaggucg

SEQ ID NO: 1740653 - RNA, 23 nt, Salmonella enterica enterica serovar Typhi Ty2
gcagcaaaccgauaaucaccagc

SEQ ID NO: 1740654 - RNA, 15 nt, Salmonella enterica enterica serovar Typhi Ty2
gcagcaaacgccaua

SEQ ID NO: 1740655 - RNA, 21 nt, Salmonella enterica enterica serovar Typhi Ty2
gcacugcuuccugccgcgauc

SEQ ID NO: 1740656 - RNA, 18 nt, Salmonella enterica enterica serovar Typhi Ty2
gcacugcgcuuauccggc

SEQ ID NO: 1740657 - RNA, 14 nt, Salmonella enterica enterica serovar Typhi Ty2
gcacuucgcugaua

SEQ ID NO: 1740658 - RNA, 15 nt, Salmonella enterica enterica serovar Typhi Ty2
gcacuuccagccacg

SEQ ID NO: 1740659 - RNA, 14 nt, Salmonella enterica enterica serovar Typhi Ty2
gcacuucagaacgg

SEQ ID NO: 1740660 - RNA, 21 nt, Salmonella enterica enterica serovar Typhi Ty2
gcacuguggugugccugcgcu

SEQ ID NO: 1740661 - RNA, 21 nt, Salmonella enterica enterica serovar Typhi Ty2
gcacguguguugcgucaacgc

SEQ ID NO: 1740662 - RNA, 20 nt, Salmonella enterica enterica serovar Typhi Ty2
gcacguuaaagccgaccauc

SEQ ID NO: 1740663 - RNA, 18 nt, Salmonella enterica enterica serovar Typhi Ty2
gcacgcccauauccagcu

SEQ ID NO: 1740664 - RNA, 21 nt, Salmonella enterica enterica serovar Typhi Ty2
gcaccguuucuuugcugccgu

SEQ ID NO: 1740665 - RNA, 20 nt, Salmonella enterica enterica serovar Typhi Ty2
gcaacguuaaggccgcaaac

SEQ ID NO: 1740666 - RNA, 15 nt, Salmonella enterica enterica serovar Typhi Ty2
gcaacguaaucccgc

SEQ ID NO: 1740667 - RNA, 15 nt, Salmonella enterica enterica serovar Typhi Ty2
gcaacguccgcagcc

SEQ ID NO: 1740668 - RNA, 17 nt, Salmonella enterica enterica serovar Typhi Ty2
gcaacgcgccauccggc

SEQ ID NO: 1740669 - RNA, 13 nt, Salmonella enterica enterica serovar Typhi Ty2
gcaacgcgccauc

SEQ ID NO: 1740670 - RNA, 14 nt, Salmonella enterica enterica serovar Typhi Ty2
gcaacggcagccag

SEQ ID NO: 1740671 - RNA, 17 nt, Salmonella enterica enterica serovar Typhi Ty2
gcaacggcaagccggua

SEQ ID NO: 1740672 - RNA, 14 nt, Salmonella enterica enterica serovar Typhi Ty2
gcaacggcgcuaag

SEQ ID NO: 1740673 - RNA, 18 nt, Salmonella enterica enterica serovar Typhi Ty2
gcaaccgucucaccaggc

SEQ ID NO: 1740674 - RNA, 17 nt, Salmonella enterica enterica serovar Typhi Ty2
gcaaccgugaccgcguu

SEQ ID NO: 1740675 - RNA, 21 nt, Salmonella enterica enterica serovar Typhi Ty2
gcaacaacaguugcagcaccu

SEQ ID NO: 1740676 - RNA, 15 nt, Salmonella enterica enterica serovar Typhi Ty2
gcaacaggccgcauc

SEQ ID NO: 1740677 - RNA, 21 nt, Salmonella enterica enterica serovar Typhi Ty2
gcaacauaaauaaacagcgcc

SEQ ID NO: 1740678 - RNA, 19 nt, Salmonella enterica enterica serovar Typhi Ty2
gcaacagguaccccgccac

SEQ ID NO: 1740679 - RNA, 15 nt, Salmonella enterica enterica serovar Typhi Ty2
gcaacauccgaaagc

SEQ ID NO: 1740680 - RNA, 17 nt, Salmonella enterica enterica serovar Typhi Ty2
gcaacauucugcuucca

SEQ ID NO: 1740681 - RNA, 18 nt, Salmonella enterica enterica serovar Typhi Ty2
gcaaccccuugcggugca

SEQ ID NO: 1740682 - RNA, 12 nt, Salmonella enterica enterica serovar Typhi Ty2
gcaacccggcua

SEQ ID NO: 1740683 - RNA, 20 nt, Salmonella enterica enterica serovar Typhi Ty2
gcaaccgcaucacgcgaagc

SEQ ID NO: 1740684 - RNA, 11 nt, Salmonella enterica enterica serovar Typhi Ty2
gcaauccgcgc

SEQ ID NO: 1740685 - RNA, 17 nt, Salmonella enterica enterica serovar Typhi Ty2
gcaaucuggcgcaaugc

SEQ ID NO: 1740686 - RNA, 12 nt, Salmonella enterica enterica serovar Typhi Ty2
gcaaucaucaga

SEQ ID NO: 1740687 - RNA, 18 nt, Salmonella enterica enterica serovar Typhi Ty2
gcaagucgcgggcgcuaa

SEQ ID NO: 1740688 - RNA, 13 nt, Salmonella enterica enterica serovar Typhi Ty2
gcaaucagcagcc

SEQ ID NO: 1740689 - RNA, 22 nt, Salmonella enterica enterica serovar Typhi Ty2
gcaauucagguaauacgcgucu

SEQ ID NO: 1740690 - RNA, 23 nt, Salmonella enterica enterica serovar Typhi Ty2
gcaauuccgcuuucuucccggca

SEQ ID NO: 1740691 - RNA, 16 nt, Salmonella enterica enterica serovar Typhi Ty2
gcaauguucaauauca

SEQ ID NO: 1740692 - RNA, 12 nt, Salmonella enterica enterica serovar Typhi Ty2
gcaaugaccaca

SEQ ID NO: 1740693 - RNA, 18 nt, Salmonella enterica enterica serovar Typhi Ty2
gcaaugccaccagcgcca

SEQ ID NO: 1740694 - RNA, 22 nt, Salmonella enterica enterica serovar Typhi Ty2
gcaaugauuuuaucaagucgcg

SEQ ID NO: 1740695 - RNA, 17 nt, Salmonella enterica enterica serovar Typhi Ty2
gcaaugauaacggcgcc

SEQ ID NO: 1740696 - RNA, 16 nt, Salmonella enterica enterica serovar Typhi Ty2
gcaaugaucagcgacg

SEQ ID NO: 1740697 - RNA, 21 nt, Salmonella enterica enterica serovar Typhi Ty2
gcaauuucucgcccgccagau

SEQ ID NO: 1740698 - RNA, 19 nt, Salmonella enterica enterica serovar Typhi Ty2
gcaagccgaacucuuccac

SEQ ID NO: 1740699 - RNA, 18 nt, Salmonella enterica enterica serovar Typhi Ty2
gcaagcggcugucaucaa

SEQ ID NO: 1740700 - RNA, 18 nt, Salmonella enterica enterica serovar Typhi Ty2
gcaagcgcugggcgauaa

SEQ ID NO: 1740701 - RNA, 15 nt, Salmonella enterica enterica serovar Typhi Ty2
gcaacugccggcuua

SEQ ID NO: 1740702 - RNA, 19 nt, Salmonella enterica enterica serovar Typhi Ty2
gcaacugcugcgcgugcug

SEQ ID NO: 1740703 - RNA, 22 nt, Salmonella enterica enterica serovar Typhi Ty2
gcaagacacagcgucgcgcgau

SEQ ID NO: 1740704 - RNA, 20 nt, Salmonella enterica enterica serovar Typhi Ty2
gcaaaggaccaacaccagcc

SEQ ID NO: 1740705 - RNA, 16 nt, Salmonella enterica enterica serovar Typhi Ty2
gcaaagguugccgcaa

SEQ ID NO: 1740706 - RNA, 18 nt, Salmonella enterica enterica serovar Typhi Ty2
gcaaaggaaugcuuuaca

SEQ ID NO: 1740707 - RNA, 18 nt, Salmonella enterica enterica serovar Typhi Ty2
gcaaagcccaucagcgcc

SEQ ID NO: 1740708 - RNA, 20 nt, Salmonella enterica enterica serovar Typhi Ty2
gcaaagucuuuuguauugcg

SEQ ID NO: 1740709 - RNA, 19 nt, Salmonella enterica enterica serovar Typhi Ty2
gcaaauccaucucaggccg

SEQ ID NO: 1740710 - RNA, 17 nt, Salmonella enterica enterica serovar Typhi Ty2
gcaaaucgccaucagcg

SEQ ID NO: 1740711 - RNA, 17 nt, Salmonella enterica enterica serovar Typhi Ty2
gcaaaugauaauaugcu

SEQ ID NO: 1740712 - RNA, 19 nt, Salmonella enterica enterica serovar Typhi Ty2
gcaaauugagaccauccug

SEQ ID NO: 1740713 - RNA, 15 nt, Salmonella enterica enterica serovar Typhi Ty2
gcaaauuuaagccag

SEQ ID NO: 1740714 - RNA, 16 nt, Salmonella enterica enterica serovar Typhi Ty2
gcaaacaguacgcccg

SEQ ID NO: 1740715 - RNA, 16 nt, Salmonella enterica enterica serovar Typhi Ty2
gcaaacagagcgccgg

SEQ ID NO: 1740716 - RNA, 22 nt, Salmonella enterica enterica serovar Typhi Ty2
gcaaaccaucgucggacaacgu

SEQ ID NO: 1740717 - RNA, 18 nt, Salmonella enterica enterica serovar Typhi Ty2
gcaaacccacccgguaau

SEQ ID NO: 1740718 - RNA, 21 nt, Salmonella enterica enterica serovar Typhi Ty2
gcaaaccgaauucguccacac

SEQ ID NO: 1740719 - RNA, 14 nt, Salmonella enterica enterica serovar Typhi Ty2
gcaaacccucaucg

SEQ ID NO: 1740720 - RNA, 16 nt, Salmonella enterica enterica serovar Typhi Ty2
gcaaacuauguacgcc

SEQ ID NO: 1740721 - RNA, 14 nt, Salmonella enterica enterica serovar Typhi Ty2
gauuucaucaggcu

SEQ ID NO: 1740722 - RNA, 13 nt, Salmonella enterica enterica serovar Typhi Ty2
gauuugcggcaau

SEQ ID NO: 1740723 - RNA, 20 nt, Salmonella enterica enterica serovar Typhi Ty2
gauuacuucaggcugccaac

SEQ ID NO: 1740724 - RNA, 17 nt, Salmonella enterica enterica serovar Typhi Ty2
gauuaucguccggcauc

SEQ ID NO: 1740725 - RNA, 20 nt, Salmonella enterica enterica serovar Typhi Ty2
gauuaugcgaaugcuggcug

SEQ ID NO: 1740726 - RNA, 15 nt, Salmonella enterica enterica serovar Typhi Ty2
gauugaaacgaaaac

SEQ ID NO: 1740727 - RNA, 13 nt, Salmonella enterica enterica serovar Typhi Ty2
gauuggucugauu

SEQ ID NO: 1740728 - RNA, 20 nt, Salmonella enterica enterica serovar Typhi Ty2
gauuggcuguuaguaagcug

SEQ ID NO: 1740729 - RNA, 17 nt, Salmonella enterica enterica serovar Typhi Ty2
gauucgcuacugcaucu

SEQ ID NO: 1740730 - RNA, 21 nt, Salmonella enterica enterica serovar Typhi Ty2
gauuccgugguuuguugcgcg

SEQ ID NO: 1740731 - RNA, 17 nt, Salmonella enterica enterica serovar Typhi Ty2
gauucgagcgcagcgag

SEQ ID NO: 1740732 - RNA, 23 nt, Salmonella enterica enterica serovar Typhi Ty2
gauggcgacuaacgucuuauccg

SEQ ID NO: 1740733 - RNA, 20 nt, Salmonella enterica enterica serovar Typhi Ty2
gauggccgguuauaccgcca

SEQ ID NO: 1740734 - RNA, 15 nt, Salmonella enterica enterica serovar Typhi Ty2
gaugcucgcucauca

SEQ ID NO: 1740735 - RNA, 20 nt, Salmonella enterica enterica serovar Typhi Ty2
gauggcacugcgcuuauccg

SEQ ID NO: 1740736 - RNA, 17 nt, Salmonella enterica enterica serovar Typhi Ty2
gauggccaaugaugcgc

SEQ ID NO: 1740737 - RNA, 19 nt, Salmonella enterica enterica serovar Typhi Ty2
gauggcgcgacgcuuauca

SEQ ID NO: 1740738 - RNA, 21 nt, Salmonella enterica enterica serovar Typhi Ty2
gauggcgcuaaugcuuauccg

SEQ ID NO: 1740739 - RNA, 22 nt, Salmonella enterica enterica serovar Typhi Ty2
gaugcggcuagcgccuuauccg

SEQ ID NO: 1740740 - RNA, 14 nt, Salmonella enterica enterica serovar Typhi Ty2
gaugcucgcucauc

SEQ ID NO: 1740741 - RNA, 19 nt, Salmonella enterica enterica serovar Typhi Ty2
gaugccgccgcaacgcgca

SEQ ID NO: 1740742 - RNA, 22 nt, Salmonella enterica enterica serovar Typhi Ty2
gaugccuggauaauaagacgcc

SEQ ID NO: 1740743 - RNA, 17 nt, Salmonella enterica enterica serovar Typhi Ty2
gaugccguugaccauau

SEQ ID NO: 1740744 - RNA, 22 nt, Salmonella enterica enterica serovar Typhi Ty2
gaucauccggguuaaaccagcu

SEQ ID NO: 1740745 - RNA, 20 nt, Salmonella enterica enterica serovar Typhi Ty2
gaucaucuucacuucacaaa

SEQ ID NO: 1740746 - RNA, 18 nt, Salmonella enterica enterica serovar Typhi Ty2
gaucaguggcgccgcaau

SEQ ID NO: 1740747 - RNA, 14 nt, Salmonella enterica enterica serovar Typhi Ty2
gaucaguuccggau

SEQ ID NO: 1740748 - RNA, 20 nt, Salmonella enterica enterica serovar Typhi Ty2
gaucaugaggaugagcguuu

SEQ ID NO: 1740749 - RNA, 15 nt, Salmonella enterica enterica serovar Typhi Ty2
gauccgccuuacgca

SEQ ID NO: 1740750 - RNA, 18 nt, Salmonella enterica enterica serovar Typhi Ty2
gauccagcgauugacggu

SEQ ID NO: 1740751 - RNA, 23 nt, Salmonella enterica enterica serovar Typhi Ty2
gauccuguaacgcauaagcgcga

SEQ ID NO: 1740752 - RNA, 20 nt, Salmonella enterica enterica serovar Typhi Ty2
gaucgauauccgugcgcaau

SEQ ID NO: 1740753 - RNA, 17 nt, Salmonella enterica enterica serovar Typhi Ty2
gaucgauauccgugcgc

SEQ ID NO: 1740754 - RNA, 15 nt, Salmonella enterica enterica serovar Typhi Ty2
gaucgaucccggcaa

SEQ ID NO: 1740755 - RNA, 17 nt, Salmonella enterica enterica serovar Typhi Ty2
gaucgauccacuuccca

SEQ ID NO: 1740756 - RNA, 16 nt, Salmonella enterica enterica serovar Typhi Ty2
gaucgccauccugcac

SEQ ID NO: 1740757 - RNA, 17 nt, Salmonella enterica enterica serovar Typhi Ty2
gaucggggcgaccggcu

SEQ ID NO: 1740758 - RNA, 20 nt, Salmonella enterica enterica serovar Typhi Ty2
gaucggcuggguuuccggau

SEQ ID NO: 1740759 - RNA, 14 nt, Salmonella enterica enterica serovar Typhi Ty2
gaucggcuggcgca

SEQ ID NO: 1740760 - RNA, 18 nt, Salmonella enterica enterica serovar Typhi Ty2
gaucuucaucccauccgg

SEQ ID NO: 1740761 - RNA, 18 nt, Salmonella enterica enterica serovar Typhi Ty2
gaucuuaucuuucagcgc

SEQ ID NO: 1740762 - RNA, 16 nt, Salmonella enterica enterica serovar Typhi Ty2
gaucugucgccaugac

SEQ ID NO: 1740763 - RNA, 17 nt, Salmonella enterica enterica serovar Typhi Ty2
gaugaagaacagcgucg

SEQ ID NO: 1740764 - RNA, 17 nt, Salmonella enterica enterica serovar Typhi Ty2
gagguauaggaaaauga

SEQ ID NO: 1740765 - RNA, 21 nt, Salmonella enterica enterica serovar Typhi Ty2
gaggcgugagcgaacaggucg

SEQ ID NO: 1740766 - RNA, 14 nt, Salmonella enterica enterica serovar Typhi Ty2
gaggccaccagcgc

SEQ ID NO: 1740767 - RNA, 16 nt, Salmonella enterica enterica serovar Typhi Ty2
gagguuuucucaucca

SEQ ID NO: 1740768 - RNA, 12 nt, Salmonella enterica enterica serovar Typhi Ty2
gagucguuaucc

SEQ ID NO: 1740769 - RNA, 18 nt, Salmonella enterica enterica serovar Typhi Ty2
gagugacgggcuggcgcu

SEQ ID NO: 1740770 - RNA, 20 nt, Salmonella enterica enterica serovar Typhi Ty2
gaguuaaugccaucaucagu

SEQ ID NO: 1740771 - RNA, 20 nt, Salmonella enterica enterica serovar Typhi Ty2
gaguuaacuucuccgccauc

SEQ ID NO: 1740772 - RNA, 14 nt, Salmonella enterica enterica serovar Typhi Ty2
gauaaacagcagcg

SEQ ID NO: 1740773 - RNA, 19 nt, Salmonella enterica enterica serovar Typhi Ty2
gauaaaauucccggcggaa

SEQ ID NO: 1740774 - RNA, 16 nt, Salmonella enterica enterica serovar Typhi Ty2
gauaaaaaaaguaucc

SEQ ID NO: 1740775 - RNA, 14 nt, Salmonella enterica enterica serovar Typhi Ty2
gaguuugucaucca

SEQ ID NO: 1740776 - RNA, 12 nt, Salmonella enterica enterica serovar Typhi Ty2
gauaaaucagcc

SEQ ID NO: 1740777 - RNA, 21 nt, Salmonella enterica enterica serovar Typhi Ty2
gauacaagguauccgccauau

SEQ ID NO: 1740778 - RNA, 21 nt, Salmonella enterica enterica serovar Typhi Ty2
gauacagaaaaccggcaaaua

SEQ ID NO: 1740779 - RNA, 19 nt, Salmonella enterica enterica serovar Typhi Ty2
gauaaaguacggcgcgcca

SEQ ID NO: 1740780 - RNA, 18 nt, Salmonella enterica enterica serovar Typhi Ty2
gauaaagcugacgcgccu

SEQ ID NO: 1740781 - RNA, 15 nt, Salmonella enterica enterica serovar Typhi Ty2
gauaaagcagcgaca

SEQ ID NO: 1740782 - RNA, 18 nt, Salmonella enterica enterica serovar Typhi Ty2
gauaaacgggaaguaagg

SEQ ID NO: 1740783 - RNA, 18 nt, Salmonella enterica enterica serovar Typhi Ty2
gauaaacucaaucaggcu

SEQ ID NO: 1740784 - RNA, 15 nt, Salmonella enterica enterica serovar Typhi Ty2
gauaaaccaggcagc

SEQ ID NO: 1740785 - RNA, 18 nt, Salmonella enterica enterica serovar Typhi Ty2
gauagagacugccgccgu

SEQ ID NO: 1740786 - RNA, 15 nt, Salmonella enterica enterica serovar Typhi Ty2
gauagacaugaccgg

SEQ ID NO: 1740787 - RNA, 22 nt, Salmonella enterica enterica serovar Typhi Ty2
gauagcacagcgcuaucaggca

SEQ ID NO: 1740788 - RNA, 19 nt, Salmonella enterica enterica serovar Typhi Ty2
gauacgauugcgcguguua

SEQ ID NO: 1740789 - RNA, 21 nt, Salmonella enterica enterica serovar Typhi Ty2
gauacgcagcaccgccgcgau

SEQ ID NO: 1740790 - RNA, 14 nt, Salmonella enterica enterica serovar Typhi Ty2
gauaguggcgaucu

SEQ ID NO: 1740791 - RNA, 20 nt, Salmonella enterica enterica serovar Typhi Ty2
gauaguggguauugaauccg

SEQ ID NO: 1740792 - RNA, 19 nt, Salmonella enterica enterica serovar Typhi Ty2
gauagcgcagcacgguaac

SEQ ID NO: 1740793 - RNA, 13 nt, Salmonella enterica enterica serovar Typhi Ty2
gauagcgccgcau

SEQ ID NO: 1740794 - RNA, 12 nt, Salmonella enterica enterica serovar Typhi Ty2
gauagccgccag

SEQ ID NO: 1740795 - RNA, 22 nt, Salmonella enterica enterica serovar Typhi Ty2
gauagcccggcauguccaucag

SEQ ID NO: 1740796 - RNA, 17 nt, Salmonella enterica enterica serovar Typhi Ty2
gauagccguucuccagc

SEQ ID NO: 1740797 - RNA, 16 nt, Salmonella enterica enterica serovar Typhi Ty2
gauagcgaggcguuuu

SEQ ID NO: 1740798 - RNA, 18 nt, Salmonella enterica enterica serovar Typhi Ty2
gauagcgacggcgcgcca

SEQ ID NO: 1740799 - RNA, 16 nt, Salmonella enterica enterica serovar Typhi Ty2
gaucagaccaucggcc

SEQ ID NO: 1740800 - RNA, 12 nt, Salmonella enterica enterica serovar Typhi Ty2
gauauuccgcgc

SEQ ID NO: 1740801 - RNA, 22 nt, Salmonella enterica enterica serovar Typhi Ty2
gauauugccgaccgccagcaga

SEQ ID NO: 1740802 - RNA, 13 nt, Salmonella enterica enterica serovar Typhi Ty2
gauauaagcgcca

SEQ ID NO: 1740803 - RNA, 18 nt, Salmonella enterica enterica serovar Typhi Ty2
gauauaucgcgucaucaa

SEQ ID NO: 1740804 - RNA, 15 nt, Salmonella enterica enterica serovar Typhi Ty2
gauauacuucaucag

SEQ ID NO: 1740805 - RNA, 17 nt, Salmonella enterica enterica serovar Typhi Ty2
gauaugcagcagccagu

SEQ ID NO: 1740806 - RNA, 19 nt, Salmonella enterica enterica serovar Typhi Ty2
gauaugcgacgaaagcggc

SEQ ID NO: 1740807 - RNA, 21 nt, Salmonella enterica enterica serovar Typhi Ty2
cagaacggcagcguccgccau

SEQ ID NO: 1740808 - RNA, 20 nt, Salmonella enterica enterica serovar Typhi Ty2
cagacaaucugugugggcac

SEQ ID NO: 1740809 - RNA, 20 nt, Salmonella enterica enterica serovar Typhi Ty2
cagacaauuuccgccgccag

SEQ ID NO: 1740810 - RNA, 13 nt, Salmonella enterica enterica serovar Typhi Ty2
cacucucuccagu

SEQ ID NO: 1740811 - RNA, 15 nt, Salmonella enterica enterica serovar Typhi Ty2
cacuucuuccagcgu

SEQ ID NO: 1740812 - RNA, 18 nt, Salmonella enterica enterica serovar Typhi Ty2
cagaccauucaaccagcc

SEQ ID NO: 1740813 - RNA, 22 nt, Salmonella enterica enterica serovar Typhi Ty2
cagaccccaguaauccggcaac

SEQ ID NO: 1740814 - RNA, 23 nt, Salmonella enterica enterica serovar Typhi Ty2
cagacagccauauuuaugcagcg

SEQ ID NO: 1740815 - RNA, 18 nt, Salmonella enterica enterica serovar Typhi Ty2
cagacacugccaccgcuc

SEQ ID NO: 1740816 - RNA, 21 nt, Salmonella enterica enterica serovar Typhi Ty2
cagacacggugugccgccauc

SEQ ID NO: 1740817 - RNA, 13 nt, Salmonella enterica enterica serovar Typhi Ty2
cagacacugccac

SEQ ID NO: 1740818 - RNA, 18 nt, Salmonella enterica enterica serovar Typhi Ty2
cagacaugaccgcacagc

SEQ ID NO: 1740819 - RNA, 17 nt, Salmonella enterica enterica serovar Typhi Ty2
cagacaugcgccggacg

SEQ ID NO: 1740820 - RNA, 15 nt, Salmonella enterica enterica serovar Typhi Ty2
cagacaggugaacau

SEQ ID NO: 1740821 - RNA, 18 nt, Salmonella enterica enterica serovar Typhi Ty2
cagacaucaucgaacgcc

SEQ ID NO: 1740822 - RNA, 20 nt, Salmonella enterica enterica serovar Typhi Ty2
cagacgaaaaaaaagacgcu

SEQ ID NO: 1740823 - RNA, 20 nt, Salmonella enterica enterica serovar Typhi Ty2
cagacgaagcgcaaacggau

SEQ ID NO: 1740824 - RNA, 21 nt, Salmonella enterica enterica serovar Typhi Ty2
cagaccuuaucgcagucagcc

SEQ ID NO: 1740825 - RNA, 13 nt, Salmonella enterica enterica serovar Typhi Ty2
cagacgccuuuca

SEQ ID NO: 1740826 - RNA, 15 nt, Salmonella enterica enterica serovar Typhi Ty2
cagaccggcagccug

SEQ ID NO: 1740827 - RNA, 13 nt, Salmonella enterica enterica serovar Typhi Ty2
cagaccgccaugc

SEQ ID NO: 1740828 - RNA, 19 nt, Salmonella enterica enterica serovar Typhi Ty2
cagaccuuaucgcagucag

SEQ ID NO: 1740829 - RNA, 17 nt, Salmonella enterica enterica serovar Typhi Ty2
cagaccgucaugacguc

SEQ ID NO: 1740830 - RNA, 15 nt, Salmonella enterica enterica serovar Typhi Ty2
cagaccgugcggcgu

SEQ ID NO: 1740831 - RNA, 19 nt, Salmonella enterica enterica serovar Typhi Ty2
cagaucccagguaaccgcu

SEQ ID NO: 1740832 - RNA, 21 nt, Salmonella enterica enterica serovar Typhi Ty2
cagauccaucgccugcggcgu

SEQ ID NO: 1740833 - RNA, 13 nt, Salmonella enterica enterica serovar Typhi Ty2
cagauaaccgucg

SEQ ID NO: 1740834 - RNA, 23 nt, Salmonella enterica enterica serovar Typhi Ty2
cagauaacaccagcgauccagau

SEQ ID NO: 1740835 - RNA, 18 nt, Salmonella enterica enterica serovar Typhi Ty2
cagauaacaccagcgauc

SEQ ID NO: 1740836 - RNA, 14 nt, Salmonella enterica enterica serovar Typhi Ty2
cagauaaaucagcc

SEQ ID NO: 1740837 - RNA, 18 nt, Salmonella enterica enterica serovar Typhi Ty2
cagaucggcaugauggcg

SEQ ID NO: 1740838 - RNA, 22 nt, Salmonella enterica enterica serovar Typhi Ty2
cagaucgccacgauugaucuca

SEQ ID NO: 1740839 - RNA, 22 nt, Salmonella enterica enterica serovar Typhi Ty2
cagauuggugaugcgcaacguu

SEQ ID NO: 1740840 - RNA, 22 nt, Salmonella enterica enterica serovar Typhi Ty2
cagauugauacggguaaucaga

SEQ ID NO: 1740841 - RNA, 14 nt, Salmonella enterica enterica serovar Typhi Ty2
cagaucuaucugaa

SEQ ID NO: 1740842 - RNA, 22 nt, Salmonella enterica enterica serovar Typhi Ty2
cagaucgguuuauccccgcugg

SEQ ID NO: 1740843 - RNA, 17 nt, Salmonella enterica enterica serovar Typhi Ty2
cagauuguugccgucuu

SEQ ID NO: 1740844 - RNA, 15 nt, Salmonella enterica enterica serovar Typhi Ty2
cagauuuagguucug

SEQ ID NO: 1740845 - RNA, 13 nt, Salmonella enterica enterica serovar Typhi Ty2
cagcaaaccgaua

SEQ ID NO: 1740846 - RNA, 21 nt, Salmonella enterica enterica serovar Typhi Ty2
cagcaaacgccauagcaucga

SEQ ID NO: 1740847 - RNA, 20 nt, Salmonella enterica enterica serovar Typhi Ty2
cagaguacuggaauaucuaa

SEQ ID NO: 1740848 - RNA, 13 nt, Salmonella enterica enterica serovar Typhi Ty2
cagaguccagcgg

SEQ ID NO: 1740849 - RNA, 14 nt, Salmonella enterica enterica serovar Typhi Ty2
cagaguacgucgcc

SEQ ID NO: 1740850 - RNA, 17 nt, Salmonella enterica enterica serovar Typhi Ty2
cagagcggggaaacucu

SEQ ID NO: 1740851 - RNA, 16 nt, Salmonella enterica enterica serovar Typhi Ty2
cagagcaucuaccgca

SEQ ID NO: 1740852 - RNA, 18 nt, Salmonella enterica enterica serovar Typhi Ty2
cagacuaaaaagcgcguc

SEQ ID NO: 1740853 - RNA, 15 nt, Salmonella enterica enterica serovar Typhi Ty2
cagacguuuaagcau

SEQ ID NO: 1740854 - RNA, 18 nt, Salmonella enterica enterica serovar Typhi Ty2
cagacgugcaauaucgcg

SEQ ID NO: 1740855 - RNA, 17 nt, Salmonella enterica enterica serovar Typhi Ty2
cagacuuagggcggaga

SEQ ID NO: 1740856 - RNA, 19 nt, Salmonella enterica enterica serovar Typhi Ty2
cagacugcacuuccugcgu

SEQ ID NO: 1740857 - RNA, 23 nt, Salmonella enterica enterica serovar Typhi Ty2
cagacggcgcuaauguacgccua

SEQ ID NO: 1740858 - RNA, 18 nt, Salmonella enterica enterica serovar Typhi Ty2
cagacggcaagcaaccgu

SEQ ID NO: 1740859 - RNA, 15 nt, Salmonella enterica enterica serovar Typhi Ty2
cagacgcgcagcacc

SEQ ID NO: 1740860 - RNA, 22 nt, Salmonella enterica enterica serovar Typhi Ty2
cacguuaaacaccucaccggcu

SEQ ID NO: 1740861 - RNA, 17 nt, Salmonella enterica enterica serovar Typhi Ty2
cacuaccauuuccggcg

SEQ ID NO: 1740862 - RNA, 20 nt, Salmonella enterica enterica serovar Typhi Ty2
cacuaacugccgcugaccgc

SEQ ID NO: 1740863 - RNA, 21 nt, Salmonella enterica enterica serovar Typhi Ty2
cacuauaaaaauaccggcauc

SEQ ID NO: 1740864 - RNA, 22 nt, Salmonella enterica enterica serovar Typhi Ty2
cacuacggcaaacgcuggugcu

SEQ ID NO: 1740865 - RNA, 19 nt, Salmonella enterica enterica serovar Typhi Ty2
cacuacgcagcuccagcuc

SEQ ID NO: 1740866 - RNA, 14 nt, Salmonella enterica enterica serovar Typhi Ty2
cacuaccaucggcg

SEQ ID NO: 1740867 - RNA, 13 nt, Salmonella enterica enterica serovar Typhi Ty2
cacgcugccgccg

SEQ ID NO: 1740868 - RNA, 21 nt, Salmonella enterica enterica serovar Typhi Ty2
cacgcugacaggauacccggc

SEQ ID NO: 1740869 - RNA, 16 nt, Salmonella enterica enterica serovar Typhi Ty2
cacgcugaaaacggca

SEQ ID NO: 1740870 - RNA, 14 nt, Salmonella enterica enterica serovar Typhi Ty2
cacgcguuauacgc

SEQ ID NO: 1740871 - RNA, 18 nt, Salmonella enterica enterica serovar Typhi Ty2
cacgcguucgcucgguga

SEQ ID NO: 1740872 - RNA, 20 nt, Salmonella enterica enterica serovar Typhi Ty2
cacgcggucgucaucggcga

SEQ ID NO: 1740873 - RNA, 23 nt, Salmonella enterica enterica serovar Typhi Ty2
cacgcucgaguucuucacgcuga

SEQ ID NO: 1740874 - RNA, 18 nt, Salmonella enterica enterica serovar Typhi Ty2
cacgcuuuucagcgccag

SEQ ID NO: 1740875 - RNA, 14 nt, Salmonella enterica enterica serovar Typhi Ty2
cacgcuucgccugu

SEQ ID NO: 1740876 - RNA, 21 nt, Salmonella enterica enterica serovar Typhi Ty2
cacgcuggauaagacgacggu

SEQ ID NO: 1740877 - RNA, 12 nt, Salmonella enterica enterica serovar Typhi Ty2
cacgcuggugcu

SEQ ID NO: 1740878 - RNA, 17 nt, Salmonella enterica enterica serovar Typhi Ty2
cacgccuaaugaagcgc

SEQ ID NO: 1740879 - RNA, 15 nt, Salmonella enterica enterica serovar Typhi Ty2
cacgccguuugccau

SEQ ID NO: 1740880 - RNA, 15 nt, Salmonella enterica enterica serovar Typhi Ty2
cacgccguccagcac

SEQ ID NO: 1740881 - RNA, 16 nt, Salmonella enterica enterica serovar Typhi Ty2
cacgcggcaucaggca

SEQ ID NO: 1740882 - RNA, 14 nt, Salmonella enterica enterica serovar Typhi Ty2
cacgcggcgcggaa

SEQ ID NO: 1740883 - RNA, 13 nt, Salmonella enterica enterica serovar Typhi Ty2
cacgccaucgcgg

SEQ ID NO: 1740884 - RNA, 16 nt, Salmonella enterica enterica serovar Typhi Ty2
caccuccagcgccugu

SEQ ID NO: 1740885 - RNA, 17 nt, Salmonella enterica enterica serovar Typhi Ty2
caccucaucacccaguc

SEQ ID NO: 1740886 - RNA, 15 nt, Salmonella enterica enterica serovar Typhi Ty2
cacgcccagcgccga

SEQ ID NO: 1740887 - RNA, 14 nt, Salmonella enterica enterica serovar Typhi Ty2
cacgcccacgcuga

SEQ ID NO: 1740888 - RNA, 13 nt, Salmonella enterica enterica serovar Typhi Ty2
cagcgccagcgac

SEQ ID NO: 1740889 - RNA, 19 nt, Salmonella enterica enterica serovar Typhi Ty2
cagcgcauagcugcccugu

SEQ ID NO: 1740890 - RNA, 18 nt, Salmonella enterica enterica serovar Typhi Ty2
cagcgcaguuuccaucgc

SEQ ID NO: 1740891 - RNA, 12 nt, Salmonella enterica enterica serovar Typhi Ty2
cagcgccaugaa

SEQ ID NO: 1740892 - RNA, 15 nt, Salmonella enterica enterica serovar Typhi Ty2
cagcgccaucaggca

SEQ ID NO: 1740893 - RNA, 18 nt, Salmonella enterica enterica serovar Typhi Ty2
cagcgccgucgccaucac

SEQ ID NO: 1740894 - RNA, 13 nt, Salmonella enterica enterica serovar Typhi Ty2
cagcgccggaaaa

SEQ ID NO: 1740895 - RNA, 14 nt, Salmonella enterica enterica serovar Typhi Ty2
cagcgccgcgccga

SEQ ID NO: 1740896 - RNA, 14 nt, Salmonella enterica enterica serovar Typhi Ty2
cagcgccgccagaa

SEQ ID NO: 1740897 - RNA, 17 nt, Salmonella enterica enterica serovar Typhi Ty2
cagcgaaaugcgaaucc

SEQ ID NO: 1740898 - RNA, 16 nt, Salmonella enterica enterica serovar Typhi Ty2
cagcgaaagcugccuu

SEQ ID NO: 1740899 - RNA, 20 nt, Salmonella enterica enterica serovar Typhi Ty2
cagccuauccccgaaaguua

SEQ ID NO: 1740900 - RNA, 22 nt, Salmonella enterica enterica serovar Typhi Ty2
cagccguuuuccggucgcgcaa

SEQ ID NO: 1740901 - RNA, 17 nt, Salmonella enterica enterica serovar Typhi Ty2
cagccuaaaaaaccggc

SEQ ID NO: 1740902 - RNA, 14 nt, Salmonella enterica enterica serovar Typhi Ty2
cagccgaucagcgc

SEQ ID NO: 1740903 - RNA, 17 nt, Salmonella enterica enterica serovar Typhi Ty2
cagccgaucagcgccau

SEQ ID NO: 1740904 - RNA, 21 nt, Salmonella enterica enterica serovar Typhi Ty2
cagccgagcgguaagagccag

SEQ ID NO: 1740905 - RNA, 17 nt, Salmonella enterica enterica serovar Typhi Ty2
cagcgacaggcugucga

SEQ ID NO: 1740906 - RNA, 23 nt, Salmonella enterica enterica serovar Typhi Ty2
cagcgaacaguguaaacgccaga

SEQ ID NO: 1740907 - RNA, 16 nt, Salmonella enterica enterica serovar Typhi Ty2
cagcgaccacgccacc

SEQ ID NO: 1740908 - RNA, 15 nt, Salmonella enterica enterica serovar Typhi Ty2
cagcgagacgcugga

SEQ ID NO: 1740909 - RNA, 20 nt, Salmonella enterica enterica serovar Typhi Ty2
cagcgaguuacguugcggcg

SEQ ID NO: 1740910 - RNA, 19 nt, Salmonella enterica enterica serovar Typhi Ty2
cagcgaugagcgccagcaa

SEQ ID NO: 1740911 - RNA, 12 nt, Salmonella enterica enterica serovar Typhi Ty2
cagcgcaacgcc

SEQ ID NO: 1740912 - RNA, 17 nt, Salmonella enterica enterica serovar Typhi Ty2
cagcgauugcgccagac

SEQ ID NO: 1740913 - RNA, 14 nt, Salmonella enterica enterica serovar Typhi Ty2
cagcgcaacgcgca

SEQ ID NO: 1740914 - RNA, 14 nt, Salmonella enterica enterica serovar Typhi Ty2
cagccaaucauaaa

SEQ ID NO: 1740915 - RNA, 16 nt, Salmonella enterica enterica serovar Typhi Ty2
cagccacguugcgcgc

SEQ ID NO: 1740916 - RNA, 22 nt, Salmonella enterica enterica serovar Typhi Ty2
cagccauaaucaguacugcgcc

SEQ ID NO: 1740917 - RNA, 21 nt, Salmonella enterica enterica serovar Typhi Ty2
cagccaguuggcuucagcaaa

SEQ ID NO: 1740918 - RNA, 23 nt, Salmonella enterica enterica serovar Typhi Ty2
cagccaguuggcuucagcaaacg

SEQ ID NO: 1740919 - RNA, 21 nt, Salmonella enterica enterica serovar Typhi Ty2
cagccaguuagcgaucgcgcc

SEQ ID NO: 1740920 - RNA, 15 nt, Salmonella enterica enterica serovar Typhi Ty2
cagccauagcgcgcc

SEQ ID NO: 1740921 - RNA, 14 nt, Salmonella enterica enterica serovar Typhi Ty2
cagccauagcagca

SEQ ID NO: 1740922 - RNA, 16 nt, Salmonella enterica enterica serovar Typhi Ty2
cagcccgauacccgcc

SEQ ID NO: 1740923 - RNA, 22 nt, Salmonella enterica enterica serovar Typhi Ty2
cagcccgacuaccggcaccagc

SEQ ID NO: 1740924 - RNA, 18 nt, Salmonella enterica enterica serovar Typhi Ty2
cagcacuaacagcagcag

SEQ ID NO: 1740925 - RNA, 19 nt, Salmonella enterica enterica serovar Typhi Ty2
cagcagcaaaccgauaauc

SEQ ID NO: 1740926 - RNA, 19 nt, Salmonella enterica enterica serovar Typhi Ty2
cagcagccgguauccagcg

SEQ ID NO: 1740927 - RNA, 20 nt, Salmonella enterica enterica serovar Typhi Ty2
cagcagccgguauccagcgc

SEQ ID NO: 1740928 - RNA, 20 nt, Salmonella enterica enterica serovar Typhi Ty2
cagcagccgggccagacgcu

SEQ ID NO: 1740929 - RNA, 18 nt, Salmonella enterica enterica serovar Typhi Ty2
cagcagccaugccagcgc

SEQ ID NO: 1740930 - RNA, 13 nt, Salmonella enterica enterica serovar Typhi Ty2
cagcaauacgccc

SEQ ID NO: 1740931 - RNA, 12 nt, Salmonella enterica enterica serovar Typhi Ty2
caucgacgccag

SEQ ID NO: 1740932 - RNA, 16 nt, Salmonella enterica enterica serovar Typhi Ty2
caucgccacgauagac

SEQ ID NO: 1740933 - RNA, 19 nt, Salmonella enterica enterica serovar Typhi Ty2
caucgccgcccaguggcaa

SEQ ID NO: 1740934 - RNA, 14 nt, Salmonella enterica enterica serovar Typhi Ty2
caucgcgccaugau

SEQ ID NO: 1740935 - RNA, 19 nt, Salmonella enterica enterica serovar Typhi Ty2
caucgccugaucgcgcaga

SEQ ID NO: 1740936 - RNA, 17 nt, Salmonella enterica enterica serovar Typhi Ty2
caucgccugaugaccgc

SEQ ID NO: 1740937 - RNA, 14 nt, Salmonella enterica enterica serovar Typhi Ty2
caucggagauuuca

SEQ ID NO: 1740938 - RNA, 18 nt, Salmonella enterica enterica serovar Typhi Ty2
caucggagauuucauccu

SEQ ID NO: 1740939 - RNA, 13 nt, Salmonella enterica enterica serovar Typhi Ty2
caucgcucuuggc

SEQ ID NO: 1740940 - RNA, 18 nt, Salmonella enterica enterica serovar Typhi Ty2
caucggcccacgcgcaga

SEQ ID NO: 1740941 - RNA, 15 nt, Salmonella enterica enterica serovar Typhi Ty2
cauagcgccaucagg

SEQ ID NO: 1740942 - RNA, 18 nt, Salmonella enterica enterica serovar Typhi Ty2
cauagcgggagauugaaa

SEQ ID NO: 1740943 - RNA, 19 nt, Salmonella enterica enterica serovar Typhi Ty2
cauagcgccccaguaacgu

SEQ ID NO: 1740944 - RNA, 16 nt, Salmonella enterica enterica serovar Typhi Ty2
cauagcggccagaugg

SEQ ID NO: 1740945 - RNA, 14 nt, Salmonella enterica enterica serovar Typhi Ty2
cauagcaucguuac

SEQ ID NO: 1740946 - RNA, 19 nt, Salmonella enterica enterica serovar Typhi Ty2
cauaggccagcgucaccuc

SEQ ID NO: 1740947 - RNA, 15 nt, Salmonella enterica enterica serovar Typhi Ty2
cauaggccagcguca

SEQ ID NO: 1740948 - RNA, 17 nt, Salmonella enterica enterica serovar Typhi Ty2
caucaauaaaaucaccg

SEQ ID NO: 1740949 - RNA, 22 nt, Salmonella enterica enterica serovar Typhi Ty2
caucaauaauuugucgauaagc

SEQ ID NO: 1740950 - RNA, 19 nt, Salmonella enterica enterica serovar Typhi Ty2
caucaaucaccuuacgcuc

SEQ ID NO: 1740951 - RNA, 10 nt, Salmonella enterica enterica serovar Typhi Ty2
caucagcgcu

SEQ ID NO: 1740952 - RNA, 16 nt, Salmonella enterica enterica serovar Typhi Ty2
caucagcgcgggauaa

SEQ ID NO: 1740953 - RNA, 22 nt, Salmonella enterica enterica serovar Typhi Ty2
caucagccauuuguuagcguuu

SEQ ID NO: 1740954 - RNA, 14 nt, Salmonella enterica enterica serovar Typhi Ty2
caucagccagcauc

SEQ ID NO: 1740955 - RNA, 14 nt, Salmonella enterica enterica serovar Typhi Ty2
caucagcacaaaau

SEQ ID NO: 1740956 - RNA, 20 nt, Salmonella enterica enterica serovar Typhi Ty2
cauccauugcgccacggaug

SEQ ID NO: 1740957 - RNA, 17 nt, Salmonella enterica enterica serovar Typhi Ty2
cauccaucuccggcauc

SEQ ID NO: 1740958 - RNA, 18 nt, Salmonella enterica enterica serovar Typhi Ty2
cauccagaaggcaaaaug

SEQ ID NO: 1740959 - RNA, 13 nt, Salmonella enterica enterica serovar Typhi Ty2
cauccagcgccag

SEQ ID NO: 1740960 - RNA, 23 nt, Salmonella enterica enterica serovar Typhi Ty2
cauccuuaugggucacauccaga

SEQ ID NO: 1740961 - RNA, 17 nt, Salmonella enterica enterica serovar Typhi Ty2
cauccugacauuacccg

SEQ ID NO: 1740962 - RNA, 19 nt, Salmonella enterica enterica serovar Typhi Ty2
cauccuguuuuuucagcgc

SEQ ID NO: 1740963 - RNA, 14 nt, Salmonella enterica enterica serovar Typhi Ty2
cauccucgccauaa

SEQ ID NO: 1740964 - RNA, 22 nt, Salmonella enterica enterica serovar Typhi Ty2
cauccggccuggcgcaacguuu

SEQ ID NO: 1740965 - RNA, 15 nt, Salmonella enterica enterica serovar Typhi Ty2
cauccggcaauaaug

SEQ ID NO: 1740966 - RNA, 23 nt, Salmonella enterica enterica serovar Typhi Ty2
cauccggcaagcgcugggcgaua

SEQ ID NO: 1740967 - RNA, 14 nt, Salmonella enterica enterica serovar Typhi Ty2
cauccggacgccag

SEQ ID NO: 1740968 - RNA, 22 nt, Salmonella enterica enterica serovar Typhi Ty2
cauccgcgcuuucuggcgcaga

SEQ ID NO: 1740969 - RNA, 15 nt, Salmonella enterica enterica serovar Typhi Ty2
caggucgccagcggg

SEQ ID NO: 1740970 - RNA, 21 nt, Salmonella enterica enterica serovar Typhi Ty2
caggucgcacuccucugucga

SEQ ID NO: 1740971 - RNA, 13 nt, Salmonella enterica enterica serovar Typhi Ty2
caggucugcgcgu

SEQ ID NO: 1740972 - RNA, 22 nt, Salmonella enterica enterica serovar Typhi Ty2
cagguuauuguugcuacgcgcc

SEQ ID NO: 1740973 - RNA, 15 nt, Salmonella enterica enterica serovar Typhi Ty2
cagguuagcagccac

SEQ ID NO: 1740974 - RNA, 20 nt, Salmonella enterica enterica serovar Typhi Ty2
cagguuccccaaugaucaau

SEQ ID NO: 1740975 - RNA, 16 nt, Salmonella enterica enterica serovar Typhi Ty2
caggugcuuaucugag

SEQ ID NO: 1740976 - RNA, 17 nt, Salmonella enterica enterica serovar Typhi Ty2
caggugcggcugggcga

SEQ ID NO: 1740977 - RNA, 21 nt, Salmonella enterica enterica serovar Typhi Ty2
caggugcggauaguccugcgc

SEQ ID NO: 1740978 - RNA, 18 nt, Salmonella enterica enterica serovar Typhi Ty2
caguaacacaaucaggcg

SEQ ID NO: 1740979 - RNA, 17 nt, Salmonella enterica enterica serovar Typhi Ty2
caguaaauuaaacagcu

SEQ ID NO: 1740980 - RNA, 21 nt, Salmonella enterica enterica serovar Typhi Ty2
caguaaaagcccgcccagcau

SEQ ID NO: 1740981 - RNA, 21 nt, Salmonella enterica enterica serovar Typhi Ty2
caguaacacccgcgccuucgc

SEQ ID NO: 1740982 - RNA, 20 nt, Salmonella enterica enterica serovar Typhi Ty2
caguaagcgaguccugccau

SEQ ID NO: 1740983 - RNA, 23 nt, Salmonella enterica enterica serovar Typhi Ty2
cagucaaaacgacauaaccggca

SEQ ID NO: 1740984 - RNA, 17 nt, Salmonella enterica enterica serovar Typhi Ty2
caguaugaugaccuggu

SEQ ID NO: 1740985 - RNA, 21 nt, Salmonella enterica enterica serovar Typhi Ty2
caguccgguggcgaaaacgcu

SEQ ID NO: 1740986 - RNA, 19 nt, Salmonella enterica enterica serovar Typhi Ty2
cagucgacaguauagaaau

SEQ ID NO: 1740987 - RNA, 12 nt, Salmonella enterica enterica serovar Typhi Ty2
cagucacagauc

SEQ ID NO: 1740988 - RNA, 16 nt, Salmonella enterica enterica serovar Typhi Ty2
caguccuuucgacgca

SEQ ID NO: 1740989 - RNA, 17 nt, Salmonella enterica enterica serovar Typhi Ty2
cagugaagaauggcgcc

SEQ ID NO: 1740990 - RNA, 16 nt, Salmonella enterica enterica serovar Typhi Ty2
caguuuuuuccagcgc

SEQ ID NO: 1740991 - RNA, 16 nt, Salmonella enterica enterica serovar Typhi Ty2
caguuuugucaucaga

SEQ ID NO: 1740992 - RNA, 22 nt, Salmonella enterica enterica serovar Typhi Ty2
caguucuucgccguuaucggcc

SEQ ID NO: 1740993 - RNA, 22 nt, Salmonella enterica enterica serovar Typhi Ty2
caguucgggacuaacuggucgc

SEQ ID NO: 1740994 - RNA, 21 nt, Salmonella enterica enterica serovar Typhi Ty2
caguucggcgauuuccagcgc

SEQ ID NO: 1740995 - RNA, 21 nt, Salmonella enterica enterica serovar Typhi Ty2
cauaauauucauaacgccgau

SEQ ID NO: 1740996 - RNA, 17 nt, Salmonella enterica enterica serovar Typhi Ty2
cauaauaagcgcucagg

SEQ ID NO: 1740997 - RNA, 13 nt, Salmonella enterica enterica serovar Typhi Ty2
cauaauaauugcg

SEQ ID NO: 1740998 - RNA, 22 nt, Salmonella enterica enterica serovar Typhi Ty2
cauaaaacccguuaaauaccag

SEQ ID NO: 1740999 - RNA, 19 nt, Salmonella enterica enterica serovar Typhi Ty2
cauacgccgcggucgagca

SEQ ID NO: 1741000 - RNA, 12 nt, Salmonella enterica enterica serovar Typhi Ty2
cauacgauucag

SEQ ID NO: 1741001 - RNA, 16 nt, Salmonella enterica enterica serovar Typhi Ty2
cauaccgguugcgcgc

SEQ ID NO: 1741002 - RNA, 18 nt, Salmonella enterica enterica serovar Typhi Ty2
cauaccgugagcuacagc

SEQ ID NO: 1741003 - RNA, 19 nt, Salmonella enterica enterica serovar Typhi Ty2
cauaaugaauuuaucccgu

SEQ ID NO: 1741004 - RNA, 20 nt, Salmonella enterica enterica serovar Typhi Ty2
cagugagcuuugcacgcugu

SEQ ID NO: 1741005 - RNA, 13 nt, Salmonella enterica enterica serovar Typhi Ty2
cagugaugacggc

SEQ ID NO: 1741006 - RNA, 19 nt, Salmonella enterica enterica serovar Typhi Ty2
caguguucccugcgcugga

SEQ ID NO: 1741007 - RNA, 20 nt, Salmonella enterica enterica serovar Typhi Ty2
caguucgccacgaucggcaa

SEQ ID NO: 1741008 - RNA, 13 nt, Salmonella enterica enterica serovar Typhi Ty2
cagcucgccaugc

SEQ ID NO: 1741009 - RNA, 22 nt, Salmonella enterica enterica serovar Typhi Ty2
cagcucgcugccgaucagauug

SEQ ID NO: 1741010 - RNA, 14 nt, Salmonella enterica enterica serovar Typhi Ty2
cagcucccgcguca

SEQ ID NO: 1741011 - RNA, 15 nt, Salmonella enterica enterica serovar Typhi Ty2
cagcguuucaugaau

SEQ ID NO: 1741012 - RNA, 17 nt, Salmonella enterica enterica serovar Typhi Ty2
cagcguauugagcugga

SEQ ID NO: 1741013 - RNA, 15 nt, Salmonella enterica enterica serovar Typhi Ty2
cagcguaccgauaau

SEQ ID NO: 1741014 - RNA, 15 nt, Salmonella enterica enterica serovar Typhi Ty2
cagcguacaauggca

SEQ ID NO: 1741015 - RNA, 22 nt, Salmonella enterica enterica serovar Typhi Ty2
caggaaugcggccauccugcgu

SEQ ID NO: 1741016 - RNA, 15 nt, Salmonella enterica enterica serovar Typhi Ty2
caggaaugccacgau

SEQ ID NO: 1741017 - RNA, 14 nt, Salmonella enterica enterica serovar Typhi Ty2
caggaagucagcuu

SEQ ID NO: 1741018 - RNA, 20 nt, Salmonella enterica enterica serovar Typhi Ty2
caggauuauuacacacaguc

SEQ ID NO: 1741019 - RNA, 23 nt, Salmonella enterica enterica serovar Typhi Ty2
caggauguccugcggacgcagcu

SEQ ID NO: 1741020 - RNA, 17 nt, Salmonella enterica enterica serovar Typhi Ty2
caggauuuacugagcgc

SEQ ID NO: 1741021 - RNA, 14 nt, Salmonella enterica enterica serovar Typhi Ty2
caggcaaagcccca

SEQ ID NO: 1741022 - RNA, 16 nt, Salmonella enterica enterica serovar Typhi Ty2
caggcaaagcucaacg

SEQ ID NO: 1741023 - RNA, 14 nt, Salmonella enterica enterica serovar Typhi Ty2
caggcaaaccagca

SEQ ID NO: 1741024 - RNA, 17 nt, Salmonella enterica enterica serovar Typhi Ty2
caggcaagacgcaugac

SEQ ID NO: 1741025 - RNA, 12 nt, Salmonella enterica enterica serovar Typhi Ty2
caggauaaagac

SEQ ID NO: 1741026 - RNA, 19 nt, Salmonella enterica enterica serovar Typhi Ty2
caggauauacuucaucagg

SEQ ID NO: 1741027 - RNA, 18 nt, Salmonella enterica enterica serovar Typhi Ty2
cagcuggcgauauccgug

SEQ ID NO: 1741028 - RNA, 12 nt, Salmonella enterica enterica serovar Typhi Ty2
cagcuggcgaua

SEQ ID NO: 1741029 - RNA, 18 nt, Salmonella enterica enterica serovar Typhi Ty2
caggcucaucagcgccau

SEQ ID NO: 1741030 - RNA, 19 nt, Salmonella enterica enterica serovar Typhi Ty2
caggcugaacccugccugc

SEQ ID NO: 1741031 - RNA, 15 nt, Salmonella enterica enterica serovar Typhi Ty2
caggcguuacagacg

SEQ ID NO: 1741032 - RNA, 15 nt, Salmonella enterica enterica serovar Typhi Ty2
caggcuaaggcgucg

SEQ ID NO: 1741033 - RNA, 22 nt, Salmonella enterica enterica serovar Typhi Ty2
caggcuaaagugcgucuggcga

SEQ ID NO: 1741034 - RNA, 17 nt, Salmonella enterica enterica serovar Typhi Ty2
caggcgucaaaacaggu

SEQ ID NO: 1741035 - RNA, 19 nt, Salmonella enterica enterica serovar Typhi Ty2
cagggcaacggccagcgca

SEQ ID NO: 1741036 - RNA, 18 nt, Salmonella enterica enterica serovar Typhi Ty2
cagggcagcgagcaccga

SEQ ID NO: 1741037 - RNA, 21 nt, Salmonella enterica enterica serovar Typhi Ty2
caggcuuuccacguucccggu

SEQ ID NO: 1741038 - RNA, 22 nt, Salmonella enterica enterica serovar Typhi Ty2
caggcugggcgauaaaccgcug

SEQ ID NO: 1741039 - RNA, 16 nt, Salmonella enterica enterica serovar Typhi Ty2
caggcugggcgauaaa

SEQ ID NO: 1741040 - RNA, 21 nt, Salmonella enterica enterica serovar Typhi Ty2
caggcuggguuucgguauaaa

SEQ ID NO: 1741041 - RNA, 18 nt, Salmonella enterica enterica serovar Typhi Ty2
caggcuuuaaauucagca

SEQ ID NO: 1741042 - RNA, 13 nt, Salmonella enterica enterica serovar Typhi Ty2
caggcuugccgcg

SEQ ID NO: 1741043 - RNA, 18 nt, Salmonella enterica enterica serovar Typhi Ty2
caggcuucccaauacggc

SEQ ID NO: 1741044 - RNA, 18 nt, Salmonella enterica enterica serovar Typhi Ty2
caggccggacaggcgacg

SEQ ID NO: 1741045 - RNA, 19 nt, Salmonella enterica enterica serovar Typhi Ty2
caggcgccaguuggcguac

SEQ ID NO: 1741046 - RNA, 13 nt, Salmonella enterica enterica serovar Typhi Ty2
caggcgacaugac

SEQ ID NO: 1741047 - RNA, 19 nt, Salmonella enterica enterica serovar Typhi Ty2
caggcgcuuaucgccguaa

SEQ ID NO: 1741048 - RNA, 14 nt, Salmonella enterica enterica serovar Typhi Ty2
caggcggcguuaua

SEQ ID NO: 1741049 - RNA, 16 nt, Salmonella enterica enterica serovar Typhi Ty2
ccaccaggaacgccau

SEQ ID NO: 1741050 - RNA, 20 nt, Salmonella enterica enterica serovar Typhi Ty2
ccacacaugcaaaaaagccc

SEQ ID NO: 1741051 - RNA, 11 nt, Salmonella enterica enterica serovar Typhi Ty2
ccacagcgcca

SEQ ID NO: 1741052 - RNA, 14 nt, Salmonella enterica enterica serovar Typhi Ty2
ccacaggcgucgcg

SEQ ID NO: 1741053 - RNA, 20 nt, Salmonella enterica enterica serovar Typhi Ty2
ccacagucgucuggcgcuau

SEQ ID NO: 1741054 - RNA, 18 nt, Salmonella enterica enterica serovar Typhi Ty2
ccacagucgucuggcgcu

SEQ ID NO: 1741055 - RNA, 19 nt, Salmonella enterica enterica serovar Typhi Ty2
ccacagugacccgccgcca

SEQ ID NO: 1741056 - RNA, 17 nt, Salmonella enterica enterica serovar Typhi Ty2
ccaaugacgcuauccgc

SEQ ID NO: 1741057 - RNA, 12 nt, Salmonella enterica enterica serovar Typhi Ty2
ccacaaccggcu

SEQ ID NO: 1741058 - RNA, 22 nt, Salmonella enterica enterica serovar Typhi Ty2
ccacaacgugauaaccaacagg

SEQ ID NO: 1741059 - RNA, 18 nt, Salmonella enterica enterica serovar Typhi Ty2
ccacaaacuccagacgau

SEQ ID NO: 1741060 - RNA, 22 nt, Salmonella enterica enterica serovar Typhi Ty2
ccacaagagcagcaacccugcc

SEQ ID NO: 1741061 - RNA, 14 nt, Salmonella enterica enterica serovar Typhi Ty2
ccacaagcccggau

SEQ ID NO: 1741062 - RNA, 15 nt, Salmonella enterica enterica serovar Typhi Ty2
ccaaucgagaagcca

SEQ ID NO: 1741063 - RNA, 21 nt, Salmonella enterica enterica serovar Typhi Ty2
ccaaucaacgccgccaggaua

SEQ ID NO: 1741064 - RNA, 13 nt, Salmonella enterica enterica serovar Typhi Ty2
ccaauagcgcuga

SEQ ID NO: 1741065 - RNA, 21 nt, Salmonella enterica enterica serovar Typhi Ty2
ccaacauacaugccugcgcca

SEQ ID NO: 1741066 - RNA, 13 nt, Salmonella enterica enterica serovar Typhi Ty2
caugccgccagac

SEQ ID NO: 1741067 - RNA, 17 nt, Salmonella enterica enterica serovar Typhi Ty2
caugcggaaucacgcau

SEQ ID NO: 1741068 - RNA, 22 nt, Salmonella enterica enterica serovar Typhi Ty2
caugaugggcgcacagcgccau

SEQ ID NO: 1741069 - RNA, 22 nt, Salmonella enterica enterica serovar Typhi Ty2
caugauuaaagccacgucugau

SEQ ID NO: 1741070 - RNA, 15 nt, Salmonella enterica enterica serovar Typhi Ty2
caucggcgcgucgcu

SEQ ID NO: 1741071 - RNA, 18 nt, Salmonella enterica enterica serovar Typhi Ty2
caugccccucgacaggag

SEQ ID NO: 1741072 - RNA, 22 nt, Salmonella enterica enterica serovar Typhi Ty2
cauguguaauguuuucugccag

SEQ ID NO: 1741073 - RNA, 19 nt, Salmonella enterica enterica serovar Typhi Ty2
cauguuagcaaaaaugccg

SEQ ID NO: 1741074 - RNA, 20 nt, Salmonella enterica enterica serovar Typhi Ty2
caugugacggcauguccggc

SEQ ID NO: 1741075 - RNA, 18 nt, Salmonella enterica enterica serovar Typhi Ty2
cauguagaauagcgccgu

SEQ ID NO: 1741076 - RNA, 16 nt, Salmonella enterica enterica serovar Typhi Ty2
caugguguguucccgc

SEQ ID NO: 1741077 - RNA, 14 nt, Salmonella enterica enterica serovar Typhi Ty2
caugggcaggaaca

SEQ ID NO: 1741078 - RNA, 19 nt, Salmonella enterica enterica serovar Typhi Ty2
cauggccuucaaucagcac

SEQ ID NO: 1741079 - RNA, 19 nt, Salmonella enterica enterica serovar Typhi Ty2
cauugaugccugcccaucu

SEQ ID NO: 1741080 - RNA, 22 nt, Salmonella enterica enterica serovar Typhi Ty2
cauugauauagaguccagccau

SEQ ID NO: 1741081 - RNA, 16 nt, Salmonella enterica enterica serovar Typhi Ty2
cauugauaaagcgcuc

SEQ ID NO: 1741082 - RNA, 14 nt, Salmonella enterica enterica serovar Typhi Ty2
cauuucaugaccga

SEQ ID NO: 1741083 - RNA, 21 nt, Salmonella enterica enterica serovar Typhi Ty2
cauuucgccgccucguaucug

SEQ ID NO: 1741084 - RNA, 19 nt, Salmonella enterica enterica serovar Typhi Ty2
cauuucgccgccauccggc

SEQ ID NO: 1741085 - RNA, 12 nt, Salmonella enterica enterica serovar Typhi Ty2
cauuuccugcau

SEQ ID NO: 1741086 - RNA, 17 nt, Salmonella enterica enterica serovar Typhi Ty2
ccaaaauagauaaucgc

SEQ ID NO: 1741087 - RNA, 12 nt, Salmonella enterica enterica serovar Typhi Ty2
ccaacagcgcaa

SEQ ID NO: 1741088 - RNA, 20 nt, Salmonella enterica enterica serovar Typhi Ty2
ccaacauaacgaaauccgcg

SEQ ID NO: 1741089 - RNA, 21 nt, Salmonella enterica enterica serovar Typhi Ty2
ccaacagguuaaucagcacau

SEQ ID NO: 1741090 - RNA, 15 nt, Salmonella enterica enterica serovar Typhi Ty2
ccaacacggcgcuca

SEQ ID NO: 1741091 - RNA, 17 nt, Salmonella enterica enterica serovar Typhi Ty2
cauuaccuuuuccggcg

SEQ ID NO: 1741092 - RNA, 22 nt, Salmonella enterica enterica serovar Typhi Ty2
cauuacugaccgagaucaggcc

SEQ ID NO: 1741093 - RNA, 20 nt, Salmonella enterica enterica serovar Typhi Ty2
cauuacugaccgagaucagg

SEQ ID NO: 1741094 - RNA, 17 nt, Salmonella enterica enterica serovar Typhi Ty2
cauuaaccuugcccaug

SEQ ID NO: 1741095 - RNA, 16 nt, Salmonella enterica enterica serovar Typhi Ty2
cauuaaagaaggcgcg

SEQ ID NO: 1741096 - RNA, 14 nt, Salmonella enterica enterica serovar Typhi Ty2
cauucaacgcauca

SEQ ID NO: 1741097 - RNA, 13 nt, Salmonella enterica enterica serovar Typhi Ty2
cauuaucaccauu

SEQ ID NO: 1741098 - RNA, 21 nt, Salmonella enterica enterica serovar Typhi Ty2
cauucgcuugcccggccguua

SEQ ID NO: 1741099 - RNA, 15 nt, Salmonella enterica enterica serovar Typhi Ty2
cauucaacgcaucaa

SEQ ID NO: 1741100 - RNA, 19 nt, Salmonella enterica enterica serovar Typhi Ty2
ccagcgaugagcgccagca

SEQ ID NO: 1741101 - RNA, 18 nt, Salmonella enterica enterica serovar Typhi Ty2
ccagcgaugagcgccagc

SEQ ID NO: 1741102 - RNA, 19 nt, Salmonella enterica enterica serovar Typhi Ty2
ccagccucgcgcauccggg

SEQ ID NO: 1741103 - RNA, 20 nt, Salmonella enterica enterica serovar Typhi Ty2
ccagccuuaucccaucccgc

SEQ ID NO: 1741104 - RNA, 18 nt, Salmonella enterica enterica serovar Typhi Ty2
ccagcaucggcagcgcca

SEQ ID NO: 1741105 - RNA, 15 nt, Salmonella enterica enterica serovar Typhi Ty2
ccagcaugagccagc

SEQ ID NO: 1741106 - RNA, 20 nt, Salmonella enterica enterica serovar Typhi Ty2
ccagccggaaaagcgcuggc

SEQ ID NO: 1741107 - RNA, 19 nt, Salmonella enterica enterica serovar Typhi Ty2
ccagccgguguuaaccaga

SEQ ID NO: 1741108 - RNA, 19 nt, Salmonella enterica enterica serovar Typhi Ty2
ccagcgcugagaugaccau

SEQ ID NO: 1741109 - RNA, 21 nt, Salmonella enterica enterica serovar Typhi Ty2
ccagcggaauccccgccgcca

SEQ ID NO: 1741110 - RNA, 14 nt, Salmonella enterica enterica serovar Typhi Ty2
ccagcgcggcgcca

SEQ ID NO: 1741111 - RNA, 17 nt, Salmonella enterica enterica serovar Typhi Ty2
ccagcgcgccauccuga

SEQ ID NO: 1741112 - RNA, 17 nt, Salmonella enterica enterica serovar Typhi Ty2
ccagcgauuacgccaga

SEQ ID NO: 1741113 - RNA, 16 nt, Salmonella enterica enterica serovar Typhi Ty2
ccagcgccaacgccac

SEQ ID NO: 1741114 - RNA, 15 nt, Salmonella enterica enterica serovar Typhi Ty2
ccagcgccagcguag

SEQ ID NO: 1741115 - RNA, 23 nt, Salmonella enterica enterica serovar Typhi Ty2
ccagcuuaucugaccaugccagc

SEQ ID NO: 1741116 - RNA, 23 nt, Salmonella enterica enterica serovar Typhi Ty2
ccagcucuuucaacuuccgcguu

SEQ ID NO: 1741117 - RNA, 18 nt, Salmonella enterica enterica serovar Typhi Ty2
ccagcguugaauaucgua

SEQ ID NO: 1741118 - RNA, 19 nt, Salmonella enterica enterica serovar Typhi Ty2
ccagcuauuuuucaccaua

SEQ ID NO: 1741119 - RNA, 14 nt, Salmonella enterica enterica serovar Typhi Ty2
ccagcggcaccagc

SEQ ID NO: 1741120 - RNA, 15 nt, Salmonella enterica enterica serovar Typhi Ty2
ccagcucaucgaacc

SEQ ID NO: 1741121 - RNA, 22 nt, Salmonella enterica enterica serovar Typhi Ty2
ccagcuccauagaaaucagcag

SEQ ID NO: 1741122 - RNA, 22 nt, Salmonella enterica enterica serovar Typhi Ty2
ccagacuccuuuuaccggcgaa

SEQ ID NO: 1741123 - RNA, 14 nt, Salmonella enterica enterica serovar Typhi Ty2
ccagacaagcacau

SEQ ID NO: 1741124 - RNA, 22 nt, Salmonella enterica enterica serovar Typhi Ty2
ccagaaucccgccuugcggcgc

SEQ ID NO: 1741125 - RNA, 22 nt, Salmonella enterica enterica serovar Typhi Ty2
ccagacgguaagcguucgcaua

SEQ ID NO: 1741126 - RNA, 15 nt, Salmonella enterica enterica serovar Typhi Ty2
ccagacggcgcuguu

SEQ ID NO: 1741127 - RNA, 18 nt, Salmonella enterica enterica serovar Typhi Ty2
ccagaaucaccgacagca

SEQ ID NO: 1741128 - RNA, 13 nt, Salmonella enterica enterica serovar Typhi Ty2
ccagaacucaucu

SEQ ID NO: 1741129 - RNA, 16 nt, Salmonella enterica enterica serovar Typhi Ty2
ccacuguucguccaua

SEQ ID NO: 1741130 - RNA, 19 nt, Salmonella enterica enterica serovar Typhi Ty2
ccacugcacgccaggguaa

SEQ ID NO: 1741131 - RNA, 12 nt, Salmonella enterica enterica serovar Typhi Ty2
ccacgggcgcac

SEQ ID NO: 1741132 - RNA, 14 nt, Salmonella enterica enterica serovar Typhi Ty2
ccacgucauccggc

SEQ ID NO: 1741133 - RNA, 16 nt, Salmonella enterica enterica serovar Typhi Ty2
ccacguaacucggcag

SEQ ID NO: 1741134 - RNA, 12 nt, Salmonella enterica enterica serovar Typhi Ty2
ccagcaucgacc

SEQ ID NO: 1741135 - RNA, 15 nt, Salmonella enterica enterica serovar Typhi Ty2
ccagcaauacccaga

SEQ ID NO: 1741136 - RNA, 18 nt, Salmonella enterica enterica serovar Typhi Ty2
ccagcaaggcugccgcca

SEQ ID NO: 1741137 - RNA, 20 nt, Salmonella enterica enterica serovar Typhi Ty2
ccagcacacgcaucccgcca

SEQ ID NO: 1741138 - RNA, 18 nt, Salmonella enterica enterica serovar Typhi Ty2
ccagcacacgcaucccgc

SEQ ID NO: 1741139 - RNA, 22 nt, Salmonella enterica enterica serovar Typhi Ty2
ccagcaccaucuuuuccggcag

SEQ ID NO: 1741140 - RNA, 15 nt, Salmonella enterica enterica serovar Typhi Ty2
ccagcaagcggcgau

SEQ ID NO: 1741141 - RNA, 17 nt, Salmonella enterica enterica serovar Typhi Ty2
ccagcaaggagacgccc

SEQ ID NO: 1741142 - RNA, 18 nt, Salmonella enterica enterica serovar Typhi Ty2
ccagcaaaccuuccgcca

SEQ ID NO: 1741143 - RNA, 20 nt, Salmonella enterica enterica serovar Typhi Ty2
ccagauuuuccaggccgcca

SEQ ID NO: 1741144 - RNA, 14 nt, Salmonella enterica enterica serovar Typhi Ty2
ccagcaaaccggca

SEQ ID NO: 1741145 - RNA, 17 nt, Salmonella enterica enterica serovar Typhi Ty2
ccagagagaugccgccg

SEQ ID NO: 1741146 - RNA, 13 nt, Salmonella enterica enterica serovar Typhi Ty2
ccagauuacgcau

SEQ ID NO: 1741147 - RNA, 22 nt, Salmonella enterica enterica serovar Typhi Ty2
ccagauuaucggccagcgccag

SEQ ID NO: 1741148 - RNA, 23 nt, Salmonella enterica enterica serovar Typhi Ty2
ccagauucuuaguccucagcgaa

SEQ ID NO: 1741149 - RNA, 13 nt, Salmonella enterica enterica serovar Typhi Ty2
ccaggauaucgcg

SEQ ID NO: 1741150 - RNA, 22 nt, Salmonella enterica enterica serovar Typhi Ty2
ccaggauccguucaucggcaua

SEQ ID NO: 1741151 - RNA, 21 nt, Salmonella enterica enterica serovar Typhi Ty2
ccaguggucguuagccagaug

SEQ ID NO: 1741152 - RNA, 15 nt, Salmonella enterica enterica serovar Typhi Ty2
ccaguguacugccaa

SEQ ID NO: 1741153 - RNA, 17 nt, Salmonella enterica enterica serovar Typhi Ty2
ccagucuuccauuacaa

SEQ ID NO: 1741154 - RNA, 16 nt, Salmonella enterica enterica serovar Typhi Ty2
ccagucuuccugcggu

SEQ ID NO: 1741155 - RNA, 14 nt, Salmonella enterica enterica serovar Typhi Ty2
ccagugacgccagu

SEQ ID NO: 1741156 - RNA, 20 nt, Salmonella enterica enterica serovar Typhi Ty2
ccagugaauccaccacguaa

SEQ ID NO: 1741157 - RNA, 16 nt, Salmonella enterica enterica serovar Typhi Ty2
ccaguuauagcgcaga

SEQ ID NO: 1741158 - RNA, 18 nt, Salmonella enterica enterica serovar Typhi Ty2
ccaguucuggcugcgcuu

SEQ ID NO: 1741159 - RNA, 19 nt, Salmonella enterica enterica serovar Typhi Ty2
ccaguuauuaaucaagccc

SEQ ID NO: 1741160 - RNA, 18 nt, Salmonella enterica enterica serovar Typhi Ty2
ccaguugcgucagcguac

SEQ ID NO: 1741161 - RNA, 13 nt, Salmonella enterica enterica serovar Typhi Ty2
ccagucgcagcca

SEQ ID NO: 1741162 - RNA, 21 nt, Salmonella enterica enterica serovar Typhi Ty2
ccagguuucuggcaacagcca

SEQ ID NO: 1741163 - RNA, 15 nt, Salmonella enterica enterica serovar Typhi Ty2
ccauggcccaaaagg

SEQ ID NO: 1741164 - RNA, 19 nt, Salmonella enterica enterica serovar Typhi Ty2
ccauguuuaccaucgcguu

SEQ ID NO: 1741165 - RNA, 16 nt, Salmonella enterica enterica serovar Typhi Ty2
ccauuacuaacacguu

SEQ ID NO: 1741166 - RNA, 21 nt, Salmonella enterica enterica serovar Typhi Ty2
ccauuacgcuauaaaguuccc

SEQ ID NO: 1741167 - RNA, 16 nt, Salmonella enterica enterica serovar Typhi Ty2
ccauuaagcaauccgc

SEQ ID NO: 1741168 - RNA, 15 nt, Salmonella enterica enterica serovar Typhi Ty2
ccauucccagcgccc

SEQ ID NO: 1741169 - RNA, 15 nt, Salmonella enterica enterica serovar Typhi Ty2
ccaugcaucaauggc

SEQ ID NO: 1741170 - RNA, 22 nt, Salmonella enterica enterica serovar Typhi Ty2
ccaugagcgaaacuccagcgau

SEQ ID NO: 1741171 - RNA, 15 nt, Salmonella enterica enterica serovar Typhi Ty2
ccaugagacgcguaa

SEQ ID NO: 1741172 - RNA, 14 nt, Salmonella enterica enterica serovar Typhi Ty2
ccaugauaaucagc

SEQ ID NO: 1741173 - RNA, 24 nt, Salmonella enterica enterica serovar Typhi Ty2
ccaugagcgaaacuccagcgauaa

SEQ ID NO: 1741174 - RNA, 19 nt, Salmonella enterica enterica serovar Typhi Ty2
ccaugacggguaacgccaa

SEQ ID NO: 1741175 - RNA, 23 nt, Salmonella enterica enterica serovar Typhi Ty2
ccaucgcggcgcaaaucgccauc

SEQ ID NO: 1741176 - RNA, 21 nt, Salmonella enterica enterica serovar Typhi Ty2
ccauccauauugagcgguagc

SEQ ID NO: 1741177 - RNA, 13 nt, Salmonella enterica enterica serovar Typhi Ty2
ccaucaugcgcca

SEQ ID NO: 1741178 - RNA, 13 nt, Salmonella enterica enterica serovar Typhi Ty2
ccaucauuaccaa

SEQ ID NO: 1741179 - RNA, 19 nt, Salmonella enterica enterica serovar Typhi Ty2
ccauccaccaggcaugcag

SEQ ID NO: 1741180 - RNA, 18 nt, Salmonella enterica enterica serovar Typhi Ty2
ccaucaguccccagcgua

SEQ ID NO: 1741181 - RNA, 22 nt, Salmonella enterica enterica serovar Typhi Ty2
ccauaauuugauauuuaaucgc

SEQ ID NO: 1741182 - RNA, 23 nt, Salmonella enterica enterica serovar Typhi Ty2
ccauaauuuauccuccgaacagg

SEQ ID NO: 1741183 - RNA, 18 nt, Salmonella enterica enterica serovar Typhi Ty2
ccaguuguuccagcagcu

SEQ ID NO: 1741184 - RNA, 21 nt, Salmonella enterica enterica serovar Typhi Ty2
ccaucgcgacacccaauccgg

SEQ ID NO: 1741185 - RNA, 19 nt, Salmonella enterica enterica serovar Typhi Ty2
ccaucgcccgggcgauauc

SEQ ID NO: 1741186 - RNA, 17 nt, Salmonella enterica enterica serovar Typhi Ty2
ccaucgacagcgccaua

SEQ ID NO: 1741187 - RNA, 18 nt, Salmonella enterica enterica serovar Typhi Ty2
ccccgauaaaccaggcag

SEQ ID NO: 1741188 - RNA, 14 nt, Salmonella enterica enterica serovar Typhi Ty2
ccccgaaagccggu

SEQ ID NO: 1741189 - RNA, 11 nt, Salmonella enterica enterica serovar Typhi Ty2
ccccggcacca

SEQ ID NO: 1741190 - RNA, 16 nt, Salmonella enterica enterica serovar Typhi Ty2
ccccgccgcugaggau

SEQ ID NO: 1741191 - RNA, 12 nt, Salmonella enterica enterica serovar Typhi Ty2
ccccauacgcgc

SEQ ID NO: 1741192 - RNA, 15 nt, Salmonella enterica enterica serovar Typhi Ty2
ccccagcgccagccg

SEQ ID NO: 1741193 - RNA, 21 nt, Salmonella enterica enterica serovar Typhi Ty2
ccccaggcgauaccgcgcugg

SEQ ID NO: 1741194 - RNA, 19 nt, Salmonella enterica enterica serovar Typhi Ty2
ccccacaaucccgccagac

SEQ ID NO: 1741195 - RNA, 19 nt, Salmonella enterica enterica serovar Typhi Ty2
cccauugaaaucgccucau

SEQ ID NO: 1741196 - RNA, 13 nt, Salmonella enterica enterica serovar Typhi Ty2
cccaucccggcaa

SEQ ID NO: 1741197 - RNA, 18 nt, Salmonella enterica enterica serovar Typhi Ty2
cccaucgccacagcggaa

SEQ ID NO: 1741198 - RNA, 12 nt, Salmonella enterica enterica serovar Typhi Ty2
ccccagcaccga

SEQ ID NO: 1741199 - RNA, 12 nt, Salmonella enterica enterica serovar Typhi Ty2
ccccacagaccu

SEQ ID NO: 1741200 - RNA, 13 nt, Salmonella enterica enterica serovar Typhi Ty2
cccagauaucagg

SEQ ID NO: 1741201 - RNA, 12 nt, Salmonella enterica enterica serovar Typhi Ty2
cccagaucgccc

SEQ ID NO: 1741202 - RNA, 13 nt, Salmonella enterica enterica serovar Typhi Ty2
cccagauauccgc

SEQ ID NO: 1741203 - RNA, 23 nt, Salmonella enterica enterica serovar Typhi Ty2
cccagacgcccuucaauaucaac

SEQ ID NO: 1741204 - RNA, 13 nt, Salmonella enterica enterica serovar Typhi Ty2
cccagaucaggcc

SEQ ID NO: 1741205 - RNA, 16 nt, Salmonella enterica enterica serovar Typhi Ty2
ccauugauaccaauaa

SEQ ID NO: 1741206 - RNA, 13 nt, Salmonella enterica enterica serovar Typhi Ty2
ccauugccagaua

SEQ ID NO: 1741207 - RNA, 12 nt, Salmonella enterica enterica serovar Typhi Ty2
ccauuccucacg

SEQ ID NO: 1741208 - RNA, 19 nt, Salmonella enterica enterica serovar Typhi Ty2
ccauuccgauagcgaaacu

SEQ ID NO: 1741209 - RNA, 15 nt, Salmonella enterica enterica serovar Typhi Ty2
ccauucccgccgcaa

SEQ ID NO: 1741210 - RNA, 20 nt, Salmonella enterica enterica serovar Typhi Ty2
cccagcugagcuaaucaccc

SEQ ID NO: 1741211 - RNA, 21 nt, Salmonella enterica enterica serovar Typhi Ty2
cccaucauugacuucaacgca

SEQ ID NO: 1741212 - RNA, 14 nt, Salmonella enterica enterica serovar Typhi Ty2
cccggccugacgca

SEQ ID NO: 1741213 - RNA, 24 nt, Salmonella enterica enterica serovar Typhi Ty2
cccggcaauuaccgccagcggcgu

SEQ ID NO: 1741214 - RNA, 14 nt, Salmonella enterica enterica serovar Typhi Ty2
cccgcacagcacau

SEQ ID NO: 1741215 - RNA, 13 nt, Salmonella enterica enterica serovar Typhi Ty2
ccccggcggcguu

SEQ ID NO: 1741216 - RNA, 17 nt, Salmonella enterica enterica serovar Typhi Ty2
cccgccgccagcaccgc

SEQ ID NO: 1741217 - RNA, 12 nt, Salmonella enterica enterica serovar Typhi Ty2
cccgccgccauc

SEQ ID NO: 1741218 - RNA, 12 nt, Salmonella enterica enterica serovar Typhi Ty2
cccgccgccauu

SEQ ID NO: 1741219 - RNA, 13 nt, Salmonella enterica enterica serovar Typhi Ty2
cccgcagccagaa

SEQ ID NO: 1741220 - RNA, 15 nt, Salmonella enterica enterica serovar Typhi Ty2
cccgcguuuccacgc

SEQ ID NO: 1741221 - RNA, 15 nt, Salmonella enterica enterica serovar Typhi Ty2
cccgcugcgccguuc

SEQ ID NO: 1741222 - RNA, 18 nt, Salmonella enterica enterica serovar Typhi Ty2
ccgaagauaaagauauuc

SEQ ID NO: 1741223 - RNA, 16 nt, Salmonella enterica enterica serovar Typhi Ty2
ccgacacggcucgccu

SEQ ID NO: 1741224 - RNA, 21 nt, Salmonella enterica enterica serovar Typhi Ty2
ccgacauaggccagccgacgc

SEQ ID NO: 1741225 - RNA, 22 nt, Salmonella enterica enterica serovar Typhi Ty2
ccgacaggguuugccagcacca

SEQ ID NO: 1741226 - RNA, 13 nt, Salmonella enterica enterica serovar Typhi Ty2
ccgaccagggcau

SEQ ID NO: 1741227 - RNA, 17 nt, Salmonella enterica enterica serovar Typhi Ty2
ccgaccuguaccgcgac

SEQ ID NO: 1741228 - RNA, 15 nt, Salmonella enterica enterica serovar Typhi Ty2
ccgaccgucggcgca

SEQ ID NO: 1741229 - RNA, 13 nt, Salmonella enterica enterica serovar Typhi Ty2
cccucggcagcaa

SEQ ID NO: 1741230 - RNA, 19 nt, Salmonella enterica enterica serovar Typhi Ty2
cccugagcgcuacgccugu

SEQ ID NO: 1741231 - RNA, 20 nt, Salmonella enterica enterica serovar Typhi Ty2
cccugcggguaauccgacgc

SEQ ID NO: 1741232 - RNA, 11 nt, Salmonella enterica enterica serovar Typhi Ty2
cccuauccgcg

SEQ ID NO: 1741233 - RNA, 17 nt, Salmonella enterica enterica serovar Typhi Ty2
cccuauaacagcgcugg

SEQ ID NO: 1741234 - RNA, 12 nt, Salmonella enterica enterica serovar Typhi Ty2
ccgaacacgcau

SEQ ID NO: 1741235 - RNA, 16 nt, Salmonella enterica enterica serovar Typhi Ty2
cccugcuguuccagug

SEQ ID NO: 1741236 - RNA, 23 nt, Salmonella enterica enterica serovar Typhi Ty2
cccuucaauaucaagauccaaca

SEQ ID NO: 1741237 - RNA, 18 nt, Salmonella enterica enterica serovar Typhi Ty2
aucaccagaucggcaucu

SEQ ID NO: 1741238 - RNA, 14 nt, Salmonella enterica enterica serovar Typhi Ty2
aucacauugcccca

SEQ ID NO: 1741239 - RNA, 12 nt, Salmonella enterica enterica serovar Typhi Ty2
aucacagacaga

SEQ ID NO: 1741240 - RNA, 14 nt, Salmonella enterica enterica serovar Typhi Ty2
aucacaaggaauga

SEQ ID NO: 1741241 - RNA, 14 nt, Salmonella enterica enterica serovar Typhi Ty2
aucaccaucacgau

SEQ ID NO: 1741242 - RNA, 23 nt, Salmonella enterica enterica serovar Typhi Ty2
aucaccgcccuggcgggaaacag

SEQ ID NO: 1741243 - RNA, 14 nt, Salmonella enterica enterica serovar Typhi Ty2
aucacgaaauaacg

SEQ ID NO: 1741244 - RNA, 21 nt, Salmonella enterica enterica serovar Typhi Ty2
aucacgccacaguauuccggc

SEQ ID NO: 1741245 - RNA, 22 nt, Salmonella enterica enterica serovar Typhi Ty2
aucacguguuacgccgcaauca

SEQ ID NO: 1741246 - RNA, 16 nt, Salmonella enterica enterica serovar Typhi Ty2
aucacgguacgcauca

SEQ ID NO: 1741247 - RNA, 14 nt, Salmonella enterica enterica serovar Typhi Ty2
aucagauuuaggau

SEQ ID NO: 1741248 - RNA, 22 nt, Salmonella enterica enterica serovar Typhi Ty2
aucagcaaaauaccggcagcgg

SEQ ID NO: 1741249 - RNA, 20 nt, Salmonella enterica enterica serovar Typhi Ty2
aucagauugauacggguaau

SEQ ID NO: 1741250 - RNA, 16 nt, Salmonella enterica enterica serovar Typhi Ty2
aucagauucgcuacug

SEQ ID NO: 1741251 - RNA, 15 nt, Salmonella enterica enterica serovar Typhi Ty2
aucagcaacgcgcca

SEQ ID NO: 1741252 - RNA, 13 nt, Salmonella enterica enterica serovar Typhi Ty2
aucagacgcauca

SEQ ID NO: 1741253 - RNA, 16 nt, Salmonella enterica enterica serovar Typhi Ty2
aucagacuguuacgcu

SEQ ID NO: 1741254 - RNA, 23 nt, Salmonella enterica enterica serovar Typhi Ty2
aucagaucaugaggaugagcguu

SEQ ID NO: 1741255 - RNA, 22 nt, Salmonella enterica enterica serovar Typhi Ty2
aucagaguaauuuguugcgcuu

SEQ ID NO: 1741256 - RNA, 19 nt, Salmonella enterica enterica serovar Typhi Ty2
aucacuauuugugcggcau

SEQ ID NO: 1741257 - RNA, 14 nt, Salmonella enterica enterica serovar Typhi Ty2
aucacuaauuugcg

SEQ ID NO: 1741258 - RNA, 16 nt, Salmonella enterica enterica serovar Typhi Ty2
aucacuaccgccauca

SEQ ID NO: 1741259 - RNA, 23 nt, Salmonella enterica enterica serovar Typhi Ty2
aucacugcaccucagaccguuag

SEQ ID NO: 1741260 - RNA, 20 nt, Salmonella enterica enterica serovar Typhi Ty2
aucacuuuacccacaucaau

SEQ ID NO: 1741261 - RNA, 16 nt, Salmonella enterica enterica serovar Typhi Ty2
aucacuuuugccguca

SEQ ID NO: 1741262 - RNA, 21 nt, Salmonella enterica enterica serovar Typhi Ty2
aucagaaaaaccuccggcuau

SEQ ID NO: 1741263 - RNA, 17 nt, Salmonella enterica enterica serovar Typhi Ty2
aucacuuacuaagguaa

SEQ ID NO: 1741264 - RNA, 13 nt, Salmonella enterica enterica serovar Typhi Ty2
aucacuuccgcca

SEQ ID NO: 1741265 - RNA, 22 nt, Salmonella enterica enterica serovar Typhi Ty2
aucagcccuaucgcugcgcugc

SEQ ID NO: 1741266 - RNA, 15 nt, Salmonella enterica enterica serovar Typhi Ty2
aucagccagccgcca

SEQ ID NO: 1741267 - RNA, 16 nt, Salmonella enterica enterica serovar Typhi Ty2
aucagccagccgccaa

SEQ ID NO: 1741268 - RNA, 11 nt, Salmonella enterica enterica serovar Typhi Ty2
aucagcgccac

SEQ ID NO: 1741269 - RNA, 21 nt, Salmonella enterica enterica serovar Typhi Ty2
aucagcauuacccccgccaua

SEQ ID NO: 1741270 - RNA, 20 nt, Salmonella enterica enterica serovar Typhi Ty2
auaugaauaauuucggcggc

SEQ ID NO: 1741271 - RNA, 17 nt, Salmonella enterica enterica serovar Typhi Ty2
auaugccccgacaucag

SEQ ID NO: 1741272 - RNA, 18 nt, Salmonella enterica enterica serovar Typhi Ty2
auauguggauguaccaga

SEQ ID NO: 1741273 - RNA, 12 nt, Salmonella enterica enterica serovar Typhi Ty2
auaugcgcauca

SEQ ID NO: 1741274 - RNA, 19 nt, Salmonella enterica enterica serovar Typhi Ty2
auaugcgucagcgcggcuu

SEQ ID NO: 1741275 - RNA, 15 nt, Salmonella enterica enterica serovar Typhi Ty2
auauuuacugaauaa

SEQ ID NO: 1741276 - RNA, 13 nt, Salmonella enterica enterica serovar Typhi Ty2
auauuuccgcgau

SEQ ID NO: 1741277 - RNA, 20 nt, Salmonella enterica enterica serovar Typhi Ty2
auagccuuuauugaugacau

SEQ ID NO: 1741278 - RNA, 14 nt, Salmonella enterica enterica serovar Typhi Ty2
auagcgaccagcgu

SEQ ID NO: 1741279 - RNA, 19 nt, Salmonella enterica enterica serovar Typhi Ty2
auagcgaccuuaccggcga

SEQ ID NO: 1741280 - RNA, 12 nt, Salmonella enterica enterica serovar Typhi Ty2
auaucaaugcgc

SEQ ID NO: 1741281 - RNA, 15 nt, Salmonella enterica enterica serovar Typhi Ty2
auagcgcagcauugg

SEQ ID NO: 1741282 - RNA, 22 nt, Salmonella enterica enterica serovar Typhi Ty2
auauccagcucgcgcaggcgga

SEQ ID NO: 1741283 - RNA, 21 nt, Salmonella enterica enterica serovar Typhi Ty2
aucaauaagggucgcgcugua

SEQ ID NO: 1741284 - RNA, 14 nt, Salmonella enterica enterica serovar Typhi Ty2
aucaaguaacgugc

SEQ ID NO: 1741285 - RNA, 21 nt, Salmonella enterica enterica serovar Typhi Ty2
aucaagcgguagcguuaucca

SEQ ID NO: 1741286 - RNA, 19 nt, Salmonella enterica enterica serovar Typhi Ty2
aucacaacgucaucccgaa

SEQ ID NO: 1741287 - RNA, 20 nt, Salmonella enterica enterica serovar Typhi Ty2
aucaaugcccagcgcaauca

SEQ ID NO: 1741288 - RNA, 16 nt, Salmonella enterica enterica serovar Typhi Ty2
aucaaucuacuguuau

SEQ ID NO: 1741289 - RNA, 20 nt, Salmonella enterica enterica serovar Typhi Ty2
aucaauauaucaggcugagc

SEQ ID NO: 1741290 - RNA, 18 nt, Salmonella enterica enterica serovar Typhi Ty2
auauuuuucauucgcgcu

SEQ ID NO: 1741291 - RNA, 17 nt, Salmonella enterica enterica serovar Typhi Ty2
auauuuuucagcuucug

SEQ ID NO: 1741292 - RNA, 13 nt, Salmonella enterica enterica serovar Typhi Ty2
auauuuguaucug

SEQ ID NO: 1741293 - RNA, 15 nt, Salmonella enterica enterica serovar Typhi Ty2
aucaaaaucaucgcc

SEQ ID NO: 1741294 - RNA, 18 nt, Salmonella enterica enterica serovar Typhi Ty2
aucaacgccgcgccauca

SEQ ID NO: 1741295 - RNA, 23 nt, Salmonella enterica enterica serovar Typhi Ty2
aucaacgaccaugguucccgcca

SEQ ID NO: 1741296 - RNA, 17 nt, Salmonella enterica enterica serovar Typhi Ty2
aucaacccgcuaccgca

SEQ ID NO: 1741297 - RNA, 21 nt, Salmonella enterica enterica serovar Typhi Ty2
aucaaaugagaauagacuggc

SEQ ID NO: 1741298 - RNA, 22 nt, Salmonella enterica enterica serovar Typhi Ty2
auacuccauugucggcagcgag

SEQ ID NO: 1741299 - RNA, 15 nt, Salmonella enterica enterica serovar Typhi Ty2
auacuccugccugac

SEQ ID NO: 1741300 - RNA, 17 nt, Salmonella enterica enterica serovar Typhi Ty2
auacucuuucccggcaa

SEQ ID NO: 1741301 - RNA, 21 nt, Salmonella enterica enterica serovar Typhi Ty2
auagacuucacuuucccggaa

SEQ ID NO: 1741302 - RNA, 15 nt, Salmonella enterica enterica serovar Typhi Ty2
auagacuuaggaaug

SEQ ID NO: 1741303 - RNA, 17 nt, Salmonella enterica enterica serovar Typhi Ty2
auacuuccgcuggcuuu

SEQ ID NO: 1741304 - RNA, 23 nt, Salmonella enterica enterica serovar Typhi Ty2
auacuucgcucucuuuuggcgac

SEQ ID NO: 1741305 - RNA, 20 nt, Salmonella enterica enterica serovar Typhi Ty2
auacugcuuuuccggcagcg

SEQ ID NO: 1741306 - RNA, 17 nt, Salmonella enterica enterica serovar Typhi Ty2
auagcaauacuuuccag

SEQ ID NO: 1741307 - RNA, 17 nt, Salmonella enterica enterica serovar Typhi Ty2
auagcaaacccucaucg

SEQ ID NO: 1741308 - RNA, 18 nt, Salmonella enterica enterica serovar Typhi Ty2
auagcaacccacuuucgg

SEQ ID NO: 1741309 - RNA, 17 nt, Salmonella enterica enterica serovar Typhi Ty2
auagcaucguaagccgc

SEQ ID NO: 1741310 - RNA, 18 nt, Salmonella enterica enterica serovar Typhi Ty2
auacgucuugcggucgcc

SEQ ID NO: 1741311 - RNA, 12 nt, Salmonella enterica enterica serovar Typhi Ty2
auaccgccaucc

SEQ ID NO: 1741312 - RNA, 15 nt, Salmonella enterica enterica serovar Typhi Ty2
auacccggcucccau

SEQ ID NO: 1741313 - RNA, 22 nt, Salmonella enterica enterica serovar Typhi Ty2
auaccgaaauccgcuuugagcu

SEQ ID NO: 1741314 - RNA, 15 nt, Salmonella enterica enterica serovar Typhi Ty2
auacauaccacgcag

SEQ ID NO: 1741315 - RNA, 19 nt, Salmonella enterica enterica serovar Typhi Ty2
auaaugcacaauacgccga

SEQ ID NO: 1741316 - RNA, 18 nt, Salmonella enterica enterica serovar Typhi Ty2
auaauguuugcgccaucg

SEQ ID NO: 1741317 - RNA, 18 nt, Salmonella enterica enterica serovar Typhi Ty2
auaaugucggauggcggc

SEQ ID NO: 1741318 - RNA, 20 nt, Salmonella enterica enterica serovar Typhi Ty2
auacagccgacuauuccgca

SEQ ID NO: 1741319 - RNA, 20 nt, Salmonella enterica enterica serovar Typhi Ty2
auaaggcgcuugcgccauca

SEQ ID NO: 1741320 - RNA, 20 nt, Salmonella enterica enterica serovar Typhi Ty2
auaaggccacgccgccaucc

SEQ ID NO: 1741321 - RNA, 19 nt, Salmonella enterica enterica serovar Typhi Ty2
auaaucccggcgccaauca

SEQ ID NO: 1741322 - RNA, 13 nt, Salmonella enterica enterica serovar Typhi Ty2
auaaucauccgcu

SEQ ID NO: 1741323 - RNA, 18 nt, Salmonella enterica enterica serovar Typhi Ty2
auaaauuuuuuaacagaa

SEQ ID NO: 1741324 - RNA, 14 nt, Salmonella enterica enterica serovar Typhi Ty2
auaacaaacgccgc

SEQ ID NO: 1741325 - RNA, 18 nt, Salmonella enterica enterica serovar Typhi Ty2
auaagcgcagcgccaucc

SEQ ID NO: 1741326 - RNA, 13 nt, Salmonella enterica enterica serovar Typhi Ty2
auaagcgucagcg

SEQ ID NO: 1741327 - RNA, 18 nt, Salmonella enterica enterica serovar Typhi Ty2
auaagcgcagcgucauca

SEQ ID NO: 1741328 - RNA, 15 nt, Salmonella enterica enterica serovar Typhi Ty2
auaagcgcucaggca

SEQ ID NO: 1741329 - RNA, 18 nt, Salmonella enterica enterica serovar Typhi Ty2
auaagcauagcgccauca

SEQ ID NO: 1741330 - RNA, 17 nt, Salmonella enterica enterica serovar Typhi Ty2
aguuuuacugaugccag

SEQ ID NO: 1741331 - RNA, 15 nt, Salmonella enterica enterica serovar Typhi Ty2
aguuuuacugaugcc

SEQ ID NO: 1741332 - RNA, 18 nt, Salmonella enterica enterica serovar Typhi Ty2
auaaaagcccuuaucgcc

SEQ ID NO: 1741333 - RNA, 22 nt, Salmonella enterica enterica serovar Typhi Ty2
auaaaaagccaucccgcugauc

SEQ ID NO: 1741334 - RNA, 15 nt, Salmonella enterica enterica serovar Typhi Ty2
auaaaaaaggccgcu

SEQ ID NO: 1741335 - RNA, 17 nt, Salmonella enterica enterica serovar Typhi Ty2
auaaaaaagcugcgauc

SEQ ID NO: 1741336 - RNA, 16 nt, Salmonella enterica enterica serovar Typhi Ty2
auaaauacaauucaac

SEQ ID NO: 1741337 - RNA, 20 nt, Salmonella enterica enterica serovar Typhi Ty2
auaaauccccgccgccauca

SEQ ID NO: 1741338 - RNA, 14 nt, Salmonella enterica enterica serovar Typhi Ty2
auaaaucagcccga

SEQ ID NO: 1741339 - RNA, 18 nt, Salmonella enterica enterica serovar Typhi Ty2
auaaauccccgccgccau

SEQ ID NO: 1741340 - RNA, 20 nt, Salmonella enterica enterica serovar Typhi Ty2
auaaagucagacaaguagcc

SEQ ID NO: 1741341 - RNA, 23 nt, Salmonella enterica enterica serovar Typhi Ty2
auaaaggccggcagccgcugaua

SEQ ID NO: 1741342 - RNA, 21 nt, Salmonella enterica enterica serovar Typhi Ty2
auaaacgccaguggaugcgcu

SEQ ID NO: 1741343 - RNA, 16 nt, Salmonella enterica enterica serovar Typhi Ty2
auaaaccuaucaggcg

SEQ ID NO: 1741344 - RNA, 22 nt, Salmonella enterica enterica serovar Typhi Ty2
auaaaccggcggccuaccaguu

SEQ ID NO: 1741345 - RNA, 21 nt, Salmonella enterica enterica serovar Typhi Ty2
aguucuggcuuugcgccggca

SEQ ID NO: 1741346 - RNA, 15 nt, Salmonella enterica enterica serovar Typhi Ty2
aguugcaagucacca

SEQ ID NO: 1741347 - RNA, 12 nt, Salmonella enterica enterica serovar Typhi Ty2
aguuccggauac

SEQ ID NO: 1741348 - RNA, 22 nt, Salmonella enterica enterica serovar Typhi Ty2
agucgcauugugccugauggcg

SEQ ID NO: 1741349 - RNA, 21 nt, Salmonella enterica enterica serovar Typhi Ty2
agugugccagcagaugaacgg

SEQ ID NO: 1741350 - RNA, 16 nt, Salmonella enterica enterica serovar Typhi Ty2
agguuucuucaucaaa

SEQ ID NO: 1741351 - RNA, 23 nt, Salmonella enterica enterica serovar Typhi Ty2
aguaaaaugcccugcuggcgcau

SEQ ID NO: 1741352 - RNA, 16 nt, Salmonella enterica enterica serovar Typhi Ty2
agguugcguccgccgc

SEQ ID NO: 1741353 - RNA, 18 nt, Salmonella enterica enterica serovar Typhi Ty2
agguuauucagguggauc

SEQ ID NO: 1741354 - RNA, 13 nt, Salmonella enterica enterica serovar Typhi Ty2
agguuaugcgcac

SEQ ID NO: 1741355 - RNA, 12 nt, Salmonella enterica enterica serovar Typhi Ty2
aggugcugguga

SEQ ID NO: 1741356 - RNA, 16 nt, Salmonella enterica enterica serovar Typhi Ty2
agguggguuccagcgc

SEQ ID NO: 1741357 - RNA, 15 nt, Salmonella enterica enterica serovar Typhi Ty2
aguaucgcgccgcca

SEQ ID NO: 1741358 - RNA, 17 nt, Salmonella enterica enterica serovar Typhi Ty2
aguacaggcauugucac

SEQ ID NO: 1741359 - RNA, 22 nt, Salmonella enterica enterica serovar Typhi Ty2
aguaacgggcaucgccgcaacu

SEQ ID NO: 1741360 - RNA, 20 nt, Salmonella enterica enterica serovar Typhi Ty2
aguaauuugaacauauccgc

SEQ ID NO: 1741361 - RNA, 14 nt, Salmonella enterica enterica serovar Typhi Ty2
aguaauuugaacau

SEQ ID NO: 1741362 - RNA, 15 nt, Salmonella enterica enterica serovar Typhi Ty2
aguaauucccggcag

SEQ ID NO: 1741363 - RNA, 23 nt, Salmonella enterica enterica serovar Typhi Ty2
agucauaauacucaauauccugc

SEQ ID NO: 1741364 - RNA, 15 nt, Salmonella enterica enterica serovar Typhi Ty2
agucagucccgcgcu

SEQ ID NO: 1741365 - RNA, 23 nt, Salmonella enterica enterica serovar Typhi Ty2
agucaggaucgguaaacgccccu

SEQ ID NO: 1741366 - RNA, 15 nt, Salmonella enterica enterica serovar Typhi Ty2
aguaugccucgcgca

SEQ ID NO: 1741367 - RNA, 11 nt, Salmonella enterica enterica serovar Typhi Ty2
aguauggcgac

SEQ ID NO: 1741368 - RNA, 15 nt, Salmonella enterica enterica serovar Typhi Ty2
aguaugaccguugau

SEQ ID NO: 1741369 - RNA, 20 nt, Salmonella enterica enterica serovar Typhi Ty2
aguccaacaaggauauccgc

SEQ ID NO: 1741370 - RNA, 22 nt, Salmonella enterica enterica serovar Typhi Ty2
aguccugccggacugauaccgc

SEQ ID NO: 1741371 - RNA, 14 nt, Salmonella enterica enterica serovar Typhi Ty2
aguccugcgucgcu

SEQ ID NO: 1741372 - RNA, 14 nt, Salmonella enterica enterica serovar Typhi Ty2
aguccuuccgccgg

SEQ ID NO: 1741373 - RNA, 17 nt, Salmonella enterica enterica serovar Typhi Ty2
agguaauaucauccggu

SEQ ID NO: 1741374 - RNA, 16 nt, Salmonella enterica enterica serovar Typhi Ty2
agguacagaugcugua

SEQ ID NO: 1741375 - RNA, 21 nt, Salmonella enterica enterica serovar Typhi Ty2
agguacugcauaauggcgacg

SEQ ID NO: 1741376 - RNA, 14 nt, Salmonella enterica enterica serovar Typhi Ty2
agguagagcuggcu

SEQ ID NO: 1741377 - RNA, 21 nt, Salmonella enterica enterica serovar Typhi Ty2
agggauuuugcuuuuucggca

SEQ ID NO: 1741378 - RNA, 18 nt, Salmonella enterica enterica serovar Typhi Ty2
agggauaagguugucaaa

SEQ ID NO: 1741379 - RNA, 21 nt, Salmonella enterica enterica serovar Typhi Ty2
agggcaagaauuaaauaacgg

SEQ ID NO: 1741380 - RNA, 16 nt, Salmonella enterica enterica serovar Typhi Ty2
agggguguuacgccau

SEQ ID NO: 1741381 - RNA, 13 nt, Salmonella enterica enterica serovar Typhi Ty2
aggucggcuccug

SEQ ID NO: 1741382 - RNA, 17 nt, Salmonella enterica enterica serovar Typhi Ty2
aggucggcuccugguga

SEQ ID NO: 1741383 - RNA, 20 nt, Salmonella enterica enterica serovar Typhi Ty2
aggucggguaaggcguagcc

SEQ ID NO: 1741384 - RNA, 15 nt, Salmonella enterica enterica serovar Typhi Ty2
aggucggguaagcgu

SEQ ID NO: 1741385 - RNA, 18 nt, Salmonella enterica enterica serovar Typhi Ty2
aggccggauaaggcgcag

SEQ ID NO: 1741386 - RNA, 16 nt, Salmonella enterica enterica serovar Typhi Ty2
aggcaucuuccagcgu

SEQ ID NO: 1741387 - RNA, 15 nt, Salmonella enterica enterica serovar Typhi Ty2
aggccaucauaccgc

SEQ ID NO: 1741388 - RNA, 20 nt, Salmonella enterica enterica serovar Typhi Ty2
aggauggccagcaccagcau

SEQ ID NO: 1741389 - RNA, 15 nt, Salmonella enterica enterica serovar Typhi Ty2
agcugccaaaaggcg

SEQ ID NO: 1741390 - RNA, 18 nt, Salmonella enterica enterica serovar Typhi Ty2
aggcggagaaaugcgaca

SEQ ID NO: 1741391 - RNA, 14 nt, Salmonella enterica enterica serovar Typhi Ty2
aggcuaaagugcgu

SEQ ID NO: 1741392 - RNA, 18 nt, Salmonella enterica enterica serovar Typhi Ty2
aggcguuuugguccgcgc

SEQ ID NO: 1741393 - RNA, 16 nt, Salmonella enterica enterica serovar Typhi Ty2
aggcguuuuauuggua

SEQ ID NO: 1741394 - RNA, 19 nt, Salmonella enterica enterica serovar Typhi Ty2
aggcguuuaugagaucggg

SEQ ID NO: 1741395 - RNA, 18 nt, Salmonella enterica enterica serovar Typhi Ty2
aggcguugcuccagcagc

SEQ ID NO: 1741396 - RNA, 23 nt, Salmonella enterica enterica serovar Typhi Ty2
aggcgugcguauugccccgucag

SEQ ID NO: 1741397 - RNA, 18 nt, Salmonella enterica enterica serovar Typhi Ty2
aggcgugccccgcaacgc

SEQ ID NO: 1741398 - RNA, 20 nt, Salmonella enterica enterica serovar Typhi Ty2
aggcuauuuuauucgccauu

SEQ ID NO: 1741399 - RNA, 13 nt, Salmonella enterica enterica serovar Typhi Ty2
aggcucagcgcca

SEQ ID NO: 1741400 - RNA, 16 nt, Salmonella enterica enterica serovar Typhi Ty2
agggagaacucaucuc

SEQ ID NO: 1741401 - RNA, 18 nt, Salmonella enterica enterica serovar Typhi Ty2
aggcgcguuuacuggcga

SEQ ID NO: 1741402 - RNA, 13 nt, Salmonella enterica enterica serovar Typhi Ty2
aggccuaccagcc

SEQ ID NO: 1741403 - RNA, 16 nt, Salmonella enterica enterica serovar Typhi Ty2
aggccuaccagccgag

SEQ ID NO: 1741404 - RNA, 20 nt, Salmonella enterica enterica serovar Typhi Ty2
aggcgauaccgguacggaac

SEQ ID NO: 1741405 - RNA, 13 nt, Salmonella enterica enterica serovar Typhi Ty2
agcagcagcgcaa

SEQ ID NO: 1741406 - RNA, 18 nt, Salmonella enterica enterica serovar Typhi Ty2
agcacuccccggcuugcg

SEQ ID NO: 1741407 - RNA, 19 nt, Salmonella enterica enterica serovar Typhi Ty2
agcacggcaguacacgcau

SEQ ID NO: 1741408 - RNA, 12 nt, Salmonella enterica enterica serovar Typhi Ty2
agcaauggcgug

SEQ ID NO: 1741409 - RNA, 20 nt, Salmonella enterica enterica serovar Typhi Ty2
agcaauggguaggccggaua

SEQ ID NO: 1741410 - RNA, 17 nt, Salmonella enterica enterica serovar Typhi Ty2
agcaaugauaacggcgc

SEQ ID NO: 1741411 - RNA, 21 nt, Salmonella enterica enterica serovar Typhi Ty2
agcaauagguuugaccagaua

SEQ ID NO: 1741412 - RNA, 13 nt, Salmonella enterica enterica serovar Typhi Ty2
agcaccagaccga

SEQ ID NO: 1741413 - RNA, 19 nt, Salmonella enterica enterica serovar Typhi Ty2
agcaacagcguaccuuuau

SEQ ID NO: 1741414 - RNA, 16 nt, Salmonella enterica enterica serovar Typhi Ty2
agcaaaucgcccauca

SEQ ID NO: 1741415 - RNA, 17 nt, Salmonella enterica enterica serovar Typhi Ty2
agaucggcaugauggcg

SEQ ID NO: 1741416 - RNA, 20 nt, Salmonella enterica enterica serovar Typhi Ty2
agaucgccgccgguaacgau

SEQ ID NO: 1741417 - RNA, 17 nt, Salmonella enterica enterica serovar Typhi Ty2
agaucgaccagcgcaua

SEQ ID NO: 1741418 - RNA, 17 nt, Salmonella enterica enterica serovar Typhi Ty2
agaucgagacgcgucag

SEQ ID NO: 1741419 - RNA, 18 nt, Salmonella enterica enterica serovar Typhi Ty2
agaugauaaucauccggg

SEQ ID NO: 1741420 - RNA, 19 nt, Salmonella enterica enterica serovar Typhi Ty2
agaugaucguuuccagcau

SEQ ID NO: 1741421 - RNA, 14 nt, Salmonella enterica enterica serovar Typhi Ty2
agaucuuccggcgu

SEQ ID NO: 1741422 - RNA, 13 nt, Salmonella enterica enterica serovar Typhi Ty2
agaugaagcgcau

SEQ ID NO: 1741423 - RNA, 20 nt, Salmonella enterica enterica serovar Typhi Ty2
agauggcgucacauggcgaa

SEQ ID NO: 1741424 - RNA, 23 nt, Salmonella enterica enterica serovar Typhi Ty2
agaaacaucaucguuugcgcgca

SEQ ID NO: 1741425 - RNA, 15 nt, Salmonella enterica enterica serovar Typhi Ty2
agaaacgcuuuccgg

SEQ ID NO: 1741426 - RNA, 13 nt, Salmonella enterica enterica serovar Typhi Ty2
agaaaaugcgcug

SEQ ID NO: 1741427 - RNA, 21 nt, Salmonella enterica enterica serovar Typhi Ty2
agaaaguaguauccccggcaa

SEQ ID NO: 1741428 - RNA, 16 nt, Salmonella enterica enterica serovar Typhi Ty2
agaaagcgaauggcgu

SEQ ID NO: 1741429 - RNA, 16 nt, Salmonella enterica enterica serovar Typhi Ty2
agacguuuaugccgcc

SEQ ID NO: 1741430 - RNA, 15 nt, Salmonella enterica enterica serovar Typhi Ty2
agaaagggagaauac

SEQ ID NO: 1741431 - RNA, 15 nt, Salmonella enterica enterica serovar Typhi Ty2
agacucaucgccgca

SEQ ID NO: 1741432 - RNA, 16 nt, Salmonella enterica enterica serovar Typhi Ty2
agaguaggccggauaa

SEQ ID NO: 1741433 - RNA, 22 nt, Salmonella enterica enterica serovar Typhi Ty2
agaguaaucguauucauugccg

SEQ ID NO: 1741434 - RNA, 18 nt, Salmonella enterica enterica serovar Typhi Ty2
agagguguaguuggcgau

SEQ ID NO: 1741435 - RNA, 18 nt, Salmonella enterica enterica serovar Typhi Ty2
agaggcgccuggcaccau

SEQ ID NO: 1741436 - RNA, 18 nt, Salmonella enterica enterica serovar Typhi Ty2
agaggcguugccgggcau

SEQ ID NO: 1741437 - RNA, 18 nt, Salmonella enterica enterica serovar Typhi Ty2
agaggccaccagcgccag

SEQ ID NO: 1741438 - RNA, 13 nt, Salmonella enterica enterica serovar Typhi Ty2
agagcucgucaaa

SEQ ID NO: 1741439 - RNA, 13 nt, Salmonella enterica enterica serovar Typhi Ty2
agcaucauguccc

SEQ ID NO: 1741440 - RNA, 13 nt, Salmonella enterica enterica serovar Typhi Ty2
agcaucagcgccg

SEQ ID NO: 1741441 - RNA, 21 nt, Salmonella enterica enterica serovar Typhi Ty2
agcauccagcucauguaguca

SEQ ID NO: 1741442 - RNA, 22 nt, Salmonella enterica enterica serovar Typhi Ty2
agcaucaauaucugcuaccgcc

SEQ ID NO: 1741443 - RNA, 15 nt, Salmonella enterica enterica serovar Typhi Ty2
agcaucaauuugaaa

SEQ ID NO: 1741444 - RNA, 18 nt, Salmonella enterica enterica serovar Typhi Ty2
agcaugagugauagcgcc

SEQ ID NO: 1741445 - RNA, 20 nt, Salmonella enterica enterica serovar Typhi Ty2
agcaugaucauacugccgcc

SEQ ID NO: 1741446 - RNA, 14 nt, Salmonella enterica enterica serovar Typhi Ty2
agcauccuccggcg

SEQ ID NO: 1741447 - RNA, 15 nt, Salmonella enterica enterica serovar Typhi Ty2
agccaaagcgaggua

SEQ ID NO: 1741448 - RNA, 21 nt, Salmonella enterica enterica serovar Typhi Ty2
agcagccaguuauuaaucaag

SEQ ID NO: 1741449 - RNA, 16 nt, Salmonella enterica enterica serovar Typhi Ty2
agcagcaucccggcaa

SEQ ID NO: 1741450 - RNA, 19 nt, Salmonella enterica enterica serovar Typhi Ty2
agcagcauaaacaucagcg

SEQ ID NO: 1741451 - RNA, 15 nt, Salmonella enterica enterica serovar Typhi Ty2
agcagcagugaggau

SEQ ID NO: 1741452 - RNA, 14 nt, Salmonella enterica enterica serovar Typhi Ty2
agccaggccgccag

SEQ ID NO: 1741453 - RNA, 14 nt, Salmonella enterica enterica serovar Typhi Ty2
agccaucccggcga

SEQ ID NO: 1741454 - RNA, 16 nt, Salmonella enterica enterica serovar Typhi Ty2
agccagaacucaucuu

SEQ ID NO: 1741455 - RNA, 23 nt, Salmonella enterica enterica serovar Typhi Ty2
agccagaaucagccgacggcgau

SEQ ID NO: 1741456 - RNA, 14 nt, Salmonella enterica enterica serovar Typhi Ty2
agccagacgcgcag

SEQ ID NO: 1741457 - RNA, 21 nt, Salmonella enterica enterica serovar Typhi Ty2
agccagauggauaaccugccg

SEQ ID NO: 1741458 - RNA, 14 nt, Salmonella enterica enterica serovar Typhi Ty2
agccagauggcugc

SEQ ID NO: 1741459 - RNA, 15 nt, Salmonella enterica enterica serovar Typhi Ty2
agccagcaucgcuaa

SEQ ID NO: 1741460 - RNA, 17 nt, Salmonella enterica enterica serovar Typhi Ty2
agccacggcaacgccgu

SEQ ID NO: 1741461 - RNA, 15 nt, Salmonella enterica enterica serovar Typhi Ty2
agcccgcccagcauu

SEQ ID NO: 1741462 - RNA, 17 nt, Salmonella enterica enterica serovar Typhi Ty2
agcccaucagcgccagc

SEQ ID NO: 1741463 - RNA, 16 nt, Salmonella enterica enterica serovar Typhi Ty2
agcccaucaccgccag

SEQ ID NO: 1741464 - RNA, 14 nt, Salmonella enterica enterica serovar Typhi Ty2
agccccacgguacg

SEQ ID NO: 1741465 - RNA, 14 nt, Salmonella enterica enterica serovar Typhi Ty2
agccccaggccggu

SEQ ID NO: 1741466 - RNA, 19 nt, Salmonella enterica enterica serovar Typhi Ty2
agcccaauacgccagccua

SEQ ID NO: 1741467 - RNA, 14 nt, Salmonella enterica enterica serovar Typhi Ty2
agcccagcacggca

SEQ ID NO: 1741468 - RNA, 13 nt, Salmonella enterica enterica serovar Typhi Ty2
agcccucuggcaa

SEQ ID NO: 1741469 - RNA, 21 nt, Salmonella enterica enterica serovar Typhi Ty2
agcgaguuacguugcggcgua

SEQ ID NO: 1741470 - RNA, 21 nt, Salmonella enterica enterica serovar Typhi Ty2
agcgauccgccgucggcaaua

SEQ ID NO: 1741471 - RNA, 22 nt, Salmonella enterica enterica serovar Typhi Ty2
agcgcacguuuagcuugcgaag

SEQ ID NO: 1741472 - RNA, 19 nt, Salmonella enterica enterica serovar Typhi Ty2
agcgcaccuucaacagcuc

SEQ ID NO: 1741473 - RNA, 15 nt, Salmonella enterica enterica serovar Typhi Ty2
agcgcagcgccauca

SEQ ID NO: 1741474 - RNA, 19 nt, Salmonella enterica enterica serovar Typhi Ty2
agcgcagucaaaacgacau

SEQ ID NO: 1741475 - RNA, 22 nt, Salmonella enterica enterica serovar Typhi Ty2
agcgaauggcgugaagccauca

SEQ ID NO: 1741476 - RNA, 17 nt, Salmonella enterica enterica serovar Typhi Ty2
agcgaauacuccugcaa

SEQ ID NO: 1741477 - RNA, 13 nt, Salmonella enterica enterica serovar Typhi Ty2
agccgcgccaucu

SEQ ID NO: 1741478 - RNA, 20 nt, Salmonella enterica enterica serovar Typhi Ty2
agccgcgcauagcuggcgua

SEQ ID NO: 1741479 - RNA, 21 nt, Salmonella enterica enterica serovar Typhi Ty2
agcgccacaacguugaccgcu

SEQ ID NO: 1741480 - RNA, 17 nt, Salmonella enterica enterica serovar Typhi Ty2
agcgccaaaaaauaacg

SEQ ID NO: 1741481 - RNA, 15 nt, Salmonella enterica enterica serovar Typhi Ty2
agcgccagauaguca

SEQ ID NO: 1741482 - RNA, 12 nt, Salmonella enterica enterica serovar Typhi Ty2
agcgccagcaug

SEQ ID NO: 1741483 - RNA, 22 nt, Salmonella enterica enterica serovar Typhi Ty2
agcgcgaccagcgugaccggua

SEQ ID NO: 1741484 - RNA, 21 nt, Salmonella enterica enterica serovar Typhi Ty2
agcgcgcgcgccugaugcgcc

SEQ ID NO: 1741485 - RNA, 16 nt, Salmonella enterica enterica serovar Typhi Ty2
agcgcgccgucaucgc

SEQ ID NO: 1741486 - RNA, 16 nt, Salmonella enterica enterica serovar Typhi Ty2
agcgcgauacgcagca

SEQ ID NO: 1741487 - RNA, 17 nt, Salmonella enterica enterica serovar Typhi Ty2
agcgcgagcgugaucuc

SEQ ID NO: 1741488 - RNA, 22 nt, Salmonella enterica enterica serovar Typhi Ty2
agcgcuacauccgccagccgcc

SEQ ID NO: 1741489 - RNA, 22 nt, Salmonella enterica enterica serovar Typhi Ty2
agcgcuuugccgcugcugccuu

SEQ ID NO: 1741490 - RNA, 16 nt, Salmonella enterica enterica serovar Typhi Ty2
agcggugaaacuguuu

SEQ ID NO: 1741491 - RNA, 20 nt, Salmonella enterica enterica serovar Typhi Ty2
agcgucgcugauugccgcca

SEQ ID NO: 1741492 - RNA, 13 nt, Salmonella enterica enterica serovar Typhi Ty2
agcgucgcgaucc

SEQ ID NO: 1741493 - RNA, 19 nt, Salmonella enterica enterica serovar Typhi Ty2
agcguggacaaaucaucgg

SEQ ID NO: 1741494 - RNA, 17 nt, Salmonella enterica enterica serovar Typhi Ty2
agcgugacggcaagcgg

SEQ ID NO: 1741495 - RNA, 16 nt, Salmonella enterica enterica serovar Typhi Ty2
agcggcucauccagca

SEQ ID NO: 1741496 - RNA, 13 nt, Salmonella enterica enterica serovar Typhi Ty2
agcggcuucgcca

SEQ ID NO: 1741497 - RNA, 19 nt, Salmonella enterica enterica serovar Typhi Ty2
agcgggccgguaacgccgu

SEQ ID NO: 1741498 - RNA, 17 nt, Salmonella enterica enterica serovar Typhi Ty2
agcggcgccaucaccau

SEQ ID NO: 1741499 - RNA, 22 nt, Salmonella enterica enterica serovar Typhi Ty2
agcggcgccgggaacuggcagc

SEQ ID NO: 1741500 - RNA, 17 nt, Salmonella enterica enterica serovar Typhi Ty2
agcggauuaaaacgcau

SEQ ID NO: 1741501 - RNA, 18 nt, Salmonella enterica enterica serovar Typhi Ty2
agcggaugucggucauca

SEQ ID NO: 1741502 - RNA, 14 nt, Salmonella enterica enterica serovar Typhi Ty2
agcugaaugguaaa

SEQ ID NO: 1741503 - RNA, 21 nt, Salmonella enterica enterica serovar Typhi Ty2
agcucuuucauuucugccugc

SEQ ID NO: 1741504 - RNA, 14 nt, Salmonella enterica enterica serovar Typhi Ty2
agcucgauccggca

SEQ ID NO: 1741505 - RNA, 22 nt, Salmonella enterica enterica serovar Typhi Ty2
agcucccgccagcgagaugaaa

SEQ ID NO: 1741506 - RNA, 19 nt, Salmonella enterica enterica serovar Typhi Ty2
agcuccgcaauuuccugau

SEQ ID NO: 1741507 - RNA, 24 nt, Salmonella enterica enterica serovar Typhi Ty2
agcuccgcaaagcccaucagcgcc

SEQ ID NO: 1741508 - RNA, 14 nt, Salmonella enterica enterica serovar Typhi Ty2
agcuccuuauuaca

SEQ ID NO: 1741509 - RNA, 19 nt, Salmonella enterica enterica serovar Typhi Ty2
agcuccagaccucguucgg

SEQ ID NO: 1741510 - RNA, 19 nt, Salmonella enterica enterica serovar Typhi Ty2
agcucaagcccgcgucguu

SEQ ID NO: 1741511 - RNA, 21 nt, Salmonella enterica enterica serovar Typhi Ty2
agcuacuugaucggcuggcgc

SEQ ID NO: 1741512 - RNA, 19 nt, Salmonella enterica enterica serovar Typhi Ty2
agcguuuauguuugcugau

SEQ ID NO: 1741513 - RNA, 16 nt, Salmonella enterica enterica serovar Typhi Ty2
aucgcccggccuccgg

SEQ ID NO: 1741514 - RNA, 16 nt, Salmonella enterica enterica serovar Typhi Ty2
aucgcgcacaugcugu

SEQ ID NO: 1741515 - RNA, 23 nt, Salmonella enterica enterica serovar Typhi Ty2
aucgccguauuucacuuuugccg

SEQ ID NO: 1741516 - RNA, 20 nt, Salmonella enterica enterica serovar Typhi Ty2
aucgccgugcucuucgugga

SEQ ID NO: 1741517 - RNA, 13 nt, Salmonella enterica enterica serovar Typhi Ty2
aucgccgugaucc

SEQ ID NO: 1741518 - RNA, 14 nt, Salmonella enterica enterica serovar Typhi Ty2
aucgacggcaauau

SEQ ID NO: 1741519 - RNA, 17 nt, Salmonella enterica enterica serovar Typhi Ty2
aucggcggcaaagccga

SEQ ID NO: 1741520 - RNA, 15 nt, Salmonella enterica enterica serovar Typhi Ty2
aucggcgagcggcua

SEQ ID NO: 1741521 - RNA, 22 nt, Salmonella enterica enterica serovar Typhi Ty2
aucggccugcucuugcggcagu

SEQ ID NO: 1741522 - RNA, 14 nt, Salmonella enterica enterica serovar Typhi Ty2
aucggccauaucca

SEQ ID NO: 1741523 - RNA, 19 nt, Salmonella enterica enterica serovar Typhi Ty2
aucggcaauauugccgcac

SEQ ID NO: 1741524 - RNA, 15 nt, Salmonella enterica enterica serovar Typhi Ty2
aucggaguccagcaa

SEQ ID NO: 1741525 - RNA, 17 nt, Salmonella enterica enterica serovar Typhi Ty2
aucgcuggcgcguucau

SEQ ID NO: 1741526 - RNA, 22 nt, Salmonella enterica enterica serovar Typhi Ty2
aucgcggcccucuaagcgcuca

SEQ ID NO: 1741527 - RNA, 22 nt, Salmonella enterica enterica serovar Typhi Ty2
aucgacauuaacaaugccuuau

SEQ ID NO: 1741528 - RNA, 18 nt, Salmonella enterica enterica serovar Typhi Ty2
aucgaccuuuucccguaa

SEQ ID NO: 1741529 - RNA, 14 nt, Salmonella enterica enterica serovar Typhi Ty2
aucgacaauccgcc

SEQ ID NO: 1741530 - RNA, 20 nt, Salmonella enterica enterica serovar Typhi Ty2
aucgacagaacggauaucca

SEQ ID NO: 1741531 - RNA, 22 nt, Salmonella enterica enterica serovar Typhi Ty2
aucgaaggcaucuucagacagu

SEQ ID NO: 1741532 - RNA, 23 nt, Salmonella enterica enterica serovar Typhi Ty2
aucgacaaaauagucaguuaacg

SEQ ID NO: 1741533 - RNA, 21 nt, Salmonella enterica enterica serovar Typhi Ty2
auccugcaccgccugcggcau

SEQ ID NO: 1741534 - RNA, 14 nt, Salmonella enterica enterica serovar Typhi Ty2
auccugcaccgccu

SEQ ID NO: 1741535 - RNA, 12 nt, Salmonella enterica enterica serovar Typhi Ty2
auccugccgcac

SEQ ID NO: 1741536 - RNA, 22 nt, Salmonella enterica enterica serovar Typhi Ty2
auccugcguuaacgacccauca

SEQ ID NO: 1741537 - RNA, 15 nt, Salmonella enterica enterica serovar Typhi Ty2
auccugccacuguuc

SEQ ID NO: 1741538 - RNA, 18 nt, Salmonella enterica enterica serovar Typhi Ty2
auccugacuauugcugag

SEQ ID NO: 1741539 - RNA, 22 nt, Salmonella enterica enterica serovar Typhi Ty2
auccgcagauccagcacggccu

SEQ ID NO: 1741540 - RNA, 20 nt, Salmonella enterica enterica serovar Typhi Ty2
auccgauuucaugcgcagca

SEQ ID NO: 1741541 - RNA, 14 nt, Salmonella enterica enterica serovar Typhi Ty2
auccgccagcgccu

SEQ ID NO: 1741542 - RNA, 11 nt, Salmonella enterica enterica serovar Typhi Ty2
auccgccaucg

SEQ ID NO: 1741543 - RNA, 19 nt, Salmonella enterica enterica serovar Typhi Ty2
auccgccaccgcgcgcaga

SEQ ID NO: 1741544 - RNA, 14 nt, Salmonella enterica enterica serovar Typhi Ty2
aucagcgucagcag

SEQ ID NO: 1741545 - RNA, 16 nt, Salmonella enterica enterica serovar Typhi Ty2
aucagcggguauugcu

SEQ ID NO: 1741546 - RNA, 21 nt, Salmonella enterica enterica serovar Typhi Ty2
auccuccggcgcggcgcgcau

SEQ ID NO: 1741547 - RNA, 23 nt, Salmonella enterica enterica serovar Typhi Ty2
auccggguaauuuugccaucgcg

SEQ ID NO: 1741548 - RNA, 23 nt, Salmonella enterica enterica serovar Typhi Ty2
auccggcaacacguuugcccgau

SEQ ID NO: 1741549 - RNA, 15 nt, Salmonella enterica enterica serovar Typhi Ty2
auccggaaaaugggu

SEQ ID NO: 1741550 - RNA, 19 nt, Salmonella enterica enterica serovar Typhi Ty2
auccggcugccugccggau

SEQ ID NO: 1741551 - RNA, 14 nt, Salmonella enterica enterica serovar Typhi Ty2
auccggcacgguca

SEQ ID NO: 1741552 - RNA, 22 nt, Salmonella enterica enterica serovar Typhi Ty2
auccggcacgccaucgccugau

SEQ ID NO: 1741553 - RNA, 13 nt, Salmonella enterica enterica serovar Typhi Ty2
aucugcuccggcg

SEQ ID NO: 1741554 - RNA, 18 nt, Salmonella enterica enterica serovar Typhi Ty2
aucugcgugaugcaucag

SEQ ID NO: 1741555 - RNA, 19 nt, Salmonella enterica enterica serovar Typhi Ty2
aucuggauagucaggcgau

SEQ ID NO: 1741556 - RNA, 20 nt, Salmonella enterica enterica serovar Typhi Ty2
aucuggugacgaugauaaca

SEQ ID NO: 1741557 - RNA, 12 nt, Salmonella enterica enterica serovar Typhi Ty2
aucugucaugcg

SEQ ID NO: 1741558 - RNA, 17 nt, Salmonella enterica enterica serovar Typhi Ty2
aucuucauuucauugcg

SEQ ID NO: 1741559 - RNA, 13 nt, Salmonella enterica enterica serovar Typhi Ty2
aucuuccugcgcg

SEQ ID NO: 1741560 - RNA, 18 nt, Salmonella enterica enterica serovar Typhi Ty2
aucuuccacgccgucgau

SEQ ID NO: 1741561 - RNA, 15 nt, Salmonella enterica enterica serovar Typhi Ty2
aucuguuaucuggau

SEQ ID NO: 1741562 - RNA, 20 nt, Salmonella enterica enterica serovar Typhi Ty2
aucuucuuugacccacgcca

SEQ ID NO: 1741563 - RNA, 23 nt, Salmonella enterica enterica serovar Typhi Ty2
aucuugucacaauaacgccggau

SEQ ID NO: 1741564 - RNA, 16 nt, Salmonella enterica enterica serovar Typhi Ty2
aucgugaccaccgcca

SEQ ID NO: 1741565 - RNA, 18 nt, Salmonella enterica enterica serovar Typhi Ty2
aucgugauaaauugcuga

SEQ ID NO: 1741566 - RNA, 19 nt, Salmonella enterica enterica serovar Typhi Ty2
aucgugccguccggcauca

SEQ ID NO: 1741567 - RNA, 17 nt, Salmonella enterica enterica serovar Typhi Ty2
aucguugcgcgcaauca

SEQ ID NO: 1741568 - RNA, 18 nt, Salmonella enterica enterica serovar Typhi Ty2
aucuacaaacgcggacau

SEQ ID NO: 1741569 - RNA, 13 nt, Salmonella enterica enterica serovar Typhi Ty2
aucuccuccggcu

SEQ ID NO: 1741570 - RNA, 19 nt, Salmonella enterica enterica serovar Typhi Ty2
aucuccgccgcuuuaucgu

SEQ ID NO: 1741571 - RNA, 12 nt, Salmonella enterica enterica serovar Typhi Ty2
aucucgccgucg

SEQ ID NO: 1741572 - RNA, 18 nt, Salmonella enterica enterica serovar Typhi Ty2
aucucgcacaucaugaug

SEQ ID NO: 1741573 - RNA, 19 nt, Salmonella enterica enterica serovar Typhi Ty2
aucuacuguuauugacgau

SEQ ID NO: 1741574 - RNA, 20 nt, Salmonella enterica enterica serovar Typhi Ty2
augauggggucacagguucg

SEQ ID NO: 1741575 - RNA, 23 nt, Salmonella enterica enterica serovar Typhi Ty2
augaugggcgcacagcgccauga

SEQ ID NO: 1741576 - RNA, 20 nt, Salmonella enterica enterica serovar Typhi Ty2
augaugggcgcacagcgcca

SEQ ID NO: 1741577 - RNA, 19 nt, Salmonella enterica enterica serovar Typhi Ty2
augaugggcgcacagcgcc

SEQ ID NO: 1741578 - RNA, 17 nt, Salmonella enterica enterica serovar Typhi Ty2
augagucgcgcgcgcca

SEQ ID NO: 1741579 - RNA, 14 nt, Salmonella enterica enterica serovar Typhi Ty2
augacgccugccag

SEQ ID NO: 1741580 - RNA, 21 nt, Salmonella enterica enterica serovar Typhi Ty2
augacgcccugcgccagcaug

SEQ ID NO: 1741581 - RNA, 12 nt, Salmonella enterica enterica serovar Typhi Ty2
augacgccgucu

SEQ ID NO: 1741582 - RNA, 14 nt, Salmonella enterica enterica serovar Typhi Ty2
augaucgucaacga

SEQ ID NO: 1741583 - RNA, 24 nt, Salmonella enterica enterica serovar Typhi Ty2
augaucagcgacgguccuggccag

SEQ ID NO: 1741584 - RNA, 22 nt, Salmonella enterica enterica serovar Typhi Ty2
augauaucgccaauggcgucgu

SEQ ID NO: 1741585 - RNA, 17 nt, Salmonella enterica enterica serovar Typhi Ty2
augaucaccaucuucac

SEQ ID NO: 1741586 - RNA, 23 nt, Salmonella enterica enterica serovar Typhi Ty2
augacgaacaggauauuaccgcc

SEQ ID NO: 1741587 - RNA, 20 nt, Salmonella enterica enterica serovar Typhi Ty2
augaccacaccgucaacauc

SEQ ID NO: 1741588 - RNA, 19 nt, Salmonella enterica enterica serovar Typhi Ty2
augaccgaacuuacgcaca

SEQ ID NO: 1741589 - RNA, 20 nt, Salmonella enterica enterica serovar Typhi Ty2
augaccgaacuuacgcacaa

SEQ ID NO: 1741590 - RNA, 21 nt, Salmonella enterica enterica serovar Typhi Ty2
augacaaagccggauaucgcu

SEQ ID NO: 1741591 - RNA, 16 nt, Salmonella enterica enterica serovar Typhi Ty2
augaaucaucgguaaa

SEQ ID NO: 1741592 - RNA, 16 nt, Salmonella enterica enterica serovar Typhi Ty2
augaaggguaaaacgu

SEQ ID NO: 1741593 - RNA, 19 nt, Salmonella enterica enterica serovar Typhi Ty2
aucuuuauugaaaagcagc

SEQ ID NO: 1741594 - RNA, 13 nt, Salmonella enterica enterica serovar Typhi Ty2
augaacaauaacg

SEQ ID NO: 1741595 - RNA, 23 nt, Salmonella enterica enterica serovar Typhi Ty2
augaagcgaagagagaucgaccg

SEQ ID NO: 1741596 - RNA, 22 nt, Salmonella enterica enterica serovar Typhi Ty2
auugauaccuaaacgcgucaga

SEQ ID NO: 1741597 - RNA, 14 nt, Salmonella enterica enterica serovar Typhi Ty2
auugauauuccgcg

SEQ ID NO: 1741598 - RNA, 20 nt, Salmonella enterica enterica serovar Typhi Ty2
auugauuaaucgucaucccg

SEQ ID NO: 1741599 - RNA, 19 nt, Salmonella enterica enterica serovar Typhi Ty2
auugccauacacgcggcga

SEQ ID NO: 1741600 - RNA, 21 nt, Salmonella enterica enterica serovar Typhi Ty2
auugccaggcguuacgcgcca

SEQ ID NO: 1741601 - RNA, 20 nt, Salmonella enterica enterica serovar Typhi Ty2
auugccaugaugagcgccau

SEQ ID NO: 1741602 - RNA, 14 nt, Salmonella enterica enterica serovar Typhi Ty2
auugcauggcaauu

SEQ ID NO: 1741603 - RNA, 17 nt, Salmonella enterica enterica serovar Typhi Ty2
auugccgaccauuaccc

SEQ ID NO: 1741604 - RNA, 15 nt, Salmonella enterica enterica serovar Typhi Ty2
auugaaacgcaucac

SEQ ID NO: 1741605 - RNA, 18 nt, Salmonella enterica enterica serovar Typhi Ty2
auugaguggacaucgcca

SEQ ID NO: 1741606 - RNA, 20 nt, Salmonella enterica enterica serovar Typhi Ty2
auugaccaucucuuccgcgg

SEQ ID NO: 1741607 - RNA, 22 nt, Salmonella enterica enterica serovar Typhi Ty2
auugaccucacgcuuaucgcca

SEQ ID NO: 1741608 - RNA, 14 nt, Salmonella enterica enterica serovar Typhi Ty2
auugcugaagauaa

SEQ ID NO: 1741609 - RNA, 14 nt, Salmonella enterica enterica serovar Typhi Ty2
auugcugccuuauc

SEQ ID NO: 1741610 - RNA, 20 nt, Salmonella enterica enterica serovar Typhi Ty2
auugccgcuuaaauuaccgc

SEQ ID NO: 1741611 - RNA, 17 nt, Salmonella enterica enterica serovar Typhi Ty2
auugccuuccaggcggu

SEQ ID NO: 1741612 - RNA, 14 nt, Salmonella enterica enterica serovar Typhi Ty2
auugcgccagcuuu

SEQ ID NO: 1741613 - RNA, 15 nt, Salmonella enterica enterica serovar Typhi Ty2
auuggcugccgacaa

SEQ ID NO: 1741614 - RNA, 21 nt, Salmonella enterica enterica serovar Typhi Ty2
auuguccgcauucuugccgca

SEQ ID NO: 1741615 - RNA, 15 nt, Salmonella enterica enterica serovar Typhi Ty2
auugucgaauuccgc

SEQ ID NO: 1741616 - RNA, 20 nt, Salmonella enterica enterica serovar Typhi Ty2
auuggcucggcgucaucccg

SEQ ID NO: 1741617 - RNA, 16 nt, Salmonella enterica enterica serovar Typhi Ty2
auuaaaugacggacca

SEQ ID NO: 1741618 - RNA, 17 nt, Salmonella enterica enterica serovar Typhi Ty2
auuaaauaacggauaac

SEQ ID NO: 1741619 - RNA, 14 nt, Salmonella enterica enterica serovar Typhi Ty2
auguugcugcaucu

SEQ ID NO: 1741620 - RNA, 13 nt, Salmonella enterica enterica serovar Typhi Ty2
auguuggcgcccu

SEQ ID NO: 1741621 - RNA, 21 nt, Salmonella enterica enterica serovar Typhi Ty2
auuccgacagugaacggcaua

SEQ ID NO: 1741622 - RNA, 16 nt, Salmonella enterica enterica serovar Typhi Ty2
auuccgucauggugau

SEQ ID NO: 1741623 - RNA, 17 nt, Salmonella enterica enterica serovar Typhi Ty2
auucagagcguccacgc

SEQ ID NO: 1741624 - RNA, 16 nt, Salmonella enterica enterica serovar Typhi Ty2
auucagaauaugccag

SEQ ID NO: 1741625 - RNA, 16 nt, Salmonella enterica enterica serovar Typhi Ty2
auucagaaccugcgau

SEQ ID NO: 1741626 - RNA, 21 nt, Salmonella enterica enterica serovar Typhi Ty2
auucagggaacguugcgccau

SEQ ID NO: 1741627 - RNA, 12 nt, Salmonella enterica enterica serovar Typhi Ty2
auucuaugccag

SEQ ID NO: 1741628 - RNA, 23 nt, Salmonella enterica enterica serovar Typhi Ty2
auucugcaucccgcuaaggccuu

SEQ ID NO: 1741629 - RNA, 21 nt, Salmonella enterica enterica serovar Typhi Ty2
auucgguagcuguaccagauc

SEQ ID NO: 1741630 - RNA, 20 nt, Salmonella enterica enterica serovar Typhi Ty2
auucgguagcuguaccagau

SEQ ID NO: 1741631 - RNA, 16 nt, Salmonella enterica enterica serovar Typhi Ty2
auucguuaccagcauc

SEQ ID NO: 1741632 - RNA, 15 nt, Salmonella enterica enterica serovar Typhi Ty2
auucguugacgcuau

SEQ ID NO: 1741633 - RNA, 18 nt, Salmonella enterica enterica serovar Typhi Ty2
auucgcugacaucgugua

SEQ ID NO: 1741634 - RNA, 18 nt, Salmonella enterica enterica serovar Typhi Ty2
auucgccccacacggcca

SEQ ID NO: 1741635 - RNA, 14 nt, Salmonella enterica enterica serovar Typhi Ty2
augcggguccugau

SEQ ID NO: 1741636 - RNA, 19 nt, Salmonella enterica enterica serovar Typhi Ty2
augcgguaaccguauugca

SEQ ID NO: 1741637 - RNA, 12 nt, Salmonella enterica enterica serovar Typhi Ty2
augcgggcucgu

SEQ ID NO: 1741638 - RNA, 16 nt, Salmonella enterica enterica serovar Typhi Ty2
augcgggggagaugau

SEQ ID NO: 1741639 - RNA, 15 nt, Salmonella enterica enterica serovar Typhi Ty2
augcugcaccgcauc

SEQ ID NO: 1741640 - RNA, 13 nt, Salmonella enterica enterica serovar Typhi Ty2
augcguaccgcua

SEQ ID NO: 1741641 - RNA, 13 nt, Salmonella enterica enterica serovar Typhi Ty2
augcugaauagcc

SEQ ID NO: 1741642 - RNA, 21 nt, Salmonella enterica enterica serovar Typhi Ty2
augcugcucuccacgccgcaa

SEQ ID NO: 1741643 - RNA, 21 nt, Salmonella enterica enterica serovar Typhi Ty2
augcgccacgacuaucgucac

SEQ ID NO: 1741644 - RNA, 14 nt, Salmonella enterica enterica serovar Typhi Ty2
augcauggcagaua

SEQ ID NO: 1741645 - RNA, 16 nt, Salmonella enterica enterica serovar Typhi Ty2
augcggcgccaucaau

SEQ ID NO: 1741646 - RNA, 19 nt, Salmonella enterica enterica serovar Typhi Ty2
augcgccagccagucgcca

SEQ ID NO: 1741647 - RNA, 13 nt, Salmonella enterica enterica serovar Typhi Ty2
augcgcccacaau

SEQ ID NO: 1741648 - RNA, 18 nt, Salmonella enterica enterica serovar Typhi Ty2
augcgccgcccaccgcca

SEQ ID NO: 1741649 - RNA, 21 nt, Salmonella enterica enterica serovar Typhi Ty2
augcgccgcccaccgccaacc

SEQ ID NO: 1741650 - RNA, 23 nt, Salmonella enterica enterica serovar Typhi Ty2
auggaugagucuugcgcguccgc

SEQ ID NO: 1741651 - RNA, 12 nt, Salmonella enterica enterica serovar Typhi Ty2
auggaucaucgg

SEQ ID NO: 1741652 - RNA, 23 nt, Salmonella enterica enterica serovar Typhi Ty2
auggacagguaaaccggucaggu

SEQ ID NO: 1741653 - RNA, 11 nt, Salmonella enterica enterica serovar Typhi Ty2
augcuggugca

SEQ ID NO: 1741654 - RNA, 13 nt, Salmonella enterica enterica serovar Typhi Ty2
auggccuggagcg

SEQ ID NO: 1741655 - RNA, 18 nt, Salmonella enterica enterica serovar Typhi Ty2
auggcaggcauagacauc

SEQ ID NO: 1741656 - RNA, 12 nt, Salmonella enterica enterica serovar Typhi Ty2
auggcagcaggg

SEQ ID NO: 1741657 - RNA, 21 nt, Salmonella enterica enterica serovar Typhi Ty2
augggguaucgccaagcggua

SEQ ID NO: 1741658 - RNA, 17 nt, Salmonella enterica enterica serovar Typhi Ty2
auggggauuaucaggau

SEQ ID NO: 1741659 - RNA, 22 nt, Salmonella enterica enterica serovar Typhi Ty2
augguggucgcggccaccgcca

SEQ ID NO: 1741660 - RNA, 11 nt, Salmonella enterica enterica serovar Typhi Ty2
auguaaaugac

SEQ ID NO: 1741661 - RNA, 15 nt, Salmonella enterica enterica serovar Typhi Ty2
augguugguauugcg

SEQ ID NO: 1741662 - RNA, 17 nt, Salmonella enterica enterica serovar Typhi Ty2
augggcgcacagcgcca

SEQ ID NO: 1741663 - RNA, 18 nt, Salmonella enterica enterica serovar Typhi Ty2
augggccaaccugccgau

SEQ ID NO: 1741664 - RNA, 17 nt, Salmonella enterica enterica serovar Typhi Ty2
augggccauuuacgcca

SEQ ID NO: 1741665 - RNA, 14 nt, Salmonella enterica enterica serovar Typhi Ty2
auggggagcagcau

SEQ ID NO: 1741666 - RNA, 18 nt, Salmonella enterica enterica serovar Typhi Ty2
auggcgacgaucagcgcc

SEQ ID NO: 1741667 - RNA, 17 nt, Salmonella enterica enterica serovar Typhi Ty2
auggcgacgcguagcgu

SEQ ID NO: 1741668 - RNA, 19 nt, Salmonella enterica enterica serovar Typhi Ty2
auggcgaaagugaacguca

SEQ ID NO: 1741669 - RNA, 22 nt, Salmonella enterica enterica serovar Typhi Ty2
auggcgauaaaaauauccgcca

SEQ ID NO: 1741670 - RNA, 14 nt, Salmonella enterica enterica serovar Typhi Ty2
augucaucguuugc

SEQ ID NO: 1741671 - RNA, 14 nt, Salmonella enterica enterica serovar Typhi Ty2
auguccagaccaau

SEQ ID NO: 1741672 - RNA, 20 nt, Salmonella enterica enterica serovar Typhi Ty2
augugagcgcauccggccag

SEQ ID NO: 1741673 - RNA, 14 nt, Salmonella enterica enterica serovar Typhi Ty2
augugagcgcaucc

SEQ ID NO: 1741674 - RNA, 15 nt, Salmonella enterica enterica serovar Typhi Ty2
augucuuuacggaug

SEQ ID NO: 1741675 - RNA, 21 nt, Salmonella enterica enterica serovar Typhi Ty2
augucguuguaguuaucgccg

SEQ ID NO: 1741676 - RNA, 13 nt, Salmonella enterica enterica serovar Typhi Ty2
auguuauaaacuu

SEQ ID NO: 1741677 - RNA, 19 nt, Salmonella enterica enterica serovar Typhi Ty2
auguuccgcuaccugcgag

SEQ ID NO: 1741678 - RNA, 21 nt, Salmonella enterica enterica serovar Typhi Ty2
auguugccaugauccaucucg

SEQ ID NO: 1741679 - RNA, 16 nt, Salmonella enterica enterica serovar Typhi Ty2
auguugccaugaucca

SEQ ID NO: 1741680 - RNA, 18 nt, Salmonella enterica enterica serovar Typhi Ty2
augugcagcauccagcuc

SEQ ID NO: 1741681 - RNA, 16 nt, Salmonella enterica enterica serovar Typhi Ty2
augugcuuucaucgcc

SEQ ID NO: 1741682 - RNA, 19 nt, Salmonella enterica enterica serovar Typhi Ty2
augugcgccagaauugccu

SEQ ID NO: 1741683 - RNA, 21 nt, Salmonella enterica enterica serovar Typhi Ty2
auguguaauguuuucugccag

SEQ ID NO: 1741684 - RNA, 20 nt, Salmonella enterica enterica serovar Typhi Ty2
caaagcucaacgcaggcugg

SEQ ID NO: 1741685 - RNA, 16 nt, Salmonella enterica enterica serovar Typhi Ty2
caaacccuuccgcauc

SEQ ID NO: 1741686 - RNA, 14 nt, Salmonella enterica enterica serovar Typhi Ty2
caaaccuuccgcca

SEQ ID NO: 1741687 - RNA, 17 nt, Salmonella enterica enterica serovar Typhi Ty2
caaacgugccuggauaa

SEQ ID NO: 1741688 - RNA, 13 nt, Salmonella enterica enterica serovar Typhi Ty2
caaacuggcgcgu

SEQ ID NO: 1741689 - RNA, 18 nt, Salmonella enterica enterica serovar Typhi Ty2
auuguugggguuaucgcu

SEQ ID NO: 1741690 - RNA, 16 nt, Salmonella enterica enterica serovar Typhi Ty2
caaaaugucaguaucg

SEQ ID NO: 1741691 - RNA, 18 nt, Salmonella enterica enterica serovar Typhi Ty2
caaaaugcaccggcguua

SEQ ID NO: 1741692 - RNA, 21 nt, Salmonella enterica enterica serovar Typhi Ty2
caaaccagacgcguaaccccu

SEQ ID NO: 1741693 - RNA, 13 nt, Salmonella enterica enterica serovar Typhi Ty2
caaaccaugauaa

SEQ ID NO: 1741694 - RNA, 19 nt, Salmonella enterica enterica serovar Typhi Ty2
caaacacaaucacgcccag

SEQ ID NO: 1741695 - RNA, 18 nt, Salmonella enterica enterica serovar Typhi Ty2
caaacaauuuacgcagcc

SEQ ID NO: 1741696 - RNA, 13 nt, Salmonella enterica enterica serovar Typhi Ty2
caaauaccacauc

SEQ ID NO: 1741697 - RNA, 16 nt, Salmonella enterica enterica serovar Typhi Ty2
caaauaguccagcagc

SEQ ID NO: 1741698 - RNA, 14 nt, Salmonella enterica enterica serovar Typhi Ty2
caaaugaccagauc

SEQ ID NO: 1741699 - RNA, 19 nt, Salmonella enterica enterica serovar Typhi Ty2
caaaugaagcgacgcuggc

SEQ ID NO: 1741700 - RNA, 14 nt, Salmonella enterica enterica serovar Typhi Ty2
caaaugcccagcuc

SEQ ID NO: 1741701 - RNA, 17 nt, Salmonella enterica enterica serovar Typhi Ty2
caaaugcagcggaauuc

SEQ ID NO: 1741702 - RNA, 21 nt, Salmonella enterica enterica serovar Typhi Ty2
caaaucugccgucaucgacuu

SEQ ID NO: 1741703 - RNA, 16 nt, Salmonella enterica enterica serovar Typhi Ty2
caaaucgccgauaugg

SEQ ID NO: 1741704 - RNA, 20 nt, Salmonella enterica enterica serovar Typhi Ty2
caaaucggcgccggcgcguu

SEQ ID NO: 1741705 - RNA, 15 nt, Salmonella enterica enterica serovar Typhi Ty2
caacaaauuccggca

SEQ ID NO: 1741706 - RNA, 15 nt, Salmonella enterica enterica serovar Typhi Ty2
caacaugaccagcgc

SEQ ID NO: 1741707 - RNA, 16 nt, Salmonella enterica enterica serovar Typhi Ty2
caacauugccggcauc

SEQ ID NO: 1741708 - RNA, 15 nt, Salmonella enterica enterica serovar Typhi Ty2
caacaugcugaccga

SEQ ID NO: 1741709 - RNA, 14 nt, Salmonella enterica enterica serovar Typhi Ty2
caaccgcgcggcgu

SEQ ID NO: 1741710 - RNA, 21 nt, Salmonella enterica enterica serovar Typhi Ty2
caaccugccguuuuccagccg

SEQ ID NO: 1741711 - RNA, 21 nt, Salmonella enterica enterica serovar Typhi Ty2
caacgacgucuuucuucgcug

SEQ ID NO: 1741712 - RNA, 20 nt, Salmonella enterica enterica serovar Typhi Ty2
caaccuguaggccggauaag

SEQ ID NO: 1741713 - RNA, 18 nt, Salmonella enterica enterica serovar Typhi Ty2
caacgcaaacuguauccg

SEQ ID NO: 1741714 - RNA, 17 nt, Salmonella enterica enterica serovar Typhi Ty2
caacguccugcggcuuu

SEQ ID NO: 1741715 - RNA, 14 nt, Salmonella enterica enterica serovar Typhi Ty2
caacgucgccaucc

SEQ ID NO: 1741716 - RNA, 18 nt, Salmonella enterica enterica serovar Typhi Ty2
caacguccaguucguucu

SEQ ID NO: 1741717 - RNA, 20 nt, Salmonella enterica enterica serovar Typhi Ty2
caacguugaaaacggcguuu

SEQ ID NO: 1741718 - RNA, 14 nt, Salmonella enterica enterica serovar Typhi Ty2
caagcgcggcagca

SEQ ID NO: 1741719 - RNA, 20 nt, Salmonella enterica enterica serovar Typhi Ty2
caagcucauguaaaggcgug

SEQ ID NO: 1741720 - RNA, 21 nt, Salmonella enterica enterica serovar Typhi Ty2
caagcgcggacagcagaauau

SEQ ID NO: 1741721 - RNA, 16 nt, Salmonella enterica enterica serovar Typhi Ty2
caaggcucaauacgca

SEQ ID NO: 1741722 - RNA, 19 nt, Salmonella enterica enterica serovar Typhi Ty2
caaguacgccuuucaccau

SEQ ID NO: 1741723 - RNA, 14 nt, Salmonella enterica enterica serovar Typhi Ty2
caauacccagcgcc

SEQ ID NO: 1741724 - RNA, 15 nt, Salmonella enterica enterica serovar Typhi Ty2
caauagaccagcggc

SEQ ID NO: 1741725 - RNA, 20 nt, Salmonella enterica enterica serovar Typhi Ty2
caauagaccugaaaucagcc

SEQ ID NO: 1741726 - RNA, 22 nt, Salmonella enterica enterica serovar Typhi Ty2
caauagaccugaaaucagccug

SEQ ID NO: 1741727 - RNA, 19 nt, Salmonella enterica enterica serovar Typhi Ty2
caauagcagcuucacgcgc

SEQ ID NO: 1741728 - RNA, 20 nt, Salmonella enterica enterica serovar Typhi Ty2
caauaggggcggacaugcgc

SEQ ID NO: 1741729 - RNA, 14 nt, Salmonella enterica enterica serovar Typhi Ty2
caauauguuccggc

SEQ ID NO: 1741730 - RNA, 15 nt, Salmonella enterica enterica serovar Typhi Ty2
caauauguuccggcg

SEQ ID NO: 1741731 - RNA, 14 nt, Salmonella enterica enterica serovar Typhi Ty2
caauaauggcgcga

SEQ ID NO: 1741732 - RNA, 14 nt, Salmonella enterica enterica serovar Typhi Ty2
caauaccagggcga

SEQ ID NO: 1741733 - RNA, 19 nt, Salmonella enterica enterica serovar Typhi Ty2
caauaacgcauucaccuuc

SEQ ID NO: 1741734 - RNA, 14 nt, Salmonella enterica enterica serovar Typhi Ty2
caauaaacagcucc

SEQ ID NO: 1741735 - RNA, 21 nt, Salmonella enterica enterica serovar Typhi Ty2
caauaaaacgcccccugccag

SEQ ID NO: 1741736 - RNA, 17 nt, Salmonella enterica enterica serovar Typhi Ty2
caaguugcgccacugcc

SEQ ID NO: 1741737 - RNA, 13 nt, Salmonella enterica enterica serovar Typhi Ty2
caaucgcgguaug

SEQ ID NO: 1741738 - RNA, 17 nt, Salmonella enterica enterica serovar Typhi Ty2
caaucgcgcccgccauc

SEQ ID NO: 1741739 - RNA, 13 nt, Salmonella enterica enterica serovar Typhi Ty2
caaucucgccaau

SEQ ID NO: 1741740 - RNA, 12 nt, Salmonella enterica enterica serovar Typhi Ty2
caaucgucuuca

SEQ ID NO: 1741741 - RNA, 17 nt, Salmonella enterica enterica serovar Typhi Ty2
caaucguuggcguauua

SEQ ID NO: 1741742 - RNA, 18 nt, Salmonella enterica enterica serovar Typhi Ty2
caaucgucguuccgccag

SEQ ID NO: 1741743 - RNA, 18 nt, Salmonella enterica enterica serovar Typhi Ty2
caaugccggacgccacca

SEQ ID NO: 1741744 - RNA, 20 nt, Salmonella enterica enterica serovar Typhi Ty2
caaugcccuuaaauccggcc

SEQ ID NO: 1741745 - RNA, 22 nt, Salmonella enterica enterica serovar Typhi Ty2
caaugcccuuaaauccggccuc

SEQ ID NO: 1741746 - RNA, 19 nt, Salmonella enterica enterica serovar Typhi Ty2
caaugccaccagcgccaua

SEQ ID NO: 1741747 - RNA, 15 nt, Salmonella enterica enterica serovar Typhi Ty2
caaugcccagcgcaa

SEQ ID NO: 1741748 - RNA, 21 nt, Salmonella enterica enterica serovar Typhi Ty2
caaucugcgucaguaccugau

SEQ ID NO: 1741749 - RNA, 15 nt, Salmonella enterica enterica serovar Typhi Ty2
caaugccaccagcgc

SEQ ID NO: 1741750 - RNA, 13 nt, Salmonella enterica enterica serovar Typhi Ty2
caaucauccugau

SEQ ID NO: 1741751 - RNA, 18 nt, Salmonella enterica enterica serovar Typhi Ty2
caaucauaaacgccugac

SEQ ID NO: 1741752 - RNA, 19 nt, Salmonella enterica enterica serovar Typhi Ty2
caaucaggcuugagcgaug

SEQ ID NO: 1741753 - RNA, 15 nt, Salmonella enterica enterica serovar Typhi Ty2
caaucacguuauagc

SEQ ID NO: 1741754 - RNA, 19 nt, Salmonella enterica enterica serovar Typhi Ty2
caaucaccugcaucacgcc

SEQ ID NO: 1741755 - RNA, 23 nt, Salmonella enterica enterica serovar Typhi Ty2
caaucccggagagagcaacuggc

SEQ ID NO: 1741756 - RNA, 19 nt, Salmonella enterica enterica serovar Typhi Ty2
caauccauuaauggcgcaa

SEQ ID NO: 1741757 - RNA, 19 nt, Salmonella enterica enterica serovar Typhi Ty2
caaucgccgaucgcauaaa

SEQ ID NO: 1741758 - RNA, 16 nt, Salmonella enterica enterica serovar Typhi Ty2
cacaccggauaccggu

SEQ ID NO: 1741759 - RNA, 13 nt, Salmonella enterica enterica serovar Typhi Ty2
cacaauagcgcua

SEQ ID NO: 1741760 - RNA, 16 nt, Salmonella enterica enterica serovar Typhi Ty2
cacaaucccgccagac

SEQ ID NO: 1741761 - RNA, 20 nt, Salmonella enterica enterica serovar Typhi Ty2
cacaaucccggcaacugcgc

SEQ ID NO: 1741762 - RNA, 20 nt, Salmonella enterica enterica serovar Typhi Ty2
cacaaucaaauggcuggcgc

SEQ ID NO: 1741763 - RNA, 18 nt, Salmonella enterica enterica serovar Typhi Ty2
cacaacuguagcaggaua

SEQ ID NO: 1741764 - RNA, 23 nt, Salmonella enterica enterica serovar Typhi Ty2
caauugguaauuaaaggcagcgu

SEQ ID NO: 1741765 - RNA, 24 nt, Salmonella enterica enterica serovar Typhi Ty2
caauugaugaaccgcuguagcgua

SEQ ID NO: 1741766 - RNA, 23 nt, Salmonella enterica enterica serovar Typhi Ty2
caauuuccccugcgaacagcgcu

SEQ ID NO: 1741767 - RNA, 15 nt, Salmonella enterica enterica serovar Typhi Ty2
caauguccgccagac

SEQ ID NO: 1741768 - RNA, 20 nt, Salmonella enterica enterica serovar Typhi Ty2
caauguuccccugaugcgua

SEQ ID NO: 1741769 - RNA, 18 nt, Salmonella enterica enterica serovar Typhi Ty2
caccgggagaaaacgcgg

SEQ ID NO: 1741770 - RNA, 13 nt, Salmonella enterica enterica serovar Typhi Ty2
caccguauccggc

SEQ ID NO: 1741771 - RNA, 20 nt, Salmonella enterica enterica serovar Typhi Ty2
caccgguacacacgcgcuga

SEQ ID NO: 1741772 - RNA, 19 nt, Salmonella enterica enterica serovar Typhi Ty2
caccgguacgcuccagggc

SEQ ID NO: 1741773 - RNA, 21 nt, Salmonella enterica enterica serovar Typhi Ty2
caccgucacugaaccugccuu

SEQ ID NO: 1741774 - RNA, 15 nt, Salmonella enterica enterica serovar Typhi Ty2
caccgucuccggcgc

SEQ ID NO: 1741775 - RNA, 23 nt, Salmonella enterica enterica serovar Typhi Ty2
caccguuacaaauagcggcacag

SEQ ID NO: 1741776 - RNA, 14 nt, Salmonella enterica enterica serovar Typhi Ty2
caccguuuuccagg

SEQ ID NO: 1741777 - RNA, 16 nt, Salmonella enterica enterica serovar Typhi Ty2
caccuaugcggauaaa

SEQ ID NO: 1741778 - RNA, 14 nt, Salmonella enterica enterica serovar Typhi Ty2
caccucagccaacc

SEQ ID NO: 1741779 - RNA, 11 nt, Salmonella enterica enterica serovar Typhi Ty2
caccgauaaac

SEQ ID NO: 1741780 - RNA, 18 nt, Salmonella enterica enterica serovar Typhi Ty2
caccggcacauccagcug

SEQ ID NO: 1741781 - RNA, 20 nt, Salmonella enterica enterica serovar Typhi Ty2
caccgcuacaauccaggacg

SEQ ID NO: 1741782 - RNA, 19 nt, Salmonella enterica enterica serovar Typhi Ty2
caccgcuuuggcgcccauu

SEQ ID NO: 1741783 - RNA, 24 nt, Salmonella enterica enterica serovar Typhi Ty2
caccagcgauuacgccagacagca

SEQ ID NO: 1741784 - RNA, 19 nt, Salmonella enterica enterica serovar Typhi Ty2
caccagcgauuacgccaga

SEQ ID NO: 1741785 - RNA, 21 nt, Salmonella enterica enterica serovar Typhi Ty2
caccagcgauuuuuacgccau

SEQ ID NO: 1741786 - RNA, 19 nt, Salmonella enterica enterica serovar Typhi Ty2
caccagcccuggcuguccu

SEQ ID NO: 1741787 - RNA, 24 nt, Salmonella enterica enterica serovar Typhi Ty2
caccagccccaaaauucacgcuuc

SEQ ID NO: 1741788 - RNA, 14 nt, Salmonella enterica enterica serovar Typhi Ty2
caccagaccgacaa

SEQ ID NO: 1741789 - RNA, 11 nt, Salmonella enterica enterica serovar Typhi Ty2
caccagcgcca

SEQ ID NO: 1741790 - RNA, 16 nt, Salmonella enterica enterica serovar Typhi Ty2
caccagcgucgcaugg

SEQ ID NO: 1741791 - RNA, 22 nt, Salmonella enterica enterica serovar Typhi Ty2
cacacucggugcauuugucgcu

SEQ ID NO: 1741792 - RNA, 15 nt, Salmonella enterica enterica serovar Typhi Ty2
cacccgcgccagcag

SEQ ID NO: 1741793 - RNA, 12 nt, Salmonella enterica enterica serovar Typhi Ty2
cacccgcgcagg

SEQ ID NO: 1741794 - RNA, 16 nt, Salmonella enterica enterica serovar Typhi Ty2
cacccgcuuccagcgc

SEQ ID NO: 1741795 - RNA, 14 nt, Salmonella enterica enterica serovar Typhi Ty2
caccgacagguuaa

SEQ ID NO: 1741796 - RNA, 21 nt, Salmonella enterica enterica serovar Typhi Ty2
accagcccaucuuucgccagc

SEQ ID NO: 1741797 - RNA, 12 nt, Salmonella enterica enterica serovar Typhi Ty2
accagcauaaug

SEQ ID NO: 1741798 - RNA, 23 nt, Salmonella enterica enterica serovar Typhi Ty2
accagcaggugcggauaguccug

SEQ ID NO: 1741799 - RNA, 22 nt, Salmonella enterica enterica serovar Typhi Ty2
accagcgaugcgcgcgcguuau

SEQ ID NO: 1741800 - RNA, 18 nt, Salmonella enterica enterica serovar Typhi Ty2
accagcgccauaauccag

SEQ ID NO: 1741801 - RNA, 20 nt, Salmonella enterica enterica serovar Typhi Ty2
accacguaacgggauucgcc

SEQ ID NO: 1741802 - RNA, 16 nt, Salmonella enterica enterica serovar Typhi Ty2
accacggauaagccag

SEQ ID NO: 1741803 - RNA, 18 nt, Salmonella enterica enterica serovar Typhi Ty2
accagauagucaucacca

SEQ ID NO: 1741804 - RNA, 21 nt, Salmonella enterica enterica serovar Typhi Ty2
accagauguacagaaugguau

SEQ ID NO: 1741805 - RNA, 22 nt, Salmonella enterica enterica serovar Typhi Ty2
accagaucuucaaucgugacca

SEQ ID NO: 1741806 - RNA, 13 nt, Salmonella enterica enterica serovar Typhi Ty2
accacgcagccau

SEQ ID NO: 1741807 - RNA, 21 nt, Salmonella enterica enterica serovar Typhi Ty2
accaccgcgcuagugccgcca

SEQ ID NO: 1741808 - RNA, 16 nt, Salmonella enterica enterica serovar Typhi Ty2
accacaaaggcgcgua

SEQ ID NO: 1741809 - RNA, 22 nt, Salmonella enterica enterica serovar Typhi Ty2
acauuacccauaucgcggguaa

SEQ ID NO: 1741810 - RNA, 14 nt, Salmonella enterica enterica serovar Typhi Ty2
acauguucagcgca

SEQ ID NO: 1741811 - RNA, 18 nt, Salmonella enterica enterica serovar Typhi Ty2
accacaaagcgguaaauc

SEQ ID NO: 1741812 - RNA, 14 nt, Salmonella enterica enterica serovar Typhi Ty2
accaauggcgcguc

SEQ ID NO: 1741813 - RNA, 13 nt, Salmonella enterica enterica serovar Typhi Ty2
accauaugcggca

SEQ ID NO: 1741814 - RNA, 14 nt, Salmonella enterica enterica serovar Typhi Ty2
accauaauuaccgg

SEQ ID NO: 1741815 - RNA, 21 nt, Salmonella enterica enterica serovar Typhi Ty2
accaguuguuccgcgcugaug

SEQ ID NO: 1741816 - RNA, 22 nt, Salmonella enterica enterica serovar Typhi Ty2
accauuaacuccggacguaccc

SEQ ID NO: 1741817 - RNA, 16 nt, Salmonella enterica enterica serovar Typhi Ty2
accauugauuuccgcg

SEQ ID NO: 1741818 - RNA, 15 nt, Salmonella enterica enterica serovar Typhi Ty2
accauuaccauuccu

SEQ ID NO: 1741819 - RNA, 14 nt, Salmonella enterica enterica serovar Typhi Ty2
accaucggcgcgua

SEQ ID NO: 1741820 - RNA, 21 nt, Salmonella enterica enterica serovar Typhi Ty2
accaucuggccuacgcgcuca

SEQ ID NO: 1741821 - RNA, 17 nt, Salmonella enterica enterica serovar Typhi Ty2
accaugauaucgccaau

SEQ ID NO: 1741822 - RNA, 16 nt, Salmonella enterica enterica serovar Typhi Ty2
accaggucugcgcguu

SEQ ID NO: 1741823 - RNA, 13 nt, Salmonella enterica enterica serovar Typhi Ty2
accagcgcggcac

SEQ ID NO: 1741824 - RNA, 16 nt, Salmonella enterica enterica serovar Typhi Ty2
accagcgcuauccagg

SEQ ID NO: 1741825 - RNA, 13 nt, Salmonella enterica enterica serovar Typhi Ty2
accaggcggcguu

SEQ ID NO: 1741826 - RNA, 16 nt, Salmonella enterica enterica serovar Typhi Ty2
acaccacgccggaauc

SEQ ID NO: 1741827 - RNA, 19 nt, Salmonella enterica enterica serovar Typhi Ty2
acaccagcgcaugacggua

SEQ ID NO: 1741828 - RNA, 18 nt, Salmonella enterica enterica serovar Typhi Ty2
acaccggcgccagcucug

SEQ ID NO: 1741829 - RNA, 13 nt, Salmonella enterica enterica serovar Typhi Ty2
aauuucugcugcc

SEQ ID NO: 1741830 - RNA, 18 nt, Salmonella enterica enterica serovar Typhi Ty2
aauuuccguagcgauaau

SEQ ID NO: 1741831 - RNA, 13 nt, Salmonella enterica enterica serovar Typhi Ty2
aauuuugcauaaa

SEQ ID NO: 1741832 - RNA, 15 nt, Salmonella enterica enterica serovar Typhi Ty2
acaccacgcaggcga

SEQ ID NO: 1741833 - RNA, 16 nt, Salmonella enterica enterica serovar Typhi Ty2
acaccaccgcucguuc

SEQ ID NO: 1741834 - RNA, 18 nt, Salmonella enterica enterica serovar Typhi Ty2
acacauaucgccagccau

SEQ ID NO: 1741835 - RNA, 16 nt, Salmonella enterica enterica serovar Typhi Ty2
acacggugugccgcca

SEQ ID NO: 1741836 - RNA, 18 nt, Salmonella enterica enterica serovar Typhi Ty2
acagacaaugcugacacu

SEQ ID NO: 1741837 - RNA, 13 nt, Salmonella enterica enterica serovar Typhi Ty2
acagacagcguaa

SEQ ID NO: 1741838 - RNA, 22 nt, Salmonella enterica enterica serovar Typhi Ty2
acagaccgccaugcggcgccau

SEQ ID NO: 1741839 - RNA, 13 nt, Salmonella enterica enterica serovar Typhi Ty2
acagaaucaucag

SEQ ID NO: 1741840 - RNA, 16 nt, Salmonella enterica enterica serovar Typhi Ty2
acagauacggcgcguc

SEQ ID NO: 1741841 - RNA, 15 nt, Salmonella enterica enterica serovar Typhi Ty2
acagagaaugcgccg

SEQ ID NO: 1741842 - RNA, 22 nt, Salmonella enterica enterica serovar Typhi Ty2
acagagaucgugcauccggacg

SEQ ID NO: 1741843 - RNA, 18 nt, Salmonella enterica enterica serovar Typhi Ty2
acagcaaaacgcgcuauc

SEQ ID NO: 1741844 - RNA, 17 nt, Salmonella enterica enterica serovar Typhi Ty2
acagauuuccacgaucu

SEQ ID NO: 1741845 - RNA, 21 nt, Salmonella enterica enterica serovar Typhi Ty2
acagcaguucgauaaucccgg

SEQ ID NO: 1741846 - RNA, 23 nt, Salmonella enterica enterica serovar Typhi Ty2
acagcuucaggcucaucagcgcc

SEQ ID NO: 1741847 - RNA, 21 nt, Salmonella enterica enterica serovar Typhi Ty2
acagcuuaaucaccagcgcau

SEQ ID NO: 1741848 - RNA, 13 nt, Salmonella enterica enterica serovar Typhi Ty2
acaggaacgccgu

SEQ ID NO: 1741849 - RNA, 19 nt, Salmonella enterica enterica serovar Typhi Ty2
acagccgcguuuugccgcu

SEQ ID NO: 1741850 - RNA, 15 nt, Salmonella enterica enterica serovar Typhi Ty2
acaggcacaacaaua

SEQ ID NO: 1741851 - RNA, 16 nt, Salmonella enterica enterica serovar Typhi Ty2
acaggcagguugccga

SEQ ID NO: 1741852 - RNA, 18 nt, Salmonella enterica enterica serovar Typhi Ty2
acaggccguucauucgcc

SEQ ID NO: 1741853 - RNA, 14 nt, Salmonella enterica enterica serovar Typhi Ty2
acaggcgcaucaga

SEQ ID NO: 1741854 - RNA, 21 nt, Salmonella enterica enterica serovar Typhi Ty2
acaggcuggcgggcgucaccg

SEQ ID NO: 1741855 - RNA, 20 nt, Salmonella enterica enterica serovar Typhi Ty2
acaggcugaacccugccugc

SEQ ID NO: 1741856 - RNA, 11 nt, Salmonella enterica enterica serovar Typhi Ty2
acaugccgcca

SEQ ID NO: 1741857 - RNA, 17 nt, Salmonella enterica enterica serovar Typhi Ty2
acaucgccagcuucgcu

SEQ ID NO: 1741858 - RNA, 11 nt, Salmonella enterica enterica serovar Typhi Ty2
acaucgccauu

SEQ ID NO: 1741859 - RNA, 16 nt, Salmonella enterica enterica serovar Typhi Ty2
acaucgcucccggcac

SEQ ID NO: 1741860 - RNA, 15 nt, Salmonella enterica enterica serovar Typhi Ty2
acaucgcucccggca

SEQ ID NO: 1741861 - RNA, 12 nt, Salmonella enterica enterica serovar Typhi Ty2
acaucgcugaua

SEQ ID NO: 1741862 - RNA, 15 nt, Salmonella enterica enterica serovar Typhi Ty2
acaucgcuggcgcgc

SEQ ID NO: 1741863 - RNA, 14 nt, Salmonella enterica enterica serovar Typhi Ty2
acaggugcgcugug

SEQ ID NO: 1741864 - RNA, 16 nt, Salmonella enterica enterica serovar Typhi Ty2
acauauuuuucacaca

SEQ ID NO: 1741865 - RNA, 22 nt, Salmonella enterica enterica serovar Typhi Ty2
acagguuaacgaagguaaacgc

SEQ ID NO: 1741866 - RNA, 19 nt, Salmonella enterica enterica serovar Typhi Ty2
acagguuaucgccgcccgu

SEQ ID NO: 1741867 - RNA, 15 nt, Salmonella enterica enterica serovar Typhi Ty2
acaucacguucgcgc

SEQ ID NO: 1741868 - RNA, 15 nt, Salmonella enterica enterica serovar Typhi Ty2
acaucaucaggccug

SEQ ID NO: 1741869 - RNA, 14 nt, Salmonella enterica enterica serovar Typhi Ty2
acaucaucgcuggu

SEQ ID NO: 1741870 - RNA, 16 nt, Salmonella enterica enterica serovar Typhi Ty2
acaucagagguaauua

SEQ ID NO: 1741871 - RNA, 16 nt, Salmonella enterica enterica serovar Typhi Ty2
acaucacguucgcgca

SEQ ID NO: 1741872 - RNA, 22 nt, Salmonella enterica enterica serovar Typhi Ty2
acccggcugccauuaucaccau

SEQ ID NO: 1741873 - RNA, 20 nt, Salmonella enterica enterica serovar Typhi Ty2
acccuguaggccugauaagc

SEQ ID NO: 1741874 - RNA, 18 nt, Salmonella enterica enterica serovar Typhi Ty2
acccgcaauaacgccgau

SEQ ID NO: 1741875 - RNA, 17 nt, Salmonella enterica enterica serovar Typhi Ty2
acccgcgcucuccggca

SEQ ID NO: 1741876 - RNA, 20 nt, Salmonella enterica enterica serovar Typhi Ty2
acccgcgcgcuuuccacaau

SEQ ID NO: 1741877 - RNA, 19 nt, Salmonella enterica enterica serovar Typhi Ty2
acccgcucgcccgccgcaa

SEQ ID NO: 1741878 - RNA, 21 nt, Salmonella enterica enterica serovar Typhi Ty2
acccgauagcgccgcgcuauc

SEQ ID NO: 1741879 - RNA, 16 nt, Salmonella enterica enterica serovar Typhi Ty2
accgaugcccagcuug

SEQ ID NO: 1741880 - RNA, 20 nt, Salmonella enterica enterica serovar Typhi Ty2
accgauagagacugccgccg

SEQ ID NO: 1741881 - RNA, 23 nt, Salmonella enterica enterica serovar Typhi Ty2
accgacuaaggggguacgcguaa

SEQ ID NO: 1741882 - RNA, 19 nt, Salmonella enterica enterica serovar Typhi Ty2
accgccauccggcgauguc

SEQ ID NO: 1741883 - RNA, 23 nt, Salmonella enterica enterica serovar Typhi Ty2
accgccgcgauagaccacgccau

SEQ ID NO: 1741884 - RNA, 18 nt, Salmonella enterica enterica serovar Typhi Ty2
accgccaccauccggcgc

SEQ ID NO: 1741885 - RNA, 14 nt, Salmonella enterica enterica serovar Typhi Ty2
accgccaggucggc

SEQ ID NO: 1741886 - RNA, 20 nt, Salmonella enterica enterica serovar Typhi Ty2
accggaccuaauagccagcc

SEQ ID NO: 1741887 - RNA, 22 nt, Salmonella enterica enterica serovar Typhi Ty2
accgcuggcgucuguccggcgc

SEQ ID NO: 1741888 - RNA, 20 nt, Salmonella enterica enterica serovar Typhi Ty2
accgcguccugacggugcgc

SEQ ID NO: 1741889 - RNA, 23 nt, Salmonella enterica enterica serovar Typhi Ty2
accggcccgggcacgauggccug

SEQ ID NO: 1741890 - RNA, 19 nt, Salmonella enterica enterica serovar Typhi Ty2
accggccccaauuugcugu

SEQ ID NO: 1741891 - RNA, 12 nt, Salmonella enterica enterica serovar Typhi Ty2
accggccacaau

SEQ ID NO: 1741892 - RNA, 20 nt, Salmonella enterica enterica serovar Typhi Ty2
accggccacaauugccagca

SEQ ID NO: 1741893 - RNA, 17 nt, Salmonella enterica enterica serovar Typhi Ty2
accggacggucggcgua

SEQ ID NO: 1741894 - RNA, 21 nt, Salmonella enterica enterica serovar Typhi Ty2
accggcacgguuaaugaaauc

SEQ ID NO: 1741895 - RNA, 12 nt, Salmonella enterica enterica serovar Typhi Ty2
accggcagcggu

SEQ ID NO: 1741896 - RNA, 23 nt, Salmonella enterica enterica serovar Typhi Ty2
accggcuguucacguaccaggca

SEQ ID NO: 1741897 - RNA, 15 nt, Salmonella enterica enterica serovar Typhi Ty2
accggcgccagcucu

SEQ ID NO: 1741898 - RNA, 13 nt, Salmonella enterica enterica serovar Typhi Ty2
accggccgccauc

SEQ ID NO: 1741899 - RNA, 23 nt, Salmonella enterica enterica serovar Typhi Ty2
accgugcccggaguccauauccg

SEQ ID NO: 1741900 - RNA, 20 nt, Salmonella enterica enterica serovar Typhi Ty2
accguggccuccggcagaaa

SEQ ID NO: 1741901 - RNA, 22 nt, Salmonella enterica enterica serovar Typhi Ty2
accgucggacuuuuugaaauca

SEQ ID NO: 1741902 - RNA, 15 nt, Salmonella enterica enterica serovar Typhi Ty2
accgguuugucauuc

SEQ ID NO: 1741903 - RNA, 14 nt, Salmonella enterica enterica serovar Typhi Ty2
accguaauaaguau

SEQ ID NO: 1741904 - RNA, 16 nt, Salmonella enterica enterica serovar Typhi Ty2
accgucaguaccagcg

SEQ ID NO: 1741905 - RNA, 15 nt, Salmonella enterica enterica serovar Typhi Ty2
accgucaucagccgu

SEQ ID NO: 1741906 - RNA, 13 nt, Salmonella enterica enterica serovar Typhi Ty2
accgucaugacgu

SEQ ID NO: 1741907 - RNA, 19 nt, Salmonella enterica enterica serovar Typhi Ty2
accggugcgauucagcgca

SEQ ID NO: 1741908 - RNA, 14 nt, Salmonella enterica enterica serovar Typhi Ty2
acuuuaccgccguu

SEQ ID NO: 1741909 - RNA, 17 nt, Salmonella enterica enterica serovar Typhi Ty2
acuuuccugguaaucga

SEQ ID NO: 1741910 - RNA, 18 nt, Salmonella enterica enterica serovar Typhi Ty2
acuuucugcuuuggccgg

SEQ ID NO: 1741911 - RNA, 20 nt, Salmonella enterica enterica serovar Typhi Ty2
acuuguucaauauuccuggc

SEQ ID NO: 1741912 - RNA, 20 nt, Salmonella enterica enterica serovar Typhi Ty2
acuucugacauucagcgcuu

SEQ ID NO: 1741913 - RNA, 21 nt, Salmonella enterica enterica serovar Typhi Ty2
acuucauacgaauggguaaua

SEQ ID NO: 1741914 - RNA, 15 nt, Salmonella enterica enterica serovar Typhi Ty2
acuucacccaucgcc

SEQ ID NO: 1741915 - RNA, 11 nt, Salmonella enterica enterica serovar Typhi Ty2
acuuccggauc

SEQ ID NO: 1741916 - RNA, 18 nt, Salmonella enterica enterica serovar Typhi Ty2
acuguuguucuucauaca

SEQ ID NO: 1741917 - RNA, 13 nt, Salmonella enterica enterica serovar Typhi Ty2
acuguucagccag

SEQ ID NO: 1741918 - RNA, 21 nt, Salmonella enterica enterica serovar Typhi Ty2
acugugguuaugguugccgca

SEQ ID NO: 1741919 - RNA, 20 nt, Salmonella enterica enterica serovar Typhi Ty2
acuucacaaucagcgcaaua

SEQ ID NO: 1741920 - RNA, 18 nt, Salmonella enterica enterica serovar Typhi Ty2
acuucaauuuuccagaua

SEQ ID NO: 1741921 - RNA, 15 nt, Salmonella enterica enterica serovar Typhi Ty2
acuucaauucagaaa

SEQ ID NO: 1741922 - RNA, 17 nt, Salmonella enterica enterica serovar Typhi Ty2
acuuagcccuggccaau

SEQ ID NO: 1741923 - RNA, 14 nt, Salmonella enterica enterica serovar Typhi Ty2
acuuacgacgcgcc

SEQ ID NO: 1741924 - RNA, 19 nt, Salmonella enterica enterica serovar Typhi Ty2
acuuaaugcaaugcgcgug

SEQ ID NO: 1741925 - RNA, 15 nt, Salmonella enterica enterica serovar Typhi Ty2
acucagcggcccaau

SEQ ID NO: 1741926 - RNA, 14 nt, Salmonella enterica enterica serovar Typhi Ty2
acucaggcgcaucu

SEQ ID NO: 1741927 - RNA, 13 nt, Salmonella enterica enterica serovar Typhi Ty2
acucacgcgcgcu

SEQ ID NO: 1741928 - RNA, 22 nt, Salmonella enterica enterica serovar Typhi Ty2
acuauuuuuuaugugacaauca

SEQ ID NO: 1741929 - RNA, 16 nt, Salmonella enterica enterica serovar Typhi Ty2
acucaagcgaauccag

SEQ ID NO: 1741930 - RNA, 23 nt, Salmonella enterica enterica serovar Typhi Ty2
acucaccacaaaggcgcguagcu

SEQ ID NO: 1741931 - RNA, 17 nt, Salmonella enterica enterica serovar Typhi Ty2
acugauaccccagcgau

SEQ ID NO: 1741932 - RNA, 23 nt, Salmonella enterica enterica serovar Typhi Ty2
acugauaaaagcccuuaucgccc

SEQ ID NO: 1741933 - RNA, 12 nt, Salmonella enterica enterica serovar Typhi Ty2
acucugcgcgua

SEQ ID NO: 1741934 - RNA, 17 nt, Salmonella enterica enterica serovar Typhi Ty2
acucugcgacgccaggc

SEQ ID NO: 1741935 - RNA, 21 nt, Salmonella enterica enterica serovar Typhi Ty2
acuggccguuuucccggcaau

SEQ ID NO: 1741936 - RNA, 21 nt, Salmonella enterica enterica serovar Typhi Ty2
acuggcgcaucuggucauggc

SEQ ID NO: 1741937 - RNA, 13 nt, Salmonella enterica enterica serovar Typhi Ty2
acuggcgccggag

SEQ ID NO: 1741938 - RNA, 21 nt, Salmonella enterica enterica serovar Typhi Ty2
acuggcggcaaaaacgccggu

SEQ ID NO: 1741939 - RNA, 13 nt, Salmonella enterica enterica serovar Typhi Ty2
acuguaaccggcg

SEQ ID NO: 1741940 - RNA, 16 nt, Salmonella enterica enterica serovar Typhi Ty2
acugcggcuuacccug

SEQ ID NO: 1741941 - RNA, 21 nt, Salmonella enterica enterica serovar Typhi Ty2
acugcggucguauuuaccgcu

SEQ ID NO: 1741942 - RNA, 16 nt, Salmonella enterica enterica serovar Typhi Ty2
acuggaucgguugcag

SEQ ID NO: 1741943 - RNA, 15 nt, Salmonella enterica enterica serovar Typhi Ty2
acuggaucacuuuug

SEQ ID NO: 1741944 - RNA, 15 nt, Salmonella enterica enterica serovar Typhi Ty2
acugcuccgccggag

SEQ ID NO: 1741945 - RNA, 15 nt, Salmonella enterica enterica serovar Typhi Ty2
acuggcauaccggug

SEQ ID NO: 1741946 - RNA, 14 nt, Salmonella enterica enterica serovar Typhi Ty2
acugcauaucgccg

SEQ ID NO: 1741947 - RNA, 14 nt, Salmonella enterica enterica serovar Typhi Ty2
acgugacguaucgc

SEQ ID NO: 1741948 - RNA, 22 nt, Salmonella enterica enterica serovar Typhi Ty2
acgugaugauaggucagcgauu

SEQ ID NO: 1741949 - RNA, 14 nt, Salmonella enterica enterica serovar Typhi Ty2
acgugacgcgccag

SEQ ID NO: 1741950 - RNA, 20 nt, Salmonella enterica enterica serovar Typhi Ty2
acgucuggaaacccgcucgc

SEQ ID NO: 1741951 - RNA, 20 nt, Salmonella enterica enterica serovar Typhi Ty2
acgucgcguacaccuuaucu

SEQ ID NO: 1741952 - RNA, 15 nt, Salmonella enterica enterica serovar Typhi Ty2
acguaaccggcguuc

SEQ ID NO: 1741953 - RNA, 18 nt, Salmonella enterica enterica serovar Typhi Ty2
acguacccgcucggcaua

SEQ ID NO: 1741954 - RNA, 23 nt, Salmonella enterica enterica serovar Typhi Ty2
acgucagcaucuccuggcgcagc

SEQ ID NO: 1741955 - RNA, 19 nt, Salmonella enterica enterica serovar Typhi Ty2
acgucagacgaggguaaua

SEQ ID NO: 1741956 - RNA, 21 nt, Salmonella enterica enterica serovar Typhi Ty2
acgucaaaccccucccggguc

SEQ ID NO: 1741957 - RNA, 15 nt, Salmonella enterica enterica serovar Typhi Ty2
acgucaaagcuaacg

SEQ ID NO: 1741958 - RNA, 17 nt, Salmonella enterica enterica serovar Typhi Ty2
acguugaucgccaucgc

SEQ ID NO: 1741959 - RNA, 15 nt, Salmonella enterica enterica serovar Typhi Ty2
acuaagaccagcauc

SEQ ID NO: 1741960 - RNA, 22 nt, Salmonella enterica enterica serovar Typhi Ty2
acguugcggcgcguucagcauc

SEQ ID NO: 1741961 - RNA, 19 nt, Salmonella enterica enterica serovar Typhi Ty2
acuauugccgauaauacgc

SEQ ID NO: 1741962 - RNA, 18 nt, Salmonella enterica enterica serovar Typhi Ty2
acuaucaugaaugcccca

SEQ ID NO: 1741963 - RNA, 18 nt, Salmonella enterica enterica serovar Typhi Ty2
acuacccggaggcaauau

SEQ ID NO: 1741964 - RNA, 15 nt, Salmonella enterica enterica serovar Typhi Ty2
acgugggucgagaau

SEQ ID NO: 1741965 - RNA, 21 nt, Salmonella enterica enterica serovar Typhi Ty2
acguuacgcggcgcgccguaa

SEQ ID NO: 1741966 - RNA, 19 nt, Salmonella enterica enterica serovar Typhi Ty2
acguuaaagccgaccaucg

SEQ ID NO: 1741967 - RNA, 19 nt, Salmonella enterica enterica serovar Typhi Ty2
acguuaucgcgcacgcgcc

SEQ ID NO: 1741968 - RNA, 21 nt, Salmonella enterica enterica serovar Typhi Ty2
acguuaucugaccuacaggcc

SEQ ID NO: 1741969 - RNA, 16 nt, Salmonella enterica enterica serovar Typhi Ty2
acguuaccgcagcgaa

SEQ ID NO: 1741970 - RNA, 17 nt, Salmonella enterica enterica serovar Typhi Ty2
acguuaccgcagcgaau

SEQ ID NO: 1741971 - RNA, 13 nt, Salmonella enterica enterica serovar Typhi Ty2
acggcuaccugca

SEQ ID NO: 1741972 - RNA, 19 nt, Salmonella enterica enterica serovar Typhi Ty2
acggcaaacgcuggugcug

SEQ ID NO: 1741973 - RNA, 18 nt, Salmonella enterica enterica serovar Typhi Ty2
acggcaacaguaccugau

SEQ ID NO: 1741974 - RNA, 20 nt, Salmonella enterica enterica serovar Typhi Ty2
acggcaaaauaaauauccuc

SEQ ID NO: 1741975 - RNA, 16 nt, Salmonella enterica enterica serovar Typhi Ty2
acggcuccagcgccag

SEQ ID NO: 1741976 - RNA, 14 nt, Salmonella enterica enterica serovar Typhi Ty2
acggcugaggcuuu

SEQ ID NO: 1741977 - RNA, 12 nt, Salmonella enterica enterica serovar Typhi Ty2
acgggaucgcag

SEQ ID NO: 1741978 - RNA, 20 nt, Salmonella enterica enterica serovar Typhi Ty2
acgggagagcguauccagca

SEQ ID NO: 1741979 - RNA, 15 nt, Salmonella enterica enterica serovar Typhi Ty2
acgggcagagucgau

SEQ ID NO: 1741980 - RNA, 17 nt, Salmonella enterica enterica serovar Typhi Ty2
acgguuaagccgguaau

SEQ ID NO: 1741981 - RNA, 22 nt, Salmonella enterica enterica serovar Typhi Ty2
acgguguuuagacacauugaug

SEQ ID NO: 1741982 - RNA, 16 nt, Salmonella enterica enterica serovar Typhi Ty2
acggugcuaauaccgg

SEQ ID NO: 1741983 - RNA, 23 nt, Salmonella enterica enterica serovar Typhi Ty2
acgaagcgggcaauuccggucau

SEQ ID NO: 1741984 - RNA, 15 nt, Salmonella enterica enterica serovar Typhi Ty2
acgauaaggccaaua

SEQ ID NO: 1741985 - RNA, 18 nt, Salmonella enterica enterica serovar Typhi Ty2
acgauaaccaugcucagc

SEQ ID NO: 1741986 - RNA, 22 nt, Salmonella enterica enterica serovar Typhi Ty2
acgaguuucguuaccccgcagc

SEQ ID NO: 1741987 - RNA, 19 nt, Salmonella enterica enterica serovar Typhi Ty2
acgaggccacgcagcgcag

SEQ ID NO: 1741988 - RNA, 23 nt, Salmonella enterica enterica serovar Typhi Ty2
accguugcggucggcagcaccgg

SEQ ID NO: 1741989 - RNA, 23 nt, Salmonella enterica enterica serovar Typhi Ty2
accguuggaauaaaucacaacgu

SEQ ID NO: 1741990 - RNA, 20 nt, Salmonella enterica enterica serovar Typhi Ty2
accguugcgcccaucaucau

SEQ ID NO: 1741991 - RNA, 19 nt, Salmonella enterica enterica serovar Typhi Ty2
accuucggucccaucgcgc

SEQ ID NO: 1741992 - RNA, 15 nt, Salmonella enterica enterica serovar Typhi Ty2
accuucuucgccaac

SEQ ID NO: 1741993 - RNA, 23 nt, Salmonella enterica enterica serovar Typhi Ty2
accuguaaccccagcaucugcau

SEQ ID NO: 1741994 - RNA, 18 nt, Salmonella enterica enterica serovar Typhi Ty2
acgaacgcuaugcgccag

SEQ ID NO: 1741995 - RNA, 23 nt, Salmonella enterica enterica serovar Typhi Ty2
acgaacugauguuccggcacggu

SEQ ID NO: 1741996 - RNA, 13 nt, Salmonella enterica enterica serovar Typhi Ty2
accuuucugccag

SEQ ID NO: 1741997 - RNA, 14 nt, Salmonella enterica enterica serovar Typhi Ty2
accuuuugccgccc

SEQ ID NO: 1741998 - RNA, 22 nt, Salmonella enterica enterica serovar Typhi Ty2
accuuuuugauccguuucagaa

SEQ ID NO: 1741999 - RNA, 14 nt, Salmonella enterica enterica serovar Typhi Ty2
acgaaaaaagcgcc

SEQ ID NO: 1742000 - RNA, 15 nt, Salmonella enterica enterica serovar Typhi Ty2
acgaaauagcgcagc

SEQ ID NO: 1742001 - RNA, 17 nt, Salmonella enterica enterica serovar Typhi Ty2
acgaaagucuguucgua

SEQ ID NO: 1742002 - RNA, 18 nt, Salmonella enterica enterica serovar Typhi Ty2
acgaaaaccgagcgcaug

SEQ ID NO: 1742003 - RNA, 17 nt, Salmonella enterica enterica serovar Typhi Ty2
acgcaucguggccgaua

SEQ ID NO: 1742004 - RNA, 22 nt, Salmonella enterica enterica serovar Typhi Ty2
acgcagcuuaaagccaauccag

SEQ ID NO: 1742005 - RNA, 15 nt, Salmonella enterica enterica serovar Typhi Ty2
acgcaggcgaaauca

SEQ ID NO: 1742006 - RNA, 15 nt, Salmonella enterica enterica serovar Typhi Ty2
acgccaucggcuaag

SEQ ID NO: 1742007 - RNA, 19 nt, Salmonella enterica enterica serovar Typhi Ty2
acgccaucgcggcgcaaau

SEQ ID NO: 1742008 - RNA, 21 nt, Salmonella enterica enterica serovar Typhi Ty2
acgccagguagccgacggcca

SEQ ID NO: 1742009 - RNA, 23 nt, Salmonella enterica enterica serovar Typhi Ty2
acgccagguuaugcgauaccucu

SEQ ID NO: 1742010 - RNA, 16 nt, Salmonella enterica enterica serovar Typhi Ty2
acgccccacagaccua

SEQ ID NO: 1742011 - RNA, 17 nt, Salmonella enterica enterica serovar Typhi Ty2
acgcccauauccagcuc

SEQ ID NO: 1742012 - RNA, 18 nt, Salmonella enterica enterica serovar Typhi Ty2
acgaugcagcaccagaua

SEQ ID NO: 1742013 - RNA, 15 nt, Salmonella enterica enterica serovar Typhi Ty2
acgaucaugccgccc

SEQ ID NO: 1742014 - RNA, 14 nt, Salmonella enterica enterica serovar Typhi Ty2
acgauccccgucaa

SEQ ID NO: 1742015 - RNA, 19 nt, Salmonella enterica enterica serovar Typhi Ty2
acgauauucuguuagcgcc

SEQ ID NO: 1742016 - RNA, 18 nt, Salmonella enterica enterica serovar Typhi Ty2
acgauaguuugccagaga

SEQ ID NO: 1742017 - RNA, 15 nt, Salmonella enterica enterica serovar Typhi Ty2
acgauaucgccuggu

SEQ ID NO: 1742018 - RNA, 19 nt, Salmonella enterica enterica serovar Typhi Ty2
acgcaacaggccgcaucgg

SEQ ID NO: 1742019 - RNA, 19 nt, Salmonella enterica enterica serovar Typhi Ty2
acgcagaagcgcguuggcg

SEQ ID NO: 1742020 - RNA, 15 nt, Salmonella enterica enterica serovar Typhi Ty2
acgcagcgcgcguag

SEQ ID NO: 1742021 - RNA, 16 nt, Salmonella enterica enterica serovar Typhi Ty2
acgcagcugaugcgaa

SEQ ID NO: 1742022 - RNA, 17 nt, Salmonella enterica enterica serovar Typhi Ty2
acgcacguacggaaggu

SEQ ID NO: 1742023 - RNA, 13 nt, Salmonella enterica enterica serovar Typhi Ty2
acgcaagcagcac

SEQ ID NO: 1742024 - RNA, 9 nt, Salmonella enterica enterica serovar Typhi Ty2
acgcugaug

SEQ ID NO: 1742025 - RNA, 18 nt, Salmonella enterica enterica serovar Typhi Ty2
acgcugaaaacggcauca

SEQ ID NO: 1742026 - RNA, 16 nt, Salmonella enterica enterica serovar Typhi Ty2
acgcugacgcgaucgc

SEQ ID NO: 1742027 - RNA, 17 nt, Salmonella enterica enterica serovar Typhi Ty2
acgcugugcgagaccau

SEQ ID NO: 1742028 - RNA, 14 nt, Salmonella enterica enterica serovar Typhi Ty2
acggaaaccagcau

SEQ ID NO: 1742029 - RNA, 21 nt, Salmonella enterica enterica serovar Typhi Ty2
acgcuuuuuugcuggcuggcg

SEQ ID NO: 1742030 - RNA, 22 nt, Salmonella enterica enterica serovar Typhi Ty2
acggaaaugaucagacgcauca

SEQ ID NO: 1742031 - RNA, 22 nt, Salmonella enterica enterica serovar Typhi Ty2
acggaaccaaaauagauaaucg

SEQ ID NO: 1742032 - RNA, 20 nt, Salmonella enterica enterica serovar Typhi Ty2
acggaagucugaccgucagc

SEQ ID NO: 1742033 - RNA, 15 nt, Salmonella enterica enterica serovar Typhi Ty2
acggaagguaauagc

SEQ ID NO: 1742034 - RNA, 18 nt, Salmonella enterica enterica serovar Typhi Ty2
acggaaucucgcacauca

SEQ ID NO: 1742035 - RNA, 20 nt, Salmonella enterica enterica serovar Typhi Ty2
acggaauggcacagcgcagc

SEQ ID NO: 1742036 - RNA, 15 nt, Salmonella enterica enterica serovar Typhi Ty2
acggagauuaacagc

SEQ ID NO: 1742037 - RNA, 15 nt, Salmonella enterica enterica serovar Typhi Ty2
acggacucaggccuu

SEQ ID NO: 1742038 - RNA, 18 nt, Salmonella enterica enterica serovar Typhi Ty2
acgcguuuuccagcacca

SEQ ID NO: 1742039 - RNA, 18 nt, Salmonella enterica enterica serovar Typhi Ty2
acgcuaccgucgacgucu

SEQ ID NO: 1742040 - RNA, 15 nt, Salmonella enterica enterica serovar Typhi Ty2
acgcucacgcagaua

SEQ ID NO: 1742041 - RNA, 15 nt, Salmonella enterica enterica serovar Typhi Ty2
acgcucacccaguuu

SEQ ID NO: 1742042 - RNA, 15 nt, Salmonella enterica enterica serovar Typhi Ty2
acgcucgacgccggu

SEQ ID NO: 1742043 - RNA, 18 nt, Salmonella enterica enterica serovar Typhi Ty2
acgcguuucacaucgcca

SEQ ID NO: 1742044 - RNA, 10 nt, Salmonella enterica enterica serovar Typhi Ty2
acgcguugcc

SEQ ID NO: 1742045 - RNA, 23 nt, Salmonella enterica enterica serovar Typhi Ty2
acgcggugaaggcaaaacaccau

SEQ ID NO: 1742046 - RNA, 21 nt, Salmonella enterica enterica serovar Typhi Ty2
acgccgggcauuaaugguuau

SEQ ID NO: 1742047 - RNA, 16 nt, Salmonella enterica enterica serovar Typhi Ty2
acgccgggccugccag

SEQ ID NO: 1742048 - RNA, 21 nt, Salmonella enterica enterica serovar Typhi Ty2
acgccgguacuggagaccggc

SEQ ID NO: 1742049 - RNA, 20 nt, Salmonella enterica enterica serovar Typhi Ty2
acgccgcgcgugguauuaca

SEQ ID NO: 1742050 - RNA, 14 nt, Salmonella enterica enterica serovar Typhi Ty2
acgccugccagaua

SEQ ID NO: 1742051 - RNA, 17 nt, Salmonella enterica enterica serovar Typhi Ty2
acgcgaaaauaccccag

SEQ ID NO: 1742052 - RNA, 19 nt, Salmonella enterica enterica serovar Typhi Ty2
acgccgucugguacggcca

SEQ ID NO: 1742053 - RNA, 16 nt, Salmonella enterica enterica serovar Typhi Ty2
acgccgugacggcgua

SEQ ID NO: 1742054 - RNA, 16 nt, Salmonella enterica enterica serovar Typhi Ty2
acgccgugaacgccaa

SEQ ID NO: 1742055 - RNA, 14 nt, Salmonella enterica enterica serovar Typhi Ty2
acgccgucgacaaa

SEQ ID NO: 1742056 - RNA, 22 nt, Salmonella enterica enterica serovar Typhi Ty2
acgccgucgaugauggcggcua

SEQ ID NO: 1742057 - RNA, 14 nt, Salmonella enterica enterica serovar Typhi Ty2
acgccguccggcga

SEQ ID NO: 1742058 - RNA, 13 nt, Salmonella enterica enterica serovar Typhi Ty2
acgccguccagca

SEQ ID NO: 1742059 - RNA, 14 nt, Salmonella enterica enterica serovar Typhi Ty2
acgcgcgcggcguc

SEQ ID NO: 1742060 - RNA, 14 nt, Salmonella enterica enterica serovar Typhi Ty2
acgcgcugauaccg

SEQ ID NO: 1742061 - RNA, 18 nt, Salmonella enterica enterica serovar Typhi Ty2
acgcgcugaccucaaucc

SEQ ID NO: 1742062 - RNA, 22 nt, Salmonella enterica enterica serovar Typhi Ty2
acgcgcucguacaaaucacugg

SEQ ID NO: 1742063 - RNA, 14 nt, Salmonella enterica enterica serovar Typhi Ty2
acgcgacgcgccag

SEQ ID NO: 1742064 - RNA, 17 nt, Salmonella enterica enterica serovar Typhi Ty2
acgcgaauagccagaca

SEQ ID NO: 1742065 - RNA, 19 nt, Salmonella enterica enterica serovar Typhi Ty2
acgcgaagauuaacccggu

SEQ ID NO: 1742066 - RNA, 18 nt, Salmonella enterica enterica serovar Typhi Ty2
acgcgaccagacacggug

SEQ ID NO: 1742067 - RNA, 15 nt, Salmonella enterica enterica serovar Typhi Ty2
acgcgaagcggcguc

SEQ ID NO: 1742068 - RNA, 19 nt, Salmonella enterica enterica serovar Typhi Ty2
acgcgguaaauuccgcagg

SEQ ID NO: 1742069 - RNA, 19 nt, Salmonella enterica enterica serovar Typhi Ty2
acgcggucgccugccgcau

SEQ ID NO: 1742070 - RNA, 17 nt, Salmonella enterica enterica serovar Typhi Ty2
acgcggaacuggugaaa

SEQ ID NO: 1742071 - RNA, 23 nt, Salmonella enterica enterica serovar Typhi Ty2
acgcgcuuuuucuuccgucagcg

SEQ ID NO: 1742072 - RNA, 12 nt, Salmonella enterica enterica serovar Typhi Ty2
uuaagcgaaccu

SEQ ID NO: 1742073 - RNA, 23 nt, Salmonella enterica enterica serovar Typhi Ty2
uuaacuccgcuggcguuggcuau

SEQ ID NO: 1742074 - RNA, 20 nt, Salmonella enterica enterica serovar Typhi Ty2
uuaacgucacgauggcgauu

SEQ ID NO: 1742075 - RNA, 13 nt, Salmonella enterica enterica serovar Typhi Ty2
uuaagcacgccgc

SEQ ID NO: 1742076 - RNA, 12 nt, Salmonella enterica enterica serovar Typhi Ty2
uguuucgaugua

SEQ ID NO: 1742077 - RNA, 17 nt, Salmonella enterica enterica serovar Typhi Ty2
uguuucucuuccgccag

SEQ ID NO: 1742078 - RNA, 14 nt, Salmonella enterica enterica serovar Typhi Ty2
uguuuuaccuguuu

SEQ ID NO: 1742079 - RNA, 22 nt, Salmonella enterica enterica serovar Typhi Ty2
uguuuguuuaacugaacuuccg

SEQ ID NO: 1742080 - RNA, 20 nt, Salmonella enterica enterica serovar Typhi Ty2
uguuugcgcaguugccagua

SEQ ID NO: 1742081 - RNA, 14 nt, Salmonella enterica enterica serovar Typhi Ty2
uguuuggguaacac

SEQ ID NO: 1742082 - RNA, 17 nt, Salmonella enterica enterica serovar Typhi Ty2
uuaacgauaauguuggu

SEQ ID NO: 1742083 - RNA, 18 nt, Salmonella enterica enterica serovar Typhi Ty2
uuaaaaucugguggccgg

SEQ ID NO: 1742084 - RNA, 21 nt, Salmonella enterica enterica serovar Typhi Ty2
uuaacgcguaaucuuccaccc

SEQ ID NO: 1742085 - RNA, 19 nt, Salmonella enterica enterica serovar Typhi Ty2
uuaacgcauguuccgcuac

SEQ ID NO: 1742086 - RNA, 22 nt, Salmonella enterica enterica serovar Typhi Ty2
uuaaaaagcgcgggcuggccgg

SEQ ID NO: 1742087 - RNA, 12 nt, Salmonella enterica enterica serovar Typhi Ty2
uguuuuucacua

SEQ ID NO: 1742088 - RNA, 23 nt, Salmonella enterica enterica serovar Typhi Ty2
uguuuaucugaugccugaaggcg

SEQ ID NO: 1742089 - RNA, 16 nt, Salmonella enterica enterica serovar Typhi Ty2
uguuuacgccgccauc

SEQ ID NO: 1742090 - RNA, 22 nt, Salmonella enterica enterica serovar Typhi Ty2
uguuggugcgcguugccaucgg

SEQ ID NO: 1742091 - RNA, 10 nt, Salmonella enterica enterica serovar Typhi Ty2
uguuccggcg

SEQ ID NO: 1742092 - RNA, 12 nt, Salmonella enterica enterica serovar Typhi Ty2
uguuccagguuu

SEQ ID NO: 1742093 - RNA, 21 nt, Salmonella enterica enterica serovar Typhi Ty2
uguuccagauaauccagcguc

SEQ ID NO: 1742094 - RNA, 20 nt, Salmonella enterica enterica serovar Typhi Ty2
uuauagcaaacccucaucgg

SEQ ID NO: 1742095 - RNA, 13 nt, Salmonella enterica enterica serovar Typhi Ty2
uuacuuugcgccc

SEQ ID NO: 1742096 - RNA, 20 nt, Salmonella enterica enterica serovar Typhi Ty2
uuagaaaauauauuggccuu

SEQ ID NO: 1742097 - RNA, 15 nt, Salmonella enterica enterica serovar Typhi Ty2
uuaccuuuuccggcg

SEQ ID NO: 1742098 - RNA, 14 nt, Salmonella enterica enterica serovar Typhi Ty2
uuacugacaauaag

SEQ ID NO: 1742099 - RNA, 16 nt, Salmonella enterica enterica serovar Typhi Ty2
uuacugaugccagccg

SEQ ID NO: 1742100 - RNA, 16 nt, Salmonella enterica enterica serovar Typhi Ty2
uuacuggcgacgaccg

SEQ ID NO: 1742101 - RNA, 11 nt, Salmonella enterica enterica serovar Typhi Ty2
uuacugauaaa

SEQ ID NO: 1742102 - RNA, 20 nt, Salmonella enterica enterica serovar Typhi Ty2
uuaccgggcaaacggcacua

SEQ ID NO: 1742103 - RNA, 19 nt, Salmonella enterica enterica serovar Typhi Ty2
uuaccuauuuguuccggca

SEQ ID NO: 1742104 - RNA, 13 nt, Salmonella enterica enterica serovar Typhi Ty2
uuaccucacggug

SEQ ID NO: 1742105 - RNA, 20 nt, Salmonella enterica enterica serovar Typhi Ty2
uuaccgggaaaugucuggcg

SEQ ID NO: 1742106 - RNA, 13 nt, Salmonella enterica enterica serovar Typhi Ty2
uuaucguccggca

SEQ ID NO: 1742107 - RNA, 13 nt, Salmonella enterica enterica serovar Typhi Ty2
uuaucgccaaaga

SEQ ID NO: 1742108 - RNA, 18 nt, Salmonella enterica enterica serovar Typhi Ty2
uuauccugcaaauagcgc

SEQ ID NO: 1742109 - RNA, 11 nt, Salmonella enterica enterica serovar Typhi Ty2
uuaucuuccac

SEQ ID NO: 1742110 - RNA, 17 nt, Salmonella enterica enterica serovar Typhi Ty2
uuaucuuccacgguaaa

SEQ ID NO: 1742111 - RNA, 13 nt, Salmonella enterica enterica serovar Typhi Ty2
uuaucuuccggca

SEQ ID NO: 1742112 - RNA, 19 nt, Salmonella enterica enterica serovar Typhi Ty2
uuaucuggcgcaaccggcg

SEQ ID NO: 1742113 - RNA, 15 nt, Salmonella enterica enterica serovar Typhi Ty2
uuaucuggucgcggu

SEQ ID NO: 1742114 - RNA, 22 nt, Salmonella enterica enterica serovar Typhi Ty2
uuaucucuuuugcuucaauaag

SEQ ID NO: 1742115 - RNA, 14 nt, Salmonella enterica enterica serovar Typhi Ty2
uuauguuugcugau

SEQ ID NO: 1742116 - RNA, 17 nt, Salmonella enterica enterica serovar Typhi Ty2
uuauucggucagauaaa

SEQ ID NO: 1742117 - RNA, 12 nt, Salmonella enterica enterica serovar Typhi Ty2
uuauucaucgau

SEQ ID NO: 1742118 - RNA, 15 nt, Salmonella enterica enterica serovar Typhi Ty2
uucaccguaucgccc

SEQ ID NO: 1742119 - RNA, 16 nt, Salmonella enterica enterica serovar Typhi Ty2
uucaccgcgccaaacg

SEQ ID NO: 1742120 - RNA, 15 nt, Salmonella enterica enterica serovar Typhi Ty2
uucaccgccucaucg

SEQ ID NO: 1742121 - RNA, 17 nt, Salmonella enterica enterica serovar Typhi Ty2
uucacaaccuccacgcc

SEQ ID NO: 1742122 - RNA, 21 nt, Salmonella enterica enterica serovar Typhi Ty2
uucacaaccuccacgcccagc

SEQ ID NO: 1742123 - RNA, 17 nt, Salmonella enterica enterica serovar Typhi Ty2
uucacaauacagaacau

SEQ ID NO: 1742124 - RNA, 21 nt, Salmonella enterica enterica serovar Typhi Ty2
uucaauauagccguggcuggc

SEQ ID NO: 1742125 - RNA, 21 nt, Salmonella enterica enterica serovar Typhi Ty2
uucaccaccacccgaucgccc

SEQ ID NO: 1742126 - RNA, 16 nt, Salmonella enterica enterica serovar Typhi Ty2
uucacccccaucgccc

SEQ ID NO: 1742127 - RNA, 17 nt, Salmonella enterica enterica serovar Typhi Ty2
uuauugaguuaccguuu

SEQ ID NO: 1742128 - RNA, 18 nt, Salmonella enterica enterica serovar Typhi Ty2
uuauugccacgccauacg

SEQ ID NO: 1742129 - RNA, 14 nt, Salmonella enterica enterica serovar Typhi Ty2
uuauugcacguuau

SEQ ID NO: 1742130 - RNA, 21 nt, Salmonella enterica enterica serovar Typhi Ty2
uuauuugaauagucaaccguu

SEQ ID NO: 1742131 - RNA, 17 nt, Salmonella enterica enterica serovar Typhi Ty2
uuauuucaagcaauacc

SEQ ID NO: 1742132 - RNA, 22 nt, Salmonella enterica enterica serovar Typhi Ty2
uucaagcguuuccagaguacau

SEQ ID NO: 1742133 - RNA, 15 nt, Salmonella enterica enterica serovar Typhi Ty2
uucaaccacgccaac

SEQ ID NO: 1742134 - RNA, 21 nt, Salmonella enterica enterica serovar Typhi Ty2
uucaaccacggauaagccagc

SEQ ID NO: 1742135 - RNA, 16 nt, Salmonella enterica enterica serovar Typhi Ty2
uugaaguuauccagcg

SEQ ID NO: 1742136 - RNA, 15 nt, Salmonella enterica enterica serovar Typhi Ty2
uugaagcgaccagcg

SEQ ID NO: 1742137 - RNA, 14 nt, Salmonella enterica enterica serovar Typhi Ty2
uugaaucguagcgu

SEQ ID NO: 1742138 - RNA, 21 nt, Salmonella enterica enterica serovar Typhi Ty2
uugaccggggcgcaauccgcg

SEQ ID NO: 1742139 - RNA, 12 nt, Salmonella enterica enterica serovar Typhi Ty2
uugacgaacgcu

SEQ ID NO: 1742140 - RNA, 17 nt, Salmonella enterica enterica serovar Typhi Ty2
uugagcuucuuggcgau

SEQ ID NO: 1742141 - RNA, 16 nt, Salmonella enterica enterica serovar Typhi Ty2
uugacguuuaccugaa

SEQ ID NO: 1742142 - RNA, 14 nt, Salmonella enterica enterica serovar Typhi Ty2
uugagcagaucagc

SEQ ID NO: 1742143 - RNA, 17 nt, Salmonella enterica enterica serovar Typhi Ty2
uucucaacauacgccgc

SEQ ID NO: 1742144 - RNA, 19 nt, Salmonella enterica enterica serovar Typhi Ty2
uucugaacuguaaccggcg

SEQ ID NO: 1742145 - RNA, 23 nt, Salmonella enterica enterica serovar Typhi Ty2
uucucugcccccgagccagaacg

SEQ ID NO: 1742146 - RNA, 19 nt, Salmonella enterica enterica serovar Typhi Ty2
uucucguguagccaguacg

SEQ ID NO: 1742147 - RNA, 14 nt, Salmonella enterica enterica serovar Typhi Ty2
uucugaucgauaaa

SEQ ID NO: 1742148 - RNA, 21 nt, Salmonella enterica enterica serovar Typhi Ty2
uucugcauuggcgacgauaaa

SEQ ID NO: 1742149 - RNA, 21 nt, Salmonella enterica enterica serovar Typhi Ty2
uugaaaaccacaaucacagcg

SEQ ID NO: 1742150 - RNA, 13 nt, Salmonella enterica enterica serovar Typhi Ty2
uucuuucaucaaa

SEQ ID NO: 1742151 - RNA, 16 nt, Salmonella enterica enterica serovar Typhi Ty2
uuccuccaucgccagc

SEQ ID NO: 1742152 - RNA, 18 nt, Salmonella enterica enterica serovar Typhi Ty2
uuccguucgcgucacaau

SEQ ID NO: 1742153 - RNA, 17 nt, Salmonella enterica enterica serovar Typhi Ty2
uuccggcucgccaaacg

SEQ ID NO: 1742154 - RNA, 21 nt, Salmonella enterica enterica serovar Typhi Ty2
uuccuggauguccgacgccgc

SEQ ID NO: 1742155 - RNA, 16 nt, Salmonella enterica enterica serovar Typhi Ty2
uuccugcugcgccagc

SEQ ID NO: 1742156 - RNA, 16 nt, Salmonella enterica enterica serovar Typhi Ty2
uuccggcagacggcug

SEQ ID NO: 1742157 - RNA, 14 nt, Salmonella enterica enterica serovar Typhi Ty2
uuccggauaacgcg

SEQ ID NO: 1742158 - RNA, 18 nt, Salmonella enterica enterica serovar Typhi Ty2
uuccgcuuuuccugccag

SEQ ID NO: 1742159 - RNA, 22 nt, Salmonella enterica enterica serovar Typhi Ty2
uucccgcacgcgacgcgccagc

SEQ ID NO: 1742160 - RNA, 14 nt, Salmonella enterica enterica serovar Typhi Ty2
uuccccacgccauc

SEQ ID NO: 1742161 - RNA, 15 nt, Salmonella enterica enterica serovar Typhi Ty2
uuccccgaguaacac

SEQ ID NO: 1742162 - RNA, 16 nt, Salmonella enterica enterica serovar Typhi Ty2
uucaguacugacgcaa

SEQ ID NO: 1742163 - RNA, 20 nt, Salmonella enterica enterica serovar Typhi Ty2
uucagguuuugcugaucaau

SEQ ID NO: 1742164 - RNA, 15 nt, Salmonella enterica enterica serovar Typhi Ty2
uucauagaaccacuu

SEQ ID NO: 1742165 - RNA, 23 nt, Salmonella enterica enterica serovar Typhi Ty2
uucccagguuuuggucagcucac

SEQ ID NO: 1742166 - RNA, 16 nt, Salmonella enterica enterica serovar Typhi Ty2
uucgcgucacaaucgc

SEQ ID NO: 1742167 - RNA, 23 nt, Salmonella enterica enterica serovar Typhi Ty2
uucgcgaacugcacucggaugua

SEQ ID NO: 1742168 - RNA, 19 nt, Salmonella enterica enterica serovar Typhi Ty2
uucgcgaauuucacgcagc

SEQ ID NO: 1742169 - RNA, 18 nt, Salmonella enterica enterica serovar Typhi Ty2
uucgcugauuugcgucaa

SEQ ID NO: 1742170 - RNA, 21 nt, Salmonella enterica enterica serovar Typhi Ty2
uucgccggaaagaaacgccgc

SEQ ID NO: 1742171 - RNA, 23 nt, Salmonella enterica enterica serovar Typhi Ty2
uucgcacgccucuggcguacgca

SEQ ID NO: 1742172 - RNA, 14 nt, Salmonella enterica enterica serovar Typhi Ty2
uucgauggccucau

SEQ ID NO: 1742173 - RNA, 20 nt, Salmonella enterica enterica serovar Typhi Ty2
uucgagauuuuucugcgcca

SEQ ID NO: 1742174 - RNA, 22 nt, Salmonella enterica enterica serovar Typhi Ty2
uucgaccccaaccgagcagcuu

SEQ ID NO: 1742175 - RNA, 20 nt, Salmonella enterica enterica serovar Typhi Ty2
uuuaucaacaaauuccggca

SEQ ID NO: 1742176 - RNA, 13 nt, Salmonella enterica enterica serovar Typhi Ty2
uuuauaagccgau

SEQ ID NO: 1742177 - RNA, 18 nt, Salmonella enterica enterica serovar Typhi Ty2
uuuauguuugcugauaag

SEQ ID NO: 1742178 - RNA, 17 nt, Salmonella enterica enterica serovar Typhi Ty2
uuuaucggcgucgcggc

SEQ ID NO: 1742179 - RNA, 22 nt, Salmonella enterica enterica serovar Typhi Ty2
uuucacugcgugaugcugcagg

SEQ ID NO: 1742180 - RNA, 12 nt, Salmonella enterica enterica serovar Typhi Ty2
uuucacuauaaa

SEQ ID NO: 1742181 - RNA, 21 nt, Salmonella enterica enterica serovar Typhi Ty2
uuucaacgcguugccugaaaa

SEQ ID NO: 1742182 - RNA, 22 nt, Salmonella enterica enterica serovar Typhi Ty2
uuucaagcaggcgaucggcgug

SEQ ID NO: 1742183 - RNA, 18 nt, Salmonella enterica enterica serovar Typhi Ty2
uuucaucaaacggauaag

SEQ ID NO: 1742184 - RNA, 16 nt, Salmonella enterica enterica serovar Typhi Ty2
uuucaucgccuuaacu

SEQ ID NO: 1742185 - RNA, 15 nt, Salmonella enterica enterica serovar Typhi Ty2
uuucaugauauucug

SEQ ID NO: 1742186 - RNA, 13 nt, Salmonella enterica enterica serovar Typhi Ty2
uuucagaucggca

SEQ ID NO: 1742187 - RNA, 13 nt, Salmonella enterica enterica serovar Typhi Ty2
uuucagaucgccg

SEQ ID NO: 1742188 - RNA, 18 nt, Salmonella enterica enterica serovar Typhi Ty2
uuucagcggcagcucugc

SEQ ID NO: 1742189 - RNA, 21 nt, Salmonella enterica enterica serovar Typhi Ty2
uuucgccagcgcaucgauaua

SEQ ID NO: 1742190 - RNA, 22 nt, Salmonella enterica enterica serovar Typhi Ty2
uuucgacgacaacgcccacauc

SEQ ID NO: 1742191 - RNA, 17 nt, Salmonella enterica enterica serovar Typhi Ty2
uuuccacaaucccggca

SEQ ID NO: 1742192 - RNA, 14 nt, Salmonella enterica enterica serovar Typhi Ty2
uuuacugaugccag

SEQ ID NO: 1742193 - RNA, 17 nt, Salmonella enterica enterica serovar Typhi Ty2
uuuaagcuggcgaacgu

SEQ ID NO: 1742194 - RNA, 15 nt, Salmonella enterica enterica serovar Typhi Ty2
uuuaaucgcccugcg

SEQ ID NO: 1742195 - RNA, 13 nt, Salmonella enterica enterica serovar Typhi Ty2
uuuagcauaacgu

SEQ ID NO: 1742196 - RNA, 20 nt, Salmonella enterica enterica serovar Typhi Ty2
uuuagcguuucaucggugua

SEQ ID NO: 1742197 - RNA, 14 nt, Salmonella enterica enterica serovar Typhi Ty2
uuuagcguuggcgu

SEQ ID NO: 1742198 - RNA, 19 nt, Salmonella enterica enterica serovar Typhi Ty2
uuguaggccugauaagcgc

SEQ ID NO: 1742199 - RNA, 18 nt, Salmonella enterica enterica serovar Typhi Ty2
uuguaucauguuccggca

SEQ ID NO: 1742200 - RNA, 19 nt, Salmonella enterica enterica serovar Typhi Ty2
uuguuuacgcccucaucgg

SEQ ID NO: 1742201 - RNA, 23 nt, Salmonella enterica enterica serovar Typhi Ty2
aauccgugcccgaaucgccgcuu

SEQ ID NO: 1742202 - RNA, 20 nt, Salmonella enterica enterica serovar Typhi Ty2
uugggcgcaacagucagcuc

SEQ ID NO: 1742203 - RNA, 19 nt, Salmonella enterica enterica serovar Typhi Ty2
uuggcuauacgcggcguac

SEQ ID NO: 1742204 - RNA, 13 nt, Salmonella enterica enterica serovar Typhi Ty2
uuggcuuccggca

SEQ ID NO: 1742205 - RNA, 17 nt, Salmonella enterica enterica serovar Typhi Ty2
uugcuucguuaccggug

SEQ ID NO: 1742206 - RNA, 14 nt, Salmonella enterica enterica serovar Typhi Ty2
uugcuucgccaucu

SEQ ID NO: 1742207 - RNA, 17 nt, Salmonella enterica enterica serovar Typhi Ty2
uugcuuugcggcauaac

SEQ ID NO: 1742208 - RNA, 17 nt, Salmonella enterica enterica serovar Typhi Ty2
uugcuuucaucaauacc

SEQ ID NO: 1742209 - RNA, 17 nt, Salmonella enterica enterica serovar Typhi Ty2
uuggacggaaucucgca

SEQ ID NO: 1742210 - RNA, 16 nt, Salmonella enterica enterica serovar Typhi Ty2
uuggacggcgucacca

SEQ ID NO: 1742211 - RNA, 16 nt, Salmonella enterica enterica serovar Typhi Ty2
uuggauuaacggcaaa

SEQ ID NO: 1742212 - RNA, 14 nt, Salmonella enterica enterica serovar Typhi Ty2
uuggauuauacauu

SEQ ID NO: 1742213 - RNA, 13 nt, Salmonella enterica enterica serovar Typhi Ty2
uugccugauggcg

SEQ ID NO: 1742214 - RNA, 19 nt, Salmonella enterica enterica serovar Typhi Ty2
uugaucguccggcgaugcc

SEQ ID NO: 1742215 - RNA, 23 nt, Salmonella enterica enterica serovar Typhi Ty2
uugaucacuuuugggccgcguag

SEQ ID NO: 1742216 - RNA, 13 nt, Salmonella enterica enterica serovar Typhi Ty2
uugcgacuaucgg

SEQ ID NO: 1742217 - RNA, 20 nt, Salmonella enterica enterica serovar Typhi Ty2
uugccugcggauuugcugcu

SEQ ID NO: 1742218 - RNA, 13 nt, Salmonella enterica enterica serovar Typhi Ty2
uugccuuccugau

SEQ ID NO: 1742219 - RNA, 13 nt, Salmonella enterica enterica serovar Typhi Ty2
uugcgcucugcca

SEQ ID NO: 1742220 - RNA, 18 nt, Salmonella enterica enterica serovar Typhi Ty2
uugcgcucgcgccagaug

SEQ ID NO: 1742221 - RNA, 20 nt, Salmonella enterica enterica serovar Typhi Ty2
uugcggaauacacgaacaca

SEQ ID NO: 1742222 - RNA, 13 nt, Salmonella enterica enterica serovar Typhi Ty2
uugcggauaugcg

SEQ ID NO: 1742223 - RNA, 13 nt, Salmonella enterica enterica serovar Typhi Ty2
uugcggaugaccg

SEQ ID NO: 1742224 - RNA, 18 nt, Salmonella enterica enterica serovar Typhi Ty2
uugcggcaucagauggcg

SEQ ID NO: 1742225 - RNA, 17 nt, Salmonella enterica enterica serovar Typhi Ty2
uugcgcgaggucgagcu

SEQ ID NO: 1742226 - RNA, 15 nt, Salmonella enterica enterica serovar Typhi Ty2
uugcgucguuccguc

SEQ ID NO: 1742227 - RNA, 14 nt, Salmonella enterica enterica serovar Typhi Ty2
uugcugacaucgcg

SEQ ID NO: 1742228 - RNA, 18 nt, Salmonella enterica enterica serovar Typhi Ty2
uugcuggugccuuccguc

SEQ ID NO: 1742229 - RNA, 15 nt, Salmonella enterica enterica serovar Typhi Ty2
uugcugcgucacgcg

SEQ ID NO: 1742230 - RNA, 19 nt, Salmonella enterica enterica serovar Typhi Ty2
uugcugcgccagccagacg

SEQ ID NO: 1742231 - RNA, 18 nt, Salmonella enterica enterica serovar Typhi Ty2
uugcucucaggcaguaac

SEQ ID NO: 1742232 - RNA, 22 nt, Salmonella enterica enterica serovar Typhi Ty2
aauucucacagaaucaucaggc

SEQ ID NO: 1742233 - RNA, 21 nt, Salmonella enterica enterica serovar Typhi Ty2
aauugagcgcaaaacgcugcu

SEQ ID NO: 1742234 - RNA, 16 nt, Salmonella enterica enterica serovar Typhi Ty2
aauuguagcugcgcca

SEQ ID NO: 1742235 - RNA, 18 nt, Salmonella enterica enterica serovar Typhi Ty2
aauuguuacuuauagcug

SEQ ID NO: 1742236 - RNA, 22 nt, Salmonella enterica enterica serovar Typhi Ty2
aauucacguuccauuucagcga

SEQ ID NO: 1742237 - RNA, 13 nt, Salmonella enterica enterica serovar Typhi Ty2
aauucagcgauau

SEQ ID NO: 1742238 - RNA, 14 nt, Salmonella enterica enterica serovar Typhi Ty2
aauuccgcauugag

SEQ ID NO: 1742239 - RNA, 19 nt, Salmonella enterica enterica serovar Typhi Ty2
aauuagacaagcaguucug

SEQ ID NO: 1742240 - RNA, 18 nt, Salmonella enterica enterica serovar Typhi Ty2
aauuaacgccgcgaggau

SEQ ID NO: 1742241 - RNA, 18 nt, Salmonella enterica enterica serovar Typhi Ty2
aauggaaaauaauaaucg

SEQ ID NO: 1742242 - RNA, 20 nt, Salmonella enterica enterica serovar Typhi Ty2
aaugcuucuucgccagcuuc

SEQ ID NO: 1742243 - RNA, 20 nt, Salmonella enterica enterica serovar Typhi Ty2
aaugcguuugauuugcgcgu

SEQ ID NO: 1742244 - RNA, 17 nt, Salmonella enterica enterica serovar Typhi Ty2
aaucucaauaccacgcc

SEQ ID NO: 1742245 - RNA, 23 nt, Salmonella enterica enterica serovar Typhi Ty2
aaucgccgcgccggacuccagca

SEQ ID NO: 1742246 - RNA, 19 nt, Salmonella enterica enterica serovar Typhi Ty2
aaucgccgauauggucgcu

SEQ ID NO: 1742247 - RNA, 20 nt, Salmonella enterica enterica serovar Typhi Ty2
aaucgccgggcggcgcagcg

SEQ ID NO: 1742248 - RNA, 17 nt, Salmonella enterica enterica serovar Typhi Ty2
aaucucuucccagcgca

SEQ ID NO: 1742249 - RNA, 15 nt, Salmonella enterica enterica serovar Typhi Ty2
uuuuguagacucgcg

SEQ ID NO: 1742250 - RNA, 20 nt, Salmonella enterica enterica serovar Typhi Ty2
uuuuggcaacggcagccagc

SEQ ID NO: 1742251 - RNA, 19 nt, Salmonella enterica enterica serovar Typhi Ty2
uuuugcgccuaccgccaua

SEQ ID NO: 1742252 - RNA, 23 nt, Salmonella enterica enterica serovar Typhi Ty2
aaucgccagcaucggcagcgcca

SEQ ID NO: 1742253 - RNA, 20 nt, Salmonella enterica enterica serovar Typhi Ty2
aaucgccagcaucggcagcg

SEQ ID NO: 1742254 - RNA, 17 nt, Salmonella enterica enterica serovar Typhi Ty2
aaucgccagcagcgcga

SEQ ID NO: 1742255 - RNA, 20 nt, Salmonella enterica enterica serovar Typhi Ty2
aaucgccccauuggcgucga

SEQ ID NO: 1742256 - RNA, 22 nt, Salmonella enterica enterica serovar Typhi Ty2
uuuuucagcucgcaggccauaa

SEQ ID NO: 1742257 - RNA, 19 nt, Salmonella enterica enterica serovar Typhi Ty2
aaugcauugauaggcugcu

SEQ ID NO: 1742258 - RNA, 13 nt, Salmonella enterica enterica serovar Typhi Ty2
aaugccagcgccg

SEQ ID NO: 1742259 - RNA, 23 nt, Salmonella enterica enterica serovar Typhi Ty2
aaugccauauuuuuccagcgccu

SEQ ID NO: 1742260 - RNA, 16 nt, Salmonella enterica enterica serovar Typhi Ty2
aaugccaccagcgcca

SEQ ID NO: 1742261 - RNA, 16 nt, Salmonella enterica enterica serovar Typhi Ty2
aaucuuuccagcucca

SEQ ID NO: 1742262 - RNA, 17 nt, Salmonella enterica enterica serovar Typhi Ty2
aaucugccgucaucgac

SEQ ID NO: 1742263 - RNA, 15 nt, Salmonella enterica enterica serovar Typhi Ty2
aaucugccgucaucg

SEQ ID NO: 1742264 - RNA, 18 nt, Salmonella enterica enterica serovar Typhi Ty2
uuuuccagcguaauccgc

SEQ ID NO: 1742265 - RNA, 21 nt, Salmonella enterica enterica serovar Typhi Ty2
uuuucgccagguacaucgcgc

SEQ ID NO: 1742266 - RNA, 16 nt, Salmonella enterica enterica serovar Typhi Ty2
uuuucgauaaucgcgc

SEQ ID NO: 1742267 - RNA, 20 nt, Salmonella enterica enterica serovar Typhi Ty2
uuuucaaugucgcaaucggc

SEQ ID NO: 1742268 - RNA, 18 nt, Salmonella enterica enterica serovar Typhi Ty2
uuuucucaauacgauauu

SEQ ID NO: 1742269 - RNA, 23 nt, Salmonella enterica enterica serovar Typhi Ty2
uuucuccugcgccagccggauac

SEQ ID NO: 1742270 - RNA, 18 nt, Salmonella enterica enterica serovar Typhi Ty2
uuucguagggccgcguau

SEQ ID NO: 1742271 - RNA, 23 nt, Salmonella enterica enterica serovar Typhi Ty2
uuucuacaccuucuucgccaacu

SEQ ID NO: 1742272 - RNA, 16 nt, Salmonella enterica enterica serovar Typhi Ty2
uuuuauggcccgccag

SEQ ID NO: 1742273 - RNA, 15 nt, Salmonella enterica enterica serovar Typhi Ty2
ugcuggugcgccugu

SEQ ID NO: 1742274 - RNA, 18 nt, Salmonella enterica enterica serovar Typhi Ty2
ugcuggucauaacgcuuu

SEQ ID NO: 1742275 - RNA, 20 nt, Salmonella enterica enterica serovar Typhi Ty2
ugcucggcggucagccacau

SEQ ID NO: 1742276 - RNA, 19 nt, Salmonella enterica enterica serovar Typhi Ty2
ugcugacacccucugcgcc

SEQ ID NO: 1742277 - RNA, 20 nt, Salmonella enterica enterica serovar Typhi Ty2
aauauccauuugcgacauca

SEQ ID NO: 1742278 - RNA, 14 nt, Salmonella enterica enterica serovar Typhi Ty2
ugcguugaccagcg

SEQ ID NO: 1742279 - RNA, 13 nt, Salmonella enterica enterica serovar Typhi Ty2
ugcguucuuccac

SEQ ID NO: 1742280 - RNA, 16 nt, Salmonella enterica enterica serovar Typhi Ty2
ugcguugucgcugauu

SEQ ID NO: 1742281 - RNA, 20 nt, Salmonella enterica enterica serovar Typhi Ty2
ugcguugcgcgcgucacaau

SEQ ID NO: 1742282 - RNA, 22 nt, Salmonella enterica enterica serovar Typhi Ty2
ugcguucuauugucaccgggcg

SEQ ID NO: 1742283 - RNA, 20 nt, Salmonella enterica enterica serovar Typhi Ty2
ugcguuuuuucgguaaucgc

SEQ ID NO: 1742284 - RNA, 13 nt, Salmonella enterica enterica serovar Typhi Ty2
ugcguuguggacg

SEQ ID NO: 1742285 - RNA, 19 nt, Salmonella enterica enterica serovar Typhi Ty2
ugcguuuaucaggccuaca

SEQ ID NO: 1742286 - RNA, 19 nt, Salmonella enterica enterica serovar Typhi Ty2
ugcuauaugcaggcauaaa

SEQ ID NO: 1742287 - RNA, 14 nt, Salmonella enterica enterica serovar Typhi Ty2
ugcuaucccaggcg

SEQ ID NO: 1742288 - RNA, 14 nt, Salmonella enterica enterica serovar Typhi Ty2
ugcuauucagcagu

SEQ ID NO: 1742289 - RNA, 18 nt, Salmonella enterica enterica serovar Typhi Ty2
ugcuaggaacagugacaa

SEQ ID NO: 1742290 - RNA, 11 nt, Salmonella enterica enterica serovar Typhi Ty2
ugcgucaacgc

SEQ ID NO: 1742291 - RNA, 14 nt, Salmonella enterica enterica serovar Typhi Ty2
ugcguauugagcgc

SEQ ID NO: 1742292 - RNA, 24 nt, Salmonella enterica enterica serovar Typhi Ty2
ugcgucaggcgauagccguccaug

SEQ ID NO: 1742293 - RNA, 16 nt, Salmonella enterica enterica serovar Typhi Ty2
ugcuguaggccgggua

SEQ ID NO: 1742294 - RNA, 15 nt, Salmonella enterica enterica serovar Typhi Ty2
ugcuguacauaucca

SEQ ID NO: 1742295 - RNA, 19 nt, Salmonella enterica enterica serovar Typhi Ty2
uggauaauugcucugccag

SEQ ID NO: 1742296 - RNA, 13 nt, Salmonella enterica enterica serovar Typhi Ty2
uggauaaccugcc

SEQ ID NO: 1742297 - RNA, 18 nt, Salmonella enterica enterica serovar Typhi Ty2
uggacuuccauucggcga

SEQ ID NO: 1742298 - RNA, 16 nt, Salmonella enterica enterica serovar Typhi Ty2
uggagaucagcauggu

SEQ ID NO: 1742299 - RNA, 13 nt, Salmonella enterica enterica serovar Typhi Ty2
uggaugaacucaa

SEQ ID NO: 1742300 - RNA, 15 nt, Salmonella enterica enterica serovar Typhi Ty2
uggauauucaucgcc

SEQ ID NO: 1742301 - RNA, 15 nt, Salmonella enterica enterica serovar Typhi Ty2
uggauagucuucaag

SEQ ID NO: 1742302 - RNA, 20 nt, Salmonella enterica enterica serovar Typhi Ty2
uggauagcaccauaaacggc

SEQ ID NO: 1742303 - RNA, 22 nt, Salmonella enterica enterica serovar Typhi Ty2
uggauuaucgaaauagcgguga

SEQ ID NO: 1742304 - RNA, 19 nt, Salmonella enterica enterica serovar Typhi Ty2
uggauuccuccaauucagg

SEQ ID NO: 1742305 - RNA, 20 nt, Salmonella enterica enterica serovar Typhi Ty2
uggcaacauagcaucguuac

SEQ ID NO: 1742306 - RNA, 13 nt, Salmonella enterica enterica serovar Typhi Ty2
uggcaaucgacgu

SEQ ID NO: 1742307 - RNA, 19 nt, Salmonella enterica enterica serovar Typhi Ty2
uggcaacccguaccuccag

SEQ ID NO: 1742308 - RNA, 17 nt, Salmonella enterica enterica serovar Typhi Ty2
uggcaguacagggcgau

SEQ ID NO: 1742309 - RNA, 20 nt, Salmonella enterica enterica serovar Typhi Ty2
uggcaguacagggcgauuuc

SEQ ID NO: 1742310 - RNA, 17 nt, Salmonella enterica enterica serovar Typhi Ty2
ugcgaggucaccgggcg

SEQ ID NO: 1742311 - RNA, 18 nt, Salmonella enterica enterica serovar Typhi Ty2
ugcgaggucaccgggcga

SEQ ID NO: 1742312 - RNA, 17 nt, Salmonella enterica enterica serovar Typhi Ty2
ugcgauagcccggcaug

SEQ ID NO: 1742313 - RNA, 14 nt, Salmonella enterica enterica serovar Typhi Ty2
ugcgacgccaggcg

SEQ ID NO: 1742314 - RNA, 22 nt, Salmonella enterica enterica serovar Typhi Ty2
ugccugccguuuuuaacgccgg

SEQ ID NO: 1742315 - RNA, 17 nt, Salmonella enterica enterica serovar Typhi Ty2
ugccuguagcagcgcca

SEQ ID NO: 1742316 - RNA, 14 nt, Salmonella enterica enterica serovar Typhi Ty2
ugcgaaucuucauc

SEQ ID NO: 1742317 - RNA, 17 nt, Salmonella enterica enterica serovar Typhi Ty2
ugccuggguuccaggcg

SEQ ID NO: 1742318 - RNA, 14 nt, Salmonella enterica enterica serovar Typhi Ty2
ugcgaauuucggca

SEQ ID NO: 1742319 - RNA, 17 nt, Salmonella enterica enterica serovar Typhi Ty2
ugcgcauauuccggcga

SEQ ID NO: 1742320 - RNA, 18 nt, Salmonella enterica enterica serovar Typhi Ty2
ugcgcagccccagcgcca

SEQ ID NO: 1742321 - RNA, 20 nt, Salmonella enterica enterica serovar Typhi Ty2
ugcgcagccccagcgccagc

SEQ ID NO: 1742322 - RNA, 14 nt, Salmonella enterica enterica serovar Typhi Ty2
aauagggcuuacgg

SEQ ID NO: 1742323 - RNA, 16 nt, Salmonella enterica enterica serovar Typhi Ty2
aauaguccagcagcca

SEQ ID NO: 1742324 - RNA, 14 nt, Salmonella enterica enterica serovar Typhi Ty2
ugccugaaccggug

SEQ ID NO: 1742325 - RNA, 20 nt, Salmonella enterica enterica serovar Typhi Ty2
ugccugacaaugacgcuucg

SEQ ID NO: 1742326 - RNA, 14 nt, Salmonella enterica enterica serovar Typhi Ty2
ugccucuuccggua

SEQ ID NO: 1742327 - RNA, 15 nt, Salmonella enterica enterica serovar Typhi Ty2
ugccucgcgcaccau

SEQ ID NO: 1742328 - RNA, 19 nt, Salmonella enterica enterica serovar Typhi Ty2
ugccucaccccauggcguc

SEQ ID NO: 1742329 - RNA, 19 nt, Salmonella enterica enterica serovar Typhi Ty2
ugccguuggcgcgaaucca

SEQ ID NO: 1742330 - RNA, 20 nt, Salmonella enterica enterica serovar Typhi Ty2
ugccguccauccggcguaau

SEQ ID NO: 1742331 - RNA, 13 nt, Salmonella enterica enterica serovar Typhi Ty2
ugccgucaucgac

SEQ ID NO: 1742332 - RNA, 21 nt, Salmonella enterica enterica serovar Typhi Ty2
ugccgucaaacaagccgccaa

SEQ ID NO: 1742333 - RNA, 23 nt, Salmonella enterica enterica serovar Typhi Ty2
ugccguagcgcgcuuccugccag

SEQ ID NO: 1742334 - RNA, 19 nt, Salmonella enterica enterica serovar Typhi Ty2
ugcggcaucagauggcgau

SEQ ID NO: 1742335 - RNA, 21 nt, Salmonella enterica enterica serovar Typhi Ty2
ugcggagagagcaauggcgug

SEQ ID NO: 1742336 - RNA, 21 nt, Salmonella enterica enterica serovar Typhi Ty2
ugcggacggcgucuggugaaa

SEQ ID NO: 1742337 - RNA, 18 nt, Salmonella enterica enterica serovar Typhi Ty2
ugcggaacaccagcgccg

SEQ ID NO: 1742338 - RNA, 14 nt, Salmonella enterica enterica serovar Typhi Ty2
ugcgcuuaucaggc

SEQ ID NO: 1742339 - RNA, 16 nt, Salmonella enterica enterica serovar Typhi Ty2
ugcgcgguccacaggc

SEQ ID NO: 1742340 - RNA, 23 nt, Salmonella enterica enterica serovar Typhi Ty2
ugcgcguuuagcgccagcagcau

SEQ ID NO: 1742341 - RNA, 22 nt, Salmonella enterica enterica serovar Typhi Ty2
ugcgcgccgcccugcaucaugc

SEQ ID NO: 1742342 - RNA, 21 nt, Salmonella enterica enterica serovar Typhi Ty2
ugcgcggauuaagcgaaucca

SEQ ID NO: 1742343 - RNA, 22 nt, Salmonella enterica enterica serovar Typhi Ty2
ugcgcggcacacuuucaucagc

SEQ ID NO: 1742344 - RNA, 16 nt, Salmonella enterica enterica serovar Typhi Ty2
ugcgcgcuucuucaug

SEQ ID NO: 1742345 - RNA, 23 nt, Salmonella enterica enterica serovar Typhi Ty2
ugcgcggaauagcggcuaaucac

SEQ ID NO: 1742346 - RNA, 14 nt, Salmonella enterica enterica serovar Typhi Ty2
ugcgcgccuucgaa

SEQ ID NO: 1742347 - RNA, 16 nt, Salmonella enterica enterica serovar Typhi Ty2
ugcgccgccauccggc

SEQ ID NO: 1742348 - RNA, 14 nt, Salmonella enterica enterica serovar Typhi Ty2
ugcgccuggcggua

SEQ ID NO: 1742349 - RNA, 16 nt, Salmonella enterica enterica serovar Typhi Ty2
uguaucagcauuuaca

SEQ ID NO: 1742350 - RNA, 16 nt, Salmonella enterica enterica serovar Typhi Ty2
uguagugcgauaugug

SEQ ID NO: 1742351 - RNA, 16 nt, Salmonella enterica enterica serovar Typhi Ty2
uguaguugccgcccug

SEQ ID NO: 1742352 - RNA, 20 nt, Salmonella enterica enterica serovar Typhi Ty2
uguauuaucgaugcgccagu

SEQ ID NO: 1742353 - RNA, 14 nt, Salmonella enterica enterica serovar Typhi Ty2
uguauugacgccga

SEQ ID NO: 1742354 - RNA, 16 nt, Salmonella enterica enterica serovar Typhi Ty2
uguauuuguucucgag

SEQ ID NO: 1742355 - RNA, 17 nt, Salmonella enterica enterica serovar Typhi Ty2
ugucaaaaaaucagcaa

SEQ ID NO: 1742356 - RNA, 17 nt, Salmonella enterica enterica serovar Typhi Ty2
uguccaccgauuucauc

SEQ ID NO: 1742357 - RNA, 21 nt, Salmonella enterica enterica serovar Typhi Ty2
ugucauggcgccaccagcgau

SEQ ID NO: 1742358 - RNA, 16 nt, Salmonella enterica enterica serovar Typhi Ty2
ugucaugcgccacgac

SEQ ID NO: 1742359 - RNA, 15 nt, Salmonella enterica enterica serovar Typhi Ty2
ugucaucgccgcuaa

SEQ ID NO: 1742360 - RNA, 20 nt, Salmonella enterica enterica serovar Typhi Ty2
uguaggccggguaagcguaa

SEQ ID NO: 1742361 - RNA, 20 nt, Salmonella enterica enterica serovar Typhi Ty2
uguaggccugauaagcgaag

SEQ ID NO: 1742362 - RNA, 16 nt, Salmonella enterica enterica serovar Typhi Ty2
uguaaccuuaaaaggc

SEQ ID NO: 1742363 - RNA, 20 nt, Salmonella enterica enterica serovar Typhi Ty2
uguaaccaccugggugagcg

SEQ ID NO: 1742364 - RNA, 20 nt, Salmonella enterica enterica serovar Typhi Ty2
uguaggccugguaagcguag

SEQ ID NO: 1742365 - RNA, 20 nt, Salmonella enterica enterica serovar Typhi Ty2
uguaggccugauaagcgcag

SEQ ID NO: 1742366 - RNA, 22 nt, Salmonella enterica enterica serovar Typhi Ty2
aaucaauggccuugccagcgag

SEQ ID NO: 1742367 - RNA, 14 nt, Salmonella enterica enterica serovar Typhi Ty2
aaucacaaagccgu

SEQ ID NO: 1742368 - RNA, 18 nt, Salmonella enterica enterica serovar Typhi Ty2
aaucacagggggaacauu

SEQ ID NO: 1742369 - RNA, 17 nt, Salmonella enterica enterica serovar Typhi Ty2
aaucacauccgccagcg

SEQ ID NO: 1742370 - RNA, 13 nt, Salmonella enterica enterica serovar Typhi Ty2
aaucacaucgccg

SEQ ID NO: 1742371 - RNA, 12 nt, Salmonella enterica enterica serovar Typhi Ty2
uguaaaagccag

SEQ ID NO: 1742372 - RNA, 18 nt, Salmonella enterica enterica serovar Typhi Ty2
uguaaacgcuucugcgcc

SEQ ID NO: 1742373 - RNA, 17 nt, Salmonella enterica enterica serovar Typhi Ty2
ugguugaaugaagccuu

SEQ ID NO: 1742374 - RNA, 20 nt, Salmonella enterica enterica serovar Typhi Ty2
ugguucugccagaacguuga

SEQ ID NO: 1742375 - RNA, 15 nt, Salmonella enterica enterica serovar Typhi Ty2
ugguuauccagcaac

SEQ ID NO: 1742376 - RNA, 16 nt, Salmonella enterica enterica serovar Typhi Ty2
ugucgaaaccagcaua

SEQ ID NO: 1742377 - RNA, 22 nt, Salmonella enterica enterica serovar Typhi Ty2
ugucgccaccgcuauucuucau

SEQ ID NO: 1742378 - RNA, 17 nt, Salmonella enterica enterica serovar Typhi Ty2
ugucccugccagcguaa

SEQ ID NO: 1742379 - RNA, 20 nt, Salmonella enterica enterica serovar Typhi Ty2
uguccgcccaguaccagcac

SEQ ID NO: 1742380 - RNA, 15 nt, Salmonella enterica enterica serovar Typhi Ty2
uguccguuccugccg

SEQ ID NO: 1742381 - RNA, 21 nt, Salmonella enterica enterica serovar Typhi Ty2
uguccggcguuuuagcgccau

SEQ ID NO: 1742382 - RNA, 19 nt, Salmonella enterica enterica serovar Typhi Ty2
uguccggguucagcgacag

SEQ ID NO: 1742383 - RNA, 13 nt, Salmonella enterica enterica serovar Typhi Ty2
uggucgcggcuca

SEQ ID NO: 1742384 - RNA, 22 nt, Salmonella enterica enterica serovar Typhi Ty2
uggucggcaaucaccugcauca

SEQ ID NO: 1742385 - RNA, 16 nt, Salmonella enterica enterica serovar Typhi Ty2
uggucgucagccguga

SEQ ID NO: 1742386 - RNA, 15 nt, Salmonella enterica enterica serovar Typhi Ty2
aaucaauacugccau

SEQ ID NO: 1742387 - RNA, 16 nt, Salmonella enterica enterica serovar Typhi Ty2
uggugaugaucgcggu

SEQ ID NO: 1742388 - RNA, 19 nt, Salmonella enterica enterica serovar Typhi Ty2
ugguuagcguaucgacaaa

SEQ ID NO: 1742389 - RNA, 13 nt, Salmonella enterica enterica serovar Typhi Ty2
ugguuauacggua

SEQ ID NO: 1742390 - RNA, 13 nt, Salmonella enterica enterica serovar Typhi Ty2
ugguguuuuccag

SEQ ID NO: 1742391 - RNA, 22 nt, Salmonella enterica enterica serovar Typhi Ty2
ugguggucggcaaucaccugca

SEQ ID NO: 1742392 - RNA, 12 nt, Salmonella enterica enterica serovar Typhi Ty2
ugguaccagauc

SEQ ID NO: 1742393 - RNA, 13 nt, Salmonella enterica enterica serovar Typhi Ty2
ugggccagcagcg

SEQ ID NO: 1742394 - RNA, 22 nt, Salmonella enterica enterica serovar Typhi Ty2
uggguaacgcucuuaccgcuaa

SEQ ID NO: 1742395 - RNA, 16 nt, Salmonella enterica enterica serovar Typhi Ty2
ugggcacucgaagaua

SEQ ID NO: 1742396 - RNA, 18 nt, Salmonella enterica enterica serovar Typhi Ty2
uggcuuuguuaaacguaa

SEQ ID NO: 1742397 - RNA, 17 nt, Salmonella enterica enterica serovar Typhi Ty2
uggcuuuuuccugccau

SEQ ID NO: 1742398 - RNA, 15 nt, Salmonella enterica enterica serovar Typhi Ty2
ugggaaacuuaucag

SEQ ID NO: 1742399 - RNA, 14 nt, Salmonella enterica enterica serovar Typhi Ty2
ugggaauaggccgc

SEQ ID NO: 1742400 - RNA, 13 nt, Salmonella enterica enterica serovar Typhi Ty2
uggcuuucaccgu

SEQ ID NO: 1742401 - RNA, 18 nt, Salmonella enterica enterica serovar Typhi Ty2
uggcuugaucaacgccgc

SEQ ID NO: 1742402 - RNA, 15 nt, Salmonella enterica enterica serovar Typhi Ty2
uggcuugaucaacgc

SEQ ID NO: 1742403 - RNA, 23 nt, Salmonella enterica enterica serovar Typhi Ty2
uggcuguagauacugaccaagcg

SEQ ID NO: 1742404 - RNA, 17 nt, Salmonella enterica enterica serovar Typhi Ty2
uggcugguggccuucgg

SEQ ID NO: 1742405 - RNA, 13 nt, Salmonella enterica enterica serovar Typhi Ty2
uggcuggcgcuga

SEQ ID NO: 1742406 - RNA, 16 nt, Salmonella enterica enterica serovar Typhi Ty2
uggcuggguaaaauca

SEQ ID NO: 1742407 - RNA, 17 nt, Salmonella enterica enterica serovar Typhi Ty2
uggcgugaaccgguaaa

SEQ ID NO: 1742408 - RNA, 15 nt, Salmonella enterica enterica serovar Typhi Ty2
uggcguacgcagauc

SEQ ID NO: 1742409 - RNA, 21 nt, Salmonella enterica enterica serovar Typhi Ty2
uggcguaaagaggguaacggc

SEQ ID NO: 1742410 - RNA, 16 nt, Salmonella enterica enterica serovar Typhi Ty2
uggcguaaaucaggcc

SEQ ID NO: 1742411 - RNA, 22 nt, Salmonella enterica enterica serovar Typhi Ty2
uggcucggccugucgcgaccau

SEQ ID NO: 1742412 - RNA, 13 nt, Salmonella enterica enterica serovar Typhi Ty2
uggcucuccggua

SEQ ID NO: 1742413 - RNA, 19 nt, Salmonella enterica enterica serovar Typhi Ty2
uggcuccuguugguuauac

SEQ ID NO: 1742414 - RNA, 18 nt, Salmonella enterica enterica serovar Typhi Ty2
uggcucgcuguccgggua

SEQ ID NO: 1742415 - RNA, 17 nt, Salmonella enterica enterica serovar Typhi Ty2
uggcuauacgcggcgua

SEQ ID NO: 1742416 - RNA, 19 nt, Salmonella enterica enterica serovar Typhi Ty2
uggcuauuuuuugcuggcg

SEQ ID NO: 1742417 - RNA, 16 nt, Salmonella enterica enterica serovar Typhi Ty2
uggcucaauccaggug

SEQ ID NO: 1742418 - RNA, 15 nt, Salmonella enterica enterica serovar Typhi Ty2
uggcuaucggccuga

SEQ ID NO: 1742419 - RNA, 16 nt, Salmonella enterica enterica serovar Typhi Ty2
uggcguuccacccagu

SEQ ID NO: 1742420 - RNA, 15 nt, Salmonella enterica enterica serovar Typhi Ty2
aauaugcgucagcgc

SEQ ID NO: 1742421 - RNA, 15 nt, Salmonella enterica enterica serovar Typhi Ty2
uggccuucauaccgu

SEQ ID NO: 1742422 - RNA, 15 nt, Salmonella enterica enterica serovar Typhi Ty2
uggccugcugcggua

SEQ ID NO: 1742423 - RNA, 17 nt, Salmonella enterica enterica serovar Typhi Ty2
uggccugcucaucaggu

SEQ ID NO: 1742424 - RNA, 14 nt, Salmonella enterica enterica serovar Typhi Ty2
uggccucuuaucag

SEQ ID NO: 1742425 - RNA, 21 nt, Salmonella enterica enterica serovar Typhi Ty2
uggccgugacuuguuccaguc

SEQ ID NO: 1742426 - RNA, 14 nt, Salmonella enterica enterica serovar Typhi Ty2
uggcaucuuaucag

SEQ ID NO: 1742427 - RNA, 23 nt, Salmonella enterica enterica serovar Typhi Ty2
uggcauguucccaugucagcgca

SEQ ID NO: 1742428 - RNA, 23 nt, Salmonella enterica enterica serovar Typhi Ty2
uggcggcauaaaugccuuauccg

SEQ ID NO: 1742429 - RNA, 16 nt, Salmonella enterica enterica serovar Typhi Ty2
uggcgcagcaaaccau

SEQ ID NO: 1742430 - RNA, 19 nt, Salmonella enterica enterica serovar Typhi Ty2
uggcgacuaaccagcgcaa

SEQ ID NO: 1742431 - RNA, 20 nt, Salmonella enterica enterica serovar Typhi Ty2
uggcgacuaccucuuauccg

SEQ ID NO: 1742432 - RNA, 15 nt, Salmonella enterica enterica serovar Typhi Ty2
uggcgaccgcugcaa

SEQ ID NO: 1742433 - RNA, 19 nt, Salmonella enterica enterica serovar Typhi Ty2
gugcaggacagacagacgu

SEQ ID NO: 1742434 - RNA, 13 nt, Salmonella enterica enterica serovar Typhi Ty2
gugccaauaacgc

SEQ ID NO: 1742435 - RNA, 22 nt, Salmonella enterica enterica serovar Typhi Ty2
gugauaguggcgucgccauaaa

SEQ ID NO: 1742436 - RNA, 14 nt, Salmonella enterica enterica serovar Typhi Ty2
gugauauagcgcca

SEQ ID NO: 1742437 - RNA, 16 nt, Salmonella enterica enterica serovar Typhi Ty2
gugauaaagcagacca

SEQ ID NO: 1742438 - RNA, 15 nt, Salmonella enterica enterica serovar Typhi Ty2
gugauaaauacgcug

SEQ ID NO: 1742439 - RNA, 19 nt, Salmonella enterica enterica serovar Typhi Ty2
gugauaagccccuuuacgc

SEQ ID NO: 1742440 - RNA, 16 nt, Salmonella enterica enterica serovar Typhi Ty2
gugauaacgcgauggc

SEQ ID NO: 1742441 - RNA, 18 nt, Salmonella enterica enterica serovar Typhi Ty2
gugaguaacgggcagcgg

SEQ ID NO: 1742442 - RNA, 20 nt, Salmonella enterica enterica serovar Typhi Ty2
gugaguuaugacggggaaca

SEQ ID NO: 1742443 - RNA, 21 nt, Salmonella enterica enterica serovar Typhi Ty2
gugccgauggcgcuccugaau

SEQ ID NO: 1742444 - RNA, 14 nt, Salmonella enterica enterica serovar Typhi Ty2
gugcggacguagcg

SEQ ID NO: 1742445 - RNA, 13 nt, Salmonella enterica enterica serovar Typhi Ty2
gugcggcuuaucg

SEQ ID NO: 1742446 - RNA, 13 nt, Salmonella enterica enterica serovar Typhi Ty2
gugcgacguaggc

SEQ ID NO: 1742447 - RNA, 21 nt, Salmonella enterica enterica serovar Typhi Ty2
gugcgacaacaaugaaacggu

SEQ ID NO: 1742448 - RNA, 14 nt, Salmonella enterica enterica serovar Typhi Ty2
gugcgacaccacgc

SEQ ID NO: 1742449 - RNA, 16 nt, Salmonella enterica enterica serovar Typhi Ty2
gugcgcaauuccagca

SEQ ID NO: 1742450 - RNA, 13 nt, Salmonella enterica enterica serovar Typhi Ty2
gugcgccauccgg

SEQ ID NO: 1742451 - RNA, 16 nt, Salmonella enterica enterica serovar Typhi Ty2
guggaaaacagcgccg

SEQ ID NO: 1742452 - RNA, 19 nt, Salmonella enterica enterica serovar Typhi Ty2
guggaaggaagggcgcugc

SEQ ID NO: 1742453 - RNA, 14 nt, Salmonella enterica enterica serovar Typhi Ty2
guggacaucgccau

SEQ ID NO: 1742454 - RNA, 16 nt, Salmonella enterica enterica serovar Typhi Ty2
guggauuuauggcguc

SEQ ID NO: 1742455 - RNA, 23 nt, Salmonella enterica enterica serovar Typhi Ty2
guguguuauagcguuuuauccgu

SEQ ID NO: 1742456 - RNA, 18 nt, Salmonella enterica enterica serovar Typhi Ty2
guguguaauugacauggc

SEQ ID NO: 1742457 - RNA, 21 nt, Salmonella enterica enterica serovar Typhi Ty2
guguguaccagcagcgccagc

SEQ ID NO: 1742458 - RNA, 22 nt, Salmonella enterica enterica serovar Typhi Ty2
guguggcuaucggccugaccau

SEQ ID NO: 1742459 - RNA, 15 nt, Salmonella enterica enterica serovar Typhi Ty2
gugguucgccaucca

SEQ ID NO: 1742460 - RNA, 15 nt, Salmonella enterica enterica serovar Typhi Ty2
guguccaucaggcuu

SEQ ID NO: 1742461 - RNA, 17 nt, Salmonella enterica enterica serovar Typhi Ty2
guggcaugcccggugau

SEQ ID NO: 1742462 - RNA, 17 nt, Salmonella enterica enterica serovar Typhi Ty2
guggcaucuuaucaggc

SEQ ID NO: 1742463 - RNA, 18 nt, Salmonella enterica enterica serovar Typhi Ty2
guggcaucuuaucaggcc

SEQ ID NO: 1742464 - RNA, 14 nt, Salmonella enterica enterica serovar Typhi Ty2
guggcaucuuauca

SEQ ID NO: 1742465 - RNA, 20 nt, Salmonella enterica enterica serovar Typhi Ty2
guucacgccgccauccgaca

SEQ ID NO: 1742466 - RNA, 17 nt, Salmonella enterica enterica serovar Typhi Ty2
guucacgccgccgccga

SEQ ID NO: 1742467 - RNA, 20 nt, Salmonella enterica enterica serovar Typhi Ty2
guuaugcgcaucaccguuac

SEQ ID NO: 1742468 - RNA, 21 nt, Salmonella enterica enterica serovar Typhi Ty2
guuaugcaaguucgaauagcc

SEQ ID NO: 1742469 - RNA, 15 nt, Salmonella enterica enterica serovar Typhi Ty2
guucagacguagcgc

SEQ ID NO: 1742470 - RNA, 13 nt, Salmonella enterica enterica serovar Typhi Ty2
guucagccgccag

SEQ ID NO: 1742471 - RNA, 11 nt, Salmonella enterica enterica serovar Typhi Ty2
guucagccagc

SEQ ID NO: 1742472 - RNA, 18 nt, Salmonella enterica enterica serovar Typhi Ty2
guucagcucgauccggca

SEQ ID NO: 1742473 - RNA, 16 nt, Salmonella enterica enterica serovar Typhi Ty2
guuaucgaauccagca

SEQ ID NO: 1742474 - RNA, 17 nt, Salmonella enterica enterica serovar Typhi Ty2
guuagcgccauccggca

SEQ ID NO: 1742475 - RNA, 23 nt, Salmonella enterica enterica serovar Typhi Ty2
guuagcgagguucccgccgccau

SEQ ID NO: 1742476 - RNA, 14 nt, Salmonella enterica enterica serovar Typhi Ty2
guuaguaguagcug

SEQ ID NO: 1742477 - RNA, 16 nt, Salmonella enterica enterica serovar Typhi Ty2
guuacugcauuccgcg

SEQ ID NO: 1742478 - RNA, 18 nt, Salmonella enterica enterica serovar Typhi Ty2
guuagcgaacguccagcg

SEQ ID NO: 1742479 - RNA, 17 nt, Salmonella enterica enterica serovar Typhi Ty2
guguuuacgccgccauc

SEQ ID NO: 1742480 - RNA, 22 nt, Salmonella enterica enterica serovar Typhi Ty2
guucaucgcuggcguacgccau

SEQ ID NO: 1742481 - RNA, 20 nt, Salmonella enterica enterica serovar Typhi Ty2
guucaucgccacaugcggca

SEQ ID NO: 1742482 - RNA, 22 nt, Salmonella enterica enterica serovar Typhi Ty2
guucaucccacuccaucgccug

SEQ ID NO: 1742483 - RNA, 12 nt, Salmonella enterica enterica serovar Typhi Ty2
guucauagccgu

SEQ ID NO: 1742484 - RNA, 15 nt, Salmonella enterica enterica serovar Typhi Ty2
guucaucauccugca

SEQ ID NO: 1742485 - RNA, 21 nt, Salmonella enterica enterica serovar Typhi Ty2
guucaucauccugcaggguaa

SEQ ID NO: 1742486 - RNA, 16 nt, Salmonella enterica enterica serovar Typhi Ty2
guucauaagucaucca

SEQ ID NO: 1742487 - RNA, 12 nt, Salmonella enterica enterica serovar Typhi Ty2
guucauucgcca

SEQ ID NO: 1742488 - RNA, 22 nt, Salmonella enterica enterica serovar Typhi Ty2
guucaucggcauacagcgauaa

SEQ ID NO: 1742489 - RNA, 21 nt, Salmonella enterica enterica serovar Typhi Ty2
guuucuacaccuucuucgcca

SEQ ID NO: 1742490 - RNA, 15 nt, Salmonella enterica enterica serovar Typhi Ty2
guuucggcgaucacc

SEQ ID NO: 1742491 - RNA, 15 nt, Salmonella enterica enterica serovar Typhi Ty2
guuuccgcguuauca

SEQ ID NO: 1742492 - RNA, 23 nt, Salmonella enterica enterica serovar Typhi Ty2
guuguacggaugggguaucgcca

SEQ ID NO: 1742493 - RNA, 20 nt, Salmonella enterica enterica serovar Typhi Ty2
guuucuuuuaaggcggcaaa

SEQ ID NO: 1742494 - RNA, 13 nt, Salmonella enterica enterica serovar Typhi Ty2
guuugcagccaga

SEQ ID NO: 1742495 - RNA, 22 nt, Salmonella enterica enterica serovar Typhi Ty2
guuugccagagagaugccgccg

SEQ ID NO: 1742496 - RNA, 18 nt, Salmonella enterica enterica serovar Typhi Ty2
guuugauaaacugcgcca

SEQ ID NO: 1742497 - RNA, 17 nt, Salmonella enterica enterica serovar Typhi Ty2
guuugacgaaaucgcau

SEQ ID NO: 1742498 - RNA, 12 nt, Salmonella enterica enterica serovar Typhi Ty2
guuuugcugaug

SEQ ID NO: 1742499 - RNA, 18 nt, Salmonella enterica enterica serovar Typhi Ty2
guuuuucgccgaccaucc

SEQ ID NO: 1742500 - RNA, 22 nt, Salmonella enterica enterica serovar Typhi Ty2
guuuuccgguauuuauccagca

SEQ ID NO: 1742501 - RNA, 14 nt, Salmonella enterica enterica serovar Typhi Ty2
guuuucgcagaguc

SEQ ID NO: 1742502 - RNA, 23 nt, Salmonella enterica enterica serovar Typhi Ty2
guuuucuauuuucuccggcaguc

SEQ ID NO: 1742503 - RNA, 14 nt, Salmonella enterica enterica serovar Typhi Ty2
guuuuauccguuuc

SEQ ID NO: 1742504 - RNA, 16 nt, Salmonella enterica enterica serovar Typhi Ty2
guuuuacgguuuaucc

SEQ ID NO: 1742505 - RNA, 17 nt, Salmonella enterica enterica serovar Typhi Ty2
guuugugccgccacggc

SEQ ID NO: 1742506 - RNA, 21 nt, Salmonella enterica enterica serovar Typhi Ty2
uaaaacaccgguugcgcaacc

SEQ ID NO: 1742507 - RNA, 18 nt, Salmonella enterica enterica serovar Typhi Ty2
uaaaaccagggaagcuac

SEQ ID NO: 1742508 - RNA, 13 nt, Salmonella enterica enterica serovar Typhi Ty2
uaaaauagccauc

SEQ ID NO: 1742509 - RNA, 11 nt, Salmonella enterica enterica serovar Typhi Ty2
uaaaaucgcgu

SEQ ID NO: 1742510 - RNA, 12 nt, Salmonella enterica enterica serovar Typhi Ty2
uaaaaucgccaa

SEQ ID NO: 1742511 - RNA, 23 nt, Salmonella enterica enterica serovar Typhi Ty2
uaaaauccggcaggcagccggau

SEQ ID NO: 1742512 - RNA, 22 nt, Salmonella enterica enterica serovar Typhi Ty2
uaaaaaucauccuucgggcgau

SEQ ID NO: 1742513 - RNA, 16 nt, Salmonella enterica enterica serovar Typhi Ty2
guuuuuuuaugcguuu

SEQ ID NO: 1742514 - RNA, 20 nt, Salmonella enterica enterica serovar Typhi Ty2
uaaaaaaggcagaagaaucu

SEQ ID NO: 1742515 - RNA, 18 nt, Salmonella enterica enterica serovar Typhi Ty2
uaaaaacggguaggccgg

SEQ ID NO: 1742516 - RNA, 21 nt, Salmonella enterica enterica serovar Typhi Ty2
guugccgaccugucgaucauc

SEQ ID NO: 1742517 - RNA, 18 nt, Salmonella enterica enterica serovar Typhi Ty2
guugccaggguucaaccu

SEQ ID NO: 1742518 - RNA, 19 nt, Salmonella enterica enterica serovar Typhi Ty2
guuggcgccaaaaccgcuc

SEQ ID NO: 1742519 - RNA, 18 nt, Salmonella enterica enterica serovar Typhi Ty2
guuggcuugaucaacgcc

SEQ ID NO: 1742520 - RNA, 18 nt, Salmonella enterica enterica serovar Typhi Ty2
guugcguguuguacagca

SEQ ID NO: 1742521 - RNA, 14 nt, Salmonella enterica enterica serovar Typhi Ty2
guugcuacgcgcca

SEQ ID NO: 1742522 - RNA, 14 nt, Salmonella enterica enterica serovar Typhi Ty2
guugcuccagcauc

SEQ ID NO: 1742523 - RNA, 21 nt, Salmonella enterica enterica serovar Typhi Ty2
guucgaauagccgguaccaaa

SEQ ID NO: 1742524 - RNA, 19 nt, Salmonella enterica enterica serovar Typhi Ty2
guucuugcugcugcugaug

SEQ ID NO: 1742525 - RNA, 18 nt, Salmonella enterica enterica serovar Typhi Ty2
guugaucguaaagcgcau

SEQ ID NO: 1742526 - RNA, 20 nt, Salmonella enterica enterica serovar Typhi Ty2
guugauuaucacccacagga

SEQ ID NO: 1742527 - RNA, 13 nt, Salmonella enterica enterica serovar Typhi Ty2
guugauuacgcuc

SEQ ID NO: 1742528 - RNA, 12 nt, Salmonella enterica enterica serovar Typhi Ty2
guugaugccgga

SEQ ID NO: 1742529 - RNA, 15 nt, Salmonella enterica enterica serovar Typhi Ty2
guugcaguuuacgag

SEQ ID NO: 1742530 - RNA, 12 nt, Salmonella enterica enterica serovar Typhi Ty2
uacaucuuccau

SEQ ID NO: 1742531 - RNA, 14 nt, Salmonella enterica enterica serovar Typhi Ty2
uaccaauuaccggc

SEQ ID NO: 1742532 - RNA, 21 nt, Salmonella enterica enterica serovar Typhi Ty2
uaccaauagccuugacgcaau

SEQ ID NO: 1742533 - RNA, 17 nt, Salmonella enterica enterica serovar Typhi Ty2
uaccaauaucgccguua

SEQ ID NO: 1742534 - RNA, 19 nt, Salmonella enterica enterica serovar Typhi Ty2
uaccacgcccgccgccagc

SEQ ID NO: 1742535 - RNA, 16 nt, Salmonella enterica enterica serovar Typhi Ty2
uaccaccacgcccuuc

SEQ ID NO: 1742536 - RNA, 18 nt, Salmonella enterica enterica serovar Typhi Ty2
uaccaccagaaucgccag

SEQ ID NO: 1742537 - RNA, 19 nt, Salmonella enterica enterica serovar Typhi Ty2
uaccaccagaaucgccagc

SEQ ID NO: 1742538 - RNA, 22 nt, Salmonella enterica enterica serovar Typhi Ty2
uacagacaucaucgaacgccgc

SEQ ID NO: 1742539 - RNA, 20 nt, Salmonella enterica enterica serovar Typhi Ty2
uacagacaucaucgaacgcc

SEQ ID NO: 1742540 - RNA, 17 nt, Salmonella enterica enterica serovar Typhi Ty2
uacagaugaacguaacg

SEQ ID NO: 1742541 - RNA, 13 nt, Salmonella enterica enterica serovar Typhi Ty2
uacagagucgcuu

SEQ ID NO: 1742542 - RNA, 17 nt, Salmonella enterica enterica serovar Typhi Ty2
uacacuucagccagacg

SEQ ID NO: 1742543 - RNA, 19 nt, Salmonella enterica enterica serovar Typhi Ty2
uacagccagguugccagaa

SEQ ID NO: 1742544 - RNA, 19 nt, Salmonella enterica enterica serovar Typhi Ty2
uacagcguuaacgacgcuc

SEQ ID NO: 1742545 - RNA, 19 nt, Salmonella enterica enterica serovar Typhi Ty2
uacagcucauaaacgcgau

SEQ ID NO: 1742546 - RNA, 19 nt, Salmonella enterica enterica serovar Typhi Ty2
uacagcuuuuacaaccaau

SEQ ID NO: 1742547 - RNA, 16 nt, Salmonella enterica enterica serovar Typhi Ty2
uacaggcaucuuccag

SEQ ID NO: 1742548 - RNA, 21 nt, Salmonella enterica enterica serovar Typhi Ty2
uacaggcgaccgggcagacau

SEQ ID NO: 1742549 - RNA, 22 nt, Salmonella enterica enterica serovar Typhi Ty2
uacacaucauuaccauagccgu

SEQ ID NO: 1742550 - RNA, 14 nt, Salmonella enterica enterica serovar Typhi Ty2
uacacagacugcuu

SEQ ID NO: 1742551 - RNA, 14 nt, Salmonella enterica enterica serovar Typhi Ty2
uacaauuucgcaaa

SEQ ID NO: 1742552 - RNA, 20 nt, Salmonella enterica enterica serovar Typhi Ty2
uacacgcgaauagccagaca

SEQ ID NO: 1742553 - RNA, 18 nt, Salmonella enterica enterica serovar Typhi Ty2
uacacgccuuccuccagc

SEQ ID NO: 1742554 - RNA, 17 nt, Salmonella enterica enterica serovar Typhi Ty2
uacaagguauccgccau

SEQ ID NO: 1742555 - RNA, 18 nt, Salmonella enterica enterica serovar Typhi Ty2
uacaagaauaugcagugc

SEQ ID NO: 1742556 - RNA, 16 nt, Salmonella enterica enterica serovar Typhi Ty2
uacaauggcaggcaua

SEQ ID NO: 1742557 - RNA, 19 nt, Salmonella enterica enterica serovar Typhi Ty2
uacaacgacuacguucauc

SEQ ID NO: 1742558 - RNA, 12 nt, Salmonella enterica enterica serovar Typhi Ty2
uacaacugucgu

SEQ ID NO: 1742559 - RNA, 19 nt, Salmonella enterica enterica serovar Typhi Ty2
uaauguugaaccgucauca

SEQ ID NO: 1742560 - RNA, 17 nt, Salmonella enterica enterica serovar Typhi Ty2
uaaugucaugcgccacg

SEQ ID NO: 1742561 - RNA, 19 nt, Salmonella enterica enterica serovar Typhi Ty2
uaauguaaacgucaccuca

SEQ ID NO: 1742562 - RNA, 16 nt, Salmonella enterica enterica serovar Typhi Ty2
uaauguaaaggugagc

SEQ ID NO: 1742563 - RNA, 14 nt, Salmonella enterica enterica serovar Typhi Ty2
uaaucaugaacguu

SEQ ID NO: 1742564 - RNA, 13 nt, Salmonella enterica enterica serovar Typhi Ty2
uaaucaucacgcu

SEQ ID NO: 1742565 - RNA, 20 nt, Salmonella enterica enterica serovar Typhi Ty2
uaaucacaggggucaucggc

SEQ ID NO: 1742566 - RNA, 14 nt, Salmonella enterica enterica serovar Typhi Ty2
uaaucaccaccuca

SEQ ID NO: 1742567 - RNA, 20 nt, Salmonella enterica enterica serovar Typhi Ty2
uaauugcucugccagcgccc

SEQ ID NO: 1742568 - RNA, 13 nt, Salmonella enterica enterica serovar Typhi Ty2
uaauaucauccgg

SEQ ID NO: 1742569 - RNA, 21 nt, Salmonella enterica enterica serovar Typhi Ty2
uaauauccaguugcgccagcg

SEQ ID NO: 1742570 - RNA, 24 nt, Salmonella enterica enterica serovar Typhi Ty2
uaauaugccaggcuuccugcgcug

SEQ ID NO: 1742571 - RNA, 19 nt, Salmonella enterica enterica serovar Typhi Ty2
uaauaugcucaacuuccag

SEQ ID NO: 1742572 - RNA, 22 nt, Salmonella enterica enterica serovar Typhi Ty2
uaaguagccgucagguccgaca

SEQ ID NO: 1742573 - RNA, 12 nt, Salmonella enterica enterica serovar Typhi Ty2
uaagguugucaa

SEQ ID NO: 1742574 - RNA, 20 nt, Salmonella enterica enterica serovar Typhi Ty2
uaaggcucucuuaccagccg

SEQ ID NO: 1742575 - RNA, 14 nt, Salmonella enterica enterica serovar Typhi Ty2
uaagugauaccgau

SEQ ID NO: 1742576 - RNA, 14 nt, Salmonella enterica enterica serovar Typhi Ty2
uaacuucuccgcca

SEQ ID NO: 1742577 - RNA, 16 nt, Salmonella enterica enterica serovar Typhi Ty2
uaacuucacgccaucg

SEQ ID NO: 1742578 - RNA, 22 nt, Salmonella enterica enterica serovar Typhi Ty2
uaagccggugaugaucaauaac

SEQ ID NO: 1742579 - RNA, 17 nt, Salmonella enterica enterica serovar Typhi Ty2
uaagccagacgcgcagc

SEQ ID NO: 1742580 - RNA, 15 nt, Salmonella enterica enterica serovar Typhi Ty2
uaagccaggcaccau

SEQ ID NO: 1742581 - RNA, 14 nt, Salmonella enterica enterica serovar Typhi Ty2
uaagccaccagauc

SEQ ID NO: 1742582 - RNA, 19 nt, Salmonella enterica enterica serovar Typhi Ty2
uaacguuaauacaucaugc

SEQ ID NO: 1742583 - RNA, 19 nt, Salmonella enterica enterica serovar Typhi Ty2
uaacuccuucuaauuccag

SEQ ID NO: 1742584 - RNA, 22 nt, Salmonella enterica enterica serovar Typhi Ty2
uaacucucguucggucaggaua

SEQ ID NO: 1742585 - RNA, 12 nt, Salmonella enterica enterica serovar Typhi Ty2
uaacucuucauc

SEQ ID NO: 1742586 - RNA, 20 nt, Salmonella enterica enterica serovar Typhi Ty2
uaaggcgcuugugauaucug

SEQ ID NO: 1742587 - RNA, 16 nt, Salmonella enterica enterica serovar Typhi Ty2
uaaggcggauacagcg

SEQ ID NO: 1742588 - RNA, 15 nt, Salmonella enterica enterica serovar Typhi Ty2
uaaggcgcggccuca

SEQ ID NO: 1742589 - RNA, 22 nt, Salmonella enterica enterica serovar Typhi Ty2
uaaggcgcuagccgcauccggc

SEQ ID NO: 1742590 - RNA, 22 nt, Salmonella enterica enterica serovar Typhi Ty2
uaaggcgcagccgccauccggc

SEQ ID NO: 1742591 - RNA, 20 nt, Salmonella enterica enterica serovar Typhi Ty2
uaaggcguucacgccgccau

SEQ ID NO: 1742592 - RNA, 13 nt, Salmonella enterica enterica serovar Typhi Ty2
uaagcgcucaggc

SEQ ID NO: 1742593 - RNA, 19 nt, Salmonella enterica enterica serovar Typhi Ty2
uaagcgcagcgcaucaggc

SEQ ID NO: 1742594 - RNA, 13 nt, Salmonella enterica enterica serovar Typhi Ty2
uaagcgccgauaa

SEQ ID NO: 1742595 - RNA, 17 nt, Salmonella enterica enterica serovar Typhi Ty2
uaagcgcagcgccaccg

SEQ ID NO: 1742596 - RNA, 15 nt, Salmonella enterica enterica serovar Typhi Ty2
uaagcgcagcgccau

SEQ ID NO: 1742597 - RNA, 20 nt, Salmonella enterica enterica serovar Typhi Ty2
uaagcgcagcgccaucaggc

SEQ ID NO: 1742598 - RNA, 20 nt, Salmonella enterica enterica serovar Typhi Ty2
uaagcgcagcgucaucaggc

SEQ ID NO: 1742599 - RNA, 14 nt, Salmonella enterica enterica serovar Typhi Ty2
uaagcgcagcgcca

SEQ ID NO: 1742600 - RNA, 14 nt, Salmonella enterica enterica serovar Typhi Ty2
uaagcgacgaaucc

SEQ ID NO: 1742601 - RNA, 16 nt, Salmonella enterica enterica serovar Typhi Ty2
uaagccuccggaugac

SEQ ID NO: 1742602 - RNA, 17 nt, Salmonella enterica enterica serovar Typhi Ty2
uaacgcauguuccgcua

SEQ ID NO: 1742603 - RNA, 15 nt, Salmonella enterica enterica serovar Typhi Ty2
uaacgcagcaucgcc

SEQ ID NO: 1742604 - RNA, 12 nt, Salmonella enterica enterica serovar Typhi Ty2
uaacgcaaccgu

SEQ ID NO: 1742605 - RNA, 14 nt, Salmonella enterica enterica serovar Typhi Ty2
uaacgcacuaccag

SEQ ID NO: 1742606 - RNA, 17 nt, Salmonella enterica enterica serovar Typhi Ty2
uaacgccggcaaauagc

SEQ ID NO: 1742607 - RNA, 16 nt, Salmonella enterica enterica serovar Typhi Ty2
uaaccggaucggccau

SEQ ID NO: 1742608 - RNA, 21 nt, Salmonella enterica enterica serovar Typhi Ty2
uaacguuuaaacucccggcua

SEQ ID NO: 1742609 - RNA, 15 nt, Salmonella enterica enterica serovar Typhi Ty2
uaacgucagcgccac

SEQ ID NO: 1742610 - RNA, 13 nt, Salmonella enterica enterica serovar Typhi Ty2
uaacgggaauaac

SEQ ID NO: 1742611 - RNA, 15 nt, Salmonella enterica enterica serovar Typhi Ty2
uaacgggcaucgccg

SEQ ID NO: 1742612 - RNA, 15 nt, Salmonella enterica enterica serovar Typhi Ty2
uaacggccagaaacc

SEQ ID NO: 1742613 - RNA, 24 nt, Salmonella enterica enterica serovar Typhi Ty2
uaacgcgcuggcggaauaucgcgg

SEQ ID NO: 1742614 - RNA, 17 nt, Salmonella enterica enterica serovar Typhi Ty2
uaacgcgcuggaugcgc

SEQ ID NO: 1742615 - RNA, 15 nt, Salmonella enterica enterica serovar Typhi Ty2
uaacgcuucaccucu

SEQ ID NO: 1742616 - RNA, 14 nt, Salmonella enterica enterica serovar Typhi Ty2
uaacaucaucaggc

SEQ ID NO: 1742617 - RNA, 17 nt, Salmonella enterica enterica serovar Typhi Ty2
uaaccagcucgcugauc

SEQ ID NO: 1742618 - RNA, 20 nt, Salmonella enterica enterica serovar Typhi Ty2
uaaccagcgcgccgccaacg

SEQ ID NO: 1742619 - RNA, 21 nt, Salmonella enterica enterica serovar Typhi Ty2
uaaccagcgcaagcagcgccc

SEQ ID NO: 1742620 - RNA, 16 nt, Salmonella enterica enterica serovar Typhi Ty2
uaaccagaucggcuau

SEQ ID NO: 1742621 - RNA, 16 nt, Salmonella enterica enterica serovar Typhi Ty2
uaaacgccucauccgg

SEQ ID NO: 1742622 - RNA, 23 nt, Salmonella enterica enterica serovar Typhi Ty2
uaacagcuggcuugccagcagau

SEQ ID NO: 1742623 - RNA, 21 nt, Salmonella enterica enterica serovar Typhi Ty2
uaacagcgcgaccaggaaacc

SEQ ID NO: 1742624 - RNA, 22 nt, Salmonella enterica enterica serovar Typhi Ty2
uaacagcgccgcgccgauagcg

SEQ ID NO: 1742625 - RNA, 12 nt, Salmonella enterica enterica serovar Typhi Ty2
uaacagcgccau

SEQ ID NO: 1742626 - RNA, 13 nt, Salmonella enterica enterica serovar Typhi Ty2
uaaaccaaagcag

SEQ ID NO: 1742627 - RNA, 14 nt, Salmonella enterica enterica serovar Typhi Ty2
ucauugcgcuaaaa

SEQ ID NO: 1742628 - RNA, 22 nt, Salmonella enterica enterica serovar Typhi Ty2
ucauucuccgggauagcaaucu

SEQ ID NO: 1742629 - RNA, 15 nt, Salmonella enterica enterica serovar Typhi Ty2
ucauucagcggcugc

SEQ ID NO: 1742630 - RNA, 19 nt, Salmonella enterica enterica serovar Typhi Ty2
ucauuacaggcgaauagcg

SEQ ID NO: 1742631 - RNA, 15 nt, Salmonella enterica enterica serovar Typhi Ty2
ucauggugaugaucg

SEQ ID NO: 1742632 - RNA, 12 nt, Salmonella enterica enterica serovar Typhi Ty2
ucaugucgucau

SEQ ID NO: 1742633 - RNA, 15 nt, Salmonella enterica enterica serovar Typhi Ty2
ucaucaugcugcuga

SEQ ID NO: 1742634 - RNA, 23 nt, Salmonella enterica enterica serovar Typhi Ty2
ucaucagaucaugaggaugagcg

SEQ ID NO: 1742635 - RNA, 13 nt, Salmonella enterica enterica serovar Typhi Ty2
ucaucagcgccau

SEQ ID NO: 1742636 - RNA, 15 nt, Salmonella enterica enterica serovar Typhi Ty2
ucaucaucauccaga

SEQ ID NO: 1742637 - RNA, 16 nt, Salmonella enterica enterica serovar Typhi Ty2
ucaucauuacaggcga

SEQ ID NO: 1742638 - RNA, 18 nt, Salmonella enterica enterica serovar Typhi Ty2
ucauccaacugcgccuga

SEQ ID NO: 1742639 - RNA, 19 nt, Salmonella enterica enterica serovar Typhi Ty2
ucauccaauaacguaaccg

SEQ ID NO: 1742640 - RNA, 23 nt, Salmonella enterica enterica serovar Typhi Ty2
ucauccugacaggccggauuagc

SEQ ID NO: 1742641 - RNA, 16 nt, Salmonella enterica enterica serovar Typhi Ty2
ucaucgauggcgccag

SEQ ID NO: 1742642 - RNA, 16 nt, Salmonella enterica enterica serovar Typhi Ty2
ucaucuccucuucagu

SEQ ID NO: 1742643 - RNA, 15 nt, Salmonella enterica enterica serovar Typhi Ty2
ucauaggugaacaug

SEQ ID NO: 1742644 - RNA, 22 nt, Salmonella enterica enterica serovar Typhi Ty2
ucauagcgccccaguaacgugc

SEQ ID NO: 1742645 - RNA, 15 nt, Salmonella enterica enterica serovar Typhi Ty2
ucauaagucauccag

SEQ ID NO: 1742646 - RNA, 13 nt, Salmonella enterica enterica serovar Typhi Ty2
ucauaaucaacgu

SEQ ID NO: 1742647 - RNA, 21 nt, Salmonella enterica enterica serovar Typhi Ty2
ucaggccagccaaaacgucgu

SEQ ID NO: 1742648 - RNA, 19 nt, Salmonella enterica enterica serovar Typhi Ty2
uccaucaugggcgcggcga

SEQ ID NO: 1742649 - RNA, 16 nt, Salmonella enterica enterica serovar Typhi Ty2
uccauccggguaauuu

SEQ ID NO: 1742650 - RNA, 12 nt, Salmonella enterica enterica serovar Typhi Ty2
uccaucgccgug

SEQ ID NO: 1742651 - RNA, 19 nt, Salmonella enterica enterica serovar Typhi Ty2
uccaucgguucucugccau

SEQ ID NO: 1742652 - RNA, 21 nt, Salmonella enterica enterica serovar Typhi Ty2
uccauuaaaugcgccagcggc

SEQ ID NO: 1742653 - RNA, 22 nt, Salmonella enterica enterica serovar Typhi Ty2
uccaguucauaagucauccaga

SEQ ID NO: 1742654 - RNA, 15 nt, Salmonella enterica enterica serovar Typhi Ty2
uccaguugucaucgu

SEQ ID NO: 1742655 - RNA, 15 nt, Salmonella enterica enterica serovar Typhi Ty2
uccagcuccauccac

SEQ ID NO: 1742656 - RNA, 14 nt, Salmonella enterica enterica serovar Typhi Ty2
uccagaccaccagc

SEQ ID NO: 1742657 - RNA, 18 nt, Salmonella enterica enterica serovar Typhi Ty2
uccagacaggacgccagc

SEQ ID NO: 1742658 - RNA, 15 nt, Salmonella enterica enterica serovar Typhi Ty2
uccagaauacgccgc

SEQ ID NO: 1742659 - RNA, 21 nt, Salmonella enterica enterica serovar Typhi Ty2
uccagaaggcaaaaugccagc

SEQ ID NO: 1742660 - RNA, 18 nt, Salmonella enterica enterica serovar Typhi Ty2
uccacucgcucauuugcg

SEQ ID NO: 1742661 - RNA, 23 nt, Salmonella enterica enterica serovar Typhi Ty2
uccacucguaacgcauauccagc

SEQ ID NO: 1742662 - RNA, 21 nt, Salmonella enterica enterica serovar Typhi Ty2
uccacugagcuucaccgccag

SEQ ID NO: 1742663 - RNA, 15 nt, Salmonella enterica enterica serovar Typhi Ty2
uccacucacccggca

SEQ ID NO: 1742664 - RNA, 13 nt, Salmonella enterica enterica serovar Typhi Ty2
uccacauccagcg

SEQ ID NO: 1742665 - RNA, 18 nt, Salmonella enterica enterica serovar Typhi Ty2
uccacauccagcgccagc

SEQ ID NO: 1742666 - RNA, 13 nt, Salmonella enterica enterica serovar Typhi Ty2
uccacaccguuac

SEQ ID NO: 1742667 - RNA, 20 nt, Salmonella enterica enterica serovar Typhi Ty2
uccacaaauagcauggcgug

SEQ ID NO: 1742668 - RNA, 17 nt, Salmonella enterica enterica serovar Typhi Ty2
uccacaccggcgcauac

SEQ ID NO: 1742669 - RNA, 19 nt, Salmonella enterica enterica serovar Typhi Ty2
uccaaucucuuuugcggcg

SEQ ID NO: 1742670 - RNA, 16 nt, Salmonella enterica enterica serovar Typhi Ty2
uccagauagguuaagc

SEQ ID NO: 1742671 - RNA, 18 nt, Salmonella enterica enterica serovar Typhi Ty2
uccagcagccaugccagc

SEQ ID NO: 1742672 - RNA, 17 nt, Salmonella enterica enterica serovar Typhi Ty2
ucagcgaauaucucuau

SEQ ID NO: 1742673 - RNA, 13 nt, Salmonella enterica enterica serovar Typhi Ty2
ucagcgcgccaau

SEQ ID NO: 1742674 - RNA, 15 nt, Salmonella enterica enterica serovar Typhi Ty2
ucagcaucuccuggc

SEQ ID NO: 1742675 - RNA, 15 nt, Salmonella enterica enterica serovar Typhi Ty2
ucagccagccgccaa

SEQ ID NO: 1742676 - RNA, 23 nt, Salmonella enterica enterica serovar Typhi Ty2
ucagcccccaguuuuugaacaua

SEQ ID NO: 1742677 - RNA, 16 nt, Salmonella enterica enterica serovar Typhi Ty2
ucagaucguaugcgcc

SEQ ID NO: 1742678 - RNA, 20 nt, Salmonella enterica enterica serovar Typhi Ty2
ucagcguuucgccguaaaac

SEQ ID NO: 1742679 - RNA, 22 nt, Salmonella enterica enterica serovar Typhi Ty2
ucagcuccucgcgaaucucaau

SEQ ID NO: 1742680 - RNA, 18 nt, Salmonella enterica enterica serovar Typhi Ty2
ucagcucgcaggccauaa

SEQ ID NO: 1742681 - RNA, 16 nt, Salmonella enterica enterica serovar Typhi Ty2
ucaggaucaauucuga

SEQ ID NO: 1742682 - RNA, 16 nt, Salmonella enterica enterica serovar Typhi Ty2
ucaggcaucagauaaa

SEQ ID NO: 1742683 - RNA, 23 nt, Salmonella enterica enterica serovar Typhi Ty2
ucaggcaucaacguuguccagcg

SEQ ID NO: 1742684 - RNA, 23 nt, Salmonella enterica enterica serovar Typhi Ty2
ucaggcaacaggauguccugcgg

SEQ ID NO: 1742685 - RNA, 14 nt, Salmonella enterica enterica serovar Typhi Ty2
ucaccugauagcgg

SEQ ID NO: 1742686 - RNA, 13 nt, Salmonella enterica enterica serovar Typhi Ty2
ucaccucuucgcu

SEQ ID NO: 1742687 - RNA, 18 nt, Salmonella enterica enterica serovar Typhi Ty2
ucaccugguaagcgccaa

SEQ ID NO: 1742688 - RNA, 19 nt, Salmonella enterica enterica serovar Typhi Ty2
ucacgcaaaugcagcggaa

SEQ ID NO: 1742689 - RNA, 20 nt, Salmonella enterica enterica serovar Typhi Ty2
ucaccuucggucccaucgcg

SEQ ID NO: 1742690 - RNA, 13 nt, Salmonella enterica enterica serovar Typhi Ty2
ucaccuucgguga

SEQ ID NO: 1742691 - RNA, 11 nt, Salmonella enterica enterica serovar Typhi Ty2
ucacgccaucg

SEQ ID NO: 1742692 - RNA, 17 nt, Salmonella enterica enterica serovar Typhi Ty2
ucacgcucuucgccaau

SEQ ID NO: 1742693 - RNA, 21 nt, Salmonella enterica enterica serovar Typhi Ty2
ucacgcucaauggcgcgccag

SEQ ID NO: 1742694 - RNA, 16 nt, Salmonella enterica enterica serovar Typhi Ty2
ucaccgccagcaacgc

SEQ ID NO: 1742695 - RNA, 16 nt, Salmonella enterica enterica serovar Typhi Ty2
ucaccggaugcgcagg

SEQ ID NO: 1742696 - RNA, 14 nt, Salmonella enterica enterica serovar Typhi Ty2
ucacaaucagccac

SEQ ID NO: 1742697 - RNA, 15 nt, Salmonella enterica enterica serovar Typhi Ty2
ucacaauaacgccgg

SEQ ID NO: 1742698 - RNA, 19 nt, Salmonella enterica enterica serovar Typhi Ty2
ucacaaggaaugacacauu

SEQ ID NO: 1742699 - RNA, 16 nt, Salmonella enterica enterica serovar Typhi Ty2
ucacacauaucgccag

SEQ ID NO: 1742700 - RNA, 21 nt, Salmonella enterica enterica serovar Typhi Ty2
ucacggcgauaaaugucagga

SEQ ID NO: 1742701 - RNA, 21 nt, Salmonella enterica enterica serovar Typhi Ty2
ucacgcugacaggauacccgg

SEQ ID NO: 1742702 - RNA, 22 nt, Salmonella enterica enterica serovar Typhi Ty2
aauaacgaagcgaucuccugca

SEQ ID NO: 1742703 - RNA, 12 nt, Salmonella enterica enterica serovar Typhi Ty2
ucagaacgccuu

SEQ ID NO: 1742704 - RNA, 13 nt, Salmonella enterica enterica serovar Typhi Ty2
ucagaaauccgcg

SEQ ID NO: 1742705 - RNA, 22 nt, Salmonella enterica enterica serovar Typhi Ty2
ucagagcgucuuuuauccccac

SEQ ID NO: 1742706 - RNA, 20 nt, Salmonella enterica enterica serovar Typhi Ty2
ucagagcguccacgccauca

SEQ ID NO: 1742707 - RNA, 13 nt, Salmonella enterica enterica serovar Typhi Ty2
aauaauaccacga

SEQ ID NO: 1742708 - RNA, 15 nt, Salmonella enterica enterica serovar Typhi Ty2
ucacuuuaccaggca

SEQ ID NO: 1742709 - RNA, 19 nt, Salmonella enterica enterica serovar Typhi Ty2
ucacuuuugccgguugcca

SEQ ID NO: 1742710 - RNA, 13 nt, Salmonella enterica enterica serovar Typhi Ty2
ucacuucauccgg

SEQ ID NO: 1742711 - RNA, 22 nt, Salmonella enterica enterica serovar Typhi Ty2
ucacuaugcuaauccgcugauu

SEQ ID NO: 1742712 - RNA, 22 nt, Salmonella enterica enterica serovar Typhi Ty2
uaucuugagucaaaagauugau

SEQ ID NO: 1742713 - RNA, 17 nt, Salmonella enterica enterica serovar Typhi Ty2
uaucuucccgauaacug

SEQ ID NO: 1742714 - RNA, 16 nt, Salmonella enterica enterica serovar Typhi Ty2
uaugaaagccaucgcu

SEQ ID NO: 1742715 - RNA, 18 nt, Salmonella enterica enterica serovar Typhi Ty2
uaugaccgagucuacauc

SEQ ID NO: 1742716 - RNA, 15 nt, Salmonella enterica enterica serovar Typhi Ty2
uaucuguaauugacg

SEQ ID NO: 1742717 - RNA, 13 nt, Salmonella enterica enterica serovar Typhi Ty2
uaucugaccuaca

SEQ ID NO: 1742718 - RNA, 13 nt, Salmonella enterica enterica serovar Typhi Ty2
uaucgucaauacg

SEQ ID NO: 1742719 - RNA, 12 nt, Salmonella enterica enterica serovar Typhi Ty2
uaucgucaauac

SEQ ID NO: 1742720 - RNA, 17 nt, Salmonella enterica enterica serovar Typhi Ty2
uaucguuuacguuauca

SEQ ID NO: 1742721 - RNA, 14 nt, Salmonella enterica enterica serovar Typhi Ty2
uauuaccgaagaua

SEQ ID NO: 1742722 - RNA, 21 nt, Salmonella enterica enterica serovar Typhi Ty2
uaugccagauauuuucggcau

SEQ ID NO: 1742723 - RNA, 21 nt, Salmonella enterica enterica serovar Typhi Ty2
uaugcccggaugauuaucauc

SEQ ID NO: 1742724 - RNA, 13 nt, Salmonella enterica enterica serovar Typhi Ty2
uaugccgccaucc

SEQ ID NO: 1742725 - RNA, 17 nt, Salmonella enterica enterica serovar Typhi Ty2
uaugaucgaaaaugcgc

SEQ ID NO: 1742726 - RNA, 19 nt, Salmonella enterica enterica serovar Typhi Ty2
uaugcaacacgccgaacaa

SEQ ID NO: 1742727 - RNA, 14 nt, Salmonella enterica enterica serovar Typhi Ty2
uauacuccagcaga

SEQ ID NO: 1742728 - RNA, 15 nt, Salmonella enterica enterica serovar Typhi Ty2
uauaccguuuggcga

SEQ ID NO: 1742729 - RNA, 23 nt, Salmonella enterica enterica serovar Typhi Ty2
uauaccgucaguaccagcgagau

SEQ ID NO: 1742730 - RNA, 14 nt, Salmonella enterica enterica serovar Typhi Ty2
uauacagacaaugc

SEQ ID NO: 1742731 - RNA, 14 nt, Salmonella enterica enterica serovar Typhi Ty2
uaggguugccagag

SEQ ID NO: 1742732 - RNA, 17 nt, Salmonella enterica enterica serovar Typhi Ty2
uaggguguuucgacccc

SEQ ID NO: 1742733 - RNA, 19 nt, Salmonella enterica enterica serovar Typhi Ty2
uagggccgauaccggcaac

SEQ ID NO: 1742734 - RNA, 20 nt, Salmonella enterica enterica serovar Typhi Ty2
uagggauaaugacauccaga

SEQ ID NO: 1742735 - RNA, 18 nt, Salmonella enterica enterica serovar Typhi Ty2
uagggcgcggcugguaag

SEQ ID NO: 1742736 - RNA, 21 nt, Salmonella enterica enterica serovar Typhi Ty2
uaucggcgucgcggcaauagc

SEQ ID NO: 1742737 - RNA, 15 nt, Salmonella enterica enterica serovar Typhi Ty2
uaucccgaaaagcgu

SEQ ID NO: 1742738 - RNA, 20 nt, Salmonella enterica enterica serovar Typhi Ty2
uauccggccuauagcuaaug

SEQ ID NO: 1742739 - RNA, 14 nt, Salmonella enterica enterica serovar Typhi Ty2
uauccccgcuggcg

SEQ ID NO: 1742740 - RNA, 21 nt, Salmonella enterica enterica serovar Typhi Ty2
uauccaggccgucggcgccag

SEQ ID NO: 1742741 - RNA, 18 nt, Salmonella enterica enterica serovar Typhi Ty2
uauccgccagcgcaacgc

SEQ ID NO: 1742742 - RNA, 12 nt, Salmonella enterica enterica serovar Typhi Ty2
uauccgccauau

SEQ ID NO: 1742743 - RNA, 16 nt, Salmonella enterica enterica serovar Typhi Ty2
uauccauuagcgccug

SEQ ID NO: 1742744 - RNA, 18 nt, Salmonella enterica enterica serovar Typhi Ty2
uaucccacugcacgccag

SEQ ID NO: 1742745 - RNA, 13 nt, Salmonella enterica enterica serovar Typhi Ty2
uauauuccgccuc

SEQ ID NO: 1742746 - RNA, 19 nt, Salmonella enterica enterica serovar Typhi Ty2
uaucagccauuaaccagau

SEQ ID NO: 1742747 - RNA, 23 nt, Salmonella enterica enterica serovar Typhi Ty2
uaucaguccccacauuacgccca

SEQ ID NO: 1742748 - RNA, 19 nt, Salmonella enterica enterica serovar Typhi Ty2
uaucauagacugcgcuuaa

SEQ ID NO: 1742749 - RNA, 14 nt, Salmonella enterica enterica serovar Typhi Ty2
uaucagccgcgaca

SEQ ID NO: 1742750 - RNA, 19 nt, Salmonella enterica enterica serovar Typhi Ty2
uaucaggccgacaaaugac

SEQ ID NO: 1742751 - RNA, 21 nt, Salmonella enterica enterica serovar Typhi Ty2
uaucaggccgacaaaugacgu

SEQ ID NO: 1742752 - RNA, 19 nt, Salmonella enterica enterica serovar Typhi Ty2
ucaaucgucguuccgccag

SEQ ID NO: 1742753 - RNA, 18 nt, Salmonella enterica enterica serovar Typhi Ty2
ucaaucgucguuccgcca

SEQ ID NO: 1742754 - RNA, 14 nt, Salmonella enterica enterica serovar Typhi Ty2
ucaaucacuuucag

SEQ ID NO: 1742755 - RNA, 13 nt, Salmonella enterica enterica serovar Typhi Ty2
ucacaaaccagac

SEQ ID NO: 1742756 - RNA, 21 nt, Salmonella enterica enterica serovar Typhi Ty2
ucaagacgcucgacguccagc

SEQ ID NO: 1742757 - RNA, 13 nt, Salmonella enterica enterica serovar Typhi Ty2
ucaagcgcaauca

SEQ ID NO: 1742758 - RNA, 13 nt, Salmonella enterica enterica serovar Typhi Ty2
ucaagcgguagcg

SEQ ID NO: 1742759 - RNA, 20 nt, Salmonella enterica enterica serovar Typhi Ty2
ucaagcuggacgguaaccau

SEQ ID NO: 1742760 - RNA, 21 nt, Salmonella enterica enterica serovar Typhi Ty2
ucaagccauugcgcgccguuc

SEQ ID NO: 1742761 - RNA, 22 nt, Salmonella enterica enterica serovar Typhi Ty2
ucaaggauggagauaucaccau

SEQ ID NO: 1742762 - RNA, 22 nt, Salmonella enterica enterica serovar Typhi Ty2
ucaauaagcgaauugccgucgc

SEQ ID NO: 1742763 - RNA, 18 nt, Salmonella enterica enterica serovar Typhi Ty2
ucaauaaacagcuccgca

SEQ ID NO: 1742764 - RNA, 24 nt, Salmonella enterica enterica serovar Typhi Ty2
uauugcaccugggaaucgugcaau

SEQ ID NO: 1742765 - RNA, 22 nt, Salmonella enterica enterica serovar Typhi Ty2
uauugccacagcgguauaucug

SEQ ID NO: 1742766 - RNA, 13 nt, Salmonella enterica enterica serovar Typhi Ty2
uauuggaaucgcu

SEQ ID NO: 1742767 - RNA, 15 nt, Salmonella enterica enterica serovar Typhi Ty2
uauugccgcacggua

SEQ ID NO: 1742768 - RNA, 21 nt, Salmonella enterica enterica serovar Typhi Ty2
ucaaacuccgcgcuggcaaua

SEQ ID NO: 1742769 - RNA, 13 nt, Salmonella enterica enterica serovar Typhi Ty2
ucaaaggccugca

SEQ ID NO: 1742770 - RNA, 21 nt, Salmonella enterica enterica serovar Typhi Ty2
ucaacccgaucgccauccugc

SEQ ID NO: 1742771 - RNA, 12 nt, Salmonella enterica enterica serovar Typhi Ty2
ucaaauacgcua

SEQ ID NO: 1742772 - RNA, 22 nt, Salmonella enterica enterica serovar Typhi Ty2
ucaaauaauacgccgguaucau

SEQ ID NO: 1742773 - RNA, 17 nt, Salmonella enterica enterica serovar Typhi Ty2
ucaaaucgugugcggua

SEQ ID NO: 1742774 - RNA, 21 nt, Salmonella enterica enterica serovar Typhi Ty2
ucaaccagggucaauacgccg

SEQ ID NO: 1742775 - RNA, 13 nt, Salmonella enterica enterica serovar Typhi Ty2
ucaaaugaucguu

SEQ ID NO: 1742776 - RNA, 21 nt, Salmonella enterica enterica serovar Typhi Ty2
ucaagaaucaauauaucaggc

SEQ ID NO: 1742777 - RNA, 16 nt, Salmonella enterica enterica serovar Typhi Ty2
uacgcaaaaaaagcca

SEQ ID NO: 1742778 - RNA, 13 nt, Salmonella enterica enterica serovar Typhi Ty2
uacgaucugacau

SEQ ID NO: 1742779 - RNA, 18 nt, Salmonella enterica enterica serovar Typhi Ty2
uacgaucgcaacggcauu

SEQ ID NO: 1742780 - RNA, 19 nt, Salmonella enterica enterica serovar Typhi Ty2
uacgcaccgucgagaaacc

SEQ ID NO: 1742781 - RNA, 17 nt, Salmonella enterica enterica serovar Typhi Ty2
uacgcaggacuuucgcu

SEQ ID NO: 1742782 - RNA, 21 nt, Salmonella enterica enterica serovar Typhi Ty2
uacgacugcacccaucuuuac

SEQ ID NO: 1742783 - RNA, 13 nt, Salmonella enterica enterica serovar Typhi Ty2
uacgaccgcagaa

SEQ ID NO: 1742784 - RNA, 21 nt, Salmonella enterica enterica serovar Typhi Ty2
uaccacuuucuugaugucauc

SEQ ID NO: 1742785 - RNA, 15 nt, Salmonella enterica enterica serovar Typhi Ty2
uaccagcagcgccag

SEQ ID NO: 1742786 - RNA, 16 nt, Salmonella enterica enterica serovar Typhi Ty2
uaccagcagcgccagc

SEQ ID NO: 1742787 - RNA, 19 nt, Salmonella enterica enterica serovar Typhi Ty2
uaccagcaucaauagcagc

SEQ ID NO: 1742788 - RNA, 15 nt, Salmonella enterica enterica serovar Typhi Ty2
uaccagcacaugaug

SEQ ID NO: 1742789 - RNA, 12 nt, Salmonella enterica enterica serovar Typhi Ty2
uaccagcggcaa

SEQ ID NO: 1742790 - RNA, 22 nt, Salmonella enterica enterica serovar Typhi Ty2
uaccuugucggguggcgcuagc

SEQ ID NO: 1742791 - RNA, 18 nt, Salmonella enterica enterica serovar Typhi Ty2
uaccuuuuuucaguaauu

SEQ ID NO: 1742792 - RNA, 17 nt, Salmonella enterica enterica serovar Typhi Ty2
uacgcuccagcuggcug

SEQ ID NO: 1742793 - RNA, 14 nt, Salmonella enterica enterica serovar Typhi Ty2
uacgcucgcugaug

SEQ ID NO: 1742794 - RNA, 14 nt, Salmonella enterica enterica serovar Typhi Ty2
uacggcauggcguc

SEQ ID NO: 1742795 - RNA, 23 nt, Salmonella enterica enterica serovar Typhi Ty2
uacggcuaauuaaucugucgaug

SEQ ID NO: 1742796 - RNA, 13 nt, Salmonella enterica enterica serovar Typhi Ty2
uacgguaaaccag

SEQ ID NO: 1742797 - RNA, 18 nt, Salmonella enterica enterica serovar Typhi Ty2
uacgcguuucacaaccuc

SEQ ID NO: 1742798 - RNA, 18 nt, Salmonella enterica enterica serovar Typhi Ty2
uacgcgucgccauccggc

SEQ ID NO: 1742799 - RNA, 23 nt, Salmonella enterica enterica serovar Typhi Ty2
uacgcgcucaccgacuccucaac

SEQ ID NO: 1742800 - RNA, 16 nt, Salmonella enterica enterica serovar Typhi Ty2
uacgccagacagcauu

SEQ ID NO: 1742801 - RNA, 20 nt, Salmonella enterica enterica serovar Typhi Ty2
uacgcgcguucguugaugua

SEQ ID NO: 1742802 - RNA, 22 nt, Salmonella enterica enterica serovar Typhi Ty2
uacgccaucaggcauggcagca

SEQ ID NO: 1742803 - RNA, 20 nt, Salmonella enterica enterica serovar Typhi Ty2
uacgcgcaaccgcaucacgc

SEQ ID NO: 1742804 - RNA, 20 nt, Salmonella enterica enterica serovar Typhi Ty2
uacugccagcgucgcugauu

SEQ ID NO: 1742805 - RNA, 16 nt, Salmonella enterica enterica serovar Typhi Ty2
uacugccgccaucgcu

SEQ ID NO: 1742806 - RNA, 18 nt, Salmonella enterica enterica serovar Typhi Ty2
uacugauuaauugcgaca

SEQ ID NO: 1742807 - RNA, 16 nt, Salmonella enterica enterica serovar Typhi Ty2
uacugaccggcccguu

SEQ ID NO: 1742808 - RNA, 22 nt, Salmonella enterica enterica serovar Typhi Ty2
uacuaucuucaaagccacacug

SEQ ID NO: 1742809 - RNA, 20 nt, Salmonella enterica enterica serovar Typhi Ty2
uacguugauuggcugugaca

SEQ ID NO: 1742810 - RNA, 12 nt, Salmonella enterica enterica serovar Typhi Ty2
uacguucggacu

SEQ ID NO: 1742811 - RNA, 14 nt, Salmonella enterica enterica serovar Typhi Ty2
uacguucaucaggc

SEQ ID NO: 1742812 - RNA, 19 nt, Salmonella enterica enterica serovar Typhi Ty2
uacgucgcccucuuuggcg

SEQ ID NO: 1742813 - RNA, 18 nt, Salmonella enterica enterica serovar Typhi Ty2
uacgucauaucauccagc

SEQ ID NO: 1742814 - RNA, 17 nt, Salmonella enterica enterica serovar Typhi Ty2
uacguacggauggcguc

SEQ ID NO: 1742815 - RNA, 22 nt, Salmonella enterica enterica serovar Typhi Ty2
uacugcuuuuccggcagcgcau

SEQ ID NO: 1742816 - RNA, 15 nt, Salmonella enterica enterica serovar Typhi Ty2
uagauuuucaucaua

SEQ ID NO: 1742817 - RNA, 23 nt, Salmonella enterica enterica serovar Typhi Ty2
uagacgagcgaaaaacugucgcc

SEQ ID NO: 1742818 - RNA, 21 nt, Salmonella enterica enterica serovar Typhi Ty2
uagacaguuuuuucguuccag

SEQ ID NO: 1742819 - RNA, 23 nt, Salmonella enterica enterica serovar Typhi Ty2
uagaccgcccaggauaucgcggg

SEQ ID NO: 1742820 - RNA, 12 nt, Salmonella enterica enterica serovar Typhi Ty2
uagccguggcug

SEQ ID NO: 1742821 - RNA, 14 nt, Salmonella enterica enterica serovar Typhi Ty2
uagccgcauccggc

SEQ ID NO: 1742822 - RNA, 23 nt, Salmonella enterica enterica serovar Typhi Ty2
uagccgacggccauaaaccccga

SEQ ID NO: 1742823 - RNA, 18 nt, Salmonella enterica enterica serovar Typhi Ty2
uagcaaauugcugauguu

SEQ ID NO: 1742824 - RNA, 19 nt, Salmonella enterica enterica serovar Typhi Ty2
uagcacauuuuuaucaggc

SEQ ID NO: 1742825 - RNA, 24 nt, Salmonella enterica enterica serovar Typhi Ty2
uagcggauugccgcgcucaaucug

SEQ ID NO: 1742826 - RNA, 21 nt, Salmonella enterica enterica serovar Typhi Ty2
uagcggcacagauacgaggug

SEQ ID NO: 1742827 - RNA, 18 nt, Salmonella enterica enterica serovar Typhi Ty2
uagcguuuuuucaucggc

SEQ ID NO: 1742828 - RNA, 20 nt, Salmonella enterica enterica serovar Typhi Ty2
uagcguugauaugcucgaca

SEQ ID NO: 1742829 - RNA, 17 nt, Salmonella enterica enterica serovar Typhi Ty2
uagcgugccgacguuca

SEQ ID NO: 1742830 - RNA, 18 nt, Salmonella enterica enterica serovar Typhi Ty2
uagcgcugaggcgcuggc

SEQ ID NO: 1742831 - RNA, 22 nt, Salmonella enterica enterica serovar Typhi Ty2
uagcggaacugcguuugaaaua

SEQ ID NO: 1742832 - RNA, 16 nt, Salmonella enterica enterica serovar Typhi Ty2
uagcuauauuuagccg

SEQ ID NO: 1742833 - RNA, 14 nt, Salmonella enterica enterica serovar Typhi Ty2
uaggcugaaagcgc

SEQ ID NO: 1742834 - RNA, 19 nt, Salmonella enterica enterica serovar Typhi Ty2
uaggccugauaagcgcagc

SEQ ID NO: 1742835 - RNA, 20 nt, Salmonella enterica enterica serovar Typhi Ty2
uaggccggauaaggcgcagc

SEQ ID NO: 1742836 - RNA, 17 nt, Salmonella enterica enterica serovar Typhi Ty2
uaggccagccgacgcuc

SEQ ID NO: 1742837 - RNA, 17 nt, Salmonella enterica enterica serovar Typhi Ty2
uaggccaggcauccggc

SEQ ID NO: 1742838 - RNA, 22 nt, Salmonella enterica enterica serovar Typhi Ty2
aauaaacacuuugcgcggauua

SEQ ID NO: 1742839 - RNA, 16 nt, Salmonella enterica enterica serovar Typhi Ty2
aauaaaguuuauuuga

SEQ ID NO: 1742840 - RNA, 14 nt, Salmonella enterica enterica serovar Typhi Ty2
aauaaaacgggccc

SEQ ID NO: 1742841 - RNA, 13 nt, Salmonella enterica enterica serovar Typhi Ty2
ucggcgauaaacc

SEQ ID NO: 1742842 - RNA, 15 nt, Salmonella enterica enterica serovar Typhi Ty2
ucggcgccaucaugc

SEQ ID NO: 1742843 - RNA, 20 nt, Salmonella enterica enterica serovar Typhi Ty2
ucggcguguagccaaucagc

SEQ ID NO: 1742844 - RNA, 13 nt, Salmonella enterica enterica serovar Typhi Ty2
ucggcucagcaau

SEQ ID NO: 1742845 - RNA, 16 nt, Salmonella enterica enterica serovar Typhi Ty2
ucggcgggcaucauau

SEQ ID NO: 1742846 - RNA, 17 nt, Salmonella enterica enterica serovar Typhi Ty2
ucggcgggaucuccaga

SEQ ID NO: 1742847 - RNA, 14 nt, Salmonella enterica enterica serovar Typhi Ty2
ucggccagcaggcg

SEQ ID NO: 1742848 - RNA, 16 nt, Salmonella enterica enterica serovar Typhi Ty2
ucggaugaucgucaac

SEQ ID NO: 1742849 - RNA, 13 nt, Salmonella enterica enterica serovar Typhi Ty2
ucggcaaagccca

SEQ ID NO: 1742850 - RNA, 18 nt, Salmonella enterica enterica serovar Typhi Ty2
ucggcaaaccaugaucgu

SEQ ID NO: 1742851 - RNA, 21 nt, Salmonella enterica enterica serovar Typhi Ty2
ucggcagcgucaggcuuaucg

SEQ ID NO: 1742852 - RNA, 21 nt, Salmonella enterica enterica serovar Typhi Ty2
ucggcauaggcuauugccuca

SEQ ID NO: 1742853 - RNA, 19 nt, Salmonella enterica enterica serovar Typhi Ty2
ucgcugugguuuauccgca

SEQ ID NO: 1742854 - RNA, 16 nt, Salmonella enterica enterica serovar Typhi Ty2
ucgcgcugcgcaggcg

SEQ ID NO: 1742855 - RNA, 15 nt, Salmonella enterica enterica serovar Typhi Ty2
ucgcgcuuauccgca

SEQ ID NO: 1742856 - RNA, 21 nt, Salmonella enterica enterica serovar Typhi Ty2
ucgcgcuuucaaucgucagac

SEQ ID NO: 1742857 - RNA, 20 nt, Salmonella enterica enterica serovar Typhi Ty2
ucgcggcuuuuuucuccagu

SEQ ID NO: 1742858 - RNA, 21 nt, Salmonella enterica enterica serovar Typhi Ty2
ucgcgccggacagcagcauau

SEQ ID NO: 1742859 - RNA, 16 nt, Salmonella enterica enterica serovar Typhi Ty2
ucgcgcagcgugaaac

SEQ ID NO: 1742860 - RNA, 22 nt, Salmonella enterica enterica serovar Typhi Ty2
ucgccgcgauaauaauuaccac

SEQ ID NO: 1742861 - RNA, 21 nt, Salmonella enterica enterica serovar Typhi Ty2
ucgccgcgcggaucgccaucg

SEQ ID NO: 1742862 - RNA, 18 nt, Salmonella enterica enterica serovar Typhi Ty2
ucgccaucgauagcagcg

SEQ ID NO: 1742863 - RNA, 21 nt, Salmonella enterica enterica serovar Typhi Ty2
ucgccauaaaucagauccacg

SEQ ID NO: 1742864 - RNA, 14 nt, Salmonella enterica enterica serovar Typhi Ty2
ucgccauccggcaa

SEQ ID NO: 1742865 - RNA, 14 nt, Salmonella enterica enterica serovar Typhi Ty2
ucgccauccugcac

SEQ ID NO: 1742866 - RNA, 18 nt, Salmonella enterica enterica serovar Typhi Ty2
ucgcccggcguaacgcca

SEQ ID NO: 1742867 - RNA, 13 nt, Salmonella enterica enterica serovar Typhi Ty2
ucgcccgccagau

SEQ ID NO: 1742868 - RNA, 11 nt, Salmonella enterica enterica serovar Typhi Ty2
ucgaccgcaga

SEQ ID NO: 1742869 - RNA, 14 nt, Salmonella enterica enterica serovar Typhi Ty2
ucgacaggcguaaa

SEQ ID NO: 1742870 - RNA, 17 nt, Salmonella enterica enterica serovar Typhi Ty2
ucgaccuggcgcucaau

SEQ ID NO: 1742871 - RNA, 22 nt, Salmonella enterica enterica serovar Typhi Ty2
ucgaagccgaccaccauccggc

SEQ ID NO: 1742872 - RNA, 19 nt, Salmonella enterica enterica serovar Typhi Ty2
ucgaacucuucgcaaccgg

SEQ ID NO: 1742873 - RNA, 14 nt, Salmonella enterica enterica serovar Typhi Ty2
ucgaacugaaaugg

SEQ ID NO: 1742874 - RNA, 11 nt, Salmonella enterica enterica serovar Typhi Ty2
ucgaacgccgc

SEQ ID NO: 1742875 - RNA, 16 nt, Salmonella enterica enterica serovar Typhi Ty2
uccugucgucaccagc

SEQ ID NO: 1742876 - RNA, 18 nt, Salmonella enterica enterica serovar Typhi Ty2
uccuuauuaaagccccuu

SEQ ID NO: 1742877 - RNA, 15 nt, Salmonella enterica enterica serovar Typhi Ty2
uccugucccugccag

SEQ ID NO: 1742878 - RNA, 14 nt, Salmonella enterica enterica serovar Typhi Ty2
uccuucuucgccgu

SEQ ID NO: 1742879 - RNA, 16 nt, Salmonella enterica enterica serovar Typhi Ty2
ucgaaauaaagaaagu

SEQ ID NO: 1742880 - RNA, 21 nt, Salmonella enterica enterica serovar Typhi Ty2
ucgaaauguccauccauugcg

SEQ ID NO: 1742881 - RNA, 15 nt, Salmonella enterica enterica serovar Typhi Ty2
ucgcaaucuccgccg

SEQ ID NO: 1742882 - RNA, 12 nt, Salmonella enterica enterica serovar Typhi Ty2
ucgcaacgccgc

SEQ ID NO: 1742883 - RNA, 21 nt, Salmonella enterica enterica serovar Typhi Ty2
ucgauuuuguuaugcgcauag

SEQ ID NO: 1742884 - RNA, 14 nt, Salmonella enterica enterica serovar Typhi Ty2
ucgcaaacgccagc

SEQ ID NO: 1742885 - RNA, 13 nt, Salmonella enterica enterica serovar Typhi Ty2
ucgcaaacgccag

SEQ ID NO: 1742886 - RNA, 21 nt, Salmonella enterica enterica serovar Typhi Ty2
ucgauuuccgguuccagcggc

SEQ ID NO: 1742887 - RNA, 16 nt, Salmonella enterica enterica serovar Typhi Ty2
ucgauuuuagcgcauc

SEQ ID NO: 1742888 - RNA, 12 nt, Salmonella enterica enterica serovar Typhi Ty2
ucgauuaaacgc

SEQ ID NO: 1742889 - RNA, 19 nt, Salmonella enterica enterica serovar Typhi Ty2
ucgauuaguccgucgggga

SEQ ID NO: 1742890 - RNA, 14 nt, Salmonella enterica enterica serovar Typhi Ty2
ucgaugucgucgau

SEQ ID NO: 1742891 - RNA, 12 nt, Salmonella enterica enterica serovar Typhi Ty2
ucgaugauggcg

SEQ ID NO: 1742892 - RNA, 19 nt, Salmonella enterica enterica serovar Typhi Ty2
ucgaugccacagcgcauuc

SEQ ID NO: 1742893 - RNA, 21 nt, Salmonella enterica enterica serovar Typhi Ty2
ucgauauaucgcgucaucaaa

SEQ ID NO: 1742894 - RNA, 16 nt, Salmonella enterica enterica serovar Typhi Ty2
ucgauacuauaacgcu

SEQ ID NO: 1742895 - RNA, 17 nt, Salmonella enterica enterica serovar Typhi Ty2
ucgauaucugccugcag

SEQ ID NO: 1742896 - RNA, 22 nt, Salmonella enterica enterica serovar Typhi Ty2
ucgacgggacgaauuuccagcg

SEQ ID NO: 1742897 - RNA, 14 nt, Salmonella enterica enterica serovar Typhi Ty2
uccguuaagcccug

SEQ ID NO: 1742898 - RNA, 15 nt, Salmonella enterica enterica serovar Typhi Ty2
uccguuaagcccuga

SEQ ID NO: 1742899 - RNA, 17 nt, Salmonella enterica enterica serovar Typhi Ty2
uccguucaucggcauac

SEQ ID NO: 1742900 - RNA, 17 nt, Salmonella enterica enterica serovar Typhi Ty2
uccuccaacgugcagau

SEQ ID NO: 1742901 - RNA, 22 nt, Salmonella enterica enterica serovar Typhi Ty2
uccuauuugcuugugacggcaa

SEQ ID NO: 1742902 - RNA, 14 nt, Salmonella enterica enterica serovar Typhi Ty2
uccuccaucgccag

SEQ ID NO: 1742903 - RNA, 15 nt, Salmonella enterica enterica serovar Typhi Ty2
uccggcgcauccagu

SEQ ID NO: 1742904 - RNA, 18 nt, Salmonella enterica enterica serovar Typhi Ty2
uccggcugccugccggau

SEQ ID NO: 1742905 - RNA, 23 nt, Salmonella enterica enterica serovar Typhi Ty2
uccggcuguucgacgaauggcgg

SEQ ID NO: 1742906 - RNA, 14 nt, Salmonella enterica enterica serovar Typhi Ty2
uccggccagcgcca

SEQ ID NO: 1742907 - RNA, 21 nt, Salmonella enterica enterica serovar Typhi Ty2
uccggcaucacaucgccguuc

SEQ ID NO: 1742908 - RNA, 15 nt, Salmonella enterica enterica serovar Typhi Ty2
uccgcgagcagccaa

SEQ ID NO: 1742909 - RNA, 21 nt, Salmonella enterica enterica serovar Typhi Ty2
uccggaucaucuuuuaccgcc

SEQ ID NO: 1742910 - RNA, 18 nt, Salmonella enterica enterica serovar Typhi Ty2
uccgcuuucuucccggca

SEQ ID NO: 1742911 - RNA, 15 nt, Salmonella enterica enterica serovar Typhi Ty2
uccgcuuuuaucggc

SEQ ID NO: 1742912 - RNA, 13 nt, Salmonella enterica enterica serovar Typhi Ty2
uccggacgccagu

SEQ ID NO: 1742913 - RNA, 21 nt, Salmonella enterica enterica serovar Typhi Ty2
uccgcuucggacuccugacgc

SEQ ID NO: 1742914 - RNA, 12 nt, Salmonella enterica enterica serovar Typhi Ty2
uccgacgccugu

SEQ ID NO: 1742915 - RNA, 22 nt, Salmonella enterica enterica serovar Typhi Ty2
uccgaugcgcuuuacugucgcu

SEQ ID NO: 1742916 - RNA, 17 nt, Salmonella enterica enterica serovar Typhi Ty2
uccgcagccgacgcauu

SEQ ID NO: 1742917 - RNA, 15 nt, Salmonella enterica enterica serovar Typhi Ty2
uccgcagauccagca

SEQ ID NO: 1742918 - RNA, 18 nt, Salmonella enterica enterica serovar Typhi Ty2
uccgcaaucacauacagc

SEQ ID NO: 1742919 - RNA, 14 nt, Salmonella enterica enterica serovar Typhi Ty2
uccgcaauccuggc

SEQ ID NO: 1742920 - RNA, 14 nt, Salmonella enterica enterica serovar Typhi Ty2
uccgccgccgccau

SEQ ID NO: 1742921 - RNA, 22 nt, Salmonella enterica enterica serovar Typhi Ty2
uccgccaugaaaaaaacgcauu

SEQ ID NO: 1742922 - RNA, 15 nt, Salmonella enterica enterica serovar Typhi Ty2
uccgcaucgacguuc

SEQ ID NO: 1742923 - RNA, 20 nt, Salmonella enterica enterica serovar Typhi Ty2
ucccgcacgcuggcaucaau

SEQ ID NO: 1742924 - RNA, 13 nt, Salmonella enterica enterica serovar Typhi Ty2
ucccgcagccacu

SEQ ID NO: 1742925 - RNA, 21 nt, Salmonella enterica enterica serovar Typhi Ty2
ucccggcuggguucauccagc

SEQ ID NO: 1742926 - RNA, 15 nt, Salmonella enterica enterica serovar Typhi Ty2
ucccggucgcgccag

SEQ ID NO: 1742927 - RNA, 21 nt, Salmonella enterica enterica serovar Typhi Ty2
uccccuuuucacccaacauuu

SEQ ID NO: 1742928 - RNA, 21 nt, Salmonella enterica enterica serovar Typhi Ty2
ucccgaugguauuuauucuau

SEQ ID NO: 1742929 - RNA, 13 nt, Salmonella enterica enterica serovar Typhi Ty2
ucccgaucuucau

SEQ ID NO: 1742930 - RNA, 19 nt, Salmonella enterica enterica serovar Typhi Ty2
uccccugcuccugccagau

SEQ ID NO: 1742931 - RNA, 20 nt, Salmonella enterica enterica serovar Typhi Ty2
ucccaaccaguaugaccguu

SEQ ID NO: 1742932 - RNA, 20 nt, Salmonella enterica enterica serovar Typhi Ty2
ucccaaugcggaaaccaguu

SEQ ID NO: 1742933 - RNA, 19 nt, Salmonella enterica enterica serovar Typhi Ty2
ucccacaguuaacgccaac

SEQ ID NO: 1742934 - RNA, 14 nt, Salmonella enterica enterica serovar Typhi Ty2
ugauucggguaaac

SEQ ID NO: 1742935 - RNA, 22 nt, Salmonella enterica enterica serovar Typhi Ty2
ugauugcuggcagaugaacaua

SEQ ID NO: 1742936 - RNA, 16 nt, Salmonella enterica enterica serovar Typhi Ty2
ugauuaacagcgccau

SEQ ID NO: 1742937 - RNA, 14 nt, Salmonella enterica enterica serovar Typhi Ty2
ugauguccagcgcg

SEQ ID NO: 1742938 - RNA, 21 nt, Salmonella enterica enterica serovar Typhi Ty2
ugauguccagcgcgccggaua

SEQ ID NO: 1742939 - RNA, 15 nt, Salmonella enterica enterica serovar Typhi Ty2
ugaugauagcgccau

SEQ ID NO: 1742940 - RNA, 17 nt, Salmonella enterica enterica serovar Typhi Ty2
ugauccguuucagaaag

SEQ ID NO: 1742941 - RNA, 21 nt, Salmonella enterica enterica serovar Typhi Ty2
ugaugcccucuuccagcgcca

SEQ ID NO: 1742942 - RNA, 18 nt, Salmonella enterica enterica serovar Typhi Ty2
ugaugaucuucagcccgu

SEQ ID NO: 1742943 - RNA, 16 nt, Salmonella enterica enterica serovar Typhi Ty2
ugcaauaucgcggcaa

SEQ ID NO: 1742944 - RNA, 13 nt, Salmonella enterica enterica serovar Typhi Ty2
ugcaaucagcgaa

SEQ ID NO: 1742945 - RNA, 17 nt, Salmonella enterica enterica serovar Typhi Ty2
ugcaauucggcggcaau

SEQ ID NO: 1742946 - RNA, 23 nt, Salmonella enterica enterica serovar Typhi Ty2
ugcaauucgagauuuuucugcgc

SEQ ID NO: 1742947 - RNA, 22 nt, Salmonella enterica enterica serovar Typhi Ty2
ugcaacauuacugaccgagauc

SEQ ID NO: 1742948 - RNA, 23 nt, Salmonella enterica enterica serovar Typhi Ty2
ugcaacccauauucgucuucauc

SEQ ID NO: 1742949 - RNA, 21 nt, Salmonella enterica enterica serovar Typhi Ty2
ugcaaauccaucucaggccga

SEQ ID NO: 1742950 - RNA, 21 nt, Salmonella enterica enterica serovar Typhi Ty2
ugcaaaucugccgucaucgac

SEQ ID NO: 1742951 - RNA, 22 nt, Salmonella enterica enterica serovar Typhi Ty2
ugcaaaccucucccccgccauu

SEQ ID NO: 1742952 - RNA, 11 nt, Salmonella enterica enterica serovar Typhi Ty2
ugcaaacguag

SEQ ID NO: 1742953 - RNA, 20 nt, Salmonella enterica enterica serovar Typhi Ty2
ugauuucaggugcuuaucug

SEQ ID NO: 1742954 - RNA, 19 nt, Salmonella enterica enterica serovar Typhi Ty2
ugagccgaaauccaccagc

SEQ ID NO: 1742955 - RNA, 20 nt, Salmonella enterica enterica serovar Typhi Ty2
ugagcucguuauaagcuuua

SEQ ID NO: 1742956 - RNA, 17 nt, Salmonella enterica enterica serovar Typhi Ty2
ugagcuaucugucugcu

SEQ ID NO: 1742957 - RNA, 18 nt, Salmonella enterica enterica serovar Typhi Ty2
ugaggcgcugcgacgcgg

SEQ ID NO: 1742958 - RNA, 15 nt, Salmonella enterica enterica serovar Typhi Ty2
ugaggcuugcagcau

SEQ ID NO: 1742959 - RNA, 18 nt, Salmonella enterica enterica serovar Typhi Ty2
ugaggcuauugucauuga

SEQ ID NO: 1742960 - RNA, 17 nt, Salmonella enterica enterica serovar Typhi Ty2
ugaguaucgggauggcg

SEQ ID NO: 1742961 - RNA, 19 nt, Salmonella enterica enterica serovar Typhi Ty2
ugauauaaaauggcgcaca

SEQ ID NO: 1742962 - RNA, 17 nt, Salmonella enterica enterica serovar Typhi Ty2
ugauagccguucuccag

SEQ ID NO: 1742963 - RNA, 21 nt, Salmonella enterica enterica serovar Typhi Ty2
ugauacuguacgcccagccgu

SEQ ID NO: 1742964 - RNA, 16 nt, Salmonella enterica enterica serovar Typhi Ty2
ugacugccagguaauc

SEQ ID NO: 1742965 - RNA, 13 nt, Salmonella enterica enterica serovar Typhi Ty2
ugaccccggccuc

SEQ ID NO: 1742966 - RNA, 12 nt, Salmonella enterica enterica serovar Typhi Ty2
ugagaucguuau

SEQ ID NO: 1742967 - RNA, 15 nt, Salmonella enterica enterica serovar Typhi Ty2
ugagaaaauuacgcc

SEQ ID NO: 1742968 - RNA, 17 nt, Salmonella enterica enterica serovar Typhi Ty2
ugacuuguuccagucca

SEQ ID NO: 1742969 - RNA, 17 nt, Salmonella enterica enterica serovar Typhi Ty2
ugacuucaacgcaggcg

SEQ ID NO: 1742970 - RNA, 15 nt, Salmonella enterica enterica serovar Typhi Ty2
ugagaauucugcgcg

SEQ ID NO: 1742971 - RNA, 12 nt, Salmonella enterica enterica serovar Typhi Ty2
ugccaguaacgu

SEQ ID NO: 1742972 - RNA, 21 nt, Salmonella enterica enterica serovar Typhi Ty2
ugccaguaacguucuucgaua

SEQ ID NO: 1742973 - RNA, 17 nt, Salmonella enterica enterica serovar Typhi Ty2
ugccaguaacucaucgc

SEQ ID NO: 1742974 - RNA, 18 nt, Salmonella enterica enterica serovar Typhi Ty2
ugccagcuuaaaucgcgg

SEQ ID NO: 1742975 - RNA, 16 nt, Salmonella enterica enterica serovar Typhi Ty2
ugcccaaccugcgcag

SEQ ID NO: 1742976 - RNA, 18 nt, Salmonella enterica enterica serovar Typhi Ty2
ugccaucaucaguaacac

SEQ ID NO: 1742977 - RNA, 16 nt, Salmonella enterica enterica serovar Typhi Ty2
ugcccaccuucgcgga

SEQ ID NO: 1742978 - RNA, 20 nt, Salmonella enterica enterica serovar Typhi Ty2
ugcccauguuuaccaucgcg

SEQ ID NO: 1742979 - RNA, 23 nt, Salmonella enterica enterica serovar Typhi Ty2
ugcaggccgauuuuuuaucucgc

SEQ ID NO: 1742980 - RNA, 17 nt, Salmonella enterica enterica serovar Typhi Ty2
ugcauuccgcgcaaaua

SEQ ID NO: 1742981 - RNA, 15 nt, Salmonella enterica enterica serovar Typhi Ty2
ugcauucgcccgcaa

SEQ ID NO: 1742982 - RNA, 16 nt, Salmonella enterica enterica serovar Typhi Ty2
ugcauuguccgcauuc

SEQ ID NO: 1742983 - RNA, 16 nt, Salmonella enterica enterica serovar Typhi Ty2
ugcauugccgggcuga

SEQ ID NO: 1742984 - RNA, 21 nt, Salmonella enterica enterica serovar Typhi Ty2
ugcaucuuaucaggccgacaa

SEQ ID NO: 1742985 - RNA, 15 nt, Salmonella enterica enterica serovar Typhi Ty2
ugcauuaaugggcga

SEQ ID NO: 1742986 - RNA, 23 nt, Salmonella enterica enterica serovar Typhi Ty2
ugccgaagucaaaggccaguaag

SEQ ID NO: 1742987 - RNA, 17 nt, Salmonella enterica enterica serovar Typhi Ty2
ugccgaccaaugacgcu

SEQ ID NO: 1742988 - RNA, 19 nt, Salmonella enterica enterica serovar Typhi Ty2
ugccgagcaacagaaacca

SEQ ID NO: 1742989 - RNA, 23 nt, Salmonella enterica enterica serovar Typhi Ty2
ugccgacagaacugauuuccgga

SEQ ID NO: 1742990 - RNA, 17 nt, Salmonella enterica enterica serovar Typhi Ty2
ugccgaugaaagagcgc

SEQ ID NO: 1742991 - RNA, 17 nt, Salmonella enterica enterica serovar Typhi Ty2
ugccgaugccugcgaga

SEQ ID NO: 1742992 - RNA, 13 nt, Salmonella enterica enterica serovar Typhi Ty2
ugccgcaaaaaug

SEQ ID NO: 1742993 - RNA, 14 nt, Salmonella enterica enterica serovar Typhi Ty2
ugccgcgaucgcgg

SEQ ID NO: 1742994 - RNA, 15 nt, Salmonella enterica enterica serovar Typhi Ty2
ugccgcgaucgcggc

SEQ ID NO: 1742995 - RNA, 13 nt, Salmonella enterica enterica serovar Typhi Ty2
ugccgccaucgcu

SEQ ID NO: 1742996 - RNA, 18 nt, Salmonella enterica enterica serovar Typhi Ty2
ugccgccauaacgccggc

SEQ ID NO: 1742997 - RNA, 14 nt, Salmonella enterica enterica serovar Typhi Ty2
ugccgccacgccgc

SEQ ID NO: 1742998 - RNA, 17 nt, Salmonella enterica enterica serovar Typhi Ty2
ucuaucuguaacuucgg

SEQ ID NO: 1742999 - RNA, 22 nt, Salmonella enterica enterica serovar Typhi Ty2
ucuaccguaggccggauaagcg

SEQ ID NO: 1743000 - RNA, 18 nt, Salmonella enterica enterica serovar Typhi Ty2
ucuaccacgcugccgccg

SEQ ID NO: 1743001 - RNA, 22 nt, Salmonella enterica enterica serovar Typhi Ty2
ucuacuaacuggcaaucaugcg

SEQ ID NO: 1743002 - RNA, 17 nt, Salmonella enterica enterica serovar Typhi Ty2
ucuaaaucauaccagcg

SEQ ID NO: 1743003 - RNA, 20 nt, Salmonella enterica enterica serovar Typhi Ty2
ucguucacguaaucgccgug

SEQ ID NO: 1743004 - RNA, 17 nt, Salmonella enterica enterica serovar Typhi Ty2
ucguuugcaguuccgca

SEQ ID NO: 1743005 - RNA, 18 nt, Salmonella enterica enterica serovar Typhi Ty2
ucgugaucgccaaagcgu

SEQ ID NO: 1743006 - RNA, 22 nt, Salmonella enterica enterica serovar Typhi Ty2
ucgguacgcgucugaaugacgc

SEQ ID NO: 1743007 - RNA, 17 nt, Salmonella enterica enterica serovar Typhi Ty2
ucggugacggaaaccag

SEQ ID NO: 1743008 - RNA, 12 nt, Salmonella enterica enterica serovar Typhi Ty2
ucguccugcaau

SEQ ID NO: 1743009 - RNA, 18 nt, Salmonella enterica enterica serovar Typhi Ty2
ucgucgcgaucgcgccag

SEQ ID NO: 1743010 - RNA, 14 nt, Salmonella enterica enterica serovar Typhi Ty2
ucgucgcuaagcgu

SEQ ID NO: 1743011 - RNA, 17 nt, Salmonella enterica enterica serovar Typhi Ty2
ucgucgcuaagcgucag

SEQ ID NO: 1743012 - RNA, 21 nt, Salmonella enterica enterica serovar Typhi Ty2
ucguaagaauuauuaccaaug

SEQ ID NO: 1743013 - RNA, 19 nt, Salmonella enterica enterica serovar Typhi Ty2
ucgucaaugugaauccagg

SEQ ID NO: 1743014 - RNA, 21 nt, Salmonella enterica enterica serovar Typhi Ty2
ucgucacgacggcgaccggca

SEQ ID NO: 1743015 - RNA, 23 nt, Salmonella enterica enterica serovar Typhi Ty2
ucguccguuucccaagucacgcc

SEQ ID NO: 1743016 - RNA, 13 nt, Salmonella enterica enterica serovar Typhi Ty2
ucgucauggcgua

SEQ ID NO: 1743017 - RNA, 12 nt, Salmonella enterica enterica serovar Typhi Ty2
ucgucaugcgcc

SEQ ID NO: 1743018 - RNA, 11 nt, Salmonella enterica enterica serovar Typhi Ty2
ucgucaucgcg

SEQ ID NO: 1743019 - RNA, 14 nt, Salmonella enterica enterica serovar Typhi Ty2
ucuggcggcguaau

SEQ ID NO: 1743020 - RNA, 22 nt, Salmonella enterica enterica serovar Typhi Ty2
ucuggcguaaugcgaugccgca

SEQ ID NO: 1743021 - RNA, 13 nt, Salmonella enterica enterica serovar Typhi Ty2
ucuggcugcugau

SEQ ID NO: 1743022 - RNA, 20 nt, Salmonella enterica enterica serovar Typhi Ty2
ucuggcgaacgacucacgcg

SEQ ID NO: 1743023 - RNA, 15 nt, Salmonella enterica enterica serovar Typhi Ty2
ucuggccucuuauca

SEQ ID NO: 1743024 - RNA, 14 nt, Salmonella enterica enterica serovar Typhi Ty2
ucuggcgcauaaug

SEQ ID NO: 1743025 - RNA, 14 nt, Salmonella enterica enterica serovar Typhi Ty2
ucugcgcuaagcgu

SEQ ID NO: 1743026 - RNA, 17 nt, Salmonella enterica enterica serovar Typhi Ty2
ucugucagaaaucugaa

SEQ ID NO: 1743027 - RNA, 21 nt, Salmonella enterica enterica serovar Typhi Ty2
ucuguccuuucugcugccgca

SEQ ID NO: 1743028 - RNA, 21 nt, Salmonella enterica enterica serovar Typhi Ty2
ucuguaggccggauaaggcgu

SEQ ID NO: 1743029 - RNA, 20 nt, Salmonella enterica enterica serovar Typhi Ty2
ucuguaggccggauaagcgg

SEQ ID NO: 1743030 - RNA, 19 nt, Salmonella enterica enterica serovar Typhi Ty2
ucugguuucccugccucaa

SEQ ID NO: 1743031 - RNA, 23 nt, Salmonella enterica enterica serovar Typhi Ty2
aauacguaauaccugaagcccuu

SEQ ID NO: 1743032 - RNA, 13 nt, Salmonella enterica enterica serovar Typhi Ty2
ucuguuaucugga

SEQ ID NO: 1743033 - RNA, 21 nt, Salmonella enterica enterica serovar Typhi Ty2
ucuucuuuauccugaagaugg

SEQ ID NO: 1743034 - RNA, 15 nt, Salmonella enterica enterica serovar Typhi Ty2
ucuguugcgccaggg

SEQ ID NO: 1743035 - RNA, 20 nt, Salmonella enterica enterica serovar Typhi Ty2
ucuuccgcaauaugcgucag

SEQ ID NO: 1743036 - RNA, 17 nt, Salmonella enterica enterica serovar Typhi Ty2
ucuuccgccagcgccag

SEQ ID NO: 1743037 - RNA, 19 nt, Salmonella enterica enterica serovar Typhi Ty2
ucuuccgccaggucgcggu

SEQ ID NO: 1743038 - RNA, 16 nt, Salmonella enterica enterica serovar Typhi Ty2
ucuuccugcugcgcca

SEQ ID NO: 1743039 - RNA, 17 nt, Salmonella enterica enterica serovar Typhi Ty2
ucuuccgguagcgccug

SEQ ID NO: 1743040 - RNA, 23 nt, Salmonella enterica enterica serovar Typhi Ty2
ucuuccggcaucacaucgccguu

SEQ ID NO: 1743041 - RNA, 19 nt, Salmonella enterica enterica serovar Typhi Ty2
ucuuccgucagcgaaucga

SEQ ID NO: 1743042 - RNA, 20 nt, Salmonella enterica enterica serovar Typhi Ty2
ucuuccugcugcgccagcgc

SEQ ID NO: 1743043 - RNA, 13 nt, Salmonella enterica enterica serovar Typhi Ty2
ugaaaaaacgggc

SEQ ID NO: 1743044 - RNA, 24 nt, Salmonella enterica enterica serovar Typhi Ty2
ugaaaaccacaaucacagcgcaga

SEQ ID NO: 1743045 - RNA, 18 nt, Salmonella enterica enterica serovar Typhi Ty2
ugaaaaccaggaaccgcg

SEQ ID NO: 1743046 - RNA, 18 nt, Salmonella enterica enterica serovar Typhi Ty2
ugaaaauguaucagacgu

SEQ ID NO: 1743047 - RNA, 14 nt, Salmonella enterica enterica serovar Typhi Ty2
ugaaaacgaaucuc

SEQ ID NO: 1743048 - RNA, 22 nt, Salmonella enterica enterica serovar Typhi Ty2
ucuuuaauuuacguccgccgug

SEQ ID NO: 1743049 - RNA, 20 nt, Salmonella enterica enterica serovar Typhi Ty2
ucuuuuaucguugcuucgcg

SEQ ID NO: 1743050 - RNA, 17 nt, Salmonella enterica enterica serovar Typhi Ty2
ucuuuggacggcaucag

SEQ ID NO: 1743051 - RNA, 12 nt, Salmonella enterica enterica serovar Typhi Ty2
ucuuuauucgcg

SEQ ID NO: 1743052 - RNA, 15 nt, Salmonella enterica enterica serovar Typhi Ty2
ugaauaaaaccggca

SEQ ID NO: 1743053 - RNA, 14 nt, Salmonella enterica enterica serovar Typhi Ty2
ugaauaaccaucgg

SEQ ID NO: 1743054 - RNA, 19 nt, Salmonella enterica enterica serovar Typhi Ty2
ugaagugguggcgaacagg

SEQ ID NO: 1743055 - RNA, 22 nt, Salmonella enterica enterica serovar Typhi Ty2
ugaauagcuuucaccggucgca

SEQ ID NO: 1743056 - RNA, 15 nt, Salmonella enterica enterica serovar Typhi Ty2
ugaagcgggaaagcg

SEQ ID NO: 1743057 - RNA, 22 nt, Salmonella enterica enterica serovar Typhi Ty2
ugaaggguaaaacguuauuggc

SEQ ID NO: 1743058 - RNA, 12 nt, Salmonella enterica enterica serovar Typhi Ty2
ugaagacaacgu

SEQ ID NO: 1743059 - RNA, 12 nt, Salmonella enterica enterica serovar Typhi Ty2
ugaagaacagcg

SEQ ID NO: 1743060 - RNA, 20 nt, Salmonella enterica enterica serovar Typhi Ty2
ugaagacguugaauauuggc

SEQ ID NO: 1743061 - RNA, 16 nt, Salmonella enterica enterica serovar Typhi Ty2
ugaacuguaaccggcg

SEQ ID NO: 1743062 - RNA, 17 nt, Salmonella enterica enterica serovar Typhi Ty2
ugaccaccauauucgcc

SEQ ID NO: 1743063 - RNA, 18 nt, Salmonella enterica enterica serovar Typhi Ty2
ugaccagccuaccugccg

SEQ ID NO: 1743064 - RNA, 13 nt, Salmonella enterica enterica serovar Typhi Ty2
ugaccagcgacgg

SEQ ID NO: 1743065 - RNA, 17 nt, Salmonella enterica enterica serovar Typhi Ty2
ugacauuuaucuuccgg

SEQ ID NO: 1743066 - RNA, 21 nt, Salmonella enterica enterica serovar Typhi Ty2
ugaaucccccugccacaaccg

SEQ ID NO: 1743067 - RNA, 15 nt, Salmonella enterica enterica serovar Typhi Ty2
ugaaucccgccaucg

SEQ ID NO: 1743068 - RNA, 21 nt, Salmonella enterica enterica serovar Typhi Ty2
ugaaucguagcgugcgcaaua

SEQ ID NO: 1743069 - RNA, 19 nt, Salmonella enterica enterica serovar Typhi Ty2
ugacacagcguacaauggc

SEQ ID NO: 1743070 - RNA, 23 nt, Salmonella enterica enterica serovar Typhi Ty2
ugacacccaucgcgacaucgccu

SEQ ID NO: 1743071 - RNA, 15 nt, Salmonella enterica enterica serovar Typhi Ty2
ugacaagcagcggaa

SEQ ID NO: 1743072 - RNA, 13 nt, Salmonella enterica enterica serovar Typhi Ty2
ugacaaccugccg

SEQ ID NO: 1743073 - RNA, 14 nt, Salmonella enterica enterica serovar Typhi Ty2
agcucgcccagcac

SEQ ID NO: 1743074 - RNA, 18 nt, Salmonella enterica enterica serovar Typhi Ty2
agcuacucaggagaucgg

SEQ ID NO: 1743075 - RNA, 14 nt, Salmonella enterica enterica serovar Typhi Ty2
agcguuucaaccgc

SEQ ID NO: 1743076 - RNA, 21 nt, Salmonella enterica enterica serovar Typhi Ty2
agcguaggguagaucacgcca

SEQ ID NO: 1743077 - RNA, 12 nt, Salmonella enterica enterica serovar Typhi Ty2
agcguaucgccc

SEQ ID NO: 1743078 - RNA, 23 nt, Salmonella enterica enterica serovar Typhi Ty2
agcgucaauaaucgcgcgcguau

SEQ ID NO: 1743079 - RNA, 12 nt, Salmonella enterica enterica serovar Typhi Ty2
agcgucagcaga

SEQ ID NO: 1743080 - RNA, 19 nt, Salmonella enterica enterica serovar Typhi Ty2
agcguaauuucugguacca

SEQ ID NO: 1743081 - RNA, 22 nt, Salmonella enterica enterica serovar Typhi Ty2
agcguaaccgguugucgcgcca

SEQ ID NO: 1743082 - RNA, 22 nt, Salmonella enterica enterica serovar Typhi Ty2
agcguaaucggcaggccaacgg

SEQ ID NO: 1743083 - RNA, 19 nt, Salmonella enterica enterica serovar Typhi Ty2
agcgguuaucggcaaacgg

SEQ ID NO: 1743084 - RNA, 13 nt, Salmonella enterica enterica serovar Typhi Ty2
agcguuagcgcca

SEQ ID NO: 1743085 - RNA, 20 nt, Salmonella enterica enterica serovar Typhi Ty2
agcguuagcgccauccggca

SEQ ID NO: 1743086 - RNA, 16 nt, Salmonella enterica enterica serovar Typhi Ty2
agcguuaucuggucgc

SEQ ID NO: 1743087 - RNA, 15 nt, Salmonella enterica enterica serovar Typhi Ty2
agcguuacuggccuu

SEQ ID NO: 1743088 - RNA, 22 nt, Salmonella enterica enterica serovar Typhi Ty2
agcgugucgcagauacgcugua

SEQ ID NO: 1743089 - RNA, 17 nt, Salmonella enterica enterica serovar Typhi Ty2
agcgucaggcuuaucgu

SEQ ID NO: 1743090 - RNA, 12 nt, Salmonella enterica enterica serovar Typhi Ty2
agcgucaggcca

SEQ ID NO: 1743091 - RNA, 15 nt, Salmonella enterica enterica serovar Typhi Ty2
agcgggcuggugcga

SEQ ID NO: 1743092 - RNA, 20 nt, Salmonella enterica enterica serovar Typhi Ty2
agcgcggcgcccauuccgcc

SEQ ID NO: 1743093 - RNA, 16 nt, Salmonella enterica enterica serovar Typhi Ty2
agcgccgucauaccgc

SEQ ID NO: 1743094 - RNA, 17 nt, Salmonella enterica enterica serovar Typhi Ty2
agcgcguccccgguaag

SEQ ID NO: 1743095 - RNA, 21 nt, Salmonella enterica enterica serovar Typhi Ty2
agcgcuuggcguauagccgcc

SEQ ID NO: 1743096 - RNA, 17 nt, Salmonella enterica enterica serovar Typhi Ty2
agcgcuggcuggcgaca

SEQ ID NO: 1743097 - RNA, 13 nt, Salmonella enterica enterica serovar Typhi Ty2
agcgcugccgcaa

SEQ ID NO: 1743098 - RNA, 18 nt, Salmonella enterica enterica serovar Typhi Ty2
agcgcgucguucacgcca

SEQ ID NO: 1743099 - RNA, 19 nt, Salmonella enterica enterica serovar Typhi Ty2
agcgcuuguuaucuggcau

SEQ ID NO: 1743100 - RNA, 18 nt, Salmonella enterica enterica serovar Typhi Ty2
agcggauugccgcgcuca

SEQ ID NO: 1743101 - RNA, 15 nt, Salmonella enterica enterica serovar Typhi Ty2
agcggaauagacggc

SEQ ID NO: 1743102 - RNA, 21 nt, Salmonella enterica enterica serovar Typhi Ty2
agcuggucgccagcgccggac

SEQ ID NO: 1743103 - RNA, 19 nt, Salmonella enterica enterica serovar Typhi Ty2
agcugcgccauaccccgau

SEQ ID NO: 1743104 - RNA, 16 nt, Salmonella enterica enterica serovar Typhi Ty2
agcuguuaauuugcau

SEQ ID NO: 1743105 - RNA, 22 nt, Salmonella enterica enterica serovar Typhi Ty2
agcugugauugcgacaggcugc

SEQ ID NO: 1743106 - RNA, 22 nt, Salmonella enterica enterica serovar Typhi Ty2
agcugguugagauccauaagau

SEQ ID NO: 1743107 - RNA, 12 nt, Salmonella enterica enterica serovar Typhi Ty2
agcuugccgcca

SEQ ID NO: 1743108 - RNA, 15 nt, Salmonella enterica enterica serovar Typhi Ty2
agcuugccguagcgc

SEQ ID NO: 1743109 - RNA, 21 nt, Salmonella enterica enterica serovar Typhi Ty2
agcuuguuguuuauccugcaa

SEQ ID NO: 1743110 - RNA, 18 nt, Salmonella enterica enterica serovar Typhi Ty2
agcuugaaagcagucccg

SEQ ID NO: 1743111 - RNA, 19 nt, Salmonella enterica enterica serovar Typhi Ty2
agcuucgguccggcgcuaa

SEQ ID NO: 1743112 - RNA, 17 nt, Salmonella enterica enterica serovar Typhi Ty2
agcuucgcccaggcggg

SEQ ID NO: 1743113 - RNA, 13 nt, Salmonella enterica enterica serovar Typhi Ty2
agcuucaugcgcc

SEQ ID NO: 1743114 - RNA, 15 nt, Salmonella enterica enterica serovar Typhi Ty2
aggaauauaccauca

SEQ ID NO: 1743115 - RNA, 18 nt, Salmonella enterica enterica serovar Typhi Ty2
aggaaucgcuaaggcggc

SEQ ID NO: 1743116 - RNA, 20 nt, Salmonella enterica enterica serovar Typhi Ty2
aggacagacagacguugcgc

SEQ ID NO: 1743117 - RNA, 20 nt, Salmonella enterica enterica serovar Typhi Ty2
aggaaggucuugauggcgau

SEQ ID NO: 1743118 - RNA, 19 nt, Salmonella enterica enterica serovar Typhi Ty2
agcuuuugccugcgucguu

SEQ ID NO: 1743119 - RNA, 16 nt, Salmonella enterica enterica serovar Typhi Ty2
agcuuuuccgcuggaa

SEQ ID NO: 1743120 - RNA, 12 nt, Salmonella enterica enterica serovar Typhi Ty2
aggaaauaacgu

SEQ ID NO: 1743121 - RNA, 14 nt, Salmonella enterica enterica serovar Typhi Ty2
aggaaccacaucca

SEQ ID NO: 1743122 - RNA, 19 nt, Salmonella enterica enterica serovar Typhi Ty2
aaacguuauuggcaggaug

SEQ ID NO: 1743123 - RNA, 14 nt, Salmonella enterica enterica serovar Typhi Ty2
aggagcaaaccgac

SEQ ID NO: 1743124 - RNA, 15 nt, Salmonella enterica enterica serovar Typhi Ty2
aggauaaccuuccgg

SEQ ID NO: 1743125 - RNA, 17 nt, Salmonella enterica enterica serovar Typhi Ty2
aggauaaaaucgccaaa

SEQ ID NO: 1743126 - RNA, 17 nt, Salmonella enterica enterica serovar Typhi Ty2
aggauaguacugaccag

SEQ ID NO: 1743127 - RNA, 20 nt, Salmonella enterica enterica serovar Typhi Ty2
aggaguaacagauagucgua

SEQ ID NO: 1743128 - RNA, 21 nt, Salmonella enterica enterica serovar Typhi Ty2
aggauauuuugcggcuucagc

SEQ ID NO: 1743129 - RNA, 15 nt, Salmonella enterica enterica serovar Typhi Ty2
aggauauuuauuugc

SEQ ID NO: 1743130 - RNA, 16 nt, Salmonella enterica enterica serovar Typhi Ty2
aggcauuuaugccgcc

SEQ ID NO: 1743131 - RNA, 19 nt, Salmonella enterica enterica serovar Typhi Ty2
aggcaagguuaacgucaga

SEQ ID NO: 1743132 - RNA, 17 nt, Salmonella enterica enterica serovar Typhi Ty2
aggcaacgacccgaagg

SEQ ID NO: 1743133 - RNA, 17 nt, Salmonella enterica enterica serovar Typhi Ty2
aggcaacggcccgaagg

SEQ ID NO: 1743134 - RNA, 19 nt, Salmonella enterica enterica serovar Typhi Ty2
aggcaagcugguaaaugcg

SEQ ID NO: 1743135 - RNA, 19 nt, Salmonella enterica enterica serovar Typhi Ty2
aggcaauauccuccggcgu

SEQ ID NO: 1743136 - RNA, 18 nt, Salmonella enterica enterica serovar Typhi Ty2
agauuagguacguacauc

SEQ ID NO: 1743137 - RNA, 19 nt, Salmonella enterica enterica serovar Typhi Ty2
agauuaugcaguucuucgc

SEQ ID NO: 1743138 - RNA, 19 nt, Salmonella enterica enterica serovar Typhi Ty2
agauuggcccgcccagcau

SEQ ID NO: 1743139 - RNA, 20 nt, Salmonella enterica enterica serovar Typhi Ty2
agauuuucaucauaucugau

SEQ ID NO: 1743140 - RNA, 10 nt, Salmonella enterica enterica serovar Typhi Ty2
agcaggcggg

SEQ ID NO: 1743141 - RNA, 15 nt, Salmonella enterica enterica serovar Typhi Ty2
agccagcgcagucaa

SEQ ID NO: 1743142 - RNA, 20 nt, Salmonella enterica enterica serovar Typhi Ty2
agccagcccuaaggucacgc

SEQ ID NO: 1743143 - RNA, 14 nt, Salmonella enterica enterica serovar Typhi Ty2
agccacucacggca

SEQ ID NO: 1743144 - RNA, 23 nt, Salmonella enterica enterica serovar Typhi Ty2
agccacgcaagcagcacacgccu

SEQ ID NO: 1743145 - RNA, 16 nt, Salmonella enterica enterica serovar Typhi Ty2
agcauaucaaacugaa

SEQ ID NO: 1743146 - RNA, 12 nt, Salmonella enterica enterica serovar Typhi Ty2
agcauaucgccg

SEQ ID NO: 1743147 - RNA, 21 nt, Salmonella enterica enterica serovar Typhi Ty2
agcauauucaccagagcauca

SEQ ID NO: 1743148 - RNA, 14 nt, Salmonella enterica enterica serovar Typhi Ty2
agccccgaugucgc

SEQ ID NO: 1743149 - RNA, 15 nt, Salmonella enterica enterica serovar Typhi Ty2
agccccagcgccagc

SEQ ID NO: 1743150 - RNA, 23 nt, Salmonella enterica enterica serovar Typhi Ty2
agccccccuuugcauuacggcga

SEQ ID NO: 1743151 - RNA, 21 nt, Salmonella enterica enterica serovar Typhi Ty2
agccaucccgcugaucgccgg

SEQ ID NO: 1743152 - RNA, 17 nt, Salmonella enterica enterica serovar Typhi Ty2
agccaucuucugcguca

SEQ ID NO: 1743153 - RNA, 21 nt, Salmonella enterica enterica serovar Typhi Ty2
agccccagcaccaacgccgcu

SEQ ID NO: 1743154 - RNA, 20 nt, Salmonella enterica enterica serovar Typhi Ty2
agccauuccccacgccaucg

SEQ ID NO: 1743155 - RNA, 15 nt, Salmonella enterica enterica serovar Typhi Ty2
agccgcgcagcgcaa

SEQ ID NO: 1743156 - RNA, 14 nt, Salmonella enterica enterica serovar Typhi Ty2
agccgauaguccgg

SEQ ID NO: 1743157 - RNA, 16 nt, Salmonella enterica enterica serovar Typhi Ty2
agccggauaagccgcg

SEQ ID NO: 1743158 - RNA, 20 nt, Salmonella enterica enterica serovar Typhi Ty2
agccggauaagcguagcgcc

SEQ ID NO: 1743159 - RNA, 19 nt, Salmonella enterica enterica serovar Typhi Ty2
agccggauguaggccugau

SEQ ID NO: 1743160 - RNA, 21 nt, Salmonella enterica enterica serovar Typhi Ty2
agccggaaaucaauuccgguu

SEQ ID NO: 1743161 - RNA, 21 nt, Salmonella enterica enterica serovar Typhi Ty2
agccggaauauugagaauaaa

SEQ ID NO: 1743162 - RNA, 13 nt, Salmonella enterica enterica serovar Typhi Ty2
agccggagccggu

SEQ ID NO: 1743163 - RNA, 22 nt, Salmonella enterica enterica serovar Typhi Ty2
agccgugaauggucacauucug

SEQ ID NO: 1743164 - RNA, 14 nt, Salmonella enterica enterica serovar Typhi Ty2
agccucgcgcaucc

SEQ ID NO: 1743165 - RNA, 12 nt, Salmonella enterica enterica serovar Typhi Ty2
agccuugcaucu

SEQ ID NO: 1743166 - RNA, 13 nt, Salmonella enterica enterica serovar Typhi Ty2
agccuugccgcaa

SEQ ID NO: 1743167 - RNA, 22 nt, Salmonella enterica enterica serovar Typhi Ty2
agccuucuccccuucaucagua

SEQ ID NO: 1743168 - RNA, 17 nt, Salmonella enterica enterica serovar Typhi Ty2
agccugaagccagcaau

SEQ ID NO: 1743169 - RNA, 20 nt, Salmonella enterica enterica serovar Typhi Ty2
agccuuacaggcgcaucaga

SEQ ID NO: 1743170 - RNA, 22 nt, Salmonella enterica enterica serovar Typhi Ty2
agcgcauacgcuguccagucaa

SEQ ID NO: 1743171 - RNA, 21 nt, Salmonella enterica enterica serovar Typhi Ty2
agcgcauagcggccagauggc

SEQ ID NO: 1743172 - RNA, 15 nt, Salmonella enterica enterica serovar Typhi Ty2
agcgcauccgguaaa

SEQ ID NO: 1743173 - RNA, 18 nt, Salmonella enterica enterica serovar Typhi Ty2
agcgcauuuuacugccgu

SEQ ID NO: 1743174 - RNA, 14 nt, Salmonella enterica enterica serovar Typhi Ty2
agcgcauugacgau

SEQ ID NO: 1743175 - RNA, 19 nt, Salmonella enterica enterica serovar Typhi Ty2
agcgccggcagcaguucuu

SEQ ID NO: 1743176 - RNA, 17 nt, Salmonella enterica enterica serovar Typhi Ty2
agcgcccagcgccggau

SEQ ID NO: 1743177 - RNA, 19 nt, Salmonella enterica enterica serovar Typhi Ty2
agcgccagcccugcgauca

SEQ ID NO: 1743178 - RNA, 16 nt, Salmonella enterica enterica serovar Typhi Ty2
agcgaucacgccgucc

SEQ ID NO: 1743179 - RNA, 16 nt, Salmonella enterica enterica serovar Typhi Ty2
agcgauauagcgcaua

SEQ ID NO: 1743180 - RNA, 22 nt, Salmonella enterica enterica serovar Typhi Ty2
agcgauauagcgcauagcggcc

SEQ ID NO: 1743181 - RNA, 17 nt, Salmonella enterica enterica serovar Typhi Ty2
agcgauuacgccagaca

SEQ ID NO: 1743182 - RNA, 17 nt, Salmonella enterica enterica serovar Typhi Ty2
agcgaugagcgccagca

SEQ ID NO: 1743183 - RNA, 18 nt, Salmonella enterica enterica serovar Typhi Ty2
agcgcagaagcagaccga

SEQ ID NO: 1743184 - RNA, 13 nt, Salmonella enterica enterica serovar Typhi Ty2
agcgcagcaacgg

SEQ ID NO: 1743185 - RNA, 16 nt, Salmonella enterica enterica serovar Typhi Ty2
agcgcaacgcgcauca

SEQ ID NO: 1743186 - RNA, 12 nt, Salmonella enterica enterica serovar Typhi Ty2
agcgcaacgccu

SEQ ID NO: 1743187 - RNA, 20 nt, Salmonella enterica enterica serovar Typhi Ty2
agcgaccuguagaugaaacu

SEQ ID NO: 1743188 - RNA, 20 nt, Salmonella enterica enterica serovar Typhi Ty2
agcgaccggcacucaccucu

SEQ ID NO: 1743189 - RNA, 12 nt, Salmonella enterica enterica serovar Typhi Ty2
agcgacugauaa

SEQ ID NO: 1743190 - RNA, 16 nt, Salmonella enterica enterica serovar Typhi Ty2
aucccccugccacaac

SEQ ID NO: 1743191 - RNA, 13 nt, Salmonella enterica enterica serovar Typhi Ty2
auccccggcaggc

SEQ ID NO: 1743192 - RNA, 20 nt, Salmonella enterica enterica serovar Typhi Ty2
aucccacuccaucgccugau

SEQ ID NO: 1743193 - RNA, 19 nt, Salmonella enterica enterica serovar Typhi Ty2
auccaugauggcguaaucc

SEQ ID NO: 1743194 - RNA, 19 nt, Salmonella enterica enterica serovar Typhi Ty2
auccauugcgccacggaug

SEQ ID NO: 1743195 - RNA, 13 nt, Salmonella enterica enterica serovar Typhi Ty2
aucccaccagcag

SEQ ID NO: 1743196 - RNA, 16 nt, Salmonella enterica enterica serovar Typhi Ty2
auccaguacgucaaca

SEQ ID NO: 1743197 - RNA, 15 nt, Salmonella enterica enterica serovar Typhi Ty2
aucccggcguagcgc

SEQ ID NO: 1743198 - RNA, 23 nt, Salmonella enterica enterica serovar Typhi Ty2
aucccggcgacagcgaccacgac

SEQ ID NO: 1743199 - RNA, 14 nt, Salmonella enterica enterica serovar Typhi Ty2
aucccgaauggcgu

SEQ ID NO: 1743200 - RNA, 14 nt, Salmonella enterica enterica serovar Typhi Ty2
aucccgcaggcggc

SEQ ID NO: 1743201 - RNA, 19 nt, Salmonella enterica enterica serovar Typhi Ty2
aucccgccagcggcgccau

SEQ ID NO: 1743202 - RNA, 23 nt, Salmonella enterica enterica serovar Typhi Ty2
aucccgcugugauccauguugcc

SEQ ID NO: 1743203 - RNA, 19 nt, Salmonella enterica enterica serovar Typhi Ty2
aucauuggauuaacggcaa

SEQ ID NO: 1743204 - RNA, 20 nt, Salmonella enterica enterica serovar Typhi Ty2
aucauugucauuaacgucgc

SEQ ID NO: 1743205 - RNA, 19 nt, Salmonella enterica enterica serovar Typhi Ty2
aucauuuuuuuggcuucug

SEQ ID NO: 1743206 - RNA, 23 nt, Salmonella enterica enterica serovar Typhi Ty2
aucauugccuguaucgcuauccg

SEQ ID NO: 1743207 - RNA, 19 nt, Salmonella enterica enterica serovar Typhi Ty2
aucauuaccugucgcccau

SEQ ID NO: 1743208 - RNA, 19 nt, Salmonella enterica enterica serovar Typhi Ty2
aucauuaauuuacugauaa

SEQ ID NO: 1743209 - RNA, 19 nt, Salmonella enterica enterica serovar Typhi Ty2
aucaugcugcaccgcauca

SEQ ID NO: 1743210 - RNA, 19 nt, Salmonella enterica enterica serovar Typhi Ty2
auccagguggaucggaaau

SEQ ID NO: 1743211 - RNA, 21 nt, Salmonella enterica enterica serovar Typhi Ty2
auccagguggaucggaaauca

SEQ ID NO: 1743212 - RNA, 20 nt, Salmonella enterica enterica serovar Typhi Ty2
auccagcgggccgacgauaa

SEQ ID NO: 1743213 - RNA, 14 nt, Salmonella enterica enterica serovar Typhi Ty2
auccagcgucgcca

SEQ ID NO: 1743214 - RNA, 22 nt, Salmonella enterica enterica serovar Typhi Ty2
auccaggagcauuggaaauuca

SEQ ID NO: 1743215 - RNA, 18 nt, Salmonella enterica enterica serovar Typhi Ty2
auccagcuugccgucaca

SEQ ID NO: 1743216 - RNA, 16 nt, Salmonella enterica enterica serovar Typhi Ty2
auccacuuuucgcgga

SEQ ID NO: 1743217 - RNA, 18 nt, Salmonella enterica enterica serovar Typhi Ty2
auccagaucggcaugaug

SEQ ID NO: 1743218 - RNA, 18 nt, Salmonella enterica enterica serovar Typhi Ty2
auccuguuaaucaucgcu

SEQ ID NO: 1743219 - RNA, 18 nt, Salmonella enterica enterica serovar Typhi Ty2
auccuguagguucgguau

SEQ ID NO: 1743220 - RNA, 22 nt, Salmonella enterica enterica serovar Typhi Ty2
auccuuuaaucgccgugcccaa

SEQ ID NO: 1743221 - RNA, 17 nt, Salmonella enterica enterica serovar Typhi Ty2
auccugcaggguaauua

SEQ ID NO: 1743222 - RNA, 20 nt, Salmonella enterica enterica serovar Typhi Ty2
auccugaguauaaaacucgc

SEQ ID NO: 1743223 - RNA, 21 nt, Salmonella enterica enterica serovar Typhi Ty2
auccugcacccgccuuaccca

SEQ ID NO: 1743224 - RNA, 19 nt, Salmonella enterica enterica serovar Typhi Ty2
auccugcauaauccaacga

SEQ ID NO: 1743225 - RNA, 22 nt, Salmonella enterica enterica serovar Typhi Ty2
auccuggaagauguugccguaa

SEQ ID NO: 1743226 - RNA, 14 nt, Salmonella enterica enterica serovar Typhi Ty2
auccggcuguucga

SEQ ID NO: 1743227 - RNA, 14 nt, Salmonella enterica enterica serovar Typhi Ty2
auccgucuggcgau

SEQ ID NO: 1743228 - RNA, 19 nt, Salmonella enterica enterica serovar Typhi Ty2
auccgucaaaaugaucaga

SEQ ID NO: 1743229 - RNA, 23 nt, Salmonella enterica enterica serovar Typhi Ty2
auccggacgauaaccaugcucag

SEQ ID NO: 1743230 - RNA, 14 nt, Salmonella enterica enterica serovar Typhi Ty2
auccgcguuaccca

SEQ ID NO: 1743231 - RNA, 13 nt, Salmonella enterica enterica serovar Typhi Ty2
auccggcggcguc

SEQ ID NO: 1743232 - RNA, 21 nt, Salmonella enterica enterica serovar Typhi Ty2
auccggcgcgguauuucgccg

SEQ ID NO: 1743233 - RNA, 13 nt, Salmonella enterica enterica serovar Typhi Ty2
auccggccugcac

SEQ ID NO: 1743234 - RNA, 15 nt, Salmonella enterica enterica serovar Typhi Ty2
auccggcauuaccgc

SEQ ID NO: 1743235 - RNA, 16 nt, Salmonella enterica enterica serovar Typhi Ty2
auccggcauuaccgcu

SEQ ID NO: 1743236 - RNA, 20 nt, Salmonella enterica enterica serovar Typhi Ty2
auccgcgccgccgccgaagg

SEQ ID NO: 1743237 - RNA, 19 nt, Salmonella enterica enterica serovar Typhi Ty2
auccgccgcccagcgggua

SEQ ID NO: 1743238 - RNA, 19 nt, Salmonella enterica enterica serovar Typhi Ty2
auccgccgagggcauugau

SEQ ID NO: 1743239 - RNA, 20 nt, Salmonella enterica enterica serovar Typhi Ty2
auccgccaguuuguaaccaa

SEQ ID NO: 1743240 - RNA, 16 nt, Salmonella enterica enterica serovar Typhi Ty2
auccgccagccgccau

SEQ ID NO: 1743241 - RNA, 13 nt, Salmonella enterica enterica serovar Typhi Ty2
auccgcacggcgg

SEQ ID NO: 1743242 - RNA, 19 nt, Salmonella enterica enterica serovar Typhi Ty2
auccgacaugaugccaaau

SEQ ID NO: 1743243 - RNA, 17 nt, Salmonella enterica enterica serovar Typhi Ty2
aucaggucaugcgcgag

SEQ ID NO: 1743244 - RNA, 19 nt, Salmonella enterica enterica serovar Typhi Ty2
aucagcugauauaacgugc

SEQ ID NO: 1743245 - RNA, 18 nt, Salmonella enterica enterica serovar Typhi Ty2
aucagucucaaaggccug

SEQ ID NO: 1743246 - RNA, 20 nt, Salmonella enterica enterica serovar Typhi Ty2
aucaguuuaaccguuccaac

SEQ ID NO: 1743247 - RNA, 20 nt, Salmonella enterica enterica serovar Typhi Ty2
aucaucucugucgaccaucg

SEQ ID NO: 1743248 - RNA, 22 nt, Salmonella enterica enterica serovar Typhi Ty2
aucaugauuucuugagcggcau

SEQ ID NO: 1743249 - RNA, 15 nt, Salmonella enterica enterica serovar Typhi Ty2
aucaucacgaucgag

SEQ ID NO: 1743250 - RNA, 17 nt, Salmonella enterica enterica serovar Typhi Ty2
aucaucaggguuauccu

SEQ ID NO: 1743251 - RNA, 17 nt, Salmonella enterica enterica serovar Typhi Ty2
aucauccccggcaggcu

SEQ ID NO: 1743252 - RNA, 17 nt, Salmonella enterica enterica serovar Typhi Ty2
aucagccauuaaccaga

SEQ ID NO: 1743253 - RNA, 14 nt, Salmonella enterica enterica serovar Typhi Ty2
aucagacgcaucag

SEQ ID NO: 1743254 - RNA, 22 nt, Salmonella enterica enterica serovar Typhi Ty2
aucagaccaucggccgcuaucu

SEQ ID NO: 1743255 - RNA, 23 nt, Salmonella enterica enterica serovar Typhi Ty2
aucacgcugaaaacggcaucaag

SEQ ID NO: 1743256 - RNA, 22 nt, Salmonella enterica enterica serovar Typhi Ty2
aucacgguauucguuaccagca

SEQ ID NO: 1743257 - RNA, 23 nt, Salmonella enterica enterica serovar Typhi Ty2
aucagaacaaacuuaucccacaa

SEQ ID NO: 1743258 - RNA, 13 nt, Salmonella enterica enterica serovar Typhi Ty2
aucacuuuuggcg

SEQ ID NO: 1743259 - RNA, 15 nt, Salmonella enterica enterica serovar Typhi Ty2
aucagaaaacagcau

SEQ ID NO: 1743260 - RNA, 16 nt, Salmonella enterica enterica serovar Typhi Ty2
aucacuuccgccacca

SEQ ID NO: 1743261 - RNA, 20 nt, Salmonella enterica enterica serovar Typhi Ty2
aucacuuaucaaaccagcuu

SEQ ID NO: 1743262 - RNA, 22 nt, Salmonella enterica enterica serovar Typhi Ty2
aucacgccacaguauuccggca

SEQ ID NO: 1743263 - RNA, 20 nt, Salmonella enterica enterica serovar Typhi Ty2
aucaccgcccaaugccccca

SEQ ID NO: 1743264 - RNA, 22 nt, Salmonella enterica enterica serovar Typhi Ty2
aucaauaaaaucaccgcggcaa

SEQ ID NO: 1743265 - RNA, 20 nt, Salmonella enterica enterica serovar Typhi Ty2
auauuuuuacgucccgguaa

SEQ ID NO: 1743266 - RNA, 15 nt, Salmonella enterica enterica serovar Typhi Ty2
aucaaaagugaucau

SEQ ID NO: 1743267 - RNA, 20 nt, Salmonella enterica enterica serovar Typhi Ty2
auauugcugugcuaugauaa

SEQ ID NO: 1743268 - RNA, 16 nt, Salmonella enterica enterica serovar Typhi Ty2
aucaaacauagagauc

SEQ ID NO: 1743269 - RNA, 14 nt, Salmonella enterica enterica serovar Typhi Ty2
aucaacgccgccag

SEQ ID NO: 1743270 - RNA, 20 nt, Salmonella enterica enterica serovar Typhi Ty2
aucaaacccuuccgcaucga

SEQ ID NO: 1743271 - RNA, 23 nt, Salmonella enterica enterica serovar Typhi Ty2
auauucgcgaugcucaaccagua

SEQ ID NO: 1743272 - RNA, 17 nt, Salmonella enterica enterica serovar Typhi Ty2
auauugauggccacauc

SEQ ID NO: 1743273 - RNA, 19 nt, Salmonella enterica enterica serovar Typhi Ty2
auauugcgcuuaccaggua

SEQ ID NO: 1743274 - RNA, 16 nt, Salmonella enterica enterica serovar Typhi Ty2
auauuccgcgcuaucg

SEQ ID NO: 1743275 - RNA, 23 nt, Salmonella enterica enterica serovar Typhi Ty2
auauucaguacugacgcaaucug

SEQ ID NO: 1743276 - RNA, 16 nt, Salmonella enterica enterica serovar Typhi Ty2
auauccaguugcgcca

SEQ ID NO: 1743277 - RNA, 18 nt, Salmonella enterica enterica serovar Typhi Ty2
auauauuucacuucauca

SEQ ID NO: 1743278 - RNA, 19 nt, Salmonella enterica enterica serovar Typhi Ty2
auaucaagagaaccaacgc

SEQ ID NO: 1743279 - RNA, 21 nt, Salmonella enterica enterica serovar Typhi Ty2
auaucagccccacggcaaauu

SEQ ID NO: 1743280 - RNA, 14 nt, Salmonella enterica enterica serovar Typhi Ty2
auaucagccccacg

SEQ ID NO: 1743281 - RNA, 22 nt, Salmonella enterica enterica serovar Typhi Ty2
auaucagggcuuuuuucucgcg

SEQ ID NO: 1743282 - RNA, 13 nt, Salmonella enterica enterica serovar Typhi Ty2
auaucaucgucau

SEQ ID NO: 1743283 - RNA, 13 nt, Salmonella enterica enterica serovar Typhi Ty2
auauccaggagca

SEQ ID NO: 1743284 - RNA, 14 nt, Salmonella enterica enterica serovar Typhi Ty2
auauccacguugau

SEQ ID NO: 1743285 - RNA, 18 nt, Salmonella enterica enterica serovar Typhi Ty2
auagugacgccgccaucc

SEQ ID NO: 1743286 - RNA, 17 nt, Salmonella enterica enterica serovar Typhi Ty2
auagucguugcgccgua

SEQ ID NO: 1743287 - RNA, 20 nt, Salmonella enterica enterica serovar Typhi Ty2
auagucgucuauuuccgcuu

SEQ ID NO: 1743288 - RNA, 16 nt, Salmonella enterica enterica serovar Typhi Ty2
auaguccagcagccau

SEQ ID NO: 1743289 - RNA, 18 nt, Salmonella enterica enterica serovar Typhi Ty2
auacagcggcgcgccaau

SEQ ID NO: 1743290 - RNA, 20 nt, Salmonella enterica enterica serovar Typhi Ty2
auaccacccgcuaugaagac

SEQ ID NO: 1743291 - RNA, 17 nt, Salmonella enterica enterica serovar Typhi Ty2
auaccacgcagcggcau

SEQ ID NO: 1743292 - RNA, 23 nt, Salmonella enterica enterica serovar Typhi Ty2
auaccacgcccgccgccagcauu

SEQ ID NO: 1743293 - RNA, 19 nt, Salmonella enterica enterica serovar Typhi Ty2
auaccaggugccgagguaa

SEQ ID NO: 1743294 - RNA, 16 nt, Salmonella enterica enterica serovar Typhi Ty2
auaccaccugccaaag

SEQ ID NO: 1743295 - RNA, 17 nt, Salmonella enterica enterica serovar Typhi Ty2
auagcuucaaugaucca

SEQ ID NO: 1743296 - RNA, 14 nt, Salmonella enterica enterica serovar Typhi Ty2
auagcuguuccgca

SEQ ID NO: 1743297 - RNA, 17 nt, Salmonella enterica enterica serovar Typhi Ty2
auagcguagcgccaucc

SEQ ID NO: 1743298 - RNA, 20 nt, Salmonella enterica enterica serovar Typhi Ty2
auagcguuuuuucaucggca

SEQ ID NO: 1743299 - RNA, 23 nt, Salmonella enterica enterica serovar Typhi Ty2
auagcguuuuauccguuuccgca

SEQ ID NO: 1743300 - RNA, 14 nt, Salmonella enterica enterica serovar Typhi Ty2
auagcggcuaccgc

SEQ ID NO: 1743301 - RNA, 22 nt, Salmonella enterica enterica serovar Typhi Ty2
auaauuaucguuuacguuauca

SEQ ID NO: 1743302 - RNA, 13 nt, Salmonella enterica enterica serovar Typhi Ty2
auaauucauaaca

SEQ ID NO: 1743303 - RNA, 13 nt, Salmonella enterica enterica serovar Typhi Ty2
auacaccgcaucc

SEQ ID NO: 1743304 - RNA, 17 nt, Salmonella enterica enterica serovar Typhi Ty2
auaaugaauacgcucca

SEQ ID NO: 1743305 - RNA, 23 nt, Salmonella enterica enterica serovar Typhi Ty2
auaaucuaccauugauaccaaua

SEQ ID NO: 1743306 - RNA, 23 nt, Salmonella enterica enterica serovar Typhi Ty2
auaaugcgccccgcaacgccgau

SEQ ID NO: 1743307 - RNA, 15 nt, Salmonella enterica enterica serovar Typhi Ty2
auaaugcuuacggca

SEQ ID NO: 1743308 - RNA, 19 nt, Salmonella enterica enterica serovar Typhi Ty2
auaauggcgcgaaaacagc

SEQ ID NO: 1743309 - RNA, 21 nt, Salmonella enterica enterica serovar Typhi Ty2
auaaucgcgauacugccgccc

SEQ ID NO: 1743310 - RNA, 11 nt, Salmonella enterica enterica serovar Typhi Ty2
auaaucaggag

SEQ ID NO: 1743311 - RNA, 20 nt, Salmonella enterica enterica serovar Typhi Ty2
auaaggccugccguccugau

SEQ ID NO: 1743312 - RNA, 13 nt, Salmonella enterica enterica serovar Typhi Ty2
auaaggcguucac

SEQ ID NO: 1743313 - RNA, 17 nt, Salmonella enterica enterica serovar Typhi Ty2
auaauauuauugacgcu

SEQ ID NO: 1743314 - RNA, 22 nt, Salmonella enterica enterica serovar Typhi Ty2
auaaucacaggggucaucggca

SEQ ID NO: 1743315 - RNA, 17 nt, Salmonella enterica enterica serovar Typhi Ty2
auaagcgugcgccaucc

SEQ ID NO: 1743316 - RNA, 19 nt, Salmonella enterica enterica serovar Typhi Ty2
auaagcggcagcgccaucc

SEQ ID NO: 1743317 - RNA, 17 nt, Salmonella enterica enterica serovar Typhi Ty2
auaagcuauugcgcuuu

SEQ ID NO: 1743318 - RNA, 18 nt, Salmonella enterica enterica serovar Typhi Ty2
auaagcgcagcgccauca

SEQ ID NO: 1743319 - RNA, 17 nt, Salmonella enterica enterica serovar Typhi Ty2
auaagcgccgucauccg

SEQ ID NO: 1743320 - RNA, 20 nt, Salmonella enterica enterica serovar Typhi Ty2
auaagccgaucuuuaccuca

SEQ ID NO: 1743321 - RNA, 16 nt, Salmonella enterica enterica serovar Typhi Ty2
aguuagcgaucgcgcc

SEQ ID NO: 1743322 - RNA, 18 nt, Salmonella enterica enterica serovar Typhi Ty2
aguuaucgguaauugcgc

SEQ ID NO: 1743323 - RNA, 16 nt, Salmonella enterica enterica serovar Typhi Ty2
aguugguucccagcac

SEQ ID NO: 1743324 - RNA, 22 nt, Salmonella enterica enterica serovar Typhi Ty2
aguuggaaccaaacaccagauc

SEQ ID NO: 1743325 - RNA, 19 nt, Salmonella enterica enterica serovar Typhi Ty2
auaaaggccggcagccgcu

SEQ ID NO: 1743326 - RNA, 21 nt, Salmonella enterica enterica serovar Typhi Ty2
auaaagcggacugccuaacug

SEQ ID NO: 1743327 - RNA, 14 nt, Salmonella enterica enterica serovar Typhi Ty2
auaaauaaugccgu

SEQ ID NO: 1743328 - RNA, 16 nt, Salmonella enterica enterica serovar Typhi Ty2
auaaacgcugcgcaac

SEQ ID NO: 1743329 - RNA, 16 nt, Salmonella enterica enterica serovar Typhi Ty2
auaaacgcuugacucu

SEQ ID NO: 1743330 - RNA, 21 nt, Salmonella enterica enterica serovar Typhi Ty2
auaaacucaaucaggcuaucg

SEQ ID NO: 1743331 - RNA, 16 nt, Salmonella enterica enterica serovar Typhi Ty2
auaaaccaaagcagag

SEQ ID NO: 1743332 - RNA, 17 nt, Salmonella enterica enterica serovar Typhi Ty2
auaaaccuucguaauag

SEQ ID NO: 1743333 - RNA, 18 nt, Salmonella enterica enterica serovar Typhi Ty2
auaaacacgauggcaaau

SEQ ID NO: 1743334 - RNA, 21 nt, Salmonella enterica enterica serovar Typhi Ty2
agucgguuaugcauugcugau

SEQ ID NO: 1743335 - RNA, 17 nt, Salmonella enterica enterica serovar Typhi Ty2
agucgugaugcauacgg

SEQ ID NO: 1743336 - RNA, 19 nt, Salmonella enterica enterica serovar Typhi Ty2
agugaucccccagaaucgg

SEQ ID NO: 1743337 - RNA, 24 nt, Salmonella enterica enterica serovar Typhi Ty2
aguuaccguaaucaucgcgaucgc

SEQ ID NO: 1743338 - RNA, 12 nt, Salmonella enterica enterica serovar Typhi Ty2
aguguuuccggc

SEQ ID NO: 1743339 - RNA, 13 nt, Salmonella enterica enterica serovar Typhi Ty2
aguguuaucgccg

SEQ ID NO: 1743340 - RNA, 15 nt, Salmonella enterica enterica serovar Typhi Ty2
agugccgccaggcaa

SEQ ID NO: 1743341 - RNA, 21 nt, Salmonella enterica enterica serovar Typhi Ty2
agugcccguuugcgagacggc

SEQ ID NO: 1743342 - RNA, 12 nt, Salmonella enterica enterica serovar Typhi Ty2
aguggcggcaau

SEQ ID NO: 1743343 - RNA, 20 nt, Salmonella enterica enterica serovar Typhi Ty2
agugccugcuggagccggaa

SEQ ID NO: 1743344 - RNA, 14 nt, Salmonella enterica enterica serovar Typhi Ty2
agucgauacgcuga

SEQ ID NO: 1743345 - RNA, 16 nt, Salmonella enterica enterica serovar Typhi Ty2
agucgcaucauggcga

SEQ ID NO: 1743346 - RNA, 13 nt, Salmonella enterica enterica serovar Typhi Ty2
agucgccaggauc

SEQ ID NO: 1743347 - RNA, 21 nt, Salmonella enterica enterica serovar Typhi Ty2
aguccgucguuaaucagcgcg

SEQ ID NO: 1743348 - RNA, 22 nt, Salmonella enterica enterica serovar Typhi Ty2
aguccugaugauggaaaacgcg

SEQ ID NO: 1743349 - RNA, 14 nt, Salmonella enterica enterica serovar Typhi Ty2
aguccgucagaaua

SEQ ID NO: 1743350 - RNA, 19 nt, Salmonella enterica enterica serovar Typhi Ty2
aguccgccgucgucaccgc

SEQ ID NO: 1743351 - RNA, 15 nt, Salmonella enterica enterica serovar Typhi Ty2
aguccggacgcccgg

SEQ ID NO: 1743352 - RNA, 19 nt, Salmonella enterica enterica serovar Typhi Ty2
agucgagggugauuuccgc

SEQ ID NO: 1743353 - RNA, 17 nt, Salmonella enterica enterica serovar Typhi Ty2
aguccugucccugccag

SEQ ID NO: 1743354 - RNA, 23 nt, Salmonella enterica enterica serovar Typhi Ty2
aguccugccaccagcguaccggc

SEQ ID NO: 1743355 - RNA, 17 nt, Salmonella enterica enterica serovar Typhi Ty2
agucagcgcgagcguga

SEQ ID NO: 1743356 - RNA, 17 nt, Salmonella enterica enterica serovar Typhi Ty2
agucauauuaucgcgcu

SEQ ID NO: 1743357 - RNA, 13 nt, Salmonella enterica enterica serovar Typhi Ty2
aguagcggaauau

SEQ ID NO: 1743358 - RNA, 17 nt, Salmonella enterica enterica serovar Typhi Ty2
aguagcugagcgucagg

SEQ ID NO: 1743359 - RNA, 18 nt, Salmonella enterica enterica serovar Typhi Ty2
agucccuggcgcgccagc

SEQ ID NO: 1743360 - RNA, 21 nt, Salmonella enterica enterica serovar Typhi Ty2
aguccauauccguacauaaca

SEQ ID NO: 1743361 - RNA, 18 nt, Salmonella enterica enterica serovar Typhi Ty2
agguucgacucgagcaau

SEQ ID NO: 1743362 - RNA, 16 nt, Salmonella enterica enterica serovar Typhi Ty2
agguuauccgccggag

SEQ ID NO: 1743363 - RNA, 15 nt, Salmonella enterica enterica serovar Typhi Ty2
agguuauauuccgcc

SEQ ID NO: 1743364 - RNA, 22 nt, Salmonella enterica enterica serovar Typhi Ty2
agguuauaaacccccuggccgg

SEQ ID NO: 1743365 - RNA, 23 nt, Salmonella enterica enterica serovar Typhi Ty2
aguaccugcccggcaacgggcaa

SEQ ID NO: 1743366 - RNA, 18 nt, Salmonella enterica enterica serovar Typhi Ty2
aguacgagcauccagauc

SEQ ID NO: 1743367 - RNA, 15 nt, Salmonella enterica enterica serovar Typhi Ty2
aguaauuccauuagc

SEQ ID NO: 1743368 - RNA, 17 nt, Salmonella enterica enterica serovar Typhi Ty2
aggucgcgauccgcgag

SEQ ID NO: 1743369 - RNA, 15 nt, Salmonella enterica enterica serovar Typhi Ty2
aggucugcaccacgg

SEQ ID NO: 1743370 - RNA, 14 nt, Salmonella enterica enterica serovar Typhi Ty2
aggccgccaaugac

SEQ ID NO: 1743371 - RNA, 17 nt, Salmonella enterica enterica serovar Typhi Ty2
aggcgucgaccggucca

SEQ ID NO: 1743372 - RNA, 20 nt, Salmonella enterica enterica serovar Typhi Ty2
aggcguuaccgggcaaacgg

SEQ ID NO: 1743373 - RNA, 18 nt, Salmonella enterica enterica serovar Typhi Ty2
aggcguuagcggcgauuc

SEQ ID NO: 1743374 - RNA, 18 nt, Salmonella enterica enterica serovar Typhi Ty2
aggcugcggacauuaacg

SEQ ID NO: 1743375 - RNA, 21 nt, Salmonella enterica enterica serovar Typhi Ty2
agggaaaaauguguugcggcc

SEQ ID NO: 1743376 - RNA, 16 nt, Salmonella enterica enterica serovar Typhi Ty2
agggaaaacaucgcuc

SEQ ID NO: 1743377 - RNA, 20 nt, Salmonella enterica enterica serovar Typhi Ty2
aggcuucggcuuuaucgccc

SEQ ID NO: 1743378 - RNA, 20 nt, Salmonella enterica enterica serovar Typhi Ty2
aggcuggagagcaacgccau

SEQ ID NO: 1743379 - RNA, 14 nt, Salmonella enterica enterica serovar Typhi Ty2
aggcuuccacgcac

SEQ ID NO: 1743380 - RNA, 22 nt, Salmonella enterica enterica serovar Typhi Ty2
agggaggugcucucccagcuga

SEQ ID NO: 1743381 - RNA, 22 nt, Salmonella enterica enterica serovar Typhi Ty2
agggcggaagcagauaccagcc

SEQ ID NO: 1743382 - RNA, 20 nt, Salmonella enterica enterica serovar Typhi Ty2
agggcaccugggcaauaacg

SEQ ID NO: 1743383 - RNA, 18 nt, Salmonella enterica enterica serovar Typhi Ty2
aggguuuucuaccgcagc

SEQ ID NO: 1743384 - RNA, 13 nt, Salmonella enterica enterica serovar Typhi Ty2
aggguaauaacgg

SEQ ID NO: 1743385 - RNA, 15 nt, Salmonella enterica enterica serovar Typhi Ty2
agggguuccggcaau

SEQ ID NO: 1743386 - RNA, 16 nt, Salmonella enterica enterica serovar Typhi Ty2
auuaaucccgccaucg

SEQ ID NO: 1743387 - RNA, 12 nt, Salmonella enterica enterica serovar Typhi Ty2
auuaaucgccag

SEQ ID NO: 1743388 - RNA, 16 nt, Salmonella enterica enterica serovar Typhi Ty2
auuaaugcgacgccca

SEQ ID NO: 1743389 - RNA, 10 nt, Salmonella enterica enterica serovar Typhi Ty2
auuaccagua

SEQ ID NO: 1743390 - RNA, 21 nt, Salmonella enterica enterica serovar Typhi Ty2
auuacaacgccugaugacgcu

SEQ ID NO: 1743391 - RNA, 17 nt, Salmonella enterica enterica serovar Typhi Ty2
auuacaaagggcaauau

SEQ ID NO: 1743392 - RNA, 17 nt, Salmonella enterica enterica serovar Typhi Ty2
auuaucguuuacguuau

SEQ ID NO: 1743393 - RNA, 16 nt, Salmonella enterica enterica serovar Typhi Ty2
auuaucguccggcauc

SEQ ID NO: 1743394 - RNA, 17 nt, Salmonella enterica enterica serovar Typhi Ty2
auucaccaaauccucac

SEQ ID NO: 1743395 - RNA, 14 nt, Salmonella enterica enterica serovar Typhi Ty2
auucaccaacugcu

SEQ ID NO: 1743396 - RNA, 19 nt, Salmonella enterica enterica serovar Typhi Ty2
auucaccgcaugacaauau

SEQ ID NO: 1743397 - RNA, 12 nt, Salmonella enterica enterica serovar Typhi Ty2
auuaccgcaucg

SEQ ID NO: 1743398 - RNA, 17 nt, Salmonella enterica enterica serovar Typhi Ty2
auuaccggcugccgaua

SEQ ID NO: 1743399 - RNA, 21 nt, Salmonella enterica enterica serovar Typhi Ty2
auuacucguccuucacguuau

SEQ ID NO: 1743400 - RNA, 21 nt, Salmonella enterica enterica serovar Typhi Ty2
auuacugaccgagaucaggcc

SEQ ID NO: 1743401 - RNA, 22 nt, Salmonella enterica enterica serovar Typhi Ty2
auucccacgcauaguccugccg

SEQ ID NO: 1743402 - RNA, 14 nt, Salmonella enterica enterica serovar Typhi Ty2
auucccaggcaaau

SEQ ID NO: 1743403 - RNA, 20 nt, Salmonella enterica enterica serovar Typhi Ty2
auucagcugcggcugaacca

SEQ ID NO: 1743404 - RNA, 18 nt, Salmonella enterica enterica serovar Typhi Ty2
auucaggguugucucaga

SEQ ID NO: 1743405 - RNA, 19 nt, Salmonella enterica enterica serovar Typhi Ty2
auucacgccaccauccgac

SEQ ID NO: 1743406 - RNA, 16 nt, Salmonella enterica enterica serovar Typhi Ty2
auucacgcagcuuauu

SEQ ID NO: 1743407 - RNA, 22 nt, Salmonella enterica enterica serovar Typhi Ty2
auucaccaccacccgaucgccc

SEQ ID NO: 1743408 - RNA, 18 nt, Salmonella enterica enterica serovar Typhi Ty2
auucacuuucgacgacaa

SEQ ID NO: 1743409 - RNA, 15 nt, Salmonella enterica enterica serovar Typhi Ty2
aaacugacugaugcu

SEQ ID NO: 1743410 - RNA, 17 nt, Salmonella enterica enterica serovar Typhi Ty2
auuccgccaacgguaag

SEQ ID NO: 1743411 - RNA, 13 nt, Salmonella enterica enterica serovar Typhi Ty2
aaacucaacuggg

SEQ ID NO: 1743412 - RNA, 15 nt, Salmonella enterica enterica serovar Typhi Ty2
auucgccccagcaua

SEQ ID NO: 1743413 - RNA, 21 nt, Salmonella enterica enterica serovar Typhi Ty2
auuccgcuuucuucccggcag

SEQ ID NO: 1743414 - RNA, 12 nt, Salmonella enterica enterica serovar Typhi Ty2
auuucgaucugu

SEQ ID NO: 1743415 - RNA, 19 nt, Salmonella enterica enterica serovar Typhi Ty2
auuucgcgaauaaucuguu

SEQ ID NO: 1743416 - RNA, 16 nt, Salmonella enterica enterica serovar Typhi Ty2
auuucggaaugagaga

SEQ ID NO: 1743417 - RNA, 19 nt, Salmonella enterica enterica serovar Typhi Ty2
auuucaccgucaauaacgg

SEQ ID NO: 1743418 - RNA, 22 nt, Salmonella enterica enterica serovar Typhi Ty2
auuucaucguagucguagaaca

SEQ ID NO: 1743419 - RNA, 21 nt, Salmonella enterica enterica serovar Typhi Ty2
auuuacaaaugaccucaagaa

SEQ ID NO: 1743420 - RNA, 21 nt, Salmonella enterica enterica serovar Typhi Ty2
auugugguguuccauugcugc

SEQ ID NO: 1743421 - RNA, 14 nt, Salmonella enterica enterica serovar Typhi Ty2
auuuauccuccgaa

SEQ ID NO: 1743422 - RNA, 23 nt, Salmonella enterica enterica serovar Typhi Ty2
auuuauccaccgccagacgcccc

SEQ ID NO: 1743423 - RNA, 18 nt, Salmonella enterica enterica serovar Typhi Ty2
auuuaucuuccggcauca

SEQ ID NO: 1743424 - RNA, 14 nt, Salmonella enterica enterica serovar Typhi Ty2
auuucaaaacccgc

SEQ ID NO: 1743425 - RNA, 14 nt, Salmonella enterica enterica serovar Typhi Ty2
auuucaaucgcgcc

SEQ ID NO: 1743426 - RNA, 13 nt, Salmonella enterica enterica serovar Typhi Ty2
auuucaaucgcgc

SEQ ID NO: 1743427 - RNA, 19 nt, Salmonella enterica enterica serovar Typhi Ty2
auuucaaugcauacugccg

SEQ ID NO: 1743428 - RNA, 23 nt, Salmonella enterica enterica serovar Typhi Ty2
auugccaugcgacuaaccugauc

SEQ ID NO: 1743429 - RNA, 13 nt, Salmonella enterica enterica serovar Typhi Ty2
auugcaucaucgg

SEQ ID NO: 1743430 - RNA, 15 nt, Salmonella enterica enterica serovar Typhi Ty2
auugcgccccagcac

SEQ ID NO: 1743431 - RNA, 20 nt, Salmonella enterica enterica serovar Typhi Ty2
auucgccuuucacgcguuca

SEQ ID NO: 1743432 - RNA, 11 nt, Salmonella enterica enterica serovar Typhi Ty2
auucgcggcaa

SEQ ID NO: 1743433 - RNA, 22 nt, Salmonella enterica enterica serovar Typhi Ty2
auucgcgccuagcgcgcgcagu

SEQ ID NO: 1743434 - RNA, 13 nt, Salmonella enterica enterica serovar Typhi Ty2
auucuaaggccgc

SEQ ID NO: 1743435 - RNA, 16 nt, Salmonella enterica enterica serovar Typhi Ty2
auuggcguuaccggca

SEQ ID NO: 1743436 - RNA, 20 nt, Salmonella enterica enterica serovar Typhi Ty2
auuguccacggggcggcaau

SEQ ID NO: 1743437 - RNA, 18 nt, Salmonella enterica enterica serovar Typhi Ty2
auugugauuccaguuguc

SEQ ID NO: 1743438 - RNA, 14 nt, Salmonella enterica enterica serovar Typhi Ty2
auuggccaucaggu

SEQ ID NO: 1743439 - RNA, 15 nt, Salmonella enterica enterica serovar Typhi Ty2
auuuuagcgcaucgc

SEQ ID NO: 1743440 - RNA, 20 nt, Salmonella enterica enterica serovar Typhi Ty2
auuuucgcaaacugaucgag

SEQ ID NO: 1743441 - RNA, 17 nt, Salmonella enterica enterica serovar Typhi Ty2
auuuucgauaaucgcgc

SEQ ID NO: 1743442 - RNA, 17 nt, Salmonella enterica enterica serovar Typhi Ty2
auuuucaaugcacgcca

SEQ ID NO: 1743443 - RNA, 18 nt, Salmonella enterica enterica serovar Typhi Ty2
auuuucuuaauaugcugc

SEQ ID NO: 1743444 - RNA, 20 nt, Salmonella enterica enterica serovar Typhi Ty2
auuuguggcguuaacggcgc

SEQ ID NO: 1743445 - RNA, 18 nt, Salmonella enterica enterica serovar Typhi Ty2
auuugcccuuccagcagc

SEQ ID NO: 1743446 - RNA, 15 nt, Salmonella enterica enterica serovar Typhi Ty2
auuucuuugucgcca

SEQ ID NO: 1743447 - RNA, 20 nt, Salmonella enterica enterica serovar Typhi Ty2
auuugaauaauucuguacca

SEQ ID NO: 1743448 - RNA, 14 nt, Salmonella enterica enterica serovar Typhi Ty2
caaaaaugaucacu

SEQ ID NO: 1743449 - RNA, 18 nt, Salmonella enterica enterica serovar Typhi Ty2
caaaaauaggcuuuugau

SEQ ID NO: 1743450 - RNA, 21 nt, Salmonella enterica enterica serovar Typhi Ty2
caaaagccggucguaaugagc

SEQ ID NO: 1743451 - RNA, 16 nt, Salmonella enterica enterica serovar Typhi Ty2
caaaagugaucauggu

SEQ ID NO: 1743452 - RNA, 16 nt, Salmonella enterica enterica serovar Typhi Ty2
caaaaaaaaaccggca

SEQ ID NO: 1743453 - RNA, 14 nt, Salmonella enterica enterica serovar Typhi Ty2
auuuuucugcgcca

SEQ ID NO: 1743454 - RNA, 23 nt, Salmonella enterica enterica serovar Typhi Ty2
caaauuaaugugcguaaacaggc

SEQ ID NO: 1743455 - RNA, 12 nt, Salmonella enterica enterica serovar Typhi Ty2
caaauuccggca

SEQ ID NO: 1743456 - RNA, 17 nt, Salmonella enterica enterica serovar Typhi Ty2
caaauuaaauccugaaa

SEQ ID NO: 1743457 - RNA, 21 nt, Salmonella enterica enterica serovar Typhi Ty2
caacagaccgacgaugaccgg

SEQ ID NO: 1743458 - RNA, 19 nt, Salmonella enterica enterica serovar Typhi Ty2
caacacuuagaacgcggaa

SEQ ID NO: 1743459 - RNA, 18 nt, Salmonella enterica enterica serovar Typhi Ty2
caacacgcgcaccaguuc

SEQ ID NO: 1743460 - RNA, 22 nt, Salmonella enterica enterica serovar Typhi Ty2
caaagucuuuuguauugcgcgu

SEQ ID NO: 1743461 - RNA, 22 nt, Salmonella enterica enterica serovar Typhi Ty2
caaacucacguuccccagcacc

SEQ ID NO: 1743462 - RNA, 16 nt, Salmonella enterica enterica serovar Typhi Ty2
caaacgccaccgccac

SEQ ID NO: 1743463 - RNA, 18 nt, Salmonella enterica enterica serovar Typhi Ty2
caaacggaauagcgccuu

SEQ ID NO: 1743464 - RNA, 15 nt, Salmonella enterica enterica serovar Typhi Ty2
caaacggcuggauaa

SEQ ID NO: 1743465 - RNA, 20 nt, Salmonella enterica enterica serovar Typhi Ty2
caaaccacaccacgugcgga

SEQ ID NO: 1743466 - RNA, 17 nt, Salmonella enterica enterica serovar Typhi Ty2
caaaccggcgaauagcg

SEQ ID NO: 1743467 - RNA, 18 nt, Salmonella enterica enterica serovar Typhi Ty2
caaaaucgcaaacgccag

SEQ ID NO: 1743468 - RNA, 21 nt, Salmonella enterica enterica serovar Typhi Ty2
caaaaucgcccaggccugaug

SEQ ID NO: 1743469 - RNA, 19 nt, Salmonella enterica enterica serovar Typhi Ty2
caaaaucgauagcgccgca

SEQ ID NO: 1743470 - RNA, 21 nt, Salmonella enterica enterica serovar Typhi Ty2
caaaaucacgcacacgucuga

SEQ ID NO: 1743471 - RNA, 13 nt, Salmonella enterica enterica serovar Typhi Ty2
caaaauuaaucgc

SEQ ID NO: 1743472 - RNA, 20 nt, Salmonella enterica enterica serovar Typhi Ty2
caaaauuaaucgccagcagc

SEQ ID NO: 1743473 - RNA, 14 nt, Salmonella enterica enterica serovar Typhi Ty2
caaacaacccggcu

SEQ ID NO: 1743474 - RNA, 21 nt, Salmonella enterica enterica serovar Typhi Ty2
caaacaguucagacaccacgc

SEQ ID NO: 1743475 - RNA, 15 nt, Salmonella enterica enterica serovar Typhi Ty2
caaacaguacgcccg

SEQ ID NO: 1743476 - RNA, 14 nt, Salmonella enterica enterica serovar Typhi Ty2
caaacaguacgccc

SEQ ID NO: 1743477 - RNA, 13 nt, Salmonella enterica enterica serovar Typhi Ty2
augaccagcgccg

SEQ ID NO: 1743478 - RNA, 17 nt, Salmonella enterica enterica serovar Typhi Ty2
augacgcagggcaauau

SEQ ID NO: 1743479 - RNA, 14 nt, Salmonella enterica enterica serovar Typhi Ty2
augaagcgucauca

SEQ ID NO: 1743480 - RNA, 11 nt, Salmonella enterica enterica serovar Typhi Ty2
augaagcgcgu

SEQ ID NO: 1743481 - RNA, 22 nt, Salmonella enterica enterica serovar Typhi Ty2
augaacgacgcugauuugccaa

SEQ ID NO: 1743482 - RNA, 22 nt, Salmonella enterica enterica serovar Typhi Ty2
augacaaagccggauaucgcua

SEQ ID NO: 1743483 - RNA, 20 nt, Salmonella enterica enterica serovar Typhi Ty2
augaaacauauauauccgcu

SEQ ID NO: 1743484 - RNA, 22 nt, Salmonella enterica enterica serovar Typhi Ty2
augaacagcgauguuuuggcgu

SEQ ID NO: 1743485 - RNA, 24 nt, Salmonella enterica enterica serovar Typhi Ty2
augaacaugcccggauggcgucug

SEQ ID NO: 1743486 - RNA, 17 nt, Salmonella enterica enterica serovar Typhi Ty2
augaaaaauccccgcaa

SEQ ID NO: 1743487 - RNA, 22 nt, Salmonella enterica enterica serovar Typhi Ty2
aucuugucacaauaacgccgga

SEQ ID NO: 1743488 - RNA, 17 nt, Salmonella enterica enterica serovar Typhi Ty2
aucuggcgcaaccggcg

SEQ ID NO: 1743489 - RNA, 23 nt, Salmonella enterica enterica serovar Typhi Ty2
aucuggcgagagcauugccugau

SEQ ID NO: 1743490 - RNA, 19 nt, Salmonella enterica enterica serovar Typhi Ty2
aucuggcuguggcguuuua

SEQ ID NO: 1743491 - RNA, 19 nt, Salmonella enterica enterica serovar Typhi Ty2
aucuggcgguuugacggcu

SEQ ID NO: 1743492 - RNA, 19 nt, Salmonella enterica enterica serovar Typhi Ty2
augcauaugcacagcgcua

SEQ ID NO: 1743493 - RNA, 22 nt, Salmonella enterica enterica serovar Typhi Ty2
augcagguucccgcccugcccg

SEQ ID NO: 1743494 - RNA, 20 nt, Salmonella enterica enterica serovar Typhi Ty2
augcaggccaagcagcgcca

SEQ ID NO: 1743495 - RNA, 22 nt, Salmonella enterica enterica serovar Typhi Ty2
augcagcgcgauggcgucacga

SEQ ID NO: 1743496 - RNA, 18 nt, Salmonella enterica enterica serovar Typhi Ty2
augaggcaaaucccugau

SEQ ID NO: 1743497 - RNA, 19 nt, Salmonella enterica enterica serovar Typhi Ty2
augaggauauugguaucaa

SEQ ID NO: 1743498 - RNA, 20 nt, Salmonella enterica enterica serovar Typhi Ty2
augacgcugcgcuuauccgg

SEQ ID NO: 1743499 - RNA, 15 nt, Salmonella enterica enterica serovar Typhi Ty2
augagcgcaggcgag

SEQ ID NO: 1743500 - RNA, 13 nt, Salmonella enterica enterica serovar Typhi Ty2
augagccgucgcu

SEQ ID NO: 1743501 - RNA, 18 nt, Salmonella enterica enterica serovar Typhi Ty2
aucgacaaaacacggcua

SEQ ID NO: 1743502 - RNA, 12 nt, Salmonella enterica enterica serovar Typhi Ty2
aucgacaacgcg

SEQ ID NO: 1743503 - RNA, 20 nt, Salmonella enterica enterica serovar Typhi Ty2
aucgacaaaggcaagauccg

SEQ ID NO: 1743504 - RNA, 13 nt, Salmonella enterica enterica serovar Typhi Ty2
aucgacaauccgc

SEQ ID NO: 1743505 - RNA, 20 nt, Salmonella enterica enterica serovar Typhi Ty2
aucgaacgccgccugcgcca

SEQ ID NO: 1743506 - RNA, 16 nt, Salmonella enterica enterica serovar Typhi Ty2
aucgguguacaucgcg

SEQ ID NO: 1743507 - RNA, 18 nt, Salmonella enterica enterica serovar Typhi Ty2
aucgguguacaucgcgcu

SEQ ID NO: 1743508 - RNA, 22 nt, Salmonella enterica enterica serovar Typhi Ty2
aucguaccaauacccagcgcca

SEQ ID NO: 1743509 - RNA, 16 nt, Salmonella enterica enterica serovar Typhi Ty2
aucgucgcgaucgcgc

SEQ ID NO: 1743510 - RNA, 23 nt, Salmonella enterica enterica serovar Typhi Ty2
aucgucgaggaagcugcgcagca

SEQ ID NO: 1743511 - RNA, 19 nt, Salmonella enterica enterica serovar Typhi Ty2
aucguaugcagccaggcca

SEQ ID NO: 1743512 - RNA, 16 nt, Salmonella enterica enterica serovar Typhi Ty2
aucguauccagcggca

SEQ ID NO: 1743513 - RNA, 12 nt, Salmonella enterica enterica serovar Typhi Ty2
aucgucgcgcca

SEQ ID NO: 1743514 - RNA, 13 nt, Salmonella enterica enterica serovar Typhi Ty2
aucucccugccag

SEQ ID NO: 1743515 - RNA, 18 nt, Salmonella enterica enterica serovar Typhi Ty2
aucguuaauucauggcca

SEQ ID NO: 1743516 - RNA, 19 nt, Salmonella enterica enterica serovar Typhi Ty2
aucguuauuaaacagacaa

SEQ ID NO: 1743517 - RNA, 17 nt, Salmonella enterica enterica serovar Typhi Ty2
aucgugguacgcggcga

SEQ ID NO: 1743518 - RNA, 14 nt, Salmonella enterica enterica serovar Typhi Ty2
aucucuuaauguaa

SEQ ID NO: 1743519 - RNA, 15 nt, Salmonella enterica enterica serovar Typhi Ty2
aucucuggcggcgua

SEQ ID NO: 1743520 - RNA, 15 nt, Salmonella enterica enterica serovar Typhi Ty2
aucucuuuugcggcg

SEQ ID NO: 1743521 - RNA, 21 nt, Salmonella enterica enterica serovar Typhi Ty2
aucugaacucuuccagauacg

SEQ ID NO: 1743522 - RNA, 22 nt, Salmonella enterica enterica serovar Typhi Ty2
aucugaugauggaacagacgcc

SEQ ID NO: 1743523 - RNA, 21 nt, Salmonella enterica enterica serovar Typhi Ty2
aucugacagccaaacugcugu

SEQ ID NO: 1743524 - RNA, 18 nt, Salmonella enterica enterica serovar Typhi Ty2
aucugaccaugccagcaa

SEQ ID NO: 1743525 - RNA, 15 nt, Salmonella enterica enterica serovar Typhi Ty2
aucugcgccauugag

SEQ ID NO: 1743526 - RNA, 14 nt, Salmonella enterica enterica serovar Typhi Ty2
auggcauaacgcug

SEQ ID NO: 1743527 - RNA, 20 nt, Salmonella enterica enterica serovar Typhi Ty2
auggcaggcauagacaucca

SEQ ID NO: 1743528 - RNA, 14 nt, Salmonella enterica enterica serovar Typhi Ty2
auggcaauugcgcc

SEQ ID NO: 1743529 - RNA, 20 nt, Salmonella enterica enterica serovar Typhi Ty2
auggcaaaauucguauuggu

SEQ ID NO: 1743530 - RNA, 15 nt, Salmonella enterica enterica serovar Typhi Ty2
auggcacaucaggca

SEQ ID NO: 1743531 - RNA, 22 nt, Salmonella enterica enterica serovar Typhi Ty2
auggccggucuuaugcugccag

SEQ ID NO: 1743532 - RNA, 16 nt, Salmonella enterica enterica serovar Typhi Ty2
auggcgaucagcgcca

SEQ ID NO: 1743533 - RNA, 15 nt, Salmonella enterica enterica serovar Typhi Ty2
auggacgggauacgg

SEQ ID NO: 1743534 - RNA, 23 nt, Salmonella enterica enterica serovar Typhi Ty2
augcugccagcgaaccgcggcau

SEQ ID NO: 1743535 - RNA, 22 nt, Salmonella enterica enterica serovar Typhi Ty2
augcugccauuuuaucgacgcu

SEQ ID NO: 1743536 - RNA, 22 nt, Salmonella enterica enterica serovar Typhi Ty2
augucagugacgguaucgugac

SEQ ID NO: 1743537 - RNA, 19 nt, Salmonella enterica enterica serovar Typhi Ty2
augucacccacgccggaaa

SEQ ID NO: 1743538 - RNA, 22 nt, Salmonella enterica enterica serovar Typhi Ty2
augguguuggcaaucagcggca

SEQ ID NO: 1743539 - RNA, 20 nt, Salmonella enterica enterica serovar Typhi Ty2
augguauuucagaccgugcu

SEQ ID NO: 1743540 - RNA, 17 nt, Salmonella enterica enterica serovar Typhi Ty2
auggcggcguuuuccgg

SEQ ID NO: 1743541 - RNA, 19 nt, Salmonella enterica enterica serovar Typhi Ty2
auggggauuaagcgagcgc

SEQ ID NO: 1743542 - RNA, 20 nt, Salmonella enterica enterica serovar Typhi Ty2
auggguacaccacuaaacgc

SEQ ID NO: 1743543 - RNA, 13 nt, Salmonella enterica enterica serovar Typhi Ty2
augccagauauuu

SEQ ID NO: 1743544 - RNA, 22 nt, Salmonella enterica enterica serovar Typhi Ty2
augccagauuuuccaggccgcc

SEQ ID NO: 1743545 - RNA, 17 nt, Salmonella enterica enterica serovar Typhi Ty2
augccacgagaaaucca

SEQ ID NO: 1743546 - RNA, 15 nt, Salmonella enterica enterica serovar Typhi Ty2
augcccggauggcgu

SEQ ID NO: 1743547 - RNA, 22 nt, Salmonella enterica enterica serovar Typhi Ty2
augcccgccagcgggccgguaa

SEQ ID NO: 1743548 - RNA, 19 nt, Salmonella enterica enterica serovar Typhi Ty2
augcccucuuccagcgcca

SEQ ID NO: 1743549 - RNA, 21 nt, Salmonella enterica enterica serovar Typhi Ty2
augcccugcuggcgcaugauc

SEQ ID NO: 1743550 - RNA, 22 nt, Salmonella enterica enterica serovar Typhi Ty2
augccgcccaggccaugcgccg

SEQ ID NO: 1743551 - RNA, 13 nt, Salmonella enterica enterica serovar Typhi Ty2
augcuaucgcgga

SEQ ID NO: 1743552 - RNA, 13 nt, Salmonella enterica enterica serovar Typhi Ty2
augcggcuagcgc

SEQ ID NO: 1743553 - RNA, 18 nt, Salmonella enterica enterica serovar Typhi Ty2
augcgccgacugaacaua

SEQ ID NO: 1743554 - RNA, 22 nt, Salmonella enterica enterica serovar Typhi Ty2
augcgcgugcgguuuuccugau

SEQ ID NO: 1743555 - RNA, 19 nt, Salmonella enterica enterica serovar Typhi Ty2
augcgcggaauagcggcua

SEQ ID NO: 1743556 - RNA, 21 nt, Salmonella enterica enterica serovar Typhi Ty2
augcgauacguaggccugaua

SEQ ID NO: 1743557 - RNA, 19 nt, Salmonella enterica enterica serovar Typhi Ty2
augccuggggucgucagcg

SEQ ID NO: 1743558 - RNA, 13 nt, Salmonella enterica enterica serovar Typhi Ty2
augcgccagcggc

SEQ ID NO: 1743559 - RNA, 18 nt, Salmonella enterica enterica serovar Typhi Ty2
augcgccccggcggcgua

SEQ ID NO: 1743560 - RNA, 22 nt, Salmonella enterica enterica serovar Typhi Ty2
augcgccccgcuucccgaaagg

SEQ ID NO: 1743561 - RNA, 23 nt, Salmonella enterica enterica serovar Typhi Ty2
augccuguguaucgcccugccag

SEQ ID NO: 1743562 - RNA, 11 nt, Salmonella enterica enterica serovar Typhi Ty2
augccuggcag

SEQ ID NO: 1743563 - RNA, 22 nt, Salmonella enterica enterica serovar Typhi Ty2
caauaaugcgcugcacaaucgc

SEQ ID NO: 1743564 - RNA, 14 nt, Salmonella enterica enterica serovar Typhi Ty2
caauaaaucaacau

SEQ ID NO: 1743565 - RNA, 16 nt, Salmonella enterica enterica serovar Typhi Ty2
caauaaccaccuguuc

SEQ ID NO: 1743566 - RNA, 23 nt, Salmonella enterica enterica serovar Typhi Ty2
caagcguaguacguuccagcguu

SEQ ID NO: 1743567 - RNA, 20 nt, Salmonella enterica enterica serovar Typhi Ty2
caagccgaacucuuccacca

SEQ ID NO: 1743568 - RNA, 11 nt, Salmonella enterica enterica serovar Typhi Ty2
caacugcugac

SEQ ID NO: 1743569 - RNA, 16 nt, Salmonella enterica enterica serovar Typhi Ty2
caacagaaucgcgaua

SEQ ID NO: 1743570 - RNA, 18 nt, Salmonella enterica enterica serovar Typhi Ty2
caagcaguucugaagcua

SEQ ID NO: 1743571 - RNA, 18 nt, Salmonella enterica enterica serovar Typhi Ty2
caagaaguuccaccgucu

SEQ ID NO: 1743572 - RNA, 19 nt, Salmonella enterica enterica serovar Typhi Ty2
cacacauaucgccagccau

SEQ ID NO: 1743573 - RNA, 12 nt, Salmonella enterica enterica serovar Typhi Ty2
cacaaucagcca

SEQ ID NO: 1743574 - RNA, 15 nt, Salmonella enterica enterica serovar Typhi Ty2
cacaaucagccacgg

SEQ ID NO: 1743575 - RNA, 22 nt, Salmonella enterica enterica serovar Typhi Ty2
cacaaucccgccagacccgcaa

SEQ ID NO: 1743576 - RNA, 22 nt, Salmonella enterica enterica serovar Typhi Ty2
caauguuaaauucagcauuagg

SEQ ID NO: 1743577 - RNA, 14 nt, Salmonella enterica enterica serovar Typhi Ty2
caauguaaaacggu

SEQ ID NO: 1743578 - RNA, 13 nt, Salmonella enterica enterica serovar Typhi Ty2
cacaacccaaagg

SEQ ID NO: 1743579 - RNA, 17 nt, Salmonella enterica enterica serovar Typhi Ty2
caauuugcccagcgcug

SEQ ID NO: 1743580 - RNA, 12 nt, Salmonella enterica enterica serovar Typhi Ty2
caauuuccugau

SEQ ID NO: 1743581 - RNA, 18 nt, Salmonella enterica enterica serovar Typhi Ty2
caauugugugcacugcac

SEQ ID NO: 1743582 - RNA, 14 nt, Salmonella enterica enterica serovar Typhi Ty2
caauccaugccggc

SEQ ID NO: 1743583 - RNA, 16 nt, Salmonella enterica enterica serovar Typhi Ty2
caaucgcgguaugcga

SEQ ID NO: 1743584 - RNA, 21 nt, Salmonella enterica enterica serovar Typhi Ty2
caaucgcggcgacaucgccaa

SEQ ID NO: 1743585 - RNA, 17 nt, Salmonella enterica enterica serovar Typhi Ty2
caaucaguucucgcgcc

SEQ ID NO: 1743586 - RNA, 15 nt, Salmonella enterica enterica serovar Typhi Ty2
caaucaguacgcgcg

SEQ ID NO: 1743587 - RNA, 22 nt, Salmonella enterica enterica serovar Typhi Ty2
caauacgguaaacagauaagcg

SEQ ID NO: 1743588 - RNA, 13 nt, Salmonella enterica enterica serovar Typhi Ty2
caaugagcaggcc

SEQ ID NO: 1743589 - RNA, 19 nt, Salmonella enterica enterica serovar Typhi Ty2
caaugaacucgccucgcug

SEQ ID NO: 1743590 - RNA, 18 nt, Salmonella enterica enterica serovar Typhi Ty2
caaugcggcaucucgcca

SEQ ID NO: 1743591 - RNA, 15 nt, Salmonella enterica enterica serovar Typhi Ty2
caaugcgguaaccgu

SEQ ID NO: 1743592 - RNA, 20 nt, Salmonella enterica enterica serovar Typhi Ty2
caaugcgcguaauuugcgac

SEQ ID NO: 1743593 - RNA, 16 nt, Salmonella enterica enterica serovar Typhi Ty2
caaugccgcagcgcgg

SEQ ID NO: 1743594 - RNA, 22 nt, Salmonella enterica enterica serovar Typhi Ty2
caaugagcugcuugucacgaag

SEQ ID NO: 1743595 - RNA, 15 nt, Salmonella enterica enterica serovar Typhi Ty2
caaugccgucggcaa

SEQ ID NO: 1743596 - RNA, 16 nt, Salmonella enterica enterica serovar Typhi Ty2
cacccagugccaccag

SEQ ID NO: 1743597 - RNA, 14 nt, Salmonella enterica enterica serovar Typhi Ty2
caccagcacagccc

SEQ ID NO: 1743598 - RNA, 18 nt, Salmonella enterica enterica serovar Typhi Ty2
caccaccgguuugucgcu

SEQ ID NO: 1743599 - RNA, 17 nt, Salmonella enterica enterica serovar Typhi Ty2
caccagcacgaugcaua

SEQ ID NO: 1743600 - RNA, 18 nt, Salmonella enterica enterica serovar Typhi Ty2
caccaggaguuaaaccug

SEQ ID NO: 1743601 - RNA, 20 nt, Salmonella enterica enterica serovar Typhi Ty2
caccagcuuaucgggaugau

SEQ ID NO: 1743602 - RNA, 18 nt, Salmonella enterica enterica serovar Typhi Ty2
cacacgccaaaaucgccc

SEQ ID NO: 1743603 - RNA, 13 nt, Salmonella enterica enterica serovar Typhi Ty2
cacaccauaccgc

SEQ ID NO: 1743604 - RNA, 15 nt, Salmonella enterica enterica serovar Typhi Ty2
cacagcgcuaucagg

SEQ ID NO: 1743605 - RNA, 14 nt, Salmonella enterica enterica serovar Typhi Ty2
cacacucucuccag

SEQ ID NO: 1743606 - RNA, 21 nt, Salmonella enterica enterica serovar Typhi Ty2
caccaauuucaccggaugcgc

SEQ ID NO: 1743607 - RNA, 20 nt, Salmonella enterica enterica serovar Typhi Ty2
cacaguacgcccggcgggua

SEQ ID NO: 1743608 - RNA, 17 nt, Salmonella enterica enterica serovar Typhi Ty2
cacagggggaacauuua

SEQ ID NO: 1743609 - RNA, 15 nt, Salmonella enterica enterica serovar Typhi Ty2
cacagcgucgcgcga

SEQ ID NO: 1743610 - RNA, 21 nt, Salmonella enterica enterica serovar Typhi Ty2
cacaucuacucauaugcggau

SEQ ID NO: 1743611 - RNA, 19 nt, Salmonella enterica enterica serovar Typhi Ty2
cacgacgcucauuaacgac

SEQ ID NO: 1743612 - RNA, 13 nt, Salmonella enterica enterica serovar Typhi Ty2
cacgaaugucgcg

SEQ ID NO: 1743613 - RNA, 16 nt, Salmonella enterica enterica serovar Typhi Ty2
cacgaucgagccgucg

SEQ ID NO: 1743614 - RNA, 21 nt, Salmonella enterica enterica serovar Typhi Ty2
caccuuuuuauuuacugccgu

SEQ ID NO: 1743615 - RNA, 17 nt, Salmonella enterica enterica serovar Typhi Ty2
caccuguaaccgcuauc

SEQ ID NO: 1743616 - RNA, 20 nt, Salmonella enterica enterica serovar Typhi Ty2
caccugguuauuagaugcga

SEQ ID NO: 1743617 - RNA, 20 nt, Salmonella enterica enterica serovar Typhi Ty2
caccugccauucacgcuggg

SEQ ID NO: 1743618 - RNA, 17 nt, Salmonella enterica enterica serovar Typhi Ty2
caccugccauucacgcu

SEQ ID NO: 1743619 - RNA, 15 nt, Salmonella enterica enterica serovar Typhi Ty2
cacgcaaugccugac

SEQ ID NO: 1743620 - RNA, 21 nt, Salmonella enterica enterica serovar Typhi Ty2
cacgcagcgccuuaucgagug

SEQ ID NO: 1743621 - RNA, 13 nt, Salmonella enterica enterica serovar Typhi Ty2
cacgcagccaugu

SEQ ID NO: 1743622 - RNA, 12 nt, Salmonella enterica enterica serovar Typhi Ty2
cacgccagcggu

SEQ ID NO: 1743623 - RNA, 14 nt, Salmonella enterica enterica serovar Typhi Ty2
cacgccacauugac

SEQ ID NO: 1743624 - RNA, 17 nt, Salmonella enterica enterica serovar Typhi Ty2
cacgccauugccaggac

SEQ ID NO: 1743625 - RNA, 14 nt, Salmonella enterica enterica serovar Typhi Ty2
cacgccuuccucca

SEQ ID NO: 1743626 - RNA, 19 nt, Salmonella enterica enterica serovar Typhi Ty2
cacgccgccauccggcaac

SEQ ID NO: 1743627 - RNA, 16 nt, Salmonella enterica enterica serovar Typhi Ty2
cacgccgccauccggc

SEQ ID NO: 1743628 - RNA, 23 nt, Salmonella enterica enterica serovar Typhi Ty2
caccgguaucgaucacgcgcagg

SEQ ID NO: 1743629 - RNA, 16 nt, Salmonella enterica enterica serovar Typhi Ty2
caccgucuaucgugga

SEQ ID NO: 1743630 - RNA, 12 nt, Salmonella enterica enterica serovar Typhi Ty2
caccuccgccac

SEQ ID NO: 1743631 - RNA, 21 nt, Salmonella enterica enterica serovar Typhi Ty2
caccugaucgugccaugacca

SEQ ID NO: 1743632 - RNA, 16 nt, Salmonella enterica enterica serovar Typhi Ty2
caccugcaacuccugg

SEQ ID NO: 1743633 - RNA, 19 nt, Salmonella enterica enterica serovar Typhi Ty2
caccucuuccgccaggucg

SEQ ID NO: 1743634 - RNA, 21 nt, Salmonella enterica enterica serovar Typhi Ty2
cacccauuuuauccucuucaa

SEQ ID NO: 1743635 - RNA, 15 nt, Salmonella enterica enterica serovar Typhi Ty2
caccgcaggcagcgg

SEQ ID NO: 1743636 - RNA, 19 nt, Salmonella enterica enterica serovar Typhi Ty2
caccgcuucacauacccgc

SEQ ID NO: 1743637 - RNA, 13 nt, Salmonella enterica enterica serovar Typhi Ty2
cagccgccauggc

SEQ ID NO: 1743638 - RNA, 18 nt, Salmonella enterica enterica serovar Typhi Ty2
cagccaaacugcuguagc

SEQ ID NO: 1743639 - RNA, 15 nt, Salmonella enterica enterica serovar Typhi Ty2
cagccaaaucagcag

SEQ ID NO: 1743640 - RNA, 16 nt, Salmonella enterica enterica serovar Typhi Ty2
cagccacggcaacgcc

SEQ ID NO: 1743641 - RNA, 16 nt, Salmonella enterica enterica serovar Typhi Ty2
cagcccgaucggcugg

SEQ ID NO: 1743642 - RNA, 17 nt, Salmonella enterica enterica serovar Typhi Ty2
cagccgauuuuucggca

SEQ ID NO: 1743643 - RNA, 20 nt, Salmonella enterica enterica serovar Typhi Ty2
cagcccguaaggggcugcgu

SEQ ID NO: 1743644 - RNA, 21 nt, Salmonella enterica enterica serovar Typhi Ty2
cagccgucgugauagccauac

SEQ ID NO: 1743645 - RNA, 19 nt, Salmonella enterica enterica serovar Typhi Ty2
cagcgaguuacguugcggc

SEQ ID NO: 1743646 - RNA, 13 nt, Salmonella enterica enterica serovar Typhi Ty2
cagcgaucacgcc

SEQ ID NO: 1743647 - RNA, 15 nt, Salmonella enterica enterica serovar Typhi Ty2
cagcgaucaggcguc

SEQ ID NO: 1743648 - RNA, 21 nt, Salmonella enterica enterica serovar Typhi Ty2
cagcgcagucaaaacgacaua

SEQ ID NO: 1743649 - RNA, 13 nt, Salmonella enterica enterica serovar Typhi Ty2
cagcgcagcaacg

SEQ ID NO: 1743650 - RNA, 14 nt, Salmonella enterica enterica serovar Typhi Ty2
cagcgccagcgcca

SEQ ID NO: 1743651 - RNA, 20 nt, Salmonella enterica enterica serovar Typhi Ty2
cagcgcccgauaaaucgcau

SEQ ID NO: 1743652 - RNA, 22 nt, Salmonella enterica enterica serovar Typhi Ty2
cagcguaaucggcaggccaacg

SEQ ID NO: 1743653 - RNA, 16 nt, Salmonella enterica enterica serovar Typhi Ty2
cagcgucggauggcga

SEQ ID NO: 1743654 - RNA, 14 nt, Salmonella enterica enterica serovar Typhi Ty2
cagcggucaucaau

SEQ ID NO: 1743655 - RNA, 20 nt, Salmonella enterica enterica serovar Typhi Ty2
cagcggucaggggucagcgu

SEQ ID NO: 1743656 - RNA, 20 nt, Salmonella enterica enterica serovar Typhi Ty2
cagcgguuacuuuugaacau

SEQ ID NO: 1743657 - RNA, 20 nt, Salmonella enterica enterica serovar Typhi Ty2
cagcguacaggcggaaauca

SEQ ID NO: 1743658 - RNA, 17 nt, Salmonella enterica enterica serovar Typhi Ty2
cagcggcaacucgugca

SEQ ID NO: 1743659 - RNA, 15 nt, Salmonella enterica enterica serovar Typhi Ty2
cagcgcgugaaccgu

SEQ ID NO: 1743660 - RNA, 17 nt, Salmonella enterica enterica serovar Typhi Ty2
cagcgcuaacgcgaaga

SEQ ID NO: 1743661 - RNA, 16 nt, Salmonella enterica enterica serovar Typhi Ty2
cagcgcucugcaaugu

SEQ ID NO: 1743662 - RNA, 21 nt, Salmonella enterica enterica serovar Typhi Ty2
cagcgcugcauuugcugccgu

SEQ ID NO: 1743663 - RNA, 23 nt, Salmonella enterica enterica serovar Typhi Ty2
cagcggaaagugaaggccagacu

SEQ ID NO: 1743664 - RNA, 16 nt, Salmonella enterica enterica serovar Typhi Ty2
cagcgcuguccagaua

SEQ ID NO: 1743665 - RNA, 12 nt, Salmonella enterica enterica serovar Typhi Ty2
cagcgcugcugu

SEQ ID NO: 1743666 - RNA, 18 nt, Salmonella enterica enterica serovar Typhi Ty2
cagcgcgggaucgagcgc

SEQ ID NO: 1743667 - RNA, 14 nt, Salmonella enterica enterica serovar Typhi Ty2
cagcgcgauacgcg

SEQ ID NO: 1743668 - RNA, 14 nt, Salmonella enterica enterica serovar Typhi Ty2
cagcgcgccagcgc

SEQ ID NO: 1743669 - RNA, 17 nt, Salmonella enterica enterica serovar Typhi Ty2
cagcgcgaccagcguga

SEQ ID NO: 1743670 - RNA, 22 nt, Salmonella enterica enterica serovar Typhi Ty2
cagcgcgaauuugccccagaua

SEQ ID NO: 1743671 - RNA, 19 nt, Salmonella enterica enterica serovar Typhi Ty2
cagcgcgcgacccagcgca

SEQ ID NO: 1743672 - RNA, 18 nt, Salmonella enterica enterica serovar Typhi Ty2
cagcgcgcgacccagcgc

SEQ ID NO: 1743673 - RNA, 17 nt, Salmonella enterica enterica serovar Typhi Ty2
cagaugaagcgcaucgg

SEQ ID NO: 1743674 - RNA, 16 nt, Salmonella enterica enterica serovar Typhi Ty2
cagaucuucacgcguc

SEQ ID NO: 1743675 - RNA, 18 nt, Salmonella enterica enterica serovar Typhi Ty2
cagaucguagccauguuc

SEQ ID NO: 1743676 - RNA, 13 nt, Salmonella enterica enterica serovar Typhi Ty2
cagaucguaugcg

SEQ ID NO: 1743677 - RNA, 16 nt, Salmonella enterica enterica serovar Typhi Ty2
cagaucgcgcugcgca

SEQ ID NO: 1743678 - RNA, 15 nt, Salmonella enterica enterica serovar Typhi Ty2
cagaucgcgcagcgu

SEQ ID NO: 1743679 - RNA, 16 nt, Salmonella enterica enterica serovar Typhi Ty2
cagauauuccagcgac

SEQ ID NO: 1743680 - RNA, 12 nt, Salmonella enterica enterica serovar Typhi Ty2
cagauaacccgg

SEQ ID NO: 1743681 - RNA, 21 nt, Salmonella enterica enterica serovar Typhi Ty2
cagauaaagcuucugcgccuu

SEQ ID NO: 1743682 - RNA, 18 nt, Salmonella enterica enterica serovar Typhi Ty2
cagaguaaaaaaaccggc

SEQ ID NO: 1743683 - RNA, 15 nt, Salmonella enterica enterica serovar Typhi Ty2
cagacauucgcgcac

SEQ ID NO: 1743684 - RNA, 13 nt, Salmonella enterica enterica serovar Typhi Ty2
cagacaugaccgc

SEQ ID NO: 1743685 - RNA, 14 nt, Salmonella enterica enterica serovar Typhi Ty2
cagacaauccgcgg

SEQ ID NO: 1743686 - RNA, 20 nt, Salmonella enterica enterica serovar Typhi Ty2
cagacaagcacauaacugag

SEQ ID NO: 1743687 - RNA, 21 nt, Salmonella enterica enterica serovar Typhi Ty2
cagacaaaaucuuuccagcuc

SEQ ID NO: 1743688 - RNA, 17 nt, Salmonella enterica enterica serovar Typhi Ty2
cagacaacguccugcgg

SEQ ID NO: 1743689 - RNA, 15 nt, Salmonella enterica enterica serovar Typhi Ty2
cagaaugccagcgcc

SEQ ID NO: 1743690 - RNA, 13 nt, Salmonella enterica enterica serovar Typhi Ty2
cagacguagcgcc

SEQ ID NO: 1743691 - RNA, 17 nt, Salmonella enterica enterica serovar Typhi Ty2
cagacgccaacgcgcga

SEQ ID NO: 1743692 - RNA, 15 nt, Salmonella enterica enterica serovar Typhi Ty2
cagacguaaauugcg

SEQ ID NO: 1743693 - RNA, 17 nt, Salmonella enterica enterica serovar Typhi Ty2
aaagacaccguucuggc

SEQ ID NO: 1743694 - RNA, 14 nt, Salmonella enterica enterica serovar Typhi Ty2
cagacucugcgcgu

SEQ ID NO: 1743695 - RNA, 19 nt, Salmonella enterica enterica serovar Typhi Ty2
aaagacggcagcgccaucc

SEQ ID NO: 1743696 - RNA, 19 nt, Salmonella enterica enterica serovar Typhi Ty2
aaagaucuggccgucuggc

SEQ ID NO: 1743697 - RNA, 16 nt, Salmonella enterica enterica serovar Typhi Ty2
aaagagccgcgcagcg

SEQ ID NO: 1743698 - RNA, 21 nt, Salmonella enterica enterica serovar Typhi Ty2
cagagagcguuucuacgccau

SEQ ID NO: 1743699 - RNA, 17 nt, Salmonella enterica enterica serovar Typhi Ty2
cacugcgcuuauccggc

SEQ ID NO: 1743700 - RNA, 20 nt, Salmonella enterica enterica serovar Typhi Ty2
cacugauaguccaucaccuc

SEQ ID NO: 1743701 - RNA, 18 nt, Salmonella enterica enterica serovar Typhi Ty2
cacugauaguccaucacc

SEQ ID NO: 1743702 - RNA, 19 nt, Salmonella enterica enterica serovar Typhi Ty2
cacugauaccccagcgauc

SEQ ID NO: 1743703 - RNA, 17 nt, Salmonella enterica enterica serovar Typhi Ty2
cacgcgaauagccagac

SEQ ID NO: 1743704 - RNA, 16 nt, Salmonella enterica enterica serovar Typhi Ty2
cacgcgacggcccaac

SEQ ID NO: 1743705 - RNA, 14 nt, Salmonella enterica enterica serovar Typhi Ty2
cacgcgcagcaucu

SEQ ID NO: 1743706 - RNA, 19 nt, Salmonella enterica enterica serovar Typhi Ty2
cacguugagaaagggauaa

SEQ ID NO: 1743707 - RNA, 19 nt, Salmonella enterica enterica serovar Typhi Ty2
cacguugaugugcccguuc

SEQ ID NO: 1743708 - RNA, 15 nt, Salmonella enterica enterica serovar Typhi Ty2
cacucauccagacca

SEQ ID NO: 1743709 - RNA, 14 nt, Salmonella enterica enterica serovar Typhi Ty2
cacguugggcacgu

SEQ ID NO: 1743710 - RNA, 21 nt, Salmonella enterica enterica serovar Typhi Ty2
cacuucauccggcguugcgcc

SEQ ID NO: 1743711 - RNA, 13 nt, Salmonella enterica enterica serovar Typhi Ty2
cacuucauccggc

SEQ ID NO: 1743712 - RNA, 16 nt, Salmonella enterica enterica serovar Typhi Ty2
cacuucauccggauaa

SEQ ID NO: 1743713 - RNA, 11 nt, Salmonella enterica enterica serovar Typhi Ty2
cacuucaucau

SEQ ID NO: 1743714 - RNA, 17 nt, Salmonella enterica enterica serovar Typhi Ty2
cacuucacccaucgcca

SEQ ID NO: 1743715 - RNA, 12 nt, Salmonella enterica enterica serovar Typhi Ty2
cacuuccagcgc

SEQ ID NO: 1743716 - RNA, 19 nt, Salmonella enterica enterica serovar Typhi Ty2
cacuucucgcgcaucagga

SEQ ID NO: 1743717 - RNA, 13 nt, Salmonella enterica enterica serovar Typhi Ty2
cacuucgauaaac

SEQ ID NO: 1743718 - RNA, 13 nt, Salmonella enterica enterica serovar Typhi Ty2
cacuugccgcguu

SEQ ID NO: 1743719 - RNA, 15 nt, Salmonella enterica enterica serovar Typhi Ty2
cagaaaucggcagca

SEQ ID NO: 1743720 - RNA, 14 nt, Salmonella enterica enterica serovar Typhi Ty2
cagaaauccgcguc

SEQ ID NO: 1743721 - RNA, 23 nt, Salmonella enterica enterica serovar Typhi Ty2
cagaaauaaaauacgcucaauau

SEQ ID NO: 1743722 - RNA, 22 nt, Salmonella enterica enterica serovar Typhi Ty2
cacuuucucggcuuuccagcuc

SEQ ID NO: 1743723 - RNA, 18 nt, Salmonella enterica enterica serovar Typhi Ty2
cacuuuccgaaucaggcg

SEQ ID NO: 1743724 - RNA, 17 nt, Salmonella enterica enterica serovar Typhi Ty2
cacuuuccgaaucaggc

SEQ ID NO: 1743725 - RNA, 13 nt, Salmonella enterica enterica serovar Typhi Ty2
cacuuucaucagc

SEQ ID NO: 1743726 - RNA, 22 nt, Salmonella enterica enterica serovar Typhi Ty2
cacuuuaauacccgauagcggc

SEQ ID NO: 1743727 - RNA, 17 nt, Salmonella enterica enterica serovar Typhi Ty2
cagaacgcuuuugcgca

SEQ ID NO: 1743728 - RNA, 21 nt, Salmonella enterica enterica serovar Typhi Ty2
cagaacucccuguuccuguau

SEQ ID NO: 1743729 - RNA, 13 nt, Salmonella enterica enterica serovar Typhi Ty2
cagaagauaugug

SEQ ID NO: 1743730 - RNA, 23 nt, Salmonella enterica enterica serovar Typhi Ty2
cagcaggauagcgaccagcguca

SEQ ID NO: 1743731 - RNA, 15 nt, Salmonella enterica enterica serovar Typhi Ty2
cagcaggcagacgcg

SEQ ID NO: 1743732 - RNA, 17 nt, Salmonella enterica enterica serovar Typhi Ty2
cagcagcggaaucgcuu

SEQ ID NO: 1743733 - RNA, 24 nt, Salmonella enterica enterica serovar Typhi Ty2
cagcagauaauuuuucagacguca

SEQ ID NO: 1743734 - RNA, 14 nt, Salmonella enterica enterica serovar Typhi Ty2
cagcauccagcuca

SEQ ID NO: 1743735 - RNA, 13 nt, Salmonella enterica enterica serovar Typhi Ty2
cagcaucccggca

SEQ ID NO: 1743736 - RNA, 19 nt, Salmonella enterica enterica serovar Typhi Ty2
cagcauugggauggauaaa

SEQ ID NO: 1743737 - RNA, 14 nt, Salmonella enterica enterica serovar Typhi Ty2
cagcauuucgucga

SEQ ID NO: 1743738 - RNA, 15 nt, Salmonella enterica enterica serovar Typhi Ty2
cagcauuucaaucgc

SEQ ID NO: 1743739 - RNA, 15 nt, Salmonella enterica enterica serovar Typhi Ty2
cagccaaauagcgcc

SEQ ID NO: 1743740 - RNA, 19 nt, Salmonella enterica enterica serovar Typhi Ty2
cagcaugcccgccagcggg

SEQ ID NO: 1743741 - RNA, 16 nt, Salmonella enterica enterica serovar Typhi Ty2
cagcaucgaccaggau

SEQ ID NO: 1743742 - RNA, 14 nt, Salmonella enterica enterica serovar Typhi Ty2
cagcaucccggcaa

SEQ ID NO: 1743743 - RNA, 21 nt, Salmonella enterica enterica serovar Typhi Ty2
cagcaucaugggcucaucaaa

SEQ ID NO: 1743744 - RNA, 14 nt, Salmonella enterica enterica serovar Typhi Ty2
cagcaauuccgcca

SEQ ID NO: 1743745 - RNA, 23 nt, Salmonella enterica enterica serovar Typhi Ty2
cagcaauuucucgcccgccagau

SEQ ID NO: 1743746 - RNA, 15 nt, Salmonella enterica enterica serovar Typhi Ty2
cagcacgagcgccag

SEQ ID NO: 1743747 - RNA, 15 nt, Salmonella enterica enterica serovar Typhi Ty2
cagaugaacggcaag

SEQ ID NO: 1743748 - RNA, 14 nt, Salmonella enterica enterica serovar Typhi Ty2
cagaugcugcguuu

SEQ ID NO: 1743749 - RNA, 21 nt, Salmonella enterica enterica serovar Typhi Ty2
cagaugcgccagauucaugau

SEQ ID NO: 1743750 - RNA, 16 nt, Salmonella enterica enterica serovar Typhi Ty2
cagauuacgcaugguc

SEQ ID NO: 1743751 - RNA, 12 nt, Salmonella enterica enterica serovar Typhi Ty2
cagauucagaug

SEQ ID NO: 1743752 - RNA, 19 nt, Salmonella enterica enterica serovar Typhi Ty2
cagauguccaccgauuuca

SEQ ID NO: 1743753 - RNA, 18 nt, Salmonella enterica enterica serovar Typhi Ty2
cagaugucggcggcaggu

SEQ ID NO: 1743754 - RNA, 17 nt, Salmonella enterica enterica serovar Typhi Ty2
cagauguaucgcgcuua

SEQ ID NO: 1743755 - RNA, 18 nt, Salmonella enterica enterica serovar Typhi Ty2
cagauguaucgcgcuuac

SEQ ID NO: 1743756 - RNA, 18 nt, Salmonella enterica enterica serovar Typhi Ty2
cagauggcuuuacgcuua

SEQ ID NO: 1743757 - RNA, 21 nt, Salmonella enterica enterica serovar Typhi Ty2
cagcaaacggcuggauaaccg

SEQ ID NO: 1743758 - RNA, 21 nt, Salmonella enterica enterica serovar Typhi Ty2
cagcaaaacggcuaccgucau

SEQ ID NO: 1743759 - RNA, 18 nt, Salmonella enterica enterica serovar Typhi Ty2
cagcaaugauuuuuagcc

SEQ ID NO: 1743760 - RNA, 15 nt, Salmonella enterica enterica serovar Typhi Ty2
cagcaagcggcuguc

SEQ ID NO: 1743761 - RNA, 15 nt, Salmonella enterica enterica serovar Typhi Ty2
cagcaacugcugcgc

SEQ ID NO: 1743762 - RNA, 18 nt, Salmonella enterica enterica serovar Typhi Ty2
caucguuaccgcuucaca

SEQ ID NO: 1743763 - RNA, 20 nt, Salmonella enterica enterica serovar Typhi Ty2
caucguuugcgcuacgcugc

SEQ ID NO: 1743764 - RNA, 16 nt, Salmonella enterica enterica serovar Typhi Ty2
caucuaccgcauacug

SEQ ID NO: 1743765 - RNA, 22 nt, Salmonella enterica enterica serovar Typhi Ty2
caucugauagcccauccagcac

SEQ ID NO: 1743766 - RNA, 16 nt, Salmonella enterica enterica serovar Typhi Ty2
caucucuuucagaaua

SEQ ID NO: 1743767 - RNA, 22 nt, Salmonella enterica enterica serovar Typhi Ty2
caucucgucaaacucuuccggg

SEQ ID NO: 1743768 - RNA, 13 nt, Salmonella enterica enterica serovar Typhi Ty2
caucuaucgccag

SEQ ID NO: 1743769 - RNA, 14 nt, Salmonella enterica enterica serovar Typhi Ty2
caucuccucgcgcg

SEQ ID NO: 1743770 - RNA, 15 nt, Salmonella enterica enterica serovar Typhi Ty2
caucucgauaccggu

SEQ ID NO: 1743771 - RNA, 21 nt, Salmonella enterica enterica serovar Typhi Ty2
caucggcucagcaaucacuuc

SEQ ID NO: 1743772 - RNA, 19 nt, Salmonella enterica enterica serovar Typhi Ty2
caucgggacggcggucgcu

SEQ ID NO: 1743773 - RNA, 20 nt, Salmonella enterica enterica serovar Typhi Ty2
caucguagucaggcaacagg

SEQ ID NO: 1743774 - RNA, 14 nt, Salmonella enterica enterica serovar Typhi Ty2
caucgguuucgcgg

SEQ ID NO: 1743775 - RNA, 23 nt, Salmonella enterica enterica serovar Typhi Ty2
caucgguaaagguuuucacgcua

SEQ ID NO: 1743776 - RNA, 19 nt, Salmonella enterica enterica serovar Typhi Ty2
caucggcagcgccagugac

SEQ ID NO: 1743777 - RNA, 15 nt, Salmonella enterica enterica serovar Typhi Ty2
caucggcagcgucag

SEQ ID NO: 1743778 - RNA, 15 nt, Salmonella enterica enterica serovar Typhi Ty2
caucggcagcgccag

SEQ ID NO: 1743779 - RNA, 21 nt, Salmonella enterica enterica serovar Typhi Ty2
caucggauucauuugauacgu

SEQ ID NO: 1743780 - RNA, 14 nt, Salmonella enterica enterica serovar Typhi Ty2
caucgcuggcgcgc

SEQ ID NO: 1743781 - RNA, 17 nt, Salmonella enterica enterica serovar Typhi Ty2
caucgcuuaacggccca

SEQ ID NO: 1743782 - RNA, 19 nt, Salmonella enterica enterica serovar Typhi Ty2
caucggccagcaggcgcac

SEQ ID NO: 1743783 - RNA, 16 nt, Salmonella enterica enterica serovar Typhi Ty2
caucggcggcaaugcc

SEQ ID NO: 1743784 - RNA, 15 nt, Salmonella enterica enterica serovar Typhi Ty2
caugauggugaacag

SEQ ID NO: 1743785 - RNA, 15 nt, Salmonella enterica enterica serovar Typhi Ty2
caugaugagcgccau

SEQ ID NO: 1743786 - RNA, 14 nt, Salmonella enterica enterica serovar Typhi Ty2
caugauauucuguc

SEQ ID NO: 1743787 - RNA, 17 nt, Salmonella enterica enterica serovar Typhi Ty2
caugauccugguccggc

SEQ ID NO: 1743788 - RNA, 21 nt, Salmonella enterica enterica serovar Typhi Ty2
caugaucggcuggguuuccgg

SEQ ID NO: 1743789 - RNA, 20 nt, Salmonella enterica enterica serovar Typhi Ty2
caugauuucuugagcggcau

SEQ ID NO: 1743790 - RNA, 22 nt, Salmonella enterica enterica serovar Typhi Ty2
caugauguuuuaacacacaguu

SEQ ID NO: 1743791 - RNA, 17 nt, Salmonella enterica enterica serovar Typhi Ty2
caugccagauuuuccag

SEQ ID NO: 1743792 - RNA, 18 nt, Salmonella enterica enterica serovar Typhi Ty2
caugcauaaugcagccau

SEQ ID NO: 1743793 - RNA, 17 nt, Salmonella enterica enterica serovar Typhi Ty2
caugcccggugauauug

SEQ ID NO: 1743794 - RNA, 15 nt, Salmonella enterica enterica serovar Typhi Ty2
caugccaucccgcga

SEQ ID NO: 1743795 - RNA, 13 nt, Salmonella enterica enterica serovar Typhi Ty2
caucuggcacagg

SEQ ID NO: 1743796 - RNA, 14 nt, Salmonella enterica enterica serovar Typhi Ty2
caucuuaucaggcc

SEQ ID NO: 1743797 - RNA, 17 nt, Salmonella enterica enterica serovar Typhi Ty2
caucuucaccuuuccag

SEQ ID NO: 1743798 - RNA, 16 nt, Salmonella enterica enterica serovar Typhi Ty2
caucuuccagcaucag

SEQ ID NO: 1743799 - RNA, 14 nt, Salmonella enterica enterica serovar Typhi Ty2
caucuuccagcauc

SEQ ID NO: 1743800 - RNA, 21 nt, Salmonella enterica enterica serovar Typhi Ty2
caugauacccagcgucccggc

SEQ ID NO: 1743801 - RNA, 14 nt, Salmonella enterica enterica serovar Typhi Ty2
caugaccagcgccg

SEQ ID NO: 1743802 - RNA, 12 nt, Salmonella enterica enterica serovar Typhi Ty2
caugaauugccg

SEQ ID NO: 1743803 - RNA, 15 nt, Salmonella enterica enterica serovar Typhi Ty2
caugacccagagcga

SEQ ID NO: 1743804 - RNA, 20 nt, Salmonella enterica enterica serovar Typhi Ty2
caugaagcgauuuauccacc

SEQ ID NO: 1743805 - RNA, 20 nt, Salmonella enterica enterica serovar Typhi Ty2
cauaacgcuuuguacagaca

SEQ ID NO: 1743806 - RNA, 16 nt, Salmonella enterica enterica serovar Typhi Ty2
cauaaugaauacgcuc

SEQ ID NO: 1743807 - RNA, 12 nt, Salmonella enterica enterica serovar Typhi Ty2
cauaaugaaucc

SEQ ID NO: 1743808 - RNA, 22 nt, Salmonella enterica enterica serovar Typhi Ty2
cauaaugaauuuaucccguggu

SEQ ID NO: 1743809 - RNA, 15 nt, Salmonella enterica enterica serovar Typhi Ty2
cauaaccaaacgcgc

SEQ ID NO: 1743810 - RNA, 16 nt, Salmonella enterica enterica serovar Typhi Ty2
cauaaccgugcggcgg

SEQ ID NO: 1743811 - RNA, 17 nt, Salmonella enterica enterica serovar Typhi Ty2
cauaacgcuguaccggc

SEQ ID NO: 1743812 - RNA, 23 nt, Salmonella enterica enterica serovar Typhi Ty2
cagugugguuucaagcggcagac

SEQ ID NO: 1743813 - RNA, 16 nt, Salmonella enterica enterica serovar Typhi Ty2
cauacgcuuuacgcuu

SEQ ID NO: 1743814 - RNA, 22 nt, Salmonella enterica enterica serovar Typhi Ty2
cauacugaaauuucuuuuccag

SEQ ID NO: 1743815 - RNA, 22 nt, Salmonella enterica enterica serovar Typhi Ty2
cauaccggacuccaggcaacgu

SEQ ID NO: 1743816 - RNA, 14 nt, Salmonella enterica enterica serovar Typhi Ty2
cauaccgucaccac

SEQ ID NO: 1743817 - RNA, 14 nt, Salmonella enterica enterica serovar Typhi Ty2
cauaauuuccggcg

SEQ ID NO: 1743818 - RNA, 16 nt, Salmonella enterica enterica serovar Typhi Ty2
cauacaccuuugcccg

SEQ ID NO: 1743819 - RNA, 13 nt, Salmonella enterica enterica serovar Typhi Ty2
cauacacgcggcg

SEQ ID NO: 1743820 - RNA, 20 nt, Salmonella enterica enterica serovar Typhi Ty2
caucagauuuaggaucguaa

SEQ ID NO: 1743821 - RNA, 17 nt, Salmonella enterica enterica serovar Typhi Ty2
caucagccagcagcuca

SEQ ID NO: 1743822 - RNA, 14 nt, Salmonella enterica enterica serovar Typhi Ty2
caucagcaggauag

SEQ ID NO: 1743823 - RNA, 18 nt, Salmonella enterica enterica serovar Typhi Ty2
caucagacuguuacgcug

SEQ ID NO: 1743824 - RNA, 20 nt, Salmonella enterica enterica serovar Typhi Ty2
caucagaagugccaguaacu

SEQ ID NO: 1743825 - RNA, 22 nt, Salmonella enterica enterica serovar Typhi Ty2
caucagaauaaugcuggcggac

SEQ ID NO: 1743826 - RNA, 19 nt, Salmonella enterica enterica serovar Typhi Ty2
caucaccugaugucccauc

SEQ ID NO: 1743827 - RNA, 16 nt, Salmonella enterica enterica serovar Typhi Ty2
caucaccguuuuccag

SEQ ID NO: 1743828 - RNA, 12 nt, Salmonella enterica enterica serovar Typhi Ty2
caucaccguuac

SEQ ID NO: 1743829 - RNA, 21 nt, Salmonella enterica enterica serovar Typhi Ty2
caucaaaaucaucgccacgau

SEQ ID NO: 1743830 - RNA, 22 nt, Salmonella enterica enterica serovar Typhi Ty2
cauauucaguuuuacgccauag

SEQ ID NO: 1743831 - RNA, 14 nt, Salmonella enterica enterica serovar Typhi Ty2
cauauugagcggua

SEQ ID NO: 1743832 - RNA, 18 nt, Salmonella enterica enterica serovar Typhi Ty2
caucaauuuugcgccuac

SEQ ID NO: 1743833 - RNA, 16 nt, Salmonella enterica enterica serovar Typhi Ty2
caucacaucgcgcagc

SEQ ID NO: 1743834 - RNA, 21 nt, Salmonella enterica enterica serovar Typhi Ty2
caucacaucguaaaucagcgu

SEQ ID NO: 1743835 - RNA, 17 nt, Salmonella enterica enterica serovar Typhi Ty2
cauagacuuuggcgcag

SEQ ID NO: 1743836 - RNA, 20 nt, Salmonella enterica enterica serovar Typhi Ty2
cauagagaagucugagcgca

SEQ ID NO: 1743837 - RNA, 18 nt, Salmonella enterica enterica serovar Typhi Ty2
cauagccacagcgcgcga

SEQ ID NO: 1743838 - RNA, 14 nt, Salmonella enterica enterica serovar Typhi Ty2
cauagccggauaau

SEQ ID NO: 1743839 - RNA, 17 nt, Salmonella enterica enterica serovar Typhi Ty2
cauauuaaauuccggcu

SEQ ID NO: 1743840 - RNA, 14 nt, Salmonella enterica enterica serovar Typhi Ty2
cauccggcaaugau

SEQ ID NO: 1743841 - RNA, 16 nt, Salmonella enterica enterica serovar Typhi Ty2
cauccgcauccgucaa

SEQ ID NO: 1743842 - RNA, 16 nt, Salmonella enterica enterica serovar Typhi Ty2
cauccggcacggucaa

SEQ ID NO: 1743843 - RNA, 20 nt, Salmonella enterica enterica serovar Typhi Ty2
cauccgucaaaaugaucaga

SEQ ID NO: 1743844 - RNA, 15 nt, Salmonella enterica enterica serovar Typhi Ty2
cauccgugaccugcu

SEQ ID NO: 1743845 - RNA, 15 nt, Salmonella enterica enterica serovar Typhi Ty2
cauccgucuggcgau

SEQ ID NO: 1743846 - RNA, 23 nt, Salmonella enterica enterica serovar Typhi Ty2
cauccucaaccaccaccgauaaa

SEQ ID NO: 1743847 - RNA, 21 nt, Salmonella enterica enterica serovar Typhi Ty2
cauccgggaguuucaugccau

SEQ ID NO: 1743848 - RNA, 19 nt, Salmonella enterica enterica serovar Typhi Ty2
caucaggcaucugaaaugc

SEQ ID NO: 1743849 - RNA, 13 nt, Salmonella enterica enterica serovar Typhi Ty2
caucaggcaucug

SEQ ID NO: 1743850 - RNA, 12 nt, Salmonella enterica enterica serovar Typhi Ty2
caucagcgccag

SEQ ID NO: 1743851 - RNA, 21 nt, Salmonella enterica enterica serovar Typhi Ty2
caucaguaugagcgaacggcu

SEQ ID NO: 1743852 - RNA, 13 nt, Salmonella enterica enterica serovar Typhi Ty2
caucgccagccau

SEQ ID NO: 1743853 - RNA, 16 nt, Salmonella enterica enterica serovar Typhi Ty2
caucgcgaccggauca

SEQ ID NO: 1743854 - RNA, 22 nt, Salmonella enterica enterica serovar Typhi Ty2
caucgcgaauuucaaucgccag

SEQ ID NO: 1743855 - RNA, 18 nt, Salmonella enterica enterica serovar Typhi Ty2
caucgcgucgccaucagg

SEQ ID NO: 1743856 - RNA, 13 nt, Salmonella enterica enterica serovar Typhi Ty2
caucgcucgcgcc

SEQ ID NO: 1743857 - RNA, 20 nt, Salmonella enterica enterica serovar Typhi Ty2
caucgcucgcgccacgcaga

SEQ ID NO: 1743858 - RNA, 16 nt, Salmonella enterica enterica serovar Typhi Ty2
caucgcggccagcaug

SEQ ID NO: 1743859 - RNA, 21 nt, Salmonella enterica enterica serovar Typhi Ty2
caucgcggccagcaugguuaa

SEQ ID NO: 1743860 - RNA, 19 nt, Salmonella enterica enterica serovar Typhi Ty2
caggacgagagacugauaa

SEQ ID NO: 1743861 - RNA, 16 nt, Salmonella enterica enterica serovar Typhi Ty2
cagcguguaaucgccg

SEQ ID NO: 1743862 - RNA, 16 nt, Salmonella enterica enterica serovar Typhi Ty2
cagcgugguuuccggc

SEQ ID NO: 1743863 - RNA, 18 nt, Salmonella enterica enterica serovar Typhi Ty2
cagcguguaaucgccgua

SEQ ID NO: 1743864 - RNA, 18 nt, Salmonella enterica enterica serovar Typhi Ty2
caggauaaaauccugcac

SEQ ID NO: 1743865 - RNA, 22 nt, Salmonella enterica enterica serovar Typhi Ty2
caggauaauaaugaucgcuuua

SEQ ID NO: 1743866 - RNA, 15 nt, Salmonella enterica enterica serovar Typhi Ty2
caggaucagauauuc

SEQ ID NO: 1743867 - RNA, 22 nt, Salmonella enterica enterica serovar Typhi Ty2
caggcaccuguaaccuuaaaag

SEQ ID NO: 1743868 - RNA, 16 nt, Salmonella enterica enterica serovar Typhi Ty2
caggcaaaaaucggcc

SEQ ID NO: 1743869 - RNA, 12 nt, Salmonella enterica enterica serovar Typhi Ty2
caggcaaaccag

SEQ ID NO: 1743870 - RNA, 16 nt, Salmonella enterica enterica serovar Typhi Ty2
caggcggguggugagc

SEQ ID NO: 1743871 - RNA, 16 nt, Salmonella enterica enterica serovar Typhi Ty2
caggcggggaggguca

SEQ ID NO: 1743872 - RNA, 19 nt, Salmonella enterica enterica serovar Typhi Ty2
caggcggcuuuuucaucau

SEQ ID NO: 1743873 - RNA, 18 nt, Salmonella enterica enterica serovar Typhi Ty2
caggcuucgcgcagccag

SEQ ID NO: 1743874 - RNA, 18 nt, Salmonella enterica enterica serovar Typhi Ty2
caggcuucaucggauaga

SEQ ID NO: 1743875 - RNA, 17 nt, Salmonella enterica enterica serovar Typhi Ty2
caggccugcaaaccucu

SEQ ID NO: 1743876 - RNA, 20 nt, Salmonella enterica enterica serovar Typhi Ty2
caggcgauuacaacgcgaug

SEQ ID NO: 1743877 - RNA, 13 nt, Salmonella enterica enterica serovar Typhi Ty2
caggccggauaag

SEQ ID NO: 1743878 - RNA, 17 nt, Salmonella enterica enterica serovar Typhi Ty2
caggcggaugaaacagu

SEQ ID NO: 1743879 - RNA, 18 nt, Salmonella enterica enterica serovar Typhi Ty2
caggcggcguuauacgcc

SEQ ID NO: 1743880 - RNA, 18 nt, Salmonella enterica enterica serovar Typhi Ty2
cagguggaucggaaauca

SEQ ID NO: 1743881 - RNA, 16 nt, Salmonella enterica enterica serovar Typhi Ty2
cagguuccccaaugau

SEQ ID NO: 1743882 - RNA, 21 nt, Salmonella enterica enterica serovar Typhi Ty2
cagguuguaucauguuccggc

SEQ ID NO: 1743883 - RNA, 23 nt, Salmonella enterica enterica serovar Typhi Ty2
caguacggaaaugaucagacgca

SEQ ID NO: 1743884 - RNA, 14 nt, Salmonella enterica enterica serovar Typhi Ty2
caguacgaucauga

SEQ ID NO: 1743885 - RNA, 20 nt, Salmonella enterica enterica serovar Typhi Ty2
cagugcaguauugcaccagg

SEQ ID NO: 1743886 - RNA, 16 nt, Salmonella enterica enterica serovar Typhi Ty2
cagucguuuacgcgcu

SEQ ID NO: 1743887 - RNA, 21 nt, Salmonella enterica enterica serovar Typhi Ty2
cagucucaaaggccugcauca

SEQ ID NO: 1743888 - RNA, 18 nt, Salmonella enterica enterica serovar Typhi Ty2
cagucucaaaggccugca

SEQ ID NO: 1743889 - RNA, 15 nt, Salmonella enterica enterica serovar Typhi Ty2
cagggcggaagcaga

SEQ ID NO: 1743890 - RNA, 16 nt, Salmonella enterica enterica serovar Typhi Ty2
cagggguuccggcaau

SEQ ID NO: 1743891 - RNA, 15 nt, Salmonella enterica enterica serovar Typhi Ty2
caggggucagcguau

SEQ ID NO: 1743892 - RNA, 20 nt, Salmonella enterica enterica serovar Typhi Ty2
cagggggccacuuacggaca

SEQ ID NO: 1743893 - RNA, 22 nt, Salmonella enterica enterica serovar Typhi Ty2
cagggcuuuuuucucgcgcuga

SEQ ID NO: 1743894 - RNA, 17 nt, Salmonella enterica enterica serovar Typhi Ty2
caggguaucuaacccgc

SEQ ID NO: 1743895 - RNA, 18 nt, Salmonella enterica enterica serovar Typhi Ty2
caggguucgcguacgcau

SEQ ID NO: 1743896 - RNA, 17 nt, Salmonella enterica enterica serovar Typhi Ty2
caggguucacugccagu

SEQ ID NO: 1743897 - RNA, 15 nt, Salmonella enterica enterica serovar Typhi Ty2
ccgaauaacgccagg

SEQ ID NO: 1743898 - RNA, 15 nt, Salmonella enterica enterica serovar Typhi Ty2
cccugcgcauacguc

SEQ ID NO: 1743899 - RNA, 19 nt, Salmonella enterica enterica serovar Typhi Ty2
cccugcgccagcauggcgu

SEQ ID NO: 1743900 - RNA, 16 nt, Salmonella enterica enterica serovar Typhi Ty2
cccugcgccagacgcg

SEQ ID NO: 1743901 - RNA, 24 nt, Salmonella enterica enterica serovar Typhi Ty2
cccugccggaaaaugcgccaggaa

SEQ ID NO: 1743902 - RNA, 22 nt, Salmonella enterica enterica serovar Typhi Ty2
cccugcgaacagcgcuccacgc

SEQ ID NO: 1743903 - RNA, 17 nt, Salmonella enterica enterica serovar Typhi Ty2
cccugcuggcgcaugau

SEQ ID NO: 1743904 - RNA, 15 nt, Salmonella enterica enterica serovar Typhi Ty2
cccuccggccagcgc

SEQ ID NO: 1743905 - RNA, 17 nt, Salmonella enterica enterica serovar Typhi Ty2
cccuccaguagcagcga

SEQ ID NO: 1743906 - RNA, 20 nt, Salmonella enterica enterica serovar Typhi Ty2
cccuuuuuuggucagaaagc

SEQ ID NO: 1743907 - RNA, 21 nt, Salmonella enterica enterica serovar Typhi Ty2
cccuuuuuugguuauccagca

SEQ ID NO: 1743908 - RNA, 12 nt, Salmonella enterica enterica serovar Typhi Ty2
cccuuccagcga

SEQ ID NO: 1743909 - RNA, 23 nt, Salmonella enterica enterica serovar Typhi Ty2
cccuggcgaauaaaauucagcgc

SEQ ID NO: 1743910 - RNA, 23 nt, Salmonella enterica enterica serovar Typhi Ty2
cccggucaagcgcaaucacguua

SEQ ID NO: 1743911 - RNA, 20 nt, Salmonella enterica enterica serovar Typhi Ty2
cccggcuuuuugccgggcgu

SEQ ID NO: 1743912 - RNA, 13 nt, Salmonella enterica enterica serovar Typhi Ty2
cccggugcucaau

SEQ ID NO: 1743913 - RNA, 16 nt, Salmonella enterica enterica serovar Typhi Ty2
cccguuuucgccggau

SEQ ID NO: 1743914 - RNA, 20 nt, Salmonella enterica enterica serovar Typhi Ty2
ccgacauucccugcgcauac

SEQ ID NO: 1743915 - RNA, 21 nt, Salmonella enterica enterica serovar Typhi Ty2
ccgacauuguucuaaacguuc

SEQ ID NO: 1743916 - RNA, 18 nt, Salmonella enterica enterica serovar Typhi Ty2
ccgacauucccugcgcau

SEQ ID NO: 1743917 - RNA, 16 nt, Salmonella enterica enterica serovar Typhi Ty2
ccgacaugacgucgca

SEQ ID NO: 1743918 - RNA, 18 nt, Salmonella enterica enterica serovar Typhi Ty2
ccgacaucgccaccgcau

SEQ ID NO: 1743919 - RNA, 21 nt, Salmonella enterica enterica serovar Typhi Ty2
ccgacacugaaacuccgcagc

SEQ ID NO: 1743920 - RNA, 22 nt, Salmonella enterica enterica serovar Typhi Ty2
ccgacagggcgugaaccagcau

SEQ ID NO: 1743921 - RNA, 23 nt, Salmonella enterica enterica serovar Typhi Ty2
ccgacaauggcgacgaucagcgc

SEQ ID NO: 1743922 - RNA, 20 nt, Salmonella enterica enterica serovar Typhi Ty2
ccgacaagguauaucaaccc

SEQ ID NO: 1743923 - RNA, 23 nt, Salmonella enterica enterica serovar Typhi Ty2
ccgacaagaaucacguaaucggc

SEQ ID NO: 1743924 - RNA, 18 nt, Salmonella enterica enterica serovar Typhi Ty2
ccgacaacgccuccugcc

SEQ ID NO: 1743925 - RNA, 13 nt, Salmonella enterica enterica serovar Typhi Ty2
ccgaccgccagca

SEQ ID NO: 1743926 - RNA, 23 nt, Salmonella enterica enterica serovar Typhi Ty2
ccgacgcgaauugcgaguaaccu

SEQ ID NO: 1743927 - RNA, 19 nt, Salmonella enterica enterica serovar Typhi Ty2
ccgacggggcguuaaucac

SEQ ID NO: 1743928 - RNA, 14 nt, Salmonella enterica enterica serovar Typhi Ty2
ccgacgccagccau

SEQ ID NO: 1743929 - RNA, 13 nt, Salmonella enterica enterica serovar Typhi Ty2
ccgacgccugcau

SEQ ID NO: 1743930 - RNA, 15 nt, Salmonella enterica enterica serovar Typhi Ty2
ccgagacccagcgcg

SEQ ID NO: 1743931 - RNA, 18 nt, Salmonella enterica enterica serovar Typhi Ty2
ccgagaguccagcgccag

SEQ ID NO: 1743932 - RNA, 16 nt, Salmonella enterica enterica serovar Typhi Ty2
ccgacuaccggcacca

SEQ ID NO: 1743933 - RNA, 12 nt, Salmonella enterica enterica serovar Typhi Ty2
ccgacucgcgca

SEQ ID NO: 1743934 - RNA, 20 nt, Salmonella enterica enterica serovar Typhi Ty2
ccgacugucgaaaccagcau

SEQ ID NO: 1743935 - RNA, 20 nt, Salmonella enterica enterica serovar Typhi Ty2
cccagcgggaacaucacgga

SEQ ID NO: 1743936 - RNA, 12 nt, Salmonella enterica enterica serovar Typhi Ty2
cccagucauccg

SEQ ID NO: 1743937 - RNA, 22 nt, Salmonella enterica enterica serovar Typhi Ty2
cccaguaauauccccaucccag

SEQ ID NO: 1743938 - RNA, 20 nt, Salmonella enterica enterica serovar Typhi Ty2
cccaguagcagacagccgau

SEQ ID NO: 1743939 - RNA, 16 nt, Salmonella enterica enterica serovar Typhi Ty2
cccagugcccgaaagc

SEQ ID NO: 1743940 - RNA, 14 nt, Salmonella enterica enterica serovar Typhi Ty2
cccaucgcgccauc

SEQ ID NO: 1743941 - RNA, 11 nt, Salmonella enterica enterica serovar Typhi Ty2
cccauccgcgc

SEQ ID NO: 1743942 - RNA, 15 nt, Salmonella enterica enterica serovar Typhi Ty2
cccaugcaaccagug

SEQ ID NO: 1743943 - RNA, 16 nt, Salmonella enterica enterica serovar Typhi Ty2
cccauuucaugaccga

SEQ ID NO: 1743944 - RNA, 15 nt, Salmonella enterica enterica serovar Typhi Ty2
cccauuaauaucagc

SEQ ID NO: 1743945 - RNA, 17 nt, Salmonella enterica enterica serovar Typhi Ty2
cccauuaugugcgacgu

SEQ ID NO: 1743946 - RNA, 15 nt, Salmonella enterica enterica serovar Typhi Ty2
cccaccaccgccacu

SEQ ID NO: 1743947 - RNA, 19 nt, Salmonella enterica enterica serovar Typhi Ty2
ccauuugaaucguagcgug

SEQ ID NO: 1743948 - RNA, 23 nt, Salmonella enterica enterica serovar Typhi Ty2
ccauuuuggggaaaauaccggua

SEQ ID NO: 1743949 - RNA, 23 nt, Salmonella enterica enterica serovar Typhi Ty2
cccagaaugccgcccauccagag

SEQ ID NO: 1743950 - RNA, 14 nt, Salmonella enterica enterica serovar Typhi Ty2
ccauuggccagaua

SEQ ID NO: 1743951 - RNA, 14 nt, Salmonella enterica enterica serovar Typhi Ty2
ccauugauuuccgc

SEQ ID NO: 1743952 - RNA, 23 nt, Salmonella enterica enterica serovar Typhi Ty2
aaaucgccaaagaaacgcugauc

SEQ ID NO: 1743953 - RNA, 16 nt, Salmonella enterica enterica serovar Typhi Ty2
aaaucgcuaagcagaa

SEQ ID NO: 1743954 - RNA, 16 nt, Salmonella enterica enterica serovar Typhi Ty2
aaaucgcaaacgccag

SEQ ID NO: 1743955 - RNA, 23 nt, Salmonella enterica enterica serovar Typhi Ty2
aaaucgacagccagcauuuccag

SEQ ID NO: 1743956 - RNA, 14 nt, Salmonella enterica enterica serovar Typhi Ty2
ccauuaagacaggu

SEQ ID NO: 1743957 - RNA, 15 nt, Salmonella enterica enterica serovar Typhi Ty2
ccauuccgccaacgg

SEQ ID NO: 1743958 - RNA, 12 nt, Salmonella enterica enterica serovar Typhi Ty2
ccauuagcgccu

SEQ ID NO: 1743959 - RNA, 14 nt, Salmonella enterica enterica serovar Typhi Ty2
ccaugcucauccaa

SEQ ID NO: 1743960 - RNA, 13 nt, Salmonella enterica enterica serovar Typhi Ty2
ccaguccggcaga

SEQ ID NO: 1743961 - RNA, 18 nt, Salmonella enterica enterica serovar Typhi Ty2
ccccggaucaccggcauu

SEQ ID NO: 1743962 - RNA, 21 nt, Salmonella enterica enterica serovar Typhi Ty2
ccccagcgcuccaccaaccag

SEQ ID NO: 1743963 - RNA, 23 nt, Salmonella enterica enterica serovar Typhi Ty2
ccccugcgguuucuaccacccag

SEQ ID NO: 1743964 - RNA, 20 nt, Salmonella enterica enterica serovar Typhi Ty2
ccccuuugggacgaaccggc

SEQ ID NO: 1743965 - RNA, 15 nt, Salmonella enterica enterica serovar Typhi Ty2
cccgacaccagccgu

SEQ ID NO: 1743966 - RNA, 16 nt, Salmonella enterica enterica serovar Typhi Ty2
cccgauaaaucgcauu

SEQ ID NO: 1743967 - RNA, 16 nt, Salmonella enterica enterica serovar Typhi Ty2
cccgccggcagcagcu

SEQ ID NO: 1743968 - RNA, 14 nt, Salmonella enterica enterica serovar Typhi Ty2
ccagggcaucaaua

SEQ ID NO: 1743969 - RNA, 16 nt, Salmonella enterica enterica serovar Typhi Ty2
ccaguaccgacgccau

SEQ ID NO: 1743970 - RNA, 15 nt, Salmonella enterica enterica serovar Typhi Ty2
ccagguuagcagcca

SEQ ID NO: 1743971 - RNA, 21 nt, Salmonella enterica enterica serovar Typhi Ty2
ccaggcagcgcgccagcgcua

SEQ ID NO: 1743972 - RNA, 17 nt, Salmonella enterica enterica serovar Typhi Ty2
ccaggccuaucagcgau

SEQ ID NO: 1743973 - RNA, 17 nt, Salmonella enterica enterica serovar Typhi Ty2
ccaggccgucggcgcca

SEQ ID NO: 1743974 - RNA, 21 nt, Salmonella enterica enterica serovar Typhi Ty2
ccagcucaugauagggcagca

SEQ ID NO: 1743975 - RNA, 22 nt, Salmonella enterica enterica serovar Typhi Ty2
ccagcucauuuuuacagacacg

SEQ ID NO: 1743976 - RNA, 15 nt, Salmonella enterica enterica serovar Typhi Ty2
ccagcuaaaccacgg

SEQ ID NO: 1743977 - RNA, 15 nt, Salmonella enterica enterica serovar Typhi Ty2
ccagcucccgcguca

SEQ ID NO: 1743978 - RNA, 15 nt, Salmonella enterica enterica serovar Typhi Ty2
ccagcugacgcagca

SEQ ID NO: 1743979 - RNA, 18 nt, Salmonella enterica enterica serovar Typhi Ty2
ccagcugacgacgccagc

SEQ ID NO: 1743980 - RNA, 14 nt, Salmonella enterica enterica serovar Typhi Ty2
ccagcugacgcagc

SEQ ID NO: 1743981 - RNA, 17 nt, Salmonella enterica enterica serovar Typhi Ty2
ccagcugcgacagcgaa

SEQ ID NO: 1743982 - RNA, 17 nt, Salmonella enterica enterica serovar Typhi Ty2
ccaggacaacgccggua

SEQ ID NO: 1743983 - RNA, 17 nt, Salmonella enterica enterica serovar Typhi Ty2
ccaggaauuuucccaua

SEQ ID NO: 1743984 - RNA, 23 nt, Salmonella enterica enterica serovar Typhi Ty2
ccagcgacauggcggucgccaua

SEQ ID NO: 1743985 - RNA, 16 nt, Salmonella enterica enterica serovar Typhi Ty2
ccagcgacaucgcaua

SEQ ID NO: 1743986 - RNA, 13 nt, Salmonella enterica enterica serovar Typhi Ty2
ccagcgcauccac

SEQ ID NO: 1743987 - RNA, 14 nt, Salmonella enterica enterica serovar Typhi Ty2
ccagcgacggcgua

SEQ ID NO: 1743988 - RNA, 17 nt, Salmonella enterica enterica serovar Typhi Ty2
ccagcccccagccgauc

SEQ ID NO: 1743989 - RNA, 18 nt, Salmonella enterica enterica serovar Typhi Ty2
ccagccccgaugucgcca

SEQ ID NO: 1743990 - RNA, 19 nt, Salmonella enterica enterica serovar Typhi Ty2
ccagcauauuuuccggcgu

SEQ ID NO: 1743991 - RNA, 13 nt, Salmonella enterica enterica serovar Typhi Ty2
ccagcaucgacca

SEQ ID NO: 1743992 - RNA, 13 nt, Salmonella enterica enterica serovar Typhi Ty2
ccagcaccugcuu

SEQ ID NO: 1743993 - RNA, 21 nt, Salmonella enterica enterica serovar Typhi Ty2
ccagcauugggccgauaaagc

SEQ ID NO: 1743994 - RNA, 19 nt, Salmonella enterica enterica serovar Typhi Ty2
ccagcauuucaaucgcgcc

SEQ ID NO: 1743995 - RNA, 15 nt, Salmonella enterica enterica serovar Typhi Ty2
ccagccacugcgcca

SEQ ID NO: 1743996 - RNA, 22 nt, Salmonella enterica enterica serovar Typhi Ty2
ccagccaguuagcgaucgcgcc

SEQ ID NO: 1743997 - RNA, 15 nt, Salmonella enterica enterica serovar Typhi Ty2
ccagccauccccaua

SEQ ID NO: 1743998 - RNA, 14 nt, Salmonella enterica enterica serovar Typhi Ty2
ccagccaugccaua

SEQ ID NO: 1743999 - RNA, 16 nt, Salmonella enterica enterica serovar Typhi Ty2
ccagccauuaaagaag

SEQ ID NO: 1744000 - RNA, 18 nt, Salmonella enterica enterica serovar Typhi Ty2
ccagcccaauacgccagc

SEQ ID NO: 1744001 - RNA, 17 nt, Salmonella enterica enterica serovar Typhi Ty2
ccagcgcccacaccaua

SEQ ID NO: 1744002 - RNA, 22 nt, Salmonella enterica enterica serovar Typhi Ty2
ccagcgccgaaggauuauuggc

SEQ ID NO: 1744003 - RNA, 22 nt, Salmonella enterica enterica serovar Typhi Ty2
ccagcgcgggcgaggccucguu

SEQ ID NO: 1744004 - RNA, 16 nt, Salmonella enterica enterica serovar Typhi Ty2
ccagcgguugcgcuuc

SEQ ID NO: 1744005 - RNA, 22 nt, Salmonella enterica enterica serovar Typhi Ty2
ccagcguaucgcucugcuucgg

SEQ ID NO: 1744006 - RNA, 22 nt, Salmonella enterica enterica serovar Typhi Ty2
ccagcguggcagugaguaacgu

SEQ ID NO: 1744007 - RNA, 17 nt, Salmonella enterica enterica serovar Typhi Ty2
ccacggaugaucuucau

SEQ ID NO: 1744008 - RNA, 16 nt, Salmonella enterica enterica serovar Typhi Ty2
ccacgcagcggcauug

SEQ ID NO: 1744009 - RNA, 17 nt, Salmonella enterica enterica serovar Typhi Ty2
aaaguacgcaaacaguu

SEQ ID NO: 1744010 - RNA, 17 nt, Salmonella enterica enterica serovar Typhi Ty2
aaagguuucggcgauca

SEQ ID NO: 1744011 - RNA, 19 nt, Salmonella enterica enterica serovar Typhi Ty2
aaagugaaggccagacuua

SEQ ID NO: 1744012 - RNA, 15 nt, Salmonella enterica enterica serovar Typhi Ty2
aaaguccugcgucgc

SEQ ID NO: 1744013 - RNA, 16 nt, Salmonella enterica enterica serovar Typhi Ty2
ccacgacaauauccuc

SEQ ID NO: 1744014 - RNA, 21 nt, Salmonella enterica enterica serovar Typhi Ty2
ccaccugccaggcuucgcgca

SEQ ID NO: 1744015 - RNA, 16 nt, Salmonella enterica enterica serovar Typhi Ty2
ccaccugcacggcguc

SEQ ID NO: 1744016 - RNA, 23 nt, Salmonella enterica enterica serovar Typhi Ty2
aaaggcguagaucucuaucggca

SEQ ID NO: 1744017 - RNA, 21 nt, Salmonella enterica enterica serovar Typhi Ty2
aaagguauuaagugaauagca

SEQ ID NO: 1744018 - RNA, 21 nt, Salmonella enterica enterica serovar Typhi Ty2
ccagaaccucaccguccgcca

SEQ ID NO: 1744019 - RNA, 22 nt, Salmonella enterica enterica serovar Typhi Ty2
ccagaaaucgcucaugcgcguc

SEQ ID NO: 1744020 - RNA, 19 nt, Salmonella enterica enterica serovar Typhi Ty2
ccacuuauuuguauugacg

SEQ ID NO: 1744021 - RNA, 16 nt, Salmonella enterica enterica serovar Typhi Ty2
ccacuccccaacguaa

SEQ ID NO: 1744022 - RNA, 13 nt, Salmonella enterica enterica serovar Typhi Ty2
ccacgucggauaa

SEQ ID NO: 1744023 - RNA, 20 nt, Salmonella enterica enterica serovar Typhi Ty2
ccagcaacacuuugcgcugc

SEQ ID NO: 1744024 - RNA, 15 nt, Salmonella enterica enterica serovar Typhi Ty2
ccagaugaagcgcau

SEQ ID NO: 1744025 - RNA, 22 nt, Salmonella enterica enterica serovar Typhi Ty2
ccagaugcagcggcaguuccgg

SEQ ID NO: 1744026 - RNA, 16 nt, Salmonella enterica enterica serovar Typhi Ty2
ccagaugcgaaacguc

SEQ ID NO: 1744027 - RNA, 18 nt, Salmonella enterica enterica serovar Typhi Ty2
ccagaugcugggcguguc

SEQ ID NO: 1744028 - RNA, 18 nt, Salmonella enterica enterica serovar Typhi Ty2
ccagaugcgccaguacgu

SEQ ID NO: 1744029 - RNA, 12 nt, Salmonella enterica enterica serovar Typhi Ty2
ccagaucauuac

SEQ ID NO: 1744030 - RNA, 17 nt, Salmonella enterica enterica serovar Typhi Ty2
ccagaucgucacgacgg

SEQ ID NO: 1744031 - RNA, 22 nt, Salmonella enterica enterica serovar Typhi Ty2
ccagacggcggcgaauagcgaa

SEQ ID NO: 1744032 - RNA, 21 nt, Salmonella enterica enterica serovar Typhi Ty2
ccagacgaacggccugaucaa

SEQ ID NO: 1744033 - RNA, 13 nt, Salmonella enterica enterica serovar Typhi Ty2
ccagacgauaagg

SEQ ID NO: 1744034 - RNA, 12 nt, Salmonella enterica enterica serovar Typhi Ty2
ccaccaaagcca

SEQ ID NO: 1744035 - RNA, 19 nt, Salmonella enterica enterica serovar Typhi Ty2
ccacagaucuaucugaaca

SEQ ID NO: 1744036 - RNA, 15 nt, Salmonella enterica enterica serovar Typhi Ty2
ccaccagccgauaac

SEQ ID NO: 1744037 - RNA, 13 nt, Salmonella enterica enterica serovar Typhi Ty2
ccaccagcgccag

SEQ ID NO: 1744038 - RNA, 13 nt, Salmonella enterica enterica serovar Typhi Ty2
ccaccagcgccau

SEQ ID NO: 1744039 - RNA, 15 nt, Salmonella enterica enterica serovar Typhi Ty2
ccacccgggaagccc

SEQ ID NO: 1744040 - RNA, 22 nt, Salmonella enterica enterica serovar Typhi Ty2
ccacccgggccggaagagcgca

SEQ ID NO: 1744041 - RNA, 13 nt, Salmonella enterica enterica serovar Typhi Ty2
ccaccauccgcgc

SEQ ID NO: 1744042 - RNA, 19 nt, Salmonella enterica enterica serovar Typhi Ty2
ccaccauaggccagcguca

SEQ ID NO: 1744043 - RNA, 12 nt, Salmonella enterica enterica serovar Typhi Ty2
ccaccgcugaug

SEQ ID NO: 1744044 - RNA, 15 nt, Salmonella enterica enterica serovar Typhi Ty2
ccaccgccucgccaa

SEQ ID NO: 1744045 - RNA, 20 nt, Salmonella enterica enterica serovar Typhi Ty2
aaagcuugaaagcagucccg

SEQ ID NO: 1744046 - RNA, 11 nt, Salmonella enterica enterica serovar Typhi Ty2
aaagcugguau

SEQ ID NO: 1744047 - RNA, 17 nt, Salmonella enterica enterica serovar Typhi Ty2
ccaagauccagcgguaa

SEQ ID NO: 1744048 - RNA, 16 nt, Salmonella enterica enterica serovar Typhi Ty2
ccaacggcgacgcccg

SEQ ID NO: 1744049 - RNA, 20 nt, Salmonella enterica enterica serovar Typhi Ty2
ccaacgucaauguaauucac

SEQ ID NO: 1744050 - RNA, 14 nt, Salmonella enterica enterica serovar Typhi Ty2
ccaaagauaagacc

SEQ ID NO: 1744051 - RNA, 15 nt, Salmonella enterica enterica serovar Typhi Ty2
ccaaagaaacgcuga

SEQ ID NO: 1744052 - RNA, 22 nt, Salmonella enterica enterica serovar Typhi Ty2
ccaaagcgcccgauaauaucac

SEQ ID NO: 1744053 - RNA, 13 nt, Salmonella enterica enterica serovar Typhi Ty2
ccaaagucauugc

SEQ ID NO: 1744054 - RNA, 15 nt, Salmonella enterica enterica serovar Typhi Ty2
ccaaaguuaaucagc

SEQ ID NO: 1744055 - RNA, 21 nt, Salmonella enterica enterica serovar Typhi Ty2
ccaacauguaauuacggcaca

SEQ ID NO: 1744056 - RNA, 17 nt, Salmonella enterica enterica serovar Typhi Ty2
ccaacagguuaaucagc

SEQ ID NO: 1744057 - RNA, 18 nt, Salmonella enterica enterica serovar Typhi Ty2
ccaaaucaugccgccaaa

SEQ ID NO: 1744058 - RNA, 16 nt, Salmonella enterica enterica serovar Typhi Ty2
ccaaauaaaagccgcc

SEQ ID NO: 1744059 - RNA, 20 nt, Salmonella enterica enterica serovar Typhi Ty2
ccaaauaguccagcagccau

SEQ ID NO: 1744060 - RNA, 19 nt, Salmonella enterica enterica serovar Typhi Ty2
aaagccggaugugagcgca

SEQ ID NO: 1744061 - RNA, 17 nt, Salmonella enterica enterica serovar Typhi Ty2
aaagccgccauccggca

SEQ ID NO: 1744062 - RNA, 20 nt, Salmonella enterica enterica serovar Typhi Ty2
ccaauauugacguuaaaaug

SEQ ID NO: 1744063 - RNA, 14 nt, Salmonella enterica enterica serovar Typhi Ty2
ccaagcagcgccac

SEQ ID NO: 1744064 - RNA, 18 nt, Salmonella enterica enterica serovar Typhi Ty2
ccacaaucacagcgcaga

SEQ ID NO: 1744065 - RNA, 14 nt, Salmonella enterica enterica serovar Typhi Ty2
ccacaaucccgcca

SEQ ID NO: 1744066 - RNA, 16 nt, Salmonella enterica enterica serovar Typhi Ty2
ccacaaauucugaaga

SEQ ID NO: 1744067 - RNA, 15 nt, Salmonella enterica enterica serovar Typhi Ty2
ccacaaaggcgcgua

SEQ ID NO: 1744068 - RNA, 17 nt, Salmonella enterica enterica serovar Typhi Ty2
ccacaaaaccguugucg

SEQ ID NO: 1744069 - RNA, 23 nt, Salmonella enterica enterica serovar Typhi Ty2
ccacaacgccugaugcugcgcau

SEQ ID NO: 1744070 - RNA, 23 nt, Salmonella enterica enterica serovar Typhi Ty2
aaagccgugaauaaaaccggcau

SEQ ID NO: 1744071 - RNA, 12 nt, Salmonella enterica enterica serovar Typhi Ty2
aaagcgaauacu

SEQ ID NO: 1744072 - RNA, 16 nt, Salmonella enterica enterica serovar Typhi Ty2
ccaaugaugcgcugua

SEQ ID NO: 1744073 - RNA, 19 nt, Salmonella enterica enterica serovar Typhi Ty2
ccaaugaacccucgaaugu

SEQ ID NO: 1744074 - RNA, 16 nt, Salmonella enterica enterica serovar Typhi Ty2
cgauucccgaucuuca

SEQ ID NO: 1744075 - RNA, 18 nt, Salmonella enterica enterica serovar Typhi Ty2
cgcaacaggccgcaucgg

SEQ ID NO: 1744076 - RNA, 16 nt, Salmonella enterica enterica serovar Typhi Ty2
cgcaacaggccgcauc

SEQ ID NO: 1744077 - RNA, 14 nt, Salmonella enterica enterica serovar Typhi Ty2
cgcaaccacggcgc

SEQ ID NO: 1744078 - RNA, 18 nt, Salmonella enterica enterica serovar Typhi Ty2
cgcaaagcccaucagcgc

SEQ ID NO: 1744079 - RNA, 20 nt, Salmonella enterica enterica serovar Typhi Ty2
cgcaaagcccaucagcgcca

SEQ ID NO: 1744080 - RNA, 19 nt, Salmonella enterica enterica serovar Typhi Ty2
cgcaaagacaggugaccag

SEQ ID NO: 1744081 - RNA, 22 nt, Salmonella enterica enterica serovar Typhi Ty2
cgcaaagacaggugaccaggcu

SEQ ID NO: 1744082 - RNA, 16 nt, Salmonella enterica enterica serovar Typhi Ty2
cgcaaacgccgugaac

SEQ ID NO: 1744083 - RNA, 13 nt, Salmonella enterica enterica serovar Typhi Ty2
cgcaaacgccgaa

SEQ ID NO: 1744084 - RNA, 17 nt, Salmonella enterica enterica serovar Typhi Ty2
cgauuuugguagcgcug

SEQ ID NO: 1744085 - RNA, 15 nt, Salmonella enterica enterica serovar Typhi Ty2
cgcaaaaccauacug

SEQ ID NO: 1744086 - RNA, 20 nt, Salmonella enterica enterica serovar Typhi Ty2
cgauugucaucauucgcgaa

SEQ ID NO: 1744087 - RNA, 14 nt, Salmonella enterica enterica serovar Typhi Ty2
cgauggugcggcgc

SEQ ID NO: 1744088 - RNA, 17 nt, Salmonella enterica enterica serovar Typhi Ty2
cgauggugccgacaacc

SEQ ID NO: 1744089 - RNA, 18 nt, Salmonella enterica enterica serovar Typhi Ty2
cgauggucucaaucgcaa

SEQ ID NO: 1744090 - RNA, 23 nt, Salmonella enterica enterica serovar Typhi Ty2
cgaugugcguauugagcgcagug

SEQ ID NO: 1744091 - RNA, 20 nt, Salmonella enterica enterica serovar Typhi Ty2
cgauguucggauaaacgcug

SEQ ID NO: 1744092 - RNA, 14 nt, Salmonella enterica enterica serovar Typhi Ty2
cgauguucgauaau

SEQ ID NO: 1744093 - RNA, 11 nt, Salmonella enterica enterica serovar Typhi Ty2
cgaugucgcca

SEQ ID NO: 1744094 - RNA, 23 nt, Salmonella enterica enterica serovar Typhi Ty2
cgaugagcuugcacuaucgggca

SEQ ID NO: 1744095 - RNA, 23 nt, Salmonella enterica enterica serovar Typhi Ty2
cgaugcaaccccugacgggcgau

SEQ ID NO: 1744096 - RNA, 16 nt, Salmonella enterica enterica serovar Typhi Ty2
cgaugaacgacgcuga

SEQ ID NO: 1744097 - RNA, 18 nt, Salmonella enterica enterica serovar Typhi Ty2
cgaucuguuggugcgcgu

SEQ ID NO: 1744098 - RNA, 19 nt, Salmonella enterica enterica serovar Typhi Ty2
cgaucugguuauccaccag

SEQ ID NO: 1744099 - RNA, 17 nt, Salmonella enterica enterica serovar Typhi Ty2
cgauauguggacgccau

SEQ ID NO: 1744100 - RNA, 20 nt, Salmonella enterica enterica serovar Typhi Ty2
cgaugcuggugaagacgcug

SEQ ID NO: 1744101 - RNA, 17 nt, Salmonella enterica enterica serovar Typhi Ty2
cgauggcgcugcgcgca

SEQ ID NO: 1744102 - RNA, 15 nt, Salmonella enterica enterica serovar Typhi Ty2
cgauggccucaucau

SEQ ID NO: 1744103 - RNA, 20 nt, Salmonella enterica enterica serovar Typhi Ty2
cgcagcuugguagcgcaacu

SEQ ID NO: 1744104 - RNA, 19 nt, Salmonella enterica enterica serovar Typhi Ty2
cgcagcggcauuggcguua

SEQ ID NO: 1744105 - RNA, 12 nt, Salmonella enterica enterica serovar Typhi Ty2
cgcagcgcgucg

SEQ ID NO: 1744106 - RNA, 17 nt, Salmonella enterica enterica serovar Typhi Ty2
cgcagcgccugcgccgc

SEQ ID NO: 1744107 - RNA, 20 nt, Salmonella enterica enterica serovar Typhi Ty2
cgcagccgccauccggcaca

SEQ ID NO: 1744108 - RNA, 15 nt, Salmonella enterica enterica serovar Typhi Ty2
cgcagaccaaaguca

SEQ ID NO: 1744109 - RNA, 13 nt, Salmonella enterica enterica serovar Typhi Ty2
cgcagaaucagcg

SEQ ID NO: 1744110 - RNA, 23 nt, Salmonella enterica enterica serovar Typhi Ty2
cgcaacgccggugccugccgccu

SEQ ID NO: 1744111 - RNA, 18 nt, Salmonella enterica enterica serovar Typhi Ty2
cgcaccacgcaaaccgcu

SEQ ID NO: 1744112 - RNA, 21 nt, Salmonella enterica enterica serovar Typhi Ty2
cgcacgcgacgcgccagccag

SEQ ID NO: 1744113 - RNA, 14 nt, Salmonella enterica enterica serovar Typhi Ty2
cgcacgccagauaa

SEQ ID NO: 1744114 - RNA, 21 nt, Salmonella enterica enterica serovar Typhi Ty2
cgcacuucacgcuccuugagc

SEQ ID NO: 1744115 - RNA, 14 nt, Salmonella enterica enterica serovar Typhi Ty2
cgccacgacgcugg

SEQ ID NO: 1744116 - RNA, 15 nt, Salmonella enterica enterica serovar Typhi Ty2
cgccacgacgcuggu

SEQ ID NO: 1744117 - RNA, 15 nt, Salmonella enterica enterica serovar Typhi Ty2
cgccacgaucggcaa

SEQ ID NO: 1744118 - RNA, 23 nt, Salmonella enterica enterica serovar Typhi Ty2
cgccacgcaacuuaguguccacu

SEQ ID NO: 1744119 - RNA, 23 nt, Salmonella enterica enterica serovar Typhi Ty2
cgccacgccauugcugucgacaa

SEQ ID NO: 1744120 - RNA, 12 nt, Salmonella enterica enterica serovar Typhi Ty2
cgccacgcagcg

SEQ ID NO: 1744121 - RNA, 21 nt, Salmonella enterica enterica serovar Typhi Ty2
cgccacgacgcugguuccccg

SEQ ID NO: 1744122 - RNA, 21 nt, Salmonella enterica enterica serovar Typhi Ty2
cgccaccagauagucaucacc

SEQ ID NO: 1744123 - RNA, 13 nt, Salmonella enterica enterica serovar Typhi Ty2
cgccaccagcgau

SEQ ID NO: 1744124 - RNA, 16 nt, Salmonella enterica enterica serovar Typhi Ty2
cgccaccauccgacaa

SEQ ID NO: 1744125 - RNA, 14 nt, Salmonella enterica enterica serovar Typhi Ty2
cgcauugccggcga

SEQ ID NO: 1744126 - RNA, 16 nt, Salmonella enterica enterica serovar Typhi Ty2
cgcauuuuaccucacg

SEQ ID NO: 1744127 - RNA, 14 nt, Salmonella enterica enterica serovar Typhi Ty2
cgccaaaccggcga

SEQ ID NO: 1744128 - RNA, 17 nt, Salmonella enterica enterica serovar Typhi Ty2
cgccaaacguggcggca

SEQ ID NO: 1744129 - RNA, 16 nt, Salmonella enterica enterica serovar Typhi Ty2
cgccaaaaucaggcau

SEQ ID NO: 1744130 - RNA, 17 nt, Salmonella enterica enterica serovar Typhi Ty2
cgcauuccagacccgau

SEQ ID NO: 1744131 - RNA, 18 nt, Salmonella enterica enterica serovar Typhi Ty2
cgccaaagcagcugcugg

SEQ ID NO: 1744132 - RNA, 15 nt, Salmonella enterica enterica serovar Typhi Ty2
cgccaacguccgccg

SEQ ID NO: 1744133 - RNA, 17 nt, Salmonella enterica enterica serovar Typhi Ty2
cgccaacuuuuugcgca

SEQ ID NO: 1744134 - RNA, 12 nt, Salmonella enterica enterica serovar Typhi Ty2
cgccaagcgcgg

SEQ ID NO: 1744135 - RNA, 16 nt, Salmonella enterica enterica serovar Typhi Ty2
cgccaccaccagcgua

SEQ ID NO: 1744136 - RNA, 23 nt, Salmonella enterica enterica serovar Typhi Ty2
cgccaaucacuauuugugcggca

SEQ ID NO: 1744137 - RNA, 20 nt, Salmonella enterica enterica serovar Typhi Ty2
cgccaauccaugccggcuuu

SEQ ID NO: 1744138 - RNA, 18 nt, Salmonella enterica enterica serovar Typhi Ty2
cgccagccuaucgccaua

SEQ ID NO: 1744139 - RNA, 14 nt, Salmonella enterica enterica serovar Typhi Ty2
cgccagccgccauu

SEQ ID NO: 1744140 - RNA, 21 nt, Salmonella enterica enterica serovar Typhi Ty2
cgccagccgaucaucguacca

SEQ ID NO: 1744141 - RNA, 21 nt, Salmonella enterica enterica serovar Typhi Ty2
cgccagccauuaaagaaggcg

SEQ ID NO: 1744142 - RNA, 13 nt, Salmonella enterica enterica serovar Typhi Ty2
cgccagcagcagc

SEQ ID NO: 1744143 - RNA, 14 nt, Salmonella enterica enterica serovar Typhi Ty2
cgccagcagcagcg

SEQ ID NO: 1744144 - RNA, 13 nt, Salmonella enterica enterica serovar Typhi Ty2
cgccagcagcucg

SEQ ID NO: 1744145 - RNA, 23 nt, Salmonella enterica enterica serovar Typhi Ty2
cgccagcaggucgcacuccucug

SEQ ID NO: 1744146 - RNA, 23 nt, Salmonella enterica enterica serovar Typhi Ty2
cgccagaucaggcgucagcaugg

SEQ ID NO: 1744147 - RNA, 17 nt, Salmonella enterica enterica serovar Typhi Ty2
cgccagaucaggcguca

SEQ ID NO: 1744148 - RNA, 21 nt, Salmonella enterica enterica serovar Typhi Ty2
cgccagacucagccaggucug

SEQ ID NO: 1744149 - RNA, 23 nt, Salmonella enterica enterica serovar Typhi Ty2
cgccagacccgcaauaacgccga

SEQ ID NO: 1744150 - RNA, 16 nt, Salmonella enterica enterica serovar Typhi Ty2
cgccagacccagcgcu

SEQ ID NO: 1744151 - RNA, 20 nt, Salmonella enterica enterica serovar Typhi Ty2
cgccagaucgaacagcggca

SEQ ID NO: 1744152 - RNA, 11 nt, Salmonella enterica enterica serovar Typhi Ty2
cgccagaugca

SEQ ID NO: 1744153 - RNA, 21 nt, Salmonella enterica enterica serovar Typhi Ty2
cgccagcaaaauuuugcgcag

SEQ ID NO: 1744154 - RNA, 13 nt, Salmonella enterica enterica serovar Typhi Ty2
cgccagcaacgag

SEQ ID NO: 1744155 - RNA, 13 nt, Salmonella enterica enterica serovar Typhi Ty2
cgccagcaacgcc

SEQ ID NO: 1744156 - RNA, 14 nt, Salmonella enterica enterica serovar Typhi Ty2
cgccagcaacgccc

SEQ ID NO: 1744157 - RNA, 14 nt, Salmonella enterica enterica serovar Typhi Ty2
cgccagcaccagca

SEQ ID NO: 1744158 - RNA, 23 nt, Salmonella enterica enterica serovar Typhi Ty2
cgccagcacauuaagcauggcgu

SEQ ID NO: 1744159 - RNA, 21 nt, Salmonella enterica enterica serovar Typhi Ty2
cgccacucuggcgacgccaau

SEQ ID NO: 1744160 - RNA, 20 nt, Salmonella enterica enterica serovar Typhi Ty2
cgccacugccauaaugaucc

SEQ ID NO: 1744161 - RNA, 17 nt, Salmonella enterica enterica serovar Typhi Ty2
cgccacucuggcgacgc

SEQ ID NO: 1744162 - RNA, 20 nt, Salmonella enterica enterica serovar Typhi Ty2
cgccacuucacuggcggcaa

SEQ ID NO: 1744163 - RNA, 19 nt, Salmonella enterica enterica serovar Typhi Ty2
cgccacuucacuggcggca

SEQ ID NO: 1744164 - RNA, 17 nt, Salmonella enterica enterica serovar Typhi Ty2
cgccagaagccgucgau

SEQ ID NO: 1744165 - RNA, 14 nt, Salmonella enterica enterica serovar Typhi Ty2
cgccagugacgcca

SEQ ID NO: 1744166 - RNA, 16 nt, Salmonella enterica enterica serovar Typhi Ty2
cgccaguucagcgucu

SEQ ID NO: 1744167 - RNA, 18 nt, Salmonella enterica enterica serovar Typhi Ty2
cgccaggccgcggcugua

SEQ ID NO: 1744168 - RNA, 22 nt, Salmonella enterica enterica serovar Typhi Ty2
cgccagguagccgacggccaua

SEQ ID NO: 1744169 - RNA, 16 nt, Salmonella enterica enterica serovar Typhi Ty2
cgccaggguaucguca

SEQ ID NO: 1744170 - RNA, 20 nt, Salmonella enterica enterica serovar Typhi Ty2
cgccagcgugcgcagcgcgu

SEQ ID NO: 1744171 - RNA, 20 nt, Salmonella enterica enterica serovar Typhi Ty2
cgccagcgcuacccgcugac

SEQ ID NO: 1744172 - RNA, 23 nt, Salmonella enterica enterica serovar Typhi Ty2
cgccagcuccauagaaaucagca

SEQ ID NO: 1744173 - RNA, 13 nt, Salmonella enterica enterica serovar Typhi Ty2
cgccagcucaacg

SEQ ID NO: 1744174 - RNA, 17 nt, Salmonella enterica enterica serovar Typhi Ty2
cgccaggccaucgacga

SEQ ID NO: 1744175 - RNA, 22 nt, Salmonella enterica enterica serovar Typhi Ty2
cgccaugaccugggcgccagag

SEQ ID NO: 1744176 - RNA, 23 nt, Salmonella enterica enterica serovar Typhi Ty2
cgccaucucauucgccagcggau

SEQ ID NO: 1744177 - RNA, 17 nt, Salmonella enterica enterica serovar Typhi Ty2
cgccaucucacgcaugg

SEQ ID NO: 1744178 - RNA, 17 nt, Salmonella enterica enterica serovar Typhi Ty2
cgccaucguccagccau

SEQ ID NO: 1744179 - RNA, 15 nt, Salmonella enterica enterica serovar Typhi Ty2
cgccaucgucacgca

SEQ ID NO: 1744180 - RNA, 18 nt, Salmonella enterica enterica serovar Typhi Ty2
cgccaucgacagcgccau

SEQ ID NO: 1744181 - RNA, 17 nt, Salmonella enterica enterica serovar Typhi Ty2
cgccaucgacagcgcca

SEQ ID NO: 1744182 - RNA, 18 nt, Salmonella enterica enterica serovar Typhi Ty2
cgccaucgacaaaggcaa

SEQ ID NO: 1744183 - RNA, 13 nt, Salmonella enterica enterica serovar Typhi Ty2
cgccauccggcaa

SEQ ID NO: 1744184 - RNA, 16 nt, Salmonella enterica enterica serovar Typhi Ty2
cgccauccggcaauga

SEQ ID NO: 1744185 - RNA, 21 nt, Salmonella enterica enterica serovar Typhi Ty2
cgccauccuguucaagcaaua

SEQ ID NO: 1744186 - RNA, 14 nt, Salmonella enterica enterica serovar Typhi Ty2
cgccauccggcaau

SEQ ID NO: 1744187 - RNA, 13 nt, Salmonella enterica enterica serovar Typhi Ty2
cgccauacguccg

SEQ ID NO: 1744188 - RNA, 20 nt, Salmonella enterica enterica serovar Typhi Ty2
cgccauaaaucccggcgauu

SEQ ID NO: 1744189 - RNA, 20 nt, Salmonella enterica enterica serovar Typhi Ty2
cgccauacaacguaccguug

SEQ ID NO: 1744190 - RNA, 14 nt, Salmonella enterica enterica serovar Typhi Ty2
cgccaguuuacgcg

SEQ ID NO: 1744191 - RNA, 15 nt, Salmonella enterica enterica serovar Typhi Ty2
cgccaucaacgacca

SEQ ID NO: 1744192 - RNA, 18 nt, Salmonella enterica enterica serovar Typhi Ty2
cgccaucaaacgcagcaa

SEQ ID NO: 1744193 - RNA, 16 nt, Salmonella enterica enterica serovar Typhi Ty2
cgccauauacgccacg

SEQ ID NO: 1744194 - RNA, 20 nt, Salmonella enterica enterica serovar Typhi Ty2
cgccauaguccauuacgcag

SEQ ID NO: 1744195 - RNA, 19 nt, Salmonella enterica enterica serovar Typhi Ty2
cgccauauauuuacugaau

SEQ ID NO: 1744196 - RNA, 17 nt, Salmonella enterica enterica serovar Typhi Ty2
cgccaucagccgcgcua

SEQ ID NO: 1744197 - RNA, 12 nt, Salmonella enterica enterica serovar Typhi Ty2
cgccaucagcaa

SEQ ID NO: 1744198 - RNA, 16 nt, Salmonella enterica enterica serovar Typhi Ty2
cgccaucauccggcaa

SEQ ID NO: 1744199 - RNA, 13 nt, Salmonella enterica enterica serovar Typhi Ty2
cgccaugcggcgc

SEQ ID NO: 1744200 - RNA, 22 nt, Salmonella enterica enterica serovar Typhi Ty2
cgccauucgcuuccgccgggaa

SEQ ID NO: 1744201 - RNA, 13 nt, Salmonella enterica enterica serovar Typhi Ty2
cgccauuacgccg

SEQ ID NO: 1744202 - RNA, 18 nt, Salmonella enterica enterica serovar Typhi Ty2
cgcccaaauaguccagca

SEQ ID NO: 1744203 - RNA, 13 nt, Salmonella enterica enterica serovar Typhi Ty2
cgcccaacgacca

SEQ ID NO: 1744204 - RNA, 15 nt, Salmonella enterica enterica serovar Typhi Ty2
cgaccaggaucagac

SEQ ID NO: 1744205 - RNA, 18 nt, Salmonella enterica enterica serovar Typhi Ty2
cgaccaguccuuccgccg

SEQ ID NO: 1744206 - RNA, 18 nt, Salmonella enterica enterica serovar Typhi Ty2
cgaccaguuuuugcgcca

SEQ ID NO: 1744207 - RNA, 22 nt, Salmonella enterica enterica serovar Typhi Ty2
cgaccauaaauagccgaccgcc

SEQ ID NO: 1744208 - RNA, 20 nt, Salmonella enterica enterica serovar Typhi Ty2
cgaccgugauuuuuaccgcc

SEQ ID NO: 1744209 - RNA, 13 nt, Salmonella enterica enterica serovar Typhi Ty2
cgaccucaucaaa

SEQ ID NO: 1744210 - RNA, 16 nt, Salmonella enterica enterica serovar Typhi Ty2
cgaccggcgucaucau

SEQ ID NO: 1744211 - RNA, 16 nt, Salmonella enterica enterica serovar Typhi Ty2
cgacgaccggcagcgu

SEQ ID NO: 1744212 - RNA, 19 nt, Salmonella enterica enterica serovar Typhi Ty2
cgacgcgcgguugcggcgg

SEQ ID NO: 1744213 - RNA, 18 nt, Salmonella enterica enterica serovar Typhi Ty2
cgaacugucugaaucagu

SEQ ID NO: 1744214 - RNA, 16 nt, Salmonella enterica enterica serovar Typhi Ty2
cgaacuugaccagcac

SEQ ID NO: 1744215 - RNA, 23 nt, Salmonella enterica enterica serovar Typhi Ty2
cgaacuacugauuccugccagac

SEQ ID NO: 1744216 - RNA, 16 nt, Salmonella enterica enterica serovar Typhi Ty2
ccuguacuugcgccgc

SEQ ID NO: 1744217 - RNA, 20 nt, Salmonella enterica enterica serovar Typhi Ty2
ccuguaacgcauaagcgcga

SEQ ID NO: 1744218 - RNA, 19 nt, Salmonella enterica enterica serovar Typhi Ty2
ccuguaaaaaauccagcgu

SEQ ID NO: 1744219 - RNA, 19 nt, Salmonella enterica enterica serovar Typhi Ty2
ccugucaguacgucgcaua

SEQ ID NO: 1744220 - RNA, 15 nt, Salmonella enterica enterica serovar Typhi Ty2
cgaagcaggcggaga

SEQ ID NO: 1744221 - RNA, 21 nt, Salmonella enterica enterica serovar Typhi Ty2
cgaagaucgcguacagcgcca

SEQ ID NO: 1744222 - RNA, 23 nt, Salmonella enterica enterica serovar Typhi Ty2
cgaagaucguuauccagcagcca

SEQ ID NO: 1744223 - RNA, 22 nt, Salmonella enterica enterica serovar Typhi Ty2
cgaagauaugcccccgaucacg

SEQ ID NO: 1744224 - RNA, 20 nt, Salmonella enterica enterica serovar Typhi Ty2
cgaagauacggauucuugac

SEQ ID NO: 1744225 - RNA, 23 nt, Salmonella enterica enterica serovar Typhi Ty2
cgaaggauaauccgguguuuguc

SEQ ID NO: 1744226 - RNA, 19 nt, Salmonella enterica enterica serovar Typhi Ty2
cgaaggggcgggcagcagc

SEQ ID NO: 1744227 - RNA, 22 nt, Salmonella enterica enterica serovar Typhi Ty2
cgaaguagcugaaaaucaaauc

SEQ ID NO: 1744228 - RNA, 17 nt, Salmonella enterica enterica serovar Typhi Ty2
cgaaggcgcuuugcgag

SEQ ID NO: 1744229 - RNA, 14 nt, Salmonella enterica enterica serovar Typhi Ty2
cgaauccgccauag

SEQ ID NO: 1744230 - RNA, 20 nt, Salmonella enterica enterica serovar Typhi Ty2
cgaaugugcaccuuaaccgu

SEQ ID NO: 1744231 - RNA, 13 nt, Salmonella enterica enterica serovar Typhi Ty2
cgaauguuccgca

SEQ ID NO: 1744232 - RNA, 16 nt, Salmonella enterica enterica serovar Typhi Ty2
cgaauguacaccguaa

SEQ ID NO: 1744233 - RNA, 19 nt, Salmonella enterica enterica serovar Typhi Ty2
cgaauccccaucuccagac

SEQ ID NO: 1744234 - RNA, 16 nt, Salmonella enterica enterica serovar Typhi Ty2
cgaauccagcgccgaa

SEQ ID NO: 1744235 - RNA, 22 nt, Salmonella enterica enterica serovar Typhi Ty2
cgacacgcugcauauaacuuuc

SEQ ID NO: 1744236 - RNA, 21 nt, Salmonella enterica enterica serovar Typhi Ty2
cgacagauuggucagcagccc

SEQ ID NO: 1744237 - RNA, 23 nt, Salmonella enterica enterica serovar Typhi Ty2
cgacagagucguuagcagaaugg

SEQ ID NO: 1744238 - RNA, 18 nt, Salmonella enterica enterica serovar Typhi Ty2
cgacagagaaugcgccgc

SEQ ID NO: 1744239 - RNA, 16 nt, Salmonella enterica enterica serovar Typhi Ty2
cgacagcccggcgugu

SEQ ID NO: 1744240 - RNA, 22 nt, Salmonella enterica enterica serovar Typhi Ty2
cgacagcaauguuaaauucagc

SEQ ID NO: 1744241 - RNA, 23 nt, Salmonella enterica enterica serovar Typhi Ty2
cgacagcaauguuaaauucagca

SEQ ID NO: 1744242 - RNA, 20 nt, Salmonella enterica enterica serovar Typhi Ty2
cgacaguaguaucauccaua

SEQ ID NO: 1744243 - RNA, 14 nt, Salmonella enterica enterica serovar Typhi Ty2
cgacagcggcgauu

SEQ ID NO: 1744244 - RNA, 16 nt, Salmonella enterica enterica serovar Typhi Ty2
cgacaccagcgucgca

SEQ ID NO: 1744245 - RNA, 23 nt, Salmonella enterica enterica serovar Typhi Ty2
cgacacauuuucaaugcacgcca

SEQ ID NO: 1744246 - RNA, 21 nt, Salmonella enterica enterica serovar Typhi Ty2
cgacaauggcgacgaucagcg

SEQ ID NO: 1744247 - RNA, 17 nt, Salmonella enterica enterica serovar Typhi Ty2
cgacaacgcuuccggcg

SEQ ID NO: 1744248 - RNA, 16 nt, Salmonella enterica enterica serovar Typhi Ty2
cgacaacgcccacauc

SEQ ID NO: 1744249 - RNA, 21 nt, Salmonella enterica enterica serovar Typhi Ty2
cgacaaccuguaggccggaua

SEQ ID NO: 1744250 - RNA, 16 nt, Salmonella enterica enterica serovar Typhi Ty2
cgaauuccgccugcug

SEQ ID NO: 1744251 - RNA, 22 nt, Salmonella enterica enterica serovar Typhi Ty2
cgacaagcuaauccccagcgcu

SEQ ID NO: 1744252 - RNA, 16 nt, Salmonella enterica enterica serovar Typhi Ty2
cgacaccgcaaaccgu

SEQ ID NO: 1744253 - RNA, 14 nt, Salmonella enterica enterica serovar Typhi Ty2
aacaagccgccaac

SEQ ID NO: 1744254 - RNA, 18 nt, Salmonella enterica enterica serovar Typhi Ty2
cgacacccgauacacgcc

SEQ ID NO: 1744255 - RNA, 19 nt, Salmonella enterica enterica serovar Typhi Ty2
aacaaagccccgggcgcug

SEQ ID NO: 1744256 - RNA, 19 nt, Salmonella enterica enterica serovar Typhi Ty2
aacaacggcauacaggccg

SEQ ID NO: 1744257 - RNA, 18 nt, Salmonella enterica enterica serovar Typhi Ty2
cgaguccgaggcgaaacg

SEQ ID NO: 1744258 - RNA, 22 nt, Salmonella enterica enterica serovar Typhi Ty2
cgaggucagcauuucauccauu

SEQ ID NO: 1744259 - RNA, 17 nt, Salmonella enterica enterica serovar Typhi Ty2
cgagggaggcaaucgca

SEQ ID NO: 1744260 - RNA, 14 nt, Salmonella enterica enterica serovar Typhi Ty2
cgaggcauucagcc

SEQ ID NO: 1744261 - RNA, 23 nt, Salmonella enterica enterica serovar Typhi Ty2
cgaggcuuaauacggcaacggga

SEQ ID NO: 1744262 - RNA, 14 nt, Salmonella enterica enterica serovar Typhi Ty2
cgauaucgauaaag

SEQ ID NO: 1744263 - RNA, 15 nt, Salmonella enterica enterica serovar Typhi Ty2
cgauauagcgcauag

SEQ ID NO: 1744264 - RNA, 13 nt, Salmonella enterica enterica serovar Typhi Ty2
cgauauagcgcau

SEQ ID NO: 1744265 - RNA, 20 nt, Salmonella enterica enterica serovar Typhi Ty2
cgauauaucgcgucaucaaa

SEQ ID NO: 1744266 - RNA, 14 nt, Salmonella enterica enterica serovar Typhi Ty2
cgauauagcgcuga

SEQ ID NO: 1744267 - RNA, 23 nt, Salmonella enterica enterica serovar Typhi Ty2
cgauaucagggcuuuuuucucgc

SEQ ID NO: 1744268 - RNA, 16 nt, Salmonella enterica enterica serovar Typhi Ty2
cgauaucacggaauuu

SEQ ID NO: 1744269 - RNA, 19 nt, Salmonella enterica enterica serovar Typhi Ty2
cgauaaagcgguuaucggc

SEQ ID NO: 1744270 - RNA, 17 nt, Salmonella enterica enterica serovar Typhi Ty2
cgauaaacucaaucagg

SEQ ID NO: 1744271 - RNA, 22 nt, Salmonella enterica enterica serovar Typhi Ty2
cgauaaaaacccaccagcgcca

SEQ ID NO: 1744272 - RNA, 22 nt, Salmonella enterica enterica serovar Typhi Ty2
cgauaccgaaacgcauacgcag

SEQ ID NO: 1744273 - RNA, 22 nt, Salmonella enterica enterica serovar Typhi Ty2
cgauacccgcccagaucaggcc

SEQ ID NO: 1744274 - RNA, 17 nt, Salmonella enterica enterica serovar Typhi Ty2
cgauacccgcccagauc

SEQ ID NO: 1744275 - RNA, 14 nt, Salmonella enterica enterica serovar Typhi Ty2
cgauaaaaacagcg

SEQ ID NO: 1744276 - RNA, 23 nt, Salmonella enterica enterica serovar Typhi Ty2
cgauaaaaacccaccagcgccag

SEQ ID NO: 1744277 - RNA, 13 nt, Salmonella enterica enterica serovar Typhi Ty2
cgaguuacguugc

SEQ ID NO: 1744278 - RNA, 15 nt, Salmonella enterica enterica serovar Typhi Ty2
cgagcgccguuaaac

SEQ ID NO: 1744279 - RNA, 21 nt, Salmonella enterica enterica serovar Typhi Ty2
cgagcgaaggggcgggcagca

SEQ ID NO: 1744280 - RNA, 22 nt, Salmonella enterica enterica serovar Typhi Ty2
cgacguucagcauauccagcgc

SEQ ID NO: 1744281 - RNA, 20 nt, Salmonella enterica enterica serovar Typhi Ty2
cgacguucagcauauccagc

SEQ ID NO: 1744282 - RNA, 15 nt, Salmonella enterica enterica serovar Typhi Ty2
cgacgugacgcgcca

SEQ ID NO: 1744283 - RNA, 17 nt, Salmonella enterica enterica serovar Typhi Ty2
cgacgcgggaucgucaa

SEQ ID NO: 1744284 - RNA, 23 nt, Salmonella enterica enterica serovar Typhi Ty2
cgacuuuaaacuuauccgccauc

SEQ ID NO: 1744285 - RNA, 16 nt, Salmonella enterica enterica serovar Typhi Ty2
cgagaaccaacugcca

SEQ ID NO: 1744286 - RNA, 12 nt, Salmonella enterica enterica serovar Typhi Ty2
cgagauacgcug

SEQ ID NO: 1744287 - RNA, 16 nt, Salmonella enterica enterica serovar Typhi Ty2
cgagauaaaaacgggu

SEQ ID NO: 1744288 - RNA, 19 nt, Salmonella enterica enterica serovar Typhi Ty2
cgagcacuuuuuccuccug

SEQ ID NO: 1744289 - RNA, 18 nt, Salmonella enterica enterica serovar Typhi Ty2
cgagauuuuucugcgcca

SEQ ID NO: 1744290 - RNA, 13 nt, Salmonella enterica enterica serovar Typhi Ty2
cgagauucaauaa

SEQ ID NO: 1744291 - RNA, 21 nt, Salmonella enterica enterica serovar Typhi Ty2
aacacccaauauagaguccug

SEQ ID NO: 1744292 - RNA, 20 nt, Salmonella enterica enterica serovar Typhi Ty2
aacacccgcaaacuaauggc

SEQ ID NO: 1744293 - RNA, 17 nt, Salmonella enterica enterica serovar Typhi Ty2
cgagccacgcggcauca

SEQ ID NO: 1744294 - RNA, 14 nt, Salmonella enterica enterica serovar Typhi Ty2
cgagccacgcggca

SEQ ID NO: 1744295 - RNA, 14 nt, Salmonella enterica enterica serovar Typhi Ty2
cgagcaguacgccu

SEQ ID NO: 1744296 - RNA, 17 nt, Salmonella enterica enterica serovar Typhi Ty2
cgagcaucuccagcgca

SEQ ID NO: 1744297 - RNA, 15 nt, Salmonella enterica enterica serovar Typhi Ty2
cgagcauccgcgcaa

SEQ ID NO: 1744298 - RNA, 19 nt, Salmonella enterica enterica serovar Typhi Ty2
cgagccaacguauaaaaug

SEQ ID NO: 1744299 - RNA, 21 nt, Salmonella enterica enterica serovar Typhi Ty2
ccggcuaugccggaggauauu

SEQ ID NO: 1744300 - RNA, 23 nt, Salmonella enterica enterica serovar Typhi Ty2
ccggcugaacguuguauaaacag

SEQ ID NO: 1744301 - RNA, 22 nt, Salmonella enterica enterica serovar Typhi Ty2
ccgggucagcgggguucagacc

SEQ ID NO: 1744302 - RNA, 15 nt, Salmonella enterica enterica serovar Typhi Ty2
ccggguggcgcugug

SEQ ID NO: 1744303 - RNA, 16 nt, Salmonella enterica enterica serovar Typhi Ty2
ccgggugcgcgucgca

SEQ ID NO: 1744304 - RNA, 20 nt, Salmonella enterica enterica serovar Typhi Ty2
ccgguaacguaaauacccag

SEQ ID NO: 1744305 - RNA, 18 nt, Salmonella enterica enterica serovar Typhi Ty2
ccgguaucgccggcagac

SEQ ID NO: 1744306 - RNA, 17 nt, Salmonella enterica enterica serovar Typhi Ty2
ccgguauuaaagcgcgg

SEQ ID NO: 1744307 - RNA, 16 nt, Salmonella enterica enterica serovar Typhi Ty2
ccgugcucuucgugga

SEQ ID NO: 1744308 - RNA, 20 nt, Salmonella enterica enterica serovar Typhi Ty2
ccguggaaaagagcgucguu

SEQ ID NO: 1744309 - RNA, 21 nt, Salmonella enterica enterica serovar Typhi Ty2
ccgugauaauaguggugcgca

SEQ ID NO: 1744310 - RNA, 12 nt, Salmonella enterica enterica serovar Typhi Ty2
ccgucgccggaa

SEQ ID NO: 1744311 - RNA, 19 nt, Salmonella enterica enterica serovar Typhi Ty2
ccgucgccaggccagaugg

SEQ ID NO: 1744312 - RNA, 16 nt, Salmonella enterica enterica serovar Typhi Ty2
ccgucgccacaccgga

SEQ ID NO: 1744313 - RNA, 23 nt, Salmonella enterica enterica serovar Typhi Ty2
ccgucgcgcccacgcgcggcauc

SEQ ID NO: 1744314 - RNA, 13 nt, Salmonella enterica enterica serovar Typhi Ty2
ccguccggcauca

SEQ ID NO: 1744315 - RNA, 13 nt, Salmonella enterica enterica serovar Typhi Ty2
ccgucgcggcauc

SEQ ID NO: 1744316 - RNA, 17 nt, Salmonella enterica enterica serovar Typhi Ty2
ccgucgcggcuuucagc

SEQ ID NO: 1744317 - RNA, 17 nt, Salmonella enterica enterica serovar Typhi Ty2
ccgucucuuuuugcagc

SEQ ID NO: 1744318 - RNA, 17 nt, Salmonella enterica enterica serovar Typhi Ty2
ccgucguuaaucagcgc

SEQ ID NO: 1744319 - RNA, 18 nt, Salmonella enterica enterica serovar Typhi Ty2
ccggucaucgcggaaagc

SEQ ID NO: 1744320 - RNA, 17 nt, Salmonella enterica enterica serovar Typhi Ty2
ccggucauacugaacaa

SEQ ID NO: 1744321 - RNA, 17 nt, Salmonella enterica enterica serovar Typhi Ty2
ccgucaaacaucgcgcu

SEQ ID NO: 1744322 - RNA, 18 nt, Salmonella enterica enterica serovar Typhi Ty2
ccgucaaagaaaacuuuc

SEQ ID NO: 1744323 - RNA, 20 nt, Salmonella enterica enterica serovar Typhi Ty2
ccgucacaccaucccggcgu

SEQ ID NO: 1744324 - RNA, 17 nt, Salmonella enterica enterica serovar Typhi Ty2
ccguccacauccagcgc

SEQ ID NO: 1744325 - RNA, 12 nt, Salmonella enterica enterica serovar Typhi Ty2
ccgguugcugau

SEQ ID NO: 1744326 - RNA, 19 nt, Salmonella enterica enterica serovar Typhi Ty2
ccguaggccugauaagacg

SEQ ID NO: 1744327 - RNA, 14 nt, Salmonella enterica enterica serovar Typhi Ty2
ccguauugccagau

SEQ ID NO: 1744328 - RNA, 19 nt, Salmonella enterica enterica serovar Typhi Ty2
ccucuuccgguagcgccug

SEQ ID NO: 1744329 - RNA, 13 nt, Salmonella enterica enterica serovar Typhi Ty2
ccugaagcgcagu

SEQ ID NO: 1744330 - RNA, 21 nt, Salmonella enterica enterica serovar Typhi Ty2
ccugaacuuuuugcaggagcu

SEQ ID NO: 1744331 - RNA, 12 nt, Salmonella enterica enterica serovar Typhi Ty2
ccugaagauagu

SEQ ID NO: 1744332 - RNA, 22 nt, Salmonella enterica enterica serovar Typhi Ty2
ccugaaaagagcgacguugucu

SEQ ID NO: 1744333 - RNA, 21 nt, Salmonella enterica enterica serovar Typhi Ty2
ccugacugcgcgccugcgcug

SEQ ID NO: 1744334 - RNA, 20 nt, Salmonella enterica enterica serovar Typhi Ty2
ccugauaaacguagcgucau

SEQ ID NO: 1744335 - RNA, 19 nt, Salmonella enterica enterica serovar Typhi Ty2
ccugauaagcgcagcgcau

SEQ ID NO: 1744336 - RNA, 19 nt, Salmonella enterica enterica serovar Typhi Ty2
ccugauaagcacaggccau

SEQ ID NO: 1744337 - RNA, 20 nt, Salmonella enterica enterica serovar Typhi Ty2
ccugauaagcgcagcgccau

SEQ ID NO: 1744338 - RNA, 12 nt, Salmonella enterica enterica serovar Typhi Ty2
ccugagcgugca

SEQ ID NO: 1744339 - RNA, 14 nt, Salmonella enterica enterica serovar Typhi Ty2
ccugagcaaucagu

SEQ ID NO: 1744340 - RNA, 15 nt, Salmonella enterica enterica serovar Typhi Ty2
ccugacggcgcuguc

SEQ ID NO: 1744341 - RNA, 17 nt, Salmonella enterica enterica serovar Typhi Ty2
ccugacgcacaggcgcg

SEQ ID NO: 1744342 - RNA, 15 nt, Salmonella enterica enterica serovar Typhi Ty2
ccugacccgcucgua

SEQ ID NO: 1744343 - RNA, 20 nt, Salmonella enterica enterica serovar Typhi Ty2
ccugacagcgcgcgaauauc

SEQ ID NO: 1744344 - RNA, 24 nt, Salmonella enterica enterica serovar Typhi Ty2
ccugaccaguuguuccgcgcugau

SEQ ID NO: 1744345 - RNA, 11 nt, Salmonella enterica enterica serovar Typhi Ty2
ccugccagauu

SEQ ID NO: 1744346 - RNA, 20 nt, Salmonella enterica enterica serovar Typhi Ty2
ccugcauuaacggcaacagu

SEQ ID NO: 1744347 - RNA, 15 nt, Salmonella enterica enterica serovar Typhi Ty2
ccugcauugccugau

SEQ ID NO: 1744348 - RNA, 20 nt, Salmonella enterica enterica serovar Typhi Ty2
ccugcaucacgcccggcggu

SEQ ID NO: 1744349 - RNA, 12 nt, Salmonella enterica enterica serovar Typhi Ty2
ccugcaucacgc

SEQ ID NO: 1744350 - RNA, 22 nt, Salmonella enterica enterica serovar Typhi Ty2
ccugcagggaauaagcgcccau

SEQ ID NO: 1744351 - RNA, 19 nt, Salmonella enterica enterica serovar Typhi Ty2
ccugcaggguuugcgcaga

SEQ ID NO: 1744352 - RNA, 16 nt, Salmonella enterica enterica serovar Typhi Ty2
ccugcacguuacccgc

SEQ ID NO: 1744353 - RNA, 19 nt, Salmonella enterica enterica serovar Typhi Ty2
ccugaucggccagcgucgc

SEQ ID NO: 1744354 - RNA, 13 nt, Salmonella enterica enterica serovar Typhi Ty2
ccugauagcgcug

SEQ ID NO: 1744355 - RNA, 13 nt, Salmonella enterica enterica serovar Typhi Ty2
ccugaucaaucaa

SEQ ID NO: 1744356 - RNA, 21 nt, Salmonella enterica enterica serovar Typhi Ty2
ccugaucaucggcgcgucgcu

SEQ ID NO: 1744357 - RNA, 19 nt, Salmonella enterica enterica serovar Typhi Ty2
ccugauggcguagcgccau

SEQ ID NO: 1744358 - RNA, 23 nt, Salmonella enterica enterica serovar Typhi Ty2
ccuggaucugcgcauuaacgcca

SEQ ID NO: 1744359 - RNA, 19 nt, Salmonella enterica enterica serovar Typhi Ty2
ccuggccugcucaucaggu

SEQ ID NO: 1744360 - RNA, 24 nt, Salmonella enterica enterica serovar Typhi Ty2
ccuggcgaaagcgaccggcacuca

SEQ ID NO: 1744361 - RNA, 19 nt, Salmonella enterica enterica serovar Typhi Ty2
ccuggcgcucaaucagaau

SEQ ID NO: 1744362 - RNA, 19 nt, Salmonella enterica enterica serovar Typhi Ty2
ccuggugcgacaccacgca

SEQ ID NO: 1744363 - RNA, 17 nt, Salmonella enterica enterica serovar Typhi Ty2
ccugguccucugauaag

SEQ ID NO: 1744364 - RNA, 13 nt, Salmonella enterica enterica serovar Typhi Ty2
ccuggcguuauca

SEQ ID NO: 1744365 - RNA, 14 nt, Salmonella enterica enterica serovar Typhi Ty2
ccuggcuuaccugc

SEQ ID NO: 1744366 - RNA, 16 nt, Salmonella enterica enterica serovar Typhi Ty2
ccuggcuugccagaua

SEQ ID NO: 1744367 - RNA, 13 nt, Salmonella enterica enterica serovar Typhi Ty2
ccugggcgaaaac

SEQ ID NO: 1744368 - RNA, 18 nt, Salmonella enterica enterica serovar Typhi Ty2
ccugcugcggauaacguu

SEQ ID NO: 1744369 - RNA, 20 nt, Salmonella enterica enterica serovar Typhi Ty2
ccugcggguucaucgccaca

SEQ ID NO: 1744370 - RNA, 18 nt, Salmonella enterica enterica serovar Typhi Ty2
ccugcgucgcuucgccaa

SEQ ID NO: 1744371 - RNA, 17 nt, Salmonella enterica enterica serovar Typhi Ty2
ccugcuaucuuauccgc

SEQ ID NO: 1744372 - RNA, 23 nt, Salmonella enterica enterica serovar Typhi Ty2
ccugcggacgcagcucauacccu

SEQ ID NO: 1744373 - RNA, 19 nt, Salmonella enterica enterica serovar Typhi Ty2
ccugcggcagaccggucgc

SEQ ID NO: 1744374 - RNA, 23 nt, Salmonella enterica enterica serovar Typhi Ty2
ccugcggcagaccggucgcggaa

SEQ ID NO: 1744375 - RNA, 22 nt, Salmonella enterica enterica serovar Typhi Ty2
ccugcgcugucaccagcagcau

SEQ ID NO: 1744376 - RNA, 15 nt, Salmonella enterica enterica serovar Typhi Ty2
ccugccccgcucgaa

SEQ ID NO: 1744377 - RNA, 22 nt, Salmonella enterica enterica serovar Typhi Ty2
ccugccggacugauaccgcguu

SEQ ID NO: 1744378 - RNA, 18 nt, Salmonella enterica enterica serovar Typhi Ty2
ccugccgucucaaccagc

SEQ ID NO: 1744379 - RNA, 17 nt, Salmonella enterica enterica serovar Typhi Ty2
ccugcgcguaaauuuca

SEQ ID NO: 1744380 - RNA, 14 nt, Salmonella enterica enterica serovar Typhi Ty2
ccugcgcgccugac

SEQ ID NO: 1744381 - RNA, 14 nt, Salmonella enterica enterica serovar Typhi Ty2
ccugcgaucaucau

SEQ ID NO: 1744382 - RNA, 14 nt, Salmonella enterica enterica serovar Typhi Ty2
ccugcgcacagcau

SEQ ID NO: 1744383 - RNA, 15 nt, Salmonella enterica enterica serovar Typhi Ty2
ccgccacccggcaaa

SEQ ID NO: 1744384 - RNA, 15 nt, Salmonella enterica enterica serovar Typhi Ty2
ccgccagauaaagcg

SEQ ID NO: 1744385 - RNA, 14 nt, Salmonella enterica enterica serovar Typhi Ty2
ccgccagagcacga

SEQ ID NO: 1744386 - RNA, 12 nt, Salmonella enterica enterica serovar Typhi Ty2
ccgccaccacgc

SEQ ID NO: 1744387 - RNA, 12 nt, Salmonella enterica enterica serovar Typhi Ty2
ccgccagcgcaa

SEQ ID NO: 1744388 - RNA, 12 nt, Salmonella enterica enterica serovar Typhi Ty2
ccgccagcgcgg

SEQ ID NO: 1744389 - RNA, 12 nt, Salmonella enterica enterica serovar Typhi Ty2
ccgcauacaucg

SEQ ID NO: 1744390 - RNA, 14 nt, Salmonella enterica enterica serovar Typhi Ty2
ccgcagcuuauucc

SEQ ID NO: 1744391 - RNA, 19 nt, Salmonella enterica enterica serovar Typhi Ty2
ccgcagccgcucaggguaa

SEQ ID NO: 1744392 - RNA, 19 nt, Salmonella enterica enterica serovar Typhi Ty2
ccgcagccgcaaucagcgu

SEQ ID NO: 1744393 - RNA, 12 nt, Salmonella enterica enterica serovar Typhi Ty2
ccgccaucgcau

SEQ ID NO: 1744394 - RNA, 21 nt, Salmonella enterica enterica serovar Typhi Ty2
ccgccaucgcaucgaggcugg

SEQ ID NO: 1744395 - RNA, 15 nt, Salmonella enterica enterica serovar Typhi Ty2
ccgccgacaaccagc

SEQ ID NO: 1744396 - RNA, 13 nt, Salmonella enterica enterica serovar Typhi Ty2
ccgccgccugcca

SEQ ID NO: 1744397 - RNA, 15 nt, Salmonella enterica enterica serovar Typhi Ty2
ccgccgcccagaugu

SEQ ID NO: 1744398 - RNA, 11 nt, Salmonella enterica enterica serovar Typhi Ty2
ccgcgccugaa

SEQ ID NO: 1744399 - RNA, 21 nt, Salmonella enterica enterica serovar Typhi Ty2
ccgcgccuucgcggugauccc

SEQ ID NO: 1744400 - RNA, 13 nt, Salmonella enterica enterica serovar Typhi Ty2
ccgcgccgauagc

SEQ ID NO: 1744401 - RNA, 18 nt, Salmonella enterica enterica serovar Typhi Ty2
ccgcgcacaaaaggcugg

SEQ ID NO: 1744402 - RNA, 17 nt, Salmonella enterica enterica serovar Typhi Ty2
ccgcgauuuagcguugg

SEQ ID NO: 1744403 - RNA, 17 nt, Salmonella enterica enterica serovar Typhi Ty2
ccgccgggcauaugauc

SEQ ID NO: 1744404 - RNA, 19 nt, Salmonella enterica enterica serovar Typhi Ty2
ccgccuugcccguauugaa

SEQ ID NO: 1744405 - RNA, 21 nt, Salmonella enterica enterica serovar Typhi Ty2
ccgcgaaaaacgauauucgcg

SEQ ID NO: 1744406 - RNA, 23 nt, Salmonella enterica enterica serovar Typhi Ty2
ccgcgaacaaagccccgggcgcu

SEQ ID NO: 1744407 - RNA, 13 nt, Salmonella enterica enterica serovar Typhi Ty2
ccgccuuaccgcg

SEQ ID NO: 1744408 - RNA, 17 nt, Salmonella enterica enterica serovar Typhi Ty2
ccgccuuaucaggccug

SEQ ID NO: 1744409 - RNA, 20 nt, Salmonella enterica enterica serovar Typhi Ty2
ccgccuguacuuccgguauc

SEQ ID NO: 1744410 - RNA, 16 nt, Salmonella enterica enterica serovar Typhi Ty2
ccgccuaccagcacau

SEQ ID NO: 1744411 - RNA, 16 nt, Salmonella enterica enterica serovar Typhi Ty2
ccggaugugagcgcau

SEQ ID NO: 1744412 - RNA, 21 nt, Salmonella enterica enterica serovar Typhi Ty2
ccggauguaggccugauaagc

SEQ ID NO: 1744413 - RNA, 21 nt, Salmonella enterica enterica serovar Typhi Ty2
ccggauggcggcuuugaacag

SEQ ID NO: 1744414 - RNA, 21 nt, Salmonella enterica enterica serovar Typhi Ty2
ccggauggcggcgucgccugu

SEQ ID NO: 1744415 - RNA, 16 nt, Salmonella enterica enterica serovar Typhi Ty2
ccggauggcggcguaa

SEQ ID NO: 1744416 - RNA, 18 nt, Salmonella enterica enterica serovar Typhi Ty2
ccggauggcacugcgcuu

SEQ ID NO: 1744417 - RNA, 23 nt, Salmonella enterica enterica serovar Typhi Ty2
ccggauggggcauuagccgccau

SEQ ID NO: 1744418 - RNA, 21 nt, Salmonella enterica enterica serovar Typhi Ty2
ccggauuagcgacagcgcuau

SEQ ID NO: 1744419 - RNA, 15 nt, Salmonella enterica enterica serovar Typhi Ty2
ccggcaaaaaucagc

SEQ ID NO: 1744420 - RNA, 19 nt, Salmonella enterica enterica serovar Typhi Ty2
ccggcaaaccuaccggcau

SEQ ID NO: 1744421 - RNA, 19 nt, Salmonella enterica enterica serovar Typhi Ty2
ccggcaaagguugccgcaa

SEQ ID NO: 1744422 - RNA, 15 nt, Salmonella enterica enterica serovar Typhi Ty2
ccggaugcgccucau

SEQ ID NO: 1744423 - RNA, 22 nt, Salmonella enterica enterica serovar Typhi Ty2
ccggcaauauuacggaaacggu

SEQ ID NO: 1744424 - RNA, 12 nt, Salmonella enterica enterica serovar Typhi Ty2
ccggcaaucaga

SEQ ID NO: 1744425 - RNA, 23 nt, Salmonella enterica enterica serovar Typhi Ty2
ccggcacauauuccggcgcuggc

SEQ ID NO: 1744426 - RNA, 18 nt, Salmonella enterica enterica serovar Typhi Ty2
ccggcaaccugagcgcga

SEQ ID NO: 1744427 - RNA, 12 nt, Salmonella enterica enterica serovar Typhi Ty2
ccggcaacugcc

SEQ ID NO: 1744428 - RNA, 23 nt, Salmonella enterica enterica serovar Typhi Ty2
ccggcagggucguacuaaagagc

SEQ ID NO: 1744429 - RNA, 20 nt, Salmonella enterica enterica serovar Typhi Ty2
ccggcagcguaacgauaugc

SEQ ID NO: 1744430 - RNA, 14 nt, Salmonella enterica enterica serovar Typhi Ty2
ccggcgacguauuc

SEQ ID NO: 1744431 - RNA, 23 nt, Salmonella enterica enterica serovar Typhi Ty2
ccggcauaauaugcaacacgccg

SEQ ID NO: 1744432 - RNA, 19 nt, Salmonella enterica enterica serovar Typhi Ty2
ccggccauuaugcaggccg

SEQ ID NO: 1744433 - RNA, 19 nt, Salmonella enterica enterica serovar Typhi Ty2
ccgcuacaauccaggacgu

SEQ ID NO: 1744434 - RNA, 14 nt, Salmonella enterica enterica serovar Typhi Ty2
ccgcuccgcgcauc

SEQ ID NO: 1744435 - RNA, 16 nt, Salmonella enterica enterica serovar Typhi Ty2
ccgcuaaaaaacaggc

SEQ ID NO: 1744436 - RNA, 18 nt, Salmonella enterica enterica serovar Typhi Ty2
ccgcguuuugcugaugaa

SEQ ID NO: 1744437 - RNA, 20 nt, Salmonella enterica enterica serovar Typhi Ty2
ccgcgucguuacgcucguca

SEQ ID NO: 1744438 - RNA, 19 nt, Salmonella enterica enterica serovar Typhi Ty2
ccgcgucguuacgcucguc

SEQ ID NO: 1744439 - RNA, 23 nt, Salmonella enterica enterica serovar Typhi Ty2
ccgcggggaucgguuuauccccg

SEQ ID NO: 1744440 - RNA, 19 nt, Salmonella enterica enterica serovar Typhi Ty2
ccgcguaggugaauagcau

SEQ ID NO: 1744441 - RNA, 14 nt, Salmonella enterica enterica serovar Typhi Ty2
ccgcgucagcacau

SEQ ID NO: 1744442 - RNA, 19 nt, Salmonella enterica enterica serovar Typhi Ty2
ccggaaucgccugcgucgc

SEQ ID NO: 1744443 - RNA, 18 nt, Salmonella enterica enterica serovar Typhi Ty2
ccggaacggacgugcgcu

SEQ ID NO: 1744444 - RNA, 18 nt, Salmonella enterica enterica serovar Typhi Ty2
ccggaacgcgagaagccc

SEQ ID NO: 1744445 - RNA, 13 nt, Salmonella enterica enterica serovar Typhi Ty2
ccggaaccggcau

SEQ ID NO: 1744446 - RNA, 17 nt, Salmonella enterica enterica serovar Typhi Ty2
ccggaaaucgcggcgau

SEQ ID NO: 1744447 - RNA, 20 nt, Salmonella enterica enterica serovar Typhi Ty2
ccggaaauggguaucuucau

SEQ ID NO: 1744448 - RNA, 16 nt, Salmonella enterica enterica serovar Typhi Ty2
ccggaucgcugagcaa

SEQ ID NO: 1744449 - RNA, 22 nt, Salmonella enterica enterica serovar Typhi Ty2
ccggauaagcgugcgccauccg

SEQ ID NO: 1744450 - RNA, 21 nt, Salmonella enterica enterica serovar Typhi Ty2
ccggauaagcggcagcgccau

SEQ ID NO: 1744451 - RNA, 17 nt, Salmonella enterica enterica serovar Typhi Ty2
ccggauauguuugacaa

SEQ ID NO: 1744452 - RNA, 19 nt, Salmonella enterica enterica serovar Typhi Ty2
ccggauaacgcgcuggaug

SEQ ID NO: 1744453 - RNA, 20 nt, Salmonella enterica enterica serovar Typhi Ty2
ccggauaagcaacgcgccau

SEQ ID NO: 1744454 - RNA, 16 nt, Salmonella enterica enterica serovar Typhi Ty2
ccggauaacgcgcugg

SEQ ID NO: 1744455 - RNA, 19 nt, Salmonella enterica enterica serovar Typhi Ty2
cggcgaaccggcaucggca

SEQ ID NO: 1744456 - RNA, 18 nt, Salmonella enterica enterica serovar Typhi Ty2
cggcgaaucgcagagcgu

SEQ ID NO: 1744457 - RNA, 17 nt, Salmonella enterica enterica serovar Typhi Ty2
cggcgaauuguggucga

SEQ ID NO: 1744458 - RNA, 14 nt, Salmonella enterica enterica serovar Typhi Ty2
cggccuugccgcca

SEQ ID NO: 1744459 - RNA, 17 nt, Salmonella enterica enterica serovar Typhi Ty2
cggcgaaagaagcgcug

SEQ ID NO: 1744460 - RNA, 16 nt, Salmonella enterica enterica serovar Typhi Ty2
cggcgaaaucgugcgc

SEQ ID NO: 1744461 - RNA, 16 nt, Salmonella enterica enterica serovar Typhi Ty2
cggccugcgguguaga

SEQ ID NO: 1744462 - RNA, 14 nt, Salmonella enterica enterica serovar Typhi Ty2
cggcgacuccagaa

SEQ ID NO: 1744463 - RNA, 15 nt, Salmonella enterica enterica serovar Typhi Ty2
cggcgacuccagaau

SEQ ID NO: 1744464 - RNA, 17 nt, Salmonella enterica enterica serovar Typhi Ty2
cggcgauaacccgcgca

SEQ ID NO: 1744465 - RNA, 15 nt, Salmonella enterica enterica serovar Typhi Ty2
cggcgcaaacaguac

SEQ ID NO: 1744466 - RNA, 17 nt, Salmonella enterica enterica serovar Typhi Ty2
cggcgcaaacaguacgc

SEQ ID NO: 1744467 - RNA, 15 nt, Salmonella enterica enterica serovar Typhi Ty2
cggcgcacugccuga

SEQ ID NO: 1744468 - RNA, 21 nt, Salmonella enterica enterica serovar Typhi Ty2
cggcgcaguucgccgccagga

SEQ ID NO: 1744469 - RNA, 16 nt, Salmonella enterica enterica serovar Typhi Ty2
cggcgccaggacaacg

SEQ ID NO: 1744470 - RNA, 16 nt, Salmonella enterica enterica serovar Typhi Ty2
cggcggaggccagacu

SEQ ID NO: 1744471 - RNA, 13 nt, Salmonella enterica enterica serovar Typhi Ty2
cggcgcuggcgcu

SEQ ID NO: 1744472 - RNA, 13 nt, Salmonella enterica enterica serovar Typhi Ty2
cggcggccaaccc

SEQ ID NO: 1744473 - RNA, 16 nt, Salmonella enterica enterica serovar Typhi Ty2
cggcgcuacggcguuu

SEQ ID NO: 1744474 - RNA, 17 nt, Salmonella enterica enterica serovar Typhi Ty2
cggcgcgggcaacggca

SEQ ID NO: 1744475 - RNA, 15 nt, Salmonella enterica enterica serovar Typhi Ty2
cggcgcgccagcgca

SEQ ID NO: 1744476 - RNA, 11 nt, Salmonella enterica enterica serovar Typhi Ty2
cggcagaccgg

SEQ ID NO: 1744477 - RNA, 16 nt, Salmonella enterica enterica serovar Typhi Ty2
cggcacuucgauaaac

SEQ ID NO: 1744478 - RNA, 15 nt, Salmonella enterica enterica serovar Typhi Ty2
cggcagaaagcagca

SEQ ID NO: 1744479 - RNA, 20 nt, Salmonella enterica enterica serovar Typhi Ty2
cggcagcagcuucagcauca

SEQ ID NO: 1744480 - RNA, 20 nt, Salmonella enterica enterica serovar Typhi Ty2
cggcagcagugagcuuugca

SEQ ID NO: 1744481 - RNA, 17 nt, Salmonella enterica enterica serovar Typhi Ty2
aacauagcaucguuacc

SEQ ID NO: 1744482 - RNA, 14 nt, Salmonella enterica enterica serovar Typhi Ty2
cggcagcagcuuca

SEQ ID NO: 1744483 - RNA, 14 nt, Salmonella enterica enterica serovar Typhi Ty2
cggacagcgcgcaa

SEQ ID NO: 1744484 - RNA, 12 nt, Salmonella enterica enterica serovar Typhi Ty2
cggcacgccgaa

SEQ ID NO: 1744485 - RNA, 23 nt, Salmonella enterica enterica serovar Typhi Ty2
aacagggugauggugucaaucgc

SEQ ID NO: 1744486 - RNA, 16 nt, Salmonella enterica enterica serovar Typhi Ty2
aacagggguuccggca

SEQ ID NO: 1744487 - RNA, 15 nt, Salmonella enterica enterica serovar Typhi Ty2
aacaggcuucccaau

SEQ ID NO: 1744488 - RNA, 20 nt, Salmonella enterica enterica serovar Typhi Ty2
cggcaucgggaacggcauac

SEQ ID NO: 1744489 - RNA, 16 nt, Salmonella enterica enterica serovar Typhi Ty2
cggcaucucgccauaa

SEQ ID NO: 1744490 - RNA, 23 nt, Salmonella enterica enterica serovar Typhi Ty2
cggcaucgugaaacucacugaau

SEQ ID NO: 1744491 - RNA, 20 nt, Salmonella enterica enterica serovar Typhi Ty2
cggcaugauggcgaacagcc

SEQ ID NO: 1744492 - RNA, 21 nt, Salmonella enterica enterica serovar Typhi Ty2
cggcauacaccgccagcgucu

SEQ ID NO: 1744493 - RNA, 20 nt, Salmonella enterica enterica serovar Typhi Ty2
cggcauacaccgccagcguc

SEQ ID NO: 1744494 - RNA, 16 nt, Salmonella enterica enterica serovar Typhi Ty2
cggcagucgcuacaac

SEQ ID NO: 1744495 - RNA, 17 nt, Salmonella enterica enterica serovar Typhi Ty2
cggcauggaugcaugag

SEQ ID NO: 1744496 - RNA, 16 nt, Salmonella enterica enterica serovar Typhi Ty2
cggccaaccccggcaa

SEQ ID NO: 1744497 - RNA, 21 nt, Salmonella enterica enterica serovar Typhi Ty2
cggcagcgcgcacguucaggu

SEQ ID NO: 1744498 - RNA, 17 nt, Salmonella enterica enterica serovar Typhi Ty2
cggcagccgacagcgua

SEQ ID NO: 1744499 - RNA, 13 nt, Salmonella enterica enterica serovar Typhi Ty2
cggcagccacgcc

SEQ ID NO: 1744500 - RNA, 14 nt, Salmonella enterica enterica serovar Typhi Ty2
cggcagccagcgua

SEQ ID NO: 1744501 - RNA, 22 nt, Salmonella enterica enterica serovar Typhi Ty2
aacaucagcccuaucgcugcgc

SEQ ID NO: 1744502 - RNA, 22 nt, Salmonella enterica enterica serovar Typhi Ty2
aacaucagacaguacggaugau

SEQ ID NO: 1744503 - RNA, 17 nt, Salmonella enterica enterica serovar Typhi Ty2
cggcccgcuaucaccgc

SEQ ID NO: 1744504 - RNA, 13 nt, Salmonella enterica enterica serovar Typhi Ty2
cggccaggauggc

SEQ ID NO: 1744505 - RNA, 16 nt, Salmonella enterica enterica serovar Typhi Ty2
cggcccaggcaucgac

SEQ ID NO: 1744506 - RNA, 23 nt, Salmonella enterica enterica serovar Typhi Ty2
cggcccauaucaaucaacgguuc

SEQ ID NO: 1744507 - RNA, 20 nt, Salmonella enterica enterica serovar Typhi Ty2
cggcccaaacgaugaccaua

SEQ ID NO: 1744508 - RNA, 20 nt, Salmonella enterica enterica serovar Typhi Ty2
aacaucguguccuggguaac

SEQ ID NO: 1744509 - RNA, 15 nt, Salmonella enterica enterica serovar Typhi Ty2
aacaucgcuccggca

SEQ ID NO: 1744510 - RNA, 19 nt, Salmonella enterica enterica serovar Typhi Ty2
aacauccuggguuugcuga

SEQ ID NO: 1744511 - RNA, 23 nt, Salmonella enterica enterica serovar Typhi Ty2
aacaucauucccguaucuucaug

SEQ ID NO: 1744512 - RNA, 20 nt, Salmonella enterica enterica serovar Typhi Ty2
aacaucauccggcugcgucg

SEQ ID NO: 1744513 - RNA, 18 nt, Salmonella enterica enterica serovar Typhi Ty2
cggucgaaaugccuuacc

SEQ ID NO: 1744514 - RNA, 23 nt, Salmonella enterica enterica serovar Typhi Ty2
cggucagggugaaucccgccauc

SEQ ID NO: 1744515 - RNA, 18 nt, Salmonella enterica enterica serovar Typhi Ty2
cggucagggugaauacca

SEQ ID NO: 1744516 - RNA, 17 nt, Salmonella enterica enterica serovar Typhi Ty2
cggucauggauaacaug

SEQ ID NO: 1744517 - RNA, 13 nt, Salmonella enterica enterica serovar Typhi Ty2
cggucacaggcau

SEQ ID NO: 1744518 - RNA, 20 nt, Salmonella enterica enterica serovar Typhi Ty2
cgguaccgcguuuugcugau

SEQ ID NO: 1744519 - RNA, 22 nt, Salmonella enterica enterica serovar Typhi Ty2
cgguaaauuucuugaucaaucu

SEQ ID NO: 1744520 - RNA, 19 nt, Salmonella enterica enterica serovar Typhi Ty2
cgguaacaucaaguacagc

SEQ ID NO: 1744521 - RNA, 17 nt, Salmonella enterica enterica serovar Typhi Ty2
cgguaagcgcagcgcca

SEQ ID NO: 1744522 - RNA, 15 nt, Salmonella enterica enterica serovar Typhi Ty2
cgguaagagccagac

SEQ ID NO: 1744523 - RNA, 16 nt, Salmonella enterica enterica serovar Typhi Ty2
cgguaagagccagacg

SEQ ID NO: 1744524 - RNA, 14 nt, Salmonella enterica enterica serovar Typhi Ty2
cgguaagcacaacg

SEQ ID NO: 1744525 - RNA, 18 nt, Salmonella enterica enterica serovar Typhi Ty2
cgguaaucacugccgcca

SEQ ID NO: 1744526 - RNA, 19 nt, Salmonella enterica enterica serovar Typhi Ty2
cgguaaucaccagaucggc

SEQ ID NO: 1744527 - RNA, 22 nt, Salmonella enterica enterica serovar Typhi Ty2
cgguaauaauuagcauccagca

SEQ ID NO: 1744528 - RNA, 21 nt, Salmonella enterica enterica serovar Typhi Ty2
cgguaaucgccugccagcgcu

SEQ ID NO: 1744529 - RNA, 13 nt, Salmonella enterica enterica serovar Typhi Ty2
aaccaucggcaaa

SEQ ID NO: 1744530 - RNA, 15 nt, Salmonella enterica enterica serovar Typhi Ty2
aacccaccagcgcca

SEQ ID NO: 1744531 - RNA, 19 nt, Salmonella enterica enterica serovar Typhi Ty2
aacccacgacgcgguaccc

SEQ ID NO: 1744532 - RNA, 15 nt, Salmonella enterica enterica serovar Typhi Ty2
cggguuuuccugaau

SEQ ID NO: 1744533 - RNA, 22 nt, Salmonella enterica enterica serovar Typhi Ty2
cgguagcaaaggcuaccgggca

SEQ ID NO: 1744534 - RNA, 18 nt, Salmonella enterica enterica serovar Typhi Ty2
cgguacgcgucugaauga

SEQ ID NO: 1744535 - RNA, 12 nt, Salmonella enterica enterica serovar Typhi Ty2
cgguacgcuggu

SEQ ID NO: 1744536 - RNA, 12 nt, Salmonella enterica enterica serovar Typhi Ty2
cgguacgcccga

SEQ ID NO: 1744537 - RNA, 18 nt, Salmonella enterica enterica serovar Typhi Ty2
cgguaguguuaucgccga

SEQ ID NO: 1744538 - RNA, 18 nt, Salmonella enterica enterica serovar Typhi Ty2
cggucaacgcgccgccaa

SEQ ID NO: 1744539 - RNA, 14 nt, Salmonella enterica enterica serovar Typhi Ty2
cggucaacgcggcu

SEQ ID NO: 1744540 - RNA, 20 nt, Salmonella enterica enterica serovar Typhi Ty2
cgguauuuuucaccucacuc

SEQ ID NO: 1744541 - RNA, 17 nt, Salmonella enterica enterica serovar Typhi Ty2
cgguauuucgcaacgcc

SEQ ID NO: 1744542 - RNA, 14 nt, Salmonella enterica enterica serovar Typhi Ty2
cgguauuccguucc

SEQ ID NO: 1744543 - RNA, 13 nt, Salmonella enterica enterica serovar Typhi Ty2
cgggucagcgucu

SEQ ID NO: 1744544 - RNA, 15 nt, Salmonella enterica enterica serovar Typhi Ty2
cggguagucaucgcc

SEQ ID NO: 1744545 - RNA, 23 nt, Salmonella enterica enterica serovar Typhi Ty2
cggguagucaucgccuucauccg

SEQ ID NO: 1744546 - RNA, 17 nt, Salmonella enterica enterica serovar Typhi Ty2
aaccagaauaaugggga

SEQ ID NO: 1744547 - RNA, 17 nt, Salmonella enterica enterica serovar Typhi Ty2
cggguccugaucggcgg

SEQ ID NO: 1744548 - RNA, 17 nt, Salmonella enterica enterica serovar Typhi Ty2
cgggguaucuguuuauu

SEQ ID NO: 1744549 - RNA, 16 nt, Salmonella enterica enterica serovar Typhi Ty2
aaccacaugaccagcg

SEQ ID NO: 1744550 - RNA, 20 nt, Salmonella enterica enterica serovar Typhi Ty2
cgggugaauaacuucacgcu

SEQ ID NO: 1744551 - RNA, 16 nt, Salmonella enterica enterica serovar Typhi Ty2
cgggugagacgcagcc

SEQ ID NO: 1744552 - RNA, 20 nt, Salmonella enterica enterica serovar Typhi Ty2
aaccagcgcgccgccaacgc

SEQ ID NO: 1744553 - RNA, 20 nt, Salmonella enterica enterica serovar Typhi Ty2
aaccaggcgaaccccaugcc

SEQ ID NO: 1744554 - RNA, 22 nt, Salmonella enterica enterica serovar Typhi Ty2
cggguucagcgacaggcugucg

SEQ ID NO: 1744555 - RNA, 12 nt, Salmonella enterica enterica serovar Typhi Ty2
cggcgugaacgu

SEQ ID NO: 1744556 - RNA, 23 nt, Salmonella enterica enterica serovar Typhi Ty2
cggcgucuucauccucgccauaa

SEQ ID NO: 1744557 - RNA, 16 nt, Salmonella enterica enterica serovar Typhi Ty2
cggcguaccagaaugc

SEQ ID NO: 1744558 - RNA, 17 nt, Salmonella enterica enterica serovar Typhi Ty2
cggcguaccgcauaccc

SEQ ID NO: 1744559 - RNA, 19 nt, Salmonella enterica enterica serovar Typhi Ty2
cggcguguaaacagaugcu

SEQ ID NO: 1744560 - RNA, 13 nt, Salmonella enterica enterica serovar Typhi Ty2
cggcguuacuccg

SEQ ID NO: 1744561 - RNA, 18 nt, Salmonella enterica enterica serovar Typhi Ty2
cggcguuacuccgcggua

SEQ ID NO: 1744562 - RNA, 14 nt, Salmonella enterica enterica serovar Typhi Ty2
cggcguuccgcaca

SEQ ID NO: 1744563 - RNA, 19 nt, Salmonella enterica enterica serovar Typhi Ty2
cggcuaccgccguaucacu

SEQ ID NO: 1744564 - RNA, 23 nt, Salmonella enterica enterica serovar Typhi Ty2
cggcguuucaagcaguuccagca

SEQ ID NO: 1744565 - RNA, 23 nt, Salmonella enterica enterica serovar Typhi Ty2
cggcuuccguuuuguugccgccc

SEQ ID NO: 1744566 - RNA, 23 nt, Salmonella enterica enterica serovar Typhi Ty2
cggcuggguuuccggaucgccga

SEQ ID NO: 1744567 - RNA, 17 nt, Salmonella enterica enterica serovar Typhi Ty2
cggcuggguuuccggau

SEQ ID NO: 1744568 - RNA, 17 nt, Salmonella enterica enterica serovar Typhi Ty2
cggcuguagccagccug

SEQ ID NO: 1744569 - RNA, 20 nt, Salmonella enterica enterica serovar Typhi Ty2
cggcugguuauacugguggu

SEQ ID NO: 1744570 - RNA, 18 nt, Salmonella enterica enterica serovar Typhi Ty2
cggcugccauuaucacca

SEQ ID NO: 1744571 - RNA, 17 nt, Salmonella enterica enterica serovar Typhi Ty2
cgggcgguauuauccgc

SEQ ID NO: 1744572 - RNA, 21 nt, Salmonella enterica enterica serovar Typhi Ty2
cgggccguuaucuacggagua

SEQ ID NO: 1744573 - RNA, 22 nt, Salmonella enterica enterica serovar Typhi Ty2
cgggcgauuauaaggucgauau

SEQ ID NO: 1744574 - RNA, 19 nt, Salmonella enterica enterica serovar Typhi Ty2
cgggcagggaauacccgcc

SEQ ID NO: 1744575 - RNA, 14 nt, Salmonella enterica enterica serovar Typhi Ty2
cgggcaggauacgg

SEQ ID NO: 1744576 - RNA, 22 nt, Salmonella enterica enterica serovar Typhi Ty2
cgggcaggcuuccacgcacgcc

SEQ ID NO: 1744577 - RNA, 13 nt, Salmonella enterica enterica serovar Typhi Ty2
cgggaucgccaga

SEQ ID NO: 1744578 - RNA, 14 nt, Salmonella enterica enterica serovar Typhi Ty2
aacauugcaggucu

SEQ ID NO: 1744579 - RNA, 16 nt, Salmonella enterica enterica serovar Typhi Ty2
cgggcaaaaugcgucg

SEQ ID NO: 1744580 - RNA, 16 nt, Salmonella enterica enterica serovar Typhi Ty2
cgggcaaaagggccau

SEQ ID NO: 1744581 - RNA, 18 nt, Salmonella enterica enterica serovar Typhi Ty2
cgggauuuuaagcaucca

SEQ ID NO: 1744582 - RNA, 14 nt, Salmonella enterica enterica serovar Typhi Ty2
cgcuggucagcgcg

SEQ ID NO: 1744583 - RNA, 15 nt, Salmonella enterica enterica serovar Typhi Ty2
cgcuggucaacacgc

SEQ ID NO: 1744584 - RNA, 15 nt, Salmonella enterica enterica serovar Typhi Ty2
cgcugggcgauaaaa

SEQ ID NO: 1744585 - RNA, 14 nt, Salmonella enterica enterica serovar Typhi Ty2
cgcugggcacgcua

SEQ ID NO: 1744586 - RNA, 10 nt, Salmonella enterica enterica serovar Typhi Ty2
cgcuggcugg

SEQ ID NO: 1744587 - RNA, 22 nt, Salmonella enterica enterica serovar Typhi Ty2
cgcugggaaucgcgauuccgga

SEQ ID NO: 1744588 - RNA, 15 nt, Salmonella enterica enterica serovar Typhi Ty2
cgcuggcugccgcca

SEQ ID NO: 1744589 - RNA, 21 nt, Salmonella enterica enterica serovar Typhi Ty2
cgcuggcgucuguccggcgcu

SEQ ID NO: 1744590 - RNA, 17 nt, Salmonella enterica enterica serovar Typhi Ty2
cgcuggcguccagcccg

SEQ ID NO: 1744591 - RNA, 23 nt, Salmonella enterica enterica serovar Typhi Ty2
cgcuggcggguagcgcauaacgc

SEQ ID NO: 1744592 - RNA, 13 nt, Salmonella enterica enterica serovar Typhi Ty2
cgcuggcgcuguc

SEQ ID NO: 1744593 - RNA, 13 nt, Salmonella enterica enterica serovar Typhi Ty2
cgcugcuggcgaa

SEQ ID NO: 1744594 - RNA, 21 nt, Salmonella enterica enterica serovar Typhi Ty2
cgcuggcauuccccaucgcga

SEQ ID NO: 1744595 - RNA, 16 nt, Salmonella enterica enterica serovar Typhi Ty2
cgcugcgcuuauccgc

SEQ ID NO: 1744596 - RNA, 20 nt, Salmonella enterica enterica serovar Typhi Ty2
cgcugcgcuuaucaggccua

SEQ ID NO: 1744597 - RNA, 20 nt, Salmonella enterica enterica serovar Typhi Ty2
cgcugcgcuuaccgggccua

SEQ ID NO: 1744598 - RNA, 14 nt, Salmonella enterica enterica serovar Typhi Ty2
cgcugcgcucacgc

SEQ ID NO: 1744599 - RNA, 20 nt, Salmonella enterica enterica serovar Typhi Ty2
cgcugcguuuaucaggccua

SEQ ID NO: 1744600 - RNA, 17 nt, Salmonella enterica enterica serovar Typhi Ty2
cgcugcguggcgggcgu

SEQ ID NO: 1744601 - RNA, 17 nt, Salmonella enterica enterica serovar Typhi Ty2
cgcugcgucaggcgaua

SEQ ID NO: 1744602 - RNA, 14 nt, Salmonella enterica enterica serovar Typhi Ty2
cgcugcgcaggcgu

SEQ ID NO: 1744603 - RNA, 13 nt, Salmonella enterica enterica serovar Typhi Ty2
cgcugcgccagau

SEQ ID NO: 1744604 - RNA, 17 nt, Salmonella enterica enterica serovar Typhi Ty2
cgcugccgcuuauccgg

SEQ ID NO: 1744605 - RNA, 22 nt, Salmonella enterica enterica serovar Typhi Ty2
cgcugccagcugcgucagcgcu

SEQ ID NO: 1744606 - RNA, 19 nt, Salmonella enterica enterica serovar Typhi Ty2
cgcugaguuucucccgcca

SEQ ID NO: 1744607 - RNA, 17 nt, Salmonella enterica enterica serovar Typhi Ty2
cgcugauaaucguauca

SEQ ID NO: 1744608 - RNA, 21 nt, Salmonella enterica enterica serovar Typhi Ty2
cgcugauacguaacaugaccu

SEQ ID NO: 1744609 - RNA, 22 nt, Salmonella enterica enterica serovar Typhi Ty2
cgcugaguuucucccgccagau

SEQ ID NO: 1744610 - RNA, 18 nt, Salmonella enterica enterica serovar Typhi Ty2
cgcucgaaaccaucgucg

SEQ ID NO: 1744611 - RNA, 17 nt, Salmonella enterica enterica serovar Typhi Ty2
cgcuccgcgcauccggc

SEQ ID NO: 1744612 - RNA, 18 nt, Salmonella enterica enterica serovar Typhi Ty2
cgcugauuuucuccagca

SEQ ID NO: 1744613 - RNA, 11 nt, Salmonella enterica enterica serovar Typhi Ty2
cgcugauggcg

SEQ ID NO: 1744614 - RNA, 14 nt, Salmonella enterica enterica serovar Typhi Ty2
cgcugcauccugua

SEQ ID NO: 1744615 - RNA, 14 nt, Salmonella enterica enterica serovar Typhi Ty2
cgcuuuagcgauaa

SEQ ID NO: 1744616 - RNA, 17 nt, Salmonella enterica enterica serovar Typhi Ty2
cgcuuucaccaucgcga

SEQ ID NO: 1744617 - RNA, 23 nt, Salmonella enterica enterica serovar Typhi Ty2
cgcuuucaccgccucaucggcgu

SEQ ID NO: 1744618 - RNA, 22 nt, Salmonella enterica enterica serovar Typhi Ty2
cgcuuuaugcgcuuccagcaug

SEQ ID NO: 1744619 - RNA, 22 nt, Salmonella enterica enterica serovar Typhi Ty2
cgcuuuccggcgcuuccugcag

SEQ ID NO: 1744620 - RNA, 16 nt, Salmonella enterica enterica serovar Typhi Ty2
cgcuuugccagcaucg

SEQ ID NO: 1744621 - RNA, 19 nt, Salmonella enterica enterica serovar Typhi Ty2
cgcuuugauuuugcgcagc

SEQ ID NO: 1744622 - RNA, 20 nt, Salmonella enterica enterica serovar Typhi Ty2
cgcuuuaaucaguucauagc

SEQ ID NO: 1744623 - RNA, 23 nt, Salmonella enterica enterica serovar Typhi Ty2
cgcuuuuuccagcauuagcgcca

SEQ ID NO: 1744624 - RNA, 20 nt, Salmonella enterica enterica serovar Typhi Ty2
cgcuuuugguuuuucaacca

SEQ ID NO: 1744625 - RNA, 16 nt, Salmonella enterica enterica serovar Typhi Ty2
cgcuuuuucacgacca

SEQ ID NO: 1744626 - RNA, 22 nt, Salmonella enterica enterica serovar Typhi Ty2
cgcuuugucgaacuuacgacgc

SEQ ID NO: 1744627 - RNA, 16 nt, Salmonella enterica enterica serovar Typhi Ty2
cgcuuuuaauugcgca

SEQ ID NO: 1744628 - RNA, 15 nt, Salmonella enterica enterica serovar Typhi Ty2
cgcuuugccgccauc

SEQ ID NO: 1744629 - RNA, 19 nt, Salmonella enterica enterica serovar Typhi Ty2
cgcuuuuaauugcgcauca

SEQ ID NO: 1744630 - RNA, 21 nt, Salmonella enterica enterica serovar Typhi Ty2
cggaaauucacuuccgucaug

SEQ ID NO: 1744631 - RNA, 19 nt, Salmonella enterica enterica serovar Typhi Ty2
cggaaaugcggguccugau

SEQ ID NO: 1744632 - RNA, 17 nt, Salmonella enterica enterica serovar Typhi Ty2
cggaaauuugcagcgcu

SEQ ID NO: 1744633 - RNA, 14 nt, Salmonella enterica enterica serovar Typhi Ty2
cggaacaccagcgc

SEQ ID NO: 1744634 - RNA, 14 nt, Salmonella enterica enterica serovar Typhi Ty2
cggaaaucacgcau

SEQ ID NO: 1744635 - RNA, 14 nt, Salmonella enterica enterica serovar Typhi Ty2
cggaaaucgcggcg

SEQ ID NO: 1744636 - RNA, 19 nt, Salmonella enterica enterica serovar Typhi Ty2
cggaaaggauauaagcgcc

SEQ ID NO: 1744637 - RNA, 15 nt, Salmonella enterica enterica serovar Typhi Ty2
cggaaaagcgcccaa

SEQ ID NO: 1744638 - RNA, 15 nt, Salmonella enterica enterica serovar Typhi Ty2
cggaaagaauaaucg

SEQ ID NO: 1744639 - RNA, 14 nt, Salmonella enterica enterica serovar Typhi Ty2
cggaaacgcuguuc

SEQ ID NO: 1744640 - RNA, 20 nt, Salmonella enterica enterica serovar Typhi Ty2
cggaauccccgccgccagua

SEQ ID NO: 1744641 - RNA, 23 nt, Salmonella enterica enterica serovar Typhi Ty2
cggaaucgccugcgucgccccaa

SEQ ID NO: 1744642 - RNA, 20 nt, Salmonella enterica enterica serovar Typhi Ty2
cggaaguagagaaccaacgu

SEQ ID NO: 1744643 - RNA, 18 nt, Salmonella enterica enterica serovar Typhi Ty2
cggaaguagccuccggcg

SEQ ID NO: 1744644 - RNA, 16 nt, Salmonella enterica enterica serovar Typhi Ty2
cggaaugacaaacgcc

SEQ ID NO: 1744645 - RNA, 23 nt, Salmonella enterica enterica serovar Typhi Ty2
cggaaugcugguuaacgccgcca

SEQ ID NO: 1744646 - RNA, 20 nt, Salmonella enterica enterica serovar Typhi Ty2
cggaaugugaaauacagcca

SEQ ID NO: 1744647 - RNA, 21 nt, Salmonella enterica enterica serovar Typhi Ty2
cggaauggcacagcgcagcaa

SEQ ID NO: 1744648 - RNA, 23 nt, Salmonella enterica enterica serovar Typhi Ty2
cggaacgcgacucccaggcgcgc

SEQ ID NO: 1744649 - RNA, 21 nt, Salmonella enterica enterica serovar Typhi Ty2
cggaagcuuuuaguuacgcac

SEQ ID NO: 1744650 - RNA, 17 nt, Salmonella enterica enterica serovar Typhi Ty2
cgcugugguuuauccgc

SEQ ID NO: 1744651 - RNA, 21 nt, Salmonella enterica enterica serovar Typhi Ty2
cgcuguguacgcguucugaau

SEQ ID NO: 1744652 - RNA, 20 nt, Salmonella enterica enterica serovar Typhi Ty2
cgcuguggucgucuggagua

SEQ ID NO: 1744653 - RNA, 15 nt, Salmonella enterica enterica serovar Typhi Ty2
cgcuguucgccggau

SEQ ID NO: 1744654 - RNA, 21 nt, Salmonella enterica enterica serovar Typhi Ty2
cgcugugcuaucaggccuaca

SEQ ID NO: 1744655 - RNA, 21 nt, Salmonella enterica enterica serovar Typhi Ty2
cgcuuaauaauaagcggccua

SEQ ID NO: 1744656 - RNA, 22 nt, Salmonella enterica enterica serovar Typhi Ty2
cgcuuacacacccggccuauca

SEQ ID NO: 1744657 - RNA, 18 nt, Salmonella enterica enterica serovar Typhi Ty2
cgcuuaccgggcaggaua

SEQ ID NO: 1744658 - RNA, 19 nt, Salmonella enterica enterica serovar Typhi Ty2
cgcuuaccaggccuacacg

SEQ ID NO: 1744659 - RNA, 18 nt, Salmonella enterica enterica serovar Typhi Ty2
cgcuguaacccgccgcca

SEQ ID NO: 1744660 - RNA, 13 nt, Salmonella enterica enterica serovar Typhi Ty2
cgcuguagcgcca

SEQ ID NO: 1744661 - RNA, 13 nt, Salmonella enterica enterica serovar Typhi Ty2
cgcuguaccggca

SEQ ID NO: 1744662 - RNA, 19 nt, Salmonella enterica enterica serovar Typhi Ty2
cgcugucacuccggcugca

SEQ ID NO: 1744663 - RNA, 17 nt, Salmonella enterica enterica serovar Typhi Ty2
cgcugucaccagcagca

SEQ ID NO: 1744664 - RNA, 15 nt, Salmonella enterica enterica serovar Typhi Ty2
cgcugucgccgcgca

SEQ ID NO: 1744665 - RNA, 16 nt, Salmonella enterica enterica serovar Typhi Ty2
cgcuucuauuaccgca

SEQ ID NO: 1744666 - RNA, 12 nt, Salmonella enterica enterica serovar Typhi Ty2
cgcuucuggaau

SEQ ID NO: 1744667 - RNA, 20 nt, Salmonella enterica enterica serovar Typhi Ty2
cgcuucuuugaaauugauca

SEQ ID NO: 1744668 - RNA, 13 nt, Salmonella enterica enterica serovar Typhi Ty2
cgcuucuucggca

SEQ ID NO: 1744669 - RNA, 18 nt, Salmonella enterica enterica serovar Typhi Ty2
cgcuucugauuauugaca

SEQ ID NO: 1744670 - RNA, 18 nt, Salmonella enterica enterica serovar Typhi Ty2
cgcuuccugccaggccgg

SEQ ID NO: 1744671 - RNA, 20 nt, Salmonella enterica enterica serovar Typhi Ty2
cgcuucgcuuaucaggccua

SEQ ID NO: 1744672 - RNA, 18 nt, Salmonella enterica enterica serovar Typhi Ty2
cgcuuauccggccuacag

SEQ ID NO: 1744673 - RNA, 19 nt, Salmonella enterica enterica serovar Typhi Ty2
cgcuuauccggccuacgcu

SEQ ID NO: 1744674 - RNA, 12 nt, Salmonella enterica enterica serovar Typhi Ty2
cgcuuaucgcca

SEQ ID NO: 1744675 - RNA, 17 nt, Salmonella enterica enterica serovar Typhi Ty2
cgcuuaucaggccuacc

SEQ ID NO: 1744676 - RNA, 19 nt, Salmonella enterica enterica serovar Typhi Ty2
cgcuuaucaggccuacaag

SEQ ID NO: 1744677 - RNA, 13 nt, Salmonella enterica enterica serovar Typhi Ty2
cgcuuaucaggcc

SEQ ID NO: 1744678 - RNA, 18 nt, Salmonella enterica enterica serovar Typhi Ty2
cgcuuaucaggccuacaa

SEQ ID NO: 1744679 - RNA, 19 nt, Salmonella enterica enterica serovar Typhi Ty2
cgcuucacgcgcggcuacu

SEQ ID NO: 1744680 - RNA, 14 nt, Salmonella enterica enterica serovar Typhi Ty2
cgcuucacauaccc

SEQ ID NO: 1744681 - RNA, 16 nt, Salmonella enterica enterica serovar Typhi Ty2
cgcgucagggcgauaa

SEQ ID NO: 1744682 - RNA, 15 nt, Salmonella enterica enterica serovar Typhi Ty2
cgcgucagggcgaua

SEQ ID NO: 1744683 - RNA, 20 nt, Salmonella enterica enterica serovar Typhi Ty2
cgcguacuuucgccaguuca

SEQ ID NO: 1744684 - RNA, 15 nt, Salmonella enterica enterica serovar Typhi Ty2
cgcgucccucuccag

SEQ ID NO: 1744685 - RNA, 23 nt, Salmonella enterica enterica serovar Typhi Ty2
cgcggucagggugaaucccgcca

SEQ ID NO: 1744686 - RNA, 16 nt, Salmonella enterica enterica serovar Typhi Ty2
cgcgggcgaaauuggc

SEQ ID NO: 1744687 - RNA, 14 nt, Salmonella enterica enterica serovar Typhi Ty2
cgcggucagcggcg

SEQ ID NO: 1744688 - RNA, 17 nt, Salmonella enterica enterica serovar Typhi Ty2
cgcuaagacgugacgua

SEQ ID NO: 1744689 - RNA, 23 nt, Salmonella enterica enterica serovar Typhi Ty2
cgcuaaaugacaaauagaagcca

SEQ ID NO: 1744690 - RNA, 14 nt, Salmonella enterica enterica serovar Typhi Ty2
cgcuaacggcacca

SEQ ID NO: 1744691 - RNA, 18 nt, Salmonella enterica enterica serovar Typhi Ty2
cgcuacaauccaggacgu

SEQ ID NO: 1744692 - RNA, 16 nt, Salmonella enterica enterica serovar Typhi Ty2
cgcucaccuccgccac

SEQ ID NO: 1744693 - RNA, 18 nt, Salmonella enterica enterica serovar Typhi Ty2
cgcucaggagcgccugac

SEQ ID NO: 1744694 - RNA, 13 nt, Salmonella enterica enterica serovar Typhi Ty2
cgcuccaucacgg

SEQ ID NO: 1744695 - RNA, 16 nt, Salmonella enterica enterica serovar Typhi Ty2
cgcucaggaucgccgg

SEQ ID NO: 1744696 - RNA, 15 nt, Salmonella enterica enterica serovar Typhi Ty2
cgcucccccggcgau

SEQ ID NO: 1744697 - RNA, 20 nt, Salmonella enterica enterica serovar Typhi Ty2
cgcguucgcuucgaggauaa

SEQ ID NO: 1744698 - RNA, 22 nt, Salmonella enterica enterica serovar Typhi Ty2
cgcguugcuuaucaggccuaca

SEQ ID NO: 1744699 - RNA, 21 nt, Salmonella enterica enterica serovar Typhi Ty2
cgcguucgcaccauagcagcc

SEQ ID NO: 1744700 - RNA, 15 nt, Salmonella enterica enterica serovar Typhi Ty2
cgcguuguaaucgcc

SEQ ID NO: 1744701 - RNA, 14 nt, Salmonella enterica enterica serovar Typhi Ty2
cgcguuuuccagca

SEQ ID NO: 1744702 - RNA, 18 nt, Salmonella enterica enterica serovar Typhi Ty2
cgcguuuaucgcauacgg

SEQ ID NO: 1744703 - RNA, 15 nt, Salmonella enterica enterica serovar Typhi Ty2
cgcguuucgcgauaa

SEQ ID NO: 1744704 - RNA, 16 nt, Salmonella enterica enterica serovar Typhi Ty2
cgcgugagaucguuau

SEQ ID NO: 1744705 - RNA, 21 nt, Salmonella enterica enterica serovar Typhi Ty2
cgcgugacgacuaccgccgau

SEQ ID NO: 1744706 - RNA, 14 nt, Salmonella enterica enterica serovar Typhi Ty2
cgcgugacgcagua

SEQ ID NO: 1744707 - RNA, 22 nt, Salmonella enterica enterica serovar Typhi Ty2
cgcggcgacggacucgcgcaga

SEQ ID NO: 1744708 - RNA, 16 nt, Salmonella enterica enterica serovar Typhi Ty2
cgcggcgaaauaggcc

SEQ ID NO: 1744709 - RNA, 19 nt, Salmonella enterica enterica serovar Typhi Ty2
cgcggccccaucagcacau

SEQ ID NO: 1744710 - RNA, 14 nt, Salmonella enterica enterica serovar Typhi Ty2
cgcggccagcaucg

SEQ ID NO: 1744711 - RNA, 19 nt, Salmonella enterica enterica serovar Typhi Ty2
aacagcauaaacguuacca

SEQ ID NO: 1744712 - RNA, 14 nt, Salmonella enterica enterica serovar Typhi Ty2
cgcggcguaccgcg

SEQ ID NO: 1744713 - RNA, 20 nt, Salmonella enterica enterica serovar Typhi Ty2
cgcggcuacugccagcgucg

SEQ ID NO: 1744714 - RNA, 19 nt, Salmonella enterica enterica serovar Typhi Ty2
cgcggaccuuuugccgccc

SEQ ID NO: 1744715 - RNA, 16 nt, Salmonella enterica enterica serovar Typhi Ty2
cgcggaauuucaggaa

SEQ ID NO: 1744716 - RNA, 19 nt, Salmonella enterica enterica serovar Typhi Ty2
cgcggauaugcagcagcca

SEQ ID NO: 1744717 - RNA, 15 nt, Salmonella enterica enterica serovar Typhi Ty2
cgcggagagaucgac

SEQ ID NO: 1744718 - RNA, 22 nt, Salmonella enterica enterica serovar Typhi Ty2
cgcgcuuacgcuccugcgguac

SEQ ID NO: 1744719 - RNA, 17 nt, Salmonella enterica enterica serovar Typhi Ty2
cgcggcauuaaaugcgc

SEQ ID NO: 1744720 - RNA, 14 nt, Salmonella enterica enterica serovar Typhi Ty2
cgcggcagccggaa

SEQ ID NO: 1744721 - RNA, 13 nt, Salmonella enterica enterica serovar Typhi Ty2
cgcggcaggaaug

SEQ ID NO: 1744722 - RNA, 21 nt, Salmonella enterica enterica serovar Typhi Ty2
cgcggaucgugauaacgcgau

SEQ ID NO: 1744723 - RNA, 20 nt, Salmonella enterica enterica serovar Typhi Ty2
cgcggaucggcacacagcca

SEQ ID NO: 1744724 - RNA, 15 nt, Salmonella enterica enterica serovar Typhi Ty2
cgcggauugccgccc

SEQ ID NO: 1744725 - RNA, 22 nt, Salmonella enterica enterica serovar Typhi Ty2
cgcgacgcgccagccagcgcca

SEQ ID NO: 1744726 - RNA, 19 nt, Salmonella enterica enterica serovar Typhi Ty2
cgcgacgcgccagccagcg

SEQ ID NO: 1744727 - RNA, 12 nt, Salmonella enterica enterica serovar Typhi Ty2
cgcgacgccgag

SEQ ID NO: 1744728 - RNA, 13 nt, Salmonella enterica enterica serovar Typhi Ty2
cgcgacgccgcau

SEQ ID NO: 1744729 - RNA, 14 nt, Salmonella enterica enterica serovar Typhi Ty2
cgcgacgccgcaua

SEQ ID NO: 1744730 - RNA, 19 nt, Salmonella enterica enterica serovar Typhi Ty2
cgcgacguacuggaacagu

SEQ ID NO: 1744731 - RNA, 14 nt, Salmonella enterica enterica serovar Typhi Ty2
cgcgaucgcggcaa

SEQ ID NO: 1744732 - RNA, 21 nt, Salmonella enterica enterica serovar Typhi Ty2
cgcgaucaaucacgccgauaa

SEQ ID NO: 1744733 - RNA, 17 nt, Salmonella enterica enterica serovar Typhi Ty2
cgcgauuuucaucaagc

SEQ ID NO: 1744734 - RNA, 18 nt, Salmonella enterica enterica serovar Typhi Ty2
cgcgcaaagccuuuccgc

SEQ ID NO: 1744735 - RNA, 14 nt, Salmonella enterica enterica serovar Typhi Ty2
cgcgcagcaggcca

SEQ ID NO: 1744736 - RNA, 15 nt, Salmonella enterica enterica serovar Typhi Ty2
cgcgcagacaguggc

SEQ ID NO: 1744737 - RNA, 13 nt, Salmonella enterica enterica serovar Typhi Ty2
cgcgcauccgggc

SEQ ID NO: 1744738 - RNA, 17 nt, Salmonella enterica enterica serovar Typhi Ty2
cgcgcaggcgccgauaa

SEQ ID NO: 1744739 - RNA, 13 nt, Salmonella enterica enterica serovar Typhi Ty2
cgcgccagcgaca

SEQ ID NO: 1744740 - RNA, 13 nt, Salmonella enterica enterica serovar Typhi Ty2
cgcgccgccaacg

SEQ ID NO: 1744741 - RNA, 22 nt, Salmonella enterica enterica serovar Typhi Ty2
cgcgccgacauagcugaacaau

SEQ ID NO: 1744742 - RNA, 15 nt, Salmonella enterica enterica serovar Typhi Ty2
cgcgcccaccgauga

SEQ ID NO: 1744743 - RNA, 18 nt, Salmonella enterica enterica serovar Typhi Ty2
cgcgcccgacauggcuga

SEQ ID NO: 1744744 - RNA, 13 nt, Salmonella enterica enterica serovar Typhi Ty2
cgcgaccacgcau

SEQ ID NO: 1744745 - RNA, 18 nt, Salmonella enterica enterica serovar Typhi Ty2
cgcgaccagagacauugc

SEQ ID NO: 1744746 - RNA, 16 nt, Salmonella enterica enterica serovar Typhi Ty2
cgcgacauggcgguaa

SEQ ID NO: 1744747 - RNA, 14 nt, Salmonella enterica enterica serovar Typhi Ty2
cgcgacauggcgaa

SEQ ID NO: 1744748 - RNA, 15 nt, Salmonella enterica enterica serovar Typhi Ty2
cgcgacauggcggua

SEQ ID NO: 1744749 - RNA, 13 nt, Salmonella enterica enterica serovar Typhi Ty2
cgcgaccgcauca

SEQ ID NO: 1744750 - RNA, 14 nt, Salmonella enterica enterica serovar Typhi Ty2
cgcgaccgccgcug

SEQ ID NO: 1744751 - RNA, 17 nt, Salmonella enterica enterica serovar Typhi Ty2
cgcgacccagcgcauga

SEQ ID NO: 1744752 - RNA, 15 nt, Salmonella enterica enterica serovar Typhi Ty2
cgcgacccagcgcau

SEQ ID NO: 1744753 - RNA, 14 nt, Salmonella enterica enterica serovar Typhi Ty2
cgcgacaacgccgg

SEQ ID NO: 1744754 - RNA, 21 nt, Salmonella enterica enterica serovar Typhi Ty2
cgcgaaucgacaauccgccac

SEQ ID NO: 1744755 - RNA, 18 nt, Salmonella enterica enterica serovar Typhi Ty2
cgcgaauuucacgcagca

SEQ ID NO: 1744756 - RNA, 21 nt, Salmonella enterica enterica serovar Typhi Ty2
cgcgaauuccuuuuuccgcca

SEQ ID NO: 1744757 - RNA, 16 nt, Salmonella enterica enterica serovar Typhi Ty2
cgcgaagugccagguu

SEQ ID NO: 1744758 - RNA, 17 nt, Salmonella enterica enterica serovar Typhi Ty2
cgccuuguugcggauga

SEQ ID NO: 1744759 - RNA, 22 nt, Salmonella enterica enterica serovar Typhi Ty2
cgccuucgaaccggguauugaa

SEQ ID NO: 1744760 - RNA, 15 nt, Salmonella enterica enterica serovar Typhi Ty2
cgccuucggccugaa

SEQ ID NO: 1744761 - RNA, 22 nt, Salmonella enterica enterica serovar Typhi Ty2
cgccuuuaauuccgccgggcaa

SEQ ID NO: 1744762 - RNA, 14 nt, Salmonella enterica enterica serovar Typhi Ty2
cgccuuuaucgaca

SEQ ID NO: 1744763 - RNA, 13 nt, Salmonella enterica enterica serovar Typhi Ty2
cgccuuuccggcc

SEQ ID NO: 1744764 - RNA, 19 nt, Salmonella enterica enterica serovar Typhi Ty2
cgccuuuucccccagcauu

SEQ ID NO: 1744765 - RNA, 15 nt, Salmonella enterica enterica serovar Typhi Ty2
cgccugaucgcgcag

SEQ ID NO: 1744766 - RNA, 22 nt, Salmonella enterica enterica serovar Typhi Ty2
cgccuccaccguuugcagccag

SEQ ID NO: 1744767 - RNA, 19 nt, Salmonella enterica enterica serovar Typhi Ty2
cgccuggaugacgaacagg

SEQ ID NO: 1744768 - RNA, 19 nt, Salmonella enterica enterica serovar Typhi Ty2
cgccuggcaguucagucgg

SEQ ID NO: 1744769 - RNA, 23 nt, Salmonella enterica enterica serovar Typhi Ty2
cgccuggcauggugcagccgcca

SEQ ID NO: 1744770 - RNA, 18 nt, Salmonella enterica enterica serovar Typhi Ty2
cgccugcuguugggcagg

SEQ ID NO: 1744771 - RNA, 17 nt, Salmonella enterica enterica serovar Typhi Ty2
cgccuguaaacguuccu

SEQ ID NO: 1744772 - RNA, 15 nt, Salmonella enterica enterica serovar Typhi Ty2
cgccuguuuacugac

SEQ ID NO: 1744773 - RNA, 18 nt, Salmonella enterica enterica serovar Typhi Ty2
cgccuguugcugacgauu

SEQ ID NO: 1744774 - RNA, 16 nt, Salmonella enterica enterica serovar Typhi Ty2
cgccugucuccagcgc

SEQ ID NO: 1744775 - RNA, 12 nt, Salmonella enterica enterica serovar Typhi Ty2
cgccuuccggcc

SEQ ID NO: 1744776 - RNA, 14 nt, Salmonella enterica enterica serovar Typhi Ty2
cgccuuaucgacca

SEQ ID NO: 1744777 - RNA, 18 nt, Salmonella enterica enterica serovar Typhi Ty2
cgccuuauccggccuacg

SEQ ID NO: 1744778 - RNA, 20 nt, Salmonella enterica enterica serovar Typhi Ty2
cgccuuauccggccuacaac

SEQ ID NO: 1744779 - RNA, 20 nt, Salmonella enterica enterica serovar Typhi Ty2
cgccuuauccggccuacaaa

SEQ ID NO: 1744780 - RNA, 19 nt, Salmonella enterica enterica serovar Typhi Ty2
cgccuuauccgaccuacag

SEQ ID NO: 1744781 - RNA, 16 nt, Salmonella enterica enterica serovar Typhi Ty2
cgccuuacccaaccgu

SEQ ID NO: 1744782 - RNA, 21 nt, Salmonella enterica enterica serovar Typhi Ty2
cgccuguuugacgaaaucgca

SEQ ID NO: 1744783 - RNA, 12 nt, Salmonella enterica enterica serovar Typhi Ty2
cgccgucauccg

SEQ ID NO: 1744784 - RNA, 21 nt, Salmonella enterica enterica serovar Typhi Ty2
cgccguacuugacacaggcgu

SEQ ID NO: 1744785 - RNA, 20 nt, Salmonella enterica enterica serovar Typhi Ty2
cgccguacuccagcccauca

SEQ ID NO: 1744786 - RNA, 15 nt, Salmonella enterica enterica serovar Typhi Ty2
cgccggucgccagca

SEQ ID NO: 1744787 - RNA, 22 nt, Salmonella enterica enterica serovar Typhi Ty2
cgccggucacugaccggcguuu

SEQ ID NO: 1744788 - RNA, 20 nt, Salmonella enterica enterica serovar Typhi Ty2
cgccgguuucuccagccucg

SEQ ID NO: 1744789 - RNA, 13 nt, Salmonella enterica enterica serovar Typhi Ty2
aacacgccgcgcu

SEQ ID NO: 1744790 - RNA, 13 nt, Salmonella enterica enterica serovar Typhi Ty2
cgccggccuguua

SEQ ID NO: 1744791 - RNA, 22 nt, Salmonella enterica enterica serovar Typhi Ty2
cgccgcuggcuggccagggcau

SEQ ID NO: 1744792 - RNA, 14 nt, Salmonella enterica enterica serovar Typhi Ty2
cgccgcuggcggaa

SEQ ID NO: 1744793 - RNA, 22 nt, Salmonella enterica enterica serovar Typhi Ty2
cgccggaaagaaacgccgcgca

SEQ ID NO: 1744794 - RNA, 18 nt, Salmonella enterica enterica serovar Typhi Ty2
cgccggaaagcuggucga

SEQ ID NO: 1744795 - RNA, 15 nt, Salmonella enterica enterica serovar Typhi Ty2
cgccggaaaucacaa

SEQ ID NO: 1744796 - RNA, 18 nt, Salmonella enterica enterica serovar Typhi Ty2
cgccgcucuucagcgucc

SEQ ID NO: 1744797 - RNA, 15 nt, Salmonella enterica enterica serovar Typhi Ty2
cgccgcuaucgacca

SEQ ID NO: 1744798 - RNA, 17 nt, Salmonella enterica enterica serovar Typhi Ty2
cgccgcuacugccgcca

SEQ ID NO: 1744799 - RNA, 16 nt, Salmonella enterica enterica serovar Typhi Ty2
cgccgcgacaacgcca

SEQ ID NO: 1744800 - RNA, 18 nt, Salmonella enterica enterica serovar Typhi Ty2
cgccgcgccuaccagcgc

SEQ ID NO: 1744801 - RNA, 14 nt, Salmonella enterica enterica serovar Typhi Ty2
cgccgccugcgcca

SEQ ID NO: 1744802 - RNA, 17 nt, Salmonella enterica enterica serovar Typhi Ty2
cgccgccugcgccaacg

SEQ ID NO: 1744803 - RNA, 14 nt, Salmonella enterica enterica serovar Typhi Ty2
cgccgccgcccaga

SEQ ID NO: 1744804 - RNA, 13 nt, Salmonella enterica enterica serovar Typhi Ty2
cgccgccggcgag

SEQ ID NO: 1744805 - RNA, 22 nt, Salmonella enterica enterica serovar Typhi Ty2
cgccgccaaagcgcccgauaau

SEQ ID NO: 1744806 - RNA, 15 nt, Salmonella enterica enterica serovar Typhi Ty2
cgccgccaaugacca

SEQ ID NO: 1744807 - RNA, 21 nt, Salmonella enterica enterica serovar Typhi Ty2
cgccgccaccauguugcgcag

SEQ ID NO: 1744808 - RNA, 18 nt, Salmonella enterica enterica serovar Typhi Ty2
cgccgccagauuauccag

SEQ ID NO: 1744809 - RNA, 13 nt, Salmonella enterica enterica serovar Typhi Ty2
cgccgccagccau

SEQ ID NO: 1744810 - RNA, 20 nt, Salmonella enterica enterica serovar Typhi Ty2
cgccgccagcucaugcgcgg

SEQ ID NO: 1744811 - RNA, 14 nt, Salmonella enterica enterica serovar Typhi Ty2
cgccgcccgcaugg

SEQ ID NO: 1744812 - RNA, 19 nt, Salmonella enterica enterica serovar Typhi Ty2
cgccgcccccaugccgccu

SEQ ID NO: 1744813 - RNA, 18 nt, Salmonella enterica enterica serovar Typhi Ty2
cgccgccauccggcauca

SEQ ID NO: 1744814 - RNA, 17 nt, Salmonella enterica enterica serovar Typhi Ty2
cgccgccauccggcaca

SEQ ID NO: 1744815 - RNA, 14 nt, Salmonella enterica enterica serovar Typhi Ty2
cgccgccaucacca

SEQ ID NO: 1744816 - RNA, 22 nt, Salmonella enterica enterica serovar Typhi Ty2
cgccgccauuuuauccaggcca

SEQ ID NO: 1744817 - RNA, 23 nt, Salmonella enterica enterica serovar Typhi Ty2
cgccgauaaccagcgcgccgcca

SEQ ID NO: 1744818 - RNA, 15 nt, Salmonella enterica enterica serovar Typhi Ty2
cgccgacucacgcag

SEQ ID NO: 1744819 - RNA, 14 nt, Salmonella enterica enterica serovar Typhi Ty2
cgcccagaacggca

SEQ ID NO: 1744820 - RNA, 20 nt, Salmonella enterica enterica serovar Typhi Ty2
cgcccagaacggcagcgucc

SEQ ID NO: 1744821 - RNA, 20 nt, Salmonella enterica enterica serovar Typhi Ty2
cgcccagauuucacaauguu

SEQ ID NO: 1744822 - RNA, 20 nt, Salmonella enterica enterica serovar Typhi Ty2
cgccgcaaauuccaccacgu

SEQ ID NO: 1744823 - RNA, 22 nt, Salmonella enterica enterica serovar Typhi Ty2
cgccgcaaaggaucaucggcca

SEQ ID NO: 1744824 - RNA, 23 nt, Salmonella enterica enterica serovar Typhi Ty2
cgccgcaggccaucauaccgcca

SEQ ID NO: 1744825 - RNA, 21 nt, Salmonella enterica enterica serovar Typhi Ty2
gucguugccuuugcguaccgc

SEQ ID NO: 1744826 - RNA, 14 nt, Salmonella enterica enterica serovar Typhi Ty2
gucgugccugcggu

SEQ ID NO: 1744827 - RNA, 19 nt, Salmonella enterica enterica serovar Typhi Ty2
gucgugagcaaccaacgcg

SEQ ID NO: 1744828 - RNA, 18 nt, Salmonella enterica enterica serovar Typhi Ty2
gucgguuucauaacgcac

SEQ ID NO: 1744829 - RNA, 22 nt, Salmonella enterica enterica serovar Typhi Ty2
gucguaccggcgcucagccaga

SEQ ID NO: 1744830 - RNA, 20 nt, Salmonella enterica enterica serovar Typhi Ty2
gucgucccgcgaguacgcac

SEQ ID NO: 1744831 - RNA, 21 nt, Salmonella enterica enterica serovar Typhi Ty2
gucggcuuacgccuuauccgg

SEQ ID NO: 1744832 - RNA, 23 nt, Salmonella enterica enterica serovar Typhi Ty2
gucgggaagagagaaaaucggcg

SEQ ID NO: 1744833 - RNA, 15 nt, Salmonella enterica enterica serovar Typhi Ty2
gucggucugauaagc

SEQ ID NO: 1744834 - RNA, 17 nt, Salmonella enterica enterica serovar Typhi Ty2
gugaccuuucaacggau

SEQ ID NO: 1744835 - RNA, 13 nt, Salmonella enterica enterica serovar Typhi Ty2
gugacgaccggca

SEQ ID NO: 1744836 - RNA, 18 nt, Salmonella enterica enterica serovar Typhi Ty2
gugacgucaagaucgcgc

SEQ ID NO: 1744837 - RNA, 15 nt, Salmonella enterica enterica serovar Typhi Ty2
gugagcauugcgcuc

SEQ ID NO: 1744838 - RNA, 15 nt, Salmonella enterica enterica serovar Typhi Ty2
gugagcucauccagc

SEQ ID NO: 1744839 - RNA, 21 nt, Salmonella enterica enterica serovar Typhi Ty2
gugaauaugaucugcgcaaca

SEQ ID NO: 1744840 - RNA, 21 nt, Salmonella enterica enterica serovar Typhi Ty2
gugaaucaucaucauccgcgc

SEQ ID NO: 1744841 - RNA, 12 nt, Salmonella enterica enterica serovar Typhi Ty2
gugaauccaggc

SEQ ID NO: 1744842 - RNA, 21 nt, Salmonella enterica enterica serovar Typhi Ty2
gugaauaugaucugcacaaca

SEQ ID NO: 1744843 - RNA, 16 nt, Salmonella enterica enterica serovar Typhi Ty2
gugaaucagauaacug

SEQ ID NO: 1744844 - RNA, 20 nt, Salmonella enterica enterica serovar Typhi Ty2
gugacauuuaucuuccggca

SEQ ID NO: 1744845 - RNA, 14 nt, Salmonella enterica enterica serovar Typhi Ty2
gugaccagcgguau

SEQ ID NO: 1744846 - RNA, 18 nt, Salmonella enterica enterica serovar Typhi Ty2
gugaccgccuuauccggc

SEQ ID NO: 1744847 - RNA, 20 nt, Salmonella enterica enterica serovar Typhi Ty2
gugaacaaaggcagccaaca

SEQ ID NO: 1744848 - RNA, 19 nt, Salmonella enterica enterica serovar Typhi Ty2
gugaacgccuuauccggcc

SEQ ID NO: 1744849 - RNA, 19 nt, Salmonella enterica enterica serovar Typhi Ty2
gugaagacacaacgugcca

SEQ ID NO: 1744850 - RNA, 16 nt, Salmonella enterica enterica serovar Typhi Ty2
gucuuaaaugccgccg

SEQ ID NO: 1744851 - RNA, 20 nt, Salmonella enterica enterica serovar Typhi Ty2
gugaaaagcgggggcgacag

SEQ ID NO: 1744852 - RNA, 15 nt, Salmonella enterica enterica serovar Typhi Ty2
gucugcgcgccggaa

SEQ ID NO: 1744853 - RNA, 19 nt, Salmonella enterica enterica serovar Typhi Ty2
gucuccucgccagcuaccg

SEQ ID NO: 1744854 - RNA, 17 nt, Salmonella enterica enterica serovar Typhi Ty2
gucuaccguaggccgga

SEQ ID NO: 1744855 - RNA, 16 nt, Salmonella enterica enterica serovar Typhi Ty2
gucucaaucgcaaauu

SEQ ID NO: 1744856 - RNA, 13 nt, Salmonella enterica enterica serovar Typhi Ty2
gucucauccggca

SEQ ID NO: 1744857 - RNA, 22 nt, Salmonella enterica enterica serovar Typhi Ty2
gucucgcccgggucgaucaauc

SEQ ID NO: 1744858 - RNA, 23 nt, Salmonella enterica enterica serovar Typhi Ty2
gucgccagacccagcgcuaacgg

SEQ ID NO: 1744859 - RNA, 18 nt, Salmonella enterica enterica serovar Typhi Ty2
gucgcaaucuggcgcaau

SEQ ID NO: 1744860 - RNA, 21 nt, Salmonella enterica enterica serovar Typhi Ty2
gucgauuuccgguuccagcgg

SEQ ID NO: 1744861 - RNA, 14 nt, Salmonella enterica enterica serovar Typhi Ty2
gucgaucucggcca

SEQ ID NO: 1744862 - RNA, 23 nt, Salmonella enterica enterica serovar Typhi Ty2
gucgagauacugcaacgccagau

SEQ ID NO: 1744863 - RNA, 17 nt, Salmonella enterica enterica serovar Typhi Ty2
guccggguucagcgaca

SEQ ID NO: 1744864 - RNA, 17 nt, Salmonella enterica enterica serovar Typhi Ty2
guccuucacaaacuucu

SEQ ID NO: 1744865 - RNA, 19 nt, Salmonella enterica enterica serovar Typhi Ty2
gucgaaaauaucggccuga

SEQ ID NO: 1744866 - RNA, 20 nt, Salmonella enterica enterica serovar Typhi Ty2
gucgaccaguccuuccgccg

SEQ ID NO: 1744867 - RNA, 14 nt, Salmonella enterica enterica serovar Typhi Ty2
guccaggucaucac

SEQ ID NO: 1744868 - RNA, 18 nt, Salmonella enterica enterica serovar Typhi Ty2
guccauuacgcaguacgc

SEQ ID NO: 1744869 - RNA, 13 nt, Salmonella enterica enterica serovar Typhi Ty2
gucaggaacgcgg

SEQ ID NO: 1744870 - RNA, 19 nt, Salmonella enterica enterica serovar Typhi Ty2
gucaggaaacgcgccggaa

SEQ ID NO: 1744871 - RNA, 17 nt, Salmonella enterica enterica serovar Typhi Ty2
guaucgccggcagacga

SEQ ID NO: 1744872 - RNA, 19 nt, Salmonella enterica enterica serovar Typhi Ty2
gucaggaccaaaacaguac

SEQ ID NO: 1744873 - RNA, 21 nt, Salmonella enterica enterica serovar Typhi Ty2
gucaggauuuucgcgaucucc

SEQ ID NO: 1744874 - RNA, 20 nt, Salmonella enterica enterica serovar Typhi Ty2
gucaguguuuccauacauuu

SEQ ID NO: 1744875 - RNA, 14 nt, Salmonella enterica enterica serovar Typhi Ty2
gucauaaucgccgu

SEQ ID NO: 1744876 - RNA, 22 nt, Salmonella enterica enterica serovar Typhi Ty2
gucaucugccaguuaucgguaa

SEQ ID NO: 1744877 - RNA, 14 nt, Salmonella enterica enterica serovar Typhi Ty2
gucaugcgccacga

SEQ ID NO: 1744878 - RNA, 19 nt, Salmonella enterica enterica serovar Typhi Ty2
gucaugauuaugcgaaugc

SEQ ID NO: 1744879 - RNA, 17 nt, Salmonella enterica enterica serovar Typhi Ty2
gucauggcuuagcgcca

SEQ ID NO: 1744880 - RNA, 19 nt, Salmonella enterica enterica serovar Typhi Ty2
guccaccgauuucaucgcu

SEQ ID NO: 1744881 - RNA, 21 nt, Salmonella enterica enterica serovar Typhi Ty2
gucauuuaccagugcuaaaau

SEQ ID NO: 1744882 - RNA, 19 nt, Salmonella enterica enterica serovar Typhi Ty2
gucauucucuuucugcgcc

SEQ ID NO: 1744883 - RNA, 21 nt, Salmonella enterica enterica serovar Typhi Ty2
guccagacuccuuuuaccggc

SEQ ID NO: 1744884 - RNA, 21 nt, Salmonella enterica enterica serovar Typhi Ty2
gggugaugacgggaucgaacc

SEQ ID NO: 1744885 - RNA, 21 nt, Salmonella enterica enterica serovar Typhi Ty2
gggucgugcaggauucgaacc

SEQ ID NO: 1744886 - RNA, 15 nt, Salmonella enterica enterica serovar Typhi Ty2
gguaauuugcgccau

SEQ ID NO: 1744887 - RNA, 22 nt, Salmonella enterica enterica serovar Typhi Ty2
gguacacaaucaaggcagcgaa

SEQ ID NO: 1744888 - RNA, 16 nt, Salmonella enterica enterica serovar Typhi Ty2
gguaauuagaucggca

SEQ ID NO: 1744889 - RNA, 17 nt, Salmonella enterica enterica serovar Typhi Ty2
gguacauccaugccauc

SEQ ID NO: 1744890 - RNA, 14 nt, Salmonella enterica enterica serovar Typhi Ty2
ggguuaaggcauca

SEQ ID NO: 1744891 - RNA, 16 nt, Salmonella enterica enterica serovar Typhi Ty2
gguacgcaucaccagg

SEQ ID NO: 1744892 - RNA, 15 nt, Salmonella enterica enterica serovar Typhi Ty2
gggguguuacgccau

SEQ ID NO: 1744893 - RNA, 16 nt, Salmonella enterica enterica serovar Typhi Ty2
ggggcaagcucagcgg

SEQ ID NO: 1744894 - RNA, 18 nt, Salmonella enterica enterica serovar Typhi Ty2
ggguaauagaugcgucgc

SEQ ID NO: 1744895 - RNA, 14 nt, Salmonella enterica enterica serovar Typhi Ty2
ggguaaauccgcga

SEQ ID NO: 1744896 - RNA, 18 nt, Salmonella enterica enterica serovar Typhi Ty2
ggucauucaggacggugg

SEQ ID NO: 1744897 - RNA, 11 nt, Salmonella enterica enterica serovar Typhi Ty2
ggucaucggcg

SEQ ID NO: 1744898 - RNA, 21 nt, Salmonella enterica enterica serovar Typhi Ty2
ggucagggugaaucccgccau

SEQ ID NO: 1744899 - RNA, 16 nt, Salmonella enterica enterica serovar Typhi Ty2
gguaguguuaucgccg

SEQ ID NO: 1744900 - RNA, 21 nt, Salmonella enterica enterica serovar Typhi Ty2
gguagucacggagagucgcac

SEQ ID NO: 1744901 - RNA, 14 nt, Salmonella enterica enterica serovar Typhi Ty2
ggucaggaagacuu

SEQ ID NO: 1744902 - RNA, 18 nt, Salmonella enterica enterica serovar Typhi Ty2
ggucggcgcaguucgccg

SEQ ID NO: 1744903 - RNA, 23 nt, Salmonella enterica enterica serovar Typhi Ty2
ggucgcuuuuugcgccagcgcca

SEQ ID NO: 1744904 - RNA, 16 nt, Salmonella enterica enterica serovar Typhi Ty2
ggucgcuaacccaggc

SEQ ID NO: 1744905 - RNA, 20 nt, Salmonella enterica enterica serovar Typhi Ty2
ggugacggcaacggcgacaa

SEQ ID NO: 1744906 - RNA, 23 nt, Salmonella enterica enterica serovar Typhi Ty2
ggugagcuccagcccgccgcccu

SEQ ID NO: 1744907 - RNA, 19 nt, Salmonella enterica enterica serovar Typhi Ty2
ggucgucugaaagcgacuc

SEQ ID NO: 1744908 - RNA, 12 nt, Salmonella enterica enterica serovar Typhi Ty2
ggugaagacgcu

SEQ ID NO: 1744909 - RNA, 17 nt, Salmonella enterica enterica serovar Typhi Ty2
ggucugacaacuauugc

SEQ ID NO: 1744910 - RNA, 13 nt, Salmonella enterica enterica serovar Typhi Ty2
ggugaaaucacgc

SEQ ID NO: 1744911 - RNA, 14 nt, Salmonella enterica enterica serovar Typhi Ty2
guacggauggcguc

SEQ ID NO: 1744912 - RNA, 15 nt, Salmonella enterica enterica serovar Typhi Ty2
guacggcauggcguc

SEQ ID NO: 1744913 - RNA, 18 nt, Salmonella enterica enterica serovar Typhi Ty2
guacggccaccaggccug

SEQ ID NO: 1744914 - RNA, 22 nt, Salmonella enterica enterica serovar Typhi Ty2
guacggaauaucccgcaagaaa

SEQ ID NO: 1744915 - RNA, 16 nt, Salmonella enterica enterica serovar Typhi Ty2
guacuauuaccgcauc

SEQ ID NO: 1744916 - RNA, 20 nt, Salmonella enterica enterica serovar Typhi Ty2
guacgcgucugaaugacgcc

SEQ ID NO: 1744917 - RNA, 17 nt, Salmonella enterica enterica serovar Typhi Ty2
guacgcgacugaucagg

SEQ ID NO: 1744918 - RNA, 16 nt, Salmonella enterica enterica serovar Typhi Ty2
guacgcagcaggcaga

SEQ ID NO: 1744919 - RNA, 20 nt, Salmonella enterica enterica serovar Typhi Ty2
guaccaccagaaucgccagc

SEQ ID NO: 1744920 - RNA, 14 nt, Salmonella enterica enterica serovar Typhi Ty2
guaccagcgcgaac

SEQ ID NO: 1744921 - RNA, 14 nt, Salmonella enterica enterica serovar Typhi Ty2
guaccggcaaccgg

SEQ ID NO: 1744922 - RNA, 21 nt, Salmonella enterica enterica serovar Typhi Ty2
guaccggcccaaacgaugacc

SEQ ID NO: 1744923 - RNA, 13 nt, Salmonella enterica enterica serovar Typhi Ty2
guaacagcgguau

SEQ ID NO: 1744924 - RNA, 14 nt, Salmonella enterica enterica serovar Typhi Ty2
guaacacaaucagg

SEQ ID NO: 1744925 - RNA, 20 nt, Salmonella enterica enterica serovar Typhi Ty2
guaaauuucaacccgaucgc

SEQ ID NO: 1744926 - RNA, 15 nt, Salmonella enterica enterica serovar Typhi Ty2
guaacccgccgccau

SEQ ID NO: 1744927 - RNA, 23 nt, Salmonella enterica enterica serovar Typhi Ty2
guaaauuucaacccgaucgccau

SEQ ID NO: 1744928 - RNA, 20 nt, Salmonella enterica enterica serovar Typhi Ty2
guaaauuuaucgaucuccau

SEQ ID NO: 1744929 - RNA, 12 nt, Salmonella enterica enterica serovar Typhi Ty2
guaaacgugcca

SEQ ID NO: 1744930 - RNA, 16 nt, Salmonella enterica enterica serovar Typhi Ty2
guacagacaucaucga

SEQ ID NO: 1744931 - RNA, 16 nt, Salmonella enterica enterica serovar Typhi Ty2
guacagaagguuauuc

SEQ ID NO: 1744932 - RNA, 23 nt, Salmonella enterica enterica serovar Typhi Ty2
guaacgugcgguauaucacgcca

SEQ ID NO: 1744933 - RNA, 18 nt, Salmonella enterica enterica serovar Typhi Ty2
guaacggacucaggccuu

SEQ ID NO: 1744934 - RNA, 17 nt, Salmonella enterica enterica serovar Typhi Ty2
guaacggaaaagcauug

SEQ ID NO: 1744935 - RNA, 20 nt, Salmonella enterica enterica serovar Typhi Ty2
guaaccuuucaccuuacccg

SEQ ID NO: 1744936 - RNA, 18 nt, Salmonella enterica enterica serovar Typhi Ty2
guaaccuuuuuauggccc

SEQ ID NO: 1744937 - RNA, 19 nt, Salmonella enterica enterica serovar Typhi Ty2
guaggccugauaagcgcag

SEQ ID NO: 1744938 - RNA, 18 nt, Salmonella enterica enterica serovar Typhi Ty2
guaggccugauaagcgca

SEQ ID NO: 1744939 - RNA, 19 nt, Salmonella enterica enterica serovar Typhi Ty2
guaggccugauaagcguag

SEQ ID NO: 1744940 - RNA, 20 nt, Salmonella enterica enterica serovar Typhi Ty2
guaggccugauaagacgcau

SEQ ID NO: 1744941 - RNA, 21 nt, Salmonella enterica enterica serovar Typhi Ty2
guaggccggauuaaggcguuu

SEQ ID NO: 1744942 - RNA, 17 nt, Salmonella enterica enterica serovar Typhi Ty2
guaggccggaucaggcg

SEQ ID NO: 1744943 - RNA, 19 nt, Salmonella enterica enterica serovar Typhi Ty2
guaggccggauaaggcauu

SEQ ID NO: 1744944 - RNA, 17 nt, Salmonella enterica enterica serovar Typhi Ty2
guaggccggauaaggca

SEQ ID NO: 1744945 - RNA, 17 nt, Salmonella enterica enterica serovar Typhi Ty2
aaguccguauuauccac

SEQ ID NO: 1744946 - RNA, 16 nt, Salmonella enterica enterica serovar Typhi Ty2
guauccugaaccagcg

SEQ ID NO: 1744947 - RNA, 14 nt, Salmonella enterica enterica serovar Typhi Ty2
guauagccaggcag

SEQ ID NO: 1744948 - RNA, 16 nt, Salmonella enterica enterica serovar Typhi Ty2
guauaccaucggcugg

SEQ ID NO: 1744949 - RNA, 18 nt, Salmonella enterica enterica serovar Typhi Ty2
guagagcggauaagcgca

SEQ ID NO: 1744950 - RNA, 14 nt, Salmonella enterica enterica serovar Typhi Ty2
guagacacgcuacc

SEQ ID NO: 1744951 - RNA, 15 nt, Salmonella enterica enterica serovar Typhi Ty2
guacuuucuacaaau

SEQ ID NO: 1744952 - RNA, 20 nt, Salmonella enterica enterica serovar Typhi Ty2
ggugcugaauauuaucggcg

SEQ ID NO: 1744953 - RNA, 14 nt, Salmonella enterica enterica serovar Typhi Ty2
ggugucaaagcgcc

SEQ ID NO: 1744954 - RNA, 18 nt, Salmonella enterica enterica serovar Typhi Ty2
ggugucaaagcgccagau

SEQ ID NO: 1744955 - RNA, 17 nt, Salmonella enterica enterica serovar Typhi Ty2
gguggguuccagcgcca

SEQ ID NO: 1744956 - RNA, 12 nt, Salmonella enterica enterica serovar Typhi Ty2
ggugguaaauca

SEQ ID NO: 1744957 - RNA, 13 nt, Salmonella enterica enterica serovar Typhi Ty2
ggugugccgccau

SEQ ID NO: 1744958 - RNA, 14 nt, Salmonella enterica enterica serovar Typhi Ty2
gguguguucccgcg

SEQ ID NO: 1744959 - RNA, 20 nt, Salmonella enterica enterica serovar Typhi Ty2
gguuaucaauaaugcgcugc

SEQ ID NO: 1744960 - RNA, 13 nt, Salmonella enterica enterica serovar Typhi Ty2
gguuccaggcgcg

SEQ ID NO: 1744961 - RNA, 16 nt, Salmonella enterica enterica serovar Typhi Ty2
gguucccgccgccauu

SEQ ID NO: 1744962 - RNA, 19 nt, Salmonella enterica enterica serovar Typhi Ty2
gguucgcguacgcaucaua

SEQ ID NO: 1744963 - RNA, 14 nt, Salmonella enterica enterica serovar Typhi Ty2
ggcuuauaccgaca

SEQ ID NO: 1744964 - RNA, 16 nt, Salmonella enterica enterica serovar Typhi Ty2
ggcuuaccggcuauca

SEQ ID NO: 1744965 - RNA, 21 nt, Salmonella enterica enterica serovar Typhi Ty2
ggcugucgauaacagcauaaa

SEQ ID NO: 1744966 - RNA, 19 nt, Salmonella enterica enterica serovar Typhi Ty2
gggaaaagcgguaucacgc

SEQ ID NO: 1744967 - RNA, 23 nt, Salmonella enterica enterica serovar Typhi Ty2
gggaaauagccuacggcuaccgc

SEQ ID NO: 1744968 - RNA, 11 nt, Salmonella enterica enterica serovar Typhi Ty2
ggcuuucacgc

SEQ ID NO: 1744969 - RNA, 21 nt, Salmonella enterica enterica serovar Typhi Ty2
ggcuuucacaccguuauccgg

SEQ ID NO: 1744970 - RNA, 19 nt, Salmonella enterica enterica serovar Typhi Ty2
ggcuuuaacgucagcauca

SEQ ID NO: 1744971 - RNA, 17 nt, Salmonella enterica enterica serovar Typhi Ty2
ggcuuugcgccaucggg

SEQ ID NO: 1744972 - RNA, 12 nt, Salmonella enterica enterica serovar Typhi Ty2
ggcuuuccacgu

SEQ ID NO: 1744973 - RNA, 11 nt, Salmonella enterica enterica serovar Typhi Ty2
ggcuuccggca

SEQ ID NO: 1744974 - RNA, 14 nt, Salmonella enterica enterica serovar Typhi Ty2
ggcuuccucgccac

SEQ ID NO: 1744975 - RNA, 18 nt, Salmonella enterica enterica serovar Typhi Ty2
ggcuucuucaacauuguc

SEQ ID NO: 1744976 - RNA, 13 nt, Salmonella enterica enterica serovar Typhi Ty2
ggcugccacacgu

SEQ ID NO: 1744977 - RNA, 15 nt, Salmonella enterica enterica serovar Typhi Ty2
ggcugaguucaggca

SEQ ID NO: 1744978 - RNA, 13 nt, Salmonella enterica enterica serovar Typhi Ty2
ggcugauggcgaa

SEQ ID NO: 1744979 - RNA, 12 nt, Salmonella enterica enterica serovar Typhi Ty2
ggcugauggcga

SEQ ID NO: 1744980 - RNA, 12 nt, Salmonella enterica enterica serovar Typhi Ty2
ggcugccgccau

SEQ ID NO: 1744981 - RNA, 22 nt, Salmonella enterica enterica serovar Typhi Ty2
ggcugcucguaaguuuccugcg

SEQ ID NO: 1744982 - RNA, 22 nt, Salmonella enterica enterica serovar Typhi Ty2
ggcucuguuuacguagcaaaua

SEQ ID NO: 1744983 - RNA, 22 nt, Salmonella enterica enterica serovar Typhi Ty2
ggcgugaccgccuuauccggcc

SEQ ID NO: 1744984 - RNA, 14 nt, Salmonella enterica enterica serovar Typhi Ty2
ggcgugacgcgcca

SEQ ID NO: 1744985 - RNA, 15 nt, Salmonella enterica enterica serovar Typhi Ty2
ggcgucgucaucgcg

SEQ ID NO: 1744986 - RNA, 21 nt, Salmonella enterica enterica serovar Typhi Ty2
ggcgucgguuauagacgccgg

SEQ ID NO: 1744987 - RNA, 21 nt, Salmonella enterica enterica serovar Typhi Ty2
ggcgugccguccugugcuuug

SEQ ID NO: 1744988 - RNA, 18 nt, Salmonella enterica enterica serovar Typhi Ty2
ggcuccgaccaucgccgc

SEQ ID NO: 1744989 - RNA, 21 nt, Salmonella enterica enterica serovar Typhi Ty2
ggcuccgaccaucgccgcgaa

SEQ ID NO: 1744990 - RNA, 19 nt, Salmonella enterica enterica serovar Typhi Ty2
ggcucccacucuuccagca

SEQ ID NO: 1744991 - RNA, 14 nt, Salmonella enterica enterica serovar Typhi Ty2
ggcucaauccaggu

SEQ ID NO: 1744992 - RNA, 12 nt, Salmonella enterica enterica serovar Typhi Ty2
ggcucagcauag

SEQ ID NO: 1744993 - RNA, 17 nt, Salmonella enterica enterica serovar Typhi Ty2
ggcguggugucucgucg

SEQ ID NO: 1744994 - RNA, 20 nt, Salmonella enterica enterica serovar Typhi Ty2
ggcguguagccaaucagccc

SEQ ID NO: 1744995 - RNA, 12 nt, Salmonella enterica enterica serovar Typhi Ty2
ggcguuccgcac

SEQ ID NO: 1744996 - RNA, 13 nt, Salmonella enterica enterica serovar Typhi Ty2
ggcguguuucagc

SEQ ID NO: 1744997 - RNA, 14 nt, Salmonella enterica enterica serovar Typhi Ty2
ggcguuacgcgcca

SEQ ID NO: 1744998 - RNA, 13 nt, Salmonella enterica enterica serovar Typhi Ty2
ggcguucacgccg

SEQ ID NO: 1744999 - RNA, 21 nt, Salmonella enterica enterica serovar Typhi Ty2
ggcguuuacgcugcuauccgg

SEQ ID NO: 1745000 - RNA, 21 nt, Salmonella enterica enterica serovar Typhi Ty2
ggcuaauacgccagccgucau

SEQ ID NO: 1745001 - RNA, 13 nt, Salmonella enterica enterica serovar Typhi Ty2
ggcuaaucgccac

SEQ ID NO: 1745002 - RNA, 14 nt, Salmonella enterica enterica serovar Typhi Ty2
ggcgccuuguccgg

SEQ ID NO: 1745003 - RNA, 22 nt, Salmonella enterica enterica serovar Typhi Ty2
ggcgcgaacgccuuauccggcc

SEQ ID NO: 1745004 - RNA, 20 nt, Salmonella enterica enterica serovar Typhi Ty2
ggcgcgcgcgccuaccgcca

SEQ ID NO: 1745005 - RNA, 21 nt, Salmonella enterica enterica serovar Typhi Ty2
ggcgcugccgcuuauccggcc

SEQ ID NO: 1745006 - RNA, 17 nt, Salmonella enterica enterica serovar Typhi Ty2
ggcgcugcgcuuaccgg

SEQ ID NO: 1745007 - RNA, 20 nt, Salmonella enterica enterica serovar Typhi Ty2
ggcgcugcgcgcaucgggcc

SEQ ID NO: 1745008 - RNA, 20 nt, Salmonella enterica enterica serovar Typhi Ty2
ggcgcugcgcuuaucagacc

SEQ ID NO: 1745009 - RNA, 18 nt, Salmonella enterica enterica serovar Typhi Ty2
ggcgcugcguuuaucagg

SEQ ID NO: 1745010 - RNA, 17 nt, Salmonella enterica enterica serovar Typhi Ty2
ggcgcugcgcuuauccg

SEQ ID NO: 1745011 - RNA, 19 nt, Salmonella enterica enterica serovar Typhi Ty2
ggcgcuaaugcuuauccgg

SEQ ID NO: 1745012 - RNA, 21 nt, Salmonella enterica enterica serovar Typhi Ty2
ggcgcuaaaauccacucggcg

SEQ ID NO: 1745013 - RNA, 14 nt, Salmonella enterica enterica serovar Typhi Ty2
ggcgcguucaugcg

SEQ ID NO: 1745014 - RNA, 18 nt, Salmonella enterica enterica serovar Typhi Ty2
ggcgcguucagcaucggg

SEQ ID NO: 1745015 - RNA, 23 nt, Salmonella enterica enterica serovar Typhi Ty2
ggcgcuaaaccggcggaauagcu

SEQ ID NO: 1745016 - RNA, 20 nt, Salmonella enterica enterica serovar Typhi Ty2
ggcggcgaugccuuauccgg

SEQ ID NO: 1745017 - RNA, 23 nt, Salmonella enterica enterica serovar Typhi Ty2
ggcggcgcaaaggccuuauccgg

SEQ ID NO: 1745018 - RNA, 23 nt, Salmonella enterica enterica serovar Typhi Ty2
ggcggcguaaacaccuuauccgg

SEQ ID NO: 1745019 - RNA, 23 nt, Salmonella enterica enterica serovar Typhi Ty2
ggcggcgugaacgccuuauccgg

SEQ ID NO: 1745020 - RNA, 16 nt, Salmonella enterica enterica serovar Typhi Ty2
ggcggcgugaacgccu

SEQ ID NO: 1745021 - RNA, 19 nt, Salmonella enterica enterica serovar Typhi Ty2
ggcggcugcgccuuauccg

SEQ ID NO: 1745022 - RNA, 19 nt, Salmonella enterica enterica serovar Typhi Ty2
ggcggcuucgccuuauccg

SEQ ID NO: 1745023 - RNA, 20 nt, Salmonella enterica enterica serovar Typhi Ty2
ggcggcuucgccuuauccgg

SEQ ID NO: 1745024 - RNA, 15 nt, Salmonella enterica enterica serovar Typhi Ty2
ggcggcuuuacccgg

SEQ ID NO: 1745025 - RNA, 23 nt, Salmonella enterica enterica serovar Typhi Ty2
ggcggcauaaaugccuuauccgg

SEQ ID NO: 1745026 - RNA, 12 nt, Salmonella enterica enterica serovar Typhi Ty2
ggcgcuuaucca

SEQ ID NO: 1745027 - RNA, 21 nt, Salmonella enterica enterica serovar Typhi Ty2
ggcgcuugcgccaucauccgg

SEQ ID NO: 1745028 - RNA, 20 nt, Salmonella enterica enterica serovar Typhi Ty2
ggcgcuucgcuuaucaggcc

SEQ ID NO: 1745029 - RNA, 18 nt, Salmonella enterica enterica serovar Typhi Ty2
ggcgcugucgcuuaccgg

SEQ ID NO: 1745030 - RNA, 15 nt, Salmonella enterica enterica serovar Typhi Ty2
ggcgcuuugccguuc

SEQ ID NO: 1745031 - RNA, 17 nt, Salmonella enterica enterica serovar Typhi Ty2
ggcgcuuugcuuauccg

SEQ ID NO: 1745032 - RNA, 15 nt, Salmonella enterica enterica serovar Typhi Ty2
ggcgaggcguaaaac

SEQ ID NO: 1745033 - RNA, 20 nt, Salmonella enterica enterica serovar Typhi Ty2
ggcgauaaaaauauccgcca

SEQ ID NO: 1745034 - RNA, 22 nt, Salmonella enterica enterica serovar Typhi Ty2
ggcgauaaaaggcgguucccgg

SEQ ID NO: 1745035 - RNA, 22 nt, Salmonella enterica enterica serovar Typhi Ty2
ggcgauaccgguacggaacguc

SEQ ID NO: 1745036 - RNA, 12 nt, Salmonella enterica enterica serovar Typhi Ty2
ggcgauaagguc

SEQ ID NO: 1745037 - RNA, 14 nt, Salmonella enterica enterica serovar Typhi Ty2
ggcgaucaccacgc

SEQ ID NO: 1745038 - RNA, 15 nt, Salmonella enterica enterica serovar Typhi Ty2
ggcgaucagcgccac

SEQ ID NO: 1745039 - RNA, 14 nt, Salmonella enterica enterica serovar Typhi Ty2
ggcgaucagcgcca

SEQ ID NO: 1745040 - RNA, 19 nt, Salmonella enterica enterica serovar Typhi Ty2
ggcgaugccuuauccggcc

SEQ ID NO: 1745041 - RNA, 19 nt, Salmonella enterica enterica serovar Typhi Ty2
ggcgaucgcuaaucaggac

SEQ ID NO: 1745042 - RNA, 17 nt, Salmonella enterica enterica serovar Typhi Ty2
ggcgauucccgaucuuc

SEQ ID NO: 1745043 - RNA, 19 nt, Salmonella enterica enterica serovar Typhi Ty2
ggcgauguuggcgcccuga

SEQ ID NO: 1745044 - RNA, 19 nt, Salmonella enterica enterica serovar Typhi Ty2
ggcgauguucuugccgcca

SEQ ID NO: 1745045 - RNA, 13 nt, Salmonella enterica enterica serovar Typhi Ty2
ggcgauuuucagc

SEQ ID NO: 1745046 - RNA, 13 nt, Salmonella enterica enterica serovar Typhi Ty2
ggcgccgaucauc

SEQ ID NO: 1745047 - RNA, 23 nt, Salmonella enterica enterica serovar Typhi Ty2
ggcgcaaaucgccaucagcgcga

SEQ ID NO: 1745048 - RNA, 12 nt, Salmonella enterica enterica serovar Typhi Ty2
ggcgcacauugc

SEQ ID NO: 1745049 - RNA, 21 nt, Salmonella enterica enterica serovar Typhi Ty2
ggcgcauuuucggcagcgcga

SEQ ID NO: 1745050 - RNA, 14 nt, Salmonella enterica enterica serovar Typhi Ty2
ggauucgaaccugc

SEQ ID NO: 1745051 - RNA, 22 nt, Salmonella enterica enterica serovar Typhi Ty2
ggauucucuaacgucagcgcca

SEQ ID NO: 1745052 - RNA, 13 nt, Salmonella enterica enterica serovar Typhi Ty2
ggauucuccggcg

SEQ ID NO: 1745053 - RNA, 11 nt, Salmonella enterica enterica serovar Typhi Ty2
ggauguaggcc

SEQ ID NO: 1745054 - RNA, 20 nt, Salmonella enterica enterica serovar Typhi Ty2
ggaugcgagaaugucgccau

SEQ ID NO: 1745055 - RNA, 13 nt, Salmonella enterica enterica serovar Typhi Ty2
ggaugccccacuu

SEQ ID NO: 1745056 - RNA, 16 nt, Salmonella enterica enterica serovar Typhi Ty2
ggaugcguaauccggc

SEQ ID NO: 1745057 - RNA, 24 nt, Salmonella enterica enterica serovar Typhi Ty2
ggaugcgccauccaccaggcaugc

SEQ ID NO: 1745058 - RNA, 15 nt, Salmonella enterica enterica serovar Typhi Ty2
ggaucgggcuuccag

SEQ ID NO: 1745059 - RNA, 20 nt, Salmonella enterica enterica serovar Typhi Ty2
ggaucugcuuaugaucgccc

SEQ ID NO: 1745060 - RNA, 13 nt, Salmonella enterica enterica serovar Typhi Ty2
ggaucuuccugcg

SEQ ID NO: 1745061 - RNA, 20 nt, Salmonella enterica enterica serovar Typhi Ty2
ggaugaagcagacaucgcgc

SEQ ID NO: 1745062 - RNA, 18 nt, Salmonella enterica enterica serovar Typhi Ty2
ggaugagcguuagcgcca

SEQ ID NO: 1745063 - RNA, 15 nt, Salmonella enterica enterica serovar Typhi Ty2
ggaacaagcaaaccu

SEQ ID NO: 1745064 - RNA, 22 nt, Salmonella enterica enterica serovar Typhi Ty2
ggcaccauaauuuccguagcga

SEQ ID NO: 1745065 - RNA, 15 nt, Salmonella enterica enterica serovar Typhi Ty2
ggcaccucguccaga

SEQ ID NO: 1745066 - RNA, 18 nt, Salmonella enterica enterica serovar Typhi Ty2
ggcacugcgcuuauccgg

SEQ ID NO: 1745067 - RNA, 15 nt, Salmonella enterica enterica serovar Typhi Ty2
ggcaaagucgaacga

SEQ ID NO: 1745068 - RNA, 13 nt, Salmonella enterica enterica serovar Typhi Ty2
ggcaacgccagag

SEQ ID NO: 1745069 - RNA, 23 nt, Salmonella enterica enterica serovar Typhi Ty2
ggauuucgucgcuaagcgucaga

SEQ ID NO: 1745070 - RNA, 20 nt, Salmonella enterica enterica serovar Typhi Ty2
ggcaaacggcgccagcucau

SEQ ID NO: 1745071 - RNA, 22 nt, Salmonella enterica enterica serovar Typhi Ty2
ggcaagagauucaggccgccag

SEQ ID NO: 1745072 - RNA, 23 nt, Salmonella enterica enterica serovar Typhi Ty2
ggcaacgccggggacuuucgaac

SEQ ID NO: 1745073 - RNA, 13 nt, Salmonella enterica enterica serovar Typhi Ty2
ggcacaucaggca

SEQ ID NO: 1745074 - RNA, 11 nt, Salmonella enterica enterica serovar Typhi Ty2
ggcacagccag

SEQ ID NO: 1745075 - RNA, 15 nt, Salmonella enterica enterica serovar Typhi Ty2
ggcaaucuuuaacgc

SEQ ID NO: 1745076 - RNA, 18 nt, Salmonella enterica enterica serovar Typhi Ty2
ggcauuccccaucgcgac

SEQ ID NO: 1745077 - RNA, 22 nt, Salmonella enterica enterica serovar Typhi Ty2
ggcauuagcaugggcuaaagca

SEQ ID NO: 1745078 - RNA, 16 nt, Salmonella enterica enterica serovar Typhi Ty2
ggcaugauuaaagcca

SEQ ID NO: 1745079 - RNA, 16 nt, Salmonella enterica enterica serovar Typhi Ty2
ggcauuuaugccgcca

SEQ ID NO: 1745080 - RNA, 13 nt, Salmonella enterica enterica serovar Typhi Ty2
ggcauucgcacac

SEQ ID NO: 1745081 - RNA, 13 nt, Salmonella enterica enterica serovar Typhi Ty2
ggccaaauaaccc

SEQ ID NO: 1745082 - RNA, 20 nt, Salmonella enterica enterica serovar Typhi Ty2
ggccaaaaccacagugaccc

SEQ ID NO: 1745083 - RNA, 20 nt, Salmonella enterica enterica serovar Typhi Ty2
ggcauuuuuauuuaacgcca

SEQ ID NO: 1745084 - RNA, 21 nt, Salmonella enterica enterica serovar Typhi Ty2
ggcauuuuuuaucuuccacgg

SEQ ID NO: 1745085 - RNA, 18 nt, Salmonella enterica enterica serovar Typhi Ty2
ggcauuuuuauuuaacgc

SEQ ID NO: 1745086 - RNA, 17 nt, Salmonella enterica enterica serovar Typhi Ty2
ggcauuucgccgccauc

SEQ ID NO: 1745087 - RNA, 12 nt, Salmonella enterica enterica serovar Typhi Ty2
ggcaucucgcca

SEQ ID NO: 1745088 - RNA, 13 nt, Salmonella enterica enterica serovar Typhi Ty2
ggcaucucaucuu

SEQ ID NO: 1745089 - RNA, 13 nt, Salmonella enterica enterica serovar Typhi Ty2
ggcaucugaucua

SEQ ID NO: 1745090 - RNA, 14 nt, Salmonella enterica enterica serovar Typhi Ty2
ggcaguuuauccgg

SEQ ID NO: 1745091 - RNA, 14 nt, Salmonella enterica enterica serovar Typhi Ty2
ggcaggcagcgcca

SEQ ID NO: 1745092 - RNA, 17 nt, Salmonella enterica enterica serovar Typhi Ty2
ggcaggcagugaacuac

SEQ ID NO: 1745093 - RNA, 17 nt, Salmonella enterica enterica serovar Typhi Ty2
ggcagaguccagcggca

SEQ ID NO: 1745094 - RNA, 11 nt, Salmonella enterica enterica serovar Typhi Ty2
ggcagauaucg

SEQ ID NO: 1745095 - RNA, 16 nt, Salmonella enterica enterica serovar Typhi Ty2
ggcagcucucccgcca

SEQ ID NO: 1745096 - RNA, 22 nt, Salmonella enterica enterica serovar Typhi Ty2
ggcagcggcaagacagacgacu

SEQ ID NO: 1745097 - RNA, 16 nt, Salmonella enterica enterica serovar Typhi Ty2
ggccagcguaccugcg

SEQ ID NO: 1745098 - RNA, 16 nt, Salmonella enterica enterica serovar Typhi Ty2
ggccaauuccgccaua

SEQ ID NO: 1745099 - RNA, 22 nt, Salmonella enterica enterica serovar Typhi Ty2
ggccaauggcucaacuccgccg

SEQ ID NO: 1745100 - RNA, 22 nt, Salmonella enterica enterica serovar Typhi Ty2
ggccacaauuguagcugcgcca

SEQ ID NO: 1745101 - RNA, 15 nt, Salmonella enterica enterica serovar Typhi Ty2
ggccacgccgccauc

SEQ ID NO: 1745102 - RNA, 17 nt, Salmonella enterica enterica serovar Typhi Ty2
ggccgauggucgcgcca

SEQ ID NO: 1745103 - RNA, 21 nt, Salmonella enterica enterica serovar Typhi Ty2
ggccgauuuuuuaucucgccg

SEQ ID NO: 1745104 - RNA, 20 nt, Salmonella enterica enterica serovar Typhi Ty2
ggccgaguaauccauagcca

SEQ ID NO: 1745105 - RNA, 16 nt, Salmonella enterica enterica serovar Typhi Ty2
ggccgacgauaaacag

SEQ ID NO: 1745106 - RNA, 16 nt, Salmonella enterica enterica serovar Typhi Ty2
ggccaggcauccggcc

SEQ ID NO: 1745107 - RNA, 22 nt, Salmonella enterica enterica serovar Typhi Ty2
ggccgguuguuuacacggcaaa

SEQ ID NO: 1745108 - RNA, 15 nt, Salmonella enterica enterica serovar Typhi Ty2
ggccggguucgcccg

SEQ ID NO: 1745109 - RNA, 14 nt, Salmonella enterica enterica serovar Typhi Ty2
ggccgucggcgcca

SEQ ID NO: 1745110 - RNA, 19 nt, Salmonella enterica enterica serovar Typhi Ty2
ggccugauaagcacaggcc

SEQ ID NO: 1745111 - RNA, 20 nt, Salmonella enterica enterica serovar Typhi Ty2
ggccugauaagcacaggcca

SEQ ID NO: 1745112 - RNA, 21 nt, Salmonella enterica enterica serovar Typhi Ty2
ggccugauaagcguagcgcca

SEQ ID NO: 1745113 - RNA, 21 nt, Salmonella enterica enterica serovar Typhi Ty2
ggccugauaagcauagcgcca

SEQ ID NO: 1745114 - RNA, 21 nt, Salmonella enterica enterica serovar Typhi Ty2
ggccggauaagcgcagcgcca

SEQ ID NO: 1745115 - RNA, 22 nt, Salmonella enterica enterica serovar Typhi Ty2
ggccggauaagcauuagcgcca

SEQ ID NO: 1745116 - RNA, 20 nt, Salmonella enterica enterica serovar Typhi Ty2
ggccggauaagcauagcguu

SEQ ID NO: 1745117 - RNA, 21 nt, Salmonella enterica enterica serovar Typhi Ty2
ggccggauaagcaacgcgcca

SEQ ID NO: 1745118 - RNA, 18 nt, Salmonella enterica enterica serovar Typhi Ty2
ggccggaauacguaauac

SEQ ID NO: 1745119 - RNA, 23 nt, Salmonella enterica enterica serovar Typhi Ty2
ggccggaugaggcgcagccgcca

SEQ ID NO: 1745120 - RNA, 14 nt, Salmonella enterica enterica serovar Typhi Ty2
ggccggaucggcgg

SEQ ID NO: 1745121 - RNA, 23 nt, Salmonella enterica enterica serovar Typhi Ty2
ggccggauaaggcgcagccgcca

SEQ ID NO: 1745122 - RNA, 14 nt, Salmonella enterica enterica serovar Typhi Ty2
ggccggauaaggcc

SEQ ID NO: 1745123 - RNA, 22 nt, Salmonella enterica enterica serovar Typhi Ty2
ggccggauaagcggcagcgcca

SEQ ID NO: 1745124 - RNA, 21 nt, Salmonella enterica enterica serovar Typhi Ty2
ggccggauaagcgcagcguca

SEQ ID NO: 1745125 - RNA, 16 nt, Salmonella enterica enterica serovar Typhi Ty2
ggccggauaaggcguu

SEQ ID NO: 1745126 - RNA, 22 nt, Salmonella enterica enterica serovar Typhi Ty2
ggccggauuagcgacagcgcua

SEQ ID NO: 1745127 - RNA, 21 nt, Salmonella enterica enterica serovar Typhi Ty2
ggccgcaaaugauaauaugcu

SEQ ID NO: 1745128 - RNA, 15 nt, Salmonella enterica enterica serovar Typhi Ty2
ggccgccgcaaaagc

SEQ ID NO: 1745129 - RNA, 19 nt, Salmonella enterica enterica serovar Typhi Ty2
gcuuauccggccuacgcuu

SEQ ID NO: 1745130 - RNA, 20 nt, Salmonella enterica enterica serovar Typhi Ty2
gcuuauccggccuacgauuu

SEQ ID NO: 1745131 - RNA, 14 nt, Salmonella enterica enterica serovar Typhi Ty2
gcuuaucgggccua

SEQ ID NO: 1745132 - RNA, 21 nt, Salmonella enterica enterica serovar Typhi Ty2
gcuuauccccauucugcugau

SEQ ID NO: 1745133 - RNA, 16 nt, Salmonella enterica enterica serovar Typhi Ty2
gcuuaucuuuacgcuu

SEQ ID NO: 1745134 - RNA, 20 nt, Salmonella enterica enterica serovar Typhi Ty2
gcuuaucugaguaucgcuuu

SEQ ID NO: 1745135 - RNA, 17 nt, Salmonella enterica enterica serovar Typhi Ty2
gcuuaucgggccuacga

SEQ ID NO: 1745136 - RNA, 22 nt, Salmonella enterica enterica serovar Typhi Ty2
gcuuauccccauucugcugaug

SEQ ID NO: 1745137 - RNA, 18 nt, Salmonella enterica enterica serovar Typhi Ty2
gcuuauccggccuacaga

SEQ ID NO: 1745138 - RNA, 14 nt, Salmonella enterica enterica serovar Typhi Ty2
gcuuauccggccua

SEQ ID NO: 1745139 - RNA, 18 nt, Salmonella enterica enterica serovar Typhi Ty2
gcuuaucaggccuacaau

SEQ ID NO: 1745140 - RNA, 16 nt, Salmonella enterica enterica serovar Typhi Ty2
gcuuaucaaguaacgu

SEQ ID NO: 1745141 - RNA, 17 nt, Salmonella enterica enterica serovar Typhi Ty2
gcuuaucaggccuacaa

SEQ ID NO: 1745142 - RNA, 20 nt, Salmonella enterica enterica serovar Typhi Ty2
gcuuauagcuacguagcgca

SEQ ID NO: 1745143 - RNA, 22 nt, Salmonella enterica enterica serovar Typhi Ty2
gcuuagcuguaauucaugcugu

SEQ ID NO: 1745144 - RNA, 17 nt, Salmonella enterica enterica serovar Typhi Ty2
gcuuaggauucgccauu

SEQ ID NO: 1745145 - RNA, 14 nt, Salmonella enterica enterica serovar Typhi Ty2
gcuuagcgccagau

SEQ ID NO: 1745146 - RNA, 17 nt, Salmonella enterica enterica serovar Typhi Ty2
gcuuacggcaaacugaa

SEQ ID NO: 1745147 - RNA, 20 nt, Salmonella enterica enterica serovar Typhi Ty2
gcuuacgcuuacccggccua

SEQ ID NO: 1745148 - RNA, 14 nt, Salmonella enterica enterica serovar Typhi Ty2
gcuucaaccuccug

SEQ ID NO: 1745149 - RNA, 16 nt, Salmonella enterica enterica serovar Typhi Ty2
gcuuauuuucgucguu

SEQ ID NO: 1745150 - RNA, 19 nt, Salmonella enterica enterica serovar Typhi Ty2
gcuuauuccagucauuaac

SEQ ID NO: 1745151 - RNA, 13 nt, Salmonella enterica enterica serovar Typhi Ty2
gcuuauugucgcc

SEQ ID NO: 1745152 - RNA, 20 nt, Salmonella enterica enterica serovar Typhi Ty2
gcuucaccuuucgccgccag

SEQ ID NO: 1745153 - RNA, 15 nt, Salmonella enterica enterica serovar Typhi Ty2
gcuucaccgccagag

SEQ ID NO: 1745154 - RNA, 20 nt, Salmonella enterica enterica serovar Typhi Ty2
gcuucacgucagcgaccauu

SEQ ID NO: 1745155 - RNA, 19 nt, Salmonella enterica enterica serovar Typhi Ty2
gcuuacacacccggccuau

SEQ ID NO: 1745156 - RNA, 18 nt, Salmonella enterica enterica serovar Typhi Ty2
gcuuacacacccggccua

SEQ ID NO: 1745157 - RNA, 22 nt, Salmonella enterica enterica serovar Typhi Ty2
gcuuaaugcccggcccgucauc

SEQ ID NO: 1745158 - RNA, 17 nt, Salmonella enterica enterica serovar Typhi Ty2
gcuuaccgggccugcgu

SEQ ID NO: 1745159 - RNA, 20 nt, Salmonella enterica enterica serovar Typhi Ty2
gcuuacaucgccauccggca

SEQ ID NO: 1745160 - RNA, 18 nt, Salmonella enterica enterica serovar Typhi Ty2
gcuuaccaucuggccuac

SEQ ID NO: 1745161 - RNA, 17 nt, Salmonella enterica enterica serovar Typhi Ty2
gcuuaaaaaauccugca

SEQ ID NO: 1745162 - RNA, 22 nt, Salmonella enterica enterica serovar Typhi Ty2
gcuuaacagcguacaggcggaa

SEQ ID NO: 1745163 - RNA, 21 nt, Salmonella enterica enterica serovar Typhi Ty2
gcuuaaucaccagcgcauuga

SEQ ID NO: 1745164 - RNA, 20 nt, Salmonella enterica enterica serovar Typhi Ty2
gcuguuuaaagguuauccgc

SEQ ID NO: 1745165 - RNA, 21 nt, Salmonella enterica enterica serovar Typhi Ty2
gcugucuuacacugauacccc

SEQ ID NO: 1745166 - RNA, 18 nt, Salmonella enterica enterica serovar Typhi Ty2
gcugucugccggcguucc

SEQ ID NO: 1745167 - RNA, 22 nt, Salmonella enterica enterica serovar Typhi Ty2
gcugugcagacugcacuuccug

SEQ ID NO: 1745168 - RNA, 18 nt, Salmonella enterica enterica serovar Typhi Ty2
gcugugccggguucugcg

SEQ ID NO: 1745169 - RNA, 17 nt, Salmonella enterica enterica serovar Typhi Ty2
gcugugcuaucaggccu

SEQ ID NO: 1745170 - RNA, 20 nt, Salmonella enterica enterica serovar Typhi Ty2
gcuguggaggguaagaaagu

SEQ ID NO: 1745171 - RNA, 21 nt, Salmonella enterica enterica serovar Typhi Ty2
gcugucggucaggcugcggac

SEQ ID NO: 1745172 - RNA, 17 nt, Salmonella enterica enterica serovar Typhi Ty2
gcuguaauagugcgcgg

SEQ ID NO: 1745173 - RNA, 22 nt, Salmonella enterica enterica serovar Typhi Ty2
gcuguaccaucaccugaugucc

SEQ ID NO: 1745174 - RNA, 18 nt, Salmonella enterica enterica serovar Typhi Ty2
gcugucccagugucaacu

SEQ ID NO: 1745175 - RNA, 20 nt, Salmonella enterica enterica serovar Typhi Ty2
gcugucaucgaaggcgauac

SEQ ID NO: 1745176 - RNA, 18 nt, Salmonella enterica enterica serovar Typhi Ty2
gcugucagaagaucggga

SEQ ID NO: 1745177 - RNA, 19 nt, Salmonella enterica enterica serovar Typhi Ty2
gcugguuuuagcuuauccc

SEQ ID NO: 1745178 - RNA, 18 nt, Salmonella enterica enterica serovar Typhi Ty2
gcuggucgagauacugca

SEQ ID NO: 1745179 - RNA, 22 nt, Salmonella enterica enterica serovar Typhi Ty2
gcuggucaccuggcugguggcc

SEQ ID NO: 1745180 - RNA, 20 nt, Salmonella enterica enterica serovar Typhi Ty2
gcuggcggucgggaacgcug

SEQ ID NO: 1745181 - RNA, 16 nt, Salmonella enterica enterica serovar Typhi Ty2
gcuggcggcgauggcc

SEQ ID NO: 1745182 - RNA, 17 nt, Salmonella enterica enterica serovar Typhi Ty2
gcugggauauuacagau

SEQ ID NO: 1745183 - RNA, 16 nt, Salmonella enterica enterica serovar Typhi Ty2
gcuggcuggccagggc

SEQ ID NO: 1745184 - RNA, 13 nt, Salmonella enterica enterica serovar Typhi Ty2
gcuggcuggcggu

SEQ ID NO: 1745185 - RNA, 18 nt, Salmonella enterica enterica serovar Typhi Ty2
gcuucgccaucuccauca

SEQ ID NO: 1745186 - RNA, 19 nt, Salmonella enterica enterica serovar Typhi Ty2
gcuucgacauagccuuugu

SEQ ID NO: 1745187 - RNA, 17 nt, Salmonella enterica enterica serovar Typhi Ty2
gcuucgguccggcgcua

SEQ ID NO: 1745188 - RNA, 21 nt, Salmonella enterica enterica serovar Typhi Ty2
gcuucaucaccaucgccggag

SEQ ID NO: 1745189 - RNA, 22 nt, Salmonella enterica enterica serovar Typhi Ty2
gcuucagcaaacggcuggauaa

SEQ ID NO: 1745190 - RNA, 22 nt, Salmonella enterica enterica serovar Typhi Ty2
gcuucaggugugguacggcuuu

SEQ ID NO: 1745191 - RNA, 19 nt, Salmonella enterica enterica serovar Typhi Ty2
gcuuccgcgacgaugcgca

SEQ ID NO: 1745192 - RNA, 15 nt, Salmonella enterica enterica serovar Typhi Ty2
gcuuccaguugaaaa

SEQ ID NO: 1745193 - RNA, 13 nt, Salmonella enterica enterica serovar Typhi Ty2
gcuucccacaguc

SEQ ID NO: 1745194 - RNA, 15 nt, Salmonella enterica enterica serovar Typhi Ty2
gcuuccaguagccua

SEQ ID NO: 1745195 - RNA, 15 nt, Salmonella enterica enterica serovar Typhi Ty2
gcuucguggcaauca

SEQ ID NO: 1745196 - RNA, 21 nt, Salmonella enterica enterica serovar Typhi Ty2
gcuucuuaaaauagccaucgu

SEQ ID NO: 1745197 - RNA, 13 nt, Salmonella enterica enterica serovar Typhi Ty2
gcuucuuggcgau

SEQ ID NO: 1745198 - RNA, 22 nt, Salmonella enterica enterica serovar Typhi Ty2
gcuugcgccgccauccggccug

SEQ ID NO: 1745199 - RNA, 12 nt, Salmonella enterica enterica serovar Typhi Ty2
gcuugcgaucca

SEQ ID NO: 1745200 - RNA, 13 nt, Salmonella enterica enterica serovar Typhi Ty2
gcuugauacgcca

SEQ ID NO: 1745201 - RNA, 17 nt, Salmonella enterica enterica serovar Typhi Ty2
gcuugcacuaucgggca

SEQ ID NO: 1745202 - RNA, 19 nt, Salmonella enterica enterica serovar Typhi Ty2
gcuugcccgauggcgcugc

SEQ ID NO: 1745203 - RNA, 14 nt, Salmonella enterica enterica serovar Typhi Ty2
gcuugcgcuauccg

SEQ ID NO: 1745204 - RNA, 20 nt, Salmonella enterica enterica serovar Typhi Ty2
gcuugggccaccugccaggc

SEQ ID NO: 1745205 - RNA, 15 nt, Salmonella enterica enterica serovar Typhi Ty2
gcuuuaccgggccua

SEQ ID NO: 1745206 - RNA, 16 nt, Salmonella enterica enterica serovar Typhi Ty2
gcuuuagugccgccau

SEQ ID NO: 1745207 - RNA, 14 nt, Salmonella enterica enterica serovar Typhi Ty2
gcuuuacagcgacg

SEQ ID NO: 1745208 - RNA, 22 nt, Salmonella enterica enterica serovar Typhi Ty2
gcuuuaugcagucgguagcuuu

SEQ ID NO: 1745209 - RNA, 16 nt, Salmonella enterica enterica serovar Typhi Ty2
gcuuuauucugucgcc

SEQ ID NO: 1745210 - RNA, 21 nt, Salmonella enterica enterica serovar Typhi Ty2
gcuuguuacugcauuccgcgu

SEQ ID NO: 1745211 - RNA, 15 nt, Salmonella enterica enterica serovar Typhi Ty2
gcuugugaugagcuc

SEQ ID NO: 1745212 - RNA, 17 nt, Salmonella enterica enterica serovar Typhi Ty2
gcuuguaaauugcgcca

SEQ ID NO: 1745213 - RNA, 20 nt, Salmonella enterica enterica serovar Typhi Ty2
gcuuucuguaggccggauaa

SEQ ID NO: 1745214 - RNA, 15 nt, Salmonella enterica enterica serovar Typhi Ty2
gcuuuuggcgucguu

SEQ ID NO: 1745215 - RNA, 23 nt, Salmonella enterica enterica serovar Typhi Ty2
gcuuuuaucggcgucgcggcaau

SEQ ID NO: 1745216 - RNA, 19 nt, Salmonella enterica enterica serovar Typhi Ty2
gcuuugcuuauccggccua

SEQ ID NO: 1745217 - RNA, 15 nt, Salmonella enterica enterica serovar Typhi Ty2
ggaaaaagccgccgu

SEQ ID NO: 1745218 - RNA, 19 nt, Salmonella enterica enterica serovar Typhi Ty2
ggaaagacggcagcgccau

SEQ ID NO: 1745219 - RNA, 16 nt, Salmonella enterica enterica serovar Typhi Ty2
ggaaacgcgccggaag

SEQ ID NO: 1745220 - RNA, 22 nt, Salmonella enterica enterica serovar Typhi Ty2
ggaaaucaugccagaauugcac

SEQ ID NO: 1745221 - RNA, 12 nt, Salmonella enterica enterica serovar Typhi Ty2
gcugcgcgcgau

SEQ ID NO: 1745222 - RNA, 19 nt, Salmonella enterica enterica serovar Typhi Ty2
gcugcguaaugaagcgucg

SEQ ID NO: 1745223 - RNA, 23 nt, Salmonella enterica enterica serovar Typhi Ty2
gcugcgucacgcguucgaccguu

SEQ ID NO: 1745224 - RNA, 17 nt, Salmonella enterica enterica serovar Typhi Ty2
gcugcgguuuacgccau

SEQ ID NO: 1745225 - RNA, 13 nt, Salmonella enterica enterica serovar Typhi Ty2
gcugccgccagaa

SEQ ID NO: 1745226 - RNA, 15 nt, Salmonella enterica enterica serovar Typhi Ty2
gcugaugacgcgccg

SEQ ID NO: 1745227 - RNA, 23 nt, Salmonella enterica enterica serovar Typhi Ty2
gcugaugcccagguuagcagcca

SEQ ID NO: 1745228 - RNA, 20 nt, Salmonella enterica enterica serovar Typhi Ty2
gcugcaauucgucgcuucgu

SEQ ID NO: 1745229 - RNA, 21 nt, Salmonella enterica enterica serovar Typhi Ty2
gcugcauuucuuguugacgac

SEQ ID NO: 1745230 - RNA, 18 nt, Salmonella enterica enterica serovar Typhi Ty2
gcugcaucuuacugaccg

SEQ ID NO: 1745231 - RNA, 21 nt, Salmonella enterica enterica serovar Typhi Ty2
gcugagcacgcccggucuguc

SEQ ID NO: 1745232 - RNA, 23 nt, Salmonella enterica enterica serovar Typhi Ty2
gcugagcucugguugcagcgcca

SEQ ID NO: 1745233 - RNA, 21 nt, Salmonella enterica enterica serovar Typhi Ty2
gcugagaaaaauacgccagau

SEQ ID NO: 1745234 - RNA, 16 nt, Salmonella enterica enterica serovar Typhi Ty2
gcugaguucaggcacg

SEQ ID NO: 1745235 - RNA, 16 nt, Salmonella enterica enterica serovar Typhi Ty2
gcugauaaucaauggc

SEQ ID NO: 1745236 - RNA, 13 nt, Salmonella enterica enterica serovar Typhi Ty2
gcugaggcgcugg

SEQ ID NO: 1745237 - RNA, 21 nt, Salmonella enterica enterica serovar Typhi Ty2
gcugauccuguuaaucaucgc

SEQ ID NO: 1745238 - RNA, 20 nt, Salmonella enterica enterica serovar Typhi Ty2
gcugauauuuuuacugauua

SEQ ID NO: 1745239 - RNA, 21 nt, Salmonella enterica enterica serovar Typhi Ty2
gcucuccuggaugcgcugaau

SEQ ID NO: 1745240 - RNA, 15 nt, Salmonella enterica enterica serovar Typhi Ty2
gcucuauucggcgcu

SEQ ID NO: 1745241 - RNA, 14 nt, Salmonella enterica enterica serovar Typhi Ty2
gcucuauuccaacu

SEQ ID NO: 1745242 - RNA, 18 nt, Salmonella enterica enterica serovar Typhi Ty2
gcucguuguuuaauacgc

SEQ ID NO: 1745243 - RNA, 17 nt, Salmonella enterica enterica serovar Typhi Ty2
gcugaauaaugccuucc

SEQ ID NO: 1745244 - RNA, 16 nt, Salmonella enterica enterica serovar Typhi Ty2
gcucuuuucaggcgcu

SEQ ID NO: 1745245 - RNA, 16 nt, Salmonella enterica enterica serovar Typhi Ty2
gcucucuuuuggcgac

SEQ ID NO: 1745246 - RNA, 19 nt, Salmonella enterica enterica serovar Typhi Ty2
gcuccuuucggacuuccug

SEQ ID NO: 1745247 - RNA, 16 nt, Salmonella enterica enterica serovar Typhi Ty2
gcuccugguccguaac

SEQ ID NO: 1745248 - RNA, 13 nt, Salmonella enterica enterica serovar Typhi Ty2
gcuccggcgcugg

SEQ ID NO: 1745249 - RNA, 15 nt, Salmonella enterica enterica serovar Typhi Ty2
gcucccgcugcggcg

SEQ ID NO: 1745250 - RNA, 15 nt, Salmonella enterica enterica serovar Typhi Ty2
gcucgcagaugcccg

SEQ ID NO: 1745251 - RNA, 21 nt, Salmonella enterica enterica serovar Typhi Ty2
gcuccagaccaccagcgacau

SEQ ID NO: 1745252 - RNA, 18 nt, Salmonella enterica enterica serovar Typhi Ty2
gcuccaauaaauauugca

SEQ ID NO: 1745253 - RNA, 17 nt, Salmonella enterica enterica serovar Typhi Ty2
gcucauuggcagaacga

SEQ ID NO: 1745254 - RNA, 20 nt, Salmonella enterica enterica serovar Typhi Ty2
gcuccaugucuugcuaucaa

SEQ ID NO: 1745255 - RNA, 15 nt, Salmonella enterica enterica serovar Typhi Ty2
gcucccgcagccacu

SEQ ID NO: 1745256 - RNA, 14 nt, Salmonella enterica enterica serovar Typhi Ty2
gcucaucagcgcca

SEQ ID NO: 1745257 - RNA, 23 nt, Salmonella enterica enterica serovar Typhi Ty2
gcucaucaccagcagcagaauca

SEQ ID NO: 1745258 - RNA, 20 nt, Salmonella enterica enterica serovar Typhi Ty2
gcucauaaauugcagcgacc

SEQ ID NO: 1745259 - RNA, 15 nt, Salmonella enterica enterica serovar Typhi Ty2
gcucauauacccugc

SEQ ID NO: 1745260 - RNA, 16 nt, Salmonella enterica enterica serovar Typhi Ty2
gcucauaaccgcgauc

SEQ ID NO: 1745261 - RNA, 22 nt, Salmonella enterica enterica serovar Typhi Ty2
gcucaggguuuucuaccgcagc

SEQ ID NO: 1745262 - RNA, 14 nt, Salmonella enterica enterica serovar Typhi Ty2
gcucaggcgcgaau

SEQ ID NO: 1745263 - RNA, 15 nt, Salmonella enterica enterica serovar Typhi Ty2
gcucagcgcggcagc

SEQ ID NO: 1745264 - RNA, 19 nt, Salmonella enterica enterica serovar Typhi Ty2
gcucagcggcggcgggaac

SEQ ID NO: 1745265 - RNA, 15 nt, Salmonella enterica enterica serovar Typhi Ty2
gcucagccagaaacg

SEQ ID NO: 1745266 - RNA, 19 nt, Salmonella enterica enterica serovar Typhi Ty2
gcggucggcagcaccggaa

SEQ ID NO: 1745267 - RNA, 22 nt, Salmonella enterica enterica serovar Typhi Ty2
gcggucggccuuaacgacccuu

SEQ ID NO: 1745268 - RNA, 22 nt, Salmonella enterica enterica serovar Typhi Ty2
gcggugaaaugcccgauggcgc

SEQ ID NO: 1745269 - RNA, 22 nt, Salmonella enterica enterica serovar Typhi Ty2
gcggugcagguugccugauggc

SEQ ID NO: 1745270 - RNA, 14 nt, Salmonella enterica enterica serovar Typhi Ty2
gcgguaauaacuga

SEQ ID NO: 1745271 - RNA, 16 nt, Salmonella enterica enterica serovar Typhi Ty2
gcggucacaggcauac

SEQ ID NO: 1745272 - RNA, 23 nt, Salmonella enterica enterica serovar Typhi Ty2
gcgguauacaccagcucccgcgu

SEQ ID NO: 1745273 - RNA, 14 nt, Salmonella enterica enterica serovar Typhi Ty2
gcgguauaucacgc

SEQ ID NO: 1745274 - RNA, 15 nt, Salmonella enterica enterica serovar Typhi Ty2
gcgguauaacugccu

SEQ ID NO: 1745275 - RNA, 15 nt, Salmonella enterica enterica serovar Typhi Ty2
gcggucagggcuuac

SEQ ID NO: 1745276 - RNA, 18 nt, Salmonella enterica enterica serovar Typhi Ty2
gcgguggguagcggcaau

SEQ ID NO: 1745277 - RNA, 13 nt, Salmonella enterica enterica serovar Typhi Ty2
gcgguuauccgcc

SEQ ID NO: 1745278 - RNA, 16 nt, Salmonella enterica enterica serovar Typhi Ty2
gcgguuauccgccagc

SEQ ID NO: 1745279 - RNA, 15 nt, Salmonella enterica enterica serovar Typhi Ty2
gcgguuucaucgagc

SEQ ID NO: 1745280 - RNA, 18 nt, Salmonella enterica enterica serovar Typhi Ty2
gcgguuuuccugaugaua

SEQ ID NO: 1745281 - RNA, 23 nt, Salmonella enterica enterica serovar Typhi Ty2
gcgguuuaaugcuaucccaggcg

SEQ ID NO: 1745282 - RNA, 16 nt, Salmonella enterica enterica serovar Typhi Ty2
gcgguucucccggcau

SEQ ID NO: 1745283 - RNA, 15 nt, Salmonella enterica enterica serovar Typhi Ty2
gcgguucucccggca

SEQ ID NO: 1745284 - RNA, 23 nt, Salmonella enterica enterica serovar Typhi Ty2
gcguacaggauguccaggcgaca

SEQ ID NO: 1745285 - RNA, 13 nt, Salmonella enterica enterica serovar Typhi Ty2
gcguaccagcgcc

SEQ ID NO: 1745286 - RNA, 15 nt, Salmonella enterica enterica serovar Typhi Ty2
gcguacauugccgga

SEQ ID NO: 1745287 - RNA, 15 nt, Salmonella enterica enterica serovar Typhi Ty2
gcguacucagcagac

SEQ ID NO: 1745288 - RNA, 14 nt, Salmonella enterica enterica serovar Typhi Ty2
gcguaccgccuugu

SEQ ID NO: 1745289 - RNA, 15 nt, Salmonella enterica enterica serovar Typhi Ty2
gcguaccaucagcgu

SEQ ID NO: 1745290 - RNA, 15 nt, Salmonella enterica enterica serovar Typhi Ty2
gcguaauauacgcca

SEQ ID NO: 1745291 - RNA, 23 nt, Salmonella enterica enterica serovar Typhi Ty2
gcguacaaucgcguuuuccagca

SEQ ID NO: 1745292 - RNA, 18 nt, Salmonella enterica enterica serovar Typhi Ty2
gcguacacuucauccggc

SEQ ID NO: 1745293 - RNA, 22 nt, Salmonella enterica enterica serovar Typhi Ty2
gcguaaaccauuucuccugcau

SEQ ID NO: 1745294 - RNA, 15 nt, Salmonella enterica enterica serovar Typhi Ty2
gcguaaaaccgcgcu

SEQ ID NO: 1745295 - RNA, 17 nt, Salmonella enterica enterica serovar Typhi Ty2
gcguaacagcgguauac

SEQ ID NO: 1745296 - RNA, 16 nt, Salmonella enterica enterica serovar Typhi Ty2
gcguaauacaggcgau

SEQ ID NO: 1745297 - RNA, 16 nt, Salmonella enterica enterica serovar Typhi Ty2
gcguaaacuuccgcca

SEQ ID NO: 1745298 - RNA, 14 nt, Salmonella enterica enterica serovar Typhi Ty2
gcguaacgaacuga

SEQ ID NO: 1745299 - RNA, 14 nt, Salmonella enterica enterica serovar Typhi Ty2
gcgucuucaucagc

SEQ ID NO: 1745300 - RNA, 21 nt, Salmonella enterica enterica serovar Typhi Ty2
gcgugauccacagcguaggcc

SEQ ID NO: 1745301 - RNA, 23 nt, Salmonella enterica enterica serovar Typhi Ty2
gcgugauaauucccccauccgcg

SEQ ID NO: 1745302 - RNA, 17 nt, Salmonella enterica enterica serovar Typhi Ty2
gcgugacgaccggcacg

SEQ ID NO: 1745303 - RNA, 23 nt, Salmonella enterica enterica serovar Typhi Ty2
gcgucuuuuagucacuccaggcg

SEQ ID NO: 1745304 - RNA, 16 nt, Salmonella enterica enterica serovar Typhi Ty2
aaggacaggugcgcug

SEQ ID NO: 1745305 - RNA, 22 nt, Salmonella enterica enterica serovar Typhi Ty2
gcguuaucguccgucagauccg

SEQ ID NO: 1745306 - RNA, 17 nt, Salmonella enterica enterica serovar Typhi Ty2
gcguuauccgccugcug

SEQ ID NO: 1745307 - RNA, 20 nt, Salmonella enterica enterica serovar Typhi Ty2
gcguuaacggcuucguuuca

SEQ ID NO: 1745308 - RNA, 18 nt, Salmonella enterica enterica serovar Typhi Ty2
gcguuaacguuuucccgc

SEQ ID NO: 1745309 - RNA, 19 nt, Salmonella enterica enterica serovar Typhi Ty2
gcguuagcgucauccggca

SEQ ID NO: 1745310 - RNA, 19 nt, Salmonella enterica enterica serovar Typhi Ty2
gcguggcaucuuaucaggc

SEQ ID NO: 1745311 - RNA, 16 nt, Salmonella enterica enterica serovar Typhi Ty2
gcguguucaugcgcgg

SEQ ID NO: 1745312 - RNA, 22 nt, Salmonella enterica enterica serovar Typhi Ty2
gcgugauuuuggccucauccgc

SEQ ID NO: 1745313 - RNA, 20 nt, Salmonella enterica enterica serovar Typhi Ty2
gcgugauuuuggccucaucc

SEQ ID NO: 1745314 - RNA, 13 nt, Salmonella enterica enterica serovar Typhi Ty2
gcgugcuggcggc

SEQ ID NO: 1745315 - RNA, 18 nt, Salmonella enterica enterica serovar Typhi Ty2
gcgucgcauucgauacgc

SEQ ID NO: 1745316 - RNA, 14 nt, Salmonella enterica enterica serovar Typhi Ty2
gcgucgcauccggc

SEQ ID NO: 1745317 - RNA, 12 nt, Salmonella enterica enterica serovar Typhi Ty2
gcgucgaccaua

SEQ ID NO: 1745318 - RNA, 18 nt, Salmonella enterica enterica serovar Typhi Ty2
gcguccguucugauacuc

SEQ ID NO: 1745319 - RNA, 15 nt, Salmonella enterica enterica serovar Typhi Ty2
gcgucggcuucauca

SEQ ID NO: 1745320 - RNA, 15 nt, Salmonella enterica enterica serovar Typhi Ty2
gcgucgcuaccaggc

SEQ ID NO: 1745321 - RNA, 11 nt, Salmonella enterica enterica serovar Typhi Ty2
gcgucgccaua

SEQ ID NO: 1745322 - RNA, 12 nt, Salmonella enterica enterica serovar Typhi Ty2
gcgucgccagac

SEQ ID NO: 1745323 - RNA, 17 nt, Salmonella enterica enterica serovar Typhi Ty2
gcgucagcgugcgguaa

SEQ ID NO: 1745324 - RNA, 22 nt, Salmonella enterica enterica serovar Typhi Ty2
gcgucaggccaucgcuucggca

SEQ ID NO: 1745325 - RNA, 20 nt, Salmonella enterica enterica serovar Typhi Ty2
gcguccaugaccaccagcgc

SEQ ID NO: 1745326 - RNA, 16 nt, Salmonella enterica enterica serovar Typhi Ty2
gcguagcccagcgccg

SEQ ID NO: 1745327 - RNA, 13 nt, Salmonella enterica enterica serovar Typhi Ty2
gcguagagagcgg

SEQ ID NO: 1745328 - RNA, 15 nt, Salmonella enterica enterica serovar Typhi Ty2
gcgucacauggcgaa

SEQ ID NO: 1745329 - RNA, 14 nt, Salmonella enterica enterica serovar Typhi Ty2
gcgucaacguccag

SEQ ID NO: 1745330 - RNA, 15 nt, Salmonella enterica enterica serovar Typhi Ty2
gcgucacaaucgcgc

SEQ ID NO: 1745331 - RNA, 17 nt, Salmonella enterica enterica serovar Typhi Ty2
gcguauagccaggcaga

SEQ ID NO: 1745332 - RNA, 14 nt, Salmonella enterica enterica serovar Typhi Ty2
gcggcucauccagc

SEQ ID NO: 1745333 - RNA, 22 nt, Salmonella enterica enterica serovar Typhi Ty2
gcggcugcgccuuauccggcgu

SEQ ID NO: 1745334 - RNA, 21 nt, Salmonella enterica enterica serovar Typhi Ty2
gcggcugucaucaaugagcgg

SEQ ID NO: 1745335 - RNA, 17 nt, Salmonella enterica enterica serovar Typhi Ty2
gcggcuuuuucaucauc

SEQ ID NO: 1745336 - RNA, 15 nt, Salmonella enterica enterica serovar Typhi Ty2
gcggcuucagcgaca

SEQ ID NO: 1745337 - RNA, 12 nt, Salmonella enterica enterica serovar Typhi Ty2
gcggcuuauccg

SEQ ID NO: 1745338 - RNA, 17 nt, Salmonella enterica enterica serovar Typhi Ty2
gcgggcaauuccgguca

SEQ ID NO: 1745339 - RNA, 16 nt, Salmonella enterica enterica serovar Typhi Ty2
aagcguagcgccauca

SEQ ID NO: 1745340 - RNA, 20 nt, Salmonella enterica enterica serovar Typhi Ty2
aagcguagcgccauccggca

SEQ ID NO: 1745341 - RNA, 17 nt, Salmonella enterica enterica serovar Typhi Ty2
aagcguggcgcaaccga

SEQ ID NO: 1745342 - RNA, 22 nt, Salmonella enterica enterica serovar Typhi Ty2
gcggcgaaaugccuuauccggc

SEQ ID NO: 1745343 - RNA, 15 nt, Salmonella enterica enterica serovar Typhi Ty2
gcggcgccaucgccu

SEQ ID NO: 1745344 - RNA, 11 nt, Salmonella enterica enterica serovar Typhi Ty2
gcggcggcaag

SEQ ID NO: 1745345 - RNA, 21 nt, Salmonella enterica enterica serovar Typhi Ty2
gcggcggggauaaucagcagc

SEQ ID NO: 1745346 - RNA, 18 nt, Salmonella enterica enterica serovar Typhi Ty2
gcggcgucugcaccggua

SEQ ID NO: 1745347 - RNA, 14 nt, Salmonella enterica enterica serovar Typhi Ty2
gcggcguaccgcgc

SEQ ID NO: 1745348 - RNA, 21 nt, Salmonella enterica enterica serovar Typhi Ty2
gcggcguaccgcgcgcccgac

SEQ ID NO: 1745349 - RNA, 13 nt, Salmonella enterica enterica serovar Typhi Ty2
gcggccagcgccu

SEQ ID NO: 1745350 - RNA, 20 nt, Salmonella enterica enterica serovar Typhi Ty2
aagcgcagcgccauccggca

SEQ ID NO: 1745351 - RNA, 14 nt, Salmonella enterica enterica serovar Typhi Ty2
aagcgccaucgggc

SEQ ID NO: 1745352 - RNA, 13 nt, Salmonella enterica enterica serovar Typhi Ty2
aagcgaagcgcca

SEQ ID NO: 1745353 - RNA, 17 nt, Salmonella enterica enterica serovar Typhi Ty2
aagcgaccagcgcgcca

SEQ ID NO: 1745354 - RNA, 20 nt, Salmonella enterica enterica serovar Typhi Ty2
aagcgacgcgcgguugcggc

SEQ ID NO: 1745355 - RNA, 15 nt, Salmonella enterica enterica serovar Typhi Ty2
aagcgaagagagauc

SEQ ID NO: 1745356 - RNA, 16 nt, Salmonella enterica enterica serovar Typhi Ty2
gcggcaggauccccau

SEQ ID NO: 1745357 - RNA, 23 nt, Salmonella enterica enterica serovar Typhi Ty2
gcggcagccaugcuauucagcag

SEQ ID NO: 1745358 - RNA, 13 nt, Salmonella enterica enterica serovar Typhi Ty2
aagcgcagcgcca

SEQ ID NO: 1745359 - RNA, 21 nt, Salmonella enterica enterica serovar Typhi Ty2
gcggccuaugacuauaucagc

SEQ ID NO: 1745360 - RNA, 21 nt, Salmonella enterica enterica serovar Typhi Ty2
gcggcgaaauaggccgcgaua

SEQ ID NO: 1745361 - RNA, 15 nt, Salmonella enterica enterica serovar Typhi Ty2
gcggcccgcgcugaa

SEQ ID NO: 1745362 - RNA, 14 nt, Salmonella enterica enterica serovar Typhi Ty2
gcggcccgcgcuga

SEQ ID NO: 1745363 - RNA, 21 nt, Salmonella enterica enterica serovar Typhi Ty2
aagcggcagcgccauccggca

SEQ ID NO: 1745364 - RNA, 20 nt, Salmonella enterica enterica serovar Typhi Ty2
aagcggcaagccgaucagcg

SEQ ID NO: 1745365 - RNA, 21 nt, Salmonella enterica enterica serovar Typhi Ty2
gcggccaugaucgccgccauc

SEQ ID NO: 1745366 - RNA, 18 nt, Salmonella enterica enterica serovar Typhi Ty2
gcggcccacucauccagc

SEQ ID NO: 1745367 - RNA, 14 nt, Salmonella enterica enterica serovar Typhi Ty2
aagcgcuagcgcca

SEQ ID NO: 1745368 - RNA, 21 nt, Salmonella enterica enterica serovar Typhi Ty2
aagcgcuagcgccacccgaca

SEQ ID NO: 1745369 - RNA, 15 nt, Salmonella enterica enterica serovar Typhi Ty2
aagcgcuggcuggcg

SEQ ID NO: 1745370 - RNA, 18 nt, Salmonella enterica enterica serovar Typhi Ty2
gcgaaaaaguucacgcuu

SEQ ID NO: 1745371 - RNA, 13 nt, Salmonella enterica enterica serovar Typhi Ty2
gcgaaaaagccgg

SEQ ID NO: 1745372 - RNA, 14 nt, Salmonella enterica enterica serovar Typhi Ty2
gcgaaaaagccggc

SEQ ID NO: 1745373 - RNA, 19 nt, Salmonella enterica enterica serovar Typhi Ty2
gcgaaagagaaagcgcuga

SEQ ID NO: 1745374 - RNA, 21 nt, Salmonella enterica enterica serovar Typhi Ty2
gcgaaagagaaagcgcugacg

SEQ ID NO: 1745375 - RNA, 15 nt, Salmonella enterica enterica serovar Typhi Ty2
gccuuucagaucggc

SEQ ID NO: 1745376 - RNA, 22 nt, Salmonella enterica enterica serovar Typhi Ty2
gccuuuggcaaucauaccguca

SEQ ID NO: 1745377 - RNA, 17 nt, Salmonella enterica enterica serovar Typhi Ty2
gccuuugcguaccgcaa

SEQ ID NO: 1745378 - RNA, 14 nt, Salmonella enterica enterica serovar Typhi Ty2
gccuuuggcaauca

SEQ ID NO: 1745379 - RNA, 16 nt, Salmonella enterica enterica serovar Typhi Ty2
gccuuugcguaccgca

SEQ ID NO: 1745380 - RNA, 16 nt, Salmonella enterica enterica serovar Typhi Ty2
gccuugauaccgccgc

SEQ ID NO: 1745381 - RNA, 22 nt, Salmonella enterica enterica serovar Typhi Ty2
gccuugcccguauugaagcgau

SEQ ID NO: 1745382 - RNA, 13 nt, Salmonella enterica enterica serovar Typhi Ty2
gccuugccgccag

SEQ ID NO: 1745383 - RNA, 16 nt, Salmonella enterica enterica serovar Typhi Ty2
gccuguugacgcgcau

SEQ ID NO: 1745384 - RNA, 13 nt, Salmonella enterica enterica serovar Typhi Ty2
gccuguuauucaa

SEQ ID NO: 1745385 - RNA, 17 nt, Salmonella enterica enterica serovar Typhi Ty2
gccugucgggccuacag

SEQ ID NO: 1745386 - RNA, 18 nt, Salmonella enterica enterica serovar Typhi Ty2
gccugucuccucagcagg

SEQ ID NO: 1745387 - RNA, 18 nt, Salmonella enterica enterica serovar Typhi Ty2
gccuucguuauaaggccu

SEQ ID NO: 1745388 - RNA, 13 nt, Salmonella enterica enterica serovar Typhi Ty2
gccuuccaggcgg

SEQ ID NO: 1745389 - RNA, 22 nt, Salmonella enterica enterica serovar Typhi Ty2
gccuucauauuaaauuccggcu

SEQ ID NO: 1745390 - RNA, 18 nt, Salmonella enterica enterica serovar Typhi Ty2
gccuuauccggccuacuc

SEQ ID NO: 1745391 - RNA, 20 nt, Salmonella enterica enterica serovar Typhi Ty2
gccuguuccggcgaggacug

SEQ ID NO: 1745392 - RNA, 20 nt, Salmonella enterica enterica serovar Typhi Ty2
gccuuauugugccgcggcuu

SEQ ID NO: 1745393 - RNA, 14 nt, Salmonella enterica enterica serovar Typhi Ty2
gcgaaccaccagcc

SEQ ID NO: 1745394 - RNA, 16 nt, Salmonella enterica enterica serovar Typhi Ty2
gcgaacauuucagcgc

SEQ ID NO: 1745395 - RNA, 17 nt, Salmonella enterica enterica serovar Typhi Ty2
gcgaacauuucagcgcc

SEQ ID NO: 1745396 - RNA, 13 nt, Salmonella enterica enterica serovar Typhi Ty2
gcgaaccggcauc

SEQ ID NO: 1745397 - RNA, 21 nt, Salmonella enterica enterica serovar Typhi Ty2
gcgaacggcuuuccagcagcc

SEQ ID NO: 1745398 - RNA, 18 nt, Salmonella enterica enterica serovar Typhi Ty2
gcgaacgccuuauccggc

SEQ ID NO: 1745399 - RNA, 22 nt, Salmonella enterica enterica serovar Typhi Ty2
gcgaacaguacggucaggcuca

SEQ ID NO: 1745400 - RNA, 12 nt, Salmonella enterica enterica serovar Typhi Ty2
gcgaacagcgca

SEQ ID NO: 1745401 - RNA, 12 nt, Salmonella enterica enterica serovar Typhi Ty2
gcgaacagcgcu

SEQ ID NO: 1745402 - RNA, 21 nt, Salmonella enterica enterica serovar Typhi Ty2
gcgaaagcacuucucgcgcau

SEQ ID NO: 1745403 - RNA, 19 nt, Salmonella enterica enterica serovar Typhi Ty2
gcgaaauaggccgcgauac

SEQ ID NO: 1745404 - RNA, 15 nt, Salmonella enterica enterica serovar Typhi Ty2
gcgaacaaagccccg

SEQ ID NO: 1745405 - RNA, 23 nt, Salmonella enterica enterica serovar Typhi Ty2
gcgaacaaagccccgggcgcugg

SEQ ID NO: 1745406 - RNA, 16 nt, Salmonella enterica enterica serovar Typhi Ty2
gcgaauaaaacugccg

SEQ ID NO: 1745407 - RNA, 17 nt, Salmonella enterica enterica serovar Typhi Ty2
gcgaauaccuuucggca

SEQ ID NO: 1745408 - RNA, 18 nt, Salmonella enterica enterica serovar Typhi Ty2
gcgaauagccagacagcc

SEQ ID NO: 1745409 - RNA, 13 nt, Salmonella enterica enterica serovar Typhi Ty2
gcgaauagcgcca

SEQ ID NO: 1745410 - RNA, 22 nt, Salmonella enterica enterica serovar Typhi Ty2
gcgaaucacauccgccagcgcc

SEQ ID NO: 1745411 - RNA, 15 nt, Salmonella enterica enterica serovar Typhi Ty2
gcgaauccgccauag

SEQ ID NO: 1745412 - RNA, 20 nt, Salmonella enterica enterica serovar Typhi Ty2
gcgaaggggcgggcagcagc

SEQ ID NO: 1745413 - RNA, 23 nt, Salmonella enterica enterica serovar Typhi Ty2
gcgaaguagauuacgaaugugca

SEQ ID NO: 1745414 - RNA, 21 nt, Salmonella enterica enterica serovar Typhi Ty2
gcgaacugguuauacaguuca

SEQ ID NO: 1745415 - RNA, 20 nt, Salmonella enterica enterica serovar Typhi Ty2
gcgaacuucauccacgccga

SEQ ID NO: 1745416 - RNA, 20 nt, Salmonella enterica enterica serovar Typhi Ty2
gcgaacguuacccggccagc

SEQ ID NO: 1745417 - RNA, 14 nt, Salmonella enterica enterica serovar Typhi Ty2
gcgaacuacaggcg

SEQ ID NO: 1745418 - RNA, 16 nt, Salmonella enterica enterica serovar Typhi Ty2
gcgaagcgcuccggca

SEQ ID NO: 1745419 - RNA, 18 nt, Salmonella enterica enterica serovar Typhi Ty2
gcgaagcgucauccggca

SEQ ID NO: 1745420 - RNA, 17 nt, Salmonella enterica enterica serovar Typhi Ty2
gcgaagcgccaucaggc

SEQ ID NO: 1745421 - RNA, 13 nt, Salmonella enterica enterica serovar Typhi Ty2
gcgaguccugccg

SEQ ID NO: 1745422 - RNA, 16 nt, Salmonella enterica enterica serovar Typhi Ty2
gcgaguacgcacaaca

SEQ ID NO: 1745423 - RNA, 14 nt, Salmonella enterica enterica serovar Typhi Ty2
gcgagugccugcug

SEQ ID NO: 1745424 - RNA, 20 nt, Salmonella enterica enterica serovar Typhi Ty2
gcgagggauuuccuggcagu

SEQ ID NO: 1745425 - RNA, 20 nt, Salmonella enterica enterica serovar Typhi Ty2
gcgacgcgccagccagcgcc

SEQ ID NO: 1745426 - RNA, 22 nt, Salmonella enterica enterica serovar Typhi Ty2
gcgagaacggguaaaugcgcgc

SEQ ID NO: 1745427 - RNA, 21 nt, Salmonella enterica enterica serovar Typhi Ty2
gcgacuuucacgaaaccggcg

SEQ ID NO: 1745428 - RNA, 14 nt, Salmonella enterica enterica serovar Typhi Ty2
gcgacugaucaggc

SEQ ID NO: 1745429 - RNA, 13 nt, Salmonella enterica enterica serovar Typhi Ty2
gcgagaacugcug

SEQ ID NO: 1745430 - RNA, 22 nt, Salmonella enterica enterica serovar Typhi Ty2
gcgacucgccguuuuaucgccc

SEQ ID NO: 1745431 - RNA, 16 nt, Salmonella enterica enterica serovar Typhi Ty2
gcgacaucagccagcc

SEQ ID NO: 1745432 - RNA, 20 nt, Salmonella enterica enterica serovar Typhi Ty2
gcgacaucguuuccagcgaa

SEQ ID NO: 1745433 - RNA, 12 nt, Salmonella enterica enterica serovar Typhi Ty2
gcgacaucagcc

SEQ ID NO: 1745434 - RNA, 16 nt, Salmonella enterica enterica serovar Typhi Ty2
gcgacacuccgcgcau

SEQ ID NO: 1745435 - RNA, 21 nt, Salmonella enterica enterica serovar Typhi Ty2
gcgaccaauauccgcaggcga

SEQ ID NO: 1745436 - RNA, 21 nt, Salmonella enterica enterica serovar Typhi Ty2
gcgacauggcgguaaucgcgc

SEQ ID NO: 1745437 - RNA, 19 nt, Salmonella enterica enterica serovar Typhi Ty2
aagcccggccacagcgcca

SEQ ID NO: 1745438 - RNA, 18 nt, Salmonella enterica enterica serovar Typhi Ty2
gcgaauuucaaucgccag

SEQ ID NO: 1745439 - RNA, 13 nt, Salmonella enterica enterica serovar Typhi Ty2
gcgaauuucggca

SEQ ID NO: 1745440 - RNA, 17 nt, Salmonella enterica enterica serovar Typhi Ty2
gcgacaaccuguaggcc

SEQ ID NO: 1745441 - RNA, 17 nt, Salmonella enterica enterica serovar Typhi Ty2
gcgacaagcaguaugac

SEQ ID NO: 1745442 - RNA, 19 nt, Salmonella enterica enterica serovar Typhi Ty2
gcgacaagcaguaugaccc

SEQ ID NO: 1745443 - RNA, 14 nt, Salmonella enterica enterica serovar Typhi Ty2
gcgaaucucaaugc

SEQ ID NO: 1745444 - RNA, 20 nt, Salmonella enterica enterica serovar Typhi Ty2
gcgaaucgccaaucgccgcc

SEQ ID NO: 1745445 - RNA, 12 nt, Salmonella enterica enterica serovar Typhi Ty2
gcgaaugcgcgc

SEQ ID NO: 1745446 - RNA, 18 nt, Salmonella enterica enterica serovar Typhi Ty2
gcgaauggagaagcgcgc

SEQ ID NO: 1745447 - RNA, 19 nt, Salmonella enterica enterica serovar Typhi Ty2
gcgacgacgccagccagcc

SEQ ID NO: 1745448 - RNA, 19 nt, Salmonella enterica enterica serovar Typhi Ty2
gcgaccuucacgccgccaa

SEQ ID NO: 1745449 - RNA, 24 nt, Salmonella enterica enterica serovar Typhi Ty2
gcgaccuguagaugaaacucgcug

SEQ ID NO: 1745450 - RNA, 17 nt, Salmonella enterica enterica serovar Typhi Ty2
gcgaccuuaccggcgac

SEQ ID NO: 1745451 - RNA, 16 nt, Salmonella enterica enterica serovar Typhi Ty2
gcgaccuuaccggcga

SEQ ID NO: 1745452 - RNA, 18 nt, Salmonella enterica enterica serovar Typhi Ty2
gcgacgccgccauccggc

SEQ ID NO: 1745453 - RNA, 18 nt, Salmonella enterica enterica serovar Typhi Ty2
gcgaccaguuauucggca

SEQ ID NO: 1745454 - RNA, 23 nt, Salmonella enterica enterica serovar Typhi Ty2
gcgaccggugaugugcuggcgga

SEQ ID NO: 1745455 - RNA, 14 nt, Salmonella enterica enterica serovar Typhi Ty2
gccggugcgagaaa

SEQ ID NO: 1745456 - RNA, 16 nt, Salmonella enterica enterica serovar Typhi Ty2
gccgguuauaccgcca

SEQ ID NO: 1745457 - RNA, 17 nt, Salmonella enterica enterica serovar Typhi Ty2
gccgguuauaccgccau

SEQ ID NO: 1745458 - RNA, 14 nt, Salmonella enterica enterica serovar Typhi Ty2
gccguagcgcgcuu

SEQ ID NO: 1745459 - RNA, 17 nt, Salmonella enterica enterica serovar Typhi Ty2
gccguaaggcguaccgc

SEQ ID NO: 1745460 - RNA, 16 nt, Salmonella enterica enterica serovar Typhi Ty2
gccgguuucauaacac

SEQ ID NO: 1745461 - RNA, 16 nt, Salmonella enterica enterica serovar Typhi Ty2
gccgguuuauccccgc

SEQ ID NO: 1745462 - RNA, 23 nt, Salmonella enterica enterica serovar Typhi Ty2
gccggcgucgaucagcgcguaga

SEQ ID NO: 1745463 - RNA, 19 nt, Salmonella enterica enterica serovar Typhi Ty2
gccggcgucaucggcgcca

SEQ ID NO: 1745464 - RNA, 20 nt, Salmonella enterica enterica serovar Typhi Ty2
gccgggacuuuaaacgucau

SEQ ID NO: 1745465 - RNA, 15 nt, Salmonella enterica enterica serovar Typhi Ty2
gccgggccagacgcu

SEQ ID NO: 1745466 - RNA, 18 nt, Salmonella enterica enterica serovar Typhi Ty2
gccgggcuauccggcugu

SEQ ID NO: 1745467 - RNA, 15 nt, Salmonella enterica enterica serovar Typhi Ty2
gccgggcuauccggc

SEQ ID NO: 1745468 - RNA, 14 nt, Salmonella enterica enterica serovar Typhi Ty2
gccgggcuggcgga

SEQ ID NO: 1745469 - RNA, 15 nt, Salmonella enterica enterica serovar Typhi Ty2
gccgggcuggcggaa

SEQ ID NO: 1745470 - RNA, 12 nt, Salmonella enterica enterica serovar Typhi Ty2
gccuaucgccau

SEQ ID NO: 1745471 - RNA, 23 nt, Salmonella enterica enterica serovar Typhi Ty2
gccuauagacaccuuauauuccg

SEQ ID NO: 1745472 - RNA, 18 nt, Salmonella enterica enterica serovar Typhi Ty2
gccuauauuucugucgcc

SEQ ID NO: 1745473 - RNA, 22 nt, Salmonella enterica enterica serovar Typhi Ty2
gccucaaacgccgauggcgcca

SEQ ID NO: 1745474 - RNA, 23 nt, Salmonella enterica enterica serovar Typhi Ty2
gccuccggguuucacugcgugau

SEQ ID NO: 1745475 - RNA, 15 nt, Salmonella enterica enterica serovar Typhi Ty2
aagccaauggugcuc

SEQ ID NO: 1745476 - RNA, 21 nt, Salmonella enterica enterica serovar Typhi Ty2
gccucccgaugguggcgucgg

SEQ ID NO: 1745477 - RNA, 14 nt, Salmonella enterica enterica serovar Typhi Ty2
gccugcacauugca

SEQ ID NO: 1745478 - RNA, 16 nt, Salmonella enterica enterica serovar Typhi Ty2
gccugaucgcgcagac

SEQ ID NO: 1745479 - RNA, 20 nt, Salmonella enterica enterica serovar Typhi Ty2
gccugauaagcgcagcgcca

SEQ ID NO: 1745480 - RNA, 18 nt, Salmonella enterica enterica serovar Typhi Ty2
gccugagcgcgcagcugg

SEQ ID NO: 1745481 - RNA, 21 nt, Salmonella enterica enterica serovar Typhi Ty2
gccugaagccagcaaucagcc

SEQ ID NO: 1745482 - RNA, 16 nt, Salmonella enterica enterica serovar Typhi Ty2
gccugaagauacgcca

SEQ ID NO: 1745483 - RNA, 18 nt, Salmonella enterica enterica serovar Typhi Ty2
gccugaauaaucggcguc

SEQ ID NO: 1745484 - RNA, 18 nt, Salmonella enterica enterica serovar Typhi Ty2
gccgugcacuucugcggu

SEQ ID NO: 1745485 - RNA, 19 nt, Salmonella enterica enterica serovar Typhi Ty2
gccgugaggcugaagcgcg

SEQ ID NO: 1745486 - RNA, 18 nt, Salmonella enterica enterica serovar Typhi Ty2
gccguuauugucaugcua

SEQ ID NO: 1745487 - RNA, 20 nt, Salmonella enterica enterica serovar Typhi Ty2
gccguuaaucuggccuacgg

SEQ ID NO: 1745488 - RNA, 16 nt, Salmonella enterica enterica serovar Typhi Ty2
gccguuccguucgcgu

SEQ ID NO: 1745489 - RNA, 15 nt, Salmonella enterica enterica serovar Typhi Ty2
gccguugucauggcg

SEQ ID NO: 1745490 - RNA, 17 nt, Salmonella enterica enterica serovar Typhi Ty2
gccuaccugccgccaua

SEQ ID NO: 1745491 - RNA, 18 nt, Salmonella enterica enterica serovar Typhi Ty2
gccuacugcccuacgcuu

SEQ ID NO: 1745492 - RNA, 18 nt, Salmonella enterica enterica serovar Typhi Ty2
gccguuuuuaacgccggc

SEQ ID NO: 1745493 - RNA, 18 nt, Salmonella enterica enterica serovar Typhi Ty2
gccguugucauggcgcca

SEQ ID NO: 1745494 - RNA, 23 nt, Salmonella enterica enterica serovar Typhi Ty2
gccguuguucucaagcguucuca

SEQ ID NO: 1745495 - RNA, 16 nt, Salmonella enterica enterica serovar Typhi Ty2
gccguuuucaugcacg

SEQ ID NO: 1745496 - RNA, 23 nt, Salmonella enterica enterica serovar Typhi Ty2
gcgauaaaaacccaccagcgcca

SEQ ID NO: 1745497 - RNA, 14 nt, Salmonella enterica enterica serovar Typhi Ty2
gcgauacugccgcc

SEQ ID NO: 1745498 - RNA, 17 nt, Salmonella enterica enterica serovar Typhi Ty2
gcgauagaccacgccau

SEQ ID NO: 1745499 - RNA, 20 nt, Salmonella enterica enterica serovar Typhi Ty2
gcgauaucaacgucuugccg

SEQ ID NO: 1745500 - RNA, 22 nt, Salmonella enterica enterica serovar Typhi Ty2
gcgauaguguggucgucagccg

SEQ ID NO: 1745501 - RNA, 18 nt, Salmonella enterica enterica serovar Typhi Ty2
gcgauauagcgcugaagu

SEQ ID NO: 1745502 - RNA, 16 nt, Salmonella enterica enterica serovar Typhi Ty2
gcgauagcccggcaug

SEQ ID NO: 1745503 - RNA, 21 nt, Salmonella enterica enterica serovar Typhi Ty2
gcgcaaugucccugacagcgc

SEQ ID NO: 1745504 - RNA, 22 nt, Salmonella enterica enterica serovar Typhi Ty2
gcgcagaaucacuucauccgga

SEQ ID NO: 1745505 - RNA, 18 nt, Salmonella enterica enterica serovar Typhi Ty2
gcgcagcgccaucaggca

SEQ ID NO: 1745506 - RNA, 19 nt, Salmonella enterica enterica serovar Typhi Ty2
gcgcagcgacuucaggcgu

SEQ ID NO: 1745507 - RNA, 11 nt, Salmonella enterica enterica serovar Typhi Ty2
gcgcagcgacu

SEQ ID NO: 1745508 - RNA, 20 nt, Salmonella enterica enterica serovar Typhi Ty2
gcgcagcgccaucaggcaug

SEQ ID NO: 1745509 - RNA, 19 nt, Salmonella enterica enterica serovar Typhi Ty2
gcgcagcgccaucaggcau

SEQ ID NO: 1745510 - RNA, 21 nt, Salmonella enterica enterica serovar Typhi Ty2
gcgcaguugccaguacagcag

SEQ ID NO: 1745511 - RNA, 14 nt, Salmonella enterica enterica serovar Typhi Ty2
gcgcauucaggcga

SEQ ID NO: 1745512 - RNA, 15 nt, Salmonella enterica enterica serovar Typhi Ty2
gcgcauguuagcaaa

SEQ ID NO: 1745513 - RNA, 19 nt, Salmonella enterica enterica serovar Typhi Ty2
gcgcaugugagcaucggcg

SEQ ID NO: 1745514 - RNA, 23 nt, Salmonella enterica enterica serovar Typhi Ty2
gcgcauuucuguugcaaauauuc

SEQ ID NO: 1745515 - RNA, 21 nt, Salmonella enterica enterica serovar Typhi Ty2
gcgccaccgggcaacacacgc

SEQ ID NO: 1745516 - RNA, 20 nt, Salmonella enterica enterica serovar Typhi Ty2
gcgcagcugggccugcuccg

SEQ ID NO: 1745517 - RNA, 20 nt, Salmonella enterica enterica serovar Typhi Ty2
gcgccgcaggccggauaaga

SEQ ID NO: 1745518 - RNA, 14 nt, Salmonella enterica enterica serovar Typhi Ty2
gcgccgccauccgg

SEQ ID NO: 1745519 - RNA, 15 nt, Salmonella enterica enterica serovar Typhi Ty2
gcgccgccauccggc

SEQ ID NO: 1745520 - RNA, 15 nt, Salmonella enterica enterica serovar Typhi Ty2
gcgccgcagcgccga

SEQ ID NO: 1745521 - RNA, 18 nt, Salmonella enterica enterica serovar Typhi Ty2
gcgccgcgacaacgccau

SEQ ID NO: 1745522 - RNA, 17 nt, Salmonella enterica enterica serovar Typhi Ty2
gcgccggaugacggcag

SEQ ID NO: 1745523 - RNA, 18 nt, Salmonella enterica enterica serovar Typhi Ty2
gcgccggauaauccagac

SEQ ID NO: 1745524 - RNA, 14 nt, Salmonella enterica enterica serovar Typhi Ty2
gcgccgucauccgc

SEQ ID NO: 1745525 - RNA, 21 nt, Salmonella enterica enterica serovar Typhi Ty2
gcgccgucaucgcucaucuca

SEQ ID NO: 1745526 - RNA, 14 nt, Salmonella enterica enterica serovar Typhi Ty2
gcgcccgccgccaa

SEQ ID NO: 1745527 - RNA, 14 nt, Salmonella enterica enterica serovar Typhi Ty2
gcgcccuuccguca

SEQ ID NO: 1745528 - RNA, 21 nt, Salmonella enterica enterica serovar Typhi Ty2
gcgcccuuuuuuggucagaaa

SEQ ID NO: 1745529 - RNA, 16 nt, Salmonella enterica enterica serovar Typhi Ty2
gcgccgaucaucccgc

SEQ ID NO: 1745530 - RNA, 16 nt, Salmonella enterica enterica serovar Typhi Ty2
gcgccgcacuucacgc

SEQ ID NO: 1745531 - RNA, 14 nt, Salmonella enterica enterica serovar Typhi Ty2
gcgccagaucaggc

SEQ ID NO: 1745532 - RNA, 21 nt, Salmonella enterica enterica serovar Typhi Ty2
gcgccagacccacuaacugcc

SEQ ID NO: 1745533 - RNA, 13 nt, Salmonella enterica enterica serovar Typhi Ty2
gcgccaucaggcu

SEQ ID NO: 1745534 - RNA, 20 nt, Salmonella enterica enterica serovar Typhi Ty2
gcgccaucauccggcaacua

SEQ ID NO: 1745535 - RNA, 12 nt, Salmonella enterica enterica serovar Typhi Ty2
gcgccauccggc

SEQ ID NO: 1745536 - RNA, 14 nt, Salmonella enterica enterica serovar Typhi Ty2
gcgccaucaggcau

SEQ ID NO: 1745537 - RNA, 12 nt, Salmonella enterica enterica serovar Typhi Ty2
gcgccaucaggc

SEQ ID NO: 1745538 - RNA, 16 nt, Salmonella enterica enterica serovar Typhi Ty2
gcgccauccggcacau

SEQ ID NO: 1745539 - RNA, 20 nt, Salmonella enterica enterica serovar Typhi Ty2
gcgccauccggcacgccauc

SEQ ID NO: 1745540 - RNA, 13 nt, Salmonella enterica enterica serovar Typhi Ty2
gcgccauccggca

SEQ ID NO: 1745541 - RNA, 20 nt, Salmonella enterica enterica serovar Typhi Ty2
gcgccaucggcgcugauugc

SEQ ID NO: 1745542 - RNA, 12 nt, Salmonella enterica enterica serovar Typhi Ty2
gcgcccaggcca

SEQ ID NO: 1745543 - RNA, 20 nt, Salmonella enterica enterica serovar Typhi Ty2
gcgcgaucgccccgaccagg

SEQ ID NO: 1745544 - RNA, 23 nt, Salmonella enterica enterica serovar Typhi Ty2
gcgcgccaaaguuaaucagcgcc

SEQ ID NO: 1745545 - RNA, 15 nt, Salmonella enterica enterica serovar Typhi Ty2
gcgcgacgccgcaua

SEQ ID NO: 1745546 - RNA, 18 nt, Salmonella enterica enterica serovar Typhi Ty2
gcgcgacgcgucagugaa

SEQ ID NO: 1745547 - RNA, 22 nt, Salmonella enterica enterica serovar Typhi Ty2
gcgcgacaauauucacgcgaau

SEQ ID NO: 1745548 - RNA, 22 nt, Salmonella enterica enterica serovar Typhi Ty2
gcgcgaaucgccucuucgaccg

SEQ ID NO: 1745549 - RNA, 21 nt, Salmonella enterica enterica serovar Typhi Ty2
gcgcgaauaaugcguccgcca

SEQ ID NO: 1745550 - RNA, 21 nt, Salmonella enterica enterica serovar Typhi Ty2
gcgcgcccaguccuuccggcg

SEQ ID NO: 1745551 - RNA, 20 nt, Salmonella enterica enterica serovar Typhi Ty2
gcgcgccagcgauuccguca

SEQ ID NO: 1745552 - RNA, 22 nt, Salmonella enterica enterica serovar Typhi Ty2
gcgcgccagcgauuccgucagg

SEQ ID NO: 1745553 - RNA, 12 nt, Salmonella enterica enterica serovar Typhi Ty2
gcgcgcuggcgu

SEQ ID NO: 1745554 - RNA, 16 nt, Salmonella enterica enterica serovar Typhi Ty2
gcgcgcuggugucgcc

SEQ ID NO: 1745555 - RNA, 16 nt, Salmonella enterica enterica serovar Typhi Ty2
gcgcggcaucauuuac

SEQ ID NO: 1745556 - RNA, 18 nt, Salmonella enterica enterica serovar Typhi Ty2
gcgcgcgaugguaggccu

SEQ ID NO: 1745557 - RNA, 21 nt, Salmonella enterica enterica serovar Typhi Ty2
gcgcgcgauacccaccucguu

SEQ ID NO: 1745558 - RNA, 16 nt, Salmonella enterica enterica serovar Typhi Ty2
gcgcgcguacugcccg

SEQ ID NO: 1745559 - RNA, 12 nt, Salmonella enterica enterica serovar Typhi Ty2
gcgcgcgcuaau

SEQ ID NO: 1745560 - RNA, 20 nt, Salmonella enterica enterica serovar Typhi Ty2
gcgcuacgcuuaucaggccu

SEQ ID NO: 1745561 - RNA, 22 nt, Salmonella enterica enterica serovar Typhi Ty2
gcgcuagcuuaucgggccuacc

SEQ ID NO: 1745562 - RNA, 13 nt, Salmonella enterica enterica serovar Typhi Ty2
gcgcuacauccgc

SEQ ID NO: 1745563 - RNA, 15 nt, Salmonella enterica enterica serovar Typhi Ty2
gcgcuaacggcggua

SEQ ID NO: 1745564 - RNA, 12 nt, Salmonella enterica enterica serovar Typhi Ty2
gcgcuaccagcg

SEQ ID NO: 1745565 - RNA, 19 nt, Salmonella enterica enterica serovar Typhi Ty2
gcgcuaauguacgccuaaa

SEQ ID NO: 1745566 - RNA, 15 nt, Salmonella enterica enterica serovar Typhi Ty2
gcgcuaacgcgaaga

SEQ ID NO: 1745567 - RNA, 17 nt, Salmonella enterica enterica serovar Typhi Ty2
gcgcuaaacagcgccgc

SEQ ID NO: 1745568 - RNA, 19 nt, Salmonella enterica enterica serovar Typhi Ty2
gcgcucaccuccgccacua

SEQ ID NO: 1745569 - RNA, 13 nt, Salmonella enterica enterica serovar Typhi Ty2
gcgcuauccggca

SEQ ID NO: 1745570 - RNA, 15 nt, Salmonella enterica enterica serovar Typhi Ty2
gcgcuaucaggcacu

SEQ ID NO: 1745571 - RNA, 23 nt, Salmonella enterica enterica serovar Typhi Ty2
gcgcuaucaggaagaacacgccg

SEQ ID NO: 1745572 - RNA, 22 nt, Salmonella enterica enterica serovar Typhi Ty2
gcgcuaucaaaaugcaccggcg

SEQ ID NO: 1745573 - RNA, 13 nt, Salmonella enterica enterica serovar Typhi Ty2
gcgcuauccggcc

SEQ ID NO: 1745574 - RNA, 14 nt, Salmonella enterica enterica serovar Typhi Ty2
gcgcuccgacugaa

SEQ ID NO: 1745575 - RNA, 20 nt, Salmonella enterica enterica serovar Typhi Ty2
gcgcucauacgaucgcgcac

SEQ ID NO: 1745576 - RNA, 22 nt, Salmonella enterica enterica serovar Typhi Ty2
gcgcucagggucagaauacaga

SEQ ID NO: 1745577 - RNA, 14 nt, Salmonella enterica enterica serovar Typhi Ty2
gcgcucagcgccgu

SEQ ID NO: 1745578 - RNA, 15 nt, Salmonella enterica enterica serovar Typhi Ty2
gcgcucaucaggccu

SEQ ID NO: 1745579 - RNA, 12 nt, Salmonella enterica enterica serovar Typhi Ty2
gcgcucaucagg

SEQ ID NO: 1745580 - RNA, 22 nt, Salmonella enterica enterica serovar Typhi Ty2
gcgcuccagaccaccagcgaca

SEQ ID NO: 1745581 - RNA, 12 nt, Salmonella enterica enterica serovar Typhi Ty2
gcgcucaugcca

SEQ ID NO: 1745582 - RNA, 15 nt, Salmonella enterica enterica serovar Typhi Ty2
gcgcguucgccguca

SEQ ID NO: 1745583 - RNA, 14 nt, Salmonella enterica enterica serovar Typhi Ty2
gcgcguuaugccga

SEQ ID NO: 1745584 - RNA, 17 nt, Salmonella enterica enterica serovar Typhi Ty2
gcgcggcgaaauaggcc

SEQ ID NO: 1745585 - RNA, 18 nt, Salmonella enterica enterica serovar Typhi Ty2
gcgcggcgaaauaggccg

SEQ ID NO: 1745586 - RNA, 18 nt, Salmonella enterica enterica serovar Typhi Ty2
gcgcggcggguugaugau

SEQ ID NO: 1745587 - RNA, 13 nt, Salmonella enterica enterica serovar Typhi Ty2
gcgcguauccgcc

SEQ ID NO: 1745588 - RNA, 15 nt, Salmonella enterica enterica serovar Typhi Ty2
gcgcgguuuccggua

SEQ ID NO: 1745589 - RNA, 16 nt, Salmonella enterica enterica serovar Typhi Ty2
gcgcgguuaugcggga

SEQ ID NO: 1745590 - RNA, 13 nt, Salmonella enterica enterica serovar Typhi Ty2
gcgcggucaacgu

SEQ ID NO: 1745591 - RNA, 17 nt, Salmonella enterica enterica serovar Typhi Ty2
gcgcgguccacaggccg

SEQ ID NO: 1745592 - RNA, 17 nt, Salmonella enterica enterica serovar Typhi Ty2
gaaaugucuggcgcuaa

SEQ ID NO: 1745593 - RNA, 13 nt, Salmonella enterica enterica serovar Typhi Ty2
gaaauuaaucagg

SEQ ID NO: 1745594 - RNA, 16 nt, Salmonella enterica enterica serovar Typhi Ty2
gaaauuccuuccggcg

SEQ ID NO: 1745595 - RNA, 19 nt, Salmonella enterica enterica serovar Typhi Ty2
gaacaaacagaccgccaug

SEQ ID NO: 1745596 - RNA, 13 nt, Salmonella enterica enterica serovar Typhi Ty2
gaaauuuauucau

SEQ ID NO: 1745597 - RNA, 15 nt, Salmonella enterica enterica serovar Typhi Ty2
gaacacagcaugaau

SEQ ID NO: 1745598 - RNA, 15 nt, Salmonella enterica enterica serovar Typhi Ty2
gaaauauuucacguu

SEQ ID NO: 1745599 - RNA, 19 nt, Salmonella enterica enterica serovar Typhi Ty2
gaaaugcagggauccugua

SEQ ID NO: 1745600 - RNA, 21 nt, Salmonella enterica enterica serovar Typhi Ty2
gaaauaccuaacucuuccgca

SEQ ID NO: 1745601 - RNA, 17 nt, Salmonella enterica enterica serovar Typhi Ty2
gaaacguagcguucauu

SEQ ID NO: 1745602 - RNA, 21 nt, Salmonella enterica enterica serovar Typhi Ty2
gaaacgguuaaaaacagccag

SEQ ID NO: 1745603 - RNA, 20 nt, Salmonella enterica enterica serovar Typhi Ty2
gaaacgguuaaaaacagcca

SEQ ID NO: 1745604 - RNA, 15 nt, Salmonella enterica enterica serovar Typhi Ty2
gaaaauuccuggauu

SEQ ID NO: 1745605 - RNA, 22 nt, Salmonella enterica enterica serovar Typhi Ty2
gaaaccagauaucccgccaaac

SEQ ID NO: 1745606 - RNA, 19 nt, Salmonella enterica enterica serovar Typhi Ty2
gaaaaugcccgacgcgccg

SEQ ID NO: 1745607 - RNA, 15 nt, Salmonella enterica enterica serovar Typhi Ty2
gaaaauauacaccug

SEQ ID NO: 1745608 - RNA, 18 nt, Salmonella enterica enterica serovar Typhi Ty2
aaccuguaggccggauaa

SEQ ID NO: 1745609 - RNA, 16 nt, Salmonella enterica enterica serovar Typhi Ty2
gaaaagcgcuggcugg

SEQ ID NO: 1745610 - RNA, 19 nt, Salmonella enterica enterica serovar Typhi Ty2
gaaaagcuggagguggaag

SEQ ID NO: 1745611 - RNA, 12 nt, Salmonella enterica enterica serovar Typhi Ty2
aaccugcgauac

SEQ ID NO: 1745612 - RNA, 18 nt, Salmonella enterica enterica serovar Typhi Ty2
aaccucacguacuacgug

SEQ ID NO: 1745613 - RNA, 13 nt, Salmonella enterica enterica serovar Typhi Ty2
gaaccgacggugc

SEQ ID NO: 1745614 - RNA, 13 nt, Salmonella enterica enterica serovar Typhi Ty2
gaaccagcggcac

SEQ ID NO: 1745615 - RNA, 14 nt, Salmonella enterica enterica serovar Typhi Ty2
gaaccacgcaaagg

SEQ ID NO: 1745616 - RNA, 18 nt, Salmonella enterica enterica serovar Typhi Ty2
gaaccauggcaacaugga

SEQ ID NO: 1745617 - RNA, 21 nt, Salmonella enterica enterica serovar Typhi Ty2
gaaccauuuccucugcggacg

SEQ ID NO: 1745618 - RNA, 11 nt, Salmonella enterica enterica serovar Typhi Ty2
gaacucaucuu

SEQ ID NO: 1745619 - RNA, 12 nt, Salmonella enterica enterica serovar Typhi Ty2
gaacgucaucau

SEQ ID NO: 1745620 - RNA, 21 nt, Salmonella enterica enterica serovar Typhi Ty2
gaacggggaccaugauaucgc

SEQ ID NO: 1745621 - RNA, 18 nt, Salmonella enterica enterica serovar Typhi Ty2
gaacgcugguuucggcau

SEQ ID NO: 1745622 - RNA, 17 nt, Salmonella enterica enterica serovar Typhi Ty2
cuuuuugcgacacgcug

SEQ ID NO: 1745623 - RNA, 15 nt, Salmonella enterica enterica serovar Typhi Ty2
gaaaaaagcagcauc

SEQ ID NO: 1745624 - RNA, 20 nt, Salmonella enterica enterica serovar Typhi Ty2
gaaaacaucgcuccggcauc

SEQ ID NO: 1745625 - RNA, 22 nt, Salmonella enterica enterica serovar Typhi Ty2
gaaaaauaagagggcgccaugc

SEQ ID NO: 1745626 - RNA, 18 nt, Salmonella enterica enterica serovar Typhi Ty2
gaaaaccguacucgcugg

SEQ ID NO: 1745627 - RNA, 16 nt, Salmonella enterica enterica serovar Typhi Ty2
gaaaaaugaauaccaa

SEQ ID NO: 1745628 - RNA, 19 nt, Salmonella enterica enterica serovar Typhi Ty2
cuuuuccucgucauaucug

SEQ ID NO: 1745629 - RNA, 18 nt, Salmonella enterica enterica serovar Typhi Ty2
cuuuuccuuccagcgcau

SEQ ID NO: 1745630 - RNA, 20 nt, Salmonella enterica enterica serovar Typhi Ty2
cuuuucccguaaugcccagg

SEQ ID NO: 1745631 - RNA, 17 nt, Salmonella enterica enterica serovar Typhi Ty2
cuuuuccggcagcgcau

SEQ ID NO: 1745632 - RNA, 21 nt, Salmonella enterica enterica serovar Typhi Ty2
cuuuuacgaucgccaccgcau

SEQ ID NO: 1745633 - RNA, 21 nt, Salmonella enterica enterica serovar Typhi Ty2
cuuuuaggcugaaagcgccuu

SEQ ID NO: 1745634 - RNA, 16 nt, Salmonella enterica enterica serovar Typhi Ty2
cuuuugcuacgucgcc

SEQ ID NO: 1745635 - RNA, 14 nt, Salmonella enterica enterica serovar Typhi Ty2
cuuuugauacucug

SEQ ID NO: 1745636 - RNA, 18 nt, Salmonella enterica enterica serovar Typhi Ty2
cuuuuggcgacaggcgcu

SEQ ID NO: 1745637 - RNA, 16 nt, Salmonella enterica enterica serovar Typhi Ty2
cuuuuuaggcuauaaa

SEQ ID NO: 1745638 - RNA, 16 nt, Salmonella enterica enterica serovar Typhi Ty2
cuuugccgcugcugcc

SEQ ID NO: 1745639 - RNA, 23 nt, Salmonella enterica enterica serovar Typhi Ty2
cuuugauuacugagauggcgcca

SEQ ID NO: 1745640 - RNA, 18 nt, Salmonella enterica enterica serovar Typhi Ty2
cuuugaaaaucacaucgc

SEQ ID NO: 1745641 - RNA, 16 nt, Salmonella enterica enterica serovar Typhi Ty2
cuuugaacagccagaa

SEQ ID NO: 1745642 - RNA, 17 nt, Salmonella enterica enterica serovar Typhi Ty2
cuuugcgauuuguccgc

SEQ ID NO: 1745643 - RNA, 15 nt, Salmonella enterica enterica serovar Typhi Ty2
cuuugcgcugcgcau

SEQ ID NO: 1745644 - RNA, 16 nt, Salmonella enterica enterica serovar Typhi Ty2
cuuugcuuauccggcc

SEQ ID NO: 1745645 - RNA, 14 nt, Salmonella enterica enterica serovar Typhi Ty2
cuuugcugacgcca

SEQ ID NO: 1745646 - RNA, 22 nt, Salmonella enterica enterica serovar Typhi Ty2
cuuuggcgcccauuucguuaau

SEQ ID NO: 1745647 - RNA, 18 nt, Salmonella enterica enterica serovar Typhi Ty2
cuuugcuuauccggccua

SEQ ID NO: 1745648 - RNA, 17 nt, Salmonella enterica enterica serovar Typhi Ty2
cuuuggacggcaucagg

SEQ ID NO: 1745649 - RNA, 22 nt, Salmonella enterica enterica serovar Typhi Ty2
cuuugucaccggaguuaccauc

SEQ ID NO: 1745650 - RNA, 19 nt, Salmonella enterica enterica serovar Typhi Ty2
cuuugggccggauacguca

SEQ ID NO: 1745651 - RNA, 15 nt, Salmonella enterica enterica serovar Typhi Ty2
cuuuccagucaacga

SEQ ID NO: 1745652 - RNA, 17 nt, Salmonella enterica enterica serovar Typhi Ty2
cuuucauucgucaaauu

SEQ ID NO: 1745653 - RNA, 15 nt, Salmonella enterica enterica serovar Typhi Ty2
cuuuccguacgguuu

SEQ ID NO: 1745654 - RNA, 16 nt, Salmonella enterica enterica serovar Typhi Ty2
cuuuccgaaucaggcg

SEQ ID NO: 1745655 - RNA, 13 nt, Salmonella enterica enterica serovar Typhi Ty2
cuuucccgucguc

SEQ ID NO: 1745656 - RNA, 13 nt, Salmonella enterica enterica serovar Typhi Ty2
cuuuccugcaaau

SEQ ID NO: 1745657 - RNA, 18 nt, Salmonella enterica enterica serovar Typhi Ty2
cuuucgacagucgguaac

SEQ ID NO: 1745658 - RNA, 17 nt, Salmonella enterica enterica serovar Typhi Ty2
cuuuccuuuuucaggca

SEQ ID NO: 1745659 - RNA, 16 nt, Salmonella enterica enterica serovar Typhi Ty2
cuuucucuccuucacg

SEQ ID NO: 1745660 - RNA, 14 nt, Salmonella enterica enterica serovar Typhi Ty2
cuuucugguaaccg

SEQ ID NO: 1745661 - RNA, 14 nt, Salmonella enterica enterica serovar Typhi Ty2
cuuucgccgccaga

SEQ ID NO: 1745662 - RNA, 22 nt, Salmonella enterica enterica serovar Typhi Ty2
cuuucgauaaucugacgcggcg

SEQ ID NO: 1745663 - RNA, 17 nt, Salmonella enterica enterica serovar Typhi Ty2
cuuggcguuaaagacgc

SEQ ID NO: 1745664 - RNA, 17 nt, Salmonella enterica enterica serovar Typhi Ty2
cuucguuagcggcguug

SEQ ID NO: 1745665 - RNA, 14 nt, Salmonella enterica enterica serovar Typhi Ty2
cuucguuuuccgca

SEQ ID NO: 1745666 - RNA, 21 nt, Salmonella enterica enterica serovar Typhi Ty2
cuucgguuucguuaaucggca

SEQ ID NO: 1745667 - RNA, 21 nt, Salmonella enterica enterica serovar Typhi Ty2
cuuuaucacuccuuaggccgu

SEQ ID NO: 1745668 - RNA, 16 nt, Salmonella enterica enterica serovar Typhi Ty2
cuuucaccaucgcgau

SEQ ID NO: 1745669 - RNA, 21 nt, Salmonella enterica enterica serovar Typhi Ty2
aaccguccacauccagcgcca

SEQ ID NO: 1745670 - RNA, 18 nt, Salmonella enterica enterica serovar Typhi Ty2
aaccguaaacgccugcac

SEQ ID NO: 1745671 - RNA, 22 nt, Salmonella enterica enterica serovar Typhi Ty2
aaccgucgggcgucgccugcca

SEQ ID NO: 1745672 - RNA, 13 nt, Salmonella enterica enterica serovar Typhi Ty2
aaccgucucacca

SEQ ID NO: 1745673 - RNA, 20 nt, Salmonella enterica enterica serovar Typhi Ty2
cuuucagaccaaauucagcg

SEQ ID NO: 1745674 - RNA, 17 nt, Salmonella enterica enterica serovar Typhi Ty2
aaccguugcgcccauca

SEQ ID NO: 1745675 - RNA, 16 nt, Salmonella enterica enterica serovar Typhi Ty2
aaccguugcgcccauc

SEQ ID NO: 1745676 - RNA, 16 nt, Salmonella enterica enterica serovar Typhi Ty2
aaccguucuuccuggg

SEQ ID NO: 1745677 - RNA, 19 nt, Salmonella enterica enterica serovar Typhi Ty2
cuuuaaaugccuguuuaua

SEQ ID NO: 1745678 - RNA, 15 nt, Salmonella enterica enterica serovar Typhi Ty2
cuugugagcgucgcg

SEQ ID NO: 1745679 - RNA, 19 nt, Salmonella enterica enterica serovar Typhi Ty2
cuuuacccuuacggccacu

SEQ ID NO: 1745680 - RNA, 14 nt, Salmonella enterica enterica serovar Typhi Ty2
cuuuacaccccacu

SEQ ID NO: 1745681 - RNA, 22 nt, Salmonella enterica enterica serovar Typhi Ty2
cuuuaggguugacugccaggua

SEQ ID NO: 1745682 - RNA, 17 nt, Salmonella enterica enterica serovar Typhi Ty2
cuuuacuucuuugcgau

SEQ ID NO: 1745683 - RNA, 22 nt, Salmonella enterica enterica serovar Typhi Ty2
cuuuacuguugccuuugcgcgc

SEQ ID NO: 1745684 - RNA, 14 nt, Salmonella enterica enterica serovar Typhi Ty2
cuggcgcccgguuc

SEQ ID NO: 1745685 - RNA, 22 nt, Salmonella enterica enterica serovar Typhi Ty2
cuggcgccuuuuggcagcagcg

SEQ ID NO: 1745686 - RNA, 18 nt, Salmonella enterica enterica serovar Typhi Ty2
cuggcgagaauagaagcc

SEQ ID NO: 1745687 - RNA, 23 nt, Salmonella enterica enterica serovar Typhi Ty2
cuggcgacggcggucgccgcaug

SEQ ID NO: 1745688 - RNA, 21 nt, Salmonella enterica enterica serovar Typhi Ty2
cuggcgaaagcgaccggcacu

SEQ ID NO: 1745689 - RNA, 18 nt, Salmonella enterica enterica serovar Typhi Ty2
cuggccaauggcucaacu

SEQ ID NO: 1745690 - RNA, 18 nt, Salmonella enterica enterica serovar Typhi Ty2
cuggccacccaccacgau

SEQ ID NO: 1745691 - RNA, 20 nt, Salmonella enterica enterica serovar Typhi Ty2
cuggagguuauccugaaagg

SEQ ID NO: 1745692 - RNA, 14 nt, Salmonella enterica enterica serovar Typhi Ty2
cuggagcugaucga

SEQ ID NO: 1745693 - RNA, 18 nt, Salmonella enterica enterica serovar Typhi Ty2
cuggaucauacauaaccg

SEQ ID NO: 1745694 - RNA, 15 nt, Salmonella enterica enterica serovar Typhi Ty2
cugggaauaggccgc

SEQ ID NO: 1745695 - RNA, 17 nt, Salmonella enterica enterica serovar Typhi Ty2
cuggcuuuccugaucaa

SEQ ID NO: 1745696 - RNA, 19 nt, Salmonella enterica enterica serovar Typhi Ty2
cuggcugugccaauaacgc

SEQ ID NO: 1745697 - RNA, 20 nt, Salmonella enterica enterica serovar Typhi Ty2
cuggcugucgauaacagcau

SEQ ID NO: 1745698 - RNA, 13 nt, Salmonella enterica enterica serovar Typhi Ty2
cuggcugcgcuuc

SEQ ID NO: 1745699 - RNA, 17 nt, Salmonella enterica enterica serovar Typhi Ty2
cuggucaggugauugcc

SEQ ID NO: 1745700 - RNA, 18 nt, Salmonella enterica enterica serovar Typhi Ty2
cuggucagcgcgccaaug

SEQ ID NO: 1745701 - RNA, 13 nt, Salmonella enterica enterica serovar Typhi Ty2
cuggucacgguuu

SEQ ID NO: 1745702 - RNA, 14 nt, Salmonella enterica enterica serovar Typhi Ty2
cuggcucggccugu

SEQ ID NO: 1745703 - RNA, 17 nt, Salmonella enterica enterica serovar Typhi Ty2
cuggcucccgcagccac

SEQ ID NO: 1745704 - RNA, 15 nt, Salmonella enterica enterica serovar Typhi Ty2
cuggcuaucccgaug

SEQ ID NO: 1745705 - RNA, 13 nt, Salmonella enterica enterica serovar Typhi Ty2
cuggcguacgcca

SEQ ID NO: 1745706 - RNA, 17 nt, Salmonella enterica enterica serovar Typhi Ty2
cuggcgcuuuuccagca

SEQ ID NO: 1745707 - RNA, 22 nt, Salmonella enterica enterica serovar Typhi Ty2
cuggcggcgaaagagaaagcgc

SEQ ID NO: 1745708 - RNA, 13 nt, Salmonella enterica enterica serovar Typhi Ty2
cuuaucuugcgca

SEQ ID NO: 1745709 - RNA, 22 nt, Salmonella enterica enterica serovar Typhi Ty2
cuuaucguuaaggccugcgcga

SEQ ID NO: 1745710 - RNA, 22 nt, Salmonella enterica enterica serovar Typhi Ty2
aaccggcccagcuuaguaaccc

SEQ ID NO: 1745711 - RNA, 14 nt, Salmonella enterica enterica serovar Typhi Ty2
cuuauacagcgcau

SEQ ID NO: 1745712 - RNA, 13 nt, Salmonella enterica enterica serovar Typhi Ty2
aaccggccccauc

SEQ ID NO: 1745713 - RNA, 23 nt, Salmonella enterica enterica serovar Typhi Ty2
aaccggcguuccgcccaggcggg

SEQ ID NO: 1745714 - RNA, 19 nt, Salmonella enterica enterica serovar Typhi Ty2
cuguggaaacuccagcggc

SEQ ID NO: 1745715 - RNA, 18 nt, Salmonella enterica enterica serovar Typhi Ty2
cugugcuaugauaagccu

SEQ ID NO: 1745716 - RNA, 18 nt, Salmonella enterica enterica serovar Typhi Ty2
cugugcgugacccacagu

SEQ ID NO: 1745717 - RNA, 15 nt, Salmonella enterica enterica serovar Typhi Ty2
cuguucaaaagccug

SEQ ID NO: 1745718 - RNA, 20 nt, Salmonella enterica enterica serovar Typhi Ty2
cuguucaaacaucagcgcau

SEQ ID NO: 1745719 - RNA, 16 nt, Salmonella enterica enterica serovar Typhi Ty2
cuguuuccaguuaccg

SEQ ID NO: 1745720 - RNA, 23 nt, Salmonella enterica enterica serovar Typhi Ty2
cuguuucaguaaaucccgcauca

SEQ ID NO: 1745721 - RNA, 22 nt, Salmonella enterica enterica serovar Typhi Ty2
cuguuucugcgccgcuugugcc

SEQ ID NO: 1745722 - RNA, 13 nt, Salmonella enterica enterica serovar Typhi Ty2
cugucaucaucaa

SEQ ID NO: 1745723 - RNA, 17 nt, Salmonella enterica enterica serovar Typhi Ty2
cugucgccgcguaaauc

SEQ ID NO: 1745724 - RNA, 16 nt, Salmonella enterica enterica serovar Typhi Ty2
cugucaucaaugagcg

SEQ ID NO: 1745725 - RNA, 15 nt, Salmonella enterica enterica serovar Typhi Ty2
cugucgcucgcggca

SEQ ID NO: 1745726 - RNA, 14 nt, Salmonella enterica enterica serovar Typhi Ty2
cugucggcgaggua

SEQ ID NO: 1745727 - RNA, 13 nt, Salmonella enterica enterica serovar Typhi Ty2
cuguagccgugcc

SEQ ID NO: 1745728 - RNA, 13 nt, Salmonella enterica enterica serovar Typhi Ty2
cuguagaugaaac

SEQ ID NO: 1745729 - RNA, 14 nt, Salmonella enterica enterica serovar Typhi Ty2
cuguagauugcgcg

SEQ ID NO: 1745730 - RNA, 15 nt, Salmonella enterica enterica serovar Typhi Ty2
cuguauaaauaaccg

SEQ ID NO: 1745731 - RNA, 11 nt, Salmonella enterica enterica serovar Typhi Ty2
cuguauccacc

SEQ ID NO: 1745732 - RNA, 16 nt, Salmonella enterica enterica serovar Typhi Ty2
cuguaccuuaaccggg

SEQ ID NO: 1745733 - RNA, 13 nt, Salmonella enterica enterica serovar Typhi Ty2
cuucaggagaccu

SEQ ID NO: 1745734 - RNA, 15 nt, Salmonella enterica enterica serovar Typhi Ty2
cuucagcguugcuau

SEQ ID NO: 1745735 - RNA, 15 nt, Salmonella enterica enterica serovar Typhi Ty2
cuucagccagacgcu

SEQ ID NO: 1745736 - RNA, 21 nt, Salmonella enterica enterica serovar Typhi Ty2
cuucaaucgucguuccgccag

SEQ ID NO: 1745737 - RNA, 12 nt, Salmonella enterica enterica serovar Typhi Ty2
cuuauuacgcaa

SEQ ID NO: 1745738 - RNA, 13 nt, Salmonella enterica enterica serovar Typhi Ty2
cuuauuacgcuuc

SEQ ID NO: 1745739 - RNA, 22 nt, Salmonella enterica enterica serovar Typhi Ty2
cuuaugaaaccccaaaucagca

SEQ ID NO: 1745740 - RNA, 18 nt, Salmonella enterica enterica serovar Typhi Ty2
cuucaacccagcagcaga

SEQ ID NO: 1745741 - RNA, 19 nt, Salmonella enterica enterica serovar Typhi Ty2
cuucaaccuuuaucuguug

SEQ ID NO: 1745742 - RNA, 21 nt, Salmonella enterica enterica serovar Typhi Ty2
cuucaacgucuuauuacgcuu

SEQ ID NO: 1745743 - RNA, 15 nt, Salmonella enterica enterica serovar Typhi Ty2
cuucauccggcguug

SEQ ID NO: 1745744 - RNA, 16 nt, Salmonella enterica enterica serovar Typhi Ty2
cuucaucguuacgcag

SEQ ID NO: 1745745 - RNA, 23 nt, Salmonella enterica enterica serovar Typhi Ty2
cuucauaaauagccagcaucaug

SEQ ID NO: 1745746 - RNA, 22 nt, Salmonella enterica enterica serovar Typhi Ty2
cuucaggcuguugcgcauucag

SEQ ID NO: 1745747 - RNA, 23 nt, Salmonella enterica enterica serovar Typhi Ty2
cuucaggcuguugcgcauucagg

SEQ ID NO: 1745748 - RNA, 17 nt, Salmonella enterica enterica serovar Typhi Ty2
cuucaguucagccgcca

SEQ ID NO: 1745749 - RNA, 21 nt, Salmonella enterica enterica serovar Typhi Ty2
cuuccagaacgcguacggcuu

SEQ ID NO: 1745750 - RNA, 17 nt, Salmonella enterica enterica serovar Typhi Ty2
cuucgccaaucgccgcc

SEQ ID NO: 1745751 - RNA, 23 nt, Salmonella enterica enterica serovar Typhi Ty2
cuucgcucucgugccaguaacgu

SEQ ID NO: 1745752 - RNA, 20 nt, Salmonella enterica enterica serovar Typhi Ty2
cuucgaauucuucgccgaag

SEQ ID NO: 1745753 - RNA, 16 nt, Salmonella enterica enterica serovar Typhi Ty2
cuuccgccauacccgg

SEQ ID NO: 1745754 - RNA, 18 nt, Salmonella enterica enterica serovar Typhi Ty2
cuuccggccacuccgcca

SEQ ID NO: 1745755 - RNA, 15 nt, Salmonella enterica enterica serovar Typhi Ty2
cuuccuucuaccggc

SEQ ID NO: 1745756 - RNA, 22 nt, Salmonella enterica enterica serovar Typhi Ty2
cuuccgcaucgacguucagcau

SEQ ID NO: 1745757 - RNA, 21 nt, Salmonella enterica enterica serovar Typhi Ty2
cuuccaguaguaaaccgguug

SEQ ID NO: 1745758 - RNA, 15 nt, Salmonella enterica enterica serovar Typhi Ty2
cuuccaguagccuau

SEQ ID NO: 1745759 - RNA, 18 nt, Salmonella enterica enterica serovar Typhi Ty2
gacgcuaacgcuuauccg

SEQ ID NO: 1745760 - RNA, 17 nt, Salmonella enterica enterica serovar Typhi Ty2
gacgcguuuuccagcac

SEQ ID NO: 1745761 - RNA, 21 nt, Salmonella enterica enterica serovar Typhi Ty2
gacgcuacgcgucgccauccg

SEQ ID NO: 1745762 - RNA, 24 nt, Salmonella enterica enterica serovar Typhi Ty2
gacgcuacgcgucgccauccggcg

SEQ ID NO: 1745763 - RNA, 15 nt, Salmonella enterica enterica serovar Typhi Ty2
gacgcggcuuauccg

SEQ ID NO: 1745764 - RNA, 16 nt, Salmonella enterica enterica serovar Typhi Ty2
gacgcgguuaucucua

SEQ ID NO: 1745765 - RNA, 14 nt, Salmonella enterica enterica serovar Typhi Ty2
gacgcgccagccag

SEQ ID NO: 1745766 - RNA, 21 nt, Salmonella enterica enterica serovar Typhi Ty2
gacgcggaacuggugaaacag

SEQ ID NO: 1745767 - RNA, 12 nt, Salmonella enterica enterica serovar Typhi Ty2
gacggcaucagg

SEQ ID NO: 1745768 - RNA, 17 nt, Salmonella enterica enterica serovar Typhi Ty2
gacgcuuacaucgccau

SEQ ID NO: 1745769 - RNA, 17 nt, Salmonella enterica enterica serovar Typhi Ty2
gacgcugauagccacgg

SEQ ID NO: 1745770 - RNA, 20 nt, Salmonella enterica enterica serovar Typhi Ty2
gacgcuccaucacgguaaac

SEQ ID NO: 1745771 - RNA, 20 nt, Salmonella enterica enterica serovar Typhi Ty2
gacgcugcgcuuauccggcc

SEQ ID NO: 1745772 - RNA, 15 nt, Salmonella enterica enterica serovar Typhi Ty2
gacgcugcgcggcga

SEQ ID NO: 1745773 - RNA, 15 nt, Salmonella enterica enterica serovar Typhi Ty2
aacguccagcggcca

SEQ ID NO: 1745774 - RNA, 17 nt, Salmonella enterica enterica serovar Typhi Ty2
gacgguccuggccaggc

SEQ ID NO: 1745775 - RNA, 14 nt, Salmonella enterica enterica serovar Typhi Ty2
gacgcgaagcggcg

SEQ ID NO: 1745776 - RNA, 17 nt, Salmonella enterica enterica serovar Typhi Ty2
gacgccggucaugccau

SEQ ID NO: 1745777 - RNA, 13 nt, Salmonella enterica enterica serovar Typhi Ty2
gacgccagccgga

SEQ ID NO: 1745778 - RNA, 19 nt, Salmonella enterica enterica serovar Typhi Ty2
gacgcaccagccaggcgau

SEQ ID NO: 1745779 - RNA, 23 nt, Salmonella enterica enterica serovar Typhi Ty2
gacgauuugcgcucgcgccagau

SEQ ID NO: 1745780 - RNA, 12 nt, Salmonella enterica enterica serovar Typhi Ty2
gacgccaggcgc

SEQ ID NO: 1745781 - RNA, 12 nt, Salmonella enterica enterica serovar Typhi Ty2
gacgccaggcag

SEQ ID NO: 1745782 - RNA, 22 nt, Salmonella enterica enterica serovar Typhi Ty2
gacgcauugagacaugccgcca

SEQ ID NO: 1745783 - RNA, 15 nt, Salmonella enterica enterica serovar Typhi Ty2
gacgcauccgccaua

SEQ ID NO: 1745784 - RNA, 16 nt, Salmonella enterica enterica serovar Typhi Ty2
gacgcagcuucgccgc

SEQ ID NO: 1745785 - RNA, 22 nt, Salmonella enterica enterica serovar Typhi Ty2
gaccuuauucccauuccugcaa

SEQ ID NO: 1745786 - RNA, 18 nt, Salmonella enterica enterica serovar Typhi Ty2
gaccuucaacccagcagc

SEQ ID NO: 1745787 - RNA, 15 nt, Salmonella enterica enterica serovar Typhi Ty2
gaccuucauggcguu

SEQ ID NO: 1745788 - RNA, 21 nt, Salmonella enterica enterica serovar Typhi Ty2
aacgucaccucaucaacgcca

SEQ ID NO: 1745789 - RNA, 14 nt, Salmonella enterica enterica serovar Typhi Ty2
aacguagcgucauc

SEQ ID NO: 1745790 - RNA, 22 nt, Salmonella enterica enterica serovar Typhi Ty2
aacguaaauacccaggccauca

SEQ ID NO: 1745791 - RNA, 19 nt, Salmonella enterica enterica serovar Typhi Ty2
aacguaaauacccaggcca

SEQ ID NO: 1745792 - RNA, 19 nt, Salmonella enterica enterica serovar Typhi Ty2
aacgguuuugcgcugguac

SEQ ID NO: 1745793 - RNA, 18 nt, Salmonella enterica enterica serovar Typhi Ty2
aacguaccgaugacggca

SEQ ID NO: 1745794 - RNA, 13 nt, Salmonella enterica enterica serovar Typhi Ty2
aacguagcgcguc

SEQ ID NO: 1745795 - RNA, 20 nt, Salmonella enterica enterica serovar Typhi Ty2
aacguaaacggcagccgcca

SEQ ID NO: 1745796 - RNA, 14 nt, Salmonella enterica enterica serovar Typhi Ty2
gacgaucagcgcca

SEQ ID NO: 1745797 - RNA, 16 nt, Salmonella enterica enterica serovar Typhi Ty2
aacgguucauccagca

SEQ ID NO: 1745798 - RNA, 15 nt, Salmonella enterica enterica serovar Typhi Ty2
gacgauaaccggacg

SEQ ID NO: 1745799 - RNA, 18 nt, Salmonella enterica enterica serovar Typhi Ty2
gacgauacgucauaucau

SEQ ID NO: 1745800 - RNA, 23 nt, Salmonella enterica enterica serovar Typhi Ty2
gacagcaaguugcgccacugcca

SEQ ID NO: 1745801 - RNA, 16 nt, Salmonella enterica enterica serovar Typhi Ty2
gacagcacauagccua

SEQ ID NO: 1745802 - RNA, 14 nt, Salmonella enterica enterica serovar Typhi Ty2
gacagacgcaucuu

SEQ ID NO: 1745803 - RNA, 17 nt, Salmonella enterica enterica serovar Typhi Ty2
gacacuggaaacagcca

SEQ ID NO: 1745804 - RNA, 16 nt, Salmonella enterica enterica serovar Typhi Ty2
gacaucgcaaugccac

SEQ ID NO: 1745805 - RNA, 17 nt, Salmonella enterica enterica serovar Typhi Ty2
gacaucacguucgcgca

SEQ ID NO: 1745806 - RNA, 14 nt, Salmonella enterica enterica serovar Typhi Ty2
gacauccaucaucu

SEQ ID NO: 1745807 - RNA, 15 nt, Salmonella enterica enterica serovar Typhi Ty2
gacauauucaugguu

SEQ ID NO: 1745808 - RNA, 16 nt, Salmonella enterica enterica serovar Typhi Ty2
gacauauucaugguuc

SEQ ID NO: 1745809 - RNA, 20 nt, Salmonella enterica enterica serovar Typhi Ty2
gacauaguaauuaccggacg

SEQ ID NO: 1745810 - RNA, 18 nt, Salmonella enterica enterica serovar Typhi Ty2
gacacaaaucuguuaucu

SEQ ID NO: 1745811 - RNA, 17 nt, Salmonella enterica enterica serovar Typhi Ty2
gacaauguccgccagac

SEQ ID NO: 1745812 - RNA, 16 nt, Salmonella enterica enterica serovar Typhi Ty2
gacaauuuucuucaug

SEQ ID NO: 1745813 - RNA, 18 nt, Salmonella enterica enterica serovar Typhi Ty2
gacacagcguuuaacuga

SEQ ID NO: 1745814 - RNA, 19 nt, Salmonella enterica enterica serovar Typhi Ty2
gaaucgcagagcguaauuc

SEQ ID NO: 1745815 - RNA, 19 nt, Salmonella enterica enterica serovar Typhi Ty2
gaauaagcugaaugguaaa

SEQ ID NO: 1745816 - RNA, 21 nt, Salmonella enterica enterica serovar Typhi Ty2
gaauaauguugguauauucga

SEQ ID NO: 1745817 - RNA, 16 nt, Salmonella enterica enterica serovar Typhi Ty2
gaauacaaaaaagccg

SEQ ID NO: 1745818 - RNA, 18 nt, Salmonella enterica enterica serovar Typhi Ty2
gaauaucggcgucaacgu

SEQ ID NO: 1745819 - RNA, 23 nt, Salmonella enterica enterica serovar Typhi Ty2
gaauauggaaaggaugcagcauc

SEQ ID NO: 1745820 - RNA, 19 nt, Salmonella enterica enterica serovar Typhi Ty2
gaauauugcgccacgcugu

SEQ ID NO: 1745821 - RNA, 13 nt, Salmonella enterica enterica serovar Typhi Ty2
gaauaaacgguaa

SEQ ID NO: 1745822 - RNA, 15 nt, Salmonella enterica enterica serovar Typhi Ty2
gaauaacccgcagcc

SEQ ID NO: 1745823 - RNA, 17 nt, Salmonella enterica enterica serovar Typhi Ty2
gaacugauguuccggca

SEQ ID NO: 1745824 - RNA, 17 nt, Salmonella enterica enterica serovar Typhi Ty2
gaacugcaucccugcuu

SEQ ID NO: 1745825 - RNA, 22 nt, Salmonella enterica enterica serovar Typhi Ty2
gaacugcgaaaucaccgacagg

SEQ ID NO: 1745826 - RNA, 20 nt, Salmonella enterica enterica serovar Typhi Ty2
gacaacacauccgcagcgaa

SEQ ID NO: 1745827 - RNA, 14 nt, Salmonella enterica enterica serovar Typhi Ty2
gacaacgccaucag

SEQ ID NO: 1745828 - RNA, 19 nt, Salmonella enterica enterica serovar Typhi Ty2
gacaaucuccuccggcuuc

SEQ ID NO: 1745829 - RNA, 17 nt, Salmonella enterica enterica serovar Typhi Ty2
gacaaucucaauaccac

SEQ ID NO: 1745830 - RNA, 16 nt, Salmonella enterica enterica serovar Typhi Ty2
gacaacguaaacggca

SEQ ID NO: 1745831 - RNA, 21 nt, Salmonella enterica enterica serovar Typhi Ty2
gacaaagccggauaucgcuau

SEQ ID NO: 1745832 - RNA, 16 nt, Salmonella enterica enterica serovar Typhi Ty2
gacaaagcguggggaa

SEQ ID NO: 1745833 - RNA, 13 nt, Salmonella enterica enterica serovar Typhi Ty2
gacaaaaagcgcg

SEQ ID NO: 1745834 - RNA, 14 nt, Salmonella enterica enterica serovar Typhi Ty2
gacaaaaauaccac

SEQ ID NO: 1745835 - RNA, 13 nt, Salmonella enterica enterica serovar Typhi Ty2
gaauuuacgggcg

SEQ ID NO: 1745836 - RNA, 20 nt, Salmonella enterica enterica serovar Typhi Ty2
gaauugguagacgcgcuagc

SEQ ID NO: 1745837 - RNA, 20 nt, Salmonella enterica enterica serovar Typhi Ty2
gaauuuccagcgggcgaucg

SEQ ID NO: 1745838 - RNA, 15 nt, Salmonella enterica enterica serovar Typhi Ty2
gaaugcgccgucagg

SEQ ID NO: 1745839 - RNA, 17 nt, Salmonella enterica enterica serovar Typhi Ty2
gaaugcugacgcguuuu

SEQ ID NO: 1745840 - RNA, 16 nt, Salmonella enterica enterica serovar Typhi Ty2
gaauggagaagcgcgc

SEQ ID NO: 1745841 - RNA, 20 nt, Salmonella enterica enterica serovar Typhi Ty2
gacaucggagauuucauccu

SEQ ID NO: 1745842 - RNA, 14 nt, Salmonella enterica enterica serovar Typhi Ty2
gacaucgcuuccgu

SEQ ID NO: 1745843 - RNA, 23 nt, Salmonella enterica enterica serovar Typhi Ty2
gacaucgccugguaaggcaaaua

SEQ ID NO: 1745844 - RNA, 21 nt, Salmonella enterica enterica serovar Typhi Ty2
gacaucgccggagccgccugg

SEQ ID NO: 1745845 - RNA, 13 nt, Salmonella enterica enterica serovar Typhi Ty2
gaccacccgcgac

SEQ ID NO: 1745846 - RNA, 12 nt, Salmonella enterica enterica serovar Typhi Ty2
gacaucuucauc

SEQ ID NO: 1745847 - RNA, 19 nt, Salmonella enterica enterica serovar Typhi Ty2
gacaucuuggcgcugccgu

SEQ ID NO: 1745848 - RNA, 22 nt, Salmonella enterica enterica serovar Typhi Ty2
gacaucuuugccaaacugcugg

SEQ ID NO: 1745849 - RNA, 14 nt, Salmonella enterica enterica serovar Typhi Ty2
aacgaucauugacg

SEQ ID NO: 1745850 - RNA, 18 nt, Salmonella enterica enterica serovar Typhi Ty2
gaccagacacggugugcc

SEQ ID NO: 1745851 - RNA, 13 nt, Salmonella enterica enterica serovar Typhi Ty2
aacgccgccgcaa

SEQ ID NO: 1745852 - RNA, 14 nt, Salmonella enterica enterica serovar Typhi Ty2
aacgccgcguucgc

SEQ ID NO: 1745853 - RNA, 22 nt, Salmonella enterica enterica serovar Typhi Ty2
aacgccaugcucauccaacugc

SEQ ID NO: 1745854 - RNA, 19 nt, Salmonella enterica enterica serovar Typhi Ty2
aacgccagcgauuugccgc

SEQ ID NO: 1745855 - RNA, 16 nt, Salmonella enterica enterica serovar Typhi Ty2
aacgauguaucgcgcg

SEQ ID NO: 1745856 - RNA, 23 nt, Salmonella enterica enterica serovar Typhi Ty2
aacgaugaccauaaaugaaaugc

SEQ ID NO: 1745857 - RNA, 14 nt, Salmonella enterica enterica serovar Typhi Ty2
aacgccacugccau

SEQ ID NO: 1745858 - RNA, 21 nt, Salmonella enterica enterica serovar Typhi Ty2
aacgccagaccgacgccaacc

SEQ ID NO: 1745859 - RNA, 15 nt, Salmonella enterica enterica serovar Typhi Ty2
gaccagcgcgccaaa

SEQ ID NO: 1745860 - RNA, 22 nt, Salmonella enterica enterica serovar Typhi Ty2
aacgccguacuccagcccauca

SEQ ID NO: 1745861 - RNA, 22 nt, Salmonella enterica enterica serovar Typhi Ty2
aacgccuccugccgaugccgcc

SEQ ID NO: 1745862 - RNA, 22 nt, Salmonella enterica enterica serovar Typhi Ty2
gaccagccuaccugccgccaua

SEQ ID NO: 1745863 - RNA, 21 nt, Salmonella enterica enterica serovar Typhi Ty2
gaccagccuaccugccgccau

SEQ ID NO: 1745864 - RNA, 21 nt, Salmonella enterica enterica serovar Typhi Ty2
gaccaugauaucgccaauggc

SEQ ID NO: 1745865 - RNA, 13 nt, Salmonella enterica enterica serovar Typhi Ty2
aacgcuaugcgcc

SEQ ID NO: 1745866 - RNA, 20 nt, Salmonella enterica enterica serovar Typhi Ty2
aacgcgucuucaucagccag

SEQ ID NO: 1745867 - RNA, 16 nt, Salmonella enterica enterica serovar Typhi Ty2
aacggaauaaacgaga

SEQ ID NO: 1745868 - RNA, 16 nt, Salmonella enterica enterica serovar Typhi Ty2
aacgcguccaacuggc

SEQ ID NO: 1745869 - RNA, 20 nt, Salmonella enterica enterica serovar Typhi Ty2
aacgcguacggcuucaaucg

SEQ ID NO: 1745870 - RNA, 23 nt, Salmonella enterica enterica serovar Typhi Ty2
aacgcggcgccgaagcaggcgga

SEQ ID NO: 1745871 - RNA, 11 nt, Salmonella enterica enterica serovar Typhi Ty2
gacccggcauu

SEQ ID NO: 1745872 - RNA, 16 nt, Salmonella enterica enterica serovar Typhi Ty2
gaccggcgcagcgccc

SEQ ID NO: 1745873 - RNA, 21 nt, Salmonella enterica enterica serovar Typhi Ty2
gaccgccgaugcugaauagcc

SEQ ID NO: 1745874 - RNA, 18 nt, Salmonella enterica enterica serovar Typhi Ty2
gaccgccgcgcgucagca

SEQ ID NO: 1745875 - RNA, 17 nt, Salmonella enterica enterica serovar Typhi Ty2
aacggauugugaaauuc

SEQ ID NO: 1745876 - RNA, 17 nt, Salmonella enterica enterica serovar Typhi Ty2
aacggacgugcgcuuca

SEQ ID NO: 1745877 - RNA, 22 nt, Salmonella enterica enterica serovar Typhi Ty2
aacggaauggcacagcgcagca

SEQ ID NO: 1745878 - RNA, 23 nt, Salmonella enterica enterica serovar Typhi Ty2
gaccgauagagacugccgccguc

SEQ ID NO: 1745879 - RNA, 16 nt, Salmonella enterica enterica serovar Typhi Ty2
cucgcgcagauagagc

SEQ ID NO: 1745880 - RNA, 18 nt, Salmonella enterica enterica serovar Typhi Ty2
cucgcgccacgcagauau

SEQ ID NO: 1745881 - RNA, 21 nt, Salmonella enterica enterica serovar Typhi Ty2
cucgcagguacgacacccgau

SEQ ID NO: 1745882 - RNA, 23 nt, Salmonella enterica enterica serovar Typhi Ty2
cucgaagauacggauucuugacg

SEQ ID NO: 1745883 - RNA, 16 nt, Salmonella enterica enterica serovar Typhi Ty2
cuccggcacauucacc

SEQ ID NO: 1745884 - RNA, 21 nt, Salmonella enterica enterica serovar Typhi Ty2
cuccggcuuaaugcauggcag

SEQ ID NO: 1745885 - RNA, 14 nt, Salmonella enterica enterica serovar Typhi Ty2
cuccggcagcgaau

SEQ ID NO: 1745886 - RNA, 12 nt, Salmonella enterica enterica serovar Typhi Ty2
cuccccacauau

SEQ ID NO: 1745887 - RNA, 17 nt, Salmonella enterica enterica serovar Typhi Ty2
cuccuggaugcgcugaa

SEQ ID NO: 1745888 - RNA, 15 nt, Salmonella enterica enterica serovar Typhi Ty2
cuccugcgccagccg

SEQ ID NO: 1745889 - RNA, 14 nt, Salmonella enterica enterica serovar Typhi Ty2
cuccuccagcgcgu

SEQ ID NO: 1745890 - RNA, 23 nt, Salmonella enterica enterica serovar Typhi Ty2
cuauagcccacgcauaaugagcg

SEQ ID NO: 1745891 - RNA, 19 nt, Salmonella enterica enterica serovar Typhi Ty2
cuauccaccccuugcgcgu

SEQ ID NO: 1745892 - RNA, 23 nt, Salmonella enterica enterica serovar Typhi Ty2
cuaucagguaacauaucgacaua

SEQ ID NO: 1745893 - RNA, 20 nt, Salmonella enterica enterica serovar Typhi Ty2
cuauauguccuuuacugcgc

SEQ ID NO: 1745894 - RNA, 16 nt, Salmonella enterica enterica serovar Typhi Ty2
cuagccgcauccggca

SEQ ID NO: 1745895 - RNA, 23 nt, Salmonella enterica enterica serovar Typhi Ty2
cguugcgacaaccuguaggccgg

SEQ ID NO: 1745896 - RNA, 13 nt, Salmonella enterica enterica serovar Typhi Ty2
cuacguaauucau

SEQ ID NO: 1745897 - RNA, 18 nt, Salmonella enterica enterica serovar Typhi Ty2
cuacguauccuggcgcgu

SEQ ID NO: 1745898 - RNA, 23 nt, Salmonella enterica enterica serovar Typhi Ty2
cuacgucaggaaacgcgccggaa

SEQ ID NO: 1745899 - RNA, 19 nt, Salmonella enterica enterica serovar Typhi Ty2
cuaucuucaauacgaaaac

SEQ ID NO: 1745900 - RNA, 23 nt, Salmonella enterica enterica serovar Typhi Ty2
cuaucugcuucuggcuugcgcua

SEQ ID NO: 1745901 - RNA, 16 nt, Salmonella enterica enterica serovar Typhi Ty2
cuaucuggauacgaua

SEQ ID NO: 1745902 - RNA, 16 nt, Salmonella enterica enterica serovar Typhi Ty2
cuauccagucagcguu

SEQ ID NO: 1745903 - RNA, 14 nt, Salmonella enterica enterica serovar Typhi Ty2
cuauccagucagcg

SEQ ID NO: 1745904 - RNA, 22 nt, Salmonella enterica enterica serovar Typhi Ty2
cuaucccaggcggagaaaugcg

SEQ ID NO: 1745905 - RNA, 12 nt, Salmonella enterica enterica serovar Typhi Ty2
cuaucgccauau

SEQ ID NO: 1745906 - RNA, 21 nt, Salmonella enterica enterica serovar Typhi Ty2
cuaucgcguaucccuaagcgu

SEQ ID NO: 1745907 - RNA, 11 nt, Salmonella enterica enterica serovar Typhi Ty2
cuaucgcuauc

SEQ ID NO: 1745908 - RNA, 16 nt, Salmonella enterica enterica serovar Typhi Ty2
cuaugcuuauccggcc

SEQ ID NO: 1745909 - RNA, 16 nt, Salmonella enterica enterica serovar Typhi Ty2
cuaugccaggcgcaac

SEQ ID NO: 1745910 - RNA, 23 nt, Salmonella enterica enterica serovar Typhi Ty2
cuauuccaacuaugugggcgaua

SEQ ID NO: 1745911 - RNA, 19 nt, Salmonella enterica enterica serovar Typhi Ty2
cucaacauugccggcauca

SEQ ID NO: 1745912 - RNA, 14 nt, Salmonella enterica enterica serovar Typhi Ty2
cucaaccaugauaa

SEQ ID NO: 1745913 - RNA, 17 nt, Salmonella enterica enterica serovar Typhi Ty2
cucaagcccgcgucguu

SEQ ID NO: 1745914 - RNA, 16 nt, Salmonella enterica enterica serovar Typhi Ty2
cucaagcuguagcguu

SEQ ID NO: 1745915 - RNA, 17 nt, Salmonella enterica enterica serovar Typhi Ty2
cuauuucuuagcgccag

SEQ ID NO: 1745916 - RNA, 12 nt, Salmonella enterica enterica serovar Typhi Ty2
cuauuuaacccu

SEQ ID NO: 1745917 - RNA, 16 nt, Salmonella enterica enterica serovar Typhi Ty2
cuauugaucgccauag

SEQ ID NO: 1745918 - RNA, 14 nt, Salmonella enterica enterica serovar Typhi Ty2
cuccagaccgcugc

SEQ ID NO: 1745919 - RNA, 19 nt, Salmonella enterica enterica serovar Typhi Ty2
cuccauagaaaucagcagg

SEQ ID NO: 1745920 - RNA, 20 nt, Salmonella enterica enterica serovar Typhi Ty2
cuccaucaugggcgcggcga

SEQ ID NO: 1745921 - RNA, 20 nt, Salmonella enterica enterica serovar Typhi Ty2
cucagcuaaaaacagcgcaa

SEQ ID NO: 1745922 - RNA, 22 nt, Salmonella enterica enterica serovar Typhi Ty2
cucauuauggacgggauacggc

SEQ ID NO: 1745923 - RNA, 19 nt, Salmonella enterica enterica serovar Typhi Ty2
cucagcuaaaaacagcgca

SEQ ID NO: 1745924 - RNA, 17 nt, Salmonella enterica enterica serovar Typhi Ty2
cucacuuuucuuuccug

SEQ ID NO: 1745925 - RNA, 19 nt, Salmonella enterica enterica serovar Typhi Ty2
cucacgcuuauccggccua

SEQ ID NO: 1745926 - RNA, 22 nt, Salmonella enterica enterica serovar Typhi Ty2
cucacgggcguagucagcgacg

SEQ ID NO: 1745927 - RNA, 22 nt, Salmonella enterica enterica serovar Typhi Ty2
cucaccuuuuuauuuacugccg

SEQ ID NO: 1745928 - RNA, 16 nt, Salmonella enterica enterica serovar Typhi Ty2
cucacgcaaugccuga

SEQ ID NO: 1745929 - RNA, 22 nt, Salmonella enterica enterica serovar Typhi Ty2
cucaccagcugacgcagcaguu

SEQ ID NO: 1745930 - RNA, 16 nt, Salmonella enterica enterica serovar Typhi Ty2
cugagcgcgccaugag

SEQ ID NO: 1745931 - RNA, 19 nt, Salmonella enterica enterica serovar Typhi Ty2
cugagcggcucauccagca

SEQ ID NO: 1745932 - RNA, 14 nt, Salmonella enterica enterica serovar Typhi Ty2
cugaggcgacaauc

SEQ ID NO: 1745933 - RNA, 23 nt, Salmonella enterica enterica serovar Typhi Ty2
cugagauggcacgauaaccagau

SEQ ID NO: 1745934 - RNA, 16 nt, Salmonella enterica enterica serovar Typhi Ty2
cugagauggcgccauu

SEQ ID NO: 1745935 - RNA, 17 nt, Salmonella enterica enterica serovar Typhi Ty2
cugauauuuuuacugau

SEQ ID NO: 1745936 - RNA, 13 nt, Salmonella enterica enterica serovar Typhi Ty2
cugaucaauugcg

SEQ ID NO: 1745937 - RNA, 20 nt, Salmonella enterica enterica serovar Typhi Ty2
cugauaguuuaaauccagcg

SEQ ID NO: 1745938 - RNA, 18 nt, Salmonella enterica enterica serovar Typhi Ty2
cugauauaucuucaucgu

SEQ ID NO: 1745939 - RNA, 14 nt, Salmonella enterica enterica serovar Typhi Ty2
cugauauaacgugc

SEQ ID NO: 1745940 - RNA, 21 nt, Salmonella enterica enterica serovar Typhi Ty2
cugauagcauuguauccagcc

SEQ ID NO: 1745941 - RNA, 17 nt, Salmonella enterica enterica serovar Typhi Ty2
cugauagacaauugcug

SEQ ID NO: 1745942 - RNA, 16 nt, Salmonella enterica enterica serovar Typhi Ty2
cugauagcacagcgcu

SEQ ID NO: 1745943 - RNA, 12 nt, Salmonella enterica enterica serovar Typhi Ty2
cugauagcccau

SEQ ID NO: 1745944 - RNA, 19 nt, Salmonella enterica enterica serovar Typhi Ty2
cugauaagcgcagcgccau

SEQ ID NO: 1745945 - RNA, 18 nt, Salmonella enterica enterica serovar Typhi Ty2
cugauaagcgaagcgcca

SEQ ID NO: 1745946 - RNA, 17 nt, Salmonella enterica enterica serovar Typhi Ty2
cugauaagcgcagcgcc

SEQ ID NO: 1745947 - RNA, 14 nt, Salmonella enterica enterica serovar Typhi Ty2
cugauacagccaaa

SEQ ID NO: 1745948 - RNA, 21 nt, Salmonella enterica enterica serovar Typhi Ty2
cugauacggaaauagcgccau

SEQ ID NO: 1745949 - RNA, 21 nt, Salmonella enterica enterica serovar Typhi Ty2
cugacgaaagucauccaguac

SEQ ID NO: 1745950 - RNA, 17 nt, Salmonella enterica enterica serovar Typhi Ty2
cugaccuuaauccagca

SEQ ID NO: 1745951 - RNA, 16 nt, Salmonella enterica enterica serovar Typhi Ty2
cugacgaguggcggac

SEQ ID NO: 1745952 - RNA, 18 nt, Salmonella enterica enterica serovar Typhi Ty2
cugacgcccaucagcauc

SEQ ID NO: 1745953 - RNA, 19 nt, Salmonella enterica enterica serovar Typhi Ty2
cugacgcagcaguuccccg

SEQ ID NO: 1745954 - RNA, 22 nt, Salmonella enterica enterica serovar Typhi Ty2
cugacgcaauuguugcgccaug

SEQ ID NO: 1745955 - RNA, 15 nt, Salmonella enterica enterica serovar Typhi Ty2
cugacucaucacauc

SEQ ID NO: 1745956 - RNA, 15 nt, Salmonella enterica enterica serovar Typhi Ty2
cugacuauugcugag

SEQ ID NO: 1745957 - RNA, 18 nt, Salmonella enterica enterica serovar Typhi Ty2
cugacugcaaaucugccg

SEQ ID NO: 1745958 - RNA, 14 nt, Salmonella enterica enterica serovar Typhi Ty2
cugacguuucucau

SEQ ID NO: 1745959 - RNA, 13 nt, Salmonella enterica enterica serovar Typhi Ty2
cugacuauccaca

SEQ ID NO: 1745960 - RNA, 19 nt, Salmonella enterica enterica serovar Typhi Ty2
cugacuuacaggcuggaaa

SEQ ID NO: 1745961 - RNA, 16 nt, Salmonella enterica enterica serovar Typhi Ty2
cugacgccugaaaugc

SEQ ID NO: 1745962 - RNA, 20 nt, Salmonella enterica enterica serovar Typhi Ty2
cugacgcgaugacggcgcgu

SEQ ID NO: 1745963 - RNA, 19 nt, Salmonella enterica enterica serovar Typhi Ty2
cugacgguagcgucaggua

SEQ ID NO: 1745964 - RNA, 14 nt, Salmonella enterica enterica serovar Typhi Ty2
cugaauagcgcugc

SEQ ID NO: 1745965 - RNA, 16 nt, Salmonella enterica enterica serovar Typhi Ty2
cugaauagucggcugc

SEQ ID NO: 1745966 - RNA, 17 nt, Salmonella enterica enterica serovar Typhi Ty2
cugaauguauauaacgc

SEQ ID NO: 1745967 - RNA, 17 nt, Salmonella enterica enterica serovar Typhi Ty2
cugacauucagcgcuua

SEQ ID NO: 1745968 - RNA, 14 nt, Salmonella enterica enterica serovar Typhi Ty2
cugaccagacagau

SEQ ID NO: 1745969 - RNA, 22 nt, Salmonella enterica enterica serovar Typhi Ty2
cugaagcugccgucccagcgga

SEQ ID NO: 1745970 - RNA, 22 nt, Salmonella enterica enterica serovar Typhi Ty2
cugaagccagcaaucagcccau

SEQ ID NO: 1745971 - RNA, 19 nt, Salmonella enterica enterica serovar Typhi Ty2
cugaagauaaacagcagcg

SEQ ID NO: 1745972 - RNA, 15 nt, Salmonella enterica enterica serovar Typhi Ty2
cugaaccaacagcug

SEQ ID NO: 1745973 - RNA, 19 nt, Salmonella enterica enterica serovar Typhi Ty2
cucugcugugccaguaccg

SEQ ID NO: 1745974 - RNA, 20 nt, Salmonella enterica enterica serovar Typhi Ty2
cucugauuucgacgauaaaa

SEQ ID NO: 1745975 - RNA, 19 nt, Salmonella enterica enterica serovar Typhi Ty2
cucugauuucgacgauaaa

SEQ ID NO: 1745976 - RNA, 19 nt, Salmonella enterica enterica serovar Typhi Ty2
cucuacgccggcgcguaau

SEQ ID NO: 1745977 - RNA, 19 nt, Salmonella enterica enterica serovar Typhi Ty2
cucuaauucccaguaaccu

SEQ ID NO: 1745978 - RNA, 15 nt, Salmonella enterica enterica serovar Typhi Ty2
cucuuaucgugcgcg

SEQ ID NO: 1745979 - RNA, 13 nt, Salmonella enterica enterica serovar Typhi Ty2
cucuuuaaagcgc

SEQ ID NO: 1745980 - RNA, 21 nt, Salmonella enterica enterica serovar Typhi Ty2
cucuuugguccauaaccaggc

SEQ ID NO: 1745981 - RNA, 15 nt, Salmonella enterica enterica serovar Typhi Ty2
cugaaaacaggccug

SEQ ID NO: 1745982 - RNA, 17 nt, Salmonella enterica enterica serovar Typhi Ty2
cucuuuuuccgccugau

SEQ ID NO: 1745983 - RNA, 15 nt, Salmonella enterica enterica serovar Typhi Ty2
cugccagcgaaccgc

SEQ ID NO: 1745984 - RNA, 21 nt, Salmonella enterica enterica serovar Typhi Ty2
cugccagccgauuuuucggca

SEQ ID NO: 1745985 - RNA, 22 nt, Salmonella enterica enterica serovar Typhi Ty2
cugccauuucugcucacgguuu

SEQ ID NO: 1745986 - RNA, 13 nt, Salmonella enterica enterica serovar Typhi Ty2
cugccaucaggca

SEQ ID NO: 1745987 - RNA, 15 nt, Salmonella enterica enterica serovar Typhi Ty2
cugcagcuccgcaau

SEQ ID NO: 1745988 - RNA, 17 nt, Salmonella enterica enterica serovar Typhi Ty2
cugcagggaauaagcgc

SEQ ID NO: 1745989 - RNA, 18 nt, Salmonella enterica enterica serovar Typhi Ty2
cugcagggaauaagcgcc

SEQ ID NO: 1745990 - RNA, 15 nt, Salmonella enterica enterica serovar Typhi Ty2
cugcauaauccaacg

SEQ ID NO: 1745991 - RNA, 19 nt, Salmonella enterica enterica serovar Typhi Ty2
cugcaucgugagcgcguca

SEQ ID NO: 1745992 - RNA, 19 nt, Salmonella enterica enterica serovar Typhi Ty2
cugcauaaaggaguaacag

SEQ ID NO: 1745993 - RNA, 18 nt, Salmonella enterica enterica serovar Typhi Ty2
cugauggcgcuacgcuua

SEQ ID NO: 1745994 - RNA, 13 nt, Salmonella enterica enterica serovar Typhi Ty2
cugauggcgcugc

SEQ ID NO: 1745995 - RNA, 17 nt, Salmonella enterica enterica serovar Typhi Ty2
cugauggcguggcgcag

SEQ ID NO: 1745996 - RNA, 13 nt, Salmonella enterica enterica serovar Typhi Ty2
cugaugcugcgca

SEQ ID NO: 1745997 - RNA, 16 nt, Salmonella enterica enterica serovar Typhi Ty2
cugaugcuggcgccau

SEQ ID NO: 1745998 - RNA, 13 nt, Salmonella enterica enterica serovar Typhi Ty2
cugaugcaggcaa

SEQ ID NO: 1745999 - RNA, 16 nt, Salmonella enterica enterica serovar Typhi Ty2
cugaucgaucagcuga

SEQ ID NO: 1746000 - RNA, 18 nt, Salmonella enterica enterica serovar Typhi Ty2
cugauggcgcugcgcuua

SEQ ID NO: 1746001 - RNA, 14 nt, Salmonella enterica enterica serovar Typhi Ty2
cugauguuccggca

SEQ ID NO: 1746002 - RNA, 20 nt, Salmonella enterica enterica serovar Typhi Ty2
cugauucaggugacaguccg

SEQ ID NO: 1746003 - RNA, 17 nt, Salmonella enterica enterica serovar Typhi Ty2
cugauuucgccccacug

SEQ ID NO: 1746004 - RNA, 23 nt, Salmonella enterica enterica serovar Typhi Ty2
cugcaaauacugcuuuuccggca

SEQ ID NO: 1746005 - RNA, 16 nt, Salmonella enterica enterica serovar Typhi Ty2
cugcaaaucuucggca

SEQ ID NO: 1746006 - RNA, 20 nt, Salmonella enterica enterica serovar Typhi Ty2
cugcaccuuuuuuuccagcg

SEQ ID NO: 1746007 - RNA, 20 nt, Salmonella enterica enterica serovar Typhi Ty2
cugcacgagagaccaugcuc

SEQ ID NO: 1746008 - RNA, 18 nt, Salmonella enterica enterica serovar Typhi Ty2
cugcaccuuuuuuuccag

SEQ ID NO: 1746009 - RNA, 20 nt, Salmonella enterica enterica serovar Typhi Ty2
cugcaaugguaaaacgcugg

SEQ ID NO: 1746010 - RNA, 20 nt, Salmonella enterica enterica serovar Typhi Ty2
cugcacauucagguggcuga

SEQ ID NO: 1746011 - RNA, 18 nt, Salmonella enterica enterica serovar Typhi Ty2
cgugaauugcgguuuauc

SEQ ID NO: 1746012 - RNA, 20 nt, Salmonella enterica enterica serovar Typhi Ty2
cgugaaucaucaucauccgc

SEQ ID NO: 1746013 - RNA, 15 nt, Salmonella enterica enterica serovar Typhi Ty2
cgugaccccaggcau

SEQ ID NO: 1746014 - RNA, 19 nt, Salmonella enterica enterica serovar Typhi Ty2
cgucugguacggccaccag

SEQ ID NO: 1746015 - RNA, 20 nt, Salmonella enterica enterica serovar Typhi Ty2
cgucuuaaugcucuccagca

SEQ ID NO: 1746016 - RNA, 12 nt, Salmonella enterica enterica serovar Typhi Ty2
cgucuucaucag

SEQ ID NO: 1746017 - RNA, 13 nt, Salmonella enterica enterica serovar Typhi Ty2
cgugaacgccaaa

SEQ ID NO: 1746018 - RNA, 23 nt, Salmonella enterica enterica serovar Typhi Ty2
cgugaaaauaaaauauccagcgu

SEQ ID NO: 1746019 - RNA, 13 nt, Salmonella enterica enterica serovar Typhi Ty2
cgugaaagcgcuu

SEQ ID NO: 1746020 - RNA, 21 nt, Salmonella enterica enterica serovar Typhi Ty2
cgucggcaggguuugaccuca

SEQ ID NO: 1746021 - RNA, 22 nt, Salmonella enterica enterica serovar Typhi Ty2
cgucggcaagaauuucaaucau

SEQ ID NO: 1746022 - RNA, 14 nt, Salmonella enterica enterica serovar Typhi Ty2
cgucuggcgaaaac

SEQ ID NO: 1746023 - RNA, 14 nt, Salmonella enterica enterica serovar Typhi Ty2
cgucugauucaggu

SEQ ID NO: 1746024 - RNA, 22 nt, Salmonella enterica enterica serovar Typhi Ty2
cgucguuaacaucaucaggccu

SEQ ID NO: 1746025 - RNA, 18 nt, Salmonella enterica enterica serovar Typhi Ty2
cgugcagcgugccgggau

SEQ ID NO: 1746026 - RNA, 13 nt, Salmonella enterica enterica serovar Typhi Ty2
cgugagcuacagc

SEQ ID NO: 1746027 - RNA, 20 nt, Salmonella enterica enterica serovar Typhi Ty2
cgugagccuauuaucagaau

SEQ ID NO: 1746028 - RNA, 18 nt, Salmonella enterica enterica serovar Typhi Ty2
cgugagagaaaaucacgc

SEQ ID NO: 1746029 - RNA, 18 nt, Salmonella enterica enterica serovar Typhi Ty2
cgugagaaguaagcgcca

SEQ ID NO: 1746030 - RNA, 16 nt, Salmonella enterica enterica serovar Typhi Ty2
cgugacuguucacauc

SEQ ID NO: 1746031 - RNA, 17 nt, Salmonella enterica enterica serovar Typhi Ty2
cgugaccguuucaaaga

SEQ ID NO: 1746032 - RNA, 13 nt, Salmonella enterica enterica serovar Typhi Ty2
cgugacggcggaa

SEQ ID NO: 1746033 - RNA, 18 nt, Salmonella enterica enterica serovar Typhi Ty2
cgugaguaucgaucguca

SEQ ID NO: 1746034 - RNA, 22 nt, Salmonella enterica enterica serovar Typhi Ty2
cgugaucacucccggaauaucg

SEQ ID NO: 1746035 - RNA, 21 nt, Salmonella enterica enterica serovar Typhi Ty2
cguugaauauuggcaucaagc

SEQ ID NO: 1746036 - RNA, 13 nt, Salmonella enterica enterica serovar Typhi Ty2
cguugauggcgua

SEQ ID NO: 1746037 - RNA, 18 nt, Salmonella enterica enterica serovar Typhi Ty2
cguucccgaaaauccgga

SEQ ID NO: 1746038 - RNA, 16 nt, Salmonella enterica enterica serovar Typhi Ty2
cguucugucgauaaac

SEQ ID NO: 1746039 - RNA, 17 nt, Salmonella enterica enterica serovar Typhi Ty2
cguucuggcugccguca

SEQ ID NO: 1746040 - RNA, 21 nt, Salmonella enterica enterica serovar Typhi Ty2
cguucuugcccgguggcgcug

SEQ ID NO: 1746041 - RNA, 15 nt, Salmonella enterica enterica serovar Typhi Ty2
cguucuucgauaaag

SEQ ID NO: 1746042 - RNA, 13 nt, Salmonella enterica enterica serovar Typhi Ty2
cguucgucgccgg

SEQ ID NO: 1746043 - RNA, 13 nt, Salmonella enterica enterica serovar Typhi Ty2
cguuaccagcauc

SEQ ID NO: 1746044 - RNA, 14 nt, Salmonella enterica enterica serovar Typhi Ty2
cguuacaaauagcg

SEQ ID NO: 1746045 - RNA, 16 nt, Salmonella enterica enterica serovar Typhi Ty2
cguuaaggccugcgcg

SEQ ID NO: 1746046 - RNA, 18 nt, Salmonella enterica enterica serovar Typhi Ty2
cguuaauccaaauccgca

SEQ ID NO: 1746047 - RNA, 20 nt, Salmonella enterica enterica serovar Typhi Ty2
cguuaaugcuguccugcaaa

SEQ ID NO: 1746048 - RNA, 17 nt, Salmonella enterica enterica serovar Typhi Ty2
cguuaucugaccuacag

SEQ ID NO: 1746049 - RNA, 17 nt, Salmonella enterica enterica serovar Typhi Ty2
cguuaugaauggcggag

SEQ ID NO: 1746050 - RNA, 16 nt, Salmonella enterica enterica serovar Typhi Ty2
cguuauuuuccugaaa

SEQ ID NO: 1746051 - RNA, 15 nt, Salmonella enterica enterica serovar Typhi Ty2
cguucacgucgcgaa

SEQ ID NO: 1746052 - RNA, 21 nt, Salmonella enterica enterica serovar Typhi Ty2
cguucaccagccacugcgcca

SEQ ID NO: 1746053 - RNA, 14 nt, Salmonella enterica enterica serovar Typhi Ty2
cguucacgccgcca

SEQ ID NO: 1746054 - RNA, 21 nt, Salmonella enterica enterica serovar Typhi Ty2
cguggugaauaucgagcggca

SEQ ID NO: 1746055 - RNA, 20 nt, Salmonella enterica enterica serovar Typhi Ty2
cguguugauuaaugcgauaa

SEQ ID NO: 1746056 - RNA, 15 nt, Salmonella enterica enterica serovar Typhi Ty2
cguguucaugcgcgg

SEQ ID NO: 1746057 - RNA, 20 nt, Salmonella enterica enterica serovar Typhi Ty2
cguuaaauccucccaucgag

SEQ ID NO: 1746058 - RNA, 22 nt, Salmonella enterica enterica serovar Typhi Ty2
cguuaaauagccccaacgcgcu

SEQ ID NO: 1746059 - RNA, 13 nt, Salmonella enterica enterica serovar Typhi Ty2
cguuaaacgcugu

SEQ ID NO: 1746060 - RNA, 14 nt, Salmonella enterica enterica serovar Typhi Ty2
cgugccguccggca

SEQ ID NO: 1746061 - RNA, 23 nt, Salmonella enterica enterica serovar Typhi Ty2
cgugccggaugauguuuauccgg

SEQ ID NO: 1746062 - RNA, 13 nt, Salmonella enterica enterica serovar Typhi Ty2
cgugccuuccgca

SEQ ID NO: 1746063 - RNA, 23 nt, Salmonella enterica enterica serovar Typhi Ty2
cgugccuuccgcaauacagcccg

SEQ ID NO: 1746064 - RNA, 16 nt, Salmonella enterica enterica serovar Typhi Ty2
cgugccugcuccgcca

SEQ ID NO: 1746065 - RNA, 15 nt, Salmonella enterica enterica serovar Typhi Ty2
cgugcgccgacaucg

SEQ ID NO: 1746066 - RNA, 16 nt, Salmonella enterica enterica serovar Typhi Ty2
cguggcgcaaccgaua

SEQ ID NO: 1746067 - RNA, 18 nt, Salmonella enterica enterica serovar Typhi Ty2
aaccgcccgcggcgauca

SEQ ID NO: 1746068 - RNA, 14 nt, Salmonella enterica enterica serovar Typhi Ty2
aaccgccagucacc

SEQ ID NO: 1746069 - RNA, 20 nt, Salmonella enterica enterica serovar Typhi Ty2
cgucaccgucuuacgauccc

SEQ ID NO: 1746070 - RNA, 15 nt, Salmonella enterica enterica serovar Typhi Ty2
cgucaccauuaacau

SEQ ID NO: 1746071 - RNA, 15 nt, Salmonella enterica enterica serovar Typhi Ty2
aacccgccgccauca

SEQ ID NO: 1746072 - RNA, 23 nt, Salmonella enterica enterica serovar Typhi Ty2
cguaucucgcgguugacgcugcu

SEQ ID NO: 1746073 - RNA, 22 nt, Salmonella enterica enterica serovar Typhi Ty2
cguagugacacggucagcggcg

SEQ ID NO: 1746074 - RNA, 15 nt, Salmonella enterica enterica serovar Typhi Ty2
cguaggcgcaaaccg

SEQ ID NO: 1746075 - RNA, 13 nt, Salmonella enterica enterica serovar Typhi Ty2
cguaguacguucc

SEQ ID NO: 1746076 - RNA, 18 nt, Salmonella enterica enterica serovar Typhi Ty2
cguaggccggauaaggcg

SEQ ID NO: 1746077 - RNA, 19 nt, Salmonella enterica enterica serovar Typhi Ty2
cguaggccugauaagcgca

SEQ ID NO: 1746078 - RNA, 20 nt, Salmonella enterica enterica serovar Typhi Ty2
cguaggccugauaagacgca

SEQ ID NO: 1746079 - RNA, 20 nt, Salmonella enterica enterica serovar Typhi Ty2
cguaggccggauaagacgcg

SEQ ID NO: 1746080 - RNA, 19 nt, Salmonella enterica enterica serovar Typhi Ty2
cguaggccggauaagcgca

SEQ ID NO: 1746081 - RNA, 20 nt, Salmonella enterica enterica serovar Typhi Ty2
cguaggccgaauaagacgcu

SEQ ID NO: 1746082 - RNA, 20 nt, Salmonella enterica enterica serovar Typhi Ty2
cguagccccuaucuggugcu

SEQ ID NO: 1746083 - RNA, 17 nt, Salmonella enterica enterica serovar Typhi Ty2
aacccauauuccugcgg

SEQ ID NO: 1746084 - RNA, 15 nt, Salmonella enterica enterica serovar Typhi Ty2
aacccauauuccugc

SEQ ID NO: 1746085 - RNA, 12 nt, Salmonella enterica enterica serovar Typhi Ty2
cguagcgccaac

SEQ ID NO: 1746086 - RNA, 21 nt, Salmonella enterica enterica serovar Typhi Ty2
aacccagcaaaucgcccauca

SEQ ID NO: 1746087 - RNA, 17 nt, Salmonella enterica enterica serovar Typhi Ty2
aacccagauaucagucu

SEQ ID NO: 1746088 - RNA, 11 nt, Salmonella enterica enterica serovar Typhi Ty2
cguagcgcguu

SEQ ID NO: 1746089 - RNA, 20 nt, Salmonella enterica enterica serovar Typhi Ty2
cguagcguaaugcagcgucu

SEQ ID NO: 1746090 - RNA, 20 nt, Salmonella enterica enterica serovar Typhi Ty2
cguagcguucauucccgcca

SEQ ID NO: 1746091 - RNA, 13 nt, Salmonella enterica enterica serovar Typhi Ty2
cguacagcgccau

SEQ ID NO: 1746092 - RNA, 16 nt, Salmonella enterica enterica serovar Typhi Ty2
cguaccaucagcguca

SEQ ID NO: 1746093 - RNA, 15 nt, Salmonella enterica enterica serovar Typhi Ty2
cguaacucggcagcg

SEQ ID NO: 1746094 - RNA, 20 nt, Salmonella enterica enterica serovar Typhi Ty2
cguacguuuuuccauucaca

SEQ ID NO: 1746095 - RNA, 22 nt, Salmonella enterica enterica serovar Typhi Ty2
cguacuaaagagcgccugaccg

SEQ ID NO: 1746096 - RNA, 16 nt, Salmonella enterica enterica serovar Typhi Ty2
cguacucuaggcgcug

SEQ ID NO: 1746097 - RNA, 18 nt, Salmonella enterica enterica serovar Typhi Ty2
cguacuacguguacgcuc

SEQ ID NO: 1746098 - RNA, 14 nt, Salmonella enterica enterica serovar Typhi Ty2
cguagaagcuuacc

SEQ ID NO: 1746099 - RNA, 15 nt, Salmonella enterica enterica serovar Typhi Ty2
cguaccuccagcgac

SEQ ID NO: 1746100 - RNA, 19 nt, Salmonella enterica enterica serovar Typhi Ty2
cguaccugucguacgccua

SEQ ID NO: 1746101 - RNA, 16 nt, Salmonella enterica enterica serovar Typhi Ty2
cgguucgccgcgcgca

SEQ ID NO: 1746102 - RNA, 20 nt, Salmonella enterica enterica serovar Typhi Ty2
cgguucacggccaaagcgcg

SEQ ID NO: 1746103 - RNA, 16 nt, Salmonella enterica enterica serovar Typhi Ty2
cgguuauaccgccauc

SEQ ID NO: 1746104 - RNA, 21 nt, Salmonella enterica enterica serovar Typhi Ty2
cgguuauaccgccauccggca

SEQ ID NO: 1746105 - RNA, 15 nt, Salmonella enterica enterica serovar Typhi Ty2
cgguuaugcgauuuc

SEQ ID NO: 1746106 - RNA, 12 nt, Salmonella enterica enterica serovar Typhi Ty2
cgguuaucggca

SEQ ID NO: 1746107 - RNA, 20 nt, Salmonella enterica enterica serovar Typhi Ty2
cgguuaucgaacagcuuacc

SEQ ID NO: 1746108 - RNA, 17 nt, Salmonella enterica enterica serovar Typhi Ty2
cgguuugcgccuacgau

SEQ ID NO: 1746109 - RNA, 22 nt, Salmonella enterica enterica serovar Typhi Ty2
cgguuugcgccuacgauggcga

SEQ ID NO: 1746110 - RNA, 22 nt, Salmonella enterica enterica serovar Typhi Ty2
cguaaauuauuuuacgcgggau

SEQ ID NO: 1746111 - RNA, 16 nt, Salmonella enterica enterica serovar Typhi Ty2
cgguuucgcggcguuc

SEQ ID NO: 1746112 - RNA, 19 nt, Salmonella enterica enterica serovar Typhi Ty2
cgguuugcaggccggauaa

SEQ ID NO: 1746113 - RNA, 18 nt, Salmonella enterica enterica serovar Typhi Ty2
cgucgaggaagcugcgca

SEQ ID NO: 1746114 - RNA, 23 nt, Salmonella enterica enterica serovar Typhi Ty2
cgucgaggguagcgacugauaag

SEQ ID NO: 1746115 - RNA, 14 nt, Salmonella enterica enterica serovar Typhi Ty2
cgucgccagcgucu

SEQ ID NO: 1746116 - RNA, 20 nt, Salmonella enterica enterica serovar Typhi Ty2
cgucgcgcuuucaaucguca

SEQ ID NO: 1746117 - RNA, 13 nt, Salmonella enterica enterica serovar Typhi Ty2
cgucgacagcgcc

SEQ ID NO: 1746118 - RNA, 18 nt, Salmonella enterica enterica serovar Typhi Ty2
cgucacgcguucgaccgu

SEQ ID NO: 1746119 - RNA, 19 nt, Salmonella enterica enterica serovar Typhi Ty2
cgucacgaaugucgcguca

SEQ ID NO: 1746120 - RNA, 21 nt, Salmonella enterica enterica serovar Typhi Ty2
cgucacgaaugucgcgucagg

SEQ ID NO: 1746121 - RNA, 13 nt, Salmonella enterica enterica serovar Typhi Ty2
cgucaugccgcca

SEQ ID NO: 1746122 - RNA, 17 nt, Salmonella enterica enterica serovar Typhi Ty2
cgucaucggcgcgcugg

SEQ ID NO: 1746123 - RNA, 16 nt, Salmonella enterica enterica serovar Typhi Ty2
cgucaucgggcuguua

SEQ ID NO: 1746124 - RNA, 17 nt, Salmonella enterica enterica serovar Typhi Ty2
cgucauggcgcauuauc

SEQ ID NO: 1746125 - RNA, 21 nt, Salmonella enterica enterica serovar Typhi Ty2
cguccauuucaaugcauacug

SEQ ID NO: 1746126 - RNA, 19 nt, Salmonella enterica enterica serovar Typhi Ty2
gaugcgaccgcgccacggc

SEQ ID NO: 1746127 - RNA, 11 nt, Salmonella enterica enterica serovar Typhi Ty2
gaugccguaag

SEQ ID NO: 1746128 - RNA, 22 nt, Salmonella enterica enterica serovar Typhi Ty2
gaugaucgucgcgaucgcgcca

SEQ ID NO: 1746129 - RNA, 21 nt, Salmonella enterica enterica serovar Typhi Ty2
aacugguuaccacaauaaucg

SEQ ID NO: 1746130 - RNA, 23 nt, Salmonella enterica enterica serovar Typhi Ty2
gaugccaaacaucgcucgcgcca

SEQ ID NO: 1746131 - RNA, 15 nt, Salmonella enterica enterica serovar Typhi Ty2
gaugccccaucacgg

SEQ ID NO: 1746132 - RNA, 18 nt, Salmonella enterica enterica serovar Typhi Ty2
gaugcagcggcgacacca

SEQ ID NO: 1746133 - RNA, 14 nt, Salmonella enterica enterica serovar Typhi Ty2
gaucgccgccgaau

SEQ ID NO: 1746134 - RNA, 17 nt, Salmonella enterica enterica serovar Typhi Ty2
gaucuucaucccauccg

SEQ ID NO: 1746135 - RNA, 22 nt, Salmonella enterica enterica serovar Typhi Ty2
gaucuuagcgguuucggcaaua

SEQ ID NO: 1746136 - RNA, 16 nt, Salmonella enterica enterica serovar Typhi Ty2
gaucuuuauccugcac

SEQ ID NO: 1746137 - RNA, 21 nt, Salmonella enterica enterica serovar Typhi Ty2
gaucugacauuugcaucaaac

SEQ ID NO: 1746138 - RNA, 17 nt, Salmonella enterica enterica serovar Typhi Ty2
gaucugauacggaaaua

SEQ ID NO: 1746139 - RNA, 15 nt, Salmonella enterica enterica serovar Typhi Ty2
gaucugaucgucguu

SEQ ID NO: 1746140 - RNA, 13 nt, Salmonella enterica enterica serovar Typhi Ty2
gaugagcgcgaaa

SEQ ID NO: 1746141 - RNA, 15 nt, Salmonella enterica enterica serovar Typhi Ty2
gaugagaugucaucg

SEQ ID NO: 1746142 - RNA, 22 nt, Salmonella enterica enterica serovar Typhi Ty2
gaugacgcuucgcuuauccggc

SEQ ID NO: 1746143 - RNA, 13 nt, Salmonella enterica enterica serovar Typhi Ty2
gaugacguccaga

SEQ ID NO: 1746144 - RNA, 20 nt, Salmonella enterica enterica serovar Typhi Ty2
aacugcgaguucaccaguuu

SEQ ID NO: 1746145 - RNA, 23 nt, Salmonella enterica enterica serovar Typhi Ty2
gaugaagcugcagggauaugcug

SEQ ID NO: 1746146 - RNA, 13 nt, Salmonella enterica enterica serovar Typhi Ty2
aacuggcgcaucu

SEQ ID NO: 1746147 - RNA, 17 nt, Salmonella enterica enterica serovar Typhi Ty2
aacuggcaaucaugcgc

SEQ ID NO: 1746148 - RNA, 16 nt, Salmonella enterica enterica serovar Typhi Ty2
aacugcucguaaagca

SEQ ID NO: 1746149 - RNA, 20 nt, Salmonella enterica enterica serovar Typhi Ty2
gauucagguuuugcugauca

SEQ ID NO: 1746150 - RNA, 19 nt, Salmonella enterica enterica serovar Typhi Ty2
gauucaaccaaugcaacgc

SEQ ID NO: 1746151 - RNA, 21 nt, Salmonella enterica enterica serovar Typhi Ty2
gauuaacccggucauccagcg

SEQ ID NO: 1746152 - RNA, 20 nt, Salmonella enterica enterica serovar Typhi Ty2
gauuaacagcgccaucagga

SEQ ID NO: 1746153 - RNA, 15 nt, Salmonella enterica enterica serovar Typhi Ty2
gauuaaggcguuauc

SEQ ID NO: 1746154 - RNA, 12 nt, Salmonella enterica enterica serovar Typhi Ty2
gauguucaacgu

SEQ ID NO: 1746155 - RNA, 17 nt, Salmonella enterica enterica serovar Typhi Ty2
gauugccggaagcggac

SEQ ID NO: 1746156 - RNA, 16 nt, Salmonella enterica enterica serovar Typhi Ty2
gauucgcccacggaug

SEQ ID NO: 1746157 - RNA, 15 nt, Salmonella enterica enterica serovar Typhi Ty2
gauuuguuucaucgc

SEQ ID NO: 1746158 - RNA, 15 nt, Salmonella enterica enterica serovar Typhi Ty2
gauuuugcguuacug

SEQ ID NO: 1746159 - RNA, 22 nt, Salmonella enterica enterica serovar Typhi Ty2
gauuuagguucuggcgccgcaa

SEQ ID NO: 1746160 - RNA, 19 nt, Salmonella enterica enterica serovar Typhi Ty2
gauuucacgaucaucgcau

SEQ ID NO: 1746161 - RNA, 16 nt, Salmonella enterica enterica serovar Typhi Ty2
gauuucaucaggcuga

SEQ ID NO: 1746162 - RNA, 18 nt, Salmonella enterica enterica serovar Typhi Ty2
gcaaacguaaccggcguu

SEQ ID NO: 1746163 - RNA, 21 nt, Salmonella enterica enterica serovar Typhi Ty2
gcaaacugcucauuauggacg

SEQ ID NO: 1746164 - RNA, 23 nt, Salmonella enterica enterica serovar Typhi Ty2
gcaaacuucacauuuuuaucagc

SEQ ID NO: 1746165 - RNA, 19 nt, Salmonella enterica enterica serovar Typhi Ty2
gcaaacgccgaagccagcg

SEQ ID NO: 1746166 - RNA, 20 nt, Salmonella enterica enterica serovar Typhi Ty2
gauuuuucaucuucaguaag

SEQ ID NO: 1746167 - RNA, 19 nt, Salmonella enterica enterica serovar Typhi Ty2
gcaaaccgauaaucaccag

SEQ ID NO: 1746168 - RNA, 22 nt, Salmonella enterica enterica serovar Typhi Ty2
gauuuuuaccgccgguuuaucc

SEQ ID NO: 1746169 - RNA, 21 nt, Salmonella enterica enterica serovar Typhi Ty2
gcaacacuuugcgcugcgcau

SEQ ID NO: 1746170 - RNA, 19 nt, Salmonella enterica enterica serovar Typhi Ty2
gcaaauucgucgccgccaa

SEQ ID NO: 1746171 - RNA, 22 nt, Salmonella enterica enterica serovar Typhi Ty2
gcaaauccuccauaaauaacau

SEQ ID NO: 1746172 - RNA, 22 nt, Salmonella enterica enterica serovar Typhi Ty2
gcaaaugucagaucguaugcgc

SEQ ID NO: 1746173 - RNA, 19 nt, Salmonella enterica enterica serovar Typhi Ty2
gcaaaucugccgucaucga

SEQ ID NO: 1746174 - RNA, 23 nt, Salmonella enterica enterica serovar Typhi Ty2
gcaaaucgcgguaaaaagcugau

SEQ ID NO: 1746175 - RNA, 21 nt, Salmonella enterica enterica serovar Typhi Ty2
gcaaauacugcuuuuccggca

SEQ ID NO: 1746176 - RNA, 17 nt, Salmonella enterica enterica serovar Typhi Ty2
gcaaaucaacauuauua

SEQ ID NO: 1746177 - RNA, 13 nt, Salmonella enterica enterica serovar Typhi Ty2
gcaaaucgccauc

SEQ ID NO: 1746178 - RNA, 16 nt, Salmonella enterica enterica serovar Typhi Ty2
gcaaagacaggugacc

SEQ ID NO: 1746179 - RNA, 22 nt, Salmonella enterica enterica serovar Typhi Ty2
gcaaagaccgcgucauuaugca

SEQ ID NO: 1746180 - RNA, 15 nt, Salmonella enterica enterica serovar Typhi Ty2
aacuugauuccuggc

SEQ ID NO: 1746181 - RNA, 23 nt, Salmonella enterica enterica serovar Typhi Ty2
gauggcacugcgcuuauccggcc

SEQ ID NO: 1746182 - RNA, 17 nt, Salmonella enterica enterica serovar Typhi Ty2
gauggcaguacagggcg

SEQ ID NO: 1746183 - RNA, 13 nt, Salmonella enterica enterica serovar Typhi Ty2
gaugcgcuuuacu

SEQ ID NO: 1746184 - RNA, 14 nt, Salmonella enterica enterica serovar Typhi Ty2
gaugcgcugcuaaa

SEQ ID NO: 1746185 - RNA, 23 nt, Salmonella enterica enterica serovar Typhi Ty2
gaugucggcuuacgccuuauccg

SEQ ID NO: 1746186 - RNA, 22 nt, Salmonella enterica enterica serovar Typhi Ty2
gaugucauugacuuaucgcgcu

SEQ ID NO: 1746187 - RNA, 14 nt, Salmonella enterica enterica serovar Typhi Ty2
gauguauuuaucca

SEQ ID NO: 1746188 - RNA, 18 nt, Salmonella enterica enterica serovar Typhi Ty2
gauguaugaacugcauca

SEQ ID NO: 1746189 - RNA, 13 nt, Salmonella enterica enterica serovar Typhi Ty2
gauggucgcgcca

SEQ ID NO: 1746190 - RNA, 13 nt, Salmonella enterica enterica serovar Typhi Ty2
gauggccucauca

SEQ ID NO: 1746191 - RNA, 20 nt, Salmonella enterica enterica serovar Typhi Ty2
gauggcgcugcgcuuaccca

SEQ ID NO: 1746192 - RNA, 17 nt, Salmonella enterica enterica serovar Typhi Ty2
gauggcgcgcuuaucug

SEQ ID NO: 1746193 - RNA, 21 nt, Salmonella enterica enterica serovar Typhi Ty2
gauggcgcugccgcuuauccg

SEQ ID NO: 1746194 - RNA, 16 nt, Salmonella enterica enterica serovar Typhi Ty2
gauggcgcuaagccag

SEQ ID NO: 1746195 - RNA, 20 nt, Salmonella enterica enterica serovar Typhi Ty2
gauggcgcuucgcuuaucag

SEQ ID NO: 1746196 - RNA, 20 nt, Salmonella enterica enterica serovar Typhi Ty2
gauggcgcugcgcuuauccg

SEQ ID NO: 1746197 - RNA, 20 nt, Salmonella enterica enterica serovar Typhi Ty2
gauggcgcugcgcuuaucag

SEQ ID NO: 1746198 - RNA, 19 nt, Salmonella enterica enterica serovar Typhi Ty2
gauggcgcuucgcuuacca

SEQ ID NO: 1746199 - RNA, 22 nt, Salmonella enterica enterica serovar Typhi Ty2
gauggcggcgaugccuuauccg

SEQ ID NO: 1746200 - RNA, 22 nt, Salmonella enterica enterica serovar Typhi Ty2
gauggcuauuaccggcuggaag

SEQ ID NO: 1746201 - RNA, 23 nt, Salmonella enterica enterica serovar Typhi Ty2
gaucgacauaagaguccauucgg

SEQ ID NO: 1746202 - RNA, 18 nt, Salmonella enterica enterica serovar Typhi Ty2
gaucgacaucuucaucaa

SEQ ID NO: 1746203 - RNA, 14 nt, Salmonella enterica enterica serovar Typhi Ty2
gaucgaaucucccg

SEQ ID NO: 1746204 - RNA, 14 nt, Salmonella enterica enterica serovar Typhi Ty2
gaucgcccggauca

SEQ ID NO: 1746205 - RNA, 20 nt, Salmonella enterica enterica serovar Typhi Ty2
gaucgauaauugcucaccca

SEQ ID NO: 1746206 - RNA, 17 nt, Salmonella enterica enterica serovar Typhi Ty2
gaucgaucccggcaaaa

SEQ ID NO: 1746207 - RNA, 20 nt, Salmonella enterica enterica serovar Typhi Ty2
gauccuguucaaacaucagc

SEQ ID NO: 1746208 - RNA, 19 nt, Salmonella enterica enterica serovar Typhi Ty2
gaucgaaaaugcgcaugau

SEQ ID NO: 1746209 - RNA, 21 nt, Salmonella enterica enterica serovar Typhi Ty2
gaucaugagucgcgcgcgcca

SEQ ID NO: 1746210 - RNA, 15 nt, Salmonella enterica enterica serovar Typhi Ty2
gaucaugccgcccag

SEQ ID NO: 1746211 - RNA, 14 nt, Salmonella enterica enterica serovar Typhi Ty2
gaucauaccggcag

SEQ ID NO: 1746212 - RNA, 20 nt, Salmonella enterica enterica serovar Typhi Ty2
gaucaggcaaaaaucggccu

SEQ ID NO: 1746213 - RNA, 21 nt, Salmonella enterica enterica serovar Typhi Ty2
gaucaggcguuagccgccauc

SEQ ID NO: 1746214 - RNA, 20 nt, Salmonella enterica enterica serovar Typhi Ty2
gauaaauguuuacuucgcuu

SEQ ID NO: 1746215 - RNA, 19 nt, Salmonella enterica enterica serovar Typhi Ty2
gauaacaguauuuguucag

SEQ ID NO: 1746216 - RNA, 11 nt, Salmonella enterica enterica serovar Typhi Ty2
gauaaccagaa

SEQ ID NO: 1746217 - RNA, 19 nt, Salmonella enterica enterica serovar Typhi Ty2
gauaaccgcguucauacgc

SEQ ID NO: 1746218 - RNA, 20 nt, Salmonella enterica enterica serovar Typhi Ty2
gauaaccccguucgacaacg

SEQ ID NO: 1746219 - RNA, 23 nt, Salmonella enterica enterica serovar Typhi Ty2
gauaagcguagcgccaucaggcu

SEQ ID NO: 1746220 - RNA, 16 nt, Salmonella enterica enterica serovar Typhi Ty2
gauaagcguagcgcca

SEQ ID NO: 1746221 - RNA, 20 nt, Salmonella enterica enterica serovar Typhi Ty2
gauaagcgcagcgucaucag

SEQ ID NO: 1746222 - RNA, 23 nt, Salmonella enterica enterica serovar Typhi Ty2
gauaagcgcagcgucaucaggcc

SEQ ID NO: 1746223 - RNA, 22 nt, Salmonella enterica enterica serovar Typhi Ty2
gauaagcguagcgcauccggca

SEQ ID NO: 1746224 - RNA, 23 nt, Salmonella enterica enterica serovar Typhi Ty2
gauaagcgcagcgccauccggca

SEQ ID NO: 1746225 - RNA, 12 nt, Salmonella enterica enterica serovar Typhi Ty2
gauaacggcgca

SEQ ID NO: 1746226 - RNA, 16 nt, Salmonella enterica enterica serovar Typhi Ty2
gauaacgcgcuggcgg

SEQ ID NO: 1746227 - RNA, 15 nt, Salmonella enterica enterica serovar Typhi Ty2
gauaacgcuaugcuu

SEQ ID NO: 1746228 - RNA, 23 nt, Salmonella enterica enterica serovar Typhi Ty2
gauaagcguagcgccaucaggca

SEQ ID NO: 1746229 - RNA, 16 nt, Salmonella enterica enterica serovar Typhi Ty2
gauaaggcguucacgc

SEQ ID NO: 1746230 - RNA, 15 nt, Salmonella enterica enterica serovar Typhi Ty2
gauacagcagcaccu

SEQ ID NO: 1746231 - RNA, 23 nt, Salmonella enterica enterica serovar Typhi Ty2
gauaagcgugagcgcauccggca

SEQ ID NO: 1746232 - RNA, 17 nt, Salmonella enterica enterica serovar Typhi Ty2
gauacggcuccagcaca

SEQ ID NO: 1746233 - RNA, 18 nt, Salmonella enterica enterica serovar Typhi Ty2
gauacggcgagaccauau

SEQ ID NO: 1746234 - RNA, 18 nt, Salmonella enterica enterica serovar Typhi Ty2
gauacgggaagucauuag

SEQ ID NO: 1746235 - RNA, 18 nt, Salmonella enterica enterica serovar Typhi Ty2
gauacggaaauagcgcca

SEQ ID NO: 1746236 - RNA, 14 nt, Salmonella enterica enterica serovar Typhi Ty2
gauacguucauccu

SEQ ID NO: 1746237 - RNA, 20 nt, Salmonella enterica enterica serovar Typhi Ty2
gauaucauucucuacgccca

SEQ ID NO: 1746238 - RNA, 16 nt, Salmonella enterica enterica serovar Typhi Ty2
gauaucaaugcgcgua

SEQ ID NO: 1746239 - RNA, 13 nt, Salmonella enterica enterica serovar Typhi Ty2
gauauccagcaua

SEQ ID NO: 1746240 - RNA, 16 nt, Salmonella enterica enterica serovar Typhi Ty2
gauaucaaacacaaau

SEQ ID NO: 1746241 - RNA, 12 nt, Salmonella enterica enterica serovar Typhi Ty2
gauauagcgcca

SEQ ID NO: 1746242 - RNA, 17 nt, Salmonella enterica enterica serovar Typhi Ty2
gauauaggguggucacg

SEQ ID NO: 1746243 - RNA, 14 nt, Salmonella enterica enterica serovar Typhi Ty2
gauagcgucaacgc

SEQ ID NO: 1746244 - RNA, 17 nt, Salmonella enterica enterica serovar Typhi Ty2
gauagcgggcaaugcca

SEQ ID NO: 1746245 - RNA, 19 nt, Salmonella enterica enterica serovar Typhi Ty2
gauaguguaaacgcgccau

SEQ ID NO: 1746246 - RNA, 16 nt, Salmonella enterica enterica serovar Typhi Ty2
gauauaaaacgggcca

SEQ ID NO: 1746247 - RNA, 14 nt, Salmonella enterica enterica serovar Typhi Ty2
gauagcgcuuucca

SEQ ID NO: 1746248 - RNA, 15 nt, Salmonella enterica enterica serovar Typhi Ty2
gaucagcacgcgccg

SEQ ID NO: 1746249 - RNA, 20 nt, Salmonella enterica enterica serovar Typhi Ty2
gagcgaacaguacggucagg

SEQ ID NO: 1746250 - RNA, 13 nt, Salmonella enterica enterica serovar Typhi Ty2
gagcgcguccaga

SEQ ID NO: 1746251 - RNA, 13 nt, Salmonella enterica enterica serovar Typhi Ty2
gagcggaacgcgu

SEQ ID NO: 1746252 - RNA, 23 nt, Salmonella enterica enterica serovar Typhi Ty2
gagccucugcgggacgcaucauc

SEQ ID NO: 1746253 - RNA, 18 nt, Salmonella enterica enterica serovar Typhi Ty2
gacguaacugucuuaucc

SEQ ID NO: 1746254 - RNA, 18 nt, Salmonella enterica enterica serovar Typhi Ty2
aacucucccacuuugcuc

SEQ ID NO: 1746255 - RNA, 21 nt, Salmonella enterica enterica serovar Typhi Ty2
gagcggcuacgccugauaagc

SEQ ID NO: 1746256 - RNA, 14 nt, Salmonella enterica enterica serovar Typhi Ty2
gagcggcucaucca

SEQ ID NO: 1746257 - RNA, 18 nt, Salmonella enterica enterica serovar Typhi Ty2
aacugcaaaucuucggca

SEQ ID NO: 1746258 - RNA, 19 nt, Salmonella enterica enterica serovar Typhi Ty2
aacugcauaucgccgcuuu

SEQ ID NO: 1746259 - RNA, 16 nt, Salmonella enterica enterica serovar Typhi Ty2
gagcgguaagagccag

SEQ ID NO: 1746260 - RNA, 14 nt, Salmonella enterica enterica serovar Typhi Ty2
gagcgggccgucag

SEQ ID NO: 1746261 - RNA, 12 nt, Salmonella enterica enterica serovar Typhi Ty2
gagcucagucca

SEQ ID NO: 1746262 - RNA, 16 nt, Salmonella enterica enterica serovar Typhi Ty2
gagcucuaccagacca

SEQ ID NO: 1746263 - RNA, 23 nt, Salmonella enterica enterica serovar Typhi Ty2
gaggcaucgcccuguaagaggca

SEQ ID NO: 1746264 - RNA, 23 nt, Salmonella enterica enterica serovar Typhi Ty2
gaggcagugaaauccucuaucca

SEQ ID NO: 1746265 - RNA, 17 nt, Salmonella enterica enterica serovar Typhi Ty2
gaggauaaaaucgccaa

SEQ ID NO: 1746266 - RNA, 15 nt, Salmonella enterica enterica serovar Typhi Ty2
gaguaaaaccggcac

SEQ ID NO: 1746267 - RNA, 18 nt, Salmonella enterica enterica serovar Typhi Ty2
gagguuuucucauccagc

SEQ ID NO: 1746268 - RNA, 13 nt, Salmonella enterica enterica serovar Typhi Ty2
gaggguguucacg

SEQ ID NO: 1746269 - RNA, 23 nt, Salmonella enterica enterica serovar Typhi Ty2
gaggcuaccguucagaucgccaa

SEQ ID NO: 1746270 - RNA, 19 nt, Salmonella enterica enterica serovar Typhi Ty2
gaggcuauugaaaaugcgg

SEQ ID NO: 1746271 - RNA, 15 nt, Salmonella enterica enterica serovar Typhi Ty2
gcagggcaugauuac

SEQ ID NO: 1746272 - RNA, 19 nt, Salmonella enterica enterica serovar Typhi Ty2
gcagggucaggaacugcgg

SEQ ID NO: 1746273 - RNA, 16 nt, Salmonella enterica enterica serovar Typhi Ty2
gcagguaguugucggc

SEQ ID NO: 1746274 - RNA, 19 nt, Salmonella enterica enterica serovar Typhi Ty2
gcagguaucguauccgguc

SEQ ID NO: 1746275 - RNA, 15 nt, Salmonella enterica enterica serovar Typhi Ty2
gcaggguguaaucgc

SEQ ID NO: 1746276 - RNA, 21 nt, Salmonella enterica enterica serovar Typhi Ty2
gcaguacgcgcaaccgcauca

SEQ ID NO: 1746277 - RNA, 13 nt, Salmonella enterica enterica serovar Typhi Ty2
gcaguacggcgca

SEQ ID NO: 1746278 - RNA, 14 nt, Salmonella enterica enterica serovar Typhi Ty2
gcaguaacgcauac

SEQ ID NO: 1746279 - RNA, 22 nt, Salmonella enterica enterica serovar Typhi Ty2
gcaguaaacuccucuuccgaca

SEQ ID NO: 1746280 - RNA, 18 nt, Salmonella enterica enterica serovar Typhi Ty2
gcaggcgggugcgcagcc

SEQ ID NO: 1746281 - RNA, 15 nt, Salmonella enterica enterica serovar Typhi Ty2
gcaggcgacuggcgu

SEQ ID NO: 1746282 - RNA, 20 nt, Salmonella enterica enterica serovar Typhi Ty2
gcaggccggauaaggcauuu

SEQ ID NO: 1746283 - RNA, 15 nt, Salmonella enterica enterica serovar Typhi Ty2
gcaggccggagcuga

SEQ ID NO: 1746284 - RNA, 13 nt, Salmonella enterica enterica serovar Typhi Ty2
gcagccgcugaua

SEQ ID NO: 1746285 - RNA, 15 nt, Salmonella enterica enterica serovar Typhi Ty2
gcagcaccgccgcga

SEQ ID NO: 1746286 - RNA, 14 nt, Salmonella enterica enterica serovar Typhi Ty2
gcagcgauauagcg

SEQ ID NO: 1746287 - RNA, 13 nt, Salmonella enterica enterica serovar Typhi Ty2
gcagcggcgguua

SEQ ID NO: 1746288 - RNA, 18 nt, Salmonella enterica enterica serovar Typhi Ty2
gcagcgcugagucauccu

SEQ ID NO: 1746289 - RNA, 19 nt, Salmonella enterica enterica serovar Typhi Ty2
gcagcgcgggaucgagcgc

SEQ ID NO: 1746290 - RNA, 15 nt, Salmonella enterica enterica serovar Typhi Ty2
gcagcuucagcauca

SEQ ID NO: 1746291 - RNA, 17 nt, Salmonella enterica enterica serovar Typhi Ty2
gcagcuucagcaucauc

SEQ ID NO: 1746292 - RNA, 18 nt, Salmonella enterica enterica serovar Typhi Ty2
gcagcuugguagcgcaac

SEQ ID NO: 1746293 - RNA, 22 nt, Salmonella enterica enterica serovar Typhi Ty2
gcagcucugccuguagcagcgc

SEQ ID NO: 1746294 - RNA, 15 nt, Salmonella enterica enterica serovar Typhi Ty2
gcaggacaaccccua

SEQ ID NO: 1746295 - RNA, 14 nt, Salmonella enterica enterica serovar Typhi Ty2
gcaggacagcgaca

SEQ ID NO: 1746296 - RNA, 18 nt, Salmonella enterica enterica serovar Typhi Ty2
gcaggaaggcgugcagcg

SEQ ID NO: 1746297 - RNA, 17 nt, Salmonella enterica enterica serovar Typhi Ty2
gcagcuuuugccugcgu

SEQ ID NO: 1746298 - RNA, 16 nt, Salmonella enterica enterica serovar Typhi Ty2
gcagcguaauacaggc

SEQ ID NO: 1746299 - RNA, 21 nt, Salmonella enterica enterica serovar Typhi Ty2
gcacuacggcaaacgcuggug

SEQ ID NO: 1746300 - RNA, 17 nt, Salmonella enterica enterica serovar Typhi Ty2
gcacuacggcaaacgcu

SEQ ID NO: 1746301 - RNA, 19 nt, Salmonella enterica enterica serovar Typhi Ty2
gcacuucacccaucgccag

SEQ ID NO: 1746302 - RNA, 14 nt, Salmonella enterica enterica serovar Typhi Ty2
gcacuucucgcgca

SEQ ID NO: 1746303 - RNA, 18 nt, Salmonella enterica enterica serovar Typhi Ty2
gcacuuuaagcggcagcu

SEQ ID NO: 1746304 - RNA, 16 nt, Salmonella enterica enterica serovar Typhi Ty2
gcacuuucagaccacu

SEQ ID NO: 1746305 - RNA, 22 nt, Salmonella enterica enterica serovar Typhi Ty2
gcagaacaaacagaccgccaug

SEQ ID NO: 1746306 - RNA, 15 nt, Salmonella enterica enterica serovar Typhi Ty2
gcacuuuucccgcca

SEQ ID NO: 1746307 - RNA, 20 nt, Salmonella enterica enterica serovar Typhi Ty2
gcagacaauuuccgccgcca

SEQ ID NO: 1746308 - RNA, 16 nt, Salmonella enterica enterica serovar Typhi Ty2
gcagacaauaaacggu

SEQ ID NO: 1746309 - RNA, 18 nt, Salmonella enterica enterica serovar Typhi Ty2
gcagacagccgaucaggc

SEQ ID NO: 1746310 - RNA, 14 nt, Salmonella enterica enterica serovar Typhi Ty2
gcagacauucgcgc

SEQ ID NO: 1746311 - RNA, 13 nt, Salmonella enterica enterica serovar Typhi Ty2
aacuuucagaaua

SEQ ID NO: 1746312 - RNA, 14 nt, Salmonella enterica enterica serovar Typhi Ty2
gcagauacgcguca

SEQ ID NO: 1746313 - RNA, 16 nt, Salmonella enterica enterica serovar Typhi Ty2
gcagauuuuuauccgu

SEQ ID NO: 1746314 - RNA, 16 nt, Salmonella enterica enterica serovar Typhi Ty2
gcagcaaacgccauag

SEQ ID NO: 1746315 - RNA, 21 nt, Salmonella enterica enterica serovar Typhi Ty2
gcagauuccgaacucaugccg

SEQ ID NO: 1746316 - RNA, 17 nt, Salmonella enterica enterica serovar Typhi Ty2
gcagcaagaauaccacu

SEQ ID NO: 1746317 - RNA, 16 nt, Salmonella enterica enterica serovar Typhi Ty2
gcagcaaugugcgcca

SEQ ID NO: 1746318 - RNA, 23 nt, Salmonella enterica enterica serovar Typhi Ty2
gcacgguuaaugaaaucgucgcc

SEQ ID NO: 1746319 - RNA, 23 nt, Salmonella enterica enterica serovar Typhi Ty2
gcacguaguaaugcauggucgcc

SEQ ID NO: 1746320 - RNA, 18 nt, Salmonella enterica enterica serovar Typhi Ty2
gcacguccagauacgcgc

SEQ ID NO: 1746321 - RNA, 17 nt, Salmonella enterica enterica serovar Typhi Ty2
gcacgcccgcauucaua

SEQ ID NO: 1746322 - RNA, 20 nt, Salmonella enterica enterica serovar Typhi Ty2
gcacgcgccgaaugcguuuu

SEQ ID NO: 1746323 - RNA, 19 nt, Salmonella enterica enterica serovar Typhi Ty2
gcacgcgccgaaugcguuu

SEQ ID NO: 1746324 - RNA, 20 nt, Salmonella enterica enterica serovar Typhi Ty2
gcaccugggaaucgugcaau

SEQ ID NO: 1746325 - RNA, 13 nt, Salmonella enterica enterica serovar Typhi Ty2
gcaccugggcaau

SEQ ID NO: 1746326 - RNA, 14 nt, Salmonella enterica enterica serovar Typhi Ty2
gcaccauucuucaa

SEQ ID NO: 1746327 - RNA, 15 nt, Salmonella enterica enterica serovar Typhi Ty2
gcaccagcagguggu

SEQ ID NO: 1746328 - RNA, 17 nt, Salmonella enterica enterica serovar Typhi Ty2
gcaccggaaccggcauc

SEQ ID NO: 1746329 - RNA, 17 nt, Salmonella enterica enterica serovar Typhi Ty2
gcaccacgcaaaccgcu

SEQ ID NO: 1746330 - RNA, 15 nt, Salmonella enterica enterica serovar Typhi Ty2
gcaccaccaggaacg

SEQ ID NO: 1746331 - RNA, 20 nt, Salmonella enterica enterica serovar Typhi Ty2
gcaccaccaggaacgccaua

SEQ ID NO: 1746332 - RNA, 13 nt, Salmonella enterica enterica serovar Typhi Ty2
gcaccaccugguu

SEQ ID NO: 1746333 - RNA, 23 nt, Salmonella enterica enterica serovar Typhi Ty2
gcacauccucaaugguuucacgc

SEQ ID NO: 1746334 - RNA, 12 nt, Salmonella enterica enterica serovar Typhi Ty2
gcacaucagcaa

SEQ ID NO: 1746335 - RNA, 15 nt, Salmonella enterica enterica serovar Typhi Ty2
gcacauauuccggcg

SEQ ID NO: 1746336 - RNA, 15 nt, Salmonella enterica enterica serovar Typhi Ty2
gcacauuuacgccag

SEQ ID NO: 1746337 - RNA, 20 nt, Salmonella enterica enterica serovar Typhi Ty2
gcacagcgcuaucaggcacu

SEQ ID NO: 1746338 - RNA, 20 nt, Salmonella enterica enterica serovar Typhi Ty2
gcacagcccuaccgccacca

SEQ ID NO: 1746339 - RNA, 22 nt, Salmonella enterica enterica serovar Typhi Ty2
gcacaggcgcggagacgugacc

SEQ ID NO: 1746340 - RNA, 16 nt, Salmonella enterica enterica serovar Typhi Ty2
gcacagguacaggccg

SEQ ID NO: 1746341 - RNA, 14 nt, Salmonella enterica enterica serovar Typhi Ty2
gcacaguacgcccg

SEQ ID NO: 1746342 - RNA, 21 nt, Salmonella enterica enterica serovar Typhi Ty2
gcacagccaguaagaacgaga

SEQ ID NO: 1746343 - RNA, 17 nt, Salmonella enterica enterica serovar Typhi Ty2
gcaauugccgauaucaa

SEQ ID NO: 1746344 - RNA, 17 nt, Salmonella enterica enterica serovar Typhi Ty2
gcaauuguuccugcguc

SEQ ID NO: 1746345 - RNA, 17 nt, Salmonella enterica enterica serovar Typhi Ty2
gcaauuugauagcgcca

SEQ ID NO: 1746346 - RNA, 22 nt, Salmonella enterica enterica serovar Typhi Ty2
gcaauuugguuagggaucaucu

SEQ ID NO: 1746347 - RNA, 12 nt, Salmonella enterica enterica serovar Typhi Ty2
gcacacaggccg

SEQ ID NO: 1746348 - RNA, 13 nt, Salmonella enterica enterica serovar Typhi Ty2
gcacaaucgccag

SEQ ID NO: 1746349 - RNA, 12 nt, Salmonella enterica enterica serovar Typhi Ty2
gcacacagcgcu

SEQ ID NO: 1746350 - RNA, 17 nt, Salmonella enterica enterica serovar Typhi Ty2
gcacaaugcccggcaua

SEQ ID NO: 1746351 - RNA, 19 nt, Salmonella enterica enterica serovar Typhi Ty2
aagaugugccacuccgcca

SEQ ID NO: 1746352 - RNA, 19 nt, Salmonella enterica enterica serovar Typhi Ty2
aagauuagccccagcgcca

SEQ ID NO: 1746353 - RNA, 12 nt, Salmonella enterica enterica serovar Typhi Ty2
gccgacggcgcu

SEQ ID NO: 1746354 - RNA, 16 nt, Salmonella enterica enterica serovar Typhi Ty2
gccgagggcauugaug

SEQ ID NO: 1746355 - RNA, 15 nt, Salmonella enterica enterica serovar Typhi Ty2
gccgaggugguggaa

SEQ ID NO: 1746356 - RNA, 17 nt, Salmonella enterica enterica serovar Typhi Ty2
gccgaucaccagcgcau

SEQ ID NO: 1746357 - RNA, 12 nt, Salmonella enterica enterica serovar Typhi Ty2
gccgaugccugc

SEQ ID NO: 1746358 - RNA, 15 nt, Salmonella enterica enterica serovar Typhi Ty2
gccgaugagcugaug

SEQ ID NO: 1746359 - RNA, 12 nt, Salmonella enterica enterica serovar Typhi Ty2
gccgcagcgccg

SEQ ID NO: 1746360 - RNA, 21 nt, Salmonella enterica enterica serovar Typhi Ty2
gccgcauccccauagacagua

SEQ ID NO: 1746361 - RNA, 14 nt, Salmonella enterica enterica serovar Typhi Ty2
gccgcauccccaua

SEQ ID NO: 1746362 - RNA, 14 nt, Salmonella enterica enterica serovar Typhi Ty2
gccgcaucgccaua

SEQ ID NO: 1746363 - RNA, 21 nt, Salmonella enterica enterica serovar Typhi Ty2
gccgaugcugaauagccagcc

SEQ ID NO: 1746364 - RNA, 17 nt, Salmonella enterica enterica serovar Typhi Ty2
aagcaccgccagcgccg

SEQ ID NO: 1746365 - RNA, 14 nt, Salmonella enterica enterica serovar Typhi Ty2
aagcaccgccagcg

SEQ ID NO: 1746366 - RNA, 15 nt, Salmonella enterica enterica serovar Typhi Ty2
gccgcacgcaccgua

SEQ ID NO: 1746367 - RNA, 22 nt, Salmonella enterica enterica serovar Typhi Ty2
aagcacuucucgcgcaucagga

SEQ ID NO: 1746368 - RNA, 17 nt, Salmonella enterica enterica serovar Typhi Ty2
gcccuuccgucagcguc

SEQ ID NO: 1746369 - RNA, 14 nt, Salmonella enterica enterica serovar Typhi Ty2
gcccuuccagcagc

SEQ ID NO: 1746370 - RNA, 15 nt, Salmonella enterica enterica serovar Typhi Ty2
gcccuuccagcagcc

SEQ ID NO: 1746371 - RNA, 13 nt, Salmonella enterica enterica serovar Typhi Ty2
gcccuggguugcc

SEQ ID NO: 1746372 - RNA, 20 nt, Salmonella enterica enterica serovar Typhi Ty2
gcccucuucuucuuccguca

SEQ ID NO: 1746373 - RNA, 16 nt, Salmonella enterica enterica serovar Typhi Ty2
gcccucuuuuagcaau

SEQ ID NO: 1746374 - RNA, 17 nt, Salmonella enterica enterica serovar Typhi Ty2
gcccugauggcgcgcca

SEQ ID NO: 1746375 - RNA, 20 nt, Salmonella enterica enterica serovar Typhi Ty2
gcccugagcccacagcggau

SEQ ID NO: 1746376 - RNA, 21 nt, Salmonella enterica enterica serovar Typhi Ty2
gcccucgggucgaauuccagu

SEQ ID NO: 1746377 - RNA, 15 nt, Salmonella enterica enterica serovar Typhi Ty2
gcccgcucgcuaccu

SEQ ID NO: 1746378 - RNA, 13 nt, Salmonella enterica enterica serovar Typhi Ty2
gccgacaucgcca

SEQ ID NO: 1746379 - RNA, 15 nt, Salmonella enterica enterica serovar Typhi Ty2
gccgaccagcgucuu

SEQ ID NO: 1746380 - RNA, 19 nt, Salmonella enterica enterica serovar Typhi Ty2
gccgacaugcuccugcauc

SEQ ID NO: 1746381 - RNA, 19 nt, Salmonella enterica enterica serovar Typhi Ty2
gccgaauauugcgccacgc

SEQ ID NO: 1746382 - RNA, 17 nt, Salmonella enterica enterica serovar Typhi Ty2
gccgaaggaagauagcg

SEQ ID NO: 1746383 - RNA, 15 nt, Salmonella enterica enterica serovar Typhi Ty2
gcccuuucagagcgu

SEQ ID NO: 1746384 - RNA, 15 nt, Salmonella enterica enterica serovar Typhi Ty2
gccgccuaucgccag

SEQ ID NO: 1746385 - RNA, 20 nt, Salmonella enterica enterica serovar Typhi Ty2
gccgccucccccucaaucgg

SEQ ID NO: 1746386 - RNA, 16 nt, Salmonella enterica enterica serovar Typhi Ty2
gccgccuggcgcgacu

SEQ ID NO: 1746387 - RNA, 22 nt, Salmonella enterica enterica serovar Typhi Ty2
gccgcgaauaaaggcgcuguug

SEQ ID NO: 1746388 - RNA, 22 nt, Salmonella enterica enterica serovar Typhi Ty2
gccgcgaagcguuccgccacua

SEQ ID NO: 1746389 - RNA, 14 nt, Salmonella enterica enterica serovar Typhi Ty2
gccgcgcaagcgau

SEQ ID NO: 1746390 - RNA, 20 nt, Salmonella enterica enterica serovar Typhi Ty2
gccgcgcaguuucuuaccua

SEQ ID NO: 1746391 - RNA, 19 nt, Salmonella enterica enterica serovar Typhi Ty2
gccgccagauuauccaguc

SEQ ID NO: 1746392 - RNA, 19 nt, Salmonella enterica enterica serovar Typhi Ty2
gccgccguagaacgggccg

SEQ ID NO: 1746393 - RNA, 17 nt, Salmonella enterica enterica serovar Typhi Ty2
gccgccgucaucugcgc

SEQ ID NO: 1746394 - RNA, 19 nt, Salmonella enterica enterica serovar Typhi Ty2
gccgcgcgaucaaucacgc

SEQ ID NO: 1746395 - RNA, 16 nt, Salmonella enterica enterica serovar Typhi Ty2
gccgcgcccugcggaa

SEQ ID NO: 1746396 - RNA, 12 nt, Salmonella enterica enterica serovar Typhi Ty2
gccgcgcugauc

SEQ ID NO: 1746397 - RNA, 16 nt, Salmonella enterica enterica serovar Typhi Ty2
gccgcucgccugcgcu

SEQ ID NO: 1746398 - RNA, 19 nt, Salmonella enterica enterica serovar Typhi Ty2
gccgcucaucaccagcagc

SEQ ID NO: 1746399 - RNA, 13 nt, Salmonella enterica enterica serovar Typhi Ty2
gccgcucacguuc

SEQ ID NO: 1746400 - RNA, 23 nt, Salmonella enterica enterica serovar Typhi Ty2
gccgcuaugacgaagcugaguau

SEQ ID NO: 1746401 - RNA, 14 nt, Salmonella enterica enterica serovar Typhi Ty2
gccgcuauccucgc

SEQ ID NO: 1746402 - RNA, 18 nt, Salmonella enterica enterica serovar Typhi Ty2
gccgcuacugccgccauc

SEQ ID NO: 1746403 - RNA, 19 nt, Salmonella enterica enterica serovar Typhi Ty2
gccgcuaaaacacccgcaa

SEQ ID NO: 1746404 - RNA, 23 nt, Salmonella enterica enterica serovar Typhi Ty2
gccccucgucuucgaccgccaua

SEQ ID NO: 1746405 - RNA, 16 nt, Salmonella enterica enterica serovar Typhi Ty2
gcccgauaaaucgcau

SEQ ID NO: 1746406 - RNA, 18 nt, Salmonella enterica enterica serovar Typhi Ty2
gcccgauacccgcccaga

SEQ ID NO: 1746407 - RNA, 23 nt, Salmonella enterica enterica serovar Typhi Ty2
gcccgauagugcaagcucaucgg

SEQ ID NO: 1746408 - RNA, 15 nt, Salmonella enterica enterica serovar Typhi Ty2
gcccgauggcgcugc

SEQ ID NO: 1746409 - RNA, 17 nt, Salmonella enterica enterica serovar Typhi Ty2
gcccgcuaacggcacca

SEQ ID NO: 1746410 - RNA, 15 nt, Salmonella enterica enterica serovar Typhi Ty2
gccccgacaucagau

SEQ ID NO: 1746411 - RNA, 17 nt, Salmonella enterica enterica serovar Typhi Ty2
gcccaucagcaucccac

SEQ ID NO: 1746412 - RNA, 12 nt, Salmonella enterica enterica serovar Typhi Ty2
gcccaucagcgc

SEQ ID NO: 1746413 - RNA, 20 nt, Salmonella enterica enterica serovar Typhi Ty2
gcccauaccccacgccauaa

SEQ ID NO: 1746414 - RNA, 21 nt, Salmonella enterica enterica serovar Typhi Ty2
gccccagcauauuuuccggcg

SEQ ID NO: 1746415 - RNA, 23 nt, Salmonella enterica enterica serovar Typhi Ty2
gcccagcgccgugucaucauuac

SEQ ID NO: 1746416 - RNA, 16 nt, Salmonella enterica enterica serovar Typhi Ty2
gcccagcgccgucaua

SEQ ID NO: 1746417 - RNA, 19 nt, Salmonella enterica enterica serovar Typhi Ty2
gcccagcgcgaccugcauc

SEQ ID NO: 1746418 - RNA, 16 nt, Salmonella enterica enterica serovar Typhi Ty2
gcccagcccggaaaua

SEQ ID NO: 1746419 - RNA, 16 nt, Salmonella enterica enterica serovar Typhi Ty2
gcccaggcaucgacgc

SEQ ID NO: 1746420 - RNA, 15 nt, Salmonella enterica enterica serovar Typhi Ty2
gcccaccuucgcgga

SEQ ID NO: 1746421 - RNA, 20 nt, Salmonella enterica enterica serovar Typhi Ty2
gcccacggaugaucuucaua

SEQ ID NO: 1746422 - RNA, 12 nt, Salmonella enterica enterica serovar Typhi Ty2
gcccacgcccag

SEQ ID NO: 1746423 - RNA, 22 nt, Salmonella enterica enterica serovar Typhi Ty2
gcccacuccggcgugaacgccu

SEQ ID NO: 1746424 - RNA, 13 nt, Salmonella enterica enterica serovar Typhi Ty2
gccauuuacgcca

SEQ ID NO: 1746425 - RNA, 19 nt, Salmonella enterica enterica serovar Typhi Ty2
gccauuguucgcgcgucca

SEQ ID NO: 1746426 - RNA, 19 nt, Salmonella enterica enterica serovar Typhi Ty2
gccauuggcgauaaaguca

SEQ ID NO: 1746427 - RNA, 17 nt, Salmonella enterica enterica serovar Typhi Ty2
gccauugccgcgccgac

SEQ ID NO: 1746428 - RNA, 17 nt, Salmonella enterica enterica serovar Typhi Ty2
gccauuccaagaaugaa

SEQ ID NO: 1746429 - RNA, 22 nt, Salmonella enterica enterica serovar Typhi Ty2
aagaccagauuaaucagcagau

SEQ ID NO: 1746430 - RNA, 16 nt, Salmonella enterica enterica serovar Typhi Ty2
aagaccgacaucgcca

SEQ ID NO: 1746431 - RNA, 19 nt, Salmonella enterica enterica serovar Typhi Ty2
gccaugaugagcgccauau

SEQ ID NO: 1746432 - RNA, 20 nt, Salmonella enterica enterica serovar Typhi Ty2
aagacagcaggcuuugcugc

SEQ ID NO: 1746433 - RNA, 19 nt, Salmonella enterica enterica serovar Typhi Ty2
gccaugcuauucagcaguu

SEQ ID NO: 1746434 - RNA, 21 nt, Salmonella enterica enterica serovar Typhi Ty2
gccaugauucaucccgcugug

SEQ ID NO: 1746435 - RNA, 12 nt, Salmonella enterica enterica serovar Typhi Ty2
gcccaccgccaa

SEQ ID NO: 1746436 - RNA, 18 nt, Salmonella enterica enterica serovar Typhi Ty2
gcccaccgccaaccgccc

SEQ ID NO: 1746437 - RNA, 19 nt, Salmonella enterica enterica serovar Typhi Ty2
gcccaccggcgagcgcgau

SEQ ID NO: 1746438 - RNA, 20 nt, Salmonella enterica enterica serovar Typhi Ty2
gcccacccagcuugcauggc

SEQ ID NO: 1746439 - RNA, 19 nt, Salmonella enterica enterica serovar Typhi Ty2
gcccaacggaugcgccauc

SEQ ID NO: 1746440 - RNA, 19 nt, Salmonella enterica enterica serovar Typhi Ty2
gcccaacaucaguucagaa

SEQ ID NO: 1746441 - RNA, 16 nt, Salmonella enterica enterica serovar Typhi Ty2
gcccaaccugcgcaga

SEQ ID NO: 1746442 - RNA, 17 nt, Salmonella enterica enterica serovar Typhi Ty2
gcccacaaccgacgcac

SEQ ID NO: 1746443 - RNA, 14 nt, Salmonella enterica enterica serovar Typhi Ty2
gcccaauacgccag

SEQ ID NO: 1746444 - RNA, 21 nt, Salmonella enterica enterica serovar Typhi Ty2
gccacccggcuuuuuauuuac

SEQ ID NO: 1746445 - RNA, 22 nt, Salmonella enterica enterica serovar Typhi Ty2
gccaccgggcagugcaacggcu

SEQ ID NO: 1746446 - RNA, 21 nt, Salmonella enterica enterica serovar Typhi Ty2
gccaccggguuaaagcccuga

SEQ ID NO: 1746447 - RNA, 20 nt, Salmonella enterica enterica serovar Typhi Ty2
gccacguucuuccagaacgc

SEQ ID NO: 1746448 - RNA, 18 nt, Salmonella enterica enterica serovar Typhi Ty2
gccacgcggcaucaggca

SEQ ID NO: 1746449 - RNA, 14 nt, Salmonella enterica enterica serovar Typhi Ty2
gccacgccgccauc

SEQ ID NO: 1746450 - RNA, 16 nt, Salmonella enterica enterica serovar Typhi Ty2
gccacccaaugauccg

SEQ ID NO: 1746451 - RNA, 15 nt, Salmonella enterica enterica serovar Typhi Ty2
gccaccagcgccaua

SEQ ID NO: 1746452 - RNA, 21 nt, Salmonella enterica enterica serovar Typhi Ty2
gccaccagcgccagcggcugc

SEQ ID NO: 1746453 - RNA, 18 nt, Salmonella enterica enterica serovar Typhi Ty2
gccaccagcacagcccag

SEQ ID NO: 1746454 - RNA, 16 nt, Salmonella enterica enterica serovar Typhi Ty2
gccaccagcguaccgg

SEQ ID NO: 1746455 - RNA, 19 nt, Salmonella enterica enterica serovar Typhi Ty2
gccaccacagucaucgcgc

SEQ ID NO: 1746456 - RNA, 16 nt, Salmonella enterica enterica serovar Typhi Ty2
gccaauuccgccauaa

SEQ ID NO: 1746457 - RNA, 13 nt, Salmonella enterica enterica serovar Typhi Ty2
gccacagcggaau

SEQ ID NO: 1746458 - RNA, 14 nt, Salmonella enterica enterica serovar Typhi Ty2
gcaguccguccaga

SEQ ID NO: 1746459 - RNA, 15 nt, Salmonella enterica enterica serovar Typhi Ty2
gcagucccaaugcgg

SEQ ID NO: 1746460 - RNA, 22 nt, Salmonella enterica enterica serovar Typhi Ty2
gccaagaaugaaacaagcggcg

SEQ ID NO: 1746461 - RNA, 23 nt, Salmonella enterica enterica serovar Typhi Ty2
gcagugacauuuaucuuccggca

SEQ ID NO: 1746462 - RNA, 17 nt, Salmonella enterica enterica serovar Typhi Ty2
gcagucuggcggcagcc

SEQ ID NO: 1746463 - RNA, 17 nt, Salmonella enterica enterica serovar Typhi Ty2
gccagguuuucaggccg

SEQ ID NO: 1746464 - RNA, 22 nt, Salmonella enterica enterica serovar Typhi Ty2
gccaguaaucccggucgcgcca

SEQ ID NO: 1746465 - RNA, 20 nt, Salmonella enterica enterica serovar Typhi Ty2
gccaguaacucaucgccagc

SEQ ID NO: 1746466 - RNA, 23 nt, Salmonella enterica enterica serovar Typhi Ty2
gccaguccgguggcgaaaacgcu

SEQ ID NO: 1746467 - RNA, 19 nt, Salmonella enterica enterica serovar Typhi Ty2
gccagccgauuuuucggca

SEQ ID NO: 1746468 - RNA, 16 nt, Salmonella enterica enterica serovar Typhi Ty2
gccagccguaacgagu

SEQ ID NO: 1746469 - RNA, 13 nt, Salmonella enterica enterica serovar Typhi Ty2
gccagcggcgcca

SEQ ID NO: 1746470 - RNA, 22 nt, Salmonella enterica enterica serovar Typhi Ty2
gccagcaaaaucaccaucacga

SEQ ID NO: 1746471 - RNA, 22 nt, Salmonella enterica enterica serovar Typhi Ty2
gccagauuaucggccagcgcca

SEQ ID NO: 1746472 - RNA, 16 nt, Salmonella enterica enterica serovar Typhi Ty2
gccagcaacgcgcuaa

SEQ ID NO: 1746473 - RNA, 18 nt, Salmonella enterica enterica serovar Typhi Ty2
gccacuuuuccggcaccu

SEQ ID NO: 1746474 - RNA, 19 nt, Salmonella enterica enterica serovar Typhi Ty2
gccagcaucggcagcgcca

SEQ ID NO: 1746475 - RNA, 14 nt, Salmonella enterica enterica serovar Typhi Ty2
acugccgcccaucg

SEQ ID NO: 1746476 - RNA, 20 nt, Salmonella enterica enterica serovar Typhi Ty2
acugcgcccgcucugcgcca

SEQ ID NO: 1746477 - RNA, 16 nt, Salmonella enterica enterica serovar Typhi Ty2
acugcgccauuaacgc

SEQ ID NO: 1746478 - RNA, 18 nt, Salmonella enterica enterica serovar Typhi Ty2
acugcggcauuacgcgcc

SEQ ID NO: 1746479 - RNA, 21 nt, Salmonella enterica enterica serovar Typhi Ty2
acuggcgccuuuuggcagcag

SEQ ID NO: 1746480 - RNA, 14 nt, Salmonella enterica enterica serovar Typhi Ty2
acuggcgaccggca

SEQ ID NO: 1746481 - RNA, 23 nt, Salmonella enterica enterica serovar Typhi Ty2
acugggucgauguaguugccgcc

SEQ ID NO: 1746482 - RNA, 16 nt, Salmonella enterica enterica serovar Typhi Ty2
acugguaaaccgugcg

SEQ ID NO: 1746483 - RNA, 16 nt, Salmonella enterica enterica serovar Typhi Ty2
acuggcccugccggaa

SEQ ID NO: 1746484 - RNA, 21 nt, Salmonella enterica enterica serovar Typhi Ty2
acuuagcgccggaauggcgac

SEQ ID NO: 1746485 - RNA, 19 nt, Salmonella enterica enterica serovar Typhi Ty2
acuguggugugccugcguu

SEQ ID NO: 1746486 - RNA, 13 nt, Salmonella enterica enterica serovar Typhi Ty2
acuguuauugacg

SEQ ID NO: 1746487 - RNA, 15 nt, Salmonella enterica enterica serovar Typhi Ty2
acuguugaugauaac

SEQ ID NO: 1746488 - RNA, 21 nt, Salmonella enterica enterica serovar Typhi Ty2
acugguaaugucauccagcga

SEQ ID NO: 1746489 - RNA, 19 nt, Salmonella enterica enterica serovar Typhi Ty2
acugaccgcguuuaucgcg

SEQ ID NO: 1746490 - RNA, 15 nt, Salmonella enterica enterica serovar Typhi Ty2
acugacacccaucgc

SEQ ID NO: 1746491 - RNA, 18 nt, Salmonella enterica enterica serovar Typhi Ty2
acugacguugcgaaucag

SEQ ID NO: 1746492 - RNA, 12 nt, Salmonella enterica enterica serovar Typhi Ty2
acugacugcugu

SEQ ID NO: 1746493 - RNA, 19 nt, Salmonella enterica enterica serovar Typhi Ty2
acugagcgucacgccauca

SEQ ID NO: 1746494 - RNA, 15 nt, Salmonella enterica enterica serovar Typhi Ty2
acugaguauuggcaa

SEQ ID NO: 1746495 - RNA, 19 nt, Salmonella enterica enterica serovar Typhi Ty2
acugauagacaauugcugc

SEQ ID NO: 1746496 - RNA, 22 nt, Salmonella enterica enterica serovar Typhi Ty2
acugauaguuuaaauccagcgc

SEQ ID NO: 1746497 - RNA, 21 nt, Salmonella enterica enterica serovar Typhi Ty2
acuaucaauauuggugucgua

SEQ ID NO: 1746498 - RNA, 16 nt, Salmonella enterica enterica serovar Typhi Ty2
acucuuuuuccgcgag

SEQ ID NO: 1746499 - RNA, 16 nt, Salmonella enterica enterica serovar Typhi Ty2
acugaacaucgccguu

SEQ ID NO: 1746500 - RNA, 13 nt, Salmonella enterica enterica serovar Typhi Ty2
acugccgccaucg

SEQ ID NO: 1746501 - RNA, 13 nt, Salmonella enterica enterica serovar Typhi Ty2
acugcagcgcguc

SEQ ID NO: 1746502 - RNA, 16 nt, Salmonella enterica enterica serovar Typhi Ty2
acugcaacgccagaug

SEQ ID NO: 1746503 - RNA, 20 nt, Salmonella enterica enterica serovar Typhi Ty2
acugcacuuccugcgucagg

SEQ ID NO: 1746504 - RNA, 19 nt, Salmonella enterica enterica serovar Typhi Ty2
acugcacgccaggguaaua

SEQ ID NO: 1746505 - RNA, 23 nt, Salmonella enterica enterica serovar Typhi Ty2
acugaucccacuuaggcagccag

SEQ ID NO: 1746506 - RNA, 15 nt, Salmonella enterica enterica serovar Typhi Ty2
acugauuucggaaug

SEQ ID NO: 1746507 - RNA, 13 nt, Salmonella enterica enterica serovar Typhi Ty2
acugcaacgccag

SEQ ID NO: 1746508 - RNA, 19 nt, Salmonella enterica enterica serovar Typhi Ty2
agaaucccaccaauugcca

SEQ ID NO: 1746509 - RNA, 23 nt, Salmonella enterica enterica serovar Typhi Ty2
agaaugccagcgccgucauggca

SEQ ID NO: 1746510 - RNA, 15 nt, Salmonella enterica enterica serovar Typhi Ty2
agaauucugcgcguc

SEQ ID NO: 1746511 - RNA, 14 nt, Salmonella enterica enterica serovar Typhi Ty2
agaauagccggaua

SEQ ID NO: 1746512 - RNA, 21 nt, Salmonella enterica enterica serovar Typhi Ty2
agaauagcgccguggccgaua

SEQ ID NO: 1746513 - RNA, 22 nt, Salmonella enterica enterica serovar Typhi Ty2
agaauauuggcgaggaacauca

SEQ ID NO: 1746514 - RNA, 12 nt, Salmonella enterica enterica serovar Typhi Ty2
agaaucaccucu

SEQ ID NO: 1746515 - RNA, 14 nt, Salmonella enterica enterica serovar Typhi Ty2
agaacgcucgcgca

SEQ ID NO: 1746516 - RNA, 11 nt, Salmonella enterica enterica serovar Typhi Ty2
agaacgcucgc

SEQ ID NO: 1746517 - RNA, 23 nt, Salmonella enterica enterica serovar Typhi Ty2
agaaccacuuauuuguauugacg

SEQ ID NO: 1746518 - RNA, 15 nt, Salmonella enterica enterica serovar Typhi Ty2
agaagcuggcggucg

SEQ ID NO: 1746519 - RNA, 18 nt, Salmonella enterica enterica serovar Typhi Ty2
agaaacggaaaucacgca

SEQ ID NO: 1746520 - RNA, 19 nt, Salmonella enterica enterica serovar Typhi Ty2
agaaaaugacgggcgaucg

SEQ ID NO: 1746521 - RNA, 14 nt, Salmonella enterica enterica serovar Typhi Ty2
agaaaccgcagaaa

SEQ ID NO: 1746522 - RNA, 17 nt, Salmonella enterica enterica serovar Typhi Ty2
acuuugaccagcaucgc

SEQ ID NO: 1746523 - RNA, 19 nt, Salmonella enterica enterica serovar Typhi Ty2
acuucgcaguuggugacau

SEQ ID NO: 1746524 - RNA, 22 nt, Salmonella enterica enterica serovar Typhi Ty2
acuuuggccuaacagucgcgcc

SEQ ID NO: 1746525 - RNA, 20 nt, Salmonella enterica enterica serovar Typhi Ty2
acuucgauaaacgccucgcu

SEQ ID NO: 1746526 - RNA, 16 nt, Salmonella enterica enterica serovar Typhi Ty2
acuuccggcugcggaa

SEQ ID NO: 1746527 - RNA, 17 nt, Salmonella enterica enterica serovar Typhi Ty2
agaaaaacaucauggcu

SEQ ID NO: 1746528 - RNA, 18 nt, Salmonella enterica enterica serovar Typhi Ty2
agaaaaaccuccggcuau

SEQ ID NO: 1746529 - RNA, 12 nt, Salmonella enterica enterica serovar Typhi Ty2
agaaaagcagag

SEQ ID NO: 1746530 - RNA, 19 nt, Salmonella enterica enterica serovar Typhi Ty2
agaaaaccuuugcugacgc

SEQ ID NO: 1746531 - RNA, 17 nt, Salmonella enterica enterica serovar Typhi Ty2
acuuuucuuuccugcaa

SEQ ID NO: 1746532 - RNA, 23 nt, Salmonella enterica enterica serovar Typhi Ty2
acuuuugaacauaaagucagaca

SEQ ID NO: 1746533 - RNA, 18 nt, Salmonella enterica enterica serovar Typhi Ty2
acuuuuacccuucagaua

SEQ ID NO: 1746534 - RNA, 20 nt, Salmonella enterica enterica serovar Typhi Ty2
agauagcugcuuaccauacu

SEQ ID NO: 1746535 - RNA, 17 nt, Salmonella enterica enterica serovar Typhi Ty2
agauaauccagcgucgc

SEQ ID NO: 1746536 - RNA, 20 nt, Salmonella enterica enterica serovar Typhi Ty2
agauaauccagcgucgccag

SEQ ID NO: 1746537 - RNA, 22 nt, Salmonella enterica enterica serovar Typhi Ty2
agauauuccagcgacaucgcau

SEQ ID NO: 1746538 - RNA, 17 nt, Salmonella enterica enterica serovar Typhi Ty2
agaucccagggcggcgu

SEQ ID NO: 1746539 - RNA, 20 nt, Salmonella enterica enterica serovar Typhi Ty2
agaucauuaccugucgccca

SEQ ID NO: 1746540 - RNA, 15 nt, Salmonella enterica enterica serovar Typhi Ty2
agagcguauccagca

SEQ ID NO: 1746541 - RNA, 12 nt, Salmonella enterica enterica serovar Typhi Ty2
agauaacgcuau

SEQ ID NO: 1746542 - RNA, 20 nt, Salmonella enterica enterica serovar Typhi Ty2
agauaacugagcuugagcca

SEQ ID NO: 1746543 - RNA, 21 nt, Salmonella enterica enterica serovar Typhi Ty2
agauaaaacugcugacaauca

SEQ ID NO: 1746544 - RNA, 22 nt, Salmonella enterica enterica serovar Typhi Ty2
agagugagcaggcuaugggaua

SEQ ID NO: 1746545 - RNA, 18 nt, Salmonella enterica enterica serovar Typhi Ty2
agaucuucacgcgucagg

SEQ ID NO: 1746546 - RNA, 18 nt, Salmonella enterica enterica serovar Typhi Ty2
agaucguuauccagcagc

SEQ ID NO: 1746547 - RNA, 16 nt, Salmonella enterica enterica serovar Typhi Ty2
agaucgugcauccgga

SEQ ID NO: 1746548 - RNA, 23 nt, Salmonella enterica enterica serovar Typhi Ty2
agaucguaagaauaaucauccgc

SEQ ID NO: 1746549 - RNA, 20 nt, Salmonella enterica enterica serovar Typhi Ty2
agaucgguaaaagcguuuag

SEQ ID NO: 1746550 - RNA, 19 nt, Salmonella enterica enterica serovar Typhi Ty2
agauccggacugauaguca

SEQ ID NO: 1746551 - RNA, 22 nt, Salmonella enterica enterica serovar Typhi Ty2
agaugacaaagccggauaucgc

SEQ ID NO: 1746552 - RNA, 14 nt, Salmonella enterica enterica serovar Typhi Ty2
agaugauagccauu

SEQ ID NO: 1746553 - RNA, 20 nt, Salmonella enterica enterica serovar Typhi Ty2
agaugaugauuuaugaauag

SEQ ID NO: 1746554 - RNA, 23 nt, Salmonella enterica enterica serovar Typhi Ty2
agaugcggcgccaacgcgcuacc

SEQ ID NO: 1746555 - RNA, 16 nt, Salmonella enterica enterica serovar Typhi Ty2
agaugccggagcgaug

SEQ ID NO: 1746556 - RNA, 12 nt, Salmonella enterica enterica serovar Typhi Ty2
agacuucaacgc

SEQ ID NO: 1746557 - RNA, 20 nt, Salmonella enterica enterica serovar Typhi Ty2
agacuuuagauggcguaucg

SEQ ID NO: 1746558 - RNA, 15 nt, Salmonella enterica enterica serovar Typhi Ty2
agagaaccugaacaa

SEQ ID NO: 1746559 - RNA, 20 nt, Salmonella enterica enterica serovar Typhi Ty2
agagcaacgccaucagcaaa

SEQ ID NO: 1746560 - RNA, 17 nt, Salmonella enterica enterica serovar Typhi Ty2
agagcaacuggcaauag

SEQ ID NO: 1746561 - RNA, 15 nt, Salmonella enterica enterica serovar Typhi Ty2
agagcaucgcggcau

SEQ ID NO: 1746562 - RNA, 16 nt, Salmonella enterica enterica serovar Typhi Ty2
agagcauaugcgcugc

SEQ ID NO: 1746563 - RNA, 23 nt, Salmonella enterica enterica serovar Typhi Ty2
agagcaaauacuggaaaaaacgg

SEQ ID NO: 1746564 - RNA, 18 nt, Salmonella enterica enterica serovar Typhi Ty2
agagccggaaccuguccu

SEQ ID NO: 1746565 - RNA, 13 nt, Salmonella enterica enterica serovar Typhi Ty2
agagcguauccag

SEQ ID NO: 1746566 - RNA, 22 nt, Salmonella enterica enterica serovar Typhi Ty2
agacggcggcuuaccgaaucuu

SEQ ID NO: 1746567 - RNA, 17 nt, Salmonella enterica enterica serovar Typhi Ty2
agacggcggcuuaccga

SEQ ID NO: 1746568 - RNA, 20 nt, Salmonella enterica enterica serovar Typhi Ty2
agacgcuuuucagcgucuuu

SEQ ID NO: 1746569 - RNA, 15 nt, Salmonella enterica enterica serovar Typhi Ty2
agacggcagcgccau

SEQ ID NO: 1746570 - RNA, 23 nt, Salmonella enterica enterica serovar Typhi Ty2
agacggugaaucagauaacugag

SEQ ID NO: 1746571 - RNA, 14 nt, Salmonella enterica enterica serovar Typhi Ty2
agacuaaaaagcgc

SEQ ID NO: 1746572 - RNA, 13 nt, Salmonella enterica enterica serovar Typhi Ty2
agacccggcauug

SEQ ID NO: 1746573 - RNA, 11 nt, Salmonella enterica enterica serovar Typhi Ty2
agacccggcau

SEQ ID NO: 1746574 - RNA, 17 nt, Salmonella enterica enterica serovar Typhi Ty2
agacccgcaauaacgcc

SEQ ID NO: 1746575 - RNA, 16 nt, Salmonella enterica enterica serovar Typhi Ty2
agaccauccaugaaau

SEQ ID NO: 1746576 - RNA, 23 nt, Salmonella enterica enterica serovar Typhi Ty2
agaccacgccaucaacagcggag

SEQ ID NO: 1746577 - RNA, 21 nt, Salmonella enterica enterica serovar Typhi Ty2
agaccacuaacccggcgaccg

SEQ ID NO: 1746578 - RNA, 23 nt, Salmonella enterica enterica serovar Typhi Ty2
agaccacgaaucaggauauucgc

SEQ ID NO: 1746579 - RNA, 12 nt, Salmonella enterica enterica serovar Typhi Ty2
agacacuuuccg

SEQ ID NO: 1746580 - RNA, 16 nt, Salmonella enterica enterica serovar Typhi Ty2
agacaggacgccagcg

SEQ ID NO: 1746581 - RNA, 19 nt, Salmonella enterica enterica serovar Typhi Ty2
agacauucgcgcacggcgc

SEQ ID NO: 1746582 - RNA, 14 nt, Salmonella enterica enterica serovar Typhi Ty2
agacauucggaaug

SEQ ID NO: 1746583 - RNA, 19 nt, Salmonella enterica enterica serovar Typhi Ty2
agacauugguuucaugcau

SEQ ID NO: 1746584 - RNA, 13 nt, Salmonella enterica enterica serovar Typhi Ty2
agacaacauccca

SEQ ID NO: 1746585 - RNA, 18 nt, Salmonella enterica enterica serovar Typhi Ty2
agacacuggaaacagcca

SEQ ID NO: 1746586 - RNA, 18 nt, Salmonella enterica enterica serovar Typhi Ty2
agaccggcaucucaucuu

SEQ ID NO: 1746587 - RNA, 19 nt, Salmonella enterica enterica serovar Typhi Ty2
agacgccgaugagcugaug

SEQ ID NO: 1746588 - RNA, 19 nt, Salmonella enterica enterica serovar Typhi Ty2
acggauacgcugcgucagg

SEQ ID NO: 1746589 - RNA, 15 nt, Salmonella enterica enterica serovar Typhi Ty2
acggaugcgccaucc

SEQ ID NO: 1746590 - RNA, 22 nt, Salmonella enterica enterica serovar Typhi Ty2
acggcaacugaaaacaggccug

SEQ ID NO: 1746591 - RNA, 18 nt, Salmonella enterica enterica serovar Typhi Ty2
acggccacgcgcgucagg

SEQ ID NO: 1746592 - RNA, 16 nt, Salmonella enterica enterica serovar Typhi Ty2
acggccaccaggccug

SEQ ID NO: 1746593 - RNA, 20 nt, Salmonella enterica enterica serovar Typhi Ty2
acgcuuaucaggccuacauc

SEQ ID NO: 1746594 - RNA, 20 nt, Salmonella enterica enterica serovar Typhi Ty2
acgcuuaucaggccuacaac

SEQ ID NO: 1746595 - RNA, 19 nt, Salmonella enterica enterica serovar Typhi Ty2
acgcuuaucaggccuacaa

SEQ ID NO: 1746596 - RNA, 19 nt, Salmonella enterica enterica serovar Typhi Ty2
acgcuuaucgggccuacga

SEQ ID NO: 1746597 - RNA, 23 nt, Salmonella enterica enterica serovar Typhi Ty2
acgcuuaucaggccuacauccgg

SEQ ID NO: 1746598 - RNA, 20 nt, Salmonella enterica enterica serovar Typhi Ty2
acgcuuacccggccuacauu

SEQ ID NO: 1746599 - RNA, 14 nt, Salmonella enterica enterica serovar Typhi Ty2
acgcuguucgcaac

SEQ ID NO: 1746600 - RNA, 20 nt, Salmonella enterica enterica serovar Typhi Ty2
acgcuguagcuggcugccgu

SEQ ID NO: 1746601 - RNA, 14 nt, Salmonella enterica enterica serovar Typhi Ty2
acgcugcaucguuu

SEQ ID NO: 1746602 - RNA, 21 nt, Salmonella enterica enterica serovar Typhi Ty2
acgcugcgcguucugcuccag

SEQ ID NO: 1746603 - RNA, 16 nt, Salmonella enterica enterica serovar Typhi Ty2
acgcuucacgucagcg

SEQ ID NO: 1746604 - RNA, 19 nt, Salmonella enterica enterica serovar Typhi Ty2
acgcuuaugcugccuacaa

SEQ ID NO: 1746605 - RNA, 16 nt, Salmonella enterica enterica serovar Typhi Ty2
acgcuuacaucgccau

SEQ ID NO: 1746606 - RNA, 23 nt, Salmonella enterica enterica serovar Typhi Ty2
acgcuuauucggucugacggccu

SEQ ID NO: 1746607 - RNA, 20 nt, Salmonella enterica enterica serovar Typhi Ty2
acgcuuuucagcgccagaua

SEQ ID NO: 1746608 - RNA, 14 nt, Salmonella enterica enterica serovar Typhi Ty2
acggaaaccagaua

SEQ ID NO: 1746609 - RNA, 20 nt, Salmonella enterica enterica serovar Typhi Ty2
acgcuuuacgcuuaucccag

SEQ ID NO: 1746610 - RNA, 16 nt, Salmonella enterica enterica serovar Typhi Ty2
acgcuugcccgguucg

SEQ ID NO: 1746611 - RNA, 20 nt, Salmonella enterica enterica serovar Typhi Ty2
acgcuugcccgguucgccau

SEQ ID NO: 1746612 - RNA, 14 nt, Salmonella enterica enterica serovar Typhi Ty2
acggaaauagcgcc

SEQ ID NO: 1746613 - RNA, 15 nt, Salmonella enterica enterica serovar Typhi Ty2
acggaaggaaauaac

SEQ ID NO: 1746614 - RNA, 22 nt, Salmonella enterica enterica serovar Typhi Ty2
acggagaugaucguuuccagca

SEQ ID NO: 1746615 - RNA, 16 nt, Salmonella enterica enterica serovar Typhi Ty2
acgcgaccagacacgg

SEQ ID NO: 1746616 - RNA, 17 nt, Salmonella enterica enterica serovar Typhi Ty2
acgcagaucguauccag

SEQ ID NO: 1746617 - RNA, 18 nt, Salmonella enterica enterica serovar Typhi Ty2
acgcagaucuuuuugcuc

SEQ ID NO: 1746618 - RNA, 17 nt, Salmonella enterica enterica serovar Typhi Ty2
acgcacuguaacgcacu

SEQ ID NO: 1746619 - RNA, 13 nt, Salmonella enterica enterica serovar Typhi Ty2
aaacaccagaucg

SEQ ID NO: 1746620 - RNA, 16 nt, Salmonella enterica enterica serovar Typhi Ty2
aaacauaagcaaaucc

SEQ ID NO: 1746621 - RNA, 16 nt, Salmonella enterica enterica serovar Typhi Ty2
acgcgacaacgccgga

SEQ ID NO: 1746622 - RNA, 15 nt, Salmonella enterica enterica serovar Typhi Ty2
acgcgaagcggcgcu

SEQ ID NO: 1746623 - RNA, 16 nt, Salmonella enterica enterica serovar Typhi Ty2
aaacaguacuggucgg

SEQ ID NO: 1746624 - RNA, 19 nt, Salmonella enterica enterica serovar Typhi Ty2
acgcggacgccaccacagu

SEQ ID NO: 1746625 - RNA, 14 nt, Salmonella enterica enterica serovar Typhi Ty2
acgcggcguaccgc

SEQ ID NO: 1746626 - RNA, 15 nt, Salmonella enterica enterica serovar Typhi Ty2
acgcgcuccagcaac

SEQ ID NO: 1746627 - RNA, 13 nt, Salmonella enterica enterica serovar Typhi Ty2
acgcgcugaccuc

SEQ ID NO: 1746628 - RNA, 13 nt, Salmonella enterica enterica serovar Typhi Ty2
acgcggcgugcgc

SEQ ID NO: 1746629 - RNA, 16 nt, Salmonella enterica enterica serovar Typhi Ty2
acgcggucgucaucgg

SEQ ID NO: 1746630 - RNA, 14 nt, Salmonella enterica enterica serovar Typhi Ty2
acgcugaugaaaac

SEQ ID NO: 1746631 - RNA, 23 nt, Salmonella enterica enterica serovar Typhi Ty2
acgcucacuuuucuuuccugcaa

SEQ ID NO: 1746632 - RNA, 14 nt, Salmonella enterica enterica serovar Typhi Ty2
acgcuccggcaggc

SEQ ID NO: 1746633 - RNA, 17 nt, Salmonella enterica enterica serovar Typhi Ty2
acgcuccagcuggcugg

SEQ ID NO: 1746634 - RNA, 14 nt, Salmonella enterica enterica serovar Typhi Ty2
acguagcgcauugc

SEQ ID NO: 1746635 - RNA, 12 nt, Salmonella enterica enterica serovar Typhi Ty2
acguagcgcauu

SEQ ID NO: 1746636 - RNA, 19 nt, Salmonella enterica enterica serovar Typhi Ty2
acguuuuuccauucacaca

SEQ ID NO: 1746637 - RNA, 14 nt, Salmonella enterica enterica serovar Typhi Ty2
acuaaaacaccggu

SEQ ID NO: 1746638 - RNA, 15 nt, Salmonella enterica enterica serovar Typhi Ty2
acguuucgcuaucgc

SEQ ID NO: 1746639 - RNA, 14 nt, Salmonella enterica enterica serovar Typhi Ty2
acguuaggcgcaaa

SEQ ID NO: 1746640 - RNA, 21 nt, Salmonella enterica enterica serovar Typhi Ty2
acguuaaagccgaccaucgcg

SEQ ID NO: 1746641 - RNA, 21 nt, Salmonella enterica enterica serovar Typhi Ty2
acuaaucccccggaucaccgg

SEQ ID NO: 1746642 - RNA, 13 nt, Salmonella enterica enterica serovar Typhi Ty2
acuaauuugcgau

SEQ ID NO: 1746643 - RNA, 22 nt, Salmonella enterica enterica serovar Typhi Ty2
acuaaccguucaucuaucgcca

SEQ ID NO: 1746644 - RNA, 13 nt, Salmonella enterica enterica serovar Typhi Ty2
acuaagaccagca

SEQ ID NO: 1746645 - RNA, 15 nt, Salmonella enterica enterica serovar Typhi Ty2
acggcggccagcauu

SEQ ID NO: 1746646 - RNA, 18 nt, Salmonella enterica enterica serovar Typhi Ty2
acggcggcgaauagcgaa

SEQ ID NO: 1746647 - RNA, 19 nt, Salmonella enterica enterica serovar Typhi Ty2
acggcgucaccaccgcagg

SEQ ID NO: 1746648 - RNA, 12 nt, Salmonella enterica enterica serovar Typhi Ty2
acggcguagcga

SEQ ID NO: 1746649 - RNA, 12 nt, Salmonella enterica enterica serovar Typhi Ty2
acgggcaaacgc

SEQ ID NO: 1746650 - RNA, 17 nt, Salmonella enterica enterica serovar Typhi Ty2
acggugugccgccauca

SEQ ID NO: 1746651 - RNA, 21 nt, Salmonella enterica enterica serovar Typhi Ty2
acgguuauuuuucagaucggu

SEQ ID NO: 1746652 - RNA, 19 nt, Salmonella enterica enterica serovar Typhi Ty2
acggugguaaaucagaaua

SEQ ID NO: 1746653 - RNA, 18 nt, Salmonella enterica enterica serovar Typhi Ty2
acgguccugauccggaau

SEQ ID NO: 1746654 - RNA, 23 nt, Salmonella enterica enterica serovar Typhi Ty2
acggucggcguaauguugcugca

SEQ ID NO: 1746655 - RNA, 15 nt, Salmonella enterica enterica serovar Typhi Ty2
acggguuaauggcag

SEQ ID NO: 1746656 - RNA, 21 nt, Salmonella enterica enterica serovar Typhi Ty2
acgguaagcguucgcauacgc

SEQ ID NO: 1746657 - RNA, 21 nt, Salmonella enterica enterica serovar Typhi Ty2
acgguacuauuaccgcaucga

SEQ ID NO: 1746658 - RNA, 16 nt, Salmonella enterica enterica serovar Typhi Ty2
acgguauucguuacca

SEQ ID NO: 1746659 - RNA, 12 nt, Salmonella enterica enterica serovar Typhi Ty2
acccgaugcgag

SEQ ID NO: 1746660 - RNA, 19 nt, Salmonella enterica enterica serovar Typhi Ty2
acccgcaaacuaauggcgc

SEQ ID NO: 1746661 - RNA, 15 nt, Salmonella enterica enterica serovar Typhi Ty2
acccgcaaugugcag

SEQ ID NO: 1746662 - RNA, 21 nt, Salmonella enterica enterica serovar Typhi Ty2
acccgcauacaggaagccggu

SEQ ID NO: 1746663 - RNA, 19 nt, Salmonella enterica enterica serovar Typhi Ty2
acccagcgcuaacggcggu

SEQ ID NO: 1746664 - RNA, 22 nt, Salmonella enterica enterica serovar Typhi Ty2
accauucuucaacaaucguuaa

SEQ ID NO: 1746665 - RNA, 22 nt, Salmonella enterica enterica serovar Typhi Ty2
accauucugggaggugaaggau

SEQ ID NO: 1746666 - RNA, 23 nt, Salmonella enterica enterica serovar Typhi Ty2
accauuccgauagcgaaacugau

SEQ ID NO: 1746667 - RNA, 21 nt, Salmonella enterica enterica serovar Typhi Ty2
accauucccacgcauaguccu

SEQ ID NO: 1746668 - RNA, 22 nt, Salmonella enterica enterica serovar Typhi Ty2
accauuuauuuaggugcuugag

SEQ ID NO: 1746669 - RNA, 20 nt, Salmonella enterica enterica serovar Typhi Ty2
accauuaccgcuaacaucgc

SEQ ID NO: 1746670 - RNA, 15 nt, Salmonella enterica enterica serovar Typhi Ty2
acccauuuuauccuc

SEQ ID NO: 1746671 - RNA, 14 nt, Salmonella enterica enterica serovar Typhi Ty2
accauaugcggcau

SEQ ID NO: 1746672 - RNA, 16 nt, Salmonella enterica enterica serovar Typhi Ty2
accauacugaccaaca

SEQ ID NO: 1746673 - RNA, 15 nt, Salmonella enterica enterica serovar Typhi Ty2
aaaaucggaccuccg

SEQ ID NO: 1746674 - RNA, 24 nt, Salmonella enterica enterica serovar Typhi Ty2
aaaauaucggccugaaugcucuca

SEQ ID NO: 1746675 - RNA, 15 nt, Salmonella enterica enterica serovar Typhi Ty2
accaugauaaccagc

SEQ ID NO: 1746676 - RNA, 16 nt, Salmonella enterica enterica serovar Typhi Ty2
accaucuuuuccggca

SEQ ID NO: 1746677 - RNA, 19 nt, Salmonella enterica enterica serovar Typhi Ty2
accaucuuuuccggcaggg

SEQ ID NO: 1746678 - RNA, 15 nt, Salmonella enterica enterica serovar Typhi Ty2
accaucggcgcuacg

SEQ ID NO: 1746679 - RNA, 14 nt, Salmonella enterica enterica serovar Typhi Ty2
accaucgcgccgcu

SEQ ID NO: 1746680 - RNA, 14 nt, Salmonella enterica enterica serovar Typhi Ty2
accaucgcguugua

SEQ ID NO: 1746681 - RNA, 10 nt, Salmonella enterica enterica serovar Typhi Ty2
accaucgccg

SEQ ID NO: 1746682 - RNA, 15 nt, Salmonella enterica enterica serovar Typhi Ty2
accaucgcauugccg

SEQ ID NO: 1746683 - RNA, 23 nt, Salmonella enterica enterica serovar Typhi Ty2
accaucgcaaauucaucgccgcc

SEQ ID NO: 1746684 - RNA, 15 nt, Salmonella enterica enterica serovar Typhi Ty2
accauccggcgcugc

SEQ ID NO: 1746685 - RNA, 21 nt, Salmonella enterica enterica serovar Typhi Ty2
accaucaaauaauacgccggu

SEQ ID NO: 1746686 - RNA, 13 nt, Salmonella enterica enterica serovar Typhi Ty2
accagguaauccg

SEQ ID NO: 1746687 - RNA, 14 nt, Salmonella enterica enterica serovar Typhi Ty2
accaggucgccagc

SEQ ID NO: 1746688 - RNA, 18 nt, Salmonella enterica enterica serovar Typhi Ty2
acaguucagacaccacgc

SEQ ID NO: 1746689 - RNA, 17 nt, Salmonella enterica enterica serovar Typhi Ty2
acauaauauuccagcgu

SEQ ID NO: 1746690 - RNA, 17 nt, Salmonella enterica enterica serovar Typhi Ty2
accgacaauauucgccg

SEQ ID NO: 1746691 - RNA, 15 nt, Salmonella enterica enterica serovar Typhi Ty2
acccgcuuccaguuu

SEQ ID NO: 1746692 - RNA, 11 nt, Salmonella enterica enterica serovar Typhi Ty2
accgaugcagc

SEQ ID NO: 1746693 - RNA, 15 nt, Salmonella enterica enterica serovar Typhi Ty2
accgcaucggcauca

SEQ ID NO: 1746694 - RNA, 22 nt, Salmonella enterica enterica serovar Typhi Ty2
accgcaucaaugcccagcgcaa

SEQ ID NO: 1746695 - RNA, 14 nt, Salmonella enterica enterica serovar Typhi Ty2
accgcaucacggca

SEQ ID NO: 1746696 - RNA, 14 nt, Salmonella enterica enterica serovar Typhi Ty2
accgcaucacgcga

SEQ ID NO: 1746697 - RNA, 14 nt, Salmonella enterica enterica serovar Typhi Ty2
accgcaucgaccgu

SEQ ID NO: 1746698 - RNA, 22 nt, Salmonella enterica enterica serovar Typhi Ty2
accgccgcgauacauugucgca

SEQ ID NO: 1746699 - RNA, 22 nt, Salmonella enterica enterica serovar Typhi Ty2
accgcgacuuggaaaguugcgc

SEQ ID NO: 1746700 - RNA, 15 nt, Salmonella enterica enterica serovar Typhi Ty2
accgccugcgcugau

SEQ ID NO: 1746701 - RNA, 13 nt, Salmonella enterica enterica serovar Typhi Ty2
accgccuccaggc

SEQ ID NO: 1746702 - RNA, 13 nt, Salmonella enterica enterica serovar Typhi Ty2
accgcugcgcuca

SEQ ID NO: 1746703 - RNA, 18 nt, Salmonella enterica enterica serovar Typhi Ty2
accgcuuaacagcguaca

SEQ ID NO: 1746704 - RNA, 16 nt, Salmonella enterica enterica serovar Typhi Ty2
accggauggaucaucg

SEQ ID NO: 1746705 - RNA, 24 nt, Salmonella enterica enterica serovar Typhi Ty2
accgcuuuaucauaccagugcaga

SEQ ID NO: 1746706 - RNA, 15 nt, Salmonella enterica enterica serovar Typhi Ty2
accgcuucgcauugc

SEQ ID NO: 1746707 - RNA, 15 nt, Salmonella enterica enterica serovar Typhi Ty2
accgcgcuccaucgc

SEQ ID NO: 1746708 - RNA, 21 nt, Salmonella enterica enterica serovar Typhi Ty2
accgguaucgaucacgcgcag

SEQ ID NO: 1746709 - RNA, 14 nt, Salmonella enterica enterica serovar Typhi Ty2
accgguugcgcgcu

SEQ ID NO: 1746710 - RNA, 17 nt, Salmonella enterica enterica serovar Typhi Ty2
accgggccugaugcgcg

SEQ ID NO: 1746711 - RNA, 16 nt, Salmonella enterica enterica serovar Typhi Ty2
accggcaaccgguacu

SEQ ID NO: 1746712 - RNA, 22 nt, Salmonella enterica enterica serovar Typhi Ty2
accggcaccagcaaugauaacg

SEQ ID NO: 1746713 - RNA, 19 nt, Salmonella enterica enterica serovar Typhi Ty2
accggggcgcucgccugau

SEQ ID NO: 1746714 - RNA, 16 nt, Salmonella enterica enterica serovar Typhi Ty2
accgggcugucaucga

SEQ ID NO: 1746715 - RNA, 19 nt, Salmonella enterica enterica serovar Typhi Ty2
accgugaugcggacgcuga

SEQ ID NO: 1746716 - RNA, 21 nt, Salmonella enterica enterica serovar Typhi Ty2
accgugauuuuuaccgccggu

SEQ ID NO: 1746717 - RNA, 18 nt, Salmonella enterica enterica serovar Typhi Ty2
accgugauuuuuaccgcc

SEQ ID NO: 1746718 - RNA, 15 nt, Salmonella enterica enterica serovar Typhi Ty2
accgucgugaaucau

SEQ ID NO: 1746719 - RNA, 16 nt, Salmonella enterica enterica serovar Typhi Ty2
accgucugcucagaaa

SEQ ID NO: 1746720 - RNA, 17 nt, Salmonella enterica enterica serovar Typhi Ty2
accgucgaucucggcca

SEQ ID NO: 1746721 - RNA, 20 nt, Salmonella enterica enterica serovar Typhi Ty2
accgucagauucugcgguaa

SEQ ID NO: 1746722 - RNA, 13 nt, Salmonella enterica enterica serovar Typhi Ty2
accgucaucgccc

SEQ ID NO: 1746723 - RNA, 17 nt, Salmonella enterica enterica serovar Typhi Ty2
accgucaccacgcgcga

SEQ ID NO: 1746724 - RNA, 18 nt, Salmonella enterica enterica serovar Typhi Ty2
accguagugacacgguca

SEQ ID NO: 1746725 - RNA, 15 nt, Salmonella enterica enterica serovar Typhi Ty2
accguaaucaucgcg

SEQ ID NO: 1746726 - RNA, 14 nt, Salmonella enterica enterica serovar Typhi Ty2
accuccuucgcgcc

SEQ ID NO: 1746727 - RNA, 16 nt, Salmonella enterica enterica serovar Typhi Ty2
accugacggcagccac

SEQ ID NO: 1746728 - RNA, 22 nt, Salmonella enterica enterica serovar Typhi Ty2
accucgguauguccugccgcaa

SEQ ID NO: 1746729 - RNA, 18 nt, Salmonella enterica enterica serovar Typhi Ty2
accuacgcuauccggcgc

SEQ ID NO: 1746730 - RNA, 21 nt, Salmonella enterica enterica serovar Typhi Ty2
accguuuuguaggccggauaa

SEQ ID NO: 1746731 - RNA, 12 nt, Salmonella enterica enterica serovar Typhi Ty2
accucaugcgcc

SEQ ID NO: 1746732 - RNA, 18 nt, Salmonella enterica enterica serovar Typhi Ty2
accucagguaaauccgcc

SEQ ID NO: 1746733 - RNA, 17 nt, Salmonella enterica enterica serovar Typhi Ty2
accuccaaagcgcuaca

SEQ ID NO: 1746734 - RNA, 16 nt, Salmonella enterica enterica serovar Typhi Ty2
accguugcgcccauca

SEQ ID NO: 1746735 - RNA, 22 nt, Salmonella enterica enterica serovar Typhi Ty2
accguucacgcucacgcagaua

SEQ ID NO: 1746736 - RNA, 16 nt, Salmonella enterica enterica serovar Typhi Ty2
accugauugaccagca

SEQ ID NO: 1746737 - RNA, 14 nt, Salmonella enterica enterica serovar Typhi Ty2
accugcaucacgcc

SEQ ID NO: 1746738 - RNA, 13 nt, Salmonella enterica enterica serovar Typhi Ty2
acgaacacggcgu

SEQ ID NO: 1746739 - RNA, 14 nt, Salmonella enterica enterica serovar Typhi Ty2
acgaaacgcaucgu

SEQ ID NO: 1746740 - RNA, 15 nt, Salmonella enterica enterica serovar Typhi Ty2
acgacgauaaggcca

SEQ ID NO: 1746741 - RNA, 19 nt, Salmonella enterica enterica serovar Typhi Ty2
acgacgaggggcuuugugc

SEQ ID NO: 1746742 - RNA, 18 nt, Salmonella enterica enterica serovar Typhi Ty2
acgacccaucaauaacga

SEQ ID NO: 1746743 - RNA, 21 nt, Salmonella enterica enterica serovar Typhi Ty2
acgacacccgauacacgccga

SEQ ID NO: 1746744 - RNA, 16 nt, Salmonella enterica enterica serovar Typhi Ty2
acgacagagaucaggc

SEQ ID NO: 1746745 - RNA, 12 nt, Salmonella enterica enterica serovar Typhi Ty2
acgaagcgcaaa

SEQ ID NO: 1746746 - RNA, 13 nt, Salmonella enterica enterica serovar Typhi Ty2
acgcaaaucaccg

SEQ ID NO: 1746747 - RNA, 14 nt, Salmonella enterica enterica serovar Typhi Ty2
acgcaacggcaugu

SEQ ID NO: 1746748 - RNA, 15 nt, Salmonella enterica enterica serovar Typhi Ty2
acgauuucucgccau

SEQ ID NO: 1746749 - RNA, 12 nt, Salmonella enterica enterica serovar Typhi Ty2
acgauugcgcgu

SEQ ID NO: 1746750 - RNA, 14 nt, Salmonella enterica enterica serovar Typhi Ty2
acgcaaugccugac

SEQ ID NO: 1746751 - RNA, 15 nt, Salmonella enterica enterica serovar Typhi Ty2
acgcaauuguugcgc

SEQ ID NO: 1746752 - RNA, 22 nt, Salmonella enterica enterica serovar Typhi Ty2
acgcacaguacgcccggcgggu

SEQ ID NO: 1746753 - RNA, 14 nt, Salmonella enterica enterica serovar Typhi Ty2
acgaugucaucgcc

SEQ ID NO: 1746754 - RNA, 20 nt, Salmonella enterica enterica serovar Typhi Ty2
acgaugugcauaaccgcgcc

SEQ ID NO: 1746755 - RNA, 19 nt, Salmonella enterica enterica serovar Typhi Ty2
acgauguaaaaccuggcac

SEQ ID NO: 1746756 - RNA, 18 nt, Salmonella enterica enterica serovar Typhi Ty2
acgaucgccuaauccgcc

SEQ ID NO: 1746757 - RNA, 13 nt, Salmonella enterica enterica serovar Typhi Ty2
acgaucgcgcaca

SEQ ID NO: 1746758 - RNA, 13 nt, Salmonella enterica enterica serovar Typhi Ty2
acgauaaaagcuc

SEQ ID NO: 1746759 - RNA, 12 nt, Salmonella enterica enterica serovar Typhi Ty2
acgauacgucau

SEQ ID NO: 1746760 - RNA, 12 nt, Salmonella enterica enterica serovar Typhi Ty2
aaacacagccau

SEQ ID NO: 1746761 - RNA, 14 nt, Salmonella enterica enterica serovar Typhi Ty2
acgacugaguauug

SEQ ID NO: 1746762 - RNA, 15 nt, Salmonella enterica enterica serovar Typhi Ty2
acgacgggaaaaagc

SEQ ID NO: 1746763 - RNA, 19 nt, Salmonella enterica enterica serovar Typhi Ty2
acgacgcugccacaauggc

SEQ ID NO: 1746764 - RNA, 21 nt, Salmonella enterica enterica serovar Typhi Ty2
aacuuuaucaccagcgauuac

SEQ ID NO: 1746765 - RNA, 21 nt, Salmonella enterica enterica serovar Typhi Ty2
aacuuuaucgcgcggcgaugu

SEQ ID NO: 1746766 - RNA, 22 nt, Salmonella enterica enterica serovar Typhi Ty2
aagaaacgccgcgcaaagcaau

SEQ ID NO: 1746767 - RNA, 14 nt, Salmonella enterica enterica serovar Typhi Ty2
aagaaacgccgacc

SEQ ID NO: 1746768 - RNA, 15 nt, Salmonella enterica enterica serovar Typhi Ty2
aacuuuuucgaugau

SEQ ID NO: 1746769 - RNA, 14 nt, Salmonella enterica enterica serovar Typhi Ty2
aagaacagcgucgc

SEQ ID NO: 1746770 - RNA, 13 nt, Salmonella enterica enterica serovar Typhi Ty2
aagaauacccuuu

SEQ ID NO: 1746771 - RNA, 18 nt, Salmonella enterica enterica serovar Typhi Ty2
aagaagucagugcugagc

SEQ ID NO: 1746772 - RNA, 16 nt, Salmonella enterica enterica serovar Typhi Ty2
aacuuauuucuaucgc

SEQ ID NO: 1746773 - RNA, 22 nt, Salmonella enterica enterica serovar Typhi Ty2
aacuguuuuaccaaaucaauag

SEQ ID NO: 1746774 - RNA, 19 nt, Salmonella enterica enterica serovar Typhi Ty2
aacugacuccagcugguau

SEQ ID NO: 1746775 - RNA, 17 nt, Salmonella enterica enterica serovar Typhi Ty2
aacugacgcgccuguaa

SEQ ID NO: 1746776 - RNA, 17 nt, Salmonella enterica enterica serovar Typhi Ty2
aacucggcagcgcgaca

SEQ ID NO: 1746777 - RNA, 23 nt, Salmonella enterica enterica serovar Typhi Ty2
aacucuggaucaguuccggauua

SEQ ID NO: 1746778 - RNA, 11 nt, Salmonella enterica enterica serovar Typhi Ty2
aacggcgauca

SEQ ID NO: 1746779 - RNA, 13 nt, Salmonella enterica enterica serovar Typhi Ty2
aacggcgagcuuu

SEQ ID NO: 1746780 - RNA, 22 nt, Salmonella enterica enterica serovar Typhi Ty2
aacgacgacgcagcuucgccgc

SEQ ID NO: 1746781 - RNA, 16 nt, Salmonella enterica enterica serovar Typhi Ty2
aacgacuuauuugcuc

SEQ ID NO: 1746782 - RNA, 21 nt, Salmonella enterica enterica serovar Typhi Ty2
aacgacuacuuccagaccacu

SEQ ID NO: 1746783 - RNA, 15 nt, Salmonella enterica enterica serovar Typhi Ty2
aacgacucggcgauc

SEQ ID NO: 1746784 - RNA, 16 nt, Salmonella enterica enterica serovar Typhi Ty2
aacgccguuaccagca

SEQ ID NO: 1746785 - RNA, 13 nt, Salmonella enterica enterica serovar Typhi Ty2
aacgccguuacca

SEQ ID NO: 1746786 - RNA, 14 nt, Salmonella enterica enterica serovar Typhi Ty2
aacgccgugaacgc

SEQ ID NO: 1746787 - RNA, 20 nt, Salmonella enterica enterica serovar Typhi Ty2
aacgcccgccgcgaccagca

SEQ ID NO: 1746788 - RNA, 22 nt, Salmonella enterica enterica serovar Typhi Ty2
aacgcguuaaucacuaccugca

SEQ ID NO: 1746789 - RNA, 15 nt, Salmonella enterica enterica serovar Typhi Ty2
aacgcucgcgcauga

SEQ ID NO: 1746790 - RNA, 14 nt, Salmonella enterica enterica serovar Typhi Ty2
aacgcugcgcaaca

SEQ ID NO: 1746791 - RNA, 17 nt, Salmonella enterica enterica serovar Typhi Ty2
aacgcugcgccgcgcca

SEQ ID NO: 1746792 - RNA, 20 nt, Salmonella enterica enterica serovar Typhi Ty2
aacggcaccggaaccggcau

SEQ ID NO: 1746793 - RNA, 20 nt, Salmonella enterica enterica serovar Typhi Ty2
aacgccugcuccguccacgc

SEQ ID NO: 1746794 - RNA, 18 nt, Salmonella enterica enterica serovar Typhi Ty2
aacgcgguaaauuccgca

SEQ ID NO: 1746795 - RNA, 14 nt, Salmonella enterica enterica serovar Typhi Ty2
aacgcggccuggaa

SEQ ID NO: 1746796 - RNA, 17 nt, Salmonella enterica enterica serovar Typhi Ty2
aaccguggccuccggca

SEQ ID NO: 1746797 - RNA, 13 nt, Salmonella enterica enterica serovar Typhi Ty2
aaccgucggcaau

SEQ ID NO: 1746798 - RNA, 17 nt, Salmonella enterica enterica serovar Typhi Ty2
aaccgucuggcugccau

SEQ ID NO: 1746799 - RNA, 20 nt, Salmonella enterica enterica serovar Typhi Ty2
aaccgucggcgccggcgucg

SEQ ID NO: 1746800 - RNA, 16 nt, Salmonella enterica enterica serovar Typhi Ty2
aaccugcucucgggca

SEQ ID NO: 1746801 - RNA, 13 nt, Salmonella enterica enterica serovar Typhi Ty2
aaccuaucaggcg

SEQ ID NO: 1746802 - RNA, 19 nt, Salmonella enterica enterica serovar Typhi Ty2
aaccgcuuuuccugcugcc

SEQ ID NO: 1746803 - RNA, 14 nt, Salmonella enterica enterica serovar Typhi Ty2
aaccggcagaccgg

SEQ ID NO: 1746804 - RNA, 22 nt, Salmonella enterica enterica serovar Typhi Ty2
aacacuauauguccuuuacugc

SEQ ID NO: 1746805 - RNA, 23 nt, Salmonella enterica enterica serovar Typhi Ty2
aacacucccccaccuuuugcagc

SEQ ID NO: 1746806 - RNA, 17 nt, Salmonella enterica enterica serovar Typhi Ty2
aaccggccccaucgccg

SEQ ID NO: 1746807 - RNA, 17 nt, Salmonella enterica enterica serovar Typhi Ty2
aauaugcggcgccauca

SEQ ID NO: 1746808 - RNA, 16 nt, Salmonella enterica enterica serovar Typhi Ty2
aauaugcgucagcgcg

SEQ ID NO: 1746809 - RNA, 15 nt, Salmonella enterica enterica serovar Typhi Ty2
aauauuuaacacauu

SEQ ID NO: 1746810 - RNA, 19 nt, Salmonella enterica enterica serovar Typhi Ty2
aauauucgcuucuucggca

SEQ ID NO: 1746811 - RNA, 12 nt, Salmonella enterica enterica serovar Typhi Ty2
aauauucgcgcc

SEQ ID NO: 1746812 - RNA, 13 nt, Salmonella enterica enterica serovar Typhi Ty2
aauauuuugcugg

SEQ ID NO: 1746813 - RNA, 21 nt, Salmonella enterica enterica serovar Typhi Ty2
aaucaagccuaucaccgcgau

SEQ ID NO: 1746814 - RNA, 13 nt, Salmonella enterica enterica serovar Typhi Ty2
aaucaaccauaca

SEQ ID NO: 1746815 - RNA, 18 nt, Salmonella enterica enterica serovar Typhi Ty2
aaucaacgccgccaggau

SEQ ID NO: 1746816 - RNA, 12 nt, Salmonella enterica enterica serovar Typhi Ty2
aauauccugcgg

SEQ ID NO: 1746817 - RNA, 14 nt, Salmonella enterica enterica serovar Typhi Ty2
aauauccugugucg

SEQ ID NO: 1746818 - RNA, 15 nt, Salmonella enterica enterica serovar Typhi Ty2
aauauccuccggcau

SEQ ID NO: 1746819 - RNA, 16 nt, Salmonella enterica enterica serovar Typhi Ty2
aauaucggcgucaacg

SEQ ID NO: 1746820 - RNA, 13 nt, Salmonella enterica enterica serovar Typhi Ty2
aauauaugaacca

SEQ ID NO: 1746821 - RNA, 15 nt, Salmonella enterica enterica serovar Typhi Ty2
aauacucuucacgca

SEQ ID NO: 1746822 - RNA, 22 nt, Salmonella enterica enterica serovar Typhi Ty2
aauauacgcaccugauaccuca

SEQ ID NO: 1746823 - RNA, 20 nt, Salmonella enterica enterica serovar Typhi Ty2
aauacgcuccagcuggcugg

SEQ ID NO: 1746824 - RNA, 18 nt, Salmonella enterica enterica serovar Typhi Ty2
aauacgcuccagcuggcu

SEQ ID NO: 1746825 - RNA, 12 nt, Salmonella enterica enterica serovar Typhi Ty2
aauacguaaacc

SEQ ID NO: 1746826 - RNA, 20 nt, Salmonella enterica enterica serovar Typhi Ty2
aauaacgaacugauggcgcu

SEQ ID NO: 1746827 - RNA, 17 nt, Salmonella enterica enterica serovar Typhi Ty2
aauaacgaacugauggc

SEQ ID NO: 1746828 - RNA, 23 nt, Salmonella enterica enterica serovar Typhi Ty2
aauaauugcgguggcgcaaaucg

SEQ ID NO: 1746829 - RNA, 16 nt, Salmonella enterica enterica serovar Typhi Ty2
aaguuauccagcgccc

SEQ ID NO: 1746830 - RNA, 23 nt, Salmonella enterica enterica serovar Typhi Ty2
aagagagccuuacaggcgcauca

SEQ ID NO: 1746831 - RNA, 17 nt, Salmonella enterica enterica serovar Typhi Ty2
aagccagacgcgcagca

SEQ ID NO: 1746832 - RNA, 19 nt, Salmonella enterica enterica serovar Typhi Ty2
aagccggcaggcagcgcca

SEQ ID NO: 1746833 - RNA, 19 nt, Salmonella enterica enterica serovar Typhi Ty2
aagccgccauccggcauuu

SEQ ID NO: 1746834 - RNA, 22 nt, Salmonella enterica enterica serovar Typhi Ty2
aagccgaugacaucucaucggc

SEQ ID NO: 1746835 - RNA, 20 nt, Salmonella enterica enterica serovar Typhi Ty2
aagcgauuuauccaccgcca

SEQ ID NO: 1746836 - RNA, 13 nt, Salmonella enterica enterica serovar Typhi Ty2
aagcgauccggca

SEQ ID NO: 1746837 - RNA, 23 nt, Salmonella enterica enterica serovar Typhi Ty2
aagccucucuuacgagaggcuuu

SEQ ID NO: 1746838 - RNA, 20 nt, Salmonella enterica enterica serovar Typhi Ty2
aagccguuuuggcagcgccc

SEQ ID NO: 1746839 - RNA, 15 nt, Salmonella enterica enterica serovar Typhi Ty2
aagcgccaucaggca

SEQ ID NO: 1746840 - RNA, 14 nt, Salmonella enterica enterica serovar Typhi Ty2
aagcgccaucaggc

SEQ ID NO: 1746841 - RNA, 13 nt, Salmonella enterica enterica serovar Typhi Ty2
aagcgcagcguca

SEQ ID NO: 1746842 - RNA, 21 nt, Salmonella enterica enterica serovar Typhi Ty2
aagcgguaguuaagcgucagc

SEQ ID NO: 1746843 - RNA, 22 nt, Salmonella enterica enterica serovar Typhi Ty2
aagcgguaguuaagcgucagcc

SEQ ID NO: 1746844 - RNA, 13 nt, Salmonella enterica enterica serovar Typhi Ty2
aagcguagcgcca

SEQ ID NO: 1746845 - RNA, 19 nt, Salmonella enterica enterica serovar Typhi Ty2
aagcguagcgcauccggca

SEQ ID NO: 1746846 - RNA, 16 nt, Salmonella enterica enterica serovar Typhi Ty2
aagcguagccgcgcca

SEQ ID NO: 1746847 - RNA, 16 nt, Salmonella enterica enterica serovar Typhi Ty2
aagcguaacagcgcua

SEQ ID NO: 1746848 - RNA, 15 nt, Salmonella enterica enterica serovar Typhi Ty2
aagcgguuaucggca

SEQ ID NO: 1746849 - RNA, 23 nt, Salmonella enterica enterica serovar Typhi Ty2
aaggcauuucgccgccauccggc

SEQ ID NO: 1746850 - RNA, 20 nt, Salmonella enterica enterica serovar Typhi Ty2
aagcguagcgccaucaggca

SEQ ID NO: 1746851 - RNA, 16 nt, Salmonella enterica enterica serovar Typhi Ty2
aaggcaacgccgccag

SEQ ID NO: 1746852 - RNA, 11 nt, Salmonella enterica enterica serovar Typhi Ty2
aaggcagccaa

SEQ ID NO: 1746853 - RNA, 20 nt, Salmonella enterica enterica serovar Typhi Ty2
aaggcuaccgguugcguagc

SEQ ID NO: 1746854 - RNA, 19 nt, Salmonella enterica enterica serovar Typhi Ty2
aaggcgaacuccagcgcga

SEQ ID NO: 1746855 - RNA, 20 nt, Salmonella enterica enterica serovar Typhi Ty2
aaggccgcuuucgcggccuu

SEQ ID NO: 1746856 - RNA, 19 nt, Salmonella enterica enterica serovar Typhi Ty2
acagaccuaaauaagcgcc

SEQ ID NO: 1746857 - RNA, 16 nt, Salmonella enterica enterica serovar Typhi Ty2
acagacgacuccaaua

SEQ ID NO: 1746858 - RNA, 23 nt, Salmonella enterica enterica serovar Typhi Ty2
acagauucccagugcgcggucau

SEQ ID NO: 1746859 - RNA, 14 nt, Salmonella enterica enterica serovar Typhi Ty2
acagaaucgcgaua

SEQ ID NO: 1746860 - RNA, 15 nt, Salmonella enterica enterica serovar Typhi Ty2
acagaagcgccuguc

SEQ ID NO: 1746861 - RNA, 13 nt, Salmonella enterica enterica serovar Typhi Ty2
acacuuuugccga

SEQ ID NO: 1746862 - RNA, 19 nt, Salmonella enterica enterica serovar Typhi Ty2
acacuuaccgacgcgcggu

SEQ ID NO: 1746863 - RNA, 12 nt, Salmonella enterica enterica serovar Typhi Ty2
acacguaacaac

SEQ ID NO: 1746864 - RNA, 23 nt, Salmonella enterica enterica serovar Typhi Ty2
acacuccggcgcgcgcgccaucg

SEQ ID NO: 1746865 - RNA, 16 nt, Salmonella enterica enterica serovar Typhi Ty2
acacuauguugaugcu

SEQ ID NO: 1746866 - RNA, 12 nt, Salmonella enterica enterica serovar Typhi Ty2
acacucgcggau

SEQ ID NO: 1746867 - RNA, 12 nt, Salmonella enterica enterica serovar Typhi Ty2
acagccugcgug

SEQ ID NO: 1746868 - RNA, 14 nt, Salmonella enterica enterica serovar Typhi Ty2
acagcguaaauaag

SEQ ID NO: 1746869 - RNA, 19 nt, Salmonella enterica enterica serovar Typhi Ty2
acaggcgacgccgccaucc

SEQ ID NO: 1746870 - RNA, 15 nt, Salmonella enterica enterica serovar Typhi Ty2
acaggcgcauacgau

SEQ ID NO: 1746871 - RNA, 19 nt, Salmonella enterica enterica serovar Typhi Ty2
acaggcgcagggcauuauu

SEQ ID NO: 1746872 - RNA, 21 nt, Salmonella enterica enterica serovar Typhi Ty2
acagcuucaggcucaucagcg

SEQ ID NO: 1746873 - RNA, 12 nt, Salmonella enterica enterica serovar Typhi Ty2
acaggcgucgcg

SEQ ID NO: 1746874 - RNA, 17 nt, Salmonella enterica enterica serovar Typhi Ty2
acacgauccccaucgau

SEQ ID NO: 1746875 - RNA, 20 nt, Salmonella enterica enterica serovar Typhi Ty2
acaccuuuggggaaagguaa

SEQ ID NO: 1746876 - RNA, 16 nt, Salmonella enterica enterica serovar Typhi Ty2
acacggggcgguaccg

SEQ ID NO: 1746877 - RNA, 18 nt, Salmonella enterica enterica serovar Typhi Ty2
acacgccuuccuccagca

SEQ ID NO: 1746878 - RNA, 22 nt, Salmonella enterica enterica serovar Typhi Ty2
acacgccugaauuucgucagga

SEQ ID NO: 1746879 - RNA, 17 nt, Salmonella enterica enterica serovar Typhi Ty2
acacgcggucgucaucg

SEQ ID NO: 1746880 - RNA, 13 nt, Salmonella enterica enterica serovar Typhi Ty2
aaaauaacgcgau

SEQ ID NO: 1746881 - RNA, 15 nt, Salmonella enterica enterica serovar Typhi Ty2
acaccagccguucac

SEQ ID NO: 1746882 - RNA, 23 nt, Salmonella enterica enterica serovar Typhi Ty2
acaccagaucauuaccugucgcc

SEQ ID NO: 1746883 - RNA, 19 nt, Salmonella enterica enterica serovar Typhi Ty2
acaccacuaaacgcgaucu

SEQ ID NO: 1746884 - RNA, 14 nt, Salmonella enterica enterica serovar Typhi Ty2
acaccggaagugaa

SEQ ID NO: 1746885 - RNA, 18 nt, Salmonella enterica enterica serovar Typhi Ty2
acaccggccauugccgcg

SEQ ID NO: 1746886 - RNA, 21 nt, Salmonella enterica enterica serovar Typhi Ty2
acaccgccuagcgucccggca

SEQ ID NO: 1746887 - RNA, 22 nt, Salmonella enterica enterica serovar Typhi Ty2
acaccgccuagcgucccggcaa

SEQ ID NO: 1746888 - RNA, 21 nt, Salmonella enterica enterica serovar Typhi Ty2
aauugauuagcuuuaauccgu

SEQ ID NO: 1746889 - RNA, 10 nt, Salmonella enterica enterica serovar Typhi Ty2
aauggcgcuc

SEQ ID NO: 1746890 - RNA, 21 nt, Salmonella enterica enterica serovar Typhi Ty2
aauguuuaaucggccagcgaa

SEQ ID NO: 1746891 - RNA, 13 nt, Salmonella enterica enterica serovar Typhi Ty2
aauggucgcgcca

SEQ ID NO: 1746892 - RNA, 18 nt, Salmonella enterica enterica serovar Typhi Ty2
aauuaagccggugaugau

SEQ ID NO: 1746893 - RNA, 14 nt, Salmonella enterica enterica serovar Typhi Ty2
aaugaccagcgccc

SEQ ID NO: 1746894 - RNA, 15 nt, Salmonella enterica enterica serovar Typhi Ty2
aaugaccauuaacgc

SEQ ID NO: 1746895 - RNA, 20 nt, Salmonella enterica enterica serovar Typhi Ty2
aaugaccauuaacgccagcg

SEQ ID NO: 1746896 - RNA, 21 nt, Salmonella enterica enterica serovar Typhi Ty2
aaugacgggcuacgucgucga

SEQ ID NO: 1746897 - RNA, 21 nt, Salmonella enterica enterica serovar Typhi Ty2
aaugaccgucgaccagcguac

SEQ ID NO: 1746898 - RNA, 12 nt, Salmonella enterica enterica serovar Typhi Ty2
aaugacgcccug

SEQ ID NO: 1746899 - RNA, 13 nt, Salmonella enterica enterica serovar Typhi Ty2
aaugaagcgcguu

SEQ ID NO: 1746900 - RNA, 14 nt, Salmonella enterica enterica serovar Typhi Ty2
aaugaagcgucgcg

SEQ ID NO: 1746901 - RNA, 14 nt, Salmonella enterica enterica serovar Typhi Ty2
aaucuugcguacca

SEQ ID NO: 1746902 - RNA, 14 nt, Salmonella enterica enterica serovar Typhi Ty2
aaucacgcggcgcu

SEQ ID NO: 1746903 - RNA, 21 nt, Salmonella enterica enterica serovar Typhi Ty2
aaucuuuacacucgcggauaa

SEQ ID NO: 1746904 - RNA, 19 nt, Salmonella enterica enterica serovar Typhi Ty2
aaucaccugcaucacgccc

SEQ ID NO: 1746905 - RNA, 16 nt, Salmonella enterica enterica serovar Typhi Ty2
aaucaccacauggccc

SEQ ID NO: 1746906 - RNA, 14 nt, Salmonella enterica enterica serovar Typhi Ty2
aaugcccagcgccg

SEQ ID NO: 1746907 - RNA, 14 nt, Salmonella enterica enterica serovar Typhi Ty2
aaugcccaggcggc

SEQ ID NO: 1746908 - RNA, 13 nt, Salmonella enterica enterica serovar Typhi Ty2
aaugccaugcugg

SEQ ID NO: 1746909 - RNA, 22 nt, Salmonella enterica enterica serovar Typhi Ty2
aauggcgacgaucagcgccacg

SEQ ID NO: 1746910 - RNA, 15 nt, Salmonella enterica enterica serovar Typhi Ty2
aaugcgucggcacca

SEQ ID NO: 1746911 - RNA, 13 nt, Salmonella enterica enterica serovar Typhi Ty2
acaaucgcguuuu

SEQ ID NO: 1746912 - RNA, 18 nt, Salmonella enterica enterica serovar Typhi Ty2
acaauccgccacgcucgc

SEQ ID NO: 1746913 - RNA, 14 nt, Salmonella enterica enterica serovar Typhi Ty2
acaaugcccggcau

SEQ ID NO: 1746914 - RNA, 21 nt, Salmonella enterica enterica serovar Typhi Ty2
acaauggcgacgaucagcgcc

SEQ ID NO: 1746915 - RNA, 18 nt, Salmonella enterica enterica serovar Typhi Ty2
acaauggcgacgaucagc

SEQ ID NO: 1746916 - RNA, 14 nt, Salmonella enterica enterica serovar Typhi Ty2
acacacgcgcugac

SEQ ID NO: 1746917 - RNA, 22 nt, Salmonella enterica enterica serovar Typhi Ty2
acacagaugacaaagccggaua

SEQ ID NO: 1746918 - RNA, 18 nt, Salmonella enterica enterica serovar Typhi Ty2
acaauagcgcuaaacagc

SEQ ID NO: 1746919 - RNA, 16 nt, Salmonella enterica enterica serovar Typhi Ty2
acaauaucaucgucau

SEQ ID NO: 1746920 - RNA, 14 nt, Salmonella enterica enterica serovar Typhi Ty2
acaaucagcgcaau

SEQ ID NO: 1746921 - RNA, 23 nt, Salmonella enterica enterica serovar Typhi Ty2
acaauaaauaacgugucaggaug

SEQ ID NO: 1746922 - RNA, 12 nt, Salmonella enterica enterica serovar Typhi Ty2
acaauaccaaua

SEQ ID NO: 1746923 - RNA, 20 nt, Salmonella enterica enterica serovar Typhi Ty2
acaagccgccaacgccagca

SEQ ID NO: 1746924 - RNA, 13 nt, Salmonella enterica enterica serovar Typhi Ty2
acaacgagauuca

SEQ ID NO: 1746925 - RNA, 14 nt, Salmonella enterica enterica serovar Typhi Ty2
acaaccuggcuugc

SEQ ID NO: 1746926 - RNA, 20 nt, Salmonella enterica enterica serovar Typhi Ty2
acaaccuguaggccggauaa

SEQ ID NO: 1746927 - RNA, 17 nt, Salmonella enterica enterica serovar Typhi Ty2
acaacgccgccuggcau

SEQ ID NO: 1746928 - RNA, 20 nt, Salmonella enterica enterica serovar Typhi Ty2
acaacgccgguacgcagcag

SEQ ID NO: 1746929 - RNA, 14 nt, Salmonella enterica enterica serovar Typhi Ty2
acaaauucgcuaau

SEQ ID NO: 1746930 - RNA, 15 nt, Salmonella enterica enterica serovar Typhi Ty2
acaacaaaaagauau

SEQ ID NO: 1746931 - RNA, 20 nt, Salmonella enterica enterica serovar Typhi Ty2
acaacacgcuuuucagcgcc

SEQ ID NO: 1746932 - RNA, 15 nt, Salmonella enterica enterica serovar Typhi Ty2
acaacagccggaacg

SEQ ID NO: 1746933 - RNA, 19 nt, Salmonella enterica enterica serovar Typhi Ty2
acaaccaucgucuguacgg

SEQ ID NO: 1746934 - RNA, 15 nt, Salmonella enterica enterica serovar Typhi Ty2
aauuuccgcagccag

SEQ ID NO: 1746935 - RNA, 17 nt, Salmonella enterica enterica serovar Typhi Ty2
acaaaaggauacagcgc

SEQ ID NO: 1746936 - RNA, 16 nt, Salmonella enterica enterica serovar Typhi Ty2
acaaaucaaacucacc

SEQ ID NO: 1746937 - RNA, 20 nt, Salmonella enterica enterica serovar Typhi Ty2
aaaucagugaacacccugcc

SEQ ID NO: 1746938 - RNA, 18 nt, Salmonella enterica enterica serovar Typhi Ty2
aaaucagguaugcuucag

SEQ ID NO: 1746939 - RNA, 15 nt, Salmonella enterica enterica serovar Typhi Ty2
aaaguuucaggauaa

SEQ ID NO: 1746940 - RNA, 17 nt, Salmonella enterica enterica serovar Typhi Ty2
aaauaaggcugcgcguu

SEQ ID NO: 1746941 - RNA, 12 nt, Salmonella enterica enterica serovar Typhi Ty2
aaaacaagcagu

SEQ ID NO: 1746942 - RNA, 21 nt, Salmonella enterica enterica serovar Typhi Ty2
aaaacacuggcgcucagcgcc

SEQ ID NO: 1746943 - RNA, 14 nt, Salmonella enterica enterica serovar Typhi Ty2
aaaucgacagccag

SEQ ID NO: 1746944 - RNA, 12 nt, Salmonella enterica enterica serovar Typhi Ty2
aaaucgccauca

SEQ ID NO: 1746945 - RNA, 23 nt, Salmonella enterica enterica serovar Typhi Ty2
aaaucgaugaucgaggcgugcga

SEQ ID NO: 1746946 - RNA, 13 nt, Salmonella enterica enterica serovar Typhi Ty2
aaauccuccggcg

SEQ ID NO: 1746947 - RNA, 23 nt, Salmonella enterica enterica serovar Typhi Ty2
aaaugacgcccugcgccagcaug

SEQ ID NO: 1746948 - RNA, 13 nt, Salmonella enterica enterica serovar Typhi Ty2
aaaucgucaucag

SEQ ID NO: 1746949 - RNA, 21 nt, Salmonella enterica enterica serovar Typhi Ty2
aaaugaggacacaguaaugag

SEQ ID NO: 1746950 - RNA, 21 nt, Salmonella enterica enterica serovar Typhi Ty2
aacacccacaccaucgucgcg

SEQ ID NO: 1746951 - RNA, 21 nt, Salmonella enterica enterica serovar Typhi Ty2
aacaaccagaauaauggggau

SEQ ID NO: 1746952 - RNA, 14 nt, Salmonella enterica enterica serovar Typhi Ty2
aacaacaggccgcc

SEQ ID NO: 1746953 - RNA, 18 nt, Salmonella enterica enterica serovar Typhi Ty2
aacaacacgaucgaugcc

SEQ ID NO: 1746954 - RNA, 17 nt, Salmonella enterica enterica serovar Typhi Ty2
aacaaacauaagcaaau

SEQ ID NO: 1746955 - RNA, 16 nt, Salmonella enterica enterica serovar Typhi Ty2
aacaaacacaaucaca

SEQ ID NO: 1746956 - RNA, 13 nt, Salmonella enterica enterica serovar Typhi Ty2
aacaaaaccagca

SEQ ID NO: 1746957 - RNA, 12 nt, Salmonella enterica enterica serovar Typhi Ty2
aaaagaauagcc

SEQ ID NO: 1746958 - RNA, 20 nt, Salmonella enterica enterica serovar Typhi Ty2
aaauuugucagacaugauaa

SEQ ID NO: 1746959 - RNA, 18 nt, Salmonella enterica enterica serovar Typhi Ty2
aaaacuggugcaggcggu

SEQ ID NO: 1746960 - RNA, 15 nt, Salmonella enterica enterica serovar Typhi Ty2
aaaccuaccggcaua

SEQ ID NO: 1746961 - RNA, 17 nt, Salmonella enterica enterica serovar Typhi Ty2
aaaccguccacauccag

SEQ ID NO: 1746962 - RNA, 17 nt, Salmonella enterica enterica serovar Typhi Ty2
aaaccgucauuuaccag

SEQ ID NO: 1746963 - RNA, 12 nt, Salmonella enterica enterica serovar Typhi Ty2
aaaccuccggcu

SEQ ID NO: 1746964 - RNA, 16 nt, Salmonella enterica enterica serovar Typhi Ty2
aaaccaucuugcguua

SEQ ID NO: 1746965 - RNA, 17 nt, Salmonella enterica enterica serovar Typhi Ty2
aaaccagcauaaugagc

SEQ ID NO: 1746966 - RNA, 18 nt, Salmonella enterica enterica serovar Typhi Ty2
aaacccgcagccggauag

SEQ ID NO: 1746967 - RNA, 11 nt, Salmonella enterica enterica serovar Typhi Ty2
aaaccgaucuc

SEQ ID NO: 1746968 - RNA, 14 nt, Salmonella enterica enterica serovar Typhi Ty2
aaacaccucagcca

SEQ ID NO: 1746969 - RNA, 21 nt, Salmonella enterica enterica serovar Typhi Ty2
aaacaccggaauucuguucag

SEQ ID NO: 1746970 - RNA, 22 nt, Salmonella enterica enterica serovar Typhi Ty2
aaacacauccggcggcgucgcg

SEQ ID NO: 1746971 - RNA, 13 nt, Salmonella enterica enterica serovar Typhi Ty2
aaacacucaggca

SEQ ID NO: 1746972 - RNA, 22 nt, Salmonella enterica enterica serovar Typhi Ty2
aaacagaccggagcgugcuuca

SEQ ID NO: 1746973 - RNA, 12 nt, Salmonella enterica enterica serovar Typhi Ty2
aaacagaauaaa

SEQ ID NO: 1746974 - RNA, 19 nt, Salmonella enterica enterica serovar Typhi Ty2
aaaccacaaucacagcgca

SEQ ID NO: 1746975 - RNA, 20 nt, Salmonella enterica enterica serovar Typhi Ty2
aaagcgcuacagggcguuuu

SEQ ID NO: 1746976 - RNA, 13 nt, Salmonella enterica enterica serovar Typhi Ty2
aaagccgucggcg

SEQ ID NO: 1746977 - RNA, 18 nt, Salmonella enterica enterica serovar Typhi Ty2
aaagcgaauacuccugca

SEQ ID NO: 1746978 - RNA, 16 nt, Salmonella enterica enterica serovar Typhi Ty2
aaagcccaucagcgcc

SEQ ID NO: 1746979 - RNA, 16 nt, Salmonella enterica enterica serovar Typhi Ty2
aaagccaggccgccag

SEQ ID NO: 1746980 - RNA, 18 nt, Salmonella enterica enterica serovar Typhi Ty2
aaagcccaucaccgccag

SEQ ID NO: 1746981 - RNA, 16 nt, Salmonella enterica enterica serovar Typhi Ty2
aaagcccgcccagcau

SEQ ID NO: 1746982 - RNA, 18 nt, Salmonella enterica enterica serovar Typhi Ty2
aaagccgccauccggcau

SEQ ID NO: 1746983 - RNA, 20 nt, Salmonella enterica enterica serovar Typhi Ty2
aaaggggaucguguaacaau

SEQ ID NO: 1746984 - RNA, 23 nt, Salmonella enterica enterica serovar Typhi Ty2
aaaggggccugcacaauaccaau

SEQ ID NO: 1746985 - RNA, 14 nt, Salmonella enterica enterica serovar Typhi Ty2
aaagcagcggcggu

SEQ ID NO: 1746986 - RNA, 15 nt, Salmonella enterica enterica serovar Typhi Ty2
aaacgccgaagccag

SEQ ID NO: 1746987 - RNA, 20 nt, Salmonella enterica enterica serovar Typhi Ty2
aaacgcgucuucaucagcca

SEQ ID NO: 1746988 - RNA, 15 nt, Salmonella enterica enterica serovar Typhi Ty2
aaacggcgcguccag

SEQ ID NO: 1746989 - RNA, 20 nt, Salmonella enterica enterica serovar Typhi Ty2
aaaaauagcauuaagcugau

SEQ ID NO: 1746990 - RNA, 17 nt, Salmonella enterica enterica serovar Typhi Ty2
aaaaaggccgcuuucgc

SEQ ID NO: 1746991 - RNA, 15 nt, Salmonella enterica enterica serovar Typhi Ty2
aaaaagcuccggacg

SEQ ID NO: 1746992 - RNA, 22 nt, Salmonella enterica enterica serovar Typhi Ty2
aaaaagccagggaaauggcgaa

SEQ ID NO: 1746993 - RNA, 15 nt, Salmonella enterica enterica serovar Typhi Ty2
aaaaacguugcuggc

SEQ ID NO: 1746994 - RNA, 18 nt, Salmonella enterica enterica serovar Typhi Ty2
aaaaacguugcuggcgcg

SEQ ID NO: 1746995 - RNA, 21 nt, Salmonella enterica enterica serovar Typhi Ty2
aaaaaccgcccccagucugcu

SEQ ID NO: 1746996 - RNA, 23 nt, Salmonella enterica enterica serovar Typhi Ty2
aaaacauggggaguaaagcagcu

SEQ ID NO: 1746997 - RNA, 16 nt, Salmonella enterica enterica serovar Typhi Ty2
aaaaccggcaaauacc

SEQ ID NO: 1746998 - RNA, 13 nt, Salmonella enterica enterica serovar Typhi Ty2
aaaaacggcuuua

SEQ ID NO: 1746999 - RNA, 18 nt, Salmonella enterica enterica serovar Typhi Ty2
aaaaaaacaucgcugaua

SEQ ID NO: 1747000 - RNA, 21 nt, Salmonella enterica enterica serovar Typhi Ty2
aaaauuaaucccaacccgacc

SEQ ID NO: 1747001 - RNA, 19 nt, Salmonella enterica enterica serovar Typhi Ty2
aaaaacagguugcguaacg

SEQ ID NO: 1747002 - RNA, 21 nt, Salmonella enterica enterica serovar Typhi Ty2
aaaaucugcgccaaucgcgau

SEQ ID NO: 1747003 - RNA, 21 nt, Salmonella enterica enterica serovar Typhi Ty2
aaaauggcaaguaaaauagcc

SEQ ID NO: 1747004 - RNA, 15 nt, Salmonella enterica enterica serovar Typhi Ty2
aaaauagcuggcugu

SEQ ID NO: 1747005 - RNA, 13 nt, Salmonella enterica enterica serovar Typhi Ty2
aaaauagcgaucg

SEQ ID NO: 1747006 - RNA, 13 nt, Salmonella enterica enterica serovar Typhi Ty2
aaaauaauccgcu

SEQ ID NO: 1747007 - RNA, 13 nt, Salmonella enterica enterica serovar Typhi Ty2
aaaauacccgacc

SEQ ID NO: 1747008 - RNA, 15 nt, Salmonella enterica enterica serovar Typhi Ty2
aaaaucccgccagcg

SEQ ID NO: 1747009 - RNA, 14 nt, Salmonella enterica enterica serovar Typhi Ty2
aaaaguauggcggu

SEQ ID NO: 1747010 - RNA, 18 nt, Salmonella enterica enterica serovar Typhi Ty2
aaaagcccgcccagcauu

SEQ ID NO: 1747011 - RNA, 13 nt, Salmonella enterica enterica serovar Typhi Ty2
uuuuucauaucca

SEQ ID NO: 1747012 - RNA, 13 nt, Salmonella enterica enterica serovar Typhi Ty2
uuuuucaucauac

SEQ ID NO: 1747013 - RNA, 21 nt, Salmonella enterica enterica serovar Typhi Ty2
uuuuuucuguuauuuccgcaa

SEQ ID NO: 1747014 - RNA, 19 nt, Salmonella enterica enterica serovar Typhi Ty2
uuuuccugaaaaaauuccc

SEQ ID NO: 1747015 - RNA, 15 nt, Salmonella enterica enterica serovar Typhi Ty2
uuuucgaaaauuucg

SEQ ID NO: 1747016 - RNA, 17 nt, Salmonella enterica enterica serovar Typhi Ty2
uuuucaggaaguuuaac

SEQ ID NO: 1747017 - RNA, 23 nt, Salmonella enterica enterica serovar Typhi Ty2
uuuucagccugaagccagcaauc

SEQ ID NO: 1747018 - RNA, 12 nt, Salmonella enterica enterica serovar Typhi Ty2
uuuucaugaauc

SEQ ID NO: 1747019 - RNA, 15 nt, Salmonella enterica enterica serovar Typhi Ty2
uuuucauauguuuga

SEQ ID NO: 1747020 - RNA, 14 nt, Salmonella enterica enterica serovar Typhi Ty2
uuuaccuuuuccuc

SEQ ID NO: 1747021 - RNA, 19 nt, Salmonella enterica enterica serovar Typhi Ty2
uuuaccggaugggcagaua

SEQ ID NO: 1747022 - RNA, 18 nt, Salmonella enterica enterica serovar Typhi Ty2
uuuaccgccgcuuuucag

SEQ ID NO: 1747023 - RNA, 21 nt, Salmonella enterica enterica serovar Typhi Ty2
uuuucaaaugaucguuuuuug

SEQ ID NO: 1747024 - RNA, 21 nt, Salmonella enterica enterica serovar Typhi Ty2
uuuucagauaacgaaccauca

SEQ ID NO: 1747025 - RNA, 19 nt, Salmonella enterica enterica serovar Typhi Ty2
uuuucacgaccaaccaaca

SEQ ID NO: 1747026 - RNA, 22 nt, Salmonella enterica enterica serovar Typhi Ty2
uuuugcagcaacugauucaaaa

SEQ ID NO: 1747027 - RNA, 12 nt, Salmonella enterica enterica serovar Typhi Ty2
uuuugaauuuuu

SEQ ID NO: 1747028 - RNA, 17 nt, Salmonella enterica enterica serovar Typhi Ty2
uuuucgccaguuuugca

SEQ ID NO: 1747029 - RNA, 15 nt, Salmonella enterica enterica serovar Typhi Ty2
uuuucgaucuucucc

SEQ ID NO: 1747030 - RNA, 20 nt, Salmonella enterica enterica serovar Typhi Ty2
uuuucgcccccagcacgaca

SEQ ID NO: 1747031 - RNA, 19 nt, Salmonella enterica enterica serovar Typhi Ty2
uuuucucguguagccagua

SEQ ID NO: 1747032 - RNA, 13 nt, Salmonella enterica enterica serovar Typhi Ty2
uuuucugcuuucu

SEQ ID NO: 1747033 - RNA, 12 nt, Salmonella enterica enterica serovar Typhi Ty2
uuuucuucuucg

SEQ ID NO: 1747034 - RNA, 23 nt, Salmonella enterica enterica serovar Typhi Ty2
uuuuuaggcuauaaaaaucaucc

SEQ ID NO: 1747035 - RNA, 12 nt, Salmonella enterica enterica serovar Typhi Ty2
uuuuuauaacau

SEQ ID NO: 1747036 - RNA, 13 nt, Salmonella enterica enterica serovar Typhi Ty2
uuuuuauauaagc

SEQ ID NO: 1747037 - RNA, 15 nt, Salmonella enterica enterica serovar Typhi Ty2
uuuuucaauuuccag

SEQ ID NO: 1747038 - RNA, 15 nt, Salmonella enterica enterica serovar Typhi Ty2
uuuuucagcaaauac

SEQ ID NO: 1747039 - RNA, 19 nt, Salmonella enterica enterica serovar Typhi Ty2
uuuuuaugugacaaucacu

SEQ ID NO: 1747040 - RNA, 15 nt, Salmonella enterica enterica serovar Typhi Ty2
uuuuuauuuguuccu

SEQ ID NO: 1747041 - RNA, 16 nt, Salmonella enterica enterica serovar Typhi Ty2
uuuuuacgccugaacg

SEQ ID NO: 1747042 - RNA, 22 nt, Salmonella enterica enterica serovar Typhi Ty2
uuuuuacgccauaacacaaacu

SEQ ID NO: 1747043 - RNA, 20 nt, Salmonella enterica enterica serovar Typhi Ty2
uuuuuagccuguuauucaau

SEQ ID NO: 1747044 - RNA, 12 nt, Salmonella enterica enterica serovar Typhi Ty2
uuuuuaccaauu

SEQ ID NO: 1747045 - RNA, 13 nt, Salmonella enterica enterica serovar Typhi Ty2
uuuuuaauauaag

SEQ ID NO: 1747046 - RNA, 19 nt, Salmonella enterica enterica serovar Typhi Ty2
uuuuuaaauaacuuuuaau

SEQ ID NO: 1747047 - RNA, 21 nt, Salmonella enterica enterica serovar Typhi Ty2
uuuugcuacgucgccuggcau

SEQ ID NO: 1747048 - RNA, 10 nt, Salmonella enterica enterica serovar Typhi Ty2
uuuugccgcc

SEQ ID NO: 1747049 - RNA, 14 nt, Salmonella enterica enterica serovar Typhi Ty2
uuuugguaucuucu

SEQ ID NO: 1747050 - RNA, 17 nt, Salmonella enterica enterica serovar Typhi Ty2
uuuuggccggaccugcg

SEQ ID NO: 1747051 - RNA, 19 nt, Salmonella enterica enterica serovar Typhi Ty2
uuuuguuguuaauuugauu

SEQ ID NO: 1747052 - RNA, 13 nt, Salmonella enterica enterica serovar Typhi Ty2
uuuugucaucaga

SEQ ID NO: 1747053 - RNA, 11 nt, Salmonella enterica enterica serovar Typhi Ty2
uuuugucaugg

SEQ ID NO: 1747054 - RNA, 21 nt, Salmonella enterica enterica serovar Typhi Ty2
uuuuguauuccuucggugcca

SEQ ID NO: 1747055 - RNA, 17 nt, Salmonella enterica enterica serovar Typhi Ty2
uuuugucggaauuuccg

SEQ ID NO: 1747056 - RNA, 18 nt, Salmonella enterica enterica serovar Typhi Ty2
uuuugugucaaaaaguug

SEQ ID NO: 1747057 - RNA, 18 nt, Salmonella enterica enterica serovar Typhi Ty2
uucguuccgcgauuuccu

SEQ ID NO: 1747058 - RNA, 21 nt, Salmonella enterica enterica serovar Typhi Ty2
uucguuccgcgauuuccugug

SEQ ID NO: 1747059 - RNA, 19 nt, Salmonella enterica enterica serovar Typhi Ty2
uucguuaccgccuuuuuuc

SEQ ID NO: 1747060 - RNA, 17 nt, Salmonella enterica enterica serovar Typhi Ty2
uucguuauaaggccugc

SEQ ID NO: 1747061 - RNA, 15 nt, Salmonella enterica enterica serovar Typhi Ty2
uucuaacgaaacaga

SEQ ID NO: 1747062 - RNA, 17 nt, Salmonella enterica enterica serovar Typhi Ty2
uucguggcgcuguucuu

SEQ ID NO: 1747063 - RNA, 20 nt, Salmonella enterica enterica serovar Typhi Ty2
uucguggcgcuguucuugcu

SEQ ID NO: 1747064 - RNA, 18 nt, Salmonella enterica enterica serovar Typhi Ty2
uucgucuuuauucaucau

SEQ ID NO: 1747065 - RNA, 18 nt, Salmonella enterica enterica serovar Typhi Ty2
uucggcagaaaaaguaga

SEQ ID NO: 1747066 - RNA, 22 nt, Salmonella enterica enterica serovar Typhi Ty2
uucggcaaaacgccgcagaaaa

SEQ ID NO: 1747067 - RNA, 23 nt, Salmonella enterica enterica serovar Typhi Ty2
uucuacuucaauuuuccagauag

SEQ ID NO: 1747068 - RNA, 21 nt, Salmonella enterica enterica serovar Typhi Ty2
uucuccugcggccuugccgcc

SEQ ID NO: 1747069 - RNA, 16 nt, Salmonella enterica enterica serovar Typhi Ty2
uucucagccagaucca

SEQ ID NO: 1747070 - RNA, 18 nt, Salmonella enterica enterica serovar Typhi Ty2
uucuguaauuugaaauug

SEQ ID NO: 1747071 - RNA, 23 nt, Salmonella enterica enterica serovar Typhi Ty2
uucuuacgauaccccauccacuu

SEQ ID NO: 1747072 - RNA, 17 nt, Salmonella enterica enterica serovar Typhi Ty2
uucuucaagccaggcuu

SEQ ID NO: 1747073 - RNA, 20 nt, Salmonella enterica enterica serovar Typhi Ty2
uucuucaagcguuuccagag

SEQ ID NO: 1747074 - RNA, 18 nt, Salmonella enterica enterica serovar Typhi Ty2
uucuuccagguuaaccca

SEQ ID NO: 1747075 - RNA, 13 nt, Salmonella enterica enterica serovar Typhi Ty2
uucuuccagaacg

SEQ ID NO: 1747076 - RNA, 12 nt, Salmonella enterica enterica serovar Typhi Ty2
uucuuccgugcc

SEQ ID NO: 1747077 - RNA, 13 nt, Salmonella enterica enterica serovar Typhi Ty2
uucuucaucuuca

SEQ ID NO: 1747078 - RNA, 15 nt, Salmonella enterica enterica serovar Typhi Ty2
uucuuccagcggcag

SEQ ID NO: 1747079 - RNA, 13 nt, Salmonella enterica enterica serovar Typhi Ty2
uucugaacgcugc

SEQ ID NO: 1747080 - RNA, 18 nt, Salmonella enterica enterica serovar Typhi Ty2
uucugaauaaauugaauu

SEQ ID NO: 1747081 - RNA, 13 nt, Salmonella enterica enterica serovar Typhi Ty2
uucugaauaaauu

SEQ ID NO: 1747082 - RNA, 21 nt, Salmonella enterica enterica serovar Typhi Ty2
uucugaagcguaacagcgcua

SEQ ID NO: 1747083 - RNA, 15 nt, Salmonella enterica enterica serovar Typhi Ty2
uucugaauuucacgc

SEQ ID NO: 1747084 - RNA, 18 nt, Salmonella enterica enterica serovar Typhi Ty2
uucugaauuucacgcuuc

SEQ ID NO: 1747085 - RNA, 24 nt, Salmonella enterica enterica serovar Typhi Ty2
uucucgggccuguuccggcgagga

SEQ ID NO: 1747086 - RNA, 17 nt, Salmonella enterica enterica serovar Typhi Ty2
uucucgcguccccagcc

SEQ ID NO: 1747087 - RNA, 23 nt, Salmonella enterica enterica serovar Typhi Ty2
uucucgccgccauuuuauccagg

SEQ ID NO: 1747088 - RNA, 17 nt, Salmonella enterica enterica serovar Typhi Ty2
uucucgaggacagugaa

SEQ ID NO: 1747089 - RNA, 17 nt, Salmonella enterica enterica serovar Typhi Ty2
uucugauaacgcaggcg

SEQ ID NO: 1747090 - RNA, 18 nt, Salmonella enterica enterica serovar Typhi Ty2
uucugaccaguugcaggc

SEQ ID NO: 1747091 - RNA, 21 nt, Salmonella enterica enterica serovar Typhi Ty2
uucugaccacauuuucucgug

SEQ ID NO: 1747092 - RNA, 20 nt, Salmonella enterica enterica serovar Typhi Ty2
uucuggccccugagcaauca

SEQ ID NO: 1747093 - RNA, 14 nt, Salmonella enterica enterica serovar Typhi Ty2
uucuggcaauaagg

SEQ ID NO: 1747094 - RNA, 16 nt, Salmonella enterica enterica serovar Typhi Ty2
uucuggauagcgguuu

SEQ ID NO: 1747095 - RNA, 15 nt, Salmonella enterica enterica serovar Typhi Ty2
uucugguaaaccuca

SEQ ID NO: 1747096 - RNA, 20 nt, Salmonella enterica enterica serovar Typhi Ty2
uugcagcgguaaacaccacc

SEQ ID NO: 1747097 - RNA, 16 nt, Salmonella enterica enterica serovar Typhi Ty2
uugcagcgugaaaagc

SEQ ID NO: 1747098 - RNA, 12 nt, Salmonella enterica enterica serovar Typhi Ty2
uugcagcgccau

SEQ ID NO: 1747099 - RNA, 18 nt, Salmonella enterica enterica serovar Typhi Ty2
uugcagcgguaaacacca

SEQ ID NO: 1747100 - RNA, 18 nt, Salmonella enterica enterica serovar Typhi Ty2
uugaugaugccaggacca

SEQ ID NO: 1747101 - RNA, 20 nt, Salmonella enterica enterica serovar Typhi Ty2
uugaugauaaccgccgccaa

SEQ ID NO: 1747102 - RNA, 15 nt, Salmonella enterica enterica serovar Typhi Ty2
uugaguuugcaaucc

SEQ ID NO: 1747103 - RNA, 12 nt, Salmonella enterica enterica serovar Typhi Ty2
uugauaaagcgc

SEQ ID NO: 1747104 - RNA, 14 nt, Salmonella enterica enterica serovar Typhi Ty2
uugauaagagaaaa

SEQ ID NO: 1747105 - RNA, 16 nt, Salmonella enterica enterica serovar Typhi Ty2
uugauaacggaaucac

SEQ ID NO: 1747106 - RNA, 14 nt, Salmonella enterica enterica serovar Typhi Ty2
uugaucgcgcagca

SEQ ID NO: 1747107 - RNA, 18 nt, Salmonella enterica enterica serovar Typhi Ty2
uugaucgcgcagcaaauc

SEQ ID NO: 1747108 - RNA, 19 nt, Salmonella enterica enterica serovar Typhi Ty2
uugaucggguuuuccugaa

SEQ ID NO: 1747109 - RNA, 17 nt, Salmonella enterica enterica serovar Typhi Ty2
uugaucguaaaaugaaa

SEQ ID NO: 1747110 - RNA, 19 nt, Salmonella enterica enterica serovar Typhi Ty2
uugauauugugcauacuga

SEQ ID NO: 1747111 - RNA, 19 nt, Salmonella enterica enterica serovar Typhi Ty2
uucuugcccgcugaguggu

SEQ ID NO: 1747112 - RNA, 13 nt, Salmonella enterica enterica serovar Typhi Ty2
uucuuugguauug

SEQ ID NO: 1747113 - RNA, 15 nt, Salmonella enterica enterica serovar Typhi Ty2
uucuuugccuuuuuc

SEQ ID NO: 1747114 - RNA, 20 nt, Salmonella enterica enterica serovar Typhi Ty2
uugaaaaaaacaucgcugau

SEQ ID NO: 1747115 - RNA, 17 nt, Salmonella enterica enterica serovar Typhi Ty2
uugaacccguaagcccu

SEQ ID NO: 1747116 - RNA, 16 nt, Salmonella enterica enterica serovar Typhi Ty2
uugaacauuuuuucag

SEQ ID NO: 1747117 - RNA, 17 nt, Salmonella enterica enterica serovar Typhi Ty2
uugaccguccccagcca

SEQ ID NO: 1747118 - RNA, 14 nt, Salmonella enterica enterica serovar Typhi Ty2
uugacggccaccau

SEQ ID NO: 1747119 - RNA, 14 nt, Salmonella enterica enterica serovar Typhi Ty2
uugagaaaaccaua

SEQ ID NO: 1747120 - RNA, 22 nt, Salmonella enterica enterica serovar Typhi Ty2
uugacgcaaacugccaggcaau

SEQ ID NO: 1747121 - RNA, 13 nt, Salmonella enterica enterica serovar Typhi Ty2
uugacgcuuugca

SEQ ID NO: 1747122 - RNA, 11 nt, Salmonella enterica enterica serovar Typhi Ty2
uugaagacagc

SEQ ID NO: 1747123 - RNA, 15 nt, Salmonella enterica enterica serovar Typhi Ty2
uugaacucuuucaga

SEQ ID NO: 1747124 - RNA, 17 nt, Salmonella enterica enterica serovar Typhi Ty2
uugaacuuacccagcaa

SEQ ID NO: 1747125 - RNA, 19 nt, Salmonella enterica enterica serovar Typhi Ty2
uuguucuuucaccauuaag

SEQ ID NO: 1747126 - RNA, 23 nt, Salmonella enterica enterica serovar Typhi Ty2
uuguucaauagagcgcagcaaaa

SEQ ID NO: 1747127 - RNA, 17 nt, Salmonella enterica enterica serovar Typhi Ty2
uuguuuauuaugcguuu

SEQ ID NO: 1747128 - RNA, 17 nt, Salmonella enterica enterica serovar Typhi Ty2
uuguuuauccugcaaau

SEQ ID NO: 1747129 - RNA, 23 nt, Salmonella enterica enterica serovar Typhi Ty2
uuguugccgcccguuuuuuccag

SEQ ID NO: 1747130 - RNA, 22 nt, Salmonella enterica enterica serovar Typhi Ty2
uugugagcuauacgguaaauca

SEQ ID NO: 1747131 - RNA, 22 nt, Salmonella enterica enterica serovar Typhi Ty2
uugugaguaauaaucacauuau

SEQ ID NO: 1747132 - RNA, 23 nt, Salmonella enterica enterica serovar Typhi Ty2
uugugauacgcgucaaauagaga

SEQ ID NO: 1747133 - RNA, 15 nt, Salmonella enterica enterica serovar Typhi Ty2
uugugaguucauaaa

SEQ ID NO: 1747134 - RNA, 13 nt, Salmonella enterica enterica serovar Typhi Ty2
uuguguaaucuuu

SEQ ID NO: 1747135 - RNA, 15 nt, Salmonella enterica enterica serovar Typhi Ty2
uugucgccaauaauu

SEQ ID NO: 1747136 - RNA, 15 nt, Salmonella enterica enterica serovar Typhi Ty2
uugucgcccugcaau

SEQ ID NO: 1747137 - RNA, 14 nt, Salmonella enterica enterica serovar Typhi Ty2
uugucugaccgggc

SEQ ID NO: 1747138 - RNA, 13 nt, Salmonella enterica enterica serovar Typhi Ty2
uugucuuaaauau

SEQ ID NO: 1747139 - RNA, 14 nt, Salmonella enterica enterica serovar Typhi Ty2
uugucuucuuagua

SEQ ID NO: 1747140 - RNA, 17 nt, Salmonella enterica enterica serovar Typhi Ty2
uugucgaucaucagacc

SEQ ID NO: 1747141 - RNA, 22 nt, Salmonella enterica enterica serovar Typhi Ty2
uuguccucaucauucgguuagg

SEQ ID NO: 1747142 - RNA, 13 nt, Salmonella enterica enterica serovar Typhi Ty2
uugucaaaaauag

SEQ ID NO: 1747143 - RNA, 18 nt, Salmonella enterica enterica serovar Typhi Ty2
uuguaggccugauagcac

SEQ ID NO: 1747144 - RNA, 18 nt, Salmonella enterica enterica serovar Typhi Ty2
uuguagcugcgccagcgu

SEQ ID NO: 1747145 - RNA, 12 nt, Salmonella enterica enterica serovar Typhi Ty2
uuguaacagcag

SEQ ID NO: 1747146 - RNA, 18 nt, Salmonella enterica enterica serovar Typhi Ty2
uuuaauguugccguggca

SEQ ID NO: 1747147 - RNA, 22 nt, Salmonella enterica enterica serovar Typhi Ty2
uuuacaaaauuggguaguaaua

SEQ ID NO: 1747148 - RNA, 14 nt, Salmonella enterica enterica serovar Typhi Ty2
uuuacaauaauucg

SEQ ID NO: 1747149 - RNA, 23 nt, Salmonella enterica enterica serovar Typhi Ty2
uuuacaaccguggcguuuucauu

SEQ ID NO: 1747150 - RNA, 17 nt, Salmonella enterica enterica serovar Typhi Ty2
uuuacaauuucgcaaac

SEQ ID NO: 1747151 - RNA, 23 nt, Salmonella enterica enterica serovar Typhi Ty2
uuuaccagugcuaaaauuauaca

SEQ ID NO: 1747152 - RNA, 16 nt, Salmonella enterica enterica serovar Typhi Ty2
uuuaauccaccacagu

SEQ ID NO: 1747153 - RNA, 16 nt, Salmonella enterica enterica serovar Typhi Ty2
uuuaagccgauugaau

SEQ ID NO: 1747154 - RNA, 18 nt, Salmonella enterica enterica serovar Typhi Ty2
uuuaagcgcaggugcgau

SEQ ID NO: 1747155 - RNA, 17 nt, Salmonella enterica enterica serovar Typhi Ty2
uuuaagcgccuccacaa

SEQ ID NO: 1747156 - RNA, 15 nt, Salmonella enterica enterica serovar Typhi Ty2
uuuaaggacauucag

SEQ ID NO: 1747157 - RNA, 16 nt, Salmonella enterica enterica serovar Typhi Ty2
uuuaaggcggcaaaga

SEQ ID NO: 1747158 - RNA, 20 nt, Salmonella enterica enterica serovar Typhi Ty2
uuuaagcuuaaugauaauug

SEQ ID NO: 1747159 - RNA, 16 nt, Salmonella enterica enterica serovar Typhi Ty2
uuuaaauuguuauacc

SEQ ID NO: 1747160 - RNA, 12 nt, Salmonella enterica enterica serovar Typhi Ty2
uuuaaaaugacc

SEQ ID NO: 1747161 - RNA, 18 nt, Salmonella enterica enterica serovar Typhi Ty2
uuguuuguggcaaaguac

SEQ ID NO: 1747162 - RNA, 22 nt, Salmonella enterica enterica serovar Typhi Ty2
uuuaaaauuccaauauuuauuu

SEQ ID NO: 1747163 - RNA, 16 nt, Salmonella enterica enterica serovar Typhi Ty2
uuuaaaauuccaauau

SEQ ID NO: 1747164 - RNA, 18 nt, Salmonella enterica enterica serovar Typhi Ty2
uuuaaaauguuuuuguug

SEQ ID NO: 1747165 - RNA, 13 nt, Salmonella enterica enterica serovar Typhi Ty2
uuuaaacaacaua

SEQ ID NO: 1747166 - RNA, 15 nt, Salmonella enterica enterica serovar Typhi Ty2
uuuaaaccacaccug

SEQ ID NO: 1747167 - RNA, 23 nt, Salmonella enterica enterica serovar Typhi Ty2
uuggucagguaagcuauuacaaa

SEQ ID NO: 1747168 - RNA, 19 nt, Salmonella enterica enterica serovar Typhi Ty2
uuggucaggcuaaauggca

SEQ ID NO: 1747169 - RNA, 18 nt, Salmonella enterica enterica serovar Typhi Ty2
uugguaaguuuuucucuu

SEQ ID NO: 1747170 - RNA, 11 nt, Salmonella enterica enterica serovar Typhi Ty2
uugguuuugcc

SEQ ID NO: 1747171 - RNA, 15 nt, Salmonella enterica enterica serovar Typhi Ty2
uugguuuugccauuc

SEQ ID NO: 1747172 - RNA, 19 nt, Salmonella enterica enterica serovar Typhi Ty2
uuguaaaaccgacuaucag

SEQ ID NO: 1747173 - RNA, 21 nt, Salmonella enterica enterica serovar Typhi Ty2
uuggugauuaacagcgccauc

SEQ ID NO: 1747174 - RNA, 17 nt, Salmonella enterica enterica serovar Typhi Ty2
uuggcuuuguaaauauu

SEQ ID NO: 1747175 - RNA, 17 nt, Salmonella enterica enterica serovar Typhi Ty2
uugcuggcuugcucagg

SEQ ID NO: 1747176 - RNA, 18 nt, Salmonella enterica enterica serovar Typhi Ty2
uugcuggcaagaaccgcu

SEQ ID NO: 1747177 - RNA, 14 nt, Salmonella enterica enterica serovar Typhi Ty2
uugcugcuauguaa

SEQ ID NO: 1747178 - RNA, 18 nt, Salmonella enterica enterica serovar Typhi Ty2
uugcugcggcacgaaaaa

SEQ ID NO: 1747179 - RNA, 18 nt, Salmonella enterica enterica serovar Typhi Ty2
uuggaaacuaugcaaaac

SEQ ID NO: 1747180 - RNA, 18 nt, Salmonella enterica enterica serovar Typhi Ty2
uuggaaccaaacaccaga

SEQ ID NO: 1747181 - RNA, 22 nt, Salmonella enterica enterica serovar Typhi Ty2
uugcuugugacggcaaaguucc

SEQ ID NO: 1747182 - RNA, 23 nt, Salmonella enterica enterica serovar Typhi Ty2
uuggcaaacugucgguaaagaaa

SEQ ID NO: 1747183 - RNA, 12 nt, Salmonella enterica enterica serovar Typhi Ty2
uuggcaauuaaa

SEQ ID NO: 1747184 - RNA, 14 nt, Salmonella enterica enterica serovar Typhi Ty2
uuggcaaucacaag

SEQ ID NO: 1747185 - RNA, 15 nt, Salmonella enterica enterica serovar Typhi Ty2
uuggcaaucaaaucc

SEQ ID NO: 1747186 - RNA, 19 nt, Salmonella enterica enterica serovar Typhi Ty2
uuggaugaaccauaucaaa

SEQ ID NO: 1747187 - RNA, 17 nt, Salmonella enterica enterica serovar Typhi Ty2
uugccagcggccagggc

SEQ ID NO: 1747188 - RNA, 23 nt, Salmonella enterica enterica serovar Typhi Ty2
uugcauauaaggcccauacccca

SEQ ID NO: 1747189 - RNA, 16 nt, Salmonella enterica enterica serovar Typhi Ty2
uugccacgccauacgu

SEQ ID NO: 1747190 - RNA, 20 nt, Salmonella enterica enterica serovar Typhi Ty2
uugcagguuacucacugccg

SEQ ID NO: 1747191 - RNA, 15 nt, Salmonella enterica enterica serovar Typhi Ty2
uugcaguacaggcau

SEQ ID NO: 1747192 - RNA, 17 nt, Salmonella enterica enterica serovar Typhi Ty2
uugcaggaagggcagca

SEQ ID NO: 1747193 - RNA, 14 nt, Salmonella enterica enterica serovar Typhi Ty2
uugcauaagagguc

SEQ ID NO: 1747194 - RNA, 23 nt, Salmonella enterica enterica serovar Typhi Ty2
uugcaguuuuaccguaaaaugcu

SEQ ID NO: 1747195 - RNA, 13 nt, Salmonella enterica enterica serovar Typhi Ty2
uugcauaaagaac

SEQ ID NO: 1747196 - RNA, 12 nt, Salmonella enterica enterica serovar Typhi Ty2
uugccauacgcc

SEQ ID NO: 1747197 - RNA, 19 nt, Salmonella enterica enterica serovar Typhi Ty2
uugccauacgcccacgcgg

SEQ ID NO: 1747198 - RNA, 22 nt, Salmonella enterica enterica serovar Typhi Ty2
uugccauaaauacaauucaacu

SEQ ID NO: 1747199 - RNA, 17 nt, Salmonella enterica enterica serovar Typhi Ty2
uugccgguuaacucuuu

SEQ ID NO: 1747200 - RNA, 16 nt, Salmonella enterica enterica serovar Typhi Ty2
uugccgggcugaccgc

SEQ ID NO: 1747201 - RNA, 21 nt, Salmonella enterica enterica serovar Typhi Ty2
uugccgguuuuuuuuugccug

SEQ ID NO: 1747202 - RNA, 23 nt, Salmonella enterica enterica serovar Typhi Ty2
uugccgucgccggaaugcgaaua

SEQ ID NO: 1747203 - RNA, 18 nt, Salmonella enterica enterica serovar Typhi Ty2
uugccgugaauauucaga

SEQ ID NO: 1747204 - RNA, 18 nt, Salmonella enterica enterica serovar Typhi Ty2
uugccguuaacugcugcu

SEQ ID NO: 1747205 - RNA, 15 nt, Salmonella enterica enterica serovar Typhi Ty2
uugccguuaacugcu

SEQ ID NO: 1747206 - RNA, 17 nt, Salmonella enterica enterica serovar Typhi Ty2
uugcuaggaacagugac

SEQ ID NO: 1747207 - RNA, 20 nt, Salmonella enterica enterica serovar Typhi Ty2
uugcgggccucguuaaaauc

SEQ ID NO: 1747208 - RNA, 20 nt, Salmonella enterica enterica serovar Typhi Ty2
uugcuccccaaccgccagcc

SEQ ID NO: 1747209 - RNA, 19 nt, Salmonella enterica enterica serovar Typhi Ty2
uugcucgcggcgugaugcc

SEQ ID NO: 1747210 - RNA, 20 nt, Salmonella enterica enterica serovar Typhi Ty2
uugccugauggcgcugcgcu

SEQ ID NO: 1747211 - RNA, 14 nt, Salmonella enterica enterica serovar Typhi Ty2
uugcgccagcgcca

SEQ ID NO: 1747212 - RNA, 15 nt, Salmonella enterica enterica serovar Typhi Ty2
uugcgcccaggccaa

SEQ ID NO: 1747213 - RNA, 15 nt, Salmonella enterica enterica serovar Typhi Ty2
uugcgcccagauaau

SEQ ID NO: 1747214 - RNA, 19 nt, Salmonella enterica enterica serovar Typhi Ty2
uugcggaucgaucucgaua

SEQ ID NO: 1747215 - RNA, 21 nt, Salmonella enterica enterica serovar Typhi Ty2
uuccugacuguaauuucgcug

SEQ ID NO: 1747216 - RNA, 20 nt, Salmonella enterica enterica serovar Typhi Ty2
uuccucuaaaugggcaggag

SEQ ID NO: 1747217 - RNA, 12 nt, Salmonella enterica enterica serovar Typhi Ty2
uuccucacagcc

SEQ ID NO: 1747218 - RNA, 16 nt, Salmonella enterica enterica serovar Typhi Ty2
uuccucagaaagcguu

SEQ ID NO: 1747219 - RNA, 22 nt, Salmonella enterica enterica serovar Typhi Ty2
uuccggcuucguuaagcgguuu

SEQ ID NO: 1747220 - RNA, 16 nt, Salmonella enterica enterica serovar Typhi Ty2
uuccggcgaaaaaccg

SEQ ID NO: 1747221 - RNA, 12 nt, Salmonella enterica enterica serovar Typhi Ty2
uuccggcagacg

SEQ ID NO: 1747222 - RNA, 22 nt, Salmonella enterica enterica serovar Typhi Ty2
uuccggaucgccgaagcggcag

SEQ ID NO: 1747223 - RNA, 21 nt, Salmonella enterica enterica serovar Typhi Ty2
uuccgggauguuaauuucauc

SEQ ID NO: 1747224 - RNA, 18 nt, Salmonella enterica enterica serovar Typhi Ty2
uuccggcggucagccagc

SEQ ID NO: 1747225 - RNA, 14 nt, Salmonella enterica enterica serovar Typhi Ty2
uuccggugugacca

SEQ ID NO: 1747226 - RNA, 15 nt, Salmonella enterica enterica serovar Typhi Ty2
uuccuaacccuucau

SEQ ID NO: 1747227 - RNA, 13 nt, Salmonella enterica enterica serovar Typhi Ty2
uuccguuagcucu

SEQ ID NO: 1747228 - RNA, 23 nt, Salmonella enterica enterica serovar Typhi Ty2
uuccguuaauggaggcagugaaa

SEQ ID NO: 1747229 - RNA, 18 nt, Salmonella enterica enterica serovar Typhi Ty2
uuccgucauggugaugau

SEQ ID NO: 1747230 - RNA, 21 nt, Salmonella enterica enterica serovar Typhi Ty2
uuccugcgcugucaccagcag

SEQ ID NO: 1747231 - RNA, 16 nt, Salmonella enterica enterica serovar Typhi Ty2
uuccugcugcgcuuug

SEQ ID NO: 1747232 - RNA, 15 nt, Salmonella enterica enterica serovar Typhi Ty2
uuccugcguugacca

SEQ ID NO: 1747233 - RNA, 16 nt, Salmonella enterica enterica serovar Typhi Ty2
uuccugauuaauauga

SEQ ID NO: 1747234 - RNA, 11 nt, Salmonella enterica enterica serovar Typhi Ty2
uuccugucaac

SEQ ID NO: 1747235 - RNA, 19 nt, Salmonella enterica enterica serovar Typhi Ty2
uuccuuguuuuaacggaau

SEQ ID NO: 1747236 - RNA, 20 nt, Salmonella enterica enterica serovar Typhi Ty2
uuccuuguccgaugcagaca

SEQ ID NO: 1747237 - RNA, 16 nt, Salmonella enterica enterica serovar Typhi Ty2
uuccuuguuccaccug

SEQ ID NO: 1747238 - RNA, 12 nt, Salmonella enterica enterica serovar Typhi Ty2
uuccuuucugcg

SEQ ID NO: 1747239 - RNA, 15 nt, Salmonella enterica enterica serovar Typhi Ty2
uuccuuugccuuucu

SEQ ID NO: 1747240 - RNA, 17 nt, Salmonella enterica enterica serovar Typhi Ty2
uucgaauuacauaacca

SEQ ID NO: 1747241 - RNA, 12 nt, Salmonella enterica enterica serovar Typhi Ty2
uucgacaucuuc

SEQ ID NO: 1747242 - RNA, 23 nt, Salmonella enterica enterica serovar Typhi Ty2
uucgaccgacgcguuuuccagca

SEQ ID NO: 1747243 - RNA, 14 nt, Salmonella enterica enterica serovar Typhi Ty2
uucgaauccuccug

SEQ ID NO: 1747244 - RNA, 23 nt, Salmonella enterica enterica serovar Typhi Ty2
uucgacgggacgaauuuccagcg

SEQ ID NO: 1747245 - RNA, 15 nt, Salmonella enterica enterica serovar Typhi Ty2
uucgacgauaaaaaa

SEQ ID NO: 1747246 - RNA, 16 nt, Salmonella enterica enterica serovar Typhi Ty2
uucgacgauaaaaaaa

SEQ ID NO: 1747247 - RNA, 19 nt, Salmonella enterica enterica serovar Typhi Ty2
uucgaugcggccauggaga

SEQ ID NO: 1747248 - RNA, 21 nt, Salmonella enterica enterica serovar Typhi Ty2
uucgauagcguuuuccagcuc

SEQ ID NO: 1747249 - RNA, 14 nt, Salmonella enterica enterica serovar Typhi Ty2
uucgauaaacucaa

SEQ ID NO: 1747250 - RNA, 17 nt, Salmonella enterica enterica serovar Typhi Ty2
uucgauaaccaccagcg

SEQ ID NO: 1747251 - RNA, 12 nt, Salmonella enterica enterica serovar Typhi Ty2
uucgcagcgcag

SEQ ID NO: 1747252 - RNA, 20 nt, Salmonella enterica enterica serovar Typhi Ty2
uucgauuguugacugccagc

SEQ ID NO: 1747253 - RNA, 18 nt, Salmonella enterica enterica serovar Typhi Ty2
uucgcgaaucgcuucacg

SEQ ID NO: 1747254 - RNA, 14 nt, Salmonella enterica enterica serovar Typhi Ty2
uucgccugaacagg

SEQ ID NO: 1747255 - RNA, 17 nt, Salmonella enterica enterica serovar Typhi Ty2
uucgcgaugcucaacca

SEQ ID NO: 1747256 - RNA, 22 nt, Salmonella enterica enterica serovar Typhi Ty2
uucgcgucaaaacuuauuuuau

SEQ ID NO: 1747257 - RNA, 16 nt, Salmonella enterica enterica serovar Typhi Ty2
uucgcggaauuucagg

SEQ ID NO: 1747258 - RNA, 13 nt, Salmonella enterica enterica serovar Typhi Ty2
uucgcuaaaucag

SEQ ID NO: 1747259 - RNA, 13 nt, Salmonella enterica enterica serovar Typhi Ty2
uucgcugcaacuu

SEQ ID NO: 1747260 - RNA, 20 nt, Salmonella enterica enterica serovar Typhi Ty2
uucgcuucuucuaccaccuu

SEQ ID NO: 1747261 - RNA, 17 nt, Salmonella enterica enterica serovar Typhi Ty2
uucgccucccucacccu

SEQ ID NO: 1747262 - RNA, 23 nt, Salmonella enterica enterica serovar Typhi Ty2
uucgccguguucuuacccacugu

SEQ ID NO: 1747263 - RNA, 19 nt, Salmonella enterica enterica serovar Typhi Ty2
uucgcccauugccacccau

SEQ ID NO: 1747264 - RNA, 17 nt, Salmonella enterica enterica serovar Typhi Ty2
uucgccccacuggcccc

SEQ ID NO: 1747265 - RNA, 18 nt, Salmonella enterica enterica serovar Typhi Ty2
uucgcccggcgccagcuc

SEQ ID NO: 1747266 - RNA, 13 nt, Salmonella enterica enterica serovar Typhi Ty2
uucgcccauaucc

SEQ ID NO: 1747267 - RNA, 15 nt, Salmonella enterica enterica serovar Typhi Ty2
uucgccagugacaaa

SEQ ID NO: 1747268 - RNA, 22 nt, Salmonella enterica enterica serovar Typhi Ty2
uuccgcagccaacaacaggccg

SEQ ID NO: 1747269 - RNA, 20 nt, Salmonella enterica enterica serovar Typhi Ty2
uuccgcaggggauucugcca

SEQ ID NO: 1747270 - RNA, 15 nt, Salmonella enterica enterica serovar Typhi Ty2
uuccgccaccacgcc

SEQ ID NO: 1747271 - RNA, 23 nt, Salmonella enterica enterica serovar Typhi Ty2
uuccgacagugaacggcauaauc

SEQ ID NO: 1747272 - RNA, 23 nt, Salmonella enterica enterica serovar Typhi Ty2
uuccgccaccagauagucaucac

SEQ ID NO: 1747273 - RNA, 16 nt, Salmonella enterica enterica serovar Typhi Ty2
uuccgccaccacgccc

SEQ ID NO: 1747274 - RNA, 19 nt, Salmonella enterica enterica serovar Typhi Ty2
uuccgccaccagauaguca

SEQ ID NO: 1747275 - RNA, 19 nt, Salmonella enterica enterica serovar Typhi Ty2
uuccgccaugaaaaaaacg

SEQ ID NO: 1747276 - RNA, 21 nt, Salmonella enterica enterica serovar Typhi Ty2
uuccgccagcgccagcagcag

SEQ ID NO: 1747277 - RNA, 19 nt, Salmonella enterica enterica serovar Typhi Ty2
uuccgcccgcgcucccgcc

SEQ ID NO: 1747278 - RNA, 14 nt, Salmonella enterica enterica serovar Typhi Ty2
uuccgcgcaaauac

SEQ ID NO: 1747279 - RNA, 15 nt, Salmonella enterica enterica serovar Typhi Ty2
uuccgcuggaauaaa

SEQ ID NO: 1747280 - RNA, 15 nt, Salmonella enterica enterica serovar Typhi Ty2
uucccggaucgcuaa

SEQ ID NO: 1747281 - RNA, 15 nt, Salmonella enterica enterica serovar Typhi Ty2
uucccggaaaaguau

SEQ ID NO: 1747282 - RNA, 16 nt, Salmonella enterica enterica serovar Typhi Ty2
uucccggaaaaguauu

SEQ ID NO: 1747283 - RNA, 17 nt, Salmonella enterica enterica serovar Typhi Ty2
uucccgcuauagaaugc

SEQ ID NO: 1747284 - RNA, 23 nt, Salmonella enterica enterica serovar Typhi Ty2
uucccgcuauagaaugcaagcag

SEQ ID NO: 1747285 - RNA, 17 nt, Salmonella enterica enterica serovar Typhi Ty2
uucccgcgccagcgucg

SEQ ID NO: 1747286 - RNA, 16 nt, Salmonella enterica enterica serovar Typhi Ty2
uucccgccgcaauucc

SEQ ID NO: 1747287 - RNA, 17 nt, Salmonella enterica enterica serovar Typhi Ty2
uucccuacucucgcaug

SEQ ID NO: 1747288 - RNA, 16 nt, Salmonella enterica enterica serovar Typhi Ty2
uucccuucugaaauga

SEQ ID NO: 1747289 - RNA, 15 nt, Salmonella enterica enterica serovar Typhi Ty2
uucccuuaucugcaa

SEQ ID NO: 1747290 - RNA, 21 nt, Salmonella enterica enterica serovar Typhi Ty2
uucccgcaaacuggccacagc

SEQ ID NO: 1747291 - RNA, 20 nt, Salmonella enterica enterica serovar Typhi Ty2
uuccccuuuaggcggcgccg

SEQ ID NO: 1747292 - RNA, 14 nt, Salmonella enterica enterica serovar Typhi Ty2
uucccgaaaggaag

SEQ ID NO: 1747293 - RNA, 15 nt, Salmonella enterica enterica serovar Typhi Ty2
uuccccuucuguaag

SEQ ID NO: 1747294 - RNA, 11 nt, Salmonella enterica enterica serovar Typhi Ty2
uuccccuccgc

SEQ ID NO: 1747295 - RNA, 19 nt, Salmonella enterica enterica serovar Typhi Ty2
uuccccgccgcacacgccg

SEQ ID NO: 1747296 - RNA, 24 nt, Salmonella enterica enterica serovar Typhi Ty2
uucccaguauugcaccugggaauc

SEQ ID NO: 1747297 - RNA, 20 nt, Salmonella enterica enterica serovar Typhi Ty2
uucccaucgcuuugcagaaa

SEQ ID NO: 1747298 - RNA, 12 nt, Salmonella enterica enterica serovar Typhi Ty2
uucccagcgccc

SEQ ID NO: 1747299 - RNA, 22 nt, Salmonella enterica enterica serovar Typhi Ty2
uucccagguuuuggucagcuca

SEQ ID NO: 1747300 - RNA, 16 nt, Salmonella enterica enterica serovar Typhi Ty2
uuccccaccaggaaug

SEQ ID NO: 1747301 - RNA, 15 nt, Salmonella enterica enterica serovar Typhi Ty2
uuccccaccaggaau

SEQ ID NO: 1747302 - RNA, 13 nt, Salmonella enterica enterica serovar Typhi Ty2
uuccccagcaccg

SEQ ID NO: 1747303 - RNA, 19 nt, Salmonella enterica enterica serovar Typhi Ty2
uucccauugggccagcagc

SEQ ID NO: 1747304 - RNA, 14 nt, Salmonella enterica enterica serovar Typhi Ty2
uuccauucacacaa

SEQ ID NO: 1747305 - RNA, 19 nt, Salmonella enterica enterica serovar Typhi Ty2
uuccauucggcgaaagaag

SEQ ID NO: 1747306 - RNA, 11 nt, Salmonella enterica enterica serovar Typhi Ty2
uuccauuuuuc

SEQ ID NO: 1747307 - RNA, 14 nt, Salmonella enterica enterica serovar Typhi Ty2
uucccacuccgccc

SEQ ID NO: 1747308 - RNA, 16 nt, Salmonella enterica enterica serovar Typhi Ty2
uucccacuccgcccag

SEQ ID NO: 1747309 - RNA, 23 nt, Salmonella enterica enterica serovar Typhi Ty2
uucccacaguuaacgccaacgcc

SEQ ID NO: 1747310 - RNA, 14 nt, Salmonella enterica enterica serovar Typhi Ty2
uucccacagucggc

SEQ ID NO: 1747311 - RNA, 21 nt, Salmonella enterica enterica serovar Typhi Ty2
uuccagcgugccgagcaacag

SEQ ID NO: 1747312 - RNA, 22 nt, Salmonella enterica enterica serovar Typhi Ty2
uuccagcagauccauuaaaugc

SEQ ID NO: 1747313 - RNA, 22 nt, Salmonella enterica enterica serovar Typhi Ty2
uuccagcucacggauauuaccc

SEQ ID NO: 1747314 - RNA, 19 nt, Salmonella enterica enterica serovar Typhi Ty2
uuccagcuguaccaucacc

SEQ ID NO: 1747315 - RNA, 20 nt, Salmonella enterica enterica serovar Typhi Ty2
uuccagcuguaccaucaccu

SEQ ID NO: 1747316 - RNA, 17 nt, Salmonella enterica enterica serovar Typhi Ty2
uuccagcauuucuucaa

SEQ ID NO: 1747317 - RNA, 16 nt, Salmonella enterica enterica serovar Typhi Ty2
uuccagcauuucuuca

SEQ ID NO: 1747318 - RNA, 22 nt, Salmonella enterica enterica serovar Typhi Ty2
uuccagcauccugacauuaccc

SEQ ID NO: 1747319 - RNA, 21 nt, Salmonella enterica enterica serovar Typhi Ty2
uuccagcaucgaccaggauuu

SEQ ID NO: 1747320 - RNA, 13 nt, Salmonella enterica enterica serovar Typhi Ty2
uuccagcacgccc

SEQ ID NO: 1747321 - RNA, 20 nt, Salmonella enterica enterica serovar Typhi Ty2
uuccagcagcucaucaauaa

SEQ ID NO: 1747322 - RNA, 20 nt, Salmonella enterica enterica serovar Typhi Ty2
uuccagauaauccagcgucg

SEQ ID NO: 1747323 - RNA, 20 nt, Salmonella enterica enterica serovar Typhi Ty2
uuccagaauucguacguuuu

SEQ ID NO: 1747324 - RNA, 17 nt, Salmonella enterica enterica serovar Typhi Ty2
uuccagguugugacgaa

SEQ ID NO: 1747325 - RNA, 21 nt, Salmonella enterica enterica serovar Typhi Ty2
uuccaguucauaagucaucca

SEQ ID NO: 1747326 - RNA, 15 nt, Salmonella enterica enterica serovar Typhi Ty2
uuccaguuucucaaa

SEQ ID NO: 1747327 - RNA, 11 nt, Salmonella enterica enterica serovar Typhi Ty2
uuccauacauu

SEQ ID NO: 1747328 - RNA, 18 nt, Salmonella enterica enterica serovar Typhi Ty2
uuccagaaauaaaauacg

SEQ ID NO: 1747329 - RNA, 23 nt, Salmonella enterica enterica serovar Typhi Ty2
uuccacgcguacgguuacaaccc

SEQ ID NO: 1747330 - RNA, 16 nt, Salmonella enterica enterica serovar Typhi Ty2
uuccaccgccaauaaa

SEQ ID NO: 1747331 - RNA, 17 nt, Salmonella enterica enterica serovar Typhi Ty2
uuccaccaccuccugcu

SEQ ID NO: 1747332 - RNA, 18 nt, Salmonella enterica enterica serovar Typhi Ty2
uuccaccaccuccugcug

SEQ ID NO: 1747333 - RNA, 20 nt, Salmonella enterica enterica serovar Typhi Ty2
uuccacaaucccggcaacug

SEQ ID NO: 1747334 - RNA, 17 nt, Salmonella enterica enterica serovar Typhi Ty2
uuccacacguccauccg

SEQ ID NO: 1747335 - RNA, 15 nt, Salmonella enterica enterica serovar Typhi Ty2
uucacguuuuccagg

SEQ ID NO: 1747336 - RNA, 24 nt, Salmonella enterica enterica serovar Typhi Ty2
uucacguacccaaauaucaaauac

SEQ ID NO: 1747337 - RNA, 23 nt, Salmonella enterica enterica serovar Typhi Ty2
uucaccgcgucguuacgcucguc

SEQ ID NO: 1747338 - RNA, 15 nt, Salmonella enterica enterica serovar Typhi Ty2
uucacccauugaacc

SEQ ID NO: 1747339 - RNA, 17 nt, Salmonella enterica enterica serovar Typhi Ty2
uucacccuauaagcugc

SEQ ID NO: 1747340 - RNA, 10 nt, Salmonella enterica enterica serovar Typhi Ty2
uucaccgugu

SEQ ID NO: 1747341 - RNA, 20 nt, Salmonella enterica enterica serovar Typhi Ty2
uucaccucccugcaacagca

SEQ ID NO: 1747342 - RNA, 20 nt, Salmonella enterica enterica serovar Typhi Ty2
uucaccguuuaaaaacauca

SEQ ID NO: 1747343 - RNA, 12 nt, Salmonella enterica enterica serovar Typhi Ty2
uucaccggcguu

SEQ ID NO: 1747344 - RNA, 13 nt, Salmonella enterica enterica serovar Typhi Ty2
uucaccggcuggu

SEQ ID NO: 1747345 - RNA, 21 nt, Salmonella enterica enterica serovar Typhi Ty2
uucaccggauacccagccaca

SEQ ID NO: 1747346 - RNA, 14 nt, Salmonella enterica enterica serovar Typhi Ty2
uucaccuuuccagu

SEQ ID NO: 1747347 - RNA, 20 nt, Salmonella enterica enterica serovar Typhi Ty2
uucacgagcggucaggccag

SEQ ID NO: 1747348 - RNA, 16 nt, Salmonella enterica enterica serovar Typhi Ty2
uucacgaucaucgcau

SEQ ID NO: 1747349 - RNA, 19 nt, Salmonella enterica enterica serovar Typhi Ty2
uucacgagcggucaggcca

SEQ ID NO: 1747350 - RNA, 20 nt, Salmonella enterica enterica serovar Typhi Ty2
uucacgcucacgcagauauu

SEQ ID NO: 1747351 - RNA, 22 nt, Salmonella enterica enterica serovar Typhi Ty2
uucacgcuauguuugcugagaa

SEQ ID NO: 1747352 - RNA, 20 nt, Salmonella enterica enterica serovar Typhi Ty2
uucacgccuuuugacgcuuc

SEQ ID NO: 1747353 - RNA, 19 nt, Salmonella enterica enterica serovar Typhi Ty2
uucacgcauugccacagcc

SEQ ID NO: 1747354 - RNA, 15 nt, Salmonella enterica enterica serovar Typhi Ty2
uucagaacguccaac

SEQ ID NO: 1747355 - RNA, 21 nt, Salmonella enterica enterica serovar Typhi Ty2
uucagaaaguuacuuuccaua

SEQ ID NO: 1747356 - RNA, 14 nt, Salmonella enterica enterica serovar Typhi Ty2
uucacuuuuucucu

SEQ ID NO: 1747357 - RNA, 17 nt, Salmonella enterica enterica serovar Typhi Ty2
uucacuuuaccaggcau

SEQ ID NO: 1747358 - RNA, 16 nt, Salmonella enterica enterica serovar Typhi Ty2
uucacuuuaaagccca

SEQ ID NO: 1747359 - RNA, 22 nt, Salmonella enterica enterica serovar Typhi Ty2
uucagagcguccacgccaucau

SEQ ID NO: 1747360 - RNA, 12 nt, Salmonella enterica enterica serovar Typhi Ty2
uucagacgucau

SEQ ID NO: 1747361 - RNA, 17 nt, Salmonella enterica enterica serovar Typhi Ty2
uucagcagcgcccagcc

SEQ ID NO: 1747362 - RNA, 13 nt, Salmonella enterica enterica serovar Typhi Ty2
uucagcagcgccc

SEQ ID NO: 1747363 - RNA, 12 nt, Salmonella enterica enterica serovar Typhi Ty2
uucagcaucauc

SEQ ID NO: 1747364 - RNA, 19 nt, Salmonella enterica enterica serovar Typhi Ty2
uucagccagguggcaauau

SEQ ID NO: 1747365 - RNA, 22 nt, Salmonella enterica enterica serovar Typhi Ty2
uucagauaucccaugaaacucg

SEQ ID NO: 1747366 - RNA, 18 nt, Salmonella enterica enterica serovar Typhi Ty2
uucaccauuaagcaaucc

SEQ ID NO: 1747367 - RNA, 22 nt, Salmonella enterica enterica serovar Typhi Ty2
uucaccauuaauacccauagua

SEQ ID NO: 1747368 - RNA, 12 nt, Salmonella enterica enterica serovar Typhi Ty2
uucaccagcgcg

SEQ ID NO: 1747369 - RNA, 16 nt, Salmonella enterica enterica serovar Typhi Ty2
uucaccagacgcuggc

SEQ ID NO: 1747370 - RNA, 24 nt, Salmonella enterica enterica serovar Typhi Ty2
uucaccaaaaggcagacagagaaa

SEQ ID NO: 1747371 - RNA, 13 nt, Salmonella enterica enterica serovar Typhi Ty2
uucacauauauuu

SEQ ID NO: 1747372 - RNA, 19 nt, Salmonella enterica enterica serovar Typhi Ty2
uucaauuaaugaguagaac

SEQ ID NO: 1747373 - RNA, 15 nt, Salmonella enterica enterica serovar Typhi Ty2
uucaauuuucgcuuu

SEQ ID NO: 1747374 - RNA, 13 nt, Salmonella enterica enterica serovar Typhi Ty2
uucacaaacuucu

SEQ ID NO: 1747375 - RNA, 17 nt, Salmonella enterica enterica serovar Typhi Ty2
uucacacaauuuucuua

SEQ ID NO: 1747376 - RNA, 22 nt, Salmonella enterica enterica serovar Typhi Ty2
uucacaccaaugucauauuugu

SEQ ID NO: 1747377 - RNA, 14 nt, Salmonella enterica enterica serovar Typhi Ty2
uucacacaauuuuc

SEQ ID NO: 1747378 - RNA, 20 nt, Salmonella enterica enterica serovar Typhi Ty2
uucacaccgccgccagccau

SEQ ID NO: 1747379 - RNA, 18 nt, Salmonella enterica enterica serovar Typhi Ty2
uucaaucgcgcccgccau

SEQ ID NO: 1747380 - RNA, 15 nt, Salmonella enterica enterica serovar Typhi Ty2
uucaauaugccaggc

SEQ ID NO: 1747381 - RNA, 17 nt, Salmonella enterica enterica serovar Typhi Ty2
uucaauaugccaggcau

SEQ ID NO: 1747382 - RNA, 20 nt, Salmonella enterica enterica serovar Typhi Ty2
uucaauauugaacauuuuuu

SEQ ID NO: 1747383 - RNA, 22 nt, Salmonella enterica enterica serovar Typhi Ty2
uucaauauuccuggcgccaccc

SEQ ID NO: 1747384 - RNA, 17 nt, Salmonella enterica enterica serovar Typhi Ty2
uucaauggguuaugggu

SEQ ID NO: 1747385 - RNA, 14 nt, Salmonella enterica enterica serovar Typhi Ty2
uucaaugcccaggc

SEQ ID NO: 1747386 - RNA, 19 nt, Salmonella enterica enterica serovar Typhi Ty2
uucaaucuggugacgauga

SEQ ID NO: 1747387 - RNA, 15 nt, Salmonella enterica enterica serovar Typhi Ty2
uucaaugaacaauaa

SEQ ID NO: 1747388 - RNA, 20 nt, Salmonella enterica enterica serovar Typhi Ty2
uucaauaagcgguaauaauu

SEQ ID NO: 1747389 - RNA, 14 nt, Salmonella enterica enterica serovar Typhi Ty2
uucaauaauaaaac

SEQ ID NO: 1747390 - RNA, 21 nt, Salmonella enterica enterica serovar Typhi Ty2
uucaauaauggcgcgaaaaca

SEQ ID NO: 1747391 - RNA, 20 nt, Salmonella enterica enterica serovar Typhi Ty2
uucaauaaguuagcuuuuuu

SEQ ID NO: 1747392 - RNA, 21 nt, Salmonella enterica enterica serovar Typhi Ty2
uucaauaaguuagcuuuuuua

SEQ ID NO: 1747393 - RNA, 17 nt, Salmonella enterica enterica serovar Typhi Ty2
uucaauacgaaaaccga

SEQ ID NO: 1747394 - RNA, 16 nt, Salmonella enterica enterica serovar Typhi Ty2
uucaauagguugaaag

SEQ ID NO: 1747395 - RNA, 23 nt, Salmonella enterica enterica serovar Typhi Ty2
uucaauacccuuuucuuuaaaca

SEQ ID NO: 1747396 - RNA, 21 nt, Salmonella enterica enterica serovar Typhi Ty2
uucaaguuuagaaaaaauuaa

SEQ ID NO: 1747397 - RNA, 17 nt, Salmonella enterica enterica serovar Typhi Ty2
uucaaguuuagaaaaaa

SEQ ID NO: 1747398 - RNA, 18 nt, Salmonella enterica enterica serovar Typhi Ty2
uucaaguuuagaaaaaau

SEQ ID NO: 1747399 - RNA, 16 nt, Salmonella enterica enterica serovar Typhi Ty2
uucaagcuggugcuuu

SEQ ID NO: 1747400 - RNA, 23 nt, Salmonella enterica enterica serovar Typhi Ty2
uucaaggcucaauacgcauaaug

SEQ ID NO: 1747401 - RNA, 13 nt, Salmonella enterica enterica serovar Typhi Ty2
uucaugcaauaau

SEQ ID NO: 1747402 - RNA, 23 nt, Salmonella enterica enterica serovar Typhi Ty2
uucaugcaucauugaagcgaugu

SEQ ID NO: 1747403 - RNA, 14 nt, Salmonella enterica enterica serovar Typhi Ty2
uucaugcagccaua

SEQ ID NO: 1747404 - RNA, 21 nt, Salmonella enterica enterica serovar Typhi Ty2
uucaugccagaagcaaauuca

SEQ ID NO: 1747405 - RNA, 19 nt, Salmonella enterica enterica serovar Typhi Ty2
uucaugccauacuccugcc

SEQ ID NO: 1747406 - RNA, 13 nt, Salmonella enterica enterica serovar Typhi Ty2
uucaugcgcggcg

SEQ ID NO: 1747407 - RNA, 19 nt, Salmonella enterica enterica serovar Typhi Ty2
uucaugguacucaacauca

SEQ ID NO: 1747408 - RNA, 20 nt, Salmonella enterica enterica serovar Typhi Ty2
uucauggcgcgacauggcga

SEQ ID NO: 1747409 - RNA, 13 nt, Salmonella enterica enterica serovar Typhi Ty2
uucauuacgcuuc

SEQ ID NO: 1747410 - RNA, 19 nt, Salmonella enterica enterica serovar Typhi Ty2
uucauuacagguguuaauc

SEQ ID NO: 1747411 - RNA, 15 nt, Salmonella enterica enterica serovar Typhi Ty2
uucauuacgccuguc

SEQ ID NO: 1747412 - RNA, 22 nt, Salmonella enterica enterica serovar Typhi Ty2
uucauguuucgacaguuucuuc

SEQ ID NO: 1747413 - RNA, 21 nt, Salmonella enterica enterica serovar Typhi Ty2
uucaugguacucaacaucauu

SEQ ID NO: 1747414 - RNA, 16 nt, Salmonella enterica enterica serovar Typhi Ty2
uucauuucacuuguuc

SEQ ID NO: 1747415 - RNA, 17 nt, Salmonella enterica enterica serovar Typhi Ty2
uucauuucgaucuguuu

SEQ ID NO: 1747416 - RNA, 18 nt, Salmonella enterica enterica serovar Typhi Ty2
uucauuuuauagucccuc

SEQ ID NO: 1747417 - RNA, 20 nt, Salmonella enterica enterica serovar Typhi Ty2
uucauucgucaaauucaccc

SEQ ID NO: 1747418 - RNA, 20 nt, Salmonella enterica enterica serovar Typhi Ty2
uucauucacccaauaaauaa

SEQ ID NO: 1747419 - RNA, 18 nt, Salmonella enterica enterica serovar Typhi Ty2
uucauuauuuuuaaauaa

SEQ ID NO: 1747420 - RNA, 19 nt, Salmonella enterica enterica serovar Typhi Ty2
uucauucgccaccaggcuc

SEQ ID NO: 1747421 - RNA, 16 nt, Salmonella enterica enterica serovar Typhi Ty2
uucauucgccaccagg

SEQ ID NO: 1747422 - RNA, 14 nt, Salmonella enterica enterica serovar Typhi Ty2
uucauccucaacca

SEQ ID NO: 1747423 - RNA, 18 nt, Salmonella enterica enterica serovar Typhi Ty2
uucauccggcguugcgcc

SEQ ID NO: 1747424 - RNA, 22 nt, Salmonella enterica enterica serovar Typhi Ty2
uucauccauauaucugaauaga

SEQ ID NO: 1747425 - RNA, 16 nt, Salmonella enterica enterica serovar Typhi Ty2
uucaucgccgauuccu

SEQ ID NO: 1747426 - RNA, 20 nt, Salmonella enterica enterica serovar Typhi Ty2
uucaucgccacaugcggcag

SEQ ID NO: 1747427 - RNA, 14 nt, Salmonella enterica enterica serovar Typhi Ty2
uucauccaccgccc

SEQ ID NO: 1747428 - RNA, 17 nt, Salmonella enterica enterica serovar Typhi Ty2
uucaucaggcugacgaa

SEQ ID NO: 1747429 - RNA, 14 nt, Salmonella enterica enterica serovar Typhi Ty2
uucaucaguaacug

SEQ ID NO: 1747430 - RNA, 18 nt, Salmonella enterica enterica serovar Typhi Ty2
uucaucaggcaauaaaca

SEQ ID NO: 1747431 - RNA, 21 nt, Salmonella enterica enterica serovar Typhi Ty2
uucaucaggcaauaaacauca

SEQ ID NO: 1747432 - RNA, 11 nt, Salmonella enterica enterica serovar Typhi Ty2
uucaucaccau

SEQ ID NO: 1747433 - RNA, 21 nt, Salmonella enterica enterica serovar Typhi Ty2
uucaucuccgauaaauaagaa

SEQ ID NO: 1747434 - RNA, 21 nt, Salmonella enterica enterica serovar Typhi Ty2
uucaucuccucuucaguaagc

SEQ ID NO: 1747435 - RNA, 15 nt, Salmonella enterica enterica serovar Typhi Ty2
uucaucucaucaaug

SEQ ID NO: 1747436 - RNA, 15 nt, Salmonella enterica enterica serovar Typhi Ty2
uucaucgguaauauu

SEQ ID NO: 1747437 - RNA, 16 nt, Salmonella enterica enterica serovar Typhi Ty2
uucaugauacccagcg

SEQ ID NO: 1747438 - RNA, 14 nt, Salmonella enterica enterica serovar Typhi Ty2
uucaugaaucauca

SEQ ID NO: 1747439 - RNA, 20 nt, Salmonella enterica enterica serovar Typhi Ty2
uucaguuucggcccccccca

SEQ ID NO: 1747440 - RNA, 17 nt, Salmonella enterica enterica serovar Typhi Ty2
uucauaaagugccaggg

SEQ ID NO: 1747441 - RNA, 14 nt, Salmonella enterica enterica serovar Typhi Ty2
uucauaaauguacu

SEQ ID NO: 1747442 - RNA, 16 nt, Salmonella enterica enterica serovar Typhi Ty2
uucauaacaccaauac

SEQ ID NO: 1747443 - RNA, 15 nt, Salmonella enterica enterica serovar Typhi Ty2
uucauaagucaucca

SEQ ID NO: 1747444 - RNA, 21 nt, Salmonella enterica enterica serovar Typhi Ty2
uucagucuacuacacacuuac

SEQ ID NO: 1747445 - RNA, 22 nt, Salmonella enterica enterica serovar Typhi Ty2
uucagucuaauuuauuaacccu

SEQ ID NO: 1747446 - RNA, 20 nt, Salmonella enterica enterica serovar Typhi Ty2
uucaguggcuaauuucaauu

SEQ ID NO: 1747447 - RNA, 13 nt, Salmonella enterica enterica serovar Typhi Ty2
uucagugccaucc

SEQ ID NO: 1747448 - RNA, 16 nt, Salmonella enterica enterica serovar Typhi Ty2
uucaucaaagaaaacc

SEQ ID NO: 1747449 - RNA, 14 nt, Salmonella enterica enterica serovar Typhi Ty2
uucaucaaaaugca

SEQ ID NO: 1747450 - RNA, 23 nt, Salmonella enterica enterica serovar Typhi Ty2
uucauauuauuauauagacuccg

SEQ ID NO: 1747451 - RNA, 15 nt, Salmonella enterica enterica serovar Typhi Ty2
uucauagccguggcu

SEQ ID NO: 1747452 - RNA, 14 nt, Salmonella enterica enterica serovar Typhi Ty2
uucauagaaccacu

SEQ ID NO: 1747453 - RNA, 12 nt, Salmonella enterica enterica serovar Typhi Ty2
uucauaccacug

SEQ ID NO: 1747454 - RNA, 23 nt, Salmonella enterica enterica serovar Typhi Ty2
uucagcugcggcugaaccacccu

SEQ ID NO: 1747455 - RNA, 22 nt, Salmonella enterica enterica serovar Typhi Ty2
uucagcucgcaggccauaaaac

SEQ ID NO: 1747456 - RNA, 17 nt, Salmonella enterica enterica serovar Typhi Ty2
uucagcggcagcucugc

SEQ ID NO: 1747457 - RNA, 15 nt, Salmonella enterica enterica serovar Typhi Ty2
uucagcuucugucag

SEQ ID NO: 1747458 - RNA, 14 nt, Salmonella enterica enterica serovar Typhi Ty2
uucaggaauacauu

SEQ ID NO: 1747459 - RNA, 17 nt, Salmonella enterica enterica serovar Typhi Ty2
uucagcgacaggcuguc

SEQ ID NO: 1747460 - RNA, 14 nt, Salmonella enterica enterica serovar Typhi Ty2
uucagcccaggcuu

SEQ ID NO: 1747461 - RNA, 16 nt, Salmonella enterica enterica serovar Typhi Ty2
uucagcguacagaagg

SEQ ID NO: 1747462 - RNA, 18 nt, Salmonella enterica enterica serovar Typhi Ty2
uucagcgcgauaaauacc

SEQ ID NO: 1747463 - RNA, 15 nt, Salmonella enterica enterica serovar Typhi Ty2
uucagcgccugaaug

SEQ ID NO: 1747464 - RNA, 18 nt, Salmonella enterica enterica serovar Typhi Ty2
uucagcgccagauaguca

SEQ ID NO: 1747465 - RNA, 23 nt, Salmonella enterica enterica serovar Typhi Ty2
uucaggauaauaucgcuggccau

SEQ ID NO: 1747466 - RNA, 19 nt, Salmonella enterica enterica serovar Typhi Ty2
uucaggauuuacugagcgc

SEQ ID NO: 1747467 - RNA, 23 nt, Salmonella enterica enterica serovar Typhi Ty2
uucagggcuuauucaagcaacug

SEQ ID NO: 1747468 - RNA, 23 nt, Salmonella enterica enterica serovar Typhi Ty2
uucaggcugccaaccagcgcuuu

SEQ ID NO: 1747469 - RNA, 22 nt, Salmonella enterica enterica serovar Typhi Ty2
uucaggucuggauuacaaaaau

SEQ ID NO: 1747470 - RNA, 21 nt, Salmonella enterica enterica serovar Typhi Ty2
uucaggucauacggcaugcca

SEQ ID NO: 1747471 - RNA, 19 nt, Salmonella enterica enterica serovar Typhi Ty2
uucaguaagcguaccauuc

SEQ ID NO: 1747472 - RNA, 17 nt, Salmonella enterica enterica serovar Typhi Ty2
uggcugagaaaaauacg

SEQ ID NO: 1747473 - RNA, 13 nt, Salmonella enterica enterica serovar Typhi Ty2
uggcugagaaaaa

SEQ ID NO: 1747474 - RNA, 20 nt, Salmonella enterica enterica serovar Typhi Ty2
uggcugaggccgcucgccau

SEQ ID NO: 1747475 - RNA, 14 nt, Salmonella enterica enterica serovar Typhi Ty2
uggcugagaaaaau

SEQ ID NO: 1747476 - RNA, 16 nt, Salmonella enterica enterica serovar Typhi Ty2
uggcugcgauaaugaa

SEQ ID NO: 1747477 - RNA, 15 nt, Salmonella enterica enterica serovar Typhi Ty2
uggcugucguuucau

SEQ ID NO: 1747478 - RNA, 19 nt, Salmonella enterica enterica serovar Typhi Ty2
uggcugucguuucauguaa

SEQ ID NO: 1747479 - RNA, 15 nt, Salmonella enterica enterica serovar Typhi Ty2
uggcugugccaauaa

SEQ ID NO: 1747480 - RNA, 14 nt, Salmonella enterica enterica serovar Typhi Ty2
uggcuuaacucacc

SEQ ID NO: 1747481 - RNA, 16 nt, Salmonella enterica enterica serovar Typhi Ty2
uggcugugcgugaccc

SEQ ID NO: 1747482 - RNA, 14 nt, Salmonella enterica enterica serovar Typhi Ty2
uggcuggcauauug

SEQ ID NO: 1747483 - RNA, 13 nt, Salmonella enterica enterica serovar Typhi Ty2
uggcugguggccu

SEQ ID NO: 1747484 - RNA, 17 nt, Salmonella enterica enterica serovar Typhi Ty2
uggcuuuauauaaaaaa

SEQ ID NO: 1747485 - RNA, 14 nt, Salmonella enterica enterica serovar Typhi Ty2
uggcuuucauccaa

SEQ ID NO: 1747486 - RNA, 19 nt, Salmonella enterica enterica serovar Typhi Ty2
ugggaaauaacguuacauu

SEQ ID NO: 1747487 - RNA, 18 nt, Salmonella enterica enterica serovar Typhi Ty2
uggcuuaaucauugcuca

SEQ ID NO: 1747488 - RNA, 17 nt, Salmonella enterica enterica serovar Typhi Ty2
uggcuuaccguaugcaa

SEQ ID NO: 1747489 - RNA, 15 nt, Salmonella enterica enterica serovar Typhi Ty2
ugggcgcaacaguca

SEQ ID NO: 1747490 - RNA, 13 nt, Salmonella enterica enterica serovar Typhi Ty2
ugggccagcagcg

SEQ ID NO: 1747491 - RNA, 17 nt, Salmonella enterica enterica serovar Typhi Ty2
ugggccagcagcgcauc

SEQ ID NO: 1747492 - RNA, 22 nt, Salmonella enterica enterica serovar Typhi Ty2
ugggcgucuuaaugcucuccag

SEQ ID NO: 1747493 - RNA, 16 nt, Salmonella enterica enterica serovar Typhi Ty2
ugggcguaagaaaagu

SEQ ID NO: 1747494 - RNA, 15 nt, Salmonella enterica enterica serovar Typhi Ty2
ugggcguaagaaaag

SEQ ID NO: 1747495 - RNA, 14 nt, Salmonella enterica enterica serovar Typhi Ty2
uggggaaguuaugu

SEQ ID NO: 1747496 - RNA, 18 nt, Salmonella enterica enterica serovar Typhi Ty2
uggggauuaucaggauga

SEQ ID NO: 1747497 - RNA, 18 nt, Salmonella enterica enterica serovar Typhi Ty2
uggggaucgggcagacuu

SEQ ID NO: 1747498 - RNA, 17 nt, Salmonella enterica enterica serovar Typhi Ty2
ugggcgugcugacggag

SEQ ID NO: 1747499 - RNA, 16 nt, Salmonella enterica enterica serovar Typhi Ty2
ugggcuugcuuuucuc

SEQ ID NO: 1747500 - RNA, 13 nt, Salmonella enterica enterica serovar Typhi Ty2
uggggaaccuggc

SEQ ID NO: 1747501 - RNA, 15 nt, Salmonella enterica enterica serovar Typhi Ty2
uggggaaccuggcag

SEQ ID NO: 1747502 - RNA, 17 nt, Salmonella enterica enterica serovar Typhi Ty2
uggggaaccuggcagaa

SEQ ID NO: 1747503 - RNA, 15 nt, Salmonella enterica enterica serovar Typhi Ty2
uggcguggccaagau

SEQ ID NO: 1747504 - RNA, 16 nt, Salmonella enterica enterica serovar Typhi Ty2
uggcguccggccacua

SEQ ID NO: 1747505 - RNA, 20 nt, Salmonella enterica enterica serovar Typhi Ty2
uggcgucgacgugucuaugc

SEQ ID NO: 1747506 - RNA, 15 nt, Salmonella enterica enterica serovar Typhi Ty2
uggcgucccuuuccc

SEQ ID NO: 1747507 - RNA, 15 nt, Salmonella enterica enterica serovar Typhi Ty2
uggcguccagcccgu

SEQ ID NO: 1747508 - RNA, 15 nt, Salmonella enterica enterica serovar Typhi Ty2
uggcuaauuucaauu

SEQ ID NO: 1747509 - RNA, 19 nt, Salmonella enterica enterica serovar Typhi Ty2
uggcguuccacccaguuca

SEQ ID NO: 1747510 - RNA, 20 nt, Salmonella enterica enterica serovar Typhi Ty2
uggcguuaccggcaggcugg

SEQ ID NO: 1747511 - RNA, 15 nt, Salmonella enterica enterica serovar Typhi Ty2
uggcucccgcagcca

SEQ ID NO: 1747512 - RNA, 18 nt, Salmonella enterica enterica serovar Typhi Ty2
uggcucggcgucaucccg

SEQ ID NO: 1747513 - RNA, 16 nt, Salmonella enterica enterica serovar Typhi Ty2
uggcucggcgucaucc

SEQ ID NO: 1747514 - RNA, 23 nt, Salmonella enterica enterica serovar Typhi Ty2
uggcucuuagcagcauaaacauc

SEQ ID NO: 1747515 - RNA, 15 nt, Salmonella enterica enterica serovar Typhi Ty2
uggcucuugguuuua

SEQ ID NO: 1747516 - RNA, 20 nt, Salmonella enterica enterica serovar Typhi Ty2
uggcuauagcucaguuggua

SEQ ID NO: 1747517 - RNA, 17 nt, Salmonella enterica enterica serovar Typhi Ty2
uggcucaaggauauugc

SEQ ID NO: 1747518 - RNA, 17 nt, Salmonella enterica enterica serovar Typhi Ty2
uggcucaauccaggugg

SEQ ID NO: 1747519 - RNA, 17 nt, Salmonella enterica enterica serovar Typhi Ty2
uggcuaucuuuauguca

SEQ ID NO: 1747520 - RNA, 18 nt, Salmonella enterica enterica serovar Typhi Ty2
uggcucagauugaacgcu

SEQ ID NO: 1747521 - RNA, 16 nt, Salmonella enterica enterica serovar Typhi Ty2
uggcgcugcgcuuacc

SEQ ID NO: 1747522 - RNA, 18 nt, Salmonella enterica enterica serovar Typhi Ty2
uggcgcuaaaauccacuc

SEQ ID NO: 1747523 - RNA, 16 nt, Salmonella enterica enterica serovar Typhi Ty2
uggcgcucagcgccgu

SEQ ID NO: 1747524 - RNA, 18 nt, Salmonella enterica enterica serovar Typhi Ty2
uggcgcuguucuugcugc

SEQ ID NO: 1747525 - RNA, 21 nt, Salmonella enterica enterica serovar Typhi Ty2
uggcgcuggccgaauagcuga

SEQ ID NO: 1747526 - RNA, 14 nt, Salmonella enterica enterica serovar Typhi Ty2
uggcgcgugcccag

SEQ ID NO: 1747527 - RNA, 14 nt, Salmonella enterica enterica serovar Typhi Ty2
uggcgcuccugaau

SEQ ID NO: 1747528 - RNA, 16 nt, Salmonella enterica enterica serovar Typhi Ty2
uggcgcuccugaaucg

SEQ ID NO: 1747529 - RNA, 17 nt, Salmonella enterica enterica serovar Typhi Ty2
uggcgcgucacaacagc

SEQ ID NO: 1747530 - RNA, 13 nt, Salmonella enterica enterica serovar Typhi Ty2
uggaaaagaaaac

SEQ ID NO: 1747531 - RNA, 17 nt, Salmonella enterica enterica serovar Typhi Ty2
uggaaaaagaccaauac

SEQ ID NO: 1747532 - RNA, 22 nt, Salmonella enterica enterica serovar Typhi Ty2
uggaaaaaucuguaggcccggu

SEQ ID NO: 1747533 - RNA, 16 nt, Salmonella enterica enterica serovar Typhi Ty2
uggaaaauaauaaucg

SEQ ID NO: 1747534 - RNA, 21 nt, Salmonella enterica enterica serovar Typhi Ty2
uggcgcgaucaguucuugcag

SEQ ID NO: 1747535 - RNA, 15 nt, Salmonella enterica enterica serovar Typhi Ty2
uggcgcgccacuucu

SEQ ID NO: 1747536 - RNA, 15 nt, Salmonella enterica enterica serovar Typhi Ty2
uggaaaauaauaauc

SEQ ID NO: 1747537 - RNA, 17 nt, Salmonella enterica enterica serovar Typhi Ty2
uggcguagaagcuuacc

SEQ ID NO: 1747538 - RNA, 23 nt, Salmonella enterica enterica serovar Typhi Ty2
uggcguacgcauccgcguuaccc

SEQ ID NO: 1747539 - RNA, 17 nt, Salmonella enterica enterica serovar Typhi Ty2
uggcguagauauucccc

SEQ ID NO: 1747540 - RNA, 17 nt, Salmonella enterica enterica serovar Typhi Ty2
uggcguacgcauccgcg

SEQ ID NO: 1747541 - RNA, 13 nt, Salmonella enterica enterica serovar Typhi Ty2
uggcguaaauauu

SEQ ID NO: 1747542 - RNA, 23 nt, Salmonella enterica enterica serovar Typhi Ty2
uggcguacgcagaucguauccag

SEQ ID NO: 1747543 - RNA, 17 nt, Salmonella enterica enterica serovar Typhi Ty2
uggcgguauaacugccu

SEQ ID NO: 1747544 - RNA, 14 nt, Salmonella enterica enterica serovar Typhi Ty2
uggcggaaagaagc

SEQ ID NO: 1747545 - RNA, 23 nt, Salmonella enterica enterica serovar Typhi Ty2
uggcggggagguuauugcucuuu

SEQ ID NO: 1747546 - RNA, 21 nt, Salmonella enterica enterica serovar Typhi Ty2
ugguuaacgccguuaccagca

SEQ ID NO: 1747547 - RNA, 14 nt, Salmonella enterica enterica serovar Typhi Ty2
ugguuaauucaaaa

SEQ ID NO: 1747548 - RNA, 16 nt, Salmonella enterica enterica serovar Typhi Ty2
ugguucgcauaauauc

SEQ ID NO: 1747549 - RNA, 21 nt, Salmonella enterica enterica serovar Typhi Ty2
ugguugccgcaaaugaccaga

SEQ ID NO: 1747550 - RNA, 16 nt, Salmonella enterica enterica serovar Typhi Ty2
ugguuguagcacagcc

SEQ ID NO: 1747551 - RNA, 15 nt, Salmonella enterica enterica serovar Typhi Ty2
ugguuguagcacagc

SEQ ID NO: 1747552 - RNA, 22 nt, Salmonella enterica enterica serovar Typhi Ty2
ugguuuaucgccgauugagggg

SEQ ID NO: 1747553 - RNA, 23 nt, Salmonella enterica enterica serovar Typhi Ty2
ugguuuaauaccgcguaaaaagu

SEQ ID NO: 1747554 - RNA, 23 nt, Salmonella enterica enterica serovar Typhi Ty2
ugguugugccaguaaucccgguc

SEQ ID NO: 1747555 - RNA, 17 nt, Salmonella enterica enterica serovar Typhi Ty2
ugguuucccugccucaa

SEQ ID NO: 1747556 - RNA, 16 nt, Salmonella enterica enterica serovar Typhi Ty2
ugguuucgcggugaaa

SEQ ID NO: 1747557 - RNA, 20 nt, Salmonella enterica enterica serovar Typhi Ty2
ugguuuauguaauuugcaaa

SEQ ID NO: 1747558 - RNA, 20 nt, Salmonella enterica enterica serovar Typhi Ty2
ugguuuuaucuguaauuaua

SEQ ID NO: 1747559 - RNA, 16 nt, Salmonella enterica enterica serovar Typhi Ty2
uguaacauauuuuuau

SEQ ID NO: 1747560 - RNA, 22 nt, Salmonella enterica enterica serovar Typhi Ty2
uguaagggaggugcucucccag

SEQ ID NO: 1747561 - RNA, 20 nt, Salmonella enterica enterica serovar Typhi Ty2
uguaacagcaggacccgaga

SEQ ID NO: 1747562 - RNA, 21 nt, Salmonella enterica enterica serovar Typhi Ty2
uguaaaaaaauaaaaaaggca

SEQ ID NO: 1747563 - RNA, 16 nt, Salmonella enterica enterica serovar Typhi Ty2
uguaaaaaauccagcg

SEQ ID NO: 1747564 - RNA, 16 nt, Salmonella enterica enterica serovar Typhi Ty2
uguaaaaaaauaaaaa

SEQ ID NO: 1747565 - RNA, 22 nt, Salmonella enterica enterica serovar Typhi Ty2
uguaauggugggacacugccgg

SEQ ID NO: 1747566 - RNA, 15 nt, Salmonella enterica enterica serovar Typhi Ty2
uguaauggugggaca

SEQ ID NO: 1747567 - RNA, 20 nt, Salmonella enterica enterica serovar Typhi Ty2
uguaauggcgcucuuuucca

SEQ ID NO: 1747568 - RNA, 22 nt, Salmonella enterica enterica serovar Typhi Ty2
uguaauuaaggauugccgccuu

SEQ ID NO: 1747569 - RNA, 20 nt, Salmonella enterica enterica serovar Typhi Ty2
uguaauguuuucugccagca

SEQ ID NO: 1747570 - RNA, 18 nt, Salmonella enterica enterica serovar Typhi Ty2
uguaauucaccaaauccu

SEQ ID NO: 1747571 - RNA, 21 nt, Salmonella enterica enterica serovar Typhi Ty2
uguaauucucccaaauuuuuu

SEQ ID NO: 1747572 - RNA, 16 nt, Salmonella enterica enterica serovar Typhi Ty2
uggguaaauaccaggc

SEQ ID NO: 1747573 - RNA, 19 nt, Salmonella enterica enterica serovar Typhi Ty2
uggguaaauaccaggcacu

SEQ ID NO: 1747574 - RNA, 22 nt, Salmonella enterica enterica serovar Typhi Ty2
ugggguugcuucuguccuuucu

SEQ ID NO: 1747575 - RNA, 16 nt, Salmonella enterica enterica serovar Typhi Ty2
ugguaaauccaauaga

SEQ ID NO: 1747576 - RNA, 16 nt, Salmonella enterica enterica serovar Typhi Ty2
ugguagacgcaccaga

SEQ ID NO: 1747577 - RNA, 16 nt, Salmonella enterica enterica serovar Typhi Ty2
ugguagagcaucgcgg

SEQ ID NO: 1747578 - RNA, 18 nt, Salmonella enterica enterica serovar Typhi Ty2
ugguaauuaaaggcagcg

SEQ ID NO: 1747579 - RNA, 18 nt, Salmonella enterica enterica serovar Typhi Ty2
ugguaauggcgaagcccg

SEQ ID NO: 1747580 - RNA, 14 nt, Salmonella enterica enterica serovar Typhi Ty2
ugguaaggcaaaua

SEQ ID NO: 1747581 - RNA, 19 nt, Salmonella enterica enterica serovar Typhi Ty2
ugguaagagcgacucaggu

SEQ ID NO: 1747582 - RNA, 19 nt, Salmonella enterica enterica serovar Typhi Ty2
ugguaagcgccaagcggca

SEQ ID NO: 1747583 - RNA, 21 nt, Salmonella enterica enterica serovar Typhi Ty2
uggucauuaggcguaauuauu

SEQ ID NO: 1747584 - RNA, 22 nt, Salmonella enterica enterica serovar Typhi Ty2
ugguagcgcugaugcaggcaau

SEQ ID NO: 1747585 - RNA, 22 nt, Salmonella enterica enterica serovar Typhi Ty2
ugguggucggcaaucaccugca

SEQ ID NO: 1747586 - RNA, 18 nt, Salmonella enterica enterica serovar Typhi Ty2
ugguguaauugcgccagg

SEQ ID NO: 1747587 - RNA, 22 nt, Salmonella enterica enterica serovar Typhi Ty2
ugguggugccguuacuguuuua

SEQ ID NO: 1747588 - RNA, 22 nt, Salmonella enterica enterica serovar Typhi Ty2
uggugcucaggaucaauucuga

SEQ ID NO: 1747589 - RNA, 21 nt, Salmonella enterica enterica serovar Typhi Ty2
uggugcugugccugccugugg

SEQ ID NO: 1747590 - RNA, 21 nt, Salmonella enterica enterica serovar Typhi Ty2
uggugggacuguucagcugac

SEQ ID NO: 1747591 - RNA, 16 nt, Salmonella enterica enterica serovar Typhi Ty2
uggugccaaucuccag

SEQ ID NO: 1747592 - RNA, 23 nt, Salmonella enterica enterica serovar Typhi Ty2
uggugcggcgcacugccugaugg

SEQ ID NO: 1747593 - RNA, 24 nt, Salmonella enterica enterica serovar Typhi Ty2
uggugaaaaucgugguuagacauc

SEQ ID NO: 1747594 - RNA, 19 nt, Salmonella enterica enterica serovar Typhi Ty2
uggucgcuaacccaggccg

SEQ ID NO: 1747595 - RNA, 21 nt, Salmonella enterica enterica serovar Typhi Ty2
uguucgcuucuucuaccaccu

SEQ ID NO: 1747596 - RNA, 15 nt, Salmonella enterica enterica serovar Typhi Ty2
uguucgcuucuucua

SEQ ID NO: 1747597 - RNA, 19 nt, Salmonella enterica enterica serovar Typhi Ty2
uguucauaccggauauggc

SEQ ID NO: 1747598 - RNA, 15 nt, Salmonella enterica enterica serovar Typhi Ty2
uguucauccauauau

SEQ ID NO: 1747599 - RNA, 22 nt, Salmonella enterica enterica serovar Typhi Ty2
uguucauccauauaucugaaua

SEQ ID NO: 1747600 - RNA, 21 nt, Salmonella enterica enterica serovar Typhi Ty2
uguucaucaaagaaaaccacg

SEQ ID NO: 1747601 - RNA, 23 nt, Salmonella enterica enterica serovar Typhi Ty2
uguucgcaaccuaaccaaacaga

SEQ ID NO: 1747602 - RNA, 20 nt, Salmonella enterica enterica serovar Typhi Ty2
uguucgagggcgauuuugac

SEQ ID NO: 1747603 - RNA, 13 nt, Salmonella enterica enterica serovar Typhi Ty2
uguugaccagguc

SEQ ID NO: 1747604 - RNA, 16 nt, Salmonella enterica enterica serovar Typhi Ty2
uguugacgacuuuugc

SEQ ID NO: 1747605 - RNA, 12 nt, Salmonella enterica enterica serovar Typhi Ty2
uguugacugcgc

SEQ ID NO: 1747606 - RNA, 14 nt, Salmonella enterica enterica serovar Typhi Ty2
uguucuuuucuuuc

SEQ ID NO: 1747607 - RNA, 13 nt, Salmonella enterica enterica serovar Typhi Ty2
uguucuuccauug

SEQ ID NO: 1747608 - RNA, 20 nt, Salmonella enterica enterica serovar Typhi Ty2
uguucagugccauccauauu

SEQ ID NO: 1747609 - RNA, 16 nt, Salmonella enterica enterica serovar Typhi Ty2
uguucaagcaauaaug

SEQ ID NO: 1747610 - RNA, 13 nt, Salmonella enterica enterica serovar Typhi Ty2
uguucaacuuuuc

SEQ ID NO: 1747611 - RNA, 14 nt, Salmonella enterica enterica serovar Typhi Ty2
uguuauuuucaaaa

SEQ ID NO: 1747612 - RNA, 14 nt, Salmonella enterica enterica serovar Typhi Ty2
uguuaguuucuauu

SEQ ID NO: 1747613 - RNA, 14 nt, Salmonella enterica enterica serovar Typhi Ty2
uguguuucagcagc

SEQ ID NO: 1747614 - RNA, 14 nt, Salmonella enterica enterica serovar Typhi Ty2
uguuaauugucagc

SEQ ID NO: 1747615 - RNA, 15 nt, Salmonella enterica enterica serovar Typhi Ty2
uguuacgccaauaau

SEQ ID NO: 1747616 - RNA, 18 nt, Salmonella enterica enterica serovar Typhi Ty2
uguuacgcugguuugugu

SEQ ID NO: 1747617 - RNA, 21 nt, Salmonella enterica enterica serovar Typhi Ty2
uguuaauuugcaucaggccaa

SEQ ID NO: 1747618 - RNA, 20 nt, Salmonella enterica enterica serovar Typhi Ty2
uguuaaucauuuucuuugca

SEQ ID NO: 1747619 - RNA, 19 nt, Salmonella enterica enterica serovar Typhi Ty2
ugugguguuccauugcugc

SEQ ID NO: 1747620 - RNA, 13 nt, Salmonella enterica enterica serovar Typhi Ty2
uguggugcggcuu

SEQ ID NO: 1747621 - RNA, 15 nt, Salmonella enterica enterica serovar Typhi Ty2
uguguacaaccauca

SEQ ID NO: 1747622 - RNA, 21 nt, Salmonella enterica enterica serovar Typhi Ty2
uguguacauccagaaggcaaa

SEQ ID NO: 1747623 - RNA, 18 nt, Salmonella enterica enterica serovar Typhi Ty2
uguguaccagcagcgcca

SEQ ID NO: 1747624 - RNA, 15 nt, Salmonella enterica enterica serovar Typhi Ty2
uguggagguuucuuc

SEQ ID NO: 1747625 - RNA, 17 nt, Salmonella enterica enterica serovar Typhi Ty2
ugugcuuccagcuccau

SEQ ID NO: 1747626 - RNA, 22 nt, Salmonella enterica enterica serovar Typhi Ty2
ugugcuuaucacguagccagag

SEQ ID NO: 1747627 - RNA, 15 nt, Salmonella enterica enterica serovar Typhi Ty2
ugugcuuaccgggcc

SEQ ID NO: 1747628 - RNA, 11 nt, Salmonella enterica enterica serovar Typhi Ty2
ugugcuuuagc

SEQ ID NO: 1747629 - RNA, 12 nt, Salmonella enterica enterica serovar Typhi Ty2
ugugcugguuga

SEQ ID NO: 1747630 - RNA, 16 nt, Salmonella enterica enterica serovar Typhi Ty2
ugugcugauugucagc

SEQ ID NO: 1747631 - RNA, 15 nt, Salmonella enterica enterica serovar Typhi Ty2
ugugccauacuguuu

SEQ ID NO: 1747632 - RNA, 16 nt, Salmonella enterica enterica serovar Typhi Ty2
ugugauuuugcuggug

SEQ ID NO: 1747633 - RNA, 22 nt, Salmonella enterica enterica serovar Typhi Ty2
ugugauugcagauaauuuugca

SEQ ID NO: 1747634 - RNA, 20 nt, Salmonella enterica enterica serovar Typhi Ty2
ugugaucugguuugguaaag

SEQ ID NO: 1747635 - RNA, 22 nt, Salmonella enterica enterica serovar Typhi Ty2
ugugaucgccgcgaggaaaauc

SEQ ID NO: 1747636 - RNA, 15 nt, Salmonella enterica enterica serovar Typhi Ty2
ugugaucaccgcccu

SEQ ID NO: 1747637 - RNA, 11 nt, Salmonella enterica enterica serovar Typhi Ty2
ugugauaaaug

SEQ ID NO: 1747638 - RNA, 16 nt, Salmonella enterica enterica serovar Typhi Ty2
ugugauacgcuuuagg

SEQ ID NO: 1747639 - RNA, 16 nt, Salmonella enterica enterica serovar Typhi Ty2
ugugaauccaggccag

SEQ ID NO: 1747640 - RNA, 14 nt, Salmonella enterica enterica serovar Typhi Ty2
ugugaaguccguau

SEQ ID NO: 1747641 - RNA, 14 nt, Salmonella enterica enterica serovar Typhi Ty2
ugugaauaaaggau

SEQ ID NO: 1747642 - RNA, 13 nt, Salmonella enterica enterica serovar Typhi Ty2
ugugaauaaagga

SEQ ID NO: 1747643 - RNA, 18 nt, Salmonella enterica enterica serovar Typhi Ty2
ugucuucgcacugcccuu

SEQ ID NO: 1747644 - RNA, 18 nt, Salmonella enterica enterica serovar Typhi Ty2
ugucuucgucaaugcugc

SEQ ID NO: 1747645 - RNA, 15 nt, Salmonella enterica enterica serovar Typhi Ty2
ugucuugcuaucaaa

SEQ ID NO: 1747646 - RNA, 23 nt, Salmonella enterica enterica serovar Typhi Ty2
ugucugcgcaacgcuuccaccuc

SEQ ID NO: 1747647 - RNA, 13 nt, Salmonella enterica enterica serovar Typhi Ty2
ugucucuccagua

SEQ ID NO: 1747648 - RNA, 19 nt, Salmonella enterica enterica serovar Typhi Ty2
ugucuuaccuaacggauaa

SEQ ID NO: 1747649 - RNA, 14 nt, Salmonella enterica enterica serovar Typhi Ty2
ugucuauuuauuga

SEQ ID NO: 1747650 - RNA, 19 nt, Salmonella enterica enterica serovar Typhi Ty2
ugucucacccguuuucucc

SEQ ID NO: 1747651 - RNA, 14 nt, Salmonella enterica enterica serovar Typhi Ty2
ugucuccucaugcc

SEQ ID NO: 1747652 - RNA, 13 nt, Salmonella enterica enterica serovar Typhi Ty2
ugucuccucagca

SEQ ID NO: 1747653 - RNA, 23 nt, Salmonella enterica enterica serovar Typhi Ty2
ugucggauggcggcguaaacgcc

SEQ ID NO: 1747654 - RNA, 21 nt, Salmonella enterica enterica serovar Typhi Ty2
ugucgcggauaugcagcagcc

SEQ ID NO: 1747655 - RNA, 22 nt, Salmonella enterica enterica serovar Typhi Ty2
ugucgcugaguacgcaccagcc

SEQ ID NO: 1747656 - RNA, 19 nt, Salmonella enterica enterica serovar Typhi Ty2
ugucgggccuacagaugaa

SEQ ID NO: 1747657 - RNA, 15 nt, Salmonella enterica enterica serovar Typhi Ty2
ugucgucgauuuucu

SEQ ID NO: 1747658 - RNA, 18 nt, Salmonella enterica enterica serovar Typhi Ty2
ugucgcgcaauaccugua

SEQ ID NO: 1747659 - RNA, 17 nt, Salmonella enterica enterica serovar Typhi Ty2
ugucgcgagcuuccagu

SEQ ID NO: 1747660 - RNA, 15 nt, Salmonella enterica enterica serovar Typhi Ty2
ugucgccggaaaaaa

SEQ ID NO: 1747661 - RNA, 14 nt, Salmonella enterica enterica serovar Typhi Ty2
ugucgccguggaac

SEQ ID NO: 1747662 - RNA, 23 nt, Salmonella enterica enterica serovar Typhi Ty2
ugucgccugcuguugggcaggag

SEQ ID NO: 1747663 - RNA, 14 nt, Salmonella enterica enterica serovar Typhi Ty2
ugucgcccgcucag

SEQ ID NO: 1747664 - RNA, 21 nt, Salmonella enterica enterica serovar Typhi Ty2
ugucgccauaucuucgcgcgu

SEQ ID NO: 1747665 - RNA, 16 nt, Salmonella enterica enterica serovar Typhi Ty2
ugucgcaaaccaccgg

SEQ ID NO: 1747666 - RNA, 20 nt, Salmonella enterica enterica serovar Typhi Ty2
ugucgauuuccgguuccagc

SEQ ID NO: 1747667 - RNA, 21 nt, Salmonella enterica enterica serovar Typhi Ty2
ugucgaucaucagacccgcau

SEQ ID NO: 1747668 - RNA, 21 nt, Salmonella enterica enterica serovar Typhi Ty2
ugucgagcaucuccagcgcau

SEQ ID NO: 1747669 - RNA, 15 nt, Salmonella enterica enterica serovar Typhi Ty2
ugucgauaaacucau

SEQ ID NO: 1747670 - RNA, 21 nt, Salmonella enterica enterica serovar Typhi Ty2
uguccuuuaucugcccuuucu

SEQ ID NO: 1747671 - RNA, 15 nt, Salmonella enterica enterica serovar Typhi Ty2
uguccuuuacugcgc

SEQ ID NO: 1747672 - RNA, 15 nt, Salmonella enterica enterica serovar Typhi Ty2
uguccuuucugcugc

SEQ ID NO: 1747673 - RNA, 22 nt, Salmonella enterica enterica serovar Typhi Ty2
uguccuuugcuacaccccuucu

SEQ ID NO: 1747674 - RNA, 15 nt, Salmonella enterica enterica serovar Typhi Ty2
ugucgaaaccagcau

SEQ ID NO: 1747675 - RNA, 19 nt, Salmonella enterica enterica serovar Typhi Ty2
ugucgaaauugccgcccgu

SEQ ID NO: 1747676 - RNA, 14 nt, Salmonella enterica enterica serovar Typhi Ty2
ugucgaauuccgcc

SEQ ID NO: 1747677 - RNA, 15 nt, Salmonella enterica enterica serovar Typhi Ty2
uguccugcagcgcca

SEQ ID NO: 1747678 - RNA, 18 nt, Salmonella enterica enterica serovar Typhi Ty2
uguccgucuuuucugucg

SEQ ID NO: 1747679 - RNA, 22 nt, Salmonella enterica enterica serovar Typhi Ty2
uguccgcauucuugccgcaucu

SEQ ID NO: 1747680 - RNA, 17 nt, Salmonella enterica enterica serovar Typhi Ty2
uguccgcaauccccugg

SEQ ID NO: 1747681 - RNA, 15 nt, Salmonella enterica enterica serovar Typhi Ty2
uguccgaugcagaca

SEQ ID NO: 1747682 - RNA, 16 nt, Salmonella enterica enterica serovar Typhi Ty2
uguccgguguccauca

SEQ ID NO: 1747683 - RNA, 20 nt, Salmonella enterica enterica serovar Typhi Ty2
uguccgccuuaucaggccug

SEQ ID NO: 1747684 - RNA, 19 nt, Salmonella enterica enterica serovar Typhi Ty2
uguccauugcgagaaaaaa

SEQ ID NO: 1747685 - RNA, 17 nt, Salmonella enterica enterica serovar Typhi Ty2
uguccauguaaacucca

SEQ ID NO: 1747686 - RNA, 23 nt, Salmonella enterica enterica serovar Typhi Ty2
uguccauguuuuauacucaaaaa

SEQ ID NO: 1747687 - RNA, 20 nt, Salmonella enterica enterica serovar Typhi Ty2
uguccaugacgaccacagcc

SEQ ID NO: 1747688 - RNA, 13 nt, Salmonella enterica enterica serovar Typhi Ty2
uguccauaaaaug

SEQ ID NO: 1747689 - RNA, 20 nt, Salmonella enterica enterica serovar Typhi Ty2
uguccaucagauucaacagg

SEQ ID NO: 1747690 - RNA, 20 nt, Salmonella enterica enterica serovar Typhi Ty2
uguccaggucaucaccucca

SEQ ID NO: 1747691 - RNA, 17 nt, Salmonella enterica enterica serovar Typhi Ty2
ugucaugguaaaugccg

SEQ ID NO: 1747692 - RNA, 13 nt, Salmonella enterica enterica serovar Typhi Ty2
ugucaucggcuuu

SEQ ID NO: 1747693 - RNA, 17 nt, Salmonella enterica enterica serovar Typhi Ty2
ugucaucgucagcaacg

SEQ ID NO: 1747694 - RNA, 21 nt, Salmonella enterica enterica serovar Typhi Ty2
ugucauagucggcgccaaagu

SEQ ID NO: 1747695 - RNA, 16 nt, Salmonella enterica enterica serovar Typhi Ty2
ugucauauuugugagc

SEQ ID NO: 1747696 - RNA, 17 nt, Salmonella enterica enterica serovar Typhi Ty2
ugucaucgccauccugc

SEQ ID NO: 1747697 - RNA, 13 nt, Salmonella enterica enterica serovar Typhi Ty2
uguaucuugcuuu

SEQ ID NO: 1747698 - RNA, 21 nt, Salmonella enterica enterica serovar Typhi Ty2
uguaucuucgccguguucuua

SEQ ID NO: 1747699 - RNA, 21 nt, Salmonella enterica enterica serovar Typhi Ty2
uguaucuucgccguauucuua

SEQ ID NO: 1747700 - RNA, 22 nt, Salmonella enterica enterica serovar Typhi Ty2
uguacaucacauugccccagcc

SEQ ID NO: 1747701 - RNA, 17 nt, Salmonella enterica enterica serovar Typhi Ty2
uguauuguaauaacgaa

SEQ ID NO: 1747702 - RNA, 19 nt, Salmonella enterica enterica serovar Typhi Ty2
ugucaacaacuucaaaaua

SEQ ID NO: 1747703 - RNA, 22 nt, Salmonella enterica enterica serovar Typhi Ty2
uuauaaggccugccguccugau

SEQ ID NO: 1747704 - RNA, 15 nt, Salmonella enterica enterica serovar Typhi Ty2
uuauaagaaccaucu

SEQ ID NO: 1747705 - RNA, 16 nt, Salmonella enterica enterica serovar Typhi Ty2
uuagagaguaaaaccg

SEQ ID NO: 1747706 - RNA, 13 nt, Salmonella enterica enterica serovar Typhi Ty2
uuagagccuaucc

SEQ ID NO: 1747707 - RNA, 17 nt, Salmonella enterica enterica serovar Typhi Ty2
uuagacuucuuccauac

SEQ ID NO: 1747708 - RNA, 22 nt, Salmonella enterica enterica serovar Typhi Ty2
uuauaaguacgccugaaaacag

SEQ ID NO: 1747709 - RNA, 20 nt, Salmonella enterica enterica serovar Typhi Ty2
uuauagcuggcuuuauauaa

SEQ ID NO: 1747710 - RNA, 17 nt, Salmonella enterica enterica serovar Typhi Ty2
uuauagcuggcuuuaua

SEQ ID NO: 1747711 - RNA, 23 nt, Salmonella enterica enterica serovar Typhi Ty2
uuauacauccugugaaguaaaaa

SEQ ID NO: 1747712 - RNA, 19 nt, Salmonella enterica enterica serovar Typhi Ty2
uuaucaacaaauuccggca

SEQ ID NO: 1747713 - RNA, 13 nt, Salmonella enterica enterica serovar Typhi Ty2
uuauauagucuua

SEQ ID NO: 1747714 - RNA, 17 nt, Salmonella enterica enterica serovar Typhi Ty2
uuauauagucuuaauuu

SEQ ID NO: 1747715 - RNA, 17 nt, Salmonella enterica enterica serovar Typhi Ty2
uuaucaucguaaaauca

SEQ ID NO: 1747716 - RNA, 14 nt, Salmonella enterica enterica serovar Typhi Ty2
uuaucccguggugg

SEQ ID NO: 1747717 - RNA, 17 nt, Salmonella enterica enterica serovar Typhi Ty2
uuaucccgcccgaucuc

SEQ ID NO: 1747718 - RNA, 11 nt, Salmonella enterica enterica serovar Typhi Ty2
uuauccccuuc

SEQ ID NO: 1747719 - RNA, 22 nt, Salmonella enterica enterica serovar Typhi Ty2
uuauccggcuuacggcuauucc

SEQ ID NO: 1747720 - RNA, 16 nt, Salmonella enterica enterica serovar Typhi Ty2
uuauccggugcgcagg

SEQ ID NO: 1747721 - RNA, 14 nt, Salmonella enterica enterica serovar Typhi Ty2
uuauccggccuaca

SEQ ID NO: 1747722 - RNA, 15 nt, Salmonella enterica enterica serovar Typhi Ty2
uuauccggcaaaaga

SEQ ID NO: 1747723 - RNA, 18 nt, Salmonella enterica enterica serovar Typhi Ty2
uuauccgcagauccagca

SEQ ID NO: 1747724 - RNA, 17 nt, Salmonella enterica enterica serovar Typhi Ty2
uuauccagucagaggaa

SEQ ID NO: 1747725 - RNA, 18 nt, Salmonella enterica enterica serovar Typhi Ty2
uuauccagucccaccggg

SEQ ID NO: 1747726 - RNA, 11 nt, Salmonella enterica enterica serovar Typhi Ty2
uuauccagcaa

SEQ ID NO: 1747727 - RNA, 17 nt, Salmonella enterica enterica serovar Typhi Ty2
uuauccacaaacuccag

SEQ ID NO: 1747728 - RNA, 13 nt, Salmonella enterica enterica serovar Typhi Ty2
uuaugcacgcuau

SEQ ID NO: 1747729 - RNA, 17 nt, Salmonella enterica enterica serovar Typhi Ty2
uuaugauuuuaacauca

SEQ ID NO: 1747730 - RNA, 20 nt, Salmonella enterica enterica serovar Typhi Ty2
uuaugcccggaugauuauca

SEQ ID NO: 1747731 - RNA, 22 nt, Salmonella enterica enterica serovar Typhi Ty2
uuaugaucgcccagccacuccu

SEQ ID NO: 1747732 - RNA, 19 nt, Salmonella enterica enterica serovar Typhi Ty2
uuaugaccauacugcucaa

SEQ ID NO: 1747733 - RNA, 21 nt, Salmonella enterica enterica serovar Typhi Ty2
uuaugaccguauuacaaguaa

SEQ ID NO: 1747734 - RNA, 17 nt, Salmonella enterica enterica serovar Typhi Ty2
uuaucuuuuacgcuguc

SEQ ID NO: 1747735 - RNA, 18 nt, Salmonella enterica enterica serovar Typhi Ty2
uuauuaaagccccuuccu

SEQ ID NO: 1747736 - RNA, 23 nt, Salmonella enterica enterica serovar Typhi Ty2
uuauguagccagccauggcccuu

SEQ ID NO: 1747737 - RNA, 17 nt, Salmonella enterica enterica serovar Typhi Ty2
uuauguccuuccagcuc

SEQ ID NO: 1747738 - RNA, 22 nt, Salmonella enterica enterica serovar Typhi Ty2
uuaugcguuuuuaucuuucuuu

SEQ ID NO: 1747739 - RNA, 19 nt, Salmonella enterica enterica serovar Typhi Ty2
uuaugcguuuaauugaauu

SEQ ID NO: 1747740 - RNA, 18 nt, Salmonella enterica enterica serovar Typhi Ty2
uuaugcggcgcuuccaga

SEQ ID NO: 1747741 - RNA, 15 nt, Salmonella enterica enterica serovar Typhi Ty2
uuaugcgguucuccc

SEQ ID NO: 1747742 - RNA, 21 nt, Salmonella enterica enterica serovar Typhi Ty2
uuaugcgucaaaguugcauca

SEQ ID NO: 1747743 - RNA, 21 nt, Salmonella enterica enterica serovar Typhi Ty2
uuauggaggauauaaaaaaca

SEQ ID NO: 1747744 - RNA, 16 nt, Salmonella enterica enterica serovar Typhi Ty2
uuauggguuuuuuauu

SEQ ID NO: 1747745 - RNA, 13 nt, Salmonella enterica enterica serovar Typhi Ty2
uuaucuuccggca

SEQ ID NO: 1747746 - RNA, 12 nt, Salmonella enterica enterica serovar Typhi Ty2
uuaucuucaagg

SEQ ID NO: 1747747 - RNA, 18 nt, Salmonella enterica enterica serovar Typhi Ty2
uuaucuucaagguuaugc

SEQ ID NO: 1747748 - RNA, 20 nt, Salmonella enterica enterica serovar Typhi Ty2
uuaucuuccacgguaaaaca

SEQ ID NO: 1747749 - RNA, 12 nt, Salmonella enterica enterica serovar Typhi Ty2
uuaucuguugau

SEQ ID NO: 1747750 - RNA, 22 nt, Salmonella enterica enterica serovar Typhi Ty2
uuaucuccccaauugcugcuau

SEQ ID NO: 1747751 - RNA, 16 nt, Salmonella enterica enterica serovar Typhi Ty2
uuaucucuacuuuccu

SEQ ID NO: 1747752 - RNA, 17 nt, Salmonella enterica enterica serovar Typhi Ty2
uuaucucuacuuuccug

SEQ ID NO: 1747753 - RNA, 14 nt, Salmonella enterica enterica serovar Typhi Ty2
uuaucucuuuugcu

SEQ ID NO: 1747754 - RNA, 16 nt, Salmonella enterica enterica serovar Typhi Ty2
uuaucucuuuugcuuc

SEQ ID NO: 1747755 - RNA, 13 nt, Salmonella enterica enterica serovar Typhi Ty2
uuaucgccugggg

SEQ ID NO: 1747756 - RNA, 12 nt, Salmonella enterica enterica serovar Typhi Ty2
uuaucgcuauca

SEQ ID NO: 1747757 - RNA, 16 nt, Salmonella enterica enterica serovar Typhi Ty2
uuaucgcgcuggcagu

SEQ ID NO: 1747758 - RNA, 23 nt, Salmonella enterica enterica serovar Typhi Ty2
uuaucggcgucgcggcaauagcg

SEQ ID NO: 1747759 - RNA, 23 nt, Salmonella enterica enterica serovar Typhi Ty2
uuaucgggccuacgagauaaaaa

SEQ ID NO: 1747760 - RNA, 22 nt, Salmonella enterica enterica serovar Typhi Ty2
uuauccuccgaacaggcguuug

SEQ ID NO: 1747761 - RNA, 16 nt, Salmonella enterica enterica serovar Typhi Ty2
uuauccugcaaauagc

SEQ ID NO: 1747762 - RNA, 13 nt, Salmonella enterica enterica serovar Typhi Ty2
uuauccugcacga

SEQ ID NO: 1747763 - RNA, 20 nt, Salmonella enterica enterica serovar Typhi Ty2
uuauccuguguuuggccgcc

SEQ ID NO: 1747764 - RNA, 16 nt, Salmonella enterica enterica serovar Typhi Ty2
uuauccuccagccagc

SEQ ID NO: 1747765 - RNA, 13 nt, Salmonella enterica enterica serovar Typhi Ty2
uuaucgacgcuau

SEQ ID NO: 1747766 - RNA, 15 nt, Salmonella enterica enterica serovar Typhi Ty2
uuaucgccaaagaua

SEQ ID NO: 1747767 - RNA, 18 nt, Salmonella enterica enterica serovar Typhi Ty2
uucaagcccgugcuuagc

SEQ ID NO: 1747768 - RNA, 12 nt, Salmonella enterica enterica serovar Typhi Ty2
uucaagcaauaa

SEQ ID NO: 1747769 - RNA, 19 nt, Salmonella enterica enterica serovar Typhi Ty2
uucaacgcguugccugaaa

SEQ ID NO: 1747770 - RNA, 14 nt, Salmonella enterica enterica serovar Typhi Ty2
uucaacggcaucaa

SEQ ID NO: 1747771 - RNA, 23 nt, Salmonella enterica enterica serovar Typhi Ty2
uucaaccacaaguuuauccagca

SEQ ID NO: 1747772 - RNA, 16 nt, Salmonella enterica enterica serovar Typhi Ty2
uucaaccuccugcaau

SEQ ID NO: 1747773 - RNA, 20 nt, Salmonella enterica enterica serovar Typhi Ty2
uucaacgaaugccugcauau

SEQ ID NO: 1747774 - RNA, 15 nt, Salmonella enterica enterica serovar Typhi Ty2
uucaaccuccugcaa

SEQ ID NO: 1747775 - RNA, 15 nt, Salmonella enterica enterica serovar Typhi Ty2
uucaaccguuucuuu

SEQ ID NO: 1747776 - RNA, 18 nt, Salmonella enterica enterica serovar Typhi Ty2
uucaacgugcaucuccuc

SEQ ID NO: 1747777 - RNA, 18 nt, Salmonella enterica enterica serovar Typhi Ty2
uucaacuuccaccaccuc

SEQ ID NO: 1747778 - RNA, 18 nt, Salmonella enterica enterica serovar Typhi Ty2
uucaacauauuuuucaca

SEQ ID NO: 1747779 - RNA, 16 nt, Salmonella enterica enterica serovar Typhi Ty2
uucaacagcucgccau

SEQ ID NO: 1747780 - RNA, 17 nt, Salmonella enterica enterica serovar Typhi Ty2
uucaaauauauugaaaa

SEQ ID NO: 1747781 - RNA, 19 nt, Salmonella enterica enterica serovar Typhi Ty2
uucaaauguuguuugaaaa

SEQ ID NO: 1747782 - RNA, 14 nt, Salmonella enterica enterica serovar Typhi Ty2
uucaaaaucaaaca

SEQ ID NO: 1747783 - RNA, 13 nt, Salmonella enterica enterica serovar Typhi Ty2
uucaaaaucaaac

SEQ ID NO: 1747784 - RNA, 23 nt, Salmonella enterica enterica serovar Typhi Ty2
uucaaagccgccauccggccugu

SEQ ID NO: 1747785 - RNA, 17 nt, Salmonella enterica enterica serovar Typhi Ty2
uuauuuuucuggcuucu

SEQ ID NO: 1747786 - RNA, 20 nt, Salmonella enterica enterica serovar Typhi Ty2
uuauuuuucgccagaucgau

SEQ ID NO: 1747787 - RNA, 12 nt, Salmonella enterica enterica serovar Typhi Ty2
uuauuuuuucau

SEQ ID NO: 1747788 - RNA, 14 nt, Salmonella enterica enterica serovar Typhi Ty2
uuauuuugucaugu

SEQ ID NO: 1747789 - RNA, 20 nt, Salmonella enterica enterica serovar Typhi Ty2
uuauuuuccugaaaaaauuc

SEQ ID NO: 1747790 - RNA, 17 nt, Salmonella enterica enterica serovar Typhi Ty2
uucaaaaaugauguguu

SEQ ID NO: 1747791 - RNA, 12 nt, Salmonella enterica enterica serovar Typhi Ty2
uucaaaaaagag

SEQ ID NO: 1747792 - RNA, 19 nt, Salmonella enterica enterica serovar Typhi Ty2
uuauuccauucaucgauuu

SEQ ID NO: 1747793 - RNA, 17 nt, Salmonella enterica enterica serovar Typhi Ty2
uuauucccauuccugca

SEQ ID NO: 1747794 - RNA, 15 nt, Salmonella enterica enterica serovar Typhi Ty2
uuauucaucuccucu

SEQ ID NO: 1747795 - RNA, 15 nt, Salmonella enterica enterica serovar Typhi Ty2
uuauuccgaauacgg

SEQ ID NO: 1747796 - RNA, 22 nt, Salmonella enterica enterica serovar Typhi Ty2
uuauucgcauguugacugcgcu

SEQ ID NO: 1747797 - RNA, 19 nt, Salmonella enterica enterica serovar Typhi Ty2
uuauuccuuaucacauuuu

SEQ ID NO: 1747798 - RNA, 15 nt, Salmonella enterica enterica serovar Typhi Ty2
uuauugagauaauuu

SEQ ID NO: 1747799 - RNA, 23 nt, Salmonella enterica enterica serovar Typhi Ty2
uuauugaccaucgccagccauuc

SEQ ID NO: 1747800 - RNA, 20 nt, Salmonella enterica enterica serovar Typhi Ty2
uuauuacgcaagaucacaua

SEQ ID NO: 1747801 - RNA, 12 nt, Salmonella enterica enterica serovar Typhi Ty2
uuauuaccaaug

SEQ ID NO: 1747802 - RNA, 22 nt, Salmonella enterica enterica serovar Typhi Ty2
uuauuauagcuauggucacuuu

SEQ ID NO: 1747803 - RNA, 23 nt, Salmonella enterica enterica serovar Typhi Ty2
uuauuagaggucagaauaacuca

SEQ ID NO: 1747804 - RNA, 15 nt, Salmonella enterica enterica serovar Typhi Ty2
uuauuuaacgccagu

SEQ ID NO: 1747805 - RNA, 22 nt, Salmonella enterica enterica serovar Typhi Ty2
uuauuuaaaaaggaaagauuac

SEQ ID NO: 1747806 - RNA, 20 nt, Salmonella enterica enterica serovar Typhi Ty2
uuauuggugaaaaaucauua

SEQ ID NO: 1747807 - RNA, 11 nt, Salmonella enterica enterica serovar Typhi Ty2
uuauuucuauc

SEQ ID NO: 1747808 - RNA, 21 nt, Salmonella enterica enterica serovar Typhi Ty2
uuauuucaggaauacauuaac

SEQ ID NO: 1747809 - RNA, 12 nt, Salmonella enterica enterica serovar Typhi Ty2
uuauuugaauag

SEQ ID NO: 1747810 - RNA, 15 nt, Salmonella enterica enterica serovar Typhi Ty2
uuaacacgauaaaac

SEQ ID NO: 1747811 - RNA, 16 nt, Salmonella enterica enterica serovar Typhi Ty2
uuaacacauauaagua

SEQ ID NO: 1747812 - RNA, 20 nt, Salmonella enterica enterica serovar Typhi Ty2
uuaacaauccccgucacagc

SEQ ID NO: 1747813 - RNA, 13 nt, Salmonella enterica enterica serovar Typhi Ty2
uuaacaucagaaa

SEQ ID NO: 1747814 - RNA, 17 nt, Salmonella enterica enterica serovar Typhi Ty2
uuaacaucaucaggccu

SEQ ID NO: 1747815 - RNA, 20 nt, Salmonella enterica enterica serovar Typhi Ty2
uuaacagcgccaucaggaaa

SEQ ID NO: 1747816 - RNA, 20 nt, Salmonella enterica enterica serovar Typhi Ty2
uuaacagcgcgaccaggaaa

SEQ ID NO: 1747817 - RNA, 18 nt, Salmonella enterica enterica serovar Typhi Ty2
uuaacauuuaagaaacaa

SEQ ID NO: 1747818 - RNA, 19 nt, Salmonella enterica enterica serovar Typhi Ty2
uuaacgccaugcucaucca

SEQ ID NO: 1747819 - RNA, 13 nt, Salmonella enterica enterica serovar Typhi Ty2
uuaacgcagaaua

SEQ ID NO: 1747820 - RNA, 18 nt, Salmonella enterica enterica serovar Typhi Ty2
uuaacgccgccaucagua

SEQ ID NO: 1747821 - RNA, 17 nt, Salmonella enterica enterica serovar Typhi Ty2
uuaacgccggcaaauag

SEQ ID NO: 1747822 - RNA, 17 nt, Salmonella enterica enterica serovar Typhi Ty2
uuaacgcgccaucuuuc

SEQ ID NO: 1747823 - RNA, 17 nt, Salmonella enterica enterica serovar Typhi Ty2
uuaacgcggccguaaua

SEQ ID NO: 1747824 - RNA, 19 nt, Salmonella enterica enterica serovar Typhi Ty2
uuaacguccauaccgguug

SEQ ID NO: 1747825 - RNA, 19 nt, Salmonella enterica enterica serovar Typhi Ty2
uuaaccugagaauauuaac

SEQ ID NO: 1747826 - RNA, 16 nt, Salmonella enterica enterica serovar Typhi Ty2
uuaacgaagguaaacg

SEQ ID NO: 1747827 - RNA, 20 nt, Salmonella enterica enterica serovar Typhi Ty2
uuaaccucgcuacuggcaaa

SEQ ID NO: 1747828 - RNA, 16 nt, Salmonella enterica enterica serovar Typhi Ty2
uuaagauuuaaaacaa

SEQ ID NO: 1747829 - RNA, 15 nt, Salmonella enterica enterica serovar Typhi Ty2
uuaacucaucacagc

SEQ ID NO: 1747830 - RNA, 18 nt, Salmonella enterica enterica serovar Typhi Ty2
uuaacuucugcagggaaa

SEQ ID NO: 1747831 - RNA, 22 nt, Salmonella enterica enterica serovar Typhi Ty2
uuaacuccuucuaauuccagga

SEQ ID NO: 1747832 - RNA, 15 nt, Salmonella enterica enterica serovar Typhi Ty2
uuaauaaacaaugca

SEQ ID NO: 1747833 - RNA, 21 nt, Salmonella enterica enterica serovar Typhi Ty2
uuaagcuuugcaccacuuugu

SEQ ID NO: 1747834 - RNA, 18 nt, Salmonella enterica enterica serovar Typhi Ty2
uuaagcuuaaugauaauu

SEQ ID NO: 1747835 - RNA, 23 nt, Salmonella enterica enterica serovar Typhi Ty2
uuaaauacugcaacggcgaggug

SEQ ID NO: 1747836 - RNA, 16 nt, Salmonella enterica enterica serovar Typhi Ty2
uuaaauagcaggcaau

SEQ ID NO: 1747837 - RNA, 17 nt, Salmonella enterica enterica serovar Typhi Ty2
uuaaauaugaaagagaa

SEQ ID NO: 1747838 - RNA, 20 nt, Salmonella enterica enterica serovar Typhi Ty2
uuaaauuaaugauuaaaaua

SEQ ID NO: 1747839 - RNA, 22 nt, Salmonella enterica enterica serovar Typhi Ty2
uuaaauggaucgacaucuucau

SEQ ID NO: 1747840 - RNA, 19 nt, Salmonella enterica enterica serovar Typhi Ty2
uuaaauucauauuuaaaua

SEQ ID NO: 1747841 - RNA, 12 nt, Salmonella enterica enterica serovar Typhi Ty2
uuaacaaaucau

SEQ ID NO: 1747842 - RNA, 15 nt, Salmonella enterica enterica serovar Typhi Ty2
uuaaauuuuuaauaa

SEQ ID NO: 1747843 - RNA, 17 nt, Salmonella enterica enterica serovar Typhi Ty2
uuaaauugguuauauua

SEQ ID NO: 1747844 - RNA, 14 nt, Salmonella enterica enterica serovar Typhi Ty2
uuaaagaaaaagaa

SEQ ID NO: 1747845 - RNA, 17 nt, Salmonella enterica enterica serovar Typhi Ty2
uuaaacgccugaucauc

SEQ ID NO: 1747846 - RNA, 22 nt, Salmonella enterica enterica serovar Typhi Ty2
uuaaagacgccguuaccaaucu

SEQ ID NO: 1747847 - RNA, 13 nt, Salmonella enterica enterica serovar Typhi Ty2
uuaaacaacauau

SEQ ID NO: 1747848 - RNA, 11 nt, Salmonella enterica enterica serovar Typhi Ty2
uuaaacaacau

SEQ ID NO: 1747849 - RNA, 15 nt, Salmonella enterica enterica serovar Typhi Ty2
uguugcgggccagca

SEQ ID NO: 1747850 - RNA, 16 nt, Salmonella enterica enterica serovar Typhi Ty2
uguugcucaaaaaaga

SEQ ID NO: 1747851 - RNA, 14 nt, Salmonella enterica enterica serovar Typhi Ty2
uguugcuaaaucca

SEQ ID NO: 1747852 - RNA, 23 nt, Salmonella enterica enterica serovar Typhi Ty2
uguugccgcccguuuuuuccagc

SEQ ID NO: 1747853 - RNA, 22 nt, Salmonella enterica enterica serovar Typhi Ty2
uguugaguucccuucuccucaa

SEQ ID NO: 1747854 - RNA, 21 nt, Salmonella enterica enterica serovar Typhi Ty2
uguugcggaugaccgcaaacc

SEQ ID NO: 1747855 - RNA, 12 nt, Salmonella enterica enterica serovar Typhi Ty2
uuaaacacaucc

SEQ ID NO: 1747856 - RNA, 16 nt, Salmonella enterica enterica serovar Typhi Ty2
uuacggauaaaaaccc

SEQ ID NO: 1747857 - RNA, 16 nt, Salmonella enterica enterica serovar Typhi Ty2
uuacggaaaaaugucg

SEQ ID NO: 1747858 - RNA, 21 nt, Salmonella enterica enterica serovar Typhi Ty2
uuacggcacauaggcaaacac

SEQ ID NO: 1747859 - RNA, 15 nt, Salmonella enterica enterica serovar Typhi Ty2
uuacggaaaaaauac

SEQ ID NO: 1747860 - RNA, 23 nt, Salmonella enterica enterica serovar Typhi Ty2
uuacgcuuaauggcgucaaucaa

SEQ ID NO: 1747861 - RNA, 20 nt, Salmonella enterica enterica serovar Typhi Ty2
uuacgcuuacccggccuaca

SEQ ID NO: 1747862 - RNA, 22 nt, Salmonella enterica enterica serovar Typhi Ty2
uuacggacugcggccugcaaag

SEQ ID NO: 1747863 - RNA, 17 nt, Salmonella enterica enterica serovar Typhi Ty2
uuacgcuauagcuauca

SEQ ID NO: 1747864 - RNA, 12 nt, Salmonella enterica enterica serovar Typhi Ty2
uuacgccgccau

SEQ ID NO: 1747865 - RNA, 21 nt, Salmonella enterica enterica serovar Typhi Ty2
uuacgcucgucaaacaguuca

SEQ ID NO: 1747866 - RNA, 15 nt, Salmonella enterica enterica serovar Typhi Ty2
uuacgggaacagaau

SEQ ID NO: 1747867 - RNA, 19 nt, Salmonella enterica enterica serovar Typhi Ty2
uuacguuaaguucaaggau

SEQ ID NO: 1747868 - RNA, 13 nt, Salmonella enterica enterica serovar Typhi Ty2
uuacgcacuuuua

SEQ ID NO: 1747869 - RNA, 22 nt, Salmonella enterica enterica serovar Typhi Ty2
uuacgcagcaagaacagagcaa

SEQ ID NO: 1747870 - RNA, 17 nt, Salmonella enterica enterica serovar Typhi Ty2
uuacgcacgccagauaa

SEQ ID NO: 1747871 - RNA, 13 nt, Salmonella enterica enterica serovar Typhi Ty2
uuacgcacaaacc

SEQ ID NO: 1747872 - RNA, 20 nt, Salmonella enterica enterica serovar Typhi Ty2
uuacgagugcguucuuccac

SEQ ID NO: 1747873 - RNA, 11 nt, Salmonella enterica enterica serovar Typhi Ty2
uuaccaacccc

SEQ ID NO: 1747874 - RNA, 22 nt, Salmonella enterica enterica serovar Typhi Ty2
uuaccauuccucacgaaguuua

SEQ ID NO: 1747875 - RNA, 13 nt, Salmonella enterica enterica serovar Typhi Ty2
uuacccagccuga

SEQ ID NO: 1747876 - RNA, 21 nt, Salmonella enterica enterica serovar Typhi Ty2
uuagaauauaguuagaaaaua

SEQ ID NO: 1747877 - RNA, 14 nt, Salmonella enterica enterica serovar Typhi Ty2
uuacuuguaggccu

SEQ ID NO: 1747878 - RNA, 18 nt, Salmonella enterica enterica serovar Typhi Ty2
uuacuuucaaaauacugg

SEQ ID NO: 1747879 - RNA, 14 nt, Salmonella enterica enterica serovar Typhi Ty2
uuacuauuuuucac

SEQ ID NO: 1747880 - RNA, 15 nt, Salmonella enterica enterica serovar Typhi Ty2
uuacucacugccgcc

SEQ ID NO: 1747881 - RNA, 15 nt, Salmonella enterica enterica serovar Typhi Ty2
uuacucaguuugccg

SEQ ID NO: 1747882 - RNA, 22 nt, Salmonella enterica enterica serovar Typhi Ty2
uuacucccgucgccuguuucug

SEQ ID NO: 1747883 - RNA, 13 nt, Salmonella enterica enterica serovar Typhi Ty2
uuacuauuuuuca

SEQ ID NO: 1747884 - RNA, 15 nt, Salmonella enterica enterica serovar Typhi Ty2
uuacuccaaaaauaa

SEQ ID NO: 1747885 - RNA, 12 nt, Salmonella enterica enterica serovar Typhi Ty2
uuacuauuuuuc

SEQ ID NO: 1747886 - RNA, 20 nt, Salmonella enterica enterica serovar Typhi Ty2
uuacugacgccauucauucc

SEQ ID NO: 1747887 - RNA, 23 nt, Salmonella enterica enterica serovar Typhi Ty2
uuacugcuuugaucacccacacc

SEQ ID NO: 1747888 - RNA, 18 nt, Salmonella enterica enterica serovar Typhi Ty2
uuacugcucguagcguuu

SEQ ID NO: 1747889 - RNA, 14 nt, Salmonella enterica enterica serovar Typhi Ty2
uuacucucuuucug

SEQ ID NO: 1747890 - RNA, 14 nt, Salmonella enterica enterica serovar Typhi Ty2
uuacucuuccacca

SEQ ID NO: 1747891 - RNA, 15 nt, Salmonella enterica enterica serovar Typhi Ty2
uuacugacaauaagu

SEQ ID NO: 1747892 - RNA, 11 nt, Salmonella enterica enterica serovar Typhi Ty2
uuacucuucca

SEQ ID NO: 1747893 - RNA, 14 nt, Salmonella enterica enterica serovar Typhi Ty2
uuaauaccugguaa

SEQ ID NO: 1747894 - RNA, 24 nt, Salmonella enterica enterica serovar Typhi Ty2
uuaauaccgugcaggacagacaga

SEQ ID NO: 1747895 - RNA, 15 nt, Salmonella enterica enterica serovar Typhi Ty2
uuaauacccauagua

SEQ ID NO: 1747896 - RNA, 14 nt, Salmonella enterica enterica serovar Typhi Ty2
uuaauacgcugucg

SEQ ID NO: 1747897 - RNA, 19 nt, Salmonella enterica enterica serovar Typhi Ty2
uuaauacguacugaaauaa

SEQ ID NO: 1747898 - RNA, 21 nt, Salmonella enterica enterica serovar Typhi Ty2
uuaaucucuucaucuguggca

SEQ ID NO: 1747899 - RNA, 17 nt, Salmonella enterica enterica serovar Typhi Ty2
uuaaugauguccagaau

SEQ ID NO: 1747900 - RNA, 16 nt, Salmonella enterica enterica serovar Typhi Ty2
uuaaugacuuuuuaua

SEQ ID NO: 1747901 - RNA, 21 nt, Salmonella enterica enterica serovar Typhi Ty2
uuaaucugcgcuggguuuuuc

SEQ ID NO: 1747902 - RNA, 14 nt, Salmonella enterica enterica serovar Typhi Ty2
uuaauuauacuguc

SEQ ID NO: 1747903 - RNA, 14 nt, Salmonella enterica enterica serovar Typhi Ty2
uuaaugucaucauc

SEQ ID NO: 1747904 - RNA, 21 nt, Salmonella enterica enterica serovar Typhi Ty2
uuaauuccucagaauccguca

SEQ ID NO: 1747905 - RNA, 23 nt, Salmonella enterica enterica serovar Typhi Ty2
uuaauggucuuaaaugccgccgg

SEQ ID NO: 1747906 - RNA, 19 nt, Salmonella enterica enterica serovar Typhi Ty2
uuaauggcgcaaugucccu

SEQ ID NO: 1747907 - RNA, 15 nt, Salmonella enterica enterica serovar Typhi Ty2
uuaaugguaccaaua

SEQ ID NO: 1747908 - RNA, 22 nt, Salmonella enterica enterica serovar Typhi Ty2
uuaaugccgccguacaaacccu

SEQ ID NO: 1747909 - RNA, 19 nt, Salmonella enterica enterica serovar Typhi Ty2
uuaaugccuucgccgccgc

SEQ ID NO: 1747910 - RNA, 18 nt, Salmonella enterica enterica serovar Typhi Ty2
uuaaugcgcacgccagcg

SEQ ID NO: 1747911 - RNA, 17 nt, Salmonella enterica enterica serovar Typhi Ty2
uuaaugcuaucccaggc

SEQ ID NO: 1747912 - RNA, 21 nt, Salmonella enterica enterica serovar Typhi Ty2
uuaaugcgccccugcaggcga

SEQ ID NO: 1747913 - RNA, 12 nt, Salmonella enterica enterica serovar Typhi Ty2
uuaaugcgcgcu

SEQ ID NO: 1747914 - RNA, 22 nt, Salmonella enterica enterica serovar Typhi Ty2
uuacaaacaggcuuuauacagu

SEQ ID NO: 1747915 - RNA, 19 nt, Salmonella enterica enterica serovar Typhi Ty2
uuaauuguaccgauuguuu

SEQ ID NO: 1747916 - RNA, 19 nt, Salmonella enterica enterica serovar Typhi Ty2
uuacaagugucgugaaucg

SEQ ID NO: 1747917 - RNA, 19 nt, Salmonella enterica enterica serovar Typhi Ty2
uuacaaaugaccucaagaa

SEQ ID NO: 1747918 - RNA, 20 nt, Salmonella enterica enterica serovar Typhi Ty2
uuacaaauuuaaacauguca

SEQ ID NO: 1747919 - RNA, 18 nt, Salmonella enterica enterica serovar Typhi Ty2
uuacaaguaauaaaauaa

SEQ ID NO: 1747920 - RNA, 12 nt, Salmonella enterica enterica serovar Typhi Ty2
uuaccaaaucaa

SEQ ID NO: 1747921 - RNA, 23 nt, Salmonella enterica enterica serovar Typhi Ty2
ugccggaaaucgcggcgauggaa

SEQ ID NO: 1747922 - RNA, 17 nt, Salmonella enterica enterica serovar Typhi Ty2
ugccgcuuccaguccag

SEQ ID NO: 1747923 - RNA, 13 nt, Salmonella enterica enterica serovar Typhi Ty2
ugccggaagggau

SEQ ID NO: 1747924 - RNA, 13 nt, Salmonella enterica enterica serovar Typhi Ty2
ugccgggccuggc

SEQ ID NO: 1747925 - RNA, 15 nt, Salmonella enterica enterica serovar Typhi Ty2
ugccgggccuggcau

SEQ ID NO: 1747926 - RNA, 14 nt, Salmonella enterica enterica serovar Typhi Ty2
ugccgggcaaaaaa

SEQ ID NO: 1747927 - RNA, 15 nt, Salmonella enterica enterica serovar Typhi Ty2
ugccgggcaaaaaac

SEQ ID NO: 1747928 - RNA, 13 nt, Salmonella enterica enterica serovar Typhi Ty2
ugccgggcaaaaa

SEQ ID NO: 1747929 - RNA, 23 nt, Salmonella enterica enterica serovar Typhi Ty2
ugccgggacuuuaaacgucaugc

SEQ ID NO: 1747930 - RNA, 15 nt, Salmonella enterica enterica serovar Typhi Ty2
ugccggcgaccaugc

SEQ ID NO: 1747931 - RNA, 23 nt, Salmonella enterica enterica serovar Typhi Ty2
ugccgcgaccacgcauaccagcc

SEQ ID NO: 1747932 - RNA, 16 nt, Salmonella enterica enterica serovar Typhi Ty2
ugccgcugcuggcguu

SEQ ID NO: 1747933 - RNA, 17 nt, Salmonella enterica enterica serovar Typhi Ty2
ugccgcuggcguauucg

SEQ ID NO: 1747934 - RNA, 16 nt, Salmonella enterica enterica serovar Typhi Ty2
ugccgcuuauccggcc

SEQ ID NO: 1747935 - RNA, 15 nt, Salmonella enterica enterica serovar Typhi Ty2
ugccgcugcugccuu

SEQ ID NO: 1747936 - RNA, 18 nt, Salmonella enterica enterica serovar Typhi Ty2
ugccucuggccaguuuca

SEQ ID NO: 1747937 - RNA, 16 nt, Salmonella enterica enterica serovar Typhi Ty2
ugccuggguuccaggc

SEQ ID NO: 1747938 - RNA, 15 nt, Salmonella enterica enterica serovar Typhi Ty2
ugccuggccuccggc

SEQ ID NO: 1747939 - RNA, 12 nt, Salmonella enterica enterica serovar Typhi Ty2
ugccuggccucc

SEQ ID NO: 1747940 - RNA, 17 nt, Salmonella enterica enterica serovar Typhi Ty2
ugccucguuucccucau

SEQ ID NO: 1747941 - RNA, 20 nt, Salmonella enterica enterica serovar Typhi Ty2
ugccucggguggcaucugau

SEQ ID NO: 1747942 - RNA, 19 nt, Salmonella enterica enterica serovar Typhi Ty2
ugccuaacuggaaaaagac

SEQ ID NO: 1747943 - RNA, 18 nt, Salmonella enterica enterica serovar Typhi Ty2
ugccuaagauggcgccuu

SEQ ID NO: 1747944 - RNA, 14 nt, Salmonella enterica enterica serovar Typhi Ty2
ugccuaaagaaaaa

SEQ ID NO: 1747945 - RNA, 15 nt, Salmonella enterica enterica serovar Typhi Ty2
ugccuaaagaaaaac

SEQ ID NO: 1747946 - RNA, 17 nt, Salmonella enterica enterica serovar Typhi Ty2
ugccuaaaccuucgcuu

SEQ ID NO: 1747947 - RNA, 23 nt, Salmonella enterica enterica serovar Typhi Ty2
ugccgguuuuagcaaugaugaug

SEQ ID NO: 1747948 - RNA, 23 nt, Salmonella enterica enterica serovar Typhi Ty2
ugccggguucguuaacccggcau

SEQ ID NO: 1747949 - RNA, 14 nt, Salmonella enterica enterica serovar Typhi Ty2
ugccguuaauaaug

SEQ ID NO: 1747950 - RNA, 15 nt, Salmonella enterica enterica serovar Typhi Ty2
ugccguuaauaaugu

SEQ ID NO: 1747951 - RNA, 12 nt, Salmonella enterica enterica serovar Typhi Ty2
ugccgugccggg

SEQ ID NO: 1747952 - RNA, 21 nt, Salmonella enterica enterica serovar Typhi Ty2
ugccguuugcgccagcccggc

SEQ ID NO: 1747953 - RNA, 18 nt, Salmonella enterica enterica serovar Typhi Ty2
ugccguuguugucaauau

SEQ ID NO: 1747954 - RNA, 18 nt, Salmonella enterica enterica serovar Typhi Ty2
ugccccaucucuuucaga

SEQ ID NO: 1747955 - RNA, 19 nt, Salmonella enterica enterica serovar Typhi Ty2
ugcccccauacgcgcgcca

SEQ ID NO: 1747956 - RNA, 19 nt, Salmonella enterica enterica serovar Typhi Ty2
ugcccccgaucacggcgaa

SEQ ID NO: 1747957 - RNA, 15 nt, Salmonella enterica enterica serovar Typhi Ty2
ugcccccgagccaga

SEQ ID NO: 1747958 - RNA, 13 nt, Salmonella enterica enterica serovar Typhi Ty2
ugccauguuucuu

SEQ ID NO: 1747959 - RNA, 18 nt, Salmonella enterica enterica serovar Typhi Ty2
ugccauucccagccgagc

SEQ ID NO: 1747960 - RNA, 22 nt, Salmonella enterica enterica serovar Typhi Ty2
ugccccacgauacgccccugcu

SEQ ID NO: 1747961 - RNA, 21 nt, Salmonella enterica enterica serovar Typhi Ty2
ugccauuuuaucgacgcuauu

SEQ ID NO: 1747962 - RNA, 17 nt, Salmonella enterica enterica serovar Typhi Ty2
ugccauuguucgcgcgu

SEQ ID NO: 1747963 - RNA, 22 nt, Salmonella enterica enterica serovar Typhi Ty2
ugcccguuugcgagacggcgaa

SEQ ID NO: 1747964 - RNA, 16 nt, Salmonella enterica enterica serovar Typhi Ty2
ugcccguugucacagg

SEQ ID NO: 1747965 - RNA, 20 nt, Salmonella enterica enterica serovar Typhi Ty2
ugcccguugucacaggcuug

SEQ ID NO: 1747966 - RNA, 13 nt, Salmonella enterica enterica serovar Typhi Ty2
ugcccguuccagg

SEQ ID NO: 1747967 - RNA, 18 nt, Salmonella enterica enterica serovar Typhi Ty2
ugcccgauagugcaagcu

SEQ ID NO: 1747968 - RNA, 18 nt, Salmonella enterica enterica serovar Typhi Ty2
ugcccgcgaucgcuucca

SEQ ID NO: 1747969 - RNA, 17 nt, Salmonella enterica enterica serovar Typhi Ty2
ugcccgagugacugaca

SEQ ID NO: 1747970 - RNA, 22 nt, Salmonella enterica enterica serovar Typhi Ty2
ugcccugcuugucgaucaucag

SEQ ID NO: 1747971 - RNA, 17 nt, Salmonella enterica enterica serovar Typhi Ty2
ugcccugacucgcaccg

SEQ ID NO: 1747972 - RNA, 17 nt, Salmonella enterica enterica serovar Typhi Ty2
ugccgauaauaaacgcg

SEQ ID NO: 1747973 - RNA, 18 nt, Salmonella enterica enterica serovar Typhi Ty2
ugccgauagucuccgcca

SEQ ID NO: 1747974 - RNA, 14 nt, Salmonella enterica enterica serovar Typhi Ty2
ugccgcagcgcagu

SEQ ID NO: 1747975 - RNA, 14 nt, Salmonella enterica enterica serovar Typhi Ty2
ugccgccgcaccac

SEQ ID NO: 1747976 - RNA, 18 nt, Salmonella enterica enterica serovar Typhi Ty2
ugccagagauaauuuucc

SEQ ID NO: 1747977 - RNA, 17 nt, Salmonella enterica enterica serovar Typhi Ty2
ugccagacgggccaggc

SEQ ID NO: 1747978 - RNA, 11 nt, Salmonella enterica enterica serovar Typhi Ty2
ugccagagaga

SEQ ID NO: 1747979 - RNA, 15 nt, Salmonella enterica enterica serovar Typhi Ty2
ugccagcccaauauc

SEQ ID NO: 1747980 - RNA, 14 nt, Salmonella enterica enterica serovar Typhi Ty2
ugccagcgccgccg

SEQ ID NO: 1747981 - RNA, 16 nt, Salmonella enterica enterica serovar Typhi Ty2
ugccaggcuuccugcg

SEQ ID NO: 1747982 - RNA, 19 nt, Salmonella enterica enterica serovar Typhi Ty2
ugccagggcggaagcagau

SEQ ID NO: 1747983 - RNA, 15 nt, Salmonella enterica enterica serovar Typhi Ty2
ugccagccgccgccg

SEQ ID NO: 1747984 - RNA, 14 nt, Salmonella enterica enterica serovar Typhi Ty2
ugccagcgcugaga

SEQ ID NO: 1747985 - RNA, 17 nt, Salmonella enterica enterica serovar Typhi Ty2
ugccaucggauauauuu

SEQ ID NO: 1747986 - RNA, 20 nt, Salmonella enterica enterica serovar Typhi Ty2
ugccaucgcuuaacccugcc

SEQ ID NO: 1747987 - RNA, 23 nt, Salmonella enterica enterica serovar Typhi Ty2
ugccaucgaccgauugggcucag

SEQ ID NO: 1747988 - RNA, 16 nt, Salmonella enterica enterica serovar Typhi Ty2
ugccaguacagcagcg

SEQ ID NO: 1747989 - RNA, 15 nt, Salmonella enterica enterica serovar Typhi Ty2
ugccaguacagcagc

SEQ ID NO: 1747990 - RNA, 14 nt, Salmonella enterica enterica serovar Typhi Ty2
ugccaucagcaccu

SEQ ID NO: 1747991 - RNA, 20 nt, Salmonella enterica enterica serovar Typhi Ty2
ugccacgaacgauauaaaaa

SEQ ID NO: 1747992 - RNA, 22 nt, Salmonella enterica enterica serovar Typhi Ty2
ugccacgucacgcaacaggccg

SEQ ID NO: 1747993 - RNA, 17 nt, Salmonella enterica enterica serovar Typhi Ty2
ugccacacucucuccag

SEQ ID NO: 1747994 - RNA, 22 nt, Salmonella enterica enterica serovar Typhi Ty2
ugccacacccugagcgccgcca

SEQ ID NO: 1747995 - RNA, 23 nt, Salmonella enterica enterica serovar Typhi Ty2
ugccacaacgccugaugcugcgc

SEQ ID NO: 1747996 - RNA, 18 nt, Salmonella enterica enterica serovar Typhi Ty2
ugccacgaacgauauaaa

SEQ ID NO: 1747997 - RNA, 15 nt, Salmonella enterica enterica serovar Typhi Ty2
ugccaaugaaauaau

SEQ ID NO: 1747998 - RNA, 13 nt, Salmonella enterica enterica serovar Typhi Ty2
ugccaaugaaaua

SEQ ID NO: 1747999 - RNA, 16 nt, Salmonella enterica enterica serovar Typhi Ty2
ugccacaauaucaucg

SEQ ID NO: 1748000 - RNA, 23 nt, Salmonella enterica enterica serovar Typhi Ty2
ugccaauggcgauaaaaauaucc

SEQ ID NO: 1748001 - RNA, 15 nt, Salmonella enterica enterica serovar Typhi Ty2
ugcauugauaggcug

SEQ ID NO: 1748002 - RNA, 16 nt, Salmonella enterica enterica serovar Typhi Ty2
ugcauuuaucaaucug

SEQ ID NO: 1748003 - RNA, 20 nt, Salmonella enterica enterica serovar Typhi Ty2
ugcauuuaucaaucugcuuu

SEQ ID NO: 1748004 - RNA, 18 nt, Salmonella enterica enterica serovar Typhi Ty2
ugcauuguacuuuuaaau

SEQ ID NO: 1748005 - RNA, 17 nt, Salmonella enterica enterica serovar Typhi Ty2
ugcauuguccgcauucu

SEQ ID NO: 1748006 - RNA, 13 nt, Salmonella enterica enterica serovar Typhi Ty2
ugccaaacugcug

SEQ ID NO: 1748007 - RNA, 16 nt, Salmonella enterica enterica serovar Typhi Ty2
ugccaaacugcuggaa

SEQ ID NO: 1748008 - RNA, 21 nt, Salmonella enterica enterica serovar Typhi Ty2
ugccaaacaucgcucgcgcca

SEQ ID NO: 1748009 - RNA, 21 nt, Salmonella enterica enterica serovar Typhi Ty2
ugccaaaagguuagguuaaau

SEQ ID NO: 1748010 - RNA, 23 nt, Salmonella enterica enterica serovar Typhi Ty2
ugccaaaagguuagguuaaauag

SEQ ID NO: 1748011 - RNA, 22 nt, Salmonella enterica enterica serovar Typhi Ty2
ugccaaaaaaacuaauccucuu

SEQ ID NO: 1748012 - RNA, 17 nt, Salmonella enterica enterica serovar Typhi Ty2
ugcauuuucaccuggau

SEQ ID NO: 1748013 - RNA, 14 nt, Salmonella enterica enterica serovar Typhi Ty2
ugcaucaaacuucg

SEQ ID NO: 1748014 - RNA, 13 nt, Salmonella enterica enterica serovar Typhi Ty2
ugcauauuguauu

SEQ ID NO: 1748015 - RNA, 16 nt, Salmonella enterica enterica serovar Typhi Ty2
ugcauauuguauuggu

SEQ ID NO: 1748016 - RNA, 19 nt, Salmonella enterica enterica serovar Typhi Ty2
ugcauaucgcuaaaccaaa

SEQ ID NO: 1748017 - RNA, 22 nt, Salmonella enterica enterica serovar Typhi Ty2
ugcauaucgccuugcugcggca

SEQ ID NO: 1748018 - RNA, 19 nt, Salmonella enterica enterica serovar Typhi Ty2
ugcauacguuucaccagca

SEQ ID NO: 1748019 - RNA, 19 nt, Salmonella enterica enterica serovar Typhi Ty2
ugcauacucacauucauaa

SEQ ID NO: 1748020 - RNA, 22 nt, Salmonella enterica enterica serovar Typhi Ty2
ugcauacucacauucauaaaag

SEQ ID NO: 1748021 - RNA, 15 nt, Salmonella enterica enterica serovar Typhi Ty2
ugcauagccccagcg

SEQ ID NO: 1748022 - RNA, 15 nt, Salmonella enterica enterica serovar Typhi Ty2
ugcauacggaugaaa

SEQ ID NO: 1748023 - RNA, 23 nt, Salmonella enterica enterica serovar Typhi Ty2
ugcauaaucgccgacuaauuauu

SEQ ID NO: 1748024 - RNA, 23 nt, Salmonella enterica enterica serovar Typhi Ty2
ugcaguuuuaccguaaaaugcug

SEQ ID NO: 1748025 - RNA, 13 nt, Salmonella enterica enterica serovar Typhi Ty2
ugcauaaaaaaac

SEQ ID NO: 1748026 - RNA, 19 nt, Salmonella enterica enterica serovar Typhi Ty2
ugcauaaagauuggcaucu

SEQ ID NO: 1748027 - RNA, 12 nt, Salmonella enterica enterica serovar Typhi Ty2
ugcauaagaggu

SEQ ID NO: 1748028 - RNA, 23 nt, Salmonella enterica enterica serovar Typhi Ty2
ugcaguuccgcaauccuggcuuc

SEQ ID NO: 1748029 - RNA, 22 nt, Salmonella enterica enterica serovar Typhi Ty2
ugcaguucaucauccugcaggg

SEQ ID NO: 1748030 - RNA, 15 nt, Salmonella enterica enterica serovar Typhi Ty2
ugcaguucaaaaggu

SEQ ID NO: 1748031 - RNA, 14 nt, Salmonella enterica enterica serovar Typhi Ty2
ugcacugcaccugg

SEQ ID NO: 1748032 - RNA, 12 nt, Salmonella enterica enterica serovar Typhi Ty2
ugcacugcaccu

SEQ ID NO: 1748033 - RNA, 15 nt, Salmonella enterica enterica serovar Typhi Ty2
ugcacugcugauagu

SEQ ID NO: 1748034 - RNA, 14 nt, Salmonella enterica enterica serovar Typhi Ty2
ugcauucaggccuc

SEQ ID NO: 1748035 - RNA, 20 nt, Salmonella enterica enterica serovar Typhi Ty2
ugcauuauuuuagugaaaaa

SEQ ID NO: 1748036 - RNA, 22 nt, Salmonella enterica enterica serovar Typhi Ty2
ugcaugggauacgccagcagac

SEQ ID NO: 1748037 - RNA, 23 nt, Salmonella enterica enterica serovar Typhi Ty2
ugcauggccggucuuaugcugcc

SEQ ID NO: 1748038 - RNA, 18 nt, Salmonella enterica enterica serovar Typhi Ty2
ugcaucuggucaggugau

SEQ ID NO: 1748039 - RNA, 23 nt, Salmonella enterica enterica serovar Typhi Ty2
ugcgcuauguaagguucccugcg

SEQ ID NO: 1748040 - RNA, 20 nt, Salmonella enterica enterica serovar Typhi Ty2
ugcgcuauccgcgcucgcca

SEQ ID NO: 1748041 - RNA, 15 nt, Salmonella enterica enterica serovar Typhi Ty2
ugcgcuauccgcgcu

SEQ ID NO: 1748042 - RNA, 16 nt, Salmonella enterica enterica serovar Typhi Ty2
ugcgcuaacuggccaa

SEQ ID NO: 1748043 - RNA, 18 nt, Salmonella enterica enterica serovar Typhi Ty2
ugcgcguuuagcgccagc

SEQ ID NO: 1748044 - RNA, 21 nt, Salmonella enterica enterica serovar Typhi Ty2
ugcgcguuuagcgccagcagc

SEQ ID NO: 1748045 - RNA, 14 nt, Salmonella enterica enterica serovar Typhi Ty2
ugcgcguuuucauc

SEQ ID NO: 1748046 - RNA, 17 nt, Salmonella enterica enterica serovar Typhi Ty2
ugcgcgucccucuccag

SEQ ID NO: 1748047 - RNA, 21 nt, Salmonella enterica enterica serovar Typhi Ty2
ugcgcgucccucuccagggca

SEQ ID NO: 1748048 - RNA, 15 nt, Salmonella enterica enterica serovar Typhi Ty2
ugcgcuacuucaggg

SEQ ID NO: 1748049 - RNA, 22 nt, Salmonella enterica enterica serovar Typhi Ty2
ugcgcucacgcuuauccggccu

SEQ ID NO: 1748050 - RNA, 16 nt, Salmonella enterica enterica serovar Typhi Ty2
ugcgcucagggucaga

SEQ ID NO: 1748051 - RNA, 21 nt, Salmonella enterica enterica serovar Typhi Ty2
ugcggaaccgcccaucaacac

SEQ ID NO: 1748052 - RNA, 13 nt, Salmonella enterica enterica serovar Typhi Ty2
ugcggacauuaac

SEQ ID NO: 1748053 - RNA, 13 nt, Salmonella enterica enterica serovar Typhi Ty2
ugcggaggccggc

SEQ ID NO: 1748054 - RNA, 18 nt, Salmonella enterica enterica serovar Typhi Ty2
ugcggcagggcggucugg

SEQ ID NO: 1748055 - RNA, 11 nt, Salmonella enterica enterica serovar Typhi Ty2
ugcggcgacuu

SEQ ID NO: 1748056 - RNA, 20 nt, Salmonella enterica enterica serovar Typhi Ty2
ugcggccuugccgccagcgc

SEQ ID NO: 1748057 - RNA, 17 nt, Salmonella enterica enterica serovar Typhi Ty2
ugcgugacaaucuccuc

SEQ ID NO: 1748058 - RNA, 14 nt, Salmonella enterica enterica serovar Typhi Ty2
ugcgugaugcugca

SEQ ID NO: 1748059 - RNA, 15 nt, Salmonella enterica enterica serovar Typhi Ty2
ugcgucuuaauggug

SEQ ID NO: 1748060 - RNA, 17 nt, Salmonella enterica enterica serovar Typhi Ty2
ugcguaaucagcuuuuc

SEQ ID NO: 1748061 - RNA, 12 nt, Salmonella enterica enterica serovar Typhi Ty2
ugcguucuucca

SEQ ID NO: 1748062 - RNA, 15 nt, Salmonella enterica enterica serovar Typhi Ty2
ugcguaaucuuuuca

SEQ ID NO: 1748063 - RNA, 21 nt, Salmonella enterica enterica serovar Typhi Ty2
ugcguaaucuuuucauauuau

SEQ ID NO: 1748064 - RNA, 15 nt, Salmonella enterica enterica serovar Typhi Ty2
ugcgguucucccggc

SEQ ID NO: 1748065 - RNA, 15 nt, Salmonella enterica enterica serovar Typhi Ty2
ugcggcgcuuccaga

SEQ ID NO: 1748066 - RNA, 16 nt, Salmonella enterica enterica serovar Typhi Ty2
ugcgggcgaucggcug

SEQ ID NO: 1748067 - RNA, 15 nt, Salmonella enterica enterica serovar Typhi Ty2
ugcggucuccugaac

SEQ ID NO: 1748068 - RNA, 23 nt, Salmonella enterica enterica serovar Typhi Ty2
ugcgcgccauacuuacugcuguc

SEQ ID NO: 1748069 - RNA, 16 nt, Salmonella enterica enterica serovar Typhi Ty2
ugcgcgcaucgggccg

SEQ ID NO: 1748070 - RNA, 23 nt, Salmonella enterica enterica serovar Typhi Ty2
ugcgcgcuggugucgccguggaa

SEQ ID NO: 1748071 - RNA, 19 nt, Salmonella enterica enterica serovar Typhi Ty2
ugcgcgcgaugcugcucca

SEQ ID NO: 1748072 - RNA, 22 nt, Salmonella enterica enterica serovar Typhi Ty2
ugcgcgcgugaccccaggcaua

SEQ ID NO: 1748073 - RNA, 16 nt, Salmonella enterica enterica serovar Typhi Ty2
ugcgcguaaauuucac

SEQ ID NO: 1748074 - RNA, 22 nt, Salmonella enterica enterica serovar Typhi Ty2
ugcgcguaaacgcaacaccauc

SEQ ID NO: 1748075 - RNA, 14 nt, Salmonella enterica enterica serovar Typhi Ty2
ugcgcguaaauuuc

SEQ ID NO: 1748076 - RNA, 15 nt, Salmonella enterica enterica serovar Typhi Ty2
ugcgcgucccucucc

SEQ ID NO: 1748077 - RNA, 20 nt, Salmonella enterica enterica serovar Typhi Ty2
ugcgcguagcccacagguag

SEQ ID NO: 1748078 - RNA, 17 nt, Salmonella enterica enterica serovar Typhi Ty2
ugcgcgguccacaggcc

SEQ ID NO: 1748079 - RNA, 23 nt, Salmonella enterica enterica serovar Typhi Ty2
ugcgcggcacacuuucaucagcc

SEQ ID NO: 1748080 - RNA, 22 nt, Salmonella enterica enterica serovar Typhi Ty2
ugcgcggcgacgcgaggcuuuu

SEQ ID NO: 1748081 - RNA, 12 nt, Salmonella enterica enterica serovar Typhi Ty2
ugcgccugcuca

SEQ ID NO: 1748082 - RNA, 16 nt, Salmonella enterica enterica serovar Typhi Ty2
ugcgccuaccgacaaa

SEQ ID NO: 1748083 - RNA, 22 nt, Salmonella enterica enterica serovar Typhi Ty2
ugcgccggcugcgcugccagcu

SEQ ID NO: 1748084 - RNA, 15 nt, Salmonella enterica enterica serovar Typhi Ty2
ugcgccgucaggcuu

SEQ ID NO: 1748085 - RNA, 18 nt, Salmonella enterica enterica serovar Typhi Ty2
ugcgccgugccuggcgcu

SEQ ID NO: 1748086 - RNA, 19 nt, Salmonella enterica enterica serovar Typhi Ty2
ugcgccguccugcaaggca

SEQ ID NO: 1748087 - RNA, 18 nt, Salmonella enterica enterica serovar Typhi Ty2
ugcgcgacgacgccagcc

SEQ ID NO: 1748088 - RNA, 22 nt, Salmonella enterica enterica serovar Typhi Ty2
ugcgcgacgacgccagccagcc

SEQ ID NO: 1748089 - RNA, 20 nt, Salmonella enterica enterica serovar Typhi Ty2
ugcgccugucuccagcgccg

SEQ ID NO: 1748090 - RNA, 14 nt, Salmonella enterica enterica serovar Typhi Ty2
ugcgccugucucca

SEQ ID NO: 1748091 - RNA, 23 nt, Salmonella enterica enterica serovar Typhi Ty2
ugcgccuuaucaagccuacaccu

SEQ ID NO: 1748092 - RNA, 18 nt, Salmonella enterica enterica serovar Typhi Ty2
ugcgccuuauccggcgug

SEQ ID NO: 1748093 - RNA, 22 nt, Salmonella enterica enterica serovar Typhi Ty2
ugcgccauauaggcauguuccu

SEQ ID NO: 1748094 - RNA, 22 nt, Salmonella enterica enterica serovar Typhi Ty2
ugcgccauccaccaggcaugca

SEQ ID NO: 1748095 - RNA, 23 nt, Salmonella enterica enterica serovar Typhi Ty2
ugcgccauugccguaucagcaag

SEQ ID NO: 1748096 - RNA, 21 nt, Salmonella enterica enterica serovar Typhi Ty2
ugcgccccagcaugagccagc

SEQ ID NO: 1748097 - RNA, 15 nt, Salmonella enterica enterica serovar Typhi Ty2
ugcgcccaucaucau

SEQ ID NO: 1748098 - RNA, 18 nt, Salmonella enterica enterica serovar Typhi Ty2
ugcgcccaugacaugaaa

SEQ ID NO: 1748099 - RNA, 21 nt, Salmonella enterica enterica serovar Typhi Ty2
ugcgccaucggcgcugauugc

SEQ ID NO: 1748100 - RNA, 14 nt, Salmonella enterica enterica serovar Typhi Ty2
ugcgccgccaggca

SEQ ID NO: 1748101 - RNA, 17 nt, Salmonella enterica enterica serovar Typhi Ty2
ugcgcccuuccgucagc

SEQ ID NO: 1748102 - RNA, 21 nt, Salmonella enterica enterica serovar Typhi Ty2
ugccuuccacggcgaucacuu

SEQ ID NO: 1748103 - RNA, 16 nt, Salmonella enterica enterica serovar Typhi Ty2
ugccuucauccgcacg

SEQ ID NO: 1748104 - RNA, 21 nt, Salmonella enterica enterica serovar Typhi Ty2
ugccuucuguuuuuugccaca

SEQ ID NO: 1748105 - RNA, 18 nt, Salmonella enterica enterica serovar Typhi Ty2
ugccuucucugucgagca

SEQ ID NO: 1748106 - RNA, 11 nt, Salmonella enterica enterica serovar Typhi Ty2
ugcgccacgac

SEQ ID NO: 1748107 - RNA, 12 nt, Salmonella enterica enterica serovar Typhi Ty2
ugcgccagauca

SEQ ID NO: 1748108 - RNA, 20 nt, Salmonella enterica enterica serovar Typhi Ty2
ugcgccagccagcucaccag

SEQ ID NO: 1748109 - RNA, 15 nt, Salmonella enterica enterica serovar Typhi Ty2
ugcgccagccugcug

SEQ ID NO: 1748110 - RNA, 18 nt, Salmonella enterica enterica serovar Typhi Ty2
ugcgccagccugcugguc

SEQ ID NO: 1748111 - RNA, 17 nt, Salmonella enterica enterica serovar Typhi Ty2
ugcgccaggcagcaccu

SEQ ID NO: 1748112 - RNA, 14 nt, Salmonella enterica enterica serovar Typhi Ty2
ugcuuuaauauuca

SEQ ID NO: 1748113 - RNA, 13 nt, Salmonella enterica enterica serovar Typhi Ty2
ugcuuuauaaaaa

SEQ ID NO: 1748114 - RNA, 21 nt, Salmonella enterica enterica serovar Typhi Ty2
ugcuuuggccgguucggccag

SEQ ID NO: 1748115 - RNA, 21 nt, Salmonella enterica enterica serovar Typhi Ty2
ugcuuuuaauagcguagccug

SEQ ID NO: 1748116 - RNA, 12 nt, Salmonella enterica enterica serovar Typhi Ty2
uggaaaaaaaga

SEQ ID NO: 1748117 - RNA, 18 nt, Salmonella enterica enterica serovar Typhi Ty2
ugcuuaucgauaucugcc

SEQ ID NO: 1748118 - RNA, 18 nt, Salmonella enterica enterica serovar Typhi Ty2
ugcuucaacggugcugag

SEQ ID NO: 1748119 - RNA, 17 nt, Salmonella enterica enterica serovar Typhi Ty2
ugcuuaugaucgcccag

SEQ ID NO: 1748120 - RNA, 22 nt, Salmonella enterica enterica serovar Typhi Ty2
ugcuucacguuuuccaggugcu

SEQ ID NO: 1748121 - RNA, 13 nt, Salmonella enterica enterica serovar Typhi Ty2
ugcuucagccaga

SEQ ID NO: 1748122 - RNA, 20 nt, Salmonella enterica enterica serovar Typhi Ty2
ugcuucagacaacgccgccu

SEQ ID NO: 1748123 - RNA, 18 nt, Salmonella enterica enterica serovar Typhi Ty2
ugcuucagguuaagugac

SEQ ID NO: 1748124 - RNA, 14 nt, Salmonella enterica enterica serovar Typhi Ty2
ugcuguucuucccu

SEQ ID NO: 1748125 - RNA, 19 nt, Salmonella enterica enterica serovar Typhi Ty2
ugcuuacggcaaacugaaa

SEQ ID NO: 1748126 - RNA, 21 nt, Salmonella enterica enterica serovar Typhi Ty2
ugcuguuucaguaaaucccgc

SEQ ID NO: 1748127 - RNA, 14 nt, Salmonella enterica enterica serovar Typhi Ty2
ugcuguaaccccug

SEQ ID NO: 1748128 - RNA, 22 nt, Salmonella enterica enterica serovar Typhi Ty2
ugcuguauaaacucagcaauau

SEQ ID NO: 1748129 - RNA, 18 nt, Salmonella enterica enterica serovar Typhi Ty2
ugcuguagcugcccggau

SEQ ID NO: 1748130 - RNA, 19 nt, Salmonella enterica enterica serovar Typhi Ty2
ugcuguagcgucucaucaa

SEQ ID NO: 1748131 - RNA, 14 nt, Salmonella enterica enterica serovar Typhi Ty2
ugcugccucaucaa

SEQ ID NO: 1748132 - RNA, 20 nt, Salmonella enterica enterica serovar Typhi Ty2
ugcugccgcagcacccgcuc

SEQ ID NO: 1748133 - RNA, 22 nt, Salmonella enterica enterica serovar Typhi Ty2
ugcugcuuuaaccuggcgcaca

SEQ ID NO: 1748134 - RNA, 16 nt, Salmonella enterica enterica serovar Typhi Ty2
ugcuggcuuaacucac

SEQ ID NO: 1748135 - RNA, 13 nt, Salmonella enterica enterica serovar Typhi Ty2
ugcuggcugaaau

SEQ ID NO: 1748136 - RNA, 23 nt, Salmonella enterica enterica serovar Typhi Ty2
ugcuggcgcgucacaacagccgg

SEQ ID NO: 1748137 - RNA, 21 nt, Salmonella enterica enterica serovar Typhi Ty2
ugcuggcgcgucacaacagcc

SEQ ID NO: 1748138 - RNA, 22 nt, Salmonella enterica enterica serovar Typhi Ty2
ugcucguaaagcaucagacuac

SEQ ID NO: 1748139 - RNA, 19 nt, Salmonella enterica enterica serovar Typhi Ty2
ugcucguagcguuuaaaga

SEQ ID NO: 1748140 - RNA, 18 nt, Salmonella enterica enterica serovar Typhi Ty2
ugcucgauauauuuuccg

SEQ ID NO: 1748141 - RNA, 14 nt, Salmonella enterica enterica serovar Typhi Ty2
ugcucgacaauaaa

SEQ ID NO: 1748142 - RNA, 23 nt, Salmonella enterica enterica serovar Typhi Ty2
ugcuccggcuuaaugcccggccc

SEQ ID NO: 1748143 - RNA, 11 nt, Salmonella enterica enterica serovar Typhi Ty2
ugcucaaugau

SEQ ID NO: 1748144 - RNA, 21 nt, Salmonella enterica enterica serovar Typhi Ty2
ugcucaugacaucgcccuggg

SEQ ID NO: 1748145 - RNA, 23 nt, Salmonella enterica enterica serovar Typhi Ty2
ugcucaugcgagguauacgccac

SEQ ID NO: 1748146 - RNA, 13 nt, Salmonella enterica enterica serovar Typhi Ty2
ugcucauauugug

SEQ ID NO: 1748147 - RNA, 23 nt, Salmonella enterica enterica serovar Typhi Ty2
ugcucaucgucuuucuccaugcu

SEQ ID NO: 1748148 - RNA, 17 nt, Salmonella enterica enterica serovar Typhi Ty2
ugcucaacuuccagagc

SEQ ID NO: 1748149 - RNA, 17 nt, Salmonella enterica enterica serovar Typhi Ty2
ugcucaaccaugauaac

SEQ ID NO: 1748150 - RNA, 12 nt, Salmonella enterica enterica serovar Typhi Ty2
ugcucaauaagc

SEQ ID NO: 1748151 - RNA, 13 nt, Salmonella enterica enterica serovar Typhi Ty2
ugcucaauauuau

SEQ ID NO: 1748152 - RNA, 18 nt, Salmonella enterica enterica serovar Typhi Ty2
ugcucaauaagccaugug

SEQ ID NO: 1748153 - RNA, 15 nt, Salmonella enterica enterica serovar Typhi Ty2
ugcugccauuuuauc

SEQ ID NO: 1748154 - RNA, 16 nt, Salmonella enterica enterica serovar Typhi Ty2
ugcugcacgucgcgcu

SEQ ID NO: 1748155 - RNA, 17 nt, Salmonella enterica enterica serovar Typhi Ty2
ugcugauggccuuugug

SEQ ID NO: 1748156 - RNA, 13 nt, Salmonella enterica enterica serovar Typhi Ty2
ugcugaugcugua

SEQ ID NO: 1748157 - RNA, 23 nt, Salmonella enterica enterica serovar Typhi Ty2
ugcugaucgugauaggccagacg

SEQ ID NO: 1748158 - RNA, 15 nt, Salmonella enterica enterica serovar Typhi Ty2
ugcugauaauacugc

SEQ ID NO: 1748159 - RNA, 18 nt, Salmonella enterica enterica serovar Typhi Ty2
ugcugcaaauugauacca

SEQ ID NO: 1748160 - RNA, 20 nt, Salmonella enterica enterica serovar Typhi Ty2
ugcugaaaugauaagugaua

SEQ ID NO: 1748161 - RNA, 21 nt, Salmonella enterica enterica serovar Typhi Ty2
ugcugaaaaucgucucucauc

SEQ ID NO: 1748162 - RNA, 20 nt, Salmonella enterica enterica serovar Typhi Ty2
ugcugaagcagauacugcgc

SEQ ID NO: 1748163 - RNA, 21 nt, Salmonella enterica enterica serovar Typhi Ty2
ugcugaacacaaugaauccuc

SEQ ID NO: 1748164 - RNA, 16 nt, Salmonella enterica enterica serovar Typhi Ty2
ugcugaagauaaaauu

SEQ ID NO: 1748165 - RNA, 18 nt, Salmonella enterica enterica serovar Typhi Ty2
ugcugacggagcuggcac

SEQ ID NO: 1748166 - RNA, 19 nt, Salmonella enterica enterica serovar Typhi Ty2
ugcugacguagauucugau

SEQ ID NO: 1748167 - RNA, 11 nt, Salmonella enterica enterica serovar Typhi Ty2
ugaauaaaaua

SEQ ID NO: 1748168 - RNA, 15 nt, Salmonella enterica enterica serovar Typhi Ty2
ugaagucgaaauuuu

SEQ ID NO: 1748169 - RNA, 22 nt, Salmonella enterica enterica serovar Typhi Ty2
ugaagugugcaaacgauaaaag

SEQ ID NO: 1748170 - RNA, 13 nt, Salmonella enterica enterica serovar Typhi Ty2
ugaauauuuugcu

SEQ ID NO: 1748171 - RNA, 14 nt, Salmonella enterica enterica serovar Typhi Ty2
ugaauaaaggguuu

SEQ ID NO: 1748172 - RNA, 16 nt, Salmonella enterica enterica serovar Typhi Ty2
ugaauaaccauacuga

SEQ ID NO: 1748173 - RNA, 21 nt, Salmonella enterica enterica serovar Typhi Ty2
ugaauaaucgucgugguuuaa

SEQ ID NO: 1748174 - RNA, 22 nt, Salmonella enterica enterica serovar Typhi Ty2
ugaauuuuagauccccaaacug

SEQ ID NO: 1748175 - RNA, 14 nt, Salmonella enterica enterica serovar Typhi Ty2
ugaauuucucgcca

SEQ ID NO: 1748176 - RNA, 20 nt, Salmonella enterica enterica serovar Typhi Ty2
ugaauuugcugcauuucuug

SEQ ID NO: 1748177 - RNA, 15 nt, Salmonella enterica enterica serovar Typhi Ty2
ugaauuuuauuagua

SEQ ID NO: 1748178 - RNA, 13 nt, Salmonella enterica enterica serovar Typhi Ty2
ugacaauacugca

SEQ ID NO: 1748179 - RNA, 17 nt, Salmonella enterica enterica serovar Typhi Ty2
ugacaaucagcacacua

SEQ ID NO: 1748180 - RNA, 16 nt, Salmonella enterica enterica serovar Typhi Ty2
ugacaaucucaauacc

SEQ ID NO: 1748181 - RNA, 23 nt, Salmonella enterica enterica serovar Typhi Ty2
ugacaauauugccauaaauacaa

SEQ ID NO: 1748182 - RNA, 24 nt, Salmonella enterica enterica serovar Typhi Ty2
ugaaucaucagaaucguccagauu

SEQ ID NO: 1748183 - RNA, 22 nt, Salmonella enterica enterica serovar Typhi Ty2
ugaaucaucgguaaaugcuuau

SEQ ID NO: 1748184 - RNA, 22 nt, Salmonella enterica enterica serovar Typhi Ty2
ugaauccauacgguuguugauu

SEQ ID NO: 1748185 - RNA, 17 nt, Salmonella enterica enterica serovar Typhi Ty2
ugaaucccccugccaca

SEQ ID NO: 1748186 - RNA, 21 nt, Salmonella enterica enterica serovar Typhi Ty2
ugaaucagauacggcuccagc

SEQ ID NO: 1748187 - RNA, 21 nt, Salmonella enterica enterica serovar Typhi Ty2
ugaaugcucucauauuccagc

SEQ ID NO: 1748188 - RNA, 18 nt, Salmonella enterica enterica serovar Typhi Ty2
ugaaugcccuuuuccaga

SEQ ID NO: 1748189 - RNA, 22 nt, Salmonella enterica enterica serovar Typhi Ty2
ugaaugccccagcgcugcugua

SEQ ID NO: 1748190 - RNA, 15 nt, Salmonella enterica enterica serovar Typhi Ty2
ugaaucccuguucaa

SEQ ID NO: 1748191 - RNA, 17 nt, Salmonella enterica enterica serovar Typhi Ty2
ugaagauuuuuauuccc

SEQ ID NO: 1748192 - RNA, 20 nt, Salmonella enterica enterica serovar Typhi Ty2
ugaagauuuuuauucccgcc

SEQ ID NO: 1748193 - RNA, 15 nt, Salmonella enterica enterica serovar Typhi Ty2
ugaagauguagacca

SEQ ID NO: 1748194 - RNA, 19 nt, Salmonella enterica enterica serovar Typhi Ty2
ugaagaguauuauuuugau

SEQ ID NO: 1748195 - RNA, 18 nt, Salmonella enterica enterica serovar Typhi Ty2
ugaagauaaacagcagcg

SEQ ID NO: 1748196 - RNA, 22 nt, Salmonella enterica enterica serovar Typhi Ty2
ugaagccuggucaccugucuuu

SEQ ID NO: 1748197 - RNA, 20 nt, Salmonella enterica enterica serovar Typhi Ty2
ugaagccuuagcgggaggug

SEQ ID NO: 1748198 - RNA, 17 nt, Salmonella enterica enterica serovar Typhi Ty2
ugaagcgcguucguccc

SEQ ID NO: 1748199 - RNA, 19 nt, Salmonella enterica enterica serovar Typhi Ty2
ugaaguaauucuucgaaug

SEQ ID NO: 1748200 - RNA, 15 nt, Salmonella enterica enterica serovar Typhi Ty2
ugaagguuuuucccg

SEQ ID NO: 1748201 - RNA, 17 nt, Salmonella enterica enterica serovar Typhi Ty2
ugaaggcguaugaauga

SEQ ID NO: 1748202 - RNA, 21 nt, Salmonella enterica enterica serovar Typhi Ty2
ugaagggcggcuggauaaaag

SEQ ID NO: 1748203 - RNA, 16 nt, Salmonella enterica enterica serovar Typhi Ty2
ugaaggcgccgcgcag

SEQ ID NO: 1748204 - RNA, 17 nt, Salmonella enterica enterica serovar Typhi Ty2
ugaaggcaaaacaccau

SEQ ID NO: 1748205 - RNA, 19 nt, Salmonella enterica enterica serovar Typhi Ty2
ugaaggccaaguuuagaaa

SEQ ID NO: 1748206 - RNA, 23 nt, Salmonella enterica enterica serovar Typhi Ty2
ugaaggagcaaugagauccacug

SEQ ID NO: 1748207 - RNA, 18 nt, Salmonella enterica enterica serovar Typhi Ty2
ugaagcugccgucccagc

SEQ ID NO: 1748208 - RNA, 13 nt, Salmonella enterica enterica serovar Typhi Ty2
ugaagcugcaggg

SEQ ID NO: 1748209 - RNA, 18 nt, Salmonella enterica enterica serovar Typhi Ty2
ugaacuuccguaaaaaga

SEQ ID NO: 1748210 - RNA, 19 nt, Salmonella enterica enterica serovar Typhi Ty2
ugaagacgacgggaaaaag

SEQ ID NO: 1748211 - RNA, 17 nt, Salmonella enterica enterica serovar Typhi Ty2
ugaagaguuugaucaug

SEQ ID NO: 1748212 - RNA, 18 nt, Salmonella enterica enterica serovar Typhi Ty2
ugaacggcucaaaauaau

SEQ ID NO: 1748213 - RNA, 19 nt, Salmonella enterica enterica serovar Typhi Ty2
ugaacgcugcuguuaaccu

SEQ ID NO: 1748214 - RNA, 14 nt, Salmonella enterica enterica serovar Typhi Ty2
ugaacguaguuagu

SEQ ID NO: 1748215 - RNA, 22 nt, Salmonella enterica enterica serovar Typhi Ty2
ugaacuacggcccuggcucaau

SEQ ID NO: 1748216 - RNA, 24 nt, Salmonella enterica enterica serovar Typhi Ty2
ugaacuacccuucaaggagaaaau

SEQ ID NO: 1748217 - RNA, 20 nt, Salmonella enterica enterica serovar Typhi Ty2
ugacgcgucauaaugcccag

SEQ ID NO: 1748218 - RNA, 18 nt, Salmonella enterica enterica serovar Typhi Ty2
ugacgggaaaucucccug

SEQ ID NO: 1748219 - RNA, 21 nt, Salmonella enterica enterica serovar Typhi Ty2
ugacggcggaagaggcgccug

SEQ ID NO: 1748220 - RNA, 15 nt, Salmonella enterica enterica serovar Typhi Ty2
ugacgcgucauaaug

SEQ ID NO: 1748221 - RNA, 11 nt, Salmonella enterica enterica serovar Typhi Ty2
ugacgccgcca

SEQ ID NO: 1748222 - RNA, 20 nt, Salmonella enterica enterica serovar Typhi Ty2
ugacgcgauauuacuccagc

SEQ ID NO: 1748223 - RNA, 20 nt, Salmonella enterica enterica serovar Typhi Ty2
ugacgccaguucccacagcu

SEQ ID NO: 1748224 - RNA, 21 nt, Salmonella enterica enterica serovar Typhi Ty2
ugacgccaguucccacagcuu

SEQ ID NO: 1748225 - RNA, 20 nt, Salmonella enterica enterica serovar Typhi Ty2
ugacgccccauguggccagc

SEQ ID NO: 1748226 - RNA, 13 nt, Salmonella enterica enterica serovar Typhi Ty2
ugacgcagcaguu

SEQ ID NO: 1748227 - RNA, 16 nt, Salmonella enterica enterica serovar Typhi Ty2
ugacgcagcaucucaa

SEQ ID NO: 1748228 - RNA, 18 nt, Salmonella enterica enterica serovar Typhi Ty2
ugacgauguucgucccug

SEQ ID NO: 1748229 - RNA, 17 nt, Salmonella enterica enterica serovar Typhi Ty2
ugaccugggcgccagag

SEQ ID NO: 1748230 - RNA, 18 nt, Salmonella enterica enterica serovar Typhi Ty2
ugaccugcagcuccgcaa

SEQ ID NO: 1748231 - RNA, 14 nt, Salmonella enterica enterica serovar Typhi Ty2
ugaccgccgcgcgu

SEQ ID NO: 1748232 - RNA, 21 nt, Salmonella enterica enterica serovar Typhi Ty2
ugaccgccgcgcgucagcacg

SEQ ID NO: 1748233 - RNA, 14 nt, Salmonella enterica enterica serovar Typhi Ty2
ugacgaccacagcc

SEQ ID NO: 1748234 - RNA, 16 nt, Salmonella enterica enterica serovar Typhi Ty2
ugacgaauagcgcgcu

SEQ ID NO: 1748235 - RNA, 20 nt, Salmonella enterica enterica serovar Typhi Ty2
ugacgaaaaccguccacauc

SEQ ID NO: 1748236 - RNA, 18 nt, Salmonella enterica enterica serovar Typhi Ty2
ugacaucccccucuugcc

SEQ ID NO: 1748237 - RNA, 18 nt, Salmonella enterica enterica serovar Typhi Ty2
ugacaucgcaaugccacc

SEQ ID NO: 1748238 - RNA, 12 nt, Salmonella enterica enterica serovar Typhi Ty2
ugacaaucugcu

SEQ ID NO: 1748239 - RNA, 15 nt, Salmonella enterica enterica serovar Typhi Ty2
ugacauuauucaccu

SEQ ID NO: 1748240 - RNA, 19 nt, Salmonella enterica enterica serovar Typhi Ty2
ugacauucugacggcccuu

SEQ ID NO: 1748241 - RNA, 20 nt, Salmonella enterica enterica serovar Typhi Ty2
ugaccaacaucauuauuccc

SEQ ID NO: 1748242 - RNA, 19 nt, Salmonella enterica enterica serovar Typhi Ty2
ugaccaacaucauuauucc

SEQ ID NO: 1748243 - RNA, 21 nt, Salmonella enterica enterica serovar Typhi Ty2
ugaccaacaucauuauucccc

SEQ ID NO: 1748244 - RNA, 18 nt, Salmonella enterica enterica serovar Typhi Ty2
ugaccaacgucagcaucu

SEQ ID NO: 1748245 - RNA, 12 nt, Salmonella enterica enterica serovar Typhi Ty2
ugaccagcgccc

SEQ ID NO: 1748246 - RNA, 19 nt, Salmonella enterica enterica serovar Typhi Ty2
ugaccaggucgccagcggg

SEQ ID NO: 1748247 - RNA, 16 nt, Salmonella enterica enterica serovar Typhi Ty2
ugaccgcacagcagac

SEQ ID NO: 1748248 - RNA, 16 nt, Salmonella enterica enterica serovar Typhi Ty2
ugaccgaucacggcuu

SEQ ID NO: 1748249 - RNA, 14 nt, Salmonella enterica enterica serovar Typhi Ty2
ugaccgaggaaauc

SEQ ID NO: 1748250 - RNA, 22 nt, Salmonella enterica enterica serovar Typhi Ty2
ugagagucgauacucacgacuu

SEQ ID NO: 1748251 - RNA, 19 nt, Salmonella enterica enterica serovar Typhi Ty2
ugagagcacguaggccuga

SEQ ID NO: 1748252 - RNA, 22 nt, Salmonella enterica enterica serovar Typhi Ty2
ugagagaacguugccgcaggca

SEQ ID NO: 1748253 - RNA, 19 nt, Salmonella enterica enterica serovar Typhi Ty2
ugagaauuuccaguucaau

SEQ ID NO: 1748254 - RNA, 13 nt, Salmonella enterica enterica serovar Typhi Ty2
ugagaccauccug

SEQ ID NO: 1748255 - RNA, 18 nt, Salmonella enterica enterica serovar Typhi Ty2
ugagaaauuauuuuaaau

SEQ ID NO: 1748256 - RNA, 20 nt, Salmonella enterica enterica serovar Typhi Ty2
ugacuucugcucgguaaaaa

SEQ ID NO: 1748257 - RNA, 23 nt, Salmonella enterica enterica serovar Typhi Ty2
ugagaaaauuacgcccaucagcc

SEQ ID NO: 1748258 - RNA, 16 nt, Salmonella enterica enterica serovar Typhi Ty2
ugacuucacacugugg

SEQ ID NO: 1748259 - RNA, 19 nt, Salmonella enterica enterica serovar Typhi Ty2
ugacuaucuggauacgaua

SEQ ID NO: 1748260 - RNA, 15 nt, Salmonella enterica enterica serovar Typhi Ty2
ugacuauccacagcg

SEQ ID NO: 1748261 - RNA, 15 nt, Salmonella enterica enterica serovar Typhi Ty2
ugacuaaaucagcau

SEQ ID NO: 1748262 - RNA, 15 nt, Salmonella enterica enterica serovar Typhi Ty2
ugacuacgucagaug

SEQ ID NO: 1748263 - RNA, 17 nt, Salmonella enterica enterica serovar Typhi Ty2
ugacugaucgauccacu

SEQ ID NO: 1748264 - RNA, 14 nt, Salmonella enterica enterica serovar Typhi Ty2
ugacuuacaggcug

SEQ ID NO: 1748265 - RNA, 16 nt, Salmonella enterica enterica serovar Typhi Ty2
ugacugaauuaucagg

SEQ ID NO: 1748266 - RNA, 15 nt, Salmonella enterica enterica serovar Typhi Ty2
ugacugaacucauca

SEQ ID NO: 1748267 - RNA, 12 nt, Salmonella enterica enterica serovar Typhi Ty2
ugacucugccuc

SEQ ID NO: 1748268 - RNA, 16 nt, Salmonella enterica enterica serovar Typhi Ty2
ugacucuguggccgcg

SEQ ID NO: 1748269 - RNA, 15 nt, Salmonella enterica enterica serovar Typhi Ty2
ugacuaaaagacgcc

SEQ ID NO: 1748270 - RNA, 22 nt, Salmonella enterica enterica serovar Typhi Ty2
ugacguacaaacaguuuuuccu

SEQ ID NO: 1748271 - RNA, 18 nt, Salmonella enterica enterica serovar Typhi Ty2
ugacguagauucugauug

SEQ ID NO: 1748272 - RNA, 20 nt, Salmonella enterica enterica serovar Typhi Ty2
ugacggggggaauguuuggc

SEQ ID NO: 1748273 - RNA, 19 nt, Salmonella enterica enterica serovar Typhi Ty2
ugacggggggaauguuugg

SEQ ID NO: 1748274 - RNA, 22 nt, Salmonella enterica enterica serovar Typhi Ty2
ugacgguauucccggucaagcg

SEQ ID NO: 1748275 - RNA, 15 nt, Salmonella enterica enterica serovar Typhi Ty2
ugacgguuuauaugc

SEQ ID NO: 1748276 - RNA, 21 nt, Salmonella enterica enterica serovar Typhi Ty2
ugcaacagaagaguuaacuuc

SEQ ID NO: 1748277 - RNA, 23 nt, Salmonella enterica enterica serovar Typhi Ty2
ugcaacgaucccuaauaaaauaa

SEQ ID NO: 1748278 - RNA, 21 nt, Salmonella enterica enterica serovar Typhi Ty2
ugcaacgaucccuaauaaaau

SEQ ID NO: 1748279 - RNA, 18 nt, Salmonella enterica enterica serovar Typhi Ty2
ugcaacgccgaugcuuuu

SEQ ID NO: 1748280 - RNA, 19 nt, Salmonella enterica enterica serovar Typhi Ty2
ugcaacauugcaggucugg

SEQ ID NO: 1748281 - RNA, 20 nt, Salmonella enterica enterica serovar Typhi Ty2
ugcaacauugcaggucugga

SEQ ID NO: 1748282 - RNA, 14 nt, Salmonella enterica enterica serovar Typhi Ty2
ugcaaccccuugcg

SEQ ID NO: 1748283 - RNA, 15 nt, Salmonella enterica enterica serovar Typhi Ty2
ugcaacauuccuugc

SEQ ID NO: 1748284 - RNA, 20 nt, Salmonella enterica enterica serovar Typhi Ty2
ugcaaucagcgaaggcaacu

SEQ ID NO: 1748285 - RNA, 15 nt, Salmonella enterica enterica serovar Typhi Ty2
ugcaauguucaauau

SEQ ID NO: 1748286 - RNA, 21 nt, Salmonella enterica enterica serovar Typhi Ty2
ugcaauguucaauaucaaauu

SEQ ID NO: 1748287 - RNA, 22 nt, Salmonella enterica enterica serovar Typhi Ty2
ugcaauguucaauaucaaauug

SEQ ID NO: 1748288 - RNA, 18 nt, Salmonella enterica enterica serovar Typhi Ty2
ugcaauaucccucgaagu

SEQ ID NO: 1748289 - RNA, 17 nt, Salmonella enterica enterica serovar Typhi Ty2
ugcaagaacgggcugcg

SEQ ID NO: 1748290 - RNA, 13 nt, Salmonella enterica enterica serovar Typhi Ty2
ugcaagagaaaua

SEQ ID NO: 1748291 - RNA, 17 nt, Salmonella enterica enterica serovar Typhi Ty2
ugcacccggagagaaac

SEQ ID NO: 1748292 - RNA, 16 nt, Salmonella enterica enterica serovar Typhi Ty2
ugcacccgccuuaccc

SEQ ID NO: 1748293 - RNA, 20 nt, Salmonella enterica enterica serovar Typhi Ty2
ugcaccaggugaaugaggug

SEQ ID NO: 1748294 - RNA, 17 nt, Salmonella enterica enterica serovar Typhi Ty2
ugcaccacuuuguuuuu

SEQ ID NO: 1748295 - RNA, 16 nt, Salmonella enterica enterica serovar Typhi Ty2
ugcaccagaacucccu

SEQ ID NO: 1748296 - RNA, 20 nt, Salmonella enterica enterica serovar Typhi Ty2
ugcaauuccggcgaaaaacc

SEQ ID NO: 1748297 - RNA, 19 nt, Salmonella enterica enterica serovar Typhi Ty2
ugcaauuccggcgaaaaac

SEQ ID NO: 1748298 - RNA, 17 nt, Salmonella enterica enterica serovar Typhi Ty2
ugcaauuccggcgaaaa

SEQ ID NO: 1748299 - RNA, 16 nt, Salmonella enterica enterica serovar Typhi Ty2
ugcacgcgauuugcag

SEQ ID NO: 1748300 - RNA, 21 nt, Salmonella enterica enterica serovar Typhi Ty2
ugcacgccaggguaauacugg

SEQ ID NO: 1748301 - RNA, 11 nt, Salmonella enterica enterica serovar Typhi Ty2
ugcacgcuguu

SEQ ID NO: 1748302 - RNA, 18 nt, Salmonella enterica enterica serovar Typhi Ty2
ugcaccucagaccguuag

SEQ ID NO: 1748303 - RNA, 13 nt, Salmonella enterica enterica serovar Typhi Ty2
ugauuaaagccac

SEQ ID NO: 1748304 - RNA, 16 nt, Salmonella enterica enterica serovar Typhi Ty2
ugauuaaaauaaauga

SEQ ID NO: 1748305 - RNA, 19 nt, Salmonella enterica enterica serovar Typhi Ty2
ugaugcgccugucuccagc

SEQ ID NO: 1748306 - RNA, 18 nt, Salmonella enterica enterica serovar Typhi Ty2
ugaugcgccugucuccag

SEQ ID NO: 1748307 - RNA, 18 nt, Salmonella enterica enterica serovar Typhi Ty2
ugaugcgccccgcuuccc

SEQ ID NO: 1748308 - RNA, 14 nt, Salmonella enterica enterica serovar Typhi Ty2
ugauuacggaacaa

SEQ ID NO: 1748309 - RNA, 18 nt, Salmonella enterica enterica serovar Typhi Ty2
ugauuaaugauuugcuuu

SEQ ID NO: 1748310 - RNA, 12 nt, Salmonella enterica enterica serovar Typhi Ty2
ugauuacaaaau

SEQ ID NO: 1748311 - RNA, 15 nt, Salmonella enterica enterica serovar Typhi Ty2
ugauuacaaaaugug

SEQ ID NO: 1748312 - RNA, 13 nt, Salmonella enterica enterica serovar Typhi Ty2
ugauugauuuugu

SEQ ID NO: 1748313 - RNA, 15 nt, Salmonella enterica enterica serovar Typhi Ty2
ugauuuauuuugaau

SEQ ID NO: 1748314 - RNA, 23 nt, Salmonella enterica enterica serovar Typhi Ty2
ugauuggcaagaauuauuucagg

SEQ ID NO: 1748315 - RNA, 17 nt, Salmonella enterica enterica serovar Typhi Ty2
ugauuuacuccaaaaau

SEQ ID NO: 1748316 - RNA, 14 nt, Salmonella enterica enterica serovar Typhi Ty2
ugcaaauauucgcc

SEQ ID NO: 1748317 - RNA, 14 nt, Salmonella enterica enterica serovar Typhi Ty2
ugcaaaucaccaca

SEQ ID NO: 1748318 - RNA, 15 nt, Salmonella enterica enterica serovar Typhi Ty2
ugcaaauacugcuuu

SEQ ID NO: 1748319 - RNA, 11 nt, Salmonella enterica enterica serovar Typhi Ty2
ugcaaauacca

SEQ ID NO: 1748320 - RNA, 23 nt, Salmonella enterica enterica serovar Typhi Ty2
ugauuuuuaccgccgguuuaucc

SEQ ID NO: 1748321 - RNA, 13 nt, Salmonella enterica enterica serovar Typhi Ty2
ugcaaaagaaaaa

SEQ ID NO: 1748322 - RNA, 22 nt, Salmonella enterica enterica serovar Typhi Ty2
ugaucugcgccggcugcgcugc

SEQ ID NO: 1748323 - RNA, 20 nt, Salmonella enterica enterica serovar Typhi Ty2
ugaucuggccaauuuuucac

SEQ ID NO: 1748324 - RNA, 15 nt, Salmonella enterica enterica serovar Typhi Ty2
ugaucguuucauuuu

SEQ ID NO: 1748325 - RNA, 14 nt, Salmonella enterica enterica serovar Typhi Ty2
ugaucggguuuucc

SEQ ID NO: 1748326 - RNA, 15 nt, Salmonella enterica enterica serovar Typhi Ty2
ugaucauacugccgc

SEQ ID NO: 1748327 - RNA, 14 nt, Salmonella enterica enterica serovar Typhi Ty2
ugaucauacugccg

SEQ ID NO: 1748328 - RNA, 13 nt, Salmonella enterica enterica serovar Typhi Ty2
ugaugaugccagg

SEQ ID NO: 1748329 - RNA, 21 nt, Salmonella enterica enterica serovar Typhi Ty2
ugaugaugcguuuguuggaga

SEQ ID NO: 1748330 - RNA, 17 nt, Salmonella enterica enterica serovar Typhi Ty2
ugaugaugaagcugcag

SEQ ID NO: 1748331 - RNA, 15 nt, Salmonella enterica enterica serovar Typhi Ty2
ugaugauagcgccau

SEQ ID NO: 1748332 - RNA, 18 nt, Salmonella enterica enterica serovar Typhi Ty2
ugaucuucaaccucuaua

SEQ ID NO: 1748333 - RNA, 12 nt, Salmonella enterica enterica serovar Typhi Ty2
ugaucuuucugg

SEQ ID NO: 1748334 - RNA, 18 nt, Salmonella enterica enterica serovar Typhi Ty2
ugaugagaugcaggccaa

SEQ ID NO: 1748335 - RNA, 23 nt, Salmonella enterica enterica serovar Typhi Ty2
ugauagagguuaccgggcuaaac

SEQ ID NO: 1748336 - RNA, 16 nt, Salmonella enterica enterica serovar Typhi Ty2
ugauagacguaaugau

SEQ ID NO: 1748337 - RNA, 14 nt, Salmonella enterica enterica serovar Typhi Ty2
ugauacucaucaua

SEQ ID NO: 1748338 - RNA, 18 nt, Salmonella enterica enterica serovar Typhi Ty2
ugauagcgaggcagcagg

SEQ ID NO: 1748339 - RNA, 15 nt, Salmonella enterica enterica serovar Typhi Ty2
ugauagcgaggcagc

SEQ ID NO: 1748340 - RNA, 18 nt, Salmonella enterica enterica serovar Typhi Ty2
ugauagccguucuccagc

SEQ ID NO: 1748341 - RNA, 20 nt, Salmonella enterica enterica serovar Typhi Ty2
ugauagcaggcacuguggug

SEQ ID NO: 1748342 - RNA, 18 nt, Salmonella enterica enterica serovar Typhi Ty2
ugauaguuuaaauccagc

SEQ ID NO: 1748343 - RNA, 13 nt, Salmonella enterica enterica serovar Typhi Ty2
ugauaguccauca

SEQ ID NO: 1748344 - RNA, 14 nt, Salmonella enterica enterica serovar Typhi Ty2
ugauagggcagcag

SEQ ID NO: 1748345 - RNA, 13 nt, Salmonella enterica enterica serovar Typhi Ty2
ugauagggcagca

SEQ ID NO: 1748346 - RNA, 20 nt, Salmonella enterica enterica serovar Typhi Ty2
ugauaggccagcuacaccug

SEQ ID NO: 1748347 - RNA, 21 nt, Salmonella enterica enterica serovar Typhi Ty2
ugauaucggccggaugccagu

SEQ ID NO: 1748348 - RNA, 19 nt, Salmonella enterica enterica serovar Typhi Ty2
ugauaugcucgacaauaaa

SEQ ID NO: 1748349 - RNA, 15 nt, Salmonella enterica enterica serovar Typhi Ty2
ugauaugcaguucau

SEQ ID NO: 1748350 - RNA, 20 nt, Salmonella enterica enterica serovar Typhi Ty2
ugauaugcaguucaucaucc

SEQ ID NO: 1748351 - RNA, 23 nt, Salmonella enterica enterica serovar Typhi Ty2
ugauauuacuaauaaaauucacu

SEQ ID NO: 1748352 - RNA, 17 nt, Salmonella enterica enterica serovar Typhi Ty2
ugauauggaaagugguu

SEQ ID NO: 1748353 - RNA, 18 nt, Salmonella enterica enterica serovar Typhi Ty2
ugaucaaucaacucuuua

SEQ ID NO: 1748354 - RNA, 23 nt, Salmonella enterica enterica serovar Typhi Ty2
ugaucaauuugccuuuauucauu

SEQ ID NO: 1748355 - RNA, 20 nt, Salmonella enterica enterica serovar Typhi Ty2
ugaucaggaaaucuuccagu

SEQ ID NO: 1748356 - RNA, 20 nt, Salmonella enterica enterica serovar Typhi Ty2
ugauaaaauaaacacuaaau

SEQ ID NO: 1748357 - RNA, 15 nt, Salmonella enterica enterica serovar Typhi Ty2
ugauaaauacgcugc

SEQ ID NO: 1748358 - RNA, 18 nt, Salmonella enterica enterica serovar Typhi Ty2
ugauaaaucgucggcagg

SEQ ID NO: 1748359 - RNA, 11 nt, Salmonella enterica enterica serovar Typhi Ty2
ugauaaauauc

SEQ ID NO: 1748360 - RNA, 22 nt, Salmonella enterica enterica serovar Typhi Ty2
ugaguuuuaacgaaggauuuau

SEQ ID NO: 1748361 - RNA, 17 nt, Salmonella enterica enterica serovar Typhi Ty2
ugaguuugacugccaga

SEQ ID NO: 1748362 - RNA, 15 nt, Salmonella enterica enterica serovar Typhi Ty2
ugaguuaacgacugc

SEQ ID NO: 1748363 - RNA, 16 nt, Salmonella enterica enterica serovar Typhi Ty2
ugaguccccgggagca

SEQ ID NO: 1748364 - RNA, 15 nt, Salmonella enterica enterica serovar Typhi Ty2
ugagucauccuuccc

SEQ ID NO: 1748365 - RNA, 16 nt, Salmonella enterica enterica serovar Typhi Ty2
ugagucauccuucccc

SEQ ID NO: 1748366 - RNA, 20 nt, Salmonella enterica enterica serovar Typhi Ty2
ugagcaucaaacuuuuaaau

SEQ ID NO: 1748367 - RNA, 16 nt, Salmonella enterica enterica serovar Typhi Ty2
ugauaccuauuuaaua

SEQ ID NO: 1748368 - RNA, 19 nt, Salmonella enterica enterica serovar Typhi Ty2
ugauacgggaagucauuag

SEQ ID NO: 1748369 - RNA, 21 nt, Salmonella enterica enterica serovar Typhi Ty2
ugauacggcgugaucacuccc

SEQ ID NO: 1748370 - RNA, 19 nt, Salmonella enterica enterica serovar Typhi Ty2
ugauacgcggcugaugcag

SEQ ID NO: 1748371 - RNA, 17 nt, Salmonella enterica enterica serovar Typhi Ty2
ugauaccuauuuaauaa

SEQ ID NO: 1748372 - RNA, 14 nt, Salmonella enterica enterica serovar Typhi Ty2
ugauaccuauuuaa

SEQ ID NO: 1748373 - RNA, 17 nt, Salmonella enterica enterica serovar Typhi Ty2
ugauaaugucaacuuaa

SEQ ID NO: 1748374 - RNA, 22 nt, Salmonella enterica enterica serovar Typhi Ty2
ugauacagaaaaccggcaaaua

SEQ ID NO: 1748375 - RNA, 18 nt, Salmonella enterica enterica serovar Typhi Ty2
ugauaauuguuaauuauu

SEQ ID NO: 1748376 - RNA, 12 nt, Salmonella enterica enterica serovar Typhi Ty2
ugauaaucagcg

SEQ ID NO: 1748377 - RNA, 13 nt, Salmonella enterica enterica serovar Typhi Ty2
ugauaauaugcuc

SEQ ID NO: 1748378 - RNA, 12 nt, Salmonella enterica enterica serovar Typhi Ty2
ugauaauacugc

SEQ ID NO: 1748379 - RNA, 21 nt, Salmonella enterica enterica serovar Typhi Ty2
ugauaauaauuguaggcagga

SEQ ID NO: 1748380 - RNA, 13 nt, Salmonella enterica enterica serovar Typhi Ty2
ugauaagcgcagc

SEQ ID NO: 1748381 - RNA, 18 nt, Salmonella enterica enterica serovar Typhi Ty2
ugauaagcauagcgccau

SEQ ID NO: 1748382 - RNA, 21 nt, Salmonella enterica enterica serovar Typhi Ty2
ugauaagcauagcgccaucag

SEQ ID NO: 1748383 - RNA, 18 nt, Salmonella enterica enterica serovar Typhi Ty2
ugauaagcgcagcgccau

SEQ ID NO: 1748384 - RNA, 21 nt, Salmonella enterica enterica serovar Typhi Ty2
ugauaagcguagcgccaucag

SEQ ID NO: 1748385 - RNA, 18 nt, Salmonella enterica enterica serovar Typhi Ty2
ugauaagcuaguaaagaa

SEQ ID NO: 1748386 - RNA, 16 nt, Salmonella enterica enterica serovar Typhi Ty2
ugauaaauguuuacuu

SEQ ID NO: 1748387 - RNA, 20 nt, Salmonella enterica enterica serovar Typhi Ty2
ucgccauccggcaaauccuc

SEQ ID NO: 1748388 - RNA, 15 nt, Salmonella enterica enterica serovar Typhi Ty2
ucgccaugucaaaug

SEQ ID NO: 1748389 - RNA, 21 nt, Salmonella enterica enterica serovar Typhi Ty2
ucgccaauaauuaguuuuacc

SEQ ID NO: 1748390 - RNA, 16 nt, Salmonella enterica enterica serovar Typhi Ty2
ucgccaauuaaauauc

SEQ ID NO: 1748391 - RNA, 13 nt, Salmonella enterica enterica serovar Typhi Ty2
ucgccaucaccag

SEQ ID NO: 1748392 - RNA, 21 nt, Salmonella enterica enterica serovar Typhi Ty2
ucgccaaauuuagugcucagc

SEQ ID NO: 1748393 - RNA, 20 nt, Salmonella enterica enterica serovar Typhi Ty2
ucgccaaagucauugcugcc

SEQ ID NO: 1748394 - RNA, 15 nt, Salmonella enterica enterica serovar Typhi Ty2
ucgccaaagauauag

SEQ ID NO: 1748395 - RNA, 22 nt, Salmonella enterica enterica serovar Typhi Ty2
ucgccaaagcagcggaaaauau

SEQ ID NO: 1748396 - RNA, 14 nt, Salmonella enterica enterica serovar Typhi Ty2
ucgccaaagcagcu

SEQ ID NO: 1748397 - RNA, 18 nt, Salmonella enterica enterica serovar Typhi Ty2
ucgccaaagcagcugcug

SEQ ID NO: 1748398 - RNA, 15 nt, Salmonella enterica enterica serovar Typhi Ty2
ucgccaaagcgcugc

SEQ ID NO: 1748399 - RNA, 21 nt, Salmonella enterica enterica serovar Typhi Ty2
ucgcaguuaugcgcaucaccg

SEQ ID NO: 1748400 - RNA, 21 nt, Salmonella enterica enterica serovar Typhi Ty2
ucgccccguaaaccaauacgc

SEQ ID NO: 1748401 - RNA, 11 nt, Salmonella enterica enterica serovar Typhi Ty2
ucgccccacac

SEQ ID NO: 1748402 - RNA, 15 nt, Salmonella enterica enterica serovar Typhi Ty2
ucgcccacgcccaga

SEQ ID NO: 1748403 - RNA, 14 nt, Salmonella enterica enterica serovar Typhi Ty2
ucgcccucgccagc

SEQ ID NO: 1748404 - RNA, 22 nt, Salmonella enterica enterica serovar Typhi Ty2
ucgcccgggcgauaucacggaa

SEQ ID NO: 1748405 - RNA, 18 nt, Salmonella enterica enterica serovar Typhi Ty2
ucgcccgccgcaaaaaau

SEQ ID NO: 1748406 - RNA, 20 nt, Salmonella enterica enterica serovar Typhi Ty2
ucgcccgccgcaaaaaauac

SEQ ID NO: 1748407 - RNA, 14 nt, Salmonella enterica enterica serovar Typhi Ty2
ucgccguccauuuc

SEQ ID NO: 1748408 - RNA, 18 nt, Salmonella enterica enterica serovar Typhi Ty2
ucgccgucguucagccag

SEQ ID NO: 1748409 - RNA, 16 nt, Salmonella enterica enterica serovar Typhi Ty2
ucgccgguuuugguau

SEQ ID NO: 1748410 - RNA, 21 nt, Salmonella enterica enterica serovar Typhi Ty2
ucgccguaggcgugggugaag

SEQ ID NO: 1748411 - RNA, 23 nt, Salmonella enterica enterica serovar Typhi Ty2
ucgccguaaaacaacagcggcgu

SEQ ID NO: 1748412 - RNA, 17 nt, Salmonella enterica enterica serovar Typhi Ty2
ucgccuucuucaucuuc

SEQ ID NO: 1748413 - RNA, 15 nt, Salmonella enterica enterica serovar Typhi Ty2
ucgcgcaccauaaua

SEQ ID NO: 1748414 - RNA, 15 nt, Salmonella enterica enterica serovar Typhi Ty2
ucgccugccagcgcu

SEQ ID NO: 1748415 - RNA, 17 nt, Salmonella enterica enterica serovar Typhi Ty2
ucgccuguaccgggcag

SEQ ID NO: 1748416 - RNA, 20 nt, Salmonella enterica enterica serovar Typhi Ty2
ucgccuguaccgggcagaca

SEQ ID NO: 1748417 - RNA, 15 nt, Salmonella enterica enterica serovar Typhi Ty2
ucgccuguuucugcg

SEQ ID NO: 1748418 - RNA, 22 nt, Salmonella enterica enterica serovar Typhi Ty2
ucgccuuaacucuuaaaucaug

SEQ ID NO: 1748419 - RNA, 19 nt, Salmonella enterica enterica serovar Typhi Ty2
ucgcccuucaucuuccagu

SEQ ID NO: 1748420 - RNA, 14 nt, Salmonella enterica enterica serovar Typhi Ty2
ucgcccuuuucgca

SEQ ID NO: 1748421 - RNA, 16 nt, Salmonella enterica enterica serovar Typhi Ty2
ucgccgcggcgcuggc

SEQ ID NO: 1748422 - RNA, 23 nt, Salmonella enterica enterica serovar Typhi Ty2
ucgccggagaauccuuccaguag

SEQ ID NO: 1748423 - RNA, 18 nt, Salmonella enterica enterica serovar Typhi Ty2
ucgccgcguuuaaguccc

SEQ ID NO: 1748424 - RNA, 22 nt, Salmonella enterica enterica serovar Typhi Ty2
ucgccgcguuuaagucccuggc

SEQ ID NO: 1748425 - RNA, 23 nt, Salmonella enterica enterica serovar Typhi Ty2
ucgccgcugauucguuuuuacac

SEQ ID NO: 1748426 - RNA, 12 nt, Salmonella enterica enterica serovar Typhi Ty2
ucgccgcgcgca

SEQ ID NO: 1748427 - RNA, 15 nt, Salmonella enterica enterica serovar Typhi Ty2
ucgccgccaggaacg

SEQ ID NO: 1748428 - RNA, 20 nt, Salmonella enterica enterica serovar Typhi Ty2
ucgcaagacgaaaaaugaau

SEQ ID NO: 1748429 - RNA, 21 nt, Salmonella enterica enterica serovar Typhi Ty2
ucgcaacgccgccgacaugac

SEQ ID NO: 1748430 - RNA, 20 nt, Salmonella enterica enterica serovar Typhi Ty2
ucgcaacgccggugccugcc

SEQ ID NO: 1748431 - RNA, 22 nt, Salmonella enterica enterica serovar Typhi Ty2
ucgauuuucugcucaauauuau

SEQ ID NO: 1748432 - RNA, 22 nt, Salmonella enterica enterica serovar Typhi Ty2
ucgaucucgauauucacacgcu

SEQ ID NO: 1748433 - RNA, 21 nt, Salmonella enterica enterica serovar Typhi Ty2
ucgcacgucgucguuuguagg

SEQ ID NO: 1748434 - RNA, 20 nt, Salmonella enterica enterica serovar Typhi Ty2
ucgcaauauacugauauugc

SEQ ID NO: 1748435 - RNA, 15 nt, Salmonella enterica enterica serovar Typhi Ty2
ucgcaauauucaugc

SEQ ID NO: 1748436 - RNA, 13 nt, Salmonella enterica enterica serovar Typhi Ty2
ucgcaaugccacc

SEQ ID NO: 1748437 - RNA, 20 nt, Salmonella enterica enterica serovar Typhi Ty2
ucgaguucuucacgcugaug

SEQ ID NO: 1748438 - RNA, 20 nt, Salmonella enterica enterica serovar Typhi Ty2
ucgacgccgguuaguaguag

SEQ ID NO: 1748439 - RNA, 14 nt, Salmonella enterica enterica serovar Typhi Ty2
ucgacgcgcaucac

SEQ ID NO: 1748440 - RNA, 16 nt, Salmonella enterica enterica serovar Typhi Ty2
ucgacggccagcgcgc

SEQ ID NO: 1748441 - RNA, 14 nt, Salmonella enterica enterica serovar Typhi Ty2
uccuuugccuuucu

SEQ ID NO: 1748442 - RNA, 15 nt, Salmonella enterica enterica serovar Typhi Ty2
uccuuuaucugcccu

SEQ ID NO: 1748443 - RNA, 19 nt, Salmonella enterica enterica serovar Typhi Ty2
uccuuuuaauaaagaaagc

SEQ ID NO: 1748444 - RNA, 21 nt, Salmonella enterica enterica serovar Typhi Ty2
uccuuuuaccggcgaagucgc

SEQ ID NO: 1748445 - RNA, 18 nt, Salmonella enterica enterica serovar Typhi Ty2
uccuuucgagaagcccag

SEQ ID NO: 1748446 - RNA, 15 nt, Salmonella enterica enterica serovar Typhi Ty2
uccuuguaggccgga

SEQ ID NO: 1748447 - RNA, 18 nt, Salmonella enterica enterica serovar Typhi Ty2
uccuuuaaucgccgugcc

SEQ ID NO: 1748448 - RNA, 21 nt, Salmonella enterica enterica serovar Typhi Ty2
uccuuuacugcgccagccugc

SEQ ID NO: 1748449 - RNA, 22 nt, Salmonella enterica enterica serovar Typhi Ty2
ucgaaagagcaaauacuggaaa

SEQ ID NO: 1748450 - RNA, 16 nt, Salmonella enterica enterica serovar Typhi Ty2
ucgaaagagcaaauac

SEQ ID NO: 1748451 - RNA, 20 nt, Salmonella enterica enterica serovar Typhi Ty2
ucgaaacuggcauugugagc

SEQ ID NO: 1748452 - RNA, 13 nt, Salmonella enterica enterica serovar Typhi Ty2
uccuuuuucaggc

SEQ ID NO: 1748453 - RNA, 21 nt, Salmonella enterica enterica serovar Typhi Ty2
ucgaauaaagacacugcugcu

SEQ ID NO: 1748454 - RNA, 23 nt, Salmonella enterica enterica serovar Typhi Ty2
ucgacaacgcguuuauuauaaac

SEQ ID NO: 1748455 - RNA, 16 nt, Salmonella enterica enterica serovar Typhi Ty2
ucgacaagcuaauccc

SEQ ID NO: 1748456 - RNA, 13 nt, Salmonella enterica enterica serovar Typhi Ty2
ucgacaauuucac

SEQ ID NO: 1748457 - RNA, 23 nt, Salmonella enterica enterica serovar Typhi Ty2
ucgaacgccgccugcgccagcgc

SEQ ID NO: 1748458 - RNA, 19 nt, Salmonella enterica enterica serovar Typhi Ty2
ucgaacgcuuccgggcuca

SEQ ID NO: 1748459 - RNA, 17 nt, Salmonella enterica enterica serovar Typhi Ty2
ucgaacgguaacaggaa

SEQ ID NO: 1748460 - RNA, 18 nt, Salmonella enterica enterica serovar Typhi Ty2
uccugucgucaccagcag

SEQ ID NO: 1748461 - RNA, 12 nt, Salmonella enterica enterica serovar Typhi Ty2
uccugucccugc

SEQ ID NO: 1748462 - RNA, 16 nt, Salmonella enterica enterica serovar Typhi Ty2
uccugugaaguaaaaa

SEQ ID NO: 1748463 - RNA, 15 nt, Salmonella enterica enterica serovar Typhi Ty2
uccugugcuuugauu

SEQ ID NO: 1748464 - RNA, 15 nt, Salmonella enterica enterica serovar Typhi Ty2
uccuggccaggcuuc

SEQ ID NO: 1748465 - RNA, 13 nt, Salmonella enterica enterica serovar Typhi Ty2
uccuggaacugac

SEQ ID NO: 1748466 - RNA, 14 nt, Salmonella enterica enterica serovar Typhi Ty2
uccuggauuugcug

SEQ ID NO: 1748467 - RNA, 13 nt, Salmonella enterica enterica serovar Typhi Ty2
uccuggauuuuac

SEQ ID NO: 1748468 - RNA, 18 nt, Salmonella enterica enterica serovar Typhi Ty2
uccugcagcgccagaaag

SEQ ID NO: 1748469 - RNA, 17 nt, Salmonella enterica enterica serovar Typhi Ty2
uccugcaggcggcaaaa

SEQ ID NO: 1748470 - RNA, 23 nt, Salmonella enterica enterica serovar Typhi Ty2
uccugcaggguaauuagccccug

SEQ ID NO: 1748471 - RNA, 23 nt, Salmonella enterica enterica serovar Typhi Ty2
uccuugcagccagaacucaucuu

SEQ ID NO: 1748472 - RNA, 14 nt, Salmonella enterica enterica serovar Typhi Ty2
uccuugcagccaga

SEQ ID NO: 1748473 - RNA, 15 nt, Salmonella enterica enterica serovar Typhi Ty2
uccuugauuucauug

SEQ ID NO: 1748474 - RNA, 17 nt, Salmonella enterica enterica serovar Typhi Ty2
uccuucggugccauauu

SEQ ID NO: 1748475 - RNA, 17 nt, Salmonella enterica enterica serovar Typhi Ty2
uccuucguuacuuucau

SEQ ID NO: 1748476 - RNA, 10 nt, Salmonella enterica enterica serovar Typhi Ty2
uccuucuucc

SEQ ID NO: 1748477 - RNA, 17 nt, Salmonella enterica enterica serovar Typhi Ty2
uccuuauaaugcuuacg

SEQ ID NO: 1748478 - RNA, 16 nt, Salmonella enterica enterica serovar Typhi Ty2
uccuuaugaccgaguc

SEQ ID NO: 1748479 - RNA, 22 nt, Salmonella enterica enterica serovar Typhi Ty2
uccuuaugggucacauccagac

SEQ ID NO: 1748480 - RNA, 21 nt, Salmonella enterica enterica serovar Typhi Ty2
uccuuauuuaauacaucagaa

SEQ ID NO: 1748481 - RNA, 13 nt, Salmonella enterica enterica serovar Typhi Ty2
uccuuaaucagcu

SEQ ID NO: 1748482 - RNA, 14 nt, Salmonella enterica enterica serovar Typhi Ty2
uccuucaauuuuac

SEQ ID NO: 1748483 - RNA, 17 nt, Salmonella enterica enterica serovar Typhi Ty2
uccuucacaaacuucuc

SEQ ID NO: 1748484 - RNA, 18 nt, Salmonella enterica enterica serovar Typhi Ty2
uccuucagcguuugcgcc

SEQ ID NO: 1748485 - RNA, 17 nt, Salmonella enterica enterica serovar Typhi Ty2
uccuuccagcccguucu

SEQ ID NO: 1748486 - RNA, 16 nt, Salmonella enterica enterica serovar Typhi Ty2
uccuuccgcuuuaagc

SEQ ID NO: 1748487 - RNA, 15 nt, Salmonella enterica enterica serovar Typhi Ty2
uccuucccccaccac

SEQ ID NO: 1748488 - RNA, 16 nt, Salmonella enterica enterica serovar Typhi Ty2
ucguucauugcuuucu

SEQ ID NO: 1748489 - RNA, 15 nt, Salmonella enterica enterica serovar Typhi Ty2
ucguucccgccugcu

SEQ ID NO: 1748490 - RNA, 15 nt, Salmonella enterica enterica serovar Typhi Ty2
ucguuccgccaggcg

SEQ ID NO: 1748491 - RNA, 22 nt, Salmonella enterica enterica serovar Typhi Ty2
ucguucgauagcguuuuccagc

SEQ ID NO: 1748492 - RNA, 14 nt, Salmonella enterica enterica serovar Typhi Ty2
ucguucgcccuuca

SEQ ID NO: 1748493 - RNA, 19 nt, Salmonella enterica enterica serovar Typhi Ty2
ucguucggucaggauacua

SEQ ID NO: 1748494 - RNA, 18 nt, Salmonella enterica enterica serovar Typhi Ty2
ucguuucccucauauuug

SEQ ID NO: 1748495 - RNA, 20 nt, Salmonella enterica enterica serovar Typhi Ty2
ucguuuacaccuauuccucc

SEQ ID NO: 1748496 - RNA, 20 nt, Salmonella enterica enterica serovar Typhi Ty2
ucguuuaaguaagguaaagc

SEQ ID NO: 1748497 - RNA, 23 nt, Salmonella enterica enterica serovar Typhi Ty2
ucgugaaucaucaucauccgcgc

SEQ ID NO: 1748498 - RNA, 15 nt, Salmonella enterica enterica serovar Typhi Ty2
ucgugacccacacau

SEQ ID NO: 1748499 - RNA, 17 nt, Salmonella enterica enterica serovar Typhi Ty2
ucgugacccgccagcau

SEQ ID NO: 1748500 - RNA, 19 nt, Salmonella enterica enterica serovar Typhi Ty2
ucguuaaugcuguccugca

SEQ ID NO: 1748501 - RNA, 12 nt, Salmonella enterica enterica serovar Typhi Ty2
ucgugauaaacg

SEQ ID NO: 1748502 - RNA, 21 nt, Salmonella enterica enterica serovar Typhi Ty2
ucguuaccggugauauugccg

SEQ ID NO: 1748503 - RNA, 23 nt, Salmonella enterica enterica serovar Typhi Ty2
ucguuaccggcuccggcaaauuc

SEQ ID NO: 1748504 - RNA, 14 nt, Salmonella enterica enterica serovar Typhi Ty2
ucguuacccgugcg

SEQ ID NO: 1748505 - RNA, 16 nt, Salmonella enterica enterica serovar Typhi Ty2
ucguuacccuccugca

SEQ ID NO: 1748506 - RNA, 14 nt, Salmonella enterica enterica serovar Typhi Ty2
ucguuaccgcuuca

SEQ ID NO: 1748507 - RNA, 14 nt, Salmonella enterica enterica serovar Typhi Ty2
ucguuaccagcauc

SEQ ID NO: 1748508 - RNA, 13 nt, Salmonella enterica enterica serovar Typhi Ty2
ucguuauuuccga

SEQ ID NO: 1748509 - RNA, 19 nt, Salmonella enterica enterica serovar Typhi Ty2
ucguuauuuuccugaaaaa

SEQ ID NO: 1748510 - RNA, 20 nt, Salmonella enterica enterica serovar Typhi Ty2
ucguuagcaaauugcugaug

SEQ ID NO: 1748511 - RNA, 20 nt, Salmonella enterica enterica serovar Typhi Ty2
ucuacaguuugucaucaguc

SEQ ID NO: 1748512 - RNA, 15 nt, Salmonella enterica enterica serovar Typhi Ty2
ucuacaucaagagaa

SEQ ID NO: 1748513 - RNA, 17 nt, Salmonella enterica enterica serovar Typhi Ty2
ucuaaaucauaccagcg

SEQ ID NO: 1748514 - RNA, 23 nt, Salmonella enterica enterica serovar Typhi Ty2
ucuaaaaaggaaagggacgauga

SEQ ID NO: 1748515 - RNA, 22 nt, Salmonella enterica enterica serovar Typhi Ty2
ucgucggcaagaauuucaauca

SEQ ID NO: 1748516 - RNA, 15 nt, Salmonella enterica enterica serovar Typhi Ty2
ucgucggcaagaauu

SEQ ID NO: 1748517 - RNA, 16 nt, Salmonella enterica enterica serovar Typhi Ty2
ucgucgccuuccagcg

SEQ ID NO: 1748518 - RNA, 19 nt, Salmonella enterica enterica serovar Typhi Ty2
ucgucccaggccagaugcg

SEQ ID NO: 1748519 - RNA, 21 nt, Salmonella enterica enterica serovar Typhi Ty2
ucgucuauuuccgcuucgcuu

SEQ ID NO: 1748520 - RNA, 15 nt, Salmonella enterica enterica serovar Typhi Ty2
ucguauccccagucu

SEQ ID NO: 1748521 - RNA, 20 nt, Salmonella enterica enterica serovar Typhi Ty2
ucguauccccagucuuccug

SEQ ID NO: 1748522 - RNA, 12 nt, Salmonella enterica enterica serovar Typhi Ty2
ucguauuauugg

SEQ ID NO: 1748523 - RNA, 14 nt, Salmonella enterica enterica serovar Typhi Ty2
ucguauuauuggug

SEQ ID NO: 1748524 - RNA, 12 nt, Salmonella enterica enterica serovar Typhi Ty2
ucgucccaggcc

SEQ ID NO: 1748525 - RNA, 18 nt, Salmonella enterica enterica serovar Typhi Ty2
ucguacgccuaaaugaac

SEQ ID NO: 1748526 - RNA, 11 nt, Salmonella enterica enterica serovar Typhi Ty2
ucguaccuuca

SEQ ID NO: 1748527 - RNA, 18 nt, Salmonella enterica enterica serovar Typhi Ty2
ucguaguggaucagcaga

SEQ ID NO: 1748528 - RNA, 15 nt, Salmonella enterica enterica serovar Typhi Ty2
ucggucuuuuucgca

SEQ ID NO: 1748529 - RNA, 15 nt, Salmonella enterica enterica serovar Typhi Ty2
ucggucaguuugccc

SEQ ID NO: 1748530 - RNA, 14 nt, Salmonella enterica enterica serovar Typhi Ty2
ucggucaggcugcg

SEQ ID NO: 1748531 - RNA, 22 nt, Salmonella enterica enterica serovar Typhi Ty2
ucgguagcuguaccagaucgcc

SEQ ID NO: 1748532 - RNA, 18 nt, Salmonella enterica enterica serovar Typhi Ty2
ucgguagaaugaauguag

SEQ ID NO: 1748533 - RNA, 16 nt, Salmonella enterica enterica serovar Typhi Ty2
ucggguuuuccugaau

SEQ ID NO: 1748534 - RNA, 21 nt, Salmonella enterica enterica serovar Typhi Ty2
  misc_feature (5)..(5): n is a, c, g or u
ucggnuaagcgcuagcgccac

SEQ ID NO: 1748535 - RNA, 17 nt, Salmonella enterica enterica serovar Typhi Ty2
ucggguucggcggugcc

SEQ ID NO: 1748536 - RNA, 19 nt, Salmonella enterica enterica serovar Typhi Ty2
ucggugacggaaaccagca

SEQ ID NO: 1748537 - RNA, 19 nt, Salmonella enterica enterica serovar Typhi Ty2
ucguaaagcgcauccagcu

SEQ ID NO: 1748538 - RNA, 22 nt, Salmonella enterica enterica serovar Typhi Ty2
ucguaacgcauauccagcagau

SEQ ID NO: 1748539 - RNA, 16 nt, Salmonella enterica enterica serovar Typhi Ty2
ucggggucuuccagca

SEQ ID NO: 1748540 - RNA, 19 nt, Salmonella enterica enterica serovar Typhi Ty2
ucgggugauaaaauaaaca

SEQ ID NO: 1748541 - RNA, 21 nt, Salmonella enterica enterica serovar Typhi Ty2
ucgggaaucaucgaggccacc

SEQ ID NO: 1748542 - RNA, 17 nt, Salmonella enterica enterica serovar Typhi Ty2
ucgggaucaauuuugcu

SEQ ID NO: 1748543 - RNA, 18 nt, Salmonella enterica enterica serovar Typhi Ty2
ucgggauauaugcaaaac

SEQ ID NO: 1748544 - RNA, 14 nt, Salmonella enterica enterica serovar Typhi Ty2
ucgggaacgcuguc

SEQ ID NO: 1748545 - RNA, 23 nt, Salmonella enterica enterica serovar Typhi Ty2
ucggcuuuuuuuuaugccucuua

SEQ ID NO: 1748546 - RNA, 14 nt, Salmonella enterica enterica serovar Typhi Ty2
ucggcuuuuuucaa

SEQ ID NO: 1748547 - RNA, 18 nt, Salmonella enterica enterica serovar Typhi Ty2
ucggcuuuuguucccgca

SEQ ID NO: 1748548 - RNA, 23 nt, Salmonella enterica enterica serovar Typhi Ty2
ucggcuuuguaucagcauuuaca

SEQ ID NO: 1748549 - RNA, 13 nt, Salmonella enterica enterica serovar Typhi Ty2
ucgggccaaucgg

SEQ ID NO: 1748550 - RNA, 23 nt, Salmonella enterica enterica serovar Typhi Ty2
ucgggcaggcuuccacgcacgcc

SEQ ID NO: 1748551 - RNA, 21 nt, Salmonella enterica enterica serovar Typhi Ty2
ucgggcagcgcuucucuuucc

SEQ ID NO: 1748552 - RNA, 15 nt, Salmonella enterica enterica serovar Typhi Ty2
ucggcgacuuucacg

SEQ ID NO: 1748553 - RNA, 17 nt, Salmonella enterica enterica serovar Typhi Ty2
ucggcgaggggcaggcg

SEQ ID NO: 1748554 - RNA, 23 nt, Salmonella enterica enterica serovar Typhi Ty2
ucggcgcagggaucguuuuucuu

SEQ ID NO: 1748555 - RNA, 22 nt, Salmonella enterica enterica serovar Typhi Ty2
ucggcgucgcgaauaauuauuu

SEQ ID NO: 1748556 - RNA, 18 nt, Salmonella enterica enterica serovar Typhi Ty2
ucggcgucgcgaauaauu

SEQ ID NO: 1748557 - RNA, 19 nt, Salmonella enterica enterica serovar Typhi Ty2
ucggcgucgugcugggcgc

SEQ ID NO: 1748558 - RNA, 18 nt, Salmonella enterica enterica serovar Typhi Ty2
ucggcguaacccagugca

SEQ ID NO: 1748559 - RNA, 20 nt, Salmonella enterica enterica serovar Typhi Ty2
ucggcgggcaggucgucuuc

SEQ ID NO: 1748560 - RNA, 14 nt, Salmonella enterica enterica serovar Typhi Ty2
ucggcuccugguga

SEQ ID NO: 1748561 - RNA, 17 nt, Salmonella enterica enterica serovar Typhi Ty2
ucggcuaguaauaccag

SEQ ID NO: 1748562 - RNA, 13 nt, Salmonella enterica enterica serovar Typhi Ty2
ucggcuuacccaa

SEQ ID NO: 1748563 - RNA, 22 nt, Salmonella enterica enterica serovar Typhi Ty2
ucggcuggcauuuuuauuuaac

SEQ ID NO: 1748564 - RNA, 16 nt, Salmonella enterica enterica serovar Typhi Ty2
ucggcuucucccaaca

SEQ ID NO: 1748565 - RNA, 20 nt, Salmonella enterica enterica serovar Typhi Ty2
ucggcuugcuucaucugguu

SEQ ID NO: 1748566 - RNA, 12 nt, Salmonella enterica enterica serovar Typhi Ty2
ucgcuuguuuca

SEQ ID NO: 1748567 - RNA, 22 nt, Salmonella enterica enterica serovar Typhi Ty2
ucgcuuuacccgggccaucuuu

SEQ ID NO: 1748568 - RNA, 23 nt, Salmonella enterica enterica serovar Typhi Ty2
ucgcuuaaauggcgaaagugaac

SEQ ID NO: 1748569 - RNA, 13 nt, Salmonella enterica enterica serovar Typhi Ty2
ucgcuguggccag

SEQ ID NO: 1748570 - RNA, 23 nt, Salmonella enterica enterica serovar Typhi Ty2
ucgcuuuuacucuuccugcugcg

SEQ ID NO: 1748571 - RNA, 19 nt, Salmonella enterica enterica serovar Typhi Ty2
ucgcuuuuauguuacccag

SEQ ID NO: 1748572 - RNA, 20 nt, Salmonella enterica enterica serovar Typhi Ty2
ucggagauuucauccucuug

SEQ ID NO: 1748573 - RNA, 18 nt, Salmonella enterica enterica serovar Typhi Ty2
ucggagauuucauccucu

SEQ ID NO: 1748574 - RNA, 19 nt, Salmonella enterica enterica serovar Typhi Ty2
ucgcgcagauagagcgccu

SEQ ID NO: 1748575 - RNA, 22 nt, Salmonella enterica enterica serovar Typhi Ty2
ucgcgcagacaguggccaucuu

SEQ ID NO: 1748576 - RNA, 14 nt, Salmonella enterica enterica serovar Typhi Ty2
ucgcgcaggcggaa

SEQ ID NO: 1748577 - RNA, 13 nt, Salmonella enterica enterica serovar Typhi Ty2
ucgcgcagccagc

SEQ ID NO: 1748578 - RNA, 20 nt, Salmonella enterica enterica serovar Typhi Ty2
ucgcugcugaugauaugggu

SEQ ID NO: 1748579 - RNA, 15 nt, Salmonella enterica enterica serovar Typhi Ty2
ucgcugcugcuuuuu

SEQ ID NO: 1748580 - RNA, 15 nt, Salmonella enterica enterica serovar Typhi Ty2
ucgcuggacauuaag

SEQ ID NO: 1748581 - RNA, 18 nt, Salmonella enterica enterica serovar Typhi Ty2
ucgcuggcguagauauuc

SEQ ID NO: 1748582 - RNA, 18 nt, Salmonella enterica enterica serovar Typhi Ty2
ucgcuguauuucccucuc

SEQ ID NO: 1748583 - RNA, 20 nt, Salmonella enterica enterica serovar Typhi Ty2
ucgcugucggucagauucag

SEQ ID NO: 1748584 - RNA, 12 nt, Salmonella enterica enterica serovar Typhi Ty2
ucgcuguuaacc

SEQ ID NO: 1748585 - RNA, 15 nt, Salmonella enterica enterica serovar Typhi Ty2
ucgcuguggccaggc

SEQ ID NO: 1748586 - RNA, 17 nt, Salmonella enterica enterica serovar Typhi Ty2
ucggcgacgucccggca

SEQ ID NO: 1748587 - RNA, 16 nt, Salmonella enterica enterica serovar Typhi Ty2
ucggccuguucuuuuu

SEQ ID NO: 1748588 - RNA, 21 nt, Salmonella enterica enterica serovar Typhi Ty2
ucggauggcgacguaacuguc

SEQ ID NO: 1748589 - RNA, 12 nt, Salmonella enterica enterica serovar Typhi Ty2
ucggccaccauu

SEQ ID NO: 1748590 - RNA, 23 nt, Salmonella enterica enterica serovar Typhi Ty2
ucuuuuucgaucagcauaucgau

SEQ ID NO: 1748591 - RNA, 16 nt, Salmonella enterica enterica serovar Typhi Ty2
ucuuuugcgccuucca

SEQ ID NO: 1748592 - RNA, 17 nt, Salmonella enterica enterica serovar Typhi Ty2
ucuuuuguuuuucucuu

SEQ ID NO: 1748593 - RNA, 23 nt, Salmonella enterica enterica serovar Typhi Ty2
ucuuuucugucguguccuugcca

SEQ ID NO: 1748594 - RNA, 12 nt, Salmonella enterica enterica serovar Typhi Ty2
ugaaaaaauuuc

SEQ ID NO: 1748595 - RNA, 18 nt, Salmonella enterica enterica serovar Typhi Ty2
ucuuuuacgaucgccacc

SEQ ID NO: 1748596 - RNA, 13 nt, Salmonella enterica enterica serovar Typhi Ty2
ucuuuucaauaaa

SEQ ID NO: 1748597 - RNA, 12 nt, Salmonella enterica enterica serovar Typhi Ty2
ucuuuuauuauu

SEQ ID NO: 1748598 - RNA, 16 nt, Salmonella enterica enterica serovar Typhi Ty2
ucuuuuaucacccgga

SEQ ID NO: 1748599 - RNA, 13 nt, Salmonella enterica enterica serovar Typhi Ty2
ucuuuuaacauaa

SEQ ID NO: 1748600 - RNA, 15 nt, Salmonella enterica enterica serovar Typhi Ty2
ucuuuuaacauaagu

SEQ ID NO: 1748601 - RNA, 15 nt, Salmonella enterica enterica serovar Typhi Ty2
ucuuuuaauuuucug

SEQ ID NO: 1748602 - RNA, 22 nt, Salmonella enterica enterica serovar Typhi Ty2
ucuuuuaaggcggcaaagauaa

SEQ ID NO: 1748603 - RNA, 15 nt, Salmonella enterica enterica serovar Typhi Ty2
ucuuuggacggcauc

SEQ ID NO: 1748604 - RNA, 14 nt, Salmonella enterica enterica serovar Typhi Ty2
ucuuugcugccguc

SEQ ID NO: 1748605 - RNA, 22 nt, Salmonella enterica enterica serovar Typhi Ty2
ucuuuggccaguaucgcgccgc

SEQ ID NO: 1748606 - RNA, 17 nt, Salmonella enterica enterica serovar Typhi Ty2
ucuuuggcuuaaucauu

SEQ ID NO: 1748607 - RNA, 12 nt, Salmonella enterica enterica serovar Typhi Ty2
ucuuuggcgauu

SEQ ID NO: 1748608 - RNA, 17 nt, Salmonella enterica enterica serovar Typhi Ty2
ucuuugccaaacugcug

SEQ ID NO: 1748609 - RNA, 19 nt, Salmonella enterica enterica serovar Typhi Ty2
ucuuugcaccgcuaaaaaa

SEQ ID NO: 1748610 - RNA, 20 nt, Salmonella enterica enterica serovar Typhi Ty2
ucuuugcagcuccuuuuaau

SEQ ID NO: 1748611 - RNA, 20 nt, Salmonella enterica enterica serovar Typhi Ty2
ucuuugacccacgccagcag

SEQ ID NO: 1748612 - RNA, 20 nt, Salmonella enterica enterica serovar Typhi Ty2
ucuuugaccagcgacgauga

SEQ ID NO: 1748613 - RNA, 12 nt, Salmonella enterica enterica serovar Typhi Ty2
ucuuuaucaaac

SEQ ID NO: 1748614 - RNA, 16 nt, Salmonella enterica enterica serovar Typhi Ty2
ucuuuauccugaagau

SEQ ID NO: 1748615 - RNA, 22 nt, Salmonella enterica enterica serovar Typhi Ty2
ucuuucagcaaacguucaauga

SEQ ID NO: 1748616 - RNA, 13 nt, Salmonella enterica enterica serovar Typhi Ty2
ucuuucaucaaac

SEQ ID NO: 1748617 - RNA, 14 nt, Salmonella enterica enterica serovar Typhi Ty2
ucuuucauuuuacc

SEQ ID NO: 1748618 - RNA, 14 nt, Salmonella enterica enterica serovar Typhi Ty2
ucuuucccaggccc

SEQ ID NO: 1748619 - RNA, 12 nt, Salmonella enterica enterica serovar Typhi Ty2
ucuuuccuuuuu

SEQ ID NO: 1748620 - RNA, 21 nt, Salmonella enterica enterica serovar Typhi Ty2
ucuuucugaaacggaucaaaa

SEQ ID NO: 1748621 - RNA, 18 nt, Salmonella enterica enterica serovar Typhi Ty2
ucuuucugcgcacgagug

SEQ ID NO: 1748622 - RNA, 12 nt, Salmonella enterica enterica serovar Typhi Ty2
ucuucccauauu

SEQ ID NO: 1748623 - RNA, 16 nt, Salmonella enterica enterica serovar Typhi Ty2
ucuuccaugccuucau

SEQ ID NO: 1748624 - RNA, 23 nt, Salmonella enterica enterica serovar Typhi Ty2
ucuuccaguuguaacgccuggcg

SEQ ID NO: 1748625 - RNA, 23 nt, Salmonella enterica enterica serovar Typhi Ty2
ucuuccagcacgauauccagcac

SEQ ID NO: 1748626 - RNA, 17 nt, Salmonella enterica enterica serovar Typhi Ty2
ucuuccagcgccaaaaa

SEQ ID NO: 1748627 - RNA, 17 nt, Salmonella enterica enterica serovar Typhi Ty2
ucuuccagcggcagacc

SEQ ID NO: 1748628 - RNA, 14 nt, Salmonella enterica enterica serovar Typhi Ty2
ucuuccagcugcuc

SEQ ID NO: 1748629 - RNA, 15 nt, Salmonella enterica enterica serovar Typhi Ty2
ucuugcucucaggca

SEQ ID NO: 1748630 - RNA, 18 nt, Salmonella enterica enterica serovar Typhi Ty2
ucuuccccgaucagaaaa

SEQ ID NO: 1748631 - RNA, 13 nt, Salmonella enterica enterica serovar Typhi Ty2
ucuuguggaacac

SEQ ID NO: 1748632 - RNA, 19 nt, Salmonella enterica enterica serovar Typhi Ty2
ucuuggagagcaucaucug

SEQ ID NO: 1748633 - RNA, 15 nt, Salmonella enterica enterica serovar Typhi Ty2
ucuuggagagcauca

SEQ ID NO: 1748634 - RNA, 17 nt, Salmonella enterica enterica serovar Typhi Ty2
ucuuggaugauuuucuu

SEQ ID NO: 1748635 - RNA, 14 nt, Salmonella enterica enterica serovar Typhi Ty2
ugaaauacagccag

SEQ ID NO: 1748636 - RNA, 19 nt, Salmonella enterica enterica serovar Typhi Ty2
ugaaauaauuguguaaucu

SEQ ID NO: 1748637 - RNA, 20 nt, Salmonella enterica enterica serovar Typhi Ty2
ugaaauaauuguguaaucuu

SEQ ID NO: 1748638 - RNA, 18 nt, Salmonella enterica enterica serovar Typhi Ty2
ugaaauauuugaucacau

SEQ ID NO: 1748639 - RNA, 22 nt, Salmonella enterica enterica serovar Typhi Ty2
ugaaaucgucagacggcuccag

SEQ ID NO: 1748640 - RNA, 17 nt, Salmonella enterica enterica serovar Typhi Ty2
ugaaauggccccaaauc

SEQ ID NO: 1748641 - RNA, 20 nt, Salmonella enterica enterica serovar Typhi Ty2
ugaaauggccccaaaucaga

SEQ ID NO: 1748642 - RNA, 19 nt, Salmonella enterica enterica serovar Typhi Ty2
ugaaauuacgccauaaaaa

SEQ ID NO: 1748643 - RNA, 15 nt, Salmonella enterica enterica serovar Typhi Ty2
ugaaauuaaucaggc

SEQ ID NO: 1748644 - RNA, 16 nt, Salmonella enterica enterica serovar Typhi Ty2
ugaaauuucuuuucca

SEQ ID NO: 1748645 - RNA, 11 nt, Salmonella enterica enterica serovar Typhi Ty2
ugaacaggcag

SEQ ID NO: 1748646 - RNA, 22 nt, Salmonella enterica enterica serovar Typhi Ty2
ugaacagcgucauccaguguua

SEQ ID NO: 1748647 - RNA, 15 nt, Salmonella enterica enterica serovar Typhi Ty2
ugaacaugcgcagaa

SEQ ID NO: 1748648 - RNA, 18 nt, Salmonella enterica enterica serovar Typhi Ty2
ugaacauacguuuaaagc

SEQ ID NO: 1748649 - RNA, 20 nt, Salmonella enterica enterica serovar Typhi Ty2
ugaacauacguuuaaagcgc

SEQ ID NO: 1748650 - RNA, 21 nt, Salmonella enterica enterica serovar Typhi Ty2
ugaacaccacugaaaaauaau

SEQ ID NO: 1748651 - RNA, 14 nt, Salmonella enterica enterica serovar Typhi Ty2
ugaacacccugccc

SEQ ID NO: 1748652 - RNA, 14 nt, Salmonella enterica enterica serovar Typhi Ty2
ugaacgaagcauuu

SEQ ID NO: 1748653 - RNA, 13 nt, Salmonella enterica enterica serovar Typhi Ty2
ugaacgccaggcc

SEQ ID NO: 1748654 - RNA, 22 nt, Salmonella enterica enterica serovar Typhi Ty2
ugaaccacggagagacaguuca

SEQ ID NO: 1748655 - RNA, 15 nt, Salmonella enterica enterica serovar Typhi Ty2
ugaacauugccccuc

SEQ ID NO: 1748656 - RNA, 17 nt, Salmonella enterica enterica serovar Typhi Ty2
ugaaccggguaguuuug

SEQ ID NO: 1748657 - RNA, 20 nt, Salmonella enterica enterica serovar Typhi Ty2
ugaaccgguaaagcagugca

SEQ ID NO: 1748658 - RNA, 19 nt, Salmonella enterica enterica serovar Typhi Ty2
ugaaaacucggcgggguuu

SEQ ID NO: 1748659 - RNA, 12 nt, Salmonella enterica enterica serovar Typhi Ty2
ugaaaagggacu

SEQ ID NO: 1748660 - RNA, 23 nt, Salmonella enterica enterica serovar Typhi Ty2
ugaaaaggggaucguguaacaau

SEQ ID NO: 1748661 - RNA, 19 nt, Salmonella enterica enterica serovar Typhi Ty2
ugaaaagcuuagaacucac

SEQ ID NO: 1748662 - RNA, 12 nt, Salmonella enterica enterica serovar Typhi Ty2
ugaaaagcuuag

SEQ ID NO: 1748663 - RNA, 11 nt, Salmonella enterica enterica serovar Typhi Ty2
ugaaaaagaau

SEQ ID NO: 1748664 - RNA, 23 nt, Salmonella enterica enterica serovar Typhi Ty2
ugaaaacaggccugcggaaaaag

SEQ ID NO: 1748665 - RNA, 13 nt, Salmonella enterica enterica serovar Typhi Ty2
ugaaaauaauuga

SEQ ID NO: 1748666 - RNA, 21 nt, Salmonella enterica enterica serovar Typhi Ty2
ugaaaaugcguccagaggauc

SEQ ID NO: 1748667 - RNA, 23 nt, Salmonella enterica enterica serovar Typhi Ty2
ugaaaaugugguauuaacccaga

SEQ ID NO: 1748668 - RNA, 20 nt, Salmonella enterica enterica serovar Typhi Ty2
ugaaacauauauauccgcua

SEQ ID NO: 1748669 - RNA, 15 nt, Salmonella enterica enterica serovar Typhi Ty2
ugaaacagaauaaac

SEQ ID NO: 1748670 - RNA, 20 nt, Salmonella enterica enterica serovar Typhi Ty2
ugaaagauuauuuuaucauc

SEQ ID NO: 1748671 - RNA, 16 nt, Salmonella enterica enterica serovar Typhi Ty2
ugaaauaacagacucc

SEQ ID NO: 1748672 - RNA, 16 nt, Salmonella enterica enterica serovar Typhi Ty2
ugaaaguuucaggaua

SEQ ID NO: 1748673 - RNA, 22 nt, Salmonella enterica enterica serovar Typhi Ty2
ugaaaccggcgcgccuuccagc

SEQ ID NO: 1748674 - RNA, 18 nt, Salmonella enterica enterica serovar Typhi Ty2
ugaaacccauaauaauga

SEQ ID NO: 1748675 - RNA, 20 nt, Salmonella enterica enterica serovar Typhi Ty2
ugaaaccccaaaucagcaaa

SEQ ID NO: 1748676 - RNA, 20 nt, Salmonella enterica enterica serovar Typhi Ty2
ugaaacccauaauaaugacu

SEQ ID NO: 1748677 - RNA, 19 nt, Salmonella enterica enterica serovar Typhi Ty2
ugaaacccgccaccgccag

SEQ ID NO: 1748678 - RNA, 17 nt, Salmonella enterica enterica serovar Typhi Ty2
ugaaacgcccuucccag

SEQ ID NO: 1748679 - RNA, 18 nt, Salmonella enterica enterica serovar Typhi Ty2
ugaaacguguuuaucccc

SEQ ID NO: 1748680 - RNA, 22 nt, Salmonella enterica enterica serovar Typhi Ty2
ugaaacaguccggcgaaaaaag

SEQ ID NO: 1748681 - RNA, 18 nt, Salmonella enterica enterica serovar Typhi Ty2
ugaaacgaaaacugggca

SEQ ID NO: 1748682 - RNA, 18 nt, Salmonella enterica enterica serovar Typhi Ty2
ugaaacugaaccaacagc

SEQ ID NO: 1748683 - RNA, 19 nt, Salmonella enterica enterica serovar Typhi Ty2
ugaaacucgccaugccauc

SEQ ID NO: 1748684 - RNA, 18 nt, Salmonella enterica enterica serovar Typhi Ty2
ugaaacucgacacacuca

SEQ ID NO: 1748685 - RNA, 23 nt, Salmonella enterica enterica serovar Typhi Ty2
ucuuccaccacggcaaaaauaug

SEQ ID NO: 1748686 - RNA, 16 nt, Salmonella enterica enterica serovar Typhi Ty2
ucuucacuaaaaacag

SEQ ID NO: 1748687 - RNA, 15 nt, Salmonella enterica enterica serovar Typhi Ty2
ucuucaccuugcugc

SEQ ID NO: 1748688 - RNA, 19 nt, Salmonella enterica enterica serovar Typhi Ty2
ucuucaccuuuccagucaa

SEQ ID NO: 1748689 - RNA, 12 nt, Salmonella enterica enterica serovar Typhi Ty2
ucuuauuuuccg

SEQ ID NO: 1748690 - RNA, 11 nt, Salmonella enterica enterica serovar Typhi Ty2
ucuuauuuucc

SEQ ID NO: 1748691 - RNA, 14 nt, Salmonella enterica enterica serovar Typhi Ty2
ucuucaauaacgaa

SEQ ID NO: 1748692 - RNA, 14 nt, Salmonella enterica enterica serovar Typhi Ty2
ucuucaacgugcau

SEQ ID NO: 1748693 - RNA, 17 nt, Salmonella enterica enterica serovar Typhi Ty2
ucuucaaugaacaauaa

SEQ ID NO: 1748694 - RNA, 18 nt, Salmonella enterica enterica serovar Typhi Ty2
ucuuauccggccugcaug

SEQ ID NO: 1748695 - RNA, 22 nt, Salmonella enterica enterica serovar Typhi Ty2
ucuuaucaggccuacacucugc

SEQ ID NO: 1748696 - RNA, 12 nt, Salmonella enterica enterica serovar Typhi Ty2
ucuuauccgacu

SEQ ID NO: 1748697 - RNA, 14 nt, Salmonella enterica enterica serovar Typhi Ty2
ucuuauuacaagaa

SEQ ID NO: 1748698 - RNA, 15 nt, Salmonella enterica enterica serovar Typhi Ty2
ucuuaguaucccuuu

SEQ ID NO: 1748699 - RNA, 24 nt, Salmonella enterica enterica serovar Typhi Ty2
ucuuagguucguagcgcaaauauc

SEQ ID NO: 1748700 - RNA, 23 nt, Salmonella enterica enterica serovar Typhi Ty2
ucuuagaauagaaucaauuucuc

SEQ ID NO: 1748701 - RNA, 20 nt, Salmonella enterica enterica serovar Typhi Ty2
ucuuacuaauaaauauucau

SEQ ID NO: 1748702 - RNA, 19 nt, Salmonella enterica enterica serovar Typhi Ty2
ucuuacuaauaaauauuca

SEQ ID NO: 1748703 - RNA, 22 nt, Salmonella enterica enterica serovar Typhi Ty2
ucuuacguugcauuuaucaauc

SEQ ID NO: 1748704 - RNA, 14 nt, Salmonella enterica enterica serovar Typhi Ty2
ucuuaccucuccug

SEQ ID NO: 1748705 - RNA, 21 nt, Salmonella enterica enterica serovar Typhi Ty2
ucuuacuaauaaauauucauc

SEQ ID NO: 1748706 - RNA, 18 nt, Salmonella enterica enterica serovar Typhi Ty2
ucuuaccgcuaaaauacc

SEQ ID NO: 1748707 - RNA, 13 nt, Salmonella enterica enterica serovar Typhi Ty2
ucuuaccacgccg

SEQ ID NO: 1748708 - RNA, 14 nt, Salmonella enterica enterica serovar Typhi Ty2
ucuguuauauauuu

SEQ ID NO: 1748709 - RNA, 23 nt, Salmonella enterica enterica serovar Typhi Ty2
ucuguuaucaggcguagagaggc

SEQ ID NO: 1748710 - RNA, 12 nt, Salmonella enterica enterica serovar Typhi Ty2
ucuguuaucugg

SEQ ID NO: 1748711 - RNA, 11 nt, Salmonella enterica enterica serovar Typhi Ty2
ucuguuauuuc

SEQ ID NO: 1748712 - RNA, 15 nt, Salmonella enterica enterica serovar Typhi Ty2
ucugcuccgccagca

SEQ ID NO: 1748713 - RNA, 13 nt, Salmonella enterica enterica serovar Typhi Ty2
ucugcuccgccag

SEQ ID NO: 1748714 - RNA, 14 nt, Salmonella enterica enterica serovar Typhi Ty2
ucugcuccgccagc

SEQ ID NO: 1748715 - RNA, 17 nt, Salmonella enterica enterica serovar Typhi Ty2
ucugcuccgccagcaau

SEQ ID NO: 1748716 - RNA, 16 nt, Salmonella enterica enterica serovar Typhi Ty2
ucugcugauaauacug

SEQ ID NO: 1748717 - RNA, 22 nt, Salmonella enterica enterica serovar Typhi Ty2
ucugcugaugcugguuuuagcu

SEQ ID NO: 1748718 - RNA, 14 nt, Salmonella enterica enterica serovar Typhi Ty2
ucugcugccagcgc

SEQ ID NO: 1748719 - RNA, 19 nt, Salmonella enterica enterica serovar Typhi Ty2
ucugcugccucaucaauuc

SEQ ID NO: 1748720 - RNA, 21 nt, Salmonella enterica enterica serovar Typhi Ty2
ucugcugggcgauuucacgaa

SEQ ID NO: 1748721 - RNA, 20 nt, Salmonella enterica enterica serovar Typhi Ty2
ucugcgcgccgcaggccgga

SEQ ID NO: 1748722 - RNA, 18 nt, Salmonella enterica enterica serovar Typhi Ty2
ucugcgggacgcaucauc

SEQ ID NO: 1748723 - RNA, 19 nt, Salmonella enterica enterica serovar Typhi Ty2
ucugcgucaguaccugaug

SEQ ID NO: 1748724 - RNA, 21 nt, Salmonella enterica enterica serovar Typhi Ty2
ucugcguccugcuuaugaaac

SEQ ID NO: 1748725 - RNA, 16 nt, Salmonella enterica enterica serovar Typhi Ty2
ucugcaccacgguguc

SEQ ID NO: 1748726 - RNA, 16 nt, Salmonella enterica enterica serovar Typhi Ty2
ucugcaccagaacucc

SEQ ID NO: 1748727 - RNA, 16 nt, Salmonella enterica enterica serovar Typhi Ty2
ucuggaaucaauuucc

SEQ ID NO: 1748728 - RNA, 14 nt, Salmonella enterica enterica serovar Typhi Ty2
ucuggcucagacca

SEQ ID NO: 1748729 - RNA, 18 nt, Salmonella enterica enterica serovar Typhi Ty2
ucuggcgcuuuuccagca

SEQ ID NO: 1748730 - RNA, 14 nt, Salmonella enterica enterica serovar Typhi Ty2
ucuggcugcugaug

SEQ ID NO: 1748731 - RNA, 21 nt, Salmonella enterica enterica serovar Typhi Ty2
ucuggugcuguuuagccgucu

SEQ ID NO: 1748732 - RNA, 14 nt, Salmonella enterica enterica serovar Typhi Ty2
ucugguuauccacc

SEQ ID NO: 1748733 - RNA, 21 nt, Salmonella enterica enterica serovar Typhi Ty2
ucuguaagagacugacaauga

SEQ ID NO: 1748734 - RNA, 15 nt, Salmonella enterica enterica serovar Typhi Ty2
ucuguaccaccagaa

SEQ ID NO: 1748735 - RNA, 21 nt, Salmonella enterica enterica serovar Typhi Ty2
ucuguacagcgucgacagccc

SEQ ID NO: 1748736 - RNA, 18 nt, Salmonella enterica enterica serovar Typhi Ty2
ucuguacgcugaauaacc

SEQ ID NO: 1748737 - RNA, 16 nt, Salmonella enterica enterica serovar Typhi Ty2
ucuguacggcauauuc

SEQ ID NO: 1748738 - RNA, 21 nt, Salmonella enterica enterica serovar Typhi Ty2
ucuguaauucucccaaauuuu

SEQ ID NO: 1748739 - RNA, 19 nt, Salmonella enterica enterica serovar Typhi Ty2
ucuguccgcuuuuuuauug

SEQ ID NO: 1748740 - RNA, 18 nt, Salmonella enterica enterica serovar Typhi Ty2
ucugucucaauaaaaugu

SEQ ID NO: 1748741 - RNA, 19 nt, Salmonella enterica enterica serovar Typhi Ty2
ucuguggggcuuaacccac

SEQ ID NO: 1748742 - RNA, 16 nt, Salmonella enterica enterica serovar Typhi Ty2
ucucaucugaugauua

SEQ ID NO: 1748743 - RNA, 20 nt, Salmonella enterica enterica serovar Typhi Ty2
ucuacaugcccuucuuuaau

SEQ ID NO: 1748744 - RNA, 17 nt, Salmonella enterica enterica serovar Typhi Ty2
ucucauuauuaaauuaa

SEQ ID NO: 1748745 - RNA, 22 nt, Salmonella enterica enterica serovar Typhi Ty2
ucuccagggcaacggccagcgc

SEQ ID NO: 1748746 - RNA, 14 nt, Salmonella enterica enterica serovar Typhi Ty2
ucuccaguuugcgu

SEQ ID NO: 1748747 - RNA, 17 nt, Salmonella enterica enterica serovar Typhi Ty2
ucuccucgccagcuacc

SEQ ID NO: 1748748 - RNA, 14 nt, Salmonella enterica enterica serovar Typhi Ty2
ucuccggcaucuca

SEQ ID NO: 1748749 - RNA, 23 nt, Salmonella enterica enterica serovar Typhi Ty2
ucuccggcagcguauugagcugg

SEQ ID NO: 1748750 - RNA, 20 nt, Salmonella enterica enterica serovar Typhi Ty2
ucuccgggauagcaaucucg

SEQ ID NO: 1748751 - RNA, 15 nt, Salmonella enterica enterica serovar Typhi Ty2
ucucccuccccauuc

SEQ ID NO: 1748752 - RNA, 19 nt, Salmonella enterica enterica serovar Typhi Ty2
ucucccguuuguauaaauu

SEQ ID NO: 1748753 - RNA, 13 nt, Salmonella enterica enterica serovar Typhi Ty2
ucucccgggccgc

SEQ ID NO: 1748754 - RNA, 18 nt, Salmonella enterica enterica serovar Typhi Ty2
ucucccgaucuucugaug

SEQ ID NO: 1748755 - RNA, 19 nt, Salmonella enterica enterica serovar Typhi Ty2
ucuccgacauuguucuaaa

SEQ ID NO: 1748756 - RNA, 22 nt, Salmonella enterica enterica serovar Typhi Ty2
ucucccuacugcuuagcucauc

SEQ ID NO: 1748757 - RNA, 16 nt, Salmonella enterica enterica serovar Typhi Ty2
ucucccugccagugaa

SEQ ID NO: 1748758 - RNA, 14 nt, Salmonella enterica enterica serovar Typhi Ty2
ucuccugccagcga

SEQ ID NO: 1748759 - RNA, 19 nt, Salmonella enterica enterica serovar Typhi Ty2
ucuccuggcgcagcgcggg

SEQ ID NO: 1748760 - RNA, 19 nt, Salmonella enterica enterica serovar Typhi Ty2
ucucgcaagauuccagaua

SEQ ID NO: 1748761 - RNA, 19 nt, Salmonella enterica enterica serovar Typhi Ty2
ucucgaauccacuuuuguc

SEQ ID NO: 1748762 - RNA, 21 nt, Salmonella enterica enterica serovar Typhi Ty2
ucucggccuggcccggcaguu

SEQ ID NO: 1748763 - RNA, 12 nt, Salmonella enterica enterica serovar Typhi Ty2
ucucgucaaggu

SEQ ID NO: 1748764 - RNA, 14 nt, Salmonella enterica enterica serovar Typhi Ty2
ucucgucgccaggg

SEQ ID NO: 1748765 - RNA, 21 nt, Salmonella enterica enterica serovar Typhi Ty2
ucucguuuuugucuccucaug

SEQ ID NO: 1748766 - RNA, 14 nt, Salmonella enterica enterica serovar Typhi Ty2
ucucuacgccggcg

SEQ ID NO: 1748767 - RNA, 22 nt, Salmonella enterica enterica serovar Typhi Ty2
ucucuucguuauuuuccugaaa

SEQ ID NO: 1748768 - RNA, 14 nt, Salmonella enterica enterica serovar Typhi Ty2
ucucuucuuuuaca

SEQ ID NO: 1748769 - RNA, 21 nt, Salmonella enterica enterica serovar Typhi Ty2
ucucuugccagcgcauccacc

SEQ ID NO: 1748770 - RNA, 14 nt, Salmonella enterica enterica serovar Typhi Ty2
ucucuugccagcgc

SEQ ID NO: 1748771 - RNA, 17 nt, Salmonella enterica enterica serovar Typhi Ty2
ucucuugcauaauaucc

SEQ ID NO: 1748772 - RNA, 12 nt, Salmonella enterica enterica serovar Typhi Ty2
ucucuugccugc

SEQ ID NO: 1748773 - RNA, 12 nt, Salmonella enterica enterica serovar Typhi Ty2
ucucuuuauuga

SEQ ID NO: 1748774 - RNA, 13 nt, Salmonella enterica enterica serovar Typhi Ty2
ucucuuuauugaa

SEQ ID NO: 1748775 - RNA, 18 nt, Salmonella enterica enterica serovar Typhi Ty2
ucucuuaauguaaaacaa

SEQ ID NO: 1748776 - RNA, 17 nt, Salmonella enterica enterica serovar Typhi Ty2
ucucuuaaugccagcgg

SEQ ID NO: 1748777 - RNA, 14 nt, Salmonella enterica enterica serovar Typhi Ty2
ucucucccuggcag

SEQ ID NO: 1748778 - RNA, 20 nt, Salmonella enterica enterica serovar Typhi Ty2
ucucugaaaagaguagucuu

SEQ ID NO: 1748779 - RNA, 15 nt, Salmonella enterica enterica serovar Typhi Ty2
ucucucauuuucuuu

SEQ ID NO: 1748780 - RNA, 13 nt, Salmonella enterica enterica serovar Typhi Ty2
ucucuauuaaccg

SEQ ID NO: 1748781 - RNA, 18 nt, Salmonella enterica enterica serovar Typhi Ty2
ucucugguuucccugccu

SEQ ID NO: 1748782 - RNA, 15 nt, Salmonella enterica enterica serovar Typhi Ty2
ucugaaucagugcau

SEQ ID NO: 1748783 - RNA, 16 nt, Salmonella enterica enterica serovar Typhi Ty2
ucugaaucucuuccca

SEQ ID NO: 1748784 - RNA, 16 nt, Salmonella enterica enterica serovar Typhi Ty2
ucugaagcguaaaaau

SEQ ID NO: 1748785 - RNA, 13 nt, Salmonella enterica enterica serovar Typhi Ty2
ucucuuucagaau

SEQ ID NO: 1748786 - RNA, 13 nt, Salmonella enterica enterica serovar Typhi Ty2
ucucuuuuaauuu

SEQ ID NO: 1748787 - RNA, 14 nt, Salmonella enterica enterica serovar Typhi Ty2
ucucuuuugcuuca

SEQ ID NO: 1748788 - RNA, 14 nt, Salmonella enterica enterica serovar Typhi Ty2
ucucuuuuuuaggc

SEQ ID NO: 1748789 - RNA, 23 nt, Salmonella enterica enterica serovar Typhi Ty2
ucugaaaaaccgucggcaauaca

SEQ ID NO: 1748790 - RNA, 20 nt, Salmonella enterica enterica serovar Typhi Ty2
ucugauagcccuauucguga

SEQ ID NO: 1748791 - RNA, 21 nt, Salmonella enterica enterica serovar Typhi Ty2
ucugauagggacacauuucuu

SEQ ID NO: 1748792 - RNA, 14 nt, Salmonella enterica enterica serovar Typhi Ty2
ucugagaucaaaca

SEQ ID NO: 1748793 - RNA, 16 nt, Salmonella enterica enterica serovar Typhi Ty2
ucugcaagagaaauaa

SEQ ID NO: 1748794 - RNA, 14 nt, Salmonella enterica enterica serovar Typhi Ty2
ucugaugccugaag

SEQ ID NO: 1748795 - RNA, 14 nt, Salmonella enterica enterica serovar Typhi Ty2
gguguaccccgccu

SEQ ID NO: 1748796 - RNA, 14 nt, Salmonella enterica enterica serovar Typhi Ty2
ggugucagauccuu

SEQ ID NO: 1748797 - RNA, 16 nt, Salmonella enterica enterica serovar Typhi Ty2
ggugguuucccugacc

SEQ ID NO: 1748798 - RNA, 16 nt, Salmonella enterica enterica serovar Typhi Ty2
ggugggugaugacggg

SEQ ID NO: 1748799 - RNA, 19 nt, Salmonella enterica enterica serovar Typhi Ty2
gguggggcuaagugagcau

SEQ ID NO: 1748800 - RNA, 17 nt, Salmonella enterica enterica serovar Typhi Ty2
ggugggguucccgagcg

SEQ ID NO: 1748801 - RNA, 13 nt, Salmonella enterica enterica serovar Typhi Ty2
ggugcuguucuuc

SEQ ID NO: 1748802 - RNA, 14 nt, Salmonella enterica enterica serovar Typhi Ty2
ggugcccgcgugga

SEQ ID NO: 1748803 - RNA, 17 nt, Salmonella enterica enterica serovar Typhi Ty2
ggugcccgcaaaaccuu

SEQ ID NO: 1748804 - RNA, 18 nt, Salmonella enterica enterica serovar Typhi Ty2
ggugcuuagcuggccaau

SEQ ID NO: 1748805 - RNA, 17 nt, Salmonella enterica enterica serovar Typhi Ty2
gguuacaggugccuggg

SEQ ID NO: 1748806 - RNA, 23 nt, Salmonella enterica enterica serovar Typhi Ty2
gguuaccaaacccuuuggcaaaa

SEQ ID NO: 1748807 - RNA, 17 nt, Salmonella enterica enterica serovar Typhi Ty2
gguuacuauuuuucacc

SEQ ID NO: 1748808 - RNA, 16 nt, Salmonella enterica enterica serovar Typhi Ty2
gguuacucacugccgc

SEQ ID NO: 1748809 - RNA, 13 nt, Salmonella enterica enterica serovar Typhi Ty2
gguuaauggcagc

SEQ ID NO: 1748810 - RNA, 16 nt, Salmonella enterica enterica serovar Typhi Ty2
gguuaaucagcacauu

SEQ ID NO: 1748811 - RNA, 20 nt, Salmonella enterica enterica serovar Typhi Ty2
gguuaaugaaaucgucgcca

SEQ ID NO: 1748812 - RNA, 13 nt, Salmonella enterica enterica serovar Typhi Ty2
gguuaaggaugua

SEQ ID NO: 1748813 - RNA, 22 nt, Salmonella enterica enterica serovar Typhi Ty2
gguuauaaacccccuggccgga

SEQ ID NO: 1748814 - RNA, 14 nt, Salmonella enterica enterica serovar Typhi Ty2
gguuauccagcagg

SEQ ID NO: 1748815 - RNA, 20 nt, Salmonella enterica enterica serovar Typhi Ty2
gguuauuccgcuggaggcca

SEQ ID NO: 1748816 - RNA, 15 nt, Salmonella enterica enterica serovar Typhi Ty2
gguucaagucccccc

SEQ ID NO: 1748817 - RNA, 19 nt, Salmonella enterica enterica serovar Typhi Ty2
gguucaauacccuuuucuu

SEQ ID NO: 1748818 - RNA, 19 nt, Salmonella enterica enterica serovar Typhi Ty2
gguucaacgcgcugcagcu

SEQ ID NO: 1748819 - RNA, 22 nt, Salmonella enterica enterica serovar Typhi Ty2
gguucaccagcgcgccgccgcc

SEQ ID NO: 1748820 - RNA, 18 nt, Salmonella enterica enterica serovar Typhi Ty2
gguucaauaugccaggca

SEQ ID NO: 1748821 - RNA, 16 nt, Salmonella enterica enterica serovar Typhi Ty2
gguucacaauacagaa

SEQ ID NO: 1748822 - RNA, 22 nt, Salmonella enterica enterica serovar Typhi Ty2
gguucagcaacgugaacugcgc

SEQ ID NO: 1748823 - RNA, 22 nt, Salmonella enterica enterica serovar Typhi Ty2
gguuuaccauuacgcuauaaag

SEQ ID NO: 1748824 - RNA, 23 nt, Salmonella enterica enterica serovar Typhi Ty2
gguugcccgguggcgcugcgcuu

SEQ ID NO: 1748825 - RNA, 17 nt, Salmonella enterica enterica serovar Typhi Ty2
gguugcccgcaggcuuc

SEQ ID NO: 1748826 - RNA, 17 nt, Salmonella enterica enterica serovar Typhi Ty2
gguugcgaauaaacaca

SEQ ID NO: 1748827 - RNA, 14 nt, Salmonella enterica enterica serovar Typhi Ty2
gguugcgcaaccuc

SEQ ID NO: 1748828 - RNA, 22 nt, Salmonella enterica enterica serovar Typhi Ty2
gguugcccgguggcgcugcgcu

SEQ ID NO: 1748829 - RNA, 23 nt, Salmonella enterica enterica serovar Typhi Ty2
gguugcggcggggauaaucagca

SEQ ID NO: 1748830 - RNA, 19 nt, Salmonella enterica enterica serovar Typhi Ty2
gguucgcgaagugucuucc

SEQ ID NO: 1748831 - RNA, 20 nt, Salmonella enterica enterica serovar Typhi Ty2
gguugaaggucugacaacua

SEQ ID NO: 1748832 - RNA, 16 nt, Salmonella enterica enterica serovar Typhi Ty2
gguugacggcuacccc

SEQ ID NO: 1748833 - RNA, 18 nt, Salmonella enterica enterica serovar Typhi Ty2
gguugacuuacaaaaaau

SEQ ID NO: 1748834 - RNA, 22 nt, Salmonella enterica enterica serovar Typhi Ty2
gguugauaccggaggagugcgc

SEQ ID NO: 1748835 - RNA, 15 nt, Salmonella enterica enterica serovar Typhi Ty2
gguuuuuauggaagg

SEQ ID NO: 1748836 - RNA, 13 nt, Salmonella enterica enterica serovar Typhi Ty2
guaaaaaaauaaa

SEQ ID NO: 1748837 - RNA, 13 nt, Salmonella enterica enterica serovar Typhi Ty2
guaaaaaaaccgu

SEQ ID NO: 1748838 - RNA, 12 nt, Salmonella enterica enterica serovar Typhi Ty2
gguuuuuuaaug

SEQ ID NO: 1748839 - RNA, 22 nt, Salmonella enterica enterica serovar Typhi Ty2
gguuuuucgccgaccauccaga

SEQ ID NO: 1748840 - RNA, 18 nt, Salmonella enterica enterica serovar Typhi Ty2
guaaaaauuguuccugua

SEQ ID NO: 1748841 - RNA, 21 nt, Salmonella enterica enterica serovar Typhi Ty2
guaaaaauuuuugaucugcuu

SEQ ID NO: 1748842 - RNA, 20 nt, Salmonella enterica enterica serovar Typhi Ty2
guaaaacacgccuccauaca

SEQ ID NO: 1748843 - RNA, 13 nt, Salmonella enterica enterica serovar Typhi Ty2
gguuucccaguca

SEQ ID NO: 1748844 - RNA, 10 nt, Salmonella enterica enterica serovar Typhi Ty2
gguuuauccc

SEQ ID NO: 1748845 - RNA, 19 nt, Salmonella enterica enterica serovar Typhi Ty2
gguuucguggcgcuguucu

SEQ ID NO: 1748846 - RNA, 15 nt, Salmonella enterica enterica serovar Typhi Ty2
gguuucuggcaacag

SEQ ID NO: 1748847 - RNA, 18 nt, Salmonella enterica enterica serovar Typhi Ty2
gguuucgccuaagcccac

SEQ ID NO: 1748848 - RNA, 23 nt, Salmonella enterica enterica serovar Typhi Ty2
gguuugacccauuuuaaaaguua

SEQ ID NO: 1748849 - RNA, 20 nt, Salmonella enterica enterica serovar Typhi Ty2
gguuugugucguaguggcau

SEQ ID NO: 1748850 - RNA, 18 nt, Salmonella enterica enterica serovar Typhi Ty2
gguuuuaugcaucgcggu

SEQ ID NO: 1748851 - RNA, 21 nt, Salmonella enterica enterica serovar Typhi Ty2
gguccggcgcuaaccagcgcu

SEQ ID NO: 1748852 - RNA, 14 nt, Salmonella enterica enterica serovar Typhi Ty2
ggucgcggucggcc

SEQ ID NO: 1748853 - RNA, 22 nt, Salmonella enterica enterica serovar Typhi Ty2
ggucgcgccaaaagaggcagca

SEQ ID NO: 1748854 - RNA, 23 nt, Salmonella enterica enterica serovar Typhi Ty2
gguccucugauaagucccggacc

SEQ ID NO: 1748855 - RNA, 19 nt, Salmonella enterica enterica serovar Typhi Ty2
ggucgcuaacccaggccgg

SEQ ID NO: 1748856 - RNA, 16 nt, Salmonella enterica enterica serovar Typhi Ty2
ggucggcuccugguga

SEQ ID NO: 1748857 - RNA, 16 nt, Salmonella enterica enterica serovar Typhi Ty2
ggucgggcaggcuucc

SEQ ID NO: 1748858 - RNA, 21 nt, Salmonella enterica enterica serovar Typhi Ty2
ggucucucgugcaggccggau

SEQ ID NO: 1748859 - RNA, 20 nt, Salmonella enterica enterica serovar Typhi Ty2
ggucucuuaaugccagcggc

SEQ ID NO: 1748860 - RNA, 21 nt, Salmonella enterica enterica serovar Typhi Ty2
ggucuccgccuggaacccagg

SEQ ID NO: 1748861 - RNA, 19 nt, Salmonella enterica enterica serovar Typhi Ty2
ggucguacuaaagagcgcc

SEQ ID NO: 1748862 - RNA, 19 nt, Salmonella enterica enterica serovar Typhi Ty2
ggucucauagcgccccagu

SEQ ID NO: 1748863 - RNA, 13 nt, Salmonella enterica enterica serovar Typhi Ty2
ggucuccaucaga

SEQ ID NO: 1748864 - RNA, 12 nt, Salmonella enterica enterica serovar Typhi Ty2
ggugagcucuuu

SEQ ID NO: 1748865 - RNA, 15 nt, Salmonella enterica enterica serovar Typhi Ty2
ggugaggucggcggg

SEQ ID NO: 1748866 - RNA, 15 nt, Salmonella enterica enterica serovar Typhi Ty2
ggugaauaaauccuu

SEQ ID NO: 1748867 - RNA, 22 nt, Salmonella enterica enterica serovar Typhi Ty2
ggugaauaccagcggcaaacag

SEQ ID NO: 1748868 - RNA, 23 nt, Salmonella enterica enterica serovar Typhi Ty2
ggugccauauuguucaguuucaa

SEQ ID NO: 1748869 - RNA, 17 nt, Salmonella enterica enterica serovar Typhi Ty2
ggugccauuccagccgg

SEQ ID NO: 1748870 - RNA, 16 nt, Salmonella enterica enterica serovar Typhi Ty2
ggugaugcgcaacguu

SEQ ID NO: 1748871 - RNA, 23 nt, Salmonella enterica enterica serovar Typhi Ty2
ggugauuucgcccgcauucgcgg

SEQ ID NO: 1748872 - RNA, 21 nt, Salmonella enterica enterica serovar Typhi Ty2
ggucaucgaaggcaucuucag

SEQ ID NO: 1748873 - RNA, 19 nt, Salmonella enterica enterica serovar Typhi Ty2
ggucagcaacgccuccagc

SEQ ID NO: 1748874 - RNA, 19 nt, Salmonella enterica enterica serovar Typhi Ty2
ggucauucauugucuuuuu

SEQ ID NO: 1748875 - RNA, 20 nt, Salmonella enterica enterica serovar Typhi Ty2
gggugguuucccugaccagu

SEQ ID NO: 1748876 - RNA, 19 nt, Salmonella enterica enterica serovar Typhi Ty2
gguauagaauacuuccugc

SEQ ID NO: 1748877 - RNA, 21 nt, Salmonella enterica enterica serovar Typhi Ty2
gguagcgucagguagcccggc

SEQ ID NO: 1748878 - RNA, 21 nt, Salmonella enterica enterica serovar Typhi Ty2
gguauauaaaucaaaagugca

SEQ ID NO: 1748879 - RNA, 21 nt, Salmonella enterica enterica serovar Typhi Ty2
gguagcgcuuguuaucuggca

SEQ ID NO: 1748880 - RNA, 14 nt, Salmonella enterica enterica serovar Typhi Ty2
ggucaaaagcugca

SEQ ID NO: 1748881 - RNA, 18 nt, Salmonella enterica enterica serovar Typhi Ty2
gguauuucugaaaaaccg

SEQ ID NO: 1748882 - RNA, 19 nt, Salmonella enterica enterica serovar Typhi Ty2
gguauucguuaccagcauc

SEQ ID NO: 1748883 - RNA, 12 nt, Salmonella enterica enterica serovar Typhi Ty2
gguauccuccug

SEQ ID NO: 1748884 - RNA, 14 nt, Salmonella enterica enterica serovar Typhi Ty2
gguauccuccugcc

SEQ ID NO: 1748885 - RNA, 14 nt, Salmonella enterica enterica serovar Typhi Ty2
gguauccugaacca

SEQ ID NO: 1748886 - RNA, 14 nt, Salmonella enterica enterica serovar Typhi Ty2
gguaucagcgcguu

SEQ ID NO: 1748887 - RNA, 23 nt, Salmonella enterica enterica serovar Typhi Ty2
ggucacacuuaccgggcaucuga

SEQ ID NO: 1748888 - RNA, 19 nt, Salmonella enterica enterica serovar Typhi Ty2
ggucaauaagauauccugc

SEQ ID NO: 1748889 - RNA, 12 nt, Salmonella enterica enterica serovar Typhi Ty2
ggggcgcagaag

SEQ ID NO: 1748890 - RNA, 13 nt, Salmonella enterica enterica serovar Typhi Ty2
ggggcgaccggcu

SEQ ID NO: 1748891 - RNA, 13 nt, Salmonella enterica enterica serovar Typhi Ty2
ggggcaguaaauu

SEQ ID NO: 1748892 - RNA, 18 nt, Salmonella enterica enterica serovar Typhi Ty2
ggggccacaggcggcaug

SEQ ID NO: 1748893 - RNA, 20 nt, Salmonella enterica enterica serovar Typhi Ty2
gggcuuccacccgggaagcc

SEQ ID NO: 1748894 - RNA, 16 nt, Salmonella enterica enterica serovar Typhi Ty2
gggcuucagauguuug

SEQ ID NO: 1748895 - RNA, 22 nt, Salmonella enterica enterica serovar Typhi Ty2
gggcugauuuuuuugcuggccg

SEQ ID NO: 1748896 - RNA, 16 nt, Salmonella enterica enterica serovar Typhi Ty2
ggggauaaccagaaaa

SEQ ID NO: 1748897 - RNA, 16 nt, Salmonella enterica enterica serovar Typhi Ty2
ggggcaagcucuucgg

SEQ ID NO: 1748898 - RNA, 13 nt, Salmonella enterica enterica serovar Typhi Ty2
gggcgcugauuuu

SEQ ID NO: 1748899 - RNA, 23 nt, Salmonella enterica enterica serovar Typhi Ty2
gggccuacgagauaaaaacgggu

SEQ ID NO: 1748900 - RNA, 23 nt, Salmonella enterica enterica serovar Typhi Ty2
gggccuacagguacagaugcugu

SEQ ID NO: 1748901 - RNA, 17 nt, Salmonella enterica enterica serovar Typhi Ty2
gggcuaugcuccaguug

SEQ ID NO: 1748902 - RNA, 13 nt, Salmonella enterica enterica serovar Typhi Ty2
gggcuaugaagag

SEQ ID NO: 1748903 - RNA, 22 nt, Salmonella enterica enterica serovar Typhi Ty2
gggcucauuuuauccaacagcg

SEQ ID NO: 1748904 - RNA, 21 nt, Salmonella enterica enterica serovar Typhi Ty2
gggcuaaucgcaaacugcgcg

SEQ ID NO: 1748905 - RNA, 16 nt, Salmonella enterica enterica serovar Typhi Ty2
gggguuuuggccggac

SEQ ID NO: 1748906 - RNA, 22 nt, Salmonella enterica enterica serovar Typhi Ty2
gggguugaugguuauuccuugu

SEQ ID NO: 1748907 - RNA, 14 nt, Salmonella enterica enterica serovar Typhi Ty2
gggucaaaugcgaa

SEQ ID NO: 1748908 - RNA, 22 nt, Salmonella enterica enterica serovar Typhi Ty2
ggguaaugaucagcaaaauagu

SEQ ID NO: 1748909 - RNA, 12 nt, Salmonella enterica enterica serovar Typhi Ty2
ggguaauaacgg

SEQ ID NO: 1748910 - RNA, 11 nt, Salmonella enterica enterica serovar Typhi Ty2
ggguaauacug

SEQ ID NO: 1748911 - RNA, 22 nt, Salmonella enterica enterica serovar Typhi Ty2
gggucagcgggguucagaccag

SEQ ID NO: 1748912 - RNA, 17 nt, Salmonella enterica enterica serovar Typhi Ty2
gggugcagcgucaggaa

SEQ ID NO: 1748913 - RNA, 14 nt, Salmonella enterica enterica serovar Typhi Ty2
gggugcaaagaaac

SEQ ID NO: 1748914 - RNA, 14 nt, Salmonella enterica enterica serovar Typhi Ty2
ggggcuuaacccac

SEQ ID NO: 1748915 - RNA, 18 nt, Salmonella enterica enterica serovar Typhi Ty2
ggggcuuugugccgcaca

SEQ ID NO: 1748916 - RNA, 12 nt, Salmonella enterica enterica serovar Typhi Ty2
ggggugaaacag

SEQ ID NO: 1748917 - RNA, 22 nt, Salmonella enterica enterica serovar Typhi Ty2
ggggguaacguuguccagcaga

SEQ ID NO: 1748918 - RNA, 20 nt, Salmonella enterica enterica serovar Typhi Ty2
gggggccugauggcgcugcg

SEQ ID NO: 1748919 - RNA, 16 nt, Salmonella enterica enterica serovar Typhi Ty2
gggauuaucaggauga

SEQ ID NO: 1748920 - RNA, 15 nt, Salmonella enterica enterica serovar Typhi Ty2
gggauuuccuggcag

SEQ ID NO: 1748921 - RNA, 21 nt, Salmonella enterica enterica serovar Typhi Ty2
gggcaaaagggccauggcugg

SEQ ID NO: 1748922 - RNA, 22 nt, Salmonella enterica enterica serovar Typhi Ty2
gggagacuucuucagucagggc

SEQ ID NO: 1748923 - RNA, 20 nt, Salmonella enterica enterica serovar Typhi Ty2
gggcagaaacguaccugaga

SEQ ID NO: 1748924 - RNA, 20 nt, Salmonella enterica enterica serovar Typhi Ty2
gggcagacauucgcgcacgg

SEQ ID NO: 1748925 - RNA, 19 nt, Salmonella enterica enterica serovar Typhi Ty2
gggcacuccggcucgcaca

SEQ ID NO: 1748926 - RNA, 12 nt, Salmonella enterica enterica serovar Typhi Ty2
gggcagaaacgu

SEQ ID NO: 1748927 - RNA, 13 nt, Salmonella enterica enterica serovar Typhi Ty2
gggcaacggccag

SEQ ID NO: 1748928 - RNA, 10 nt, Salmonella enterica enterica serovar Typhi Ty2
gggccgccgc

SEQ ID NO: 1748929 - RNA, 14 nt, Salmonella enterica enterica serovar Typhi Ty2
gggccgccgcagca

SEQ ID NO: 1748930 - RNA, 20 nt, Salmonella enterica enterica serovar Typhi Ty2
gggccauacacucaaccaac

SEQ ID NO: 1748931 - RNA, 17 nt, Salmonella enterica enterica serovar Typhi Ty2
ggcuugccagauagaca

SEQ ID NO: 1748932 - RNA, 22 nt, Salmonella enterica enterica serovar Typhi Ty2
ggcuugaucgcgcagcaaauca

SEQ ID NO: 1748933 - RNA, 20 nt, Salmonella enterica enterica serovar Typhi Ty2
ggcuugaguuuuucucgcaa

SEQ ID NO: 1748934 - RNA, 18 nt, Salmonella enterica enterica serovar Typhi Ty2
ggcuucaaccguuucuuu

SEQ ID NO: 1748935 - RNA, 23 nt, Salmonella enterica enterica serovar Typhi Ty2
ggcuguggcguuuuaccgcccga

SEQ ID NO: 1748936 - RNA, 21 nt, Salmonella enterica enterica serovar Typhi Ty2
ggcuuacuuuccaaaauccag

SEQ ID NO: 1748937 - RNA, 12 nt, Salmonella enterica enterica serovar Typhi Ty2
ggccgccagggg

SEQ ID NO: 1748938 - RNA, 16 nt, Salmonella enterica enterica serovar Typhi Ty2
ggcugucgcggcggca

SEQ ID NO: 1748939 - RNA, 13 nt, Salmonella enterica enterica serovar Typhi Ty2
ggcugucgauccc

SEQ ID NO: 1748940 - RNA, 16 nt, Salmonella enterica enterica serovar Typhi Ty2
gggaaguaaggcauga

SEQ ID NO: 1748941 - RNA, 23 nt, Salmonella enterica enterica serovar Typhi Ty2
gggaaguugcccuuaucuggaug

SEQ ID NO: 1748942 - RNA, 24 nt, Salmonella enterica enterica serovar Typhi Ty2
gggaagaucauuaucaauagcuuc

SEQ ID NO: 1748943 - RNA, 18 nt, Salmonella enterica enterica serovar Typhi Ty2
gggaagaugugccacucc

SEQ ID NO: 1748944 - RNA, 14 nt, Salmonella enterica enterica serovar Typhi Ty2
ggcuuugcugcugc

SEQ ID NO: 1748945 - RNA, 14 nt, Salmonella enterica enterica serovar Typhi Ty2
ggcuuuuaucgaca

SEQ ID NO: 1748946 - RNA, 23 nt, Salmonella enterica enterica serovar Typhi Ty2
gggacuaucgaaagagcaaauac

SEQ ID NO: 1748947 - RNA, 23 nt, Salmonella enterica enterica serovar Typhi Ty2
gggacguuucgauaaccaccagc

SEQ ID NO: 1748948 - RNA, 13 nt, Salmonella enterica enterica serovar Typhi Ty2
gggacgcugcuga

SEQ ID NO: 1748949 - RNA, 16 nt, Salmonella enterica enterica serovar Typhi Ty2
gggacggcggccagca

SEQ ID NO: 1748950 - RNA, 23 nt, Salmonella enterica enterica serovar Typhi Ty2
gggacgaauuuccagcgggcgau

SEQ ID NO: 1748951 - RNA, 15 nt, Salmonella enterica enterica serovar Typhi Ty2
gggacacugccggcu

SEQ ID NO: 1748952 - RNA, 12 nt, Salmonella enterica enterica serovar Typhi Ty2
gggacacucaag

SEQ ID NO: 1748953 - RNA, 19 nt, Salmonella enterica enterica serovar Typhi Ty2
gucguuuucacuuguucaa

SEQ ID NO: 1748954 - RNA, 19 nt, Salmonella enterica enterica serovar Typhi Ty2
gucuacccgguguaaaaaa

SEQ ID NO: 1748955 - RNA, 16 nt, Salmonella enterica enterica serovar Typhi Ty2
gucucccaaaugaaaa

SEQ ID NO: 1748956 - RNA, 18 nt, Salmonella enterica enterica serovar Typhi Ty2
gucucauuauuaaauuaa

SEQ ID NO: 1748957 - RNA, 21 nt, Salmonella enterica enterica serovar Typhi Ty2
gucucauuguguacauccaga

SEQ ID NO: 1748958 - RNA, 16 nt, Salmonella enterica enterica serovar Typhi Ty2
gucuccucagcaggcg

SEQ ID NO: 1748959 - RNA, 18 nt, Salmonella enterica enterica serovar Typhi Ty2
gucuccggcgcgccgcug

SEQ ID NO: 1748960 - RNA, 16 nt, Salmonella enterica enterica serovar Typhi Ty2
gucucccuccugcucc

SEQ ID NO: 1748961 - RNA, 17 nt, Salmonella enterica enterica serovar Typhi Ty2
gucucccaaaugaaaaa

SEQ ID NO: 1748962 - RNA, 17 nt, Salmonella enterica enterica serovar Typhi Ty2
gucuauugccuaaauaa

SEQ ID NO: 1748963 - RNA, 15 nt, Salmonella enterica enterica serovar Typhi Ty2
gucuaugguacacau

SEQ ID NO: 1748964 - RNA, 16 nt, Salmonella enterica enterica serovar Typhi Ty2
gucuaucgcuccuccc

SEQ ID NO: 1748965 - RNA, 19 nt, Salmonella enterica enterica serovar Typhi Ty2
gucucaucggucgcaucca

SEQ ID NO: 1748966 - RNA, 22 nt, Salmonella enterica enterica serovar Typhi Ty2
gucguaccguuaaucgauuuuc

SEQ ID NO: 1748967 - RNA, 15 nt, Salmonella enterica enterica serovar Typhi Ty2
gucgguuccagcgug

SEQ ID NO: 1748968 - RNA, 16 nt, Salmonella enterica enterica serovar Typhi Ty2
gucgucauaucgaugg

SEQ ID NO: 1748969 - RNA, 22 nt, Salmonella enterica enterica serovar Typhi Ty2
gucguauccccagucuuccugc

SEQ ID NO: 1748970 - RNA, 21 nt, Salmonella enterica enterica serovar Typhi Ty2
gucgucgauuuucugcucaau

SEQ ID NO: 1748971 - RNA, 19 nt, Salmonella enterica enterica serovar Typhi Ty2
gucgucgauuuucugcuca

SEQ ID NO: 1748972 - RNA, 17 nt, Salmonella enterica enterica serovar Typhi Ty2
gucguauuuauuuucug

SEQ ID NO: 1748973 - RNA, 18 nt, Salmonella enterica enterica serovar Typhi Ty2
gucguccucaggccggau

SEQ ID NO: 1748974 - RNA, 21 nt, Salmonella enterica enterica serovar Typhi Ty2
gucgugccugacguccacgga

SEQ ID NO: 1748975 - RNA, 22 nt, Salmonella enterica enterica serovar Typhi Ty2
gucguuacugcucguagcguuu

SEQ ID NO: 1748976 - RNA, 13 nt, Salmonella enterica enterica serovar Typhi Ty2
gucguucacguaa

SEQ ID NO: 1748977 - RNA, 15 nt, Salmonella enterica enterica serovar Typhi Ty2
gucguggguucgaau

SEQ ID NO: 1748978 - RNA, 13 nt, Salmonella enterica enterica serovar Typhi Ty2
gucgggaauugcc

SEQ ID NO: 1748979 - RNA, 15 nt, Salmonella enterica enterica serovar Typhi Ty2
gucggcuuuuguucc

SEQ ID NO: 1748980 - RNA, 17 nt, Salmonella enterica enterica serovar Typhi Ty2
gucgggccgcgcugcgc

SEQ ID NO: 1748981 - RNA, 23 nt, Salmonella enterica enterica serovar Typhi Ty2
gucggaaaucuguuccagcgagc

SEQ ID NO: 1748982 - RNA, 17 nt, Salmonella enterica enterica serovar Typhi Ty2
gucggcaaucaccugca

SEQ ID NO: 1748983 - RNA, 18 nt, Salmonella enterica enterica serovar Typhi Ty2
gucgcgacguccgccaac

SEQ ID NO: 1748984 - RNA, 18 nt, Salmonella enterica enterica serovar Typhi Ty2
gucgcgccauuccgcaga

SEQ ID NO: 1748985 - RNA, 22 nt, Salmonella enterica enterica serovar Typhi Ty2
gucgcgccaaaagaggcagcaa

SEQ ID NO: 1748986 - RNA, 16 nt, Salmonella enterica enterica serovar Typhi Ty2
gucgcgcccuccucca

SEQ ID NO: 1748987 - RNA, 15 nt, Salmonella enterica enterica serovar Typhi Ty2
gucgaugucgccgcc

SEQ ID NO: 1748988 - RNA, 13 nt, Salmonella enterica enterica serovar Typhi Ty2
gucgaugauuuuc

SEQ ID NO: 1748989 - RNA, 15 nt, Salmonella enterica enterica serovar Typhi Ty2
gucgaucucggccac

SEQ ID NO: 1748990 - RNA, 20 nt, Salmonella enterica enterica serovar Typhi Ty2
gucgagcaucuccagcgcau

SEQ ID NO: 1748991 - RNA, 22 nt, Salmonella enterica enterica serovar Typhi Ty2
guccgcucacgauaaugaaccu

SEQ ID NO: 1748992 - RNA, 18 nt, Salmonella enterica enterica serovar Typhi Ty2
guccgguauugauuagcu

SEQ ID NO: 1748993 - RNA, 16 nt, Salmonella enterica enterica serovar Typhi Ty2
guccgguccgguggcg

SEQ ID NO: 1748994 - RNA, 14 nt, Salmonella enterica enterica serovar Typhi Ty2
guccuccauggcuu

SEQ ID NO: 1748995 - RNA, 20 nt, Salmonella enterica enterica serovar Typhi Ty2
guccgguugcaguacaggca

SEQ ID NO: 1748996 - RNA, 22 nt, Salmonella enterica enterica serovar Typhi Ty2
guccguauuauccacccccgca

SEQ ID NO: 1748997 - RNA, 17 nt, Salmonella enterica enterica serovar Typhi Ty2
guccgccuaccagcaca

SEQ ID NO: 1748998 - RNA, 17 nt, Salmonella enterica enterica serovar Typhi Ty2
gucccucuccagggcaa

SEQ ID NO: 1748999 - RNA, 19 nt, Salmonella enterica enterica serovar Typhi Ty2
gucccugauguagcugggu

SEQ ID NO: 1749000 - RNA, 18 nt, Salmonella enterica enterica serovar Typhi Ty2
guccauugcgagaaaaaa

SEQ ID NO: 1749001 - RNA, 21 nt, Salmonella enterica enterica serovar Typhi Ty2
guccauuacucucauguucaa

SEQ ID NO: 1749002 - RNA, 16 nt, Salmonella enterica enterica serovar Typhi Ty2
guccauugcgagaaaa

SEQ ID NO: 1749003 - RNA, 24 nt, Salmonella enterica enterica serovar Typhi Ty2
guccauuuauugcagguauugagu

SEQ ID NO: 1749004 - RNA, 14 nt, Salmonella enterica enterica serovar Typhi Ty2
guccauuuuccuau

SEQ ID NO: 1749005 - RNA, 14 nt, Salmonella enterica enterica serovar Typhi Ty2
guccauuuuuuauc

SEQ ID NO: 1749006 - RNA, 18 nt, Salmonella enterica enterica serovar Typhi Ty2
gucccggcagugcauaaa

SEQ ID NO: 1749007 - RNA, 13 nt, Salmonella enterica enterica serovar Typhi Ty2
gucccggcagugc

SEQ ID NO: 1749008 - RNA, 22 nt, Salmonella enterica enterica serovar Typhi Ty2
guccuuuacugcgccagccugc

SEQ ID NO: 1749009 - RNA, 21 nt, Salmonella enterica enterica serovar Typhi Ty2
guccuuuaucugcccuuucuu

SEQ ID NO: 1749010 - RNA, 22 nt, Salmonella enterica enterica serovar Typhi Ty2
guccucggcaacauaccgggua

SEQ ID NO: 1749011 - RNA, 18 nt, Salmonella enterica enterica serovar Typhi Ty2
gucgaacuuacgacgcgc

SEQ ID NO: 1749012 - RNA, 21 nt, Salmonella enterica enterica serovar Typhi Ty2
gucgagaaaccgcucgccgcc

SEQ ID NO: 1749013 - RNA, 17 nt, Salmonella enterica enterica serovar Typhi Ty2
gucgacgccuuccacuu

SEQ ID NO: 1749014 - RNA, 16 nt, Salmonella enterica enterica serovar Typhi Ty2
gucgacgucuuucuua

SEQ ID NO: 1749015 - RNA, 21 nt, Salmonella enterica enterica serovar Typhi Ty2
gucgacauaauuuccggccag

SEQ ID NO: 1749016 - RNA, 22 nt, Salmonella enterica enterica serovar Typhi Ty2
gucgacauaauuuccggccagu

SEQ ID NO: 1749017 - RNA, 19 nt, Salmonella enterica enterica serovar Typhi Ty2
gucgaccgcagaccggaug

SEQ ID NO: 1749018 - RNA, 20 nt, Salmonella enterica enterica serovar Typhi Ty2
guccagcgcggguucuuucc

SEQ ID NO: 1749019 - RNA, 13 nt, Salmonella enterica enterica serovar Typhi Ty2
guccagcgcguga

SEQ ID NO: 1749020 - RNA, 14 nt, Salmonella enterica enterica serovar Typhi Ty2
guccagcggcagcu

SEQ ID NO: 1749021 - RNA, 16 nt, Salmonella enterica enterica serovar Typhi Ty2
guccagccggugguuc

SEQ ID NO: 1749022 - RNA, 15 nt, Salmonella enterica enterica serovar Typhi Ty2
guccagggaaaaaua

SEQ ID NO: 1749023 - RNA, 19 nt, Salmonella enterica enterica serovar Typhi Ty2
guccagauagggccaggcg

SEQ ID NO: 1749024 - RNA, 15 nt, Salmonella enterica enterica serovar Typhi Ty2
guccagaugcugggc

SEQ ID NO: 1749025 - RNA, 21 nt, Salmonella enterica enterica serovar Typhi Ty2
guccagauuacgcauggucaa

SEQ ID NO: 1749026 - RNA, 20 nt, Salmonella enterica enterica serovar Typhi Ty2
guccacguucaaaucgauga

SEQ ID NO: 1749027 - RNA, 15 nt, Salmonella enterica enterica serovar Typhi Ty2
guccacgacaauauc

SEQ ID NO: 1749028 - RNA, 19 nt, Salmonella enterica enterica serovar Typhi Ty2
guccacgacaauauccucg

SEQ ID NO: 1749029 - RNA, 20 nt, Salmonella enterica enterica serovar Typhi Ty2
gucaucaaauuaucuguuga

SEQ ID NO: 1749030 - RNA, 20 nt, Salmonella enterica enterica serovar Typhi Ty2
gucauaucugaugcucgccg

SEQ ID NO: 1749031 - RNA, 15 nt, Salmonella enterica enterica serovar Typhi Ty2
gucauaucauccagc

SEQ ID NO: 1749032 - RNA, 22 nt, Salmonella enterica enterica serovar Typhi Ty2
gucaucaggcgguguuguuuua

SEQ ID NO: 1749033 - RNA, 12 nt, Salmonella enterica enterica serovar Typhi Ty2
gucaucccgaac

SEQ ID NO: 1749034 - RNA, 18 nt, Salmonella enterica enterica serovar Typhi Ty2
gucaucauuacaggcgaa

SEQ ID NO: 1749035 - RNA, 15 nt, Salmonella enterica enterica serovar Typhi Ty2
gucaucauuacaggc

SEQ ID NO: 1749036 - RNA, 11 nt, Salmonella enterica enterica serovar Typhi Ty2
gucauccgcgu

SEQ ID NO: 1749037 - RNA, 22 nt, Salmonella enterica enterica serovar Typhi Ty2
gucaucccgguuucccgcguga

SEQ ID NO: 1749038 - RNA, 18 nt, Salmonella enterica enterica serovar Typhi Ty2
gucauccugcaggcggca

SEQ ID NO: 1749039 - RNA, 16 nt, Salmonella enterica enterica serovar Typhi Ty2
gucauccggcauaaga

SEQ ID NO: 1749040 - RNA, 12 nt, Salmonella enterica enterica serovar Typhi Ty2
gucauccuuccc

SEQ ID NO: 1749041 - RNA, 16 nt, Salmonella enterica enterica serovar Typhi Ty2
guccacacaggccugc

SEQ ID NO: 1749042 - RNA, 24 nt, Salmonella enterica enterica serovar Typhi Ty2
guccacauccagcgccagcgccac

SEQ ID NO: 1749043 - RNA, 23 nt, Salmonella enterica enterica serovar Typhi Ty2
guccaacaaggauauccgccagu

SEQ ID NO: 1749044 - RNA, 15 nt, Salmonella enterica enterica serovar Typhi Ty2
gucauguccagggca

SEQ ID NO: 1749045 - RNA, 23 nt, Salmonella enterica enterica serovar Typhi Ty2
gucauguccagggcauucauugu

SEQ ID NO: 1749046 - RNA, 22 nt, Salmonella enterica enterica serovar Typhi Ty2
gucaugcuucaccucagcaaaa

SEQ ID NO: 1749047 - RNA, 15 nt, Salmonella enterica enterica serovar Typhi Ty2
gucaugcuaaaacag

SEQ ID NO: 1749048 - RNA, 22 nt, Salmonella enterica enterica serovar Typhi Ty2
gucaugccuucauagagaaguc

SEQ ID NO: 1749049 - RNA, 17 nt, Salmonella enterica enterica serovar Typhi Ty2
gucaugcgggagcuugg

SEQ ID NO: 1749050 - RNA, 18 nt, Salmonella enterica enterica serovar Typhi Ty2
guauuucugaaaaaccgu

SEQ ID NO: 1749051 - RNA, 18 nt, Salmonella enterica enterica serovar Typhi Ty2
guauuucgcagcggucag

SEQ ID NO: 1749052 - RNA, 17 nt, Salmonella enterica enterica serovar Typhi Ty2
guauuuccauuuuucag

SEQ ID NO: 1749053 - RNA, 11 nt, Salmonella enterica enterica serovar Typhi Ty2
guauuuauucu

SEQ ID NO: 1749054 - RNA, 13 nt, Salmonella enterica enterica serovar Typhi Ty2
guauuuauccagc

SEQ ID NO: 1749055 - RNA, 12 nt, Salmonella enterica enterica serovar Typhi Ty2
guauugugcuua

SEQ ID NO: 1749056 - RNA, 16 nt, Salmonella enterica enterica serovar Typhi Ty2
guauugcuuucaauuu

SEQ ID NO: 1749057 - RNA, 15 nt, Salmonella enterica enterica serovar Typhi Ty2
guauugcaccuggga

SEQ ID NO: 1749058 - RNA, 14 nt, Salmonella enterica enterica serovar Typhi Ty2
guauugcaccuggg

SEQ ID NO: 1749059 - RNA, 16 nt, Salmonella enterica enterica serovar Typhi Ty2
guauugauuuuuaaaa

SEQ ID NO: 1749060 - RNA, 14 nt, Salmonella enterica enterica serovar Typhi Ty2
guauugaagcgaua

SEQ ID NO: 1749061 - RNA, 20 nt, Salmonella enterica enterica serovar Typhi Ty2
guauucugcgccagccagcu

SEQ ID NO: 1749062 - RNA, 14 nt, Salmonella enterica enterica serovar Typhi Ty2
guauucguuaccag

SEQ ID NO: 1749063 - RNA, 13 nt, Salmonella enterica enterica serovar Typhi Ty2
guauucuaacuga

SEQ ID NO: 1749064 - RNA, 18 nt, Salmonella enterica enterica serovar Typhi Ty2
guauucgguggaaaccgc

SEQ ID NO: 1749065 - RNA, 16 nt, Salmonella enterica enterica serovar Typhi Ty2
guauucggaauaaugu

SEQ ID NO: 1749066 - RNA, 17 nt, Salmonella enterica enterica serovar Typhi Ty2
guauuccguuccuucuu

SEQ ID NO: 1749067 - RNA, 16 nt, Salmonella enterica enterica serovar Typhi Ty2
gucacgacguauuaaa

SEQ ID NO: 1749068 - RNA, 16 nt, Salmonella enterica enterica serovar Typhi Ty2
gucacgauccgcaaau

SEQ ID NO: 1749069 - RNA, 20 nt, Salmonella enterica enterica serovar Typhi Ty2
gucaccagcagcauuucaaa

SEQ ID NO: 1749070 - RNA, 13 nt, Salmonella enterica enterica serovar Typhi Ty2
gucaccagcagca

SEQ ID NO: 1749071 - RNA, 16 nt, Salmonella enterica enterica serovar Typhi Ty2
gucaaucgccugcugu

SEQ ID NO: 1749072 - RNA, 16 nt, Salmonella enterica enterica serovar Typhi Ty2
gucaauauuaaugcug

SEQ ID NO: 1749073 - RNA, 21 nt, Salmonella enterica enterica serovar Typhi Ty2
gucacaaucguucucaggaag

SEQ ID NO: 1749074 - RNA, 13 nt, Salmonella enterica enterica serovar Typhi Ty2
gucaaacgcuauc

SEQ ID NO: 1749075 - RNA, 18 nt, Salmonella enterica enterica serovar Typhi Ty2
gucaaacuuuuauaaaua

SEQ ID NO: 1749076 - RNA, 23 nt, Salmonella enterica enterica serovar Typhi Ty2
gucaaagaaaacuuucauuucac

SEQ ID NO: 1749077 - RNA, 13 nt, Salmonella enterica enterica serovar Typhi Ty2
gucaaaaugauca

SEQ ID NO: 1749078 - RNA, 19 nt, Salmonella enterica enterica serovar Typhi Ty2
gucaaacaguucagacacc

SEQ ID NO: 1749079 - RNA, 14 nt, Salmonella enterica enterica serovar Typhi Ty2
gucaauaagccaga

SEQ ID NO: 1749080 - RNA, 18 nt, Salmonella enterica enterica serovar Typhi Ty2
gucaauaaagacuggccc

SEQ ID NO: 1749081 - RNA, 22 nt, Salmonella enterica enterica serovar Typhi Ty2
gucaaaugggaucuucaaugaa

SEQ ID NO: 1749082 - RNA, 18 nt, Salmonella enterica enterica serovar Typhi Ty2
gucaaauuaagaaaguag

SEQ ID NO: 1749083 - RNA, 21 nt, Salmonella enterica enterica serovar Typhi Ty2
gucaaauucacccguuauuca

SEQ ID NO: 1749084 - RNA, 22 nt, Salmonella enterica enterica serovar Typhi Ty2
guaucugucccagccuuccugg

SEQ ID NO: 1749085 - RNA, 13 nt, Salmonella enterica enterica serovar Typhi Ty2
guaucuuccagcg

SEQ ID NO: 1749086 - RNA, 18 nt, Salmonella enterica enterica serovar Typhi Ty2
guaucguguuauuuucaa

SEQ ID NO: 1749087 - RNA, 14 nt, Salmonella enterica enterica serovar Typhi Ty2
guauccuuccagcc

SEQ ID NO: 1749088 - RNA, 13 nt, Salmonella enterica enterica serovar Typhi Ty2
guaucgcucugcu

SEQ ID NO: 1749089 - RNA, 22 nt, Salmonella enterica enterica serovar Typhi Ty2
guaucguuugcccaucauucaa

SEQ ID NO: 1749090 - RNA, 13 nt, Salmonella enterica enterica serovar Typhi Ty2
guaugccuuccag

SEQ ID NO: 1749091 - RNA, 16 nt, Salmonella enterica enterica serovar Typhi Ty2
guaugcggucaaaagc

SEQ ID NO: 1749092 - RNA, 22 nt, Salmonella enterica enterica serovar Typhi Ty2
guaugccucgcgcaccauaaua

SEQ ID NO: 1749093 - RNA, 20 nt, Salmonella enterica enterica serovar Typhi Ty2
guaugauuuucuuauuacaa

SEQ ID NO: 1749094 - RNA, 15 nt, Salmonella enterica enterica serovar Typhi Ty2
guaugguggcggggu

SEQ ID NO: 1749095 - RNA, 17 nt, Salmonella enterica enterica serovar Typhi Ty2
guauuaacgcuuugcca

SEQ ID NO: 1749096 - RNA, 12 nt, Salmonella enterica enterica serovar Typhi Ty2
guauuaaauaca

SEQ ID NO: 1749097 - RNA, 23 nt, Salmonella enterica enterica serovar Typhi Ty2
guauuacaugccguuaauaaugu

SEQ ID NO: 1749098 - RNA, 18 nt, Salmonella enterica enterica serovar Typhi Ty2
guauuacaagcaguuaau

SEQ ID NO: 1749099 - RNA, 20 nt, Salmonella enterica enterica serovar Typhi Ty2
guauuacaaguaauaaaaua

SEQ ID NO: 1749100 - RNA, 16 nt, Salmonella enterica enterica serovar Typhi Ty2
guauccggucaauaca

SEQ ID NO: 1749101 - RNA, 19 nt, Salmonella enterica enterica serovar Typhi Ty2
guauccggccugcagggaa

SEQ ID NO: 1749102 - RNA, 13 nt, Salmonella enterica enterica serovar Typhi Ty2
guauccuccugcc

SEQ ID NO: 1749103 - RNA, 12 nt, Salmonella enterica enterica serovar Typhi Ty2
guaucccgccag

SEQ ID NO: 1749104 - RNA, 12 nt, Salmonella enterica enterica serovar Typhi Ty2
guaucccaaacg

SEQ ID NO: 1749105 - RNA, 18 nt, Salmonella enterica enterica serovar Typhi Ty2
guauccccagucuuccug

SEQ ID NO: 1749106 - RNA, 21 nt, Salmonella enterica enterica serovar Typhi Ty2
guauccauucucaucagaccg

SEQ ID NO: 1749107 - RNA, 11 nt, Salmonella enterica enterica serovar Typhi Ty2
guaucaucgcu

SEQ ID NO: 1749108 - RNA, 15 nt, Salmonella enterica enterica serovar Typhi Ty2
guaucaucgauuuua

SEQ ID NO: 1749109 - RNA, 21 nt, Salmonella enterica enterica serovar Typhi Ty2
guauccacccgguuuaccauu

SEQ ID NO: 1749110 - RNA, 18 nt, Salmonella enterica enterica serovar Typhi Ty2
guaucacugauauaaccc

SEQ ID NO: 1749111 - RNA, 16 nt, Salmonella enterica enterica serovar Typhi Ty2
guaucacuguaaaagg

SEQ ID NO: 1749112 - RNA, 16 nt, Salmonella enterica enterica serovar Typhi Ty2
guaucacugaagagag

SEQ ID NO: 1749113 - RNA, 14 nt, Salmonella enterica enterica serovar Typhi Ty2
guaucacgcgugcg

SEQ ID NO: 1749114 - RNA, 20 nt, Salmonella enterica enterica serovar Typhi Ty2
guagcgucaauacaccucgg

SEQ ID NO: 1749115 - RNA, 21 nt, Salmonella enterica enterica serovar Typhi Ty2
guagcgucagguagcccggca

SEQ ID NO: 1749116 - RNA, 14 nt, Salmonella enterica enterica serovar Typhi Ty2
guagcgucaaugau

SEQ ID NO: 1749117 - RNA, 14 nt, Salmonella enterica enterica serovar Typhi Ty2
guagcuggcugccg

SEQ ID NO: 1749118 - RNA, 18 nt, Salmonella enterica enterica serovar Typhi Ty2
guagcuggucgccagcgc

SEQ ID NO: 1749119 - RNA, 15 nt, Salmonella enterica enterica serovar Typhi Ty2
guagcuucagcugga

SEQ ID NO: 1749120 - RNA, 16 nt, Salmonella enterica enterica serovar Typhi Ty2
guagcuuuuccgcugg

SEQ ID NO: 1749121 - RNA, 14 nt, Salmonella enterica enterica serovar Typhi Ty2
guauagaaauagcc

SEQ ID NO: 1749122 - RNA, 21 nt, Salmonella enterica enterica serovar Typhi Ty2
guauagcggcguuuauauaaa

SEQ ID NO: 1749123 - RNA, 18 nt, Salmonella enterica enterica serovar Typhi Ty2
guagcggcaacagcacca

SEQ ID NO: 1749124 - RNA, 21 nt, Salmonella enterica enterica serovar Typhi Ty2
guagcggcaacagcaccagaa

SEQ ID NO: 1749125 - RNA, 14 nt, Salmonella enterica enterica serovar Typhi Ty2
guagcggcgccggg

SEQ ID NO: 1749126 - RNA, 16 nt, Salmonella enterica enterica serovar Typhi Ty2
guagcguacaggcgga

SEQ ID NO: 1749127 - RNA, 17 nt, Salmonella enterica enterica serovar Typhi Ty2
guagccgcgcgccgccu

SEQ ID NO: 1749128 - RNA, 20 nt, Salmonella enterica enterica serovar Typhi Ty2
guagccgcagaaccauuucc

SEQ ID NO: 1749129 - RNA, 20 nt, Salmonella enterica enterica serovar Typhi Ty2
guagccagagcgcgcuggca

SEQ ID NO: 1749130 - RNA, 20 nt, Salmonella enterica enterica serovar Typhi Ty2
guagccaaaauuuacgggga

SEQ ID NO: 1749131 - RNA, 17 nt, Salmonella enterica enterica serovar Typhi Ty2
guagccacgcccgccgc

SEQ ID NO: 1749132 - RNA, 19 nt, Salmonella enterica enterica serovar Typhi Ty2
guagccacgcccgccgccu

SEQ ID NO: 1749133 - RNA, 18 nt, Salmonella enterica enterica serovar Typhi Ty2
guagcaguguaucgaaga

SEQ ID NO: 1749134 - RNA, 20 nt, Salmonella enterica enterica serovar Typhi Ty2
guagauggcgcuaaaaccgu

SEQ ID NO: 1749135 - RNA, 23 nt, Salmonella enterica enterica serovar Typhi Ty2
guagcaacccuggcgcuuuaaac

SEQ ID NO: 1749136 - RNA, 24 nt, Salmonella enterica enterica serovar Typhi Ty2
guagaacguauuauuauuacgcau

SEQ ID NO: 1749137 - RNA, 16 nt, Salmonella enterica enterica serovar Typhi Ty2
guagaaaaagguaacu

SEQ ID NO: 1749138 - RNA, 16 nt, Salmonella enterica enterica serovar Typhi Ty2
guaccagcgcccgagc

SEQ ID NO: 1749139 - RNA, 15 nt, Salmonella enterica enterica serovar Typhi Ty2
guaccacgccgcaca

SEQ ID NO: 1749140 - RNA, 13 nt, Salmonella enterica enterica serovar Typhi Ty2
guacaucauuggc

SEQ ID NO: 1749141 - RNA, 23 nt, Salmonella enterica enterica serovar Typhi Ty2
guacauauacugucuuguggaac

SEQ ID NO: 1749142 - RNA, 11 nt, Salmonella enterica enterica serovar Typhi Ty2
guacauaucca

SEQ ID NO: 1749143 - RNA, 13 nt, Salmonella enterica enterica serovar Typhi Ty2
guacaucuuccau

SEQ ID NO: 1749144 - RNA, 20 nt, Salmonella enterica enterica serovar Typhi Ty2
guaccuuuaucuugaccuga

SEQ ID NO: 1749145 - RNA, 20 nt, Salmonella enterica enterica serovar Typhi Ty2
guaccugcggcaauggcuca

SEQ ID NO: 1749146 - RNA, 13 nt, Salmonella enterica enterica serovar Typhi Ty2
guacuuuucaucc

SEQ ID NO: 1749147 - RNA, 21 nt, Salmonella enterica enterica serovar Typhi Ty2
guacuuuucauccacagcgcc

SEQ ID NO: 1749148 - RNA, 21 nt, Salmonella enterica enterica serovar Typhi Ty2
guacuuucuacaaauguuguc

SEQ ID NO: 1749149 - RNA, 13 nt, Salmonella enterica enterica serovar Typhi Ty2
guacuuucacuac

SEQ ID NO: 1749150 - RNA, 22 nt, Salmonella enterica enterica serovar Typhi Ty2
guacuuucacuaccacuuucuu

SEQ ID NO: 1749151 - RNA, 11 nt, Salmonella enterica enterica serovar Typhi Ty2
guacuuucaaa

SEQ ID NO: 1749152 - RNA, 20 nt, Salmonella enterica enterica serovar Typhi Ty2
guacugcccguggcggaggu

SEQ ID NO: 1749153 - RNA, 16 nt, Salmonella enterica enterica serovar Typhi Ty2
guacucuuccagcugc

SEQ ID NO: 1749154 - RNA, 16 nt, Salmonella enterica enterica serovar Typhi Ty2
guacgccugucgcaac

SEQ ID NO: 1749155 - RNA, 11 nt, Salmonella enterica enterica serovar Typhi Ty2
guacgccgcca

SEQ ID NO: 1749156 - RNA, 18 nt, Salmonella enterica enterica serovar Typhi Ty2
guacgccgccauccggca

SEQ ID NO: 1749157 - RNA, 16 nt, Salmonella enterica enterica serovar Typhi Ty2
guacgccuaaaugaac

SEQ ID NO: 1749158 - RNA, 22 nt, Salmonella enterica enterica serovar Typhi Ty2
guacgccuaaaugaacuuacac

SEQ ID NO: 1749159 - RNA, 21 nt, Salmonella enterica enterica serovar Typhi Ty2
guacgcccgugacgccaggca

SEQ ID NO: 1749160 - RNA, 12 nt, Salmonella enterica enterica serovar Typhi Ty2
guacgcccagcc

SEQ ID NO: 1749161 - RNA, 22 nt, Salmonella enterica enterica serovar Typhi Ty2
guacgccaaaucuguucugucc

SEQ ID NO: 1749162 - RNA, 17 nt, Salmonella enterica enterica serovar Typhi Ty2
guacacuucauccggcg

SEQ ID NO: 1749163 - RNA, 19 nt, Salmonella enterica enterica serovar Typhi Ty2
guacaccaguacaucuuca

SEQ ID NO: 1749164 - RNA, 12 nt, Salmonella enterica enterica serovar Typhi Ty2
guacagaugcug

SEQ ID NO: 1749165 - RNA, 16 nt, Salmonella enterica enterica serovar Typhi Ty2
guacauaacagcagca

SEQ ID NO: 1749166 - RNA, 17 nt, Salmonella enterica enterica serovar Typhi Ty2
guacauaacagcagcag

SEQ ID NO: 1749167 - RNA, 17 nt, Salmonella enterica enterica serovar Typhi Ty2
guacagccuaaaaaacc

SEQ ID NO: 1749168 - RNA, 20 nt, Salmonella enterica enterica serovar Typhi Ty2
guacagcuuaaucaccagcg

SEQ ID NO: 1749169 - RNA, 17 nt, Salmonella enterica enterica serovar Typhi Ty2
guaauuucauagaccgc

SEQ ID NO: 1749170 - RNA, 18 nt, Salmonella enterica enterica serovar Typhi Ty2
guaauuucgcuggcggcc

SEQ ID NO: 1749171 - RNA, 13 nt, Salmonella enterica enterica serovar Typhi Ty2
guaauuuauaaag

SEQ ID NO: 1749172 - RNA, 14 nt, Salmonella enterica enterica serovar Typhi Ty2
guaauuugcuuucu

SEQ ID NO: 1749173 - RNA, 17 nt, Salmonella enterica enterica serovar Typhi Ty2
guaauuuuucucccagc

SEQ ID NO: 1749174 - RNA, 15 nt, Salmonella enterica enterica serovar Typhi Ty2
guacaaacaaauaaa

SEQ ID NO: 1749175 - RNA, 17 nt, Salmonella enterica enterica serovar Typhi Ty2
guacacauaugggaaga

SEQ ID NO: 1749176 - RNA, 19 nt, Salmonella enterica enterica serovar Typhi Ty2
guacaagagccgccgccau

SEQ ID NO: 1749177 - RNA, 15 nt, Salmonella enterica enterica serovar Typhi Ty2
guacaauggcaggca

SEQ ID NO: 1749178 - RNA, 15 nt, Salmonella enterica enterica serovar Typhi Ty2
guaaugcgccaggca

SEQ ID NO: 1749179 - RNA, 19 nt, Salmonella enterica enterica serovar Typhi Ty2
guaaugcgccaggcagcac

SEQ ID NO: 1749180 - RNA, 19 nt, Salmonella enterica enterica serovar Typhi Ty2
guaaugagcacuuuccaca

SEQ ID NO: 1749181 - RNA, 17 nt, Salmonella enterica enterica serovar Typhi Ty2
guaaucuuccacccgcg

SEQ ID NO: 1749182 - RNA, 16 nt, Salmonella enterica enterica serovar Typhi Ty2
guaaucuuuucauauu

SEQ ID NO: 1749183 - RNA, 15 nt, Salmonella enterica enterica serovar Typhi Ty2
guaauucagcucgcu

SEQ ID NO: 1749184 - RNA, 16 nt, Salmonella enterica enterica serovar Typhi Ty2
guaauucucacagaau

SEQ ID NO: 1749185 - RNA, 19 nt, Salmonella enterica enterica serovar Typhi Ty2
guaauuaaggauugccgcc

SEQ ID NO: 1749186 - RNA, 14 nt, Salmonella enterica enterica serovar Typhi Ty2
guaauugacauggc

SEQ ID NO: 1749187 - RNA, 23 nt, Salmonella enterica enterica serovar Typhi Ty2
guaauugcgccguucacuucaaa

SEQ ID NO: 1749188 - RNA, 22 nt, Salmonella enterica enterica serovar Typhi Ty2
guaaaacgccaagaaugaaaca

SEQ ID NO: 1749189 - RNA, 12 nt, Salmonella enterica enterica serovar Typhi Ty2
guaaaacgcugg

SEQ ID NO: 1749190 - RNA, 13 nt, Salmonella enterica enterica serovar Typhi Ty2
guaauaauacuaa

SEQ ID NO: 1749191 - RNA, 22 nt, Salmonella enterica enterica serovar Typhi Ty2
guaaucacuaacugaccauaua

SEQ ID NO: 1749192 - RNA, 20 nt, Salmonella enterica enterica serovar Typhi Ty2
guaaucaucaccguuuucca

SEQ ID NO: 1749193 - RNA, 11 nt, Salmonella enterica enterica serovar Typhi Ty2
guaauacuucc

SEQ ID NO: 1749194 - RNA, 12 nt, Salmonella enterica enterica serovar Typhi Ty2
guggcaucauca

SEQ ID NO: 1749195 - RNA, 17 nt, Salmonella enterica enterica serovar Typhi Ty2
guggccugcagagcggc

SEQ ID NO: 1749196 - RNA, 12 nt, Salmonella enterica enterica serovar Typhi Ty2
guggccguggug

SEQ ID NO: 1749197 - RNA, 21 nt, Salmonella enterica enterica serovar Typhi Ty2
guggucgcggcucaccagcug

SEQ ID NO: 1749198 - RNA, 15 nt, Salmonella enterica enterica serovar Typhi Ty2
gugggcuaugcucca

SEQ ID NO: 1749199 - RNA, 16 nt, Salmonella enterica enterica serovar Typhi Ty2
gugggcggcaccagcg

SEQ ID NO: 1749200 - RNA, 14 nt, Salmonella enterica enterica serovar Typhi Ty2
gugggccguuccgc

SEQ ID NO: 1749201 - RNA, 22 nt, Salmonella enterica enterica serovar Typhi Ty2
gugcgccagccuuaucccaucc

SEQ ID NO: 1749202 - RNA, 19 nt, Salmonella enterica enterica serovar Typhi Ty2
gugcgauucagcgcaggca

SEQ ID NO: 1749203 - RNA, 13 nt, Salmonella enterica enterica serovar Typhi Ty2
guggaaucagcca

SEQ ID NO: 1749204 - RNA, 22 nt, Salmonella enterica enterica serovar Typhi Ty2
guggaacuuuaucgcgcggcga

SEQ ID NO: 1749205 - RNA, 19 nt, Salmonella enterica enterica serovar Typhi Ty2
guggaaaguaccaaaacag

SEQ ID NO: 1749206 - RNA, 22 nt, Salmonella enterica enterica serovar Typhi Ty2
guggagaggccaccagcgccag

SEQ ID NO: 1749207 - RNA, 22 nt, Salmonella enterica enterica serovar Typhi Ty2
guuaauggccugaugacgcugc

SEQ ID NO: 1749208 - RNA, 20 nt, Salmonella enterica enterica serovar Typhi Ty2
guuaaugcuguccugcaaaa

SEQ ID NO: 1749209 - RNA, 23 nt, Salmonella enterica enterica serovar Typhi Ty2
guuaauccuuagaauguuuuuua

SEQ ID NO: 1749210 - RNA, 14 nt, Salmonella enterica enterica serovar Typhi Ty2
guuaaucauuuucu

SEQ ID NO: 1749211 - RNA, 22 nt, Salmonella enterica enterica serovar Typhi Ty2
guuaaucauuuucuuugcagcu

SEQ ID NO: 1749212 - RNA, 15 nt, Salmonella enterica enterica serovar Typhi Ty2
guuaacagaaugcug

SEQ ID NO: 1749213 - RNA, 15 nt, Salmonella enterica enterica serovar Typhi Ty2
guuaaaaccggcugc

SEQ ID NO: 1749214 - RNA, 17 nt, Salmonella enterica enterica serovar Typhi Ty2
guuaaauucauauuuaa

SEQ ID NO: 1749215 - RNA, 23 nt, Salmonella enterica enterica serovar Typhi Ty2
guuaaaucgcgcaaauauuacaa

SEQ ID NO: 1749216 - RNA, 13 nt, Salmonella enterica enterica serovar Typhi Ty2
guuaaaucauaac

SEQ ID NO: 1749217 - RNA, 19 nt, Salmonella enterica enterica serovar Typhi Ty2
guguuuuuuaauauauuca

SEQ ID NO: 1749218 - RNA, 21 nt, Salmonella enterica enterica serovar Typhi Ty2
guuaaaaaucgcuauauugcu

SEQ ID NO: 1749219 - RNA, 16 nt, Salmonella enterica enterica serovar Typhi Ty2
gugugggcacucgaag

SEQ ID NO: 1749220 - RNA, 21 nt, Salmonella enterica enterica serovar Typhi Ty2
guguuauauucccgaaaggug

SEQ ID NO: 1749221 - RNA, 21 nt, Salmonella enterica enterica serovar Typhi Ty2
guguuauuuucaaaaacaagg

SEQ ID NO: 1749222 - RNA, 18 nt, Salmonella enterica enterica serovar Typhi Ty2
guguucaugcgcggcgga

SEQ ID NO: 1749223 - RNA, 15 nt, Salmonella enterica enterica serovar Typhi Ty2
guguucacaauugug

SEQ ID NO: 1749224 - RNA, 15 nt, Salmonella enterica enterica serovar Typhi Ty2
guguuccauugcugc

SEQ ID NO: 1749225 - RNA, 15 nt, Salmonella enterica enterica serovar Typhi Ty2
gugucgccauaaauc

SEQ ID NO: 1749226 - RNA, 20 nt, Salmonella enterica enterica serovar Typhi Ty2
gugucgccggggcgcuggcg

SEQ ID NO: 1749227 - RNA, 23 nt, Salmonella enterica enterica serovar Typhi Ty2
gugucgaugagcucguuauaagc

SEQ ID NO: 1749228 - RNA, 14 nt, Salmonella enterica enterica serovar Typhi Ty2
gugucguaguggca

SEQ ID NO: 1749229 - RNA, 18 nt, Salmonella enterica enterica serovar Typhi Ty2
guguccguaagcggcgga

SEQ ID NO: 1749230 - RNA, 17 nt, Salmonella enterica enterica serovar Typhi Ty2
gugucucgucgccaggg

SEQ ID NO: 1749231 - RNA, 19 nt, Salmonella enterica enterica serovar Typhi Ty2
guguagaauguaggccggg

SEQ ID NO: 1749232 - RNA, 15 nt, Salmonella enterica enterica serovar Typhi Ty2
guguagagauucugc

SEQ ID NO: 1749233 - RNA, 19 nt, Salmonella enterica enterica serovar Typhi Ty2
guguaggaaaggcagagaa

SEQ ID NO: 1749234 - RNA, 18 nt, Salmonella enterica enterica serovar Typhi Ty2
guguaucgcccugccagc

SEQ ID NO: 1749235 - RNA, 15 nt, Salmonella enterica enterica serovar Typhi Ty2
guguauaccaaaaau

SEQ ID NO: 1749236 - RNA, 19 nt, Salmonella enterica enterica serovar Typhi Ty2
gugucauaacgaccaaaca

SEQ ID NO: 1749237 - RNA, 19 nt, Salmonella enterica enterica serovar Typhi Ty2
gugucaucauuacaggcga

SEQ ID NO: 1749238 - RNA, 20 nt, Salmonella enterica enterica serovar Typhi Ty2
gugucagacaccgggcuauu

SEQ ID NO: 1749239 - RNA, 11 nt, Salmonella enterica enterica serovar Typhi Ty2
gugucaaagcg

SEQ ID NO: 1749240 - RNA, 11 nt, Salmonella enterica enterica serovar Typhi Ty2
guguauuuuuu

SEQ ID NO: 1749241 - RNA, 20 nt, Salmonella enterica enterica serovar Typhi Ty2
guucgaauccagguacccca

SEQ ID NO: 1749242 - RNA, 16 nt, Salmonella enterica enterica serovar Typhi Ty2
guuccuuuacuucuuu

SEQ ID NO: 1749243 - RNA, 22 nt, Salmonella enterica enterica serovar Typhi Ty2
guuccuuuacuucuuugcgauu

SEQ ID NO: 1749244 - RNA, 16 nt, Salmonella enterica enterica serovar Typhi Ty2
guuccggcagacggcu

SEQ ID NO: 1749245 - RNA, 21 nt, Salmonella enterica enterica serovar Typhi Ty2
guucgucccugcaacgccugc

SEQ ID NO: 1749246 - RNA, 16 nt, Salmonella enterica enterica serovar Typhi Ty2
guucggguuuuccugc

SEQ ID NO: 1749247 - RNA, 20 nt, Salmonella enterica enterica serovar Typhi Ty2
guucucgcgccaccugcacg

SEQ ID NO: 1749248 - RNA, 20 nt, Salmonella enterica enterica serovar Typhi Ty2
guucugcgccauuuccagcc

SEQ ID NO: 1749249 - RNA, 17 nt, Salmonella enterica enterica serovar Typhi Ty2
guucucgcucuuccagu

SEQ ID NO: 1749250 - RNA, 20 nt, Salmonella enterica enterica serovar Typhi Ty2
guucaccaccacccagugcc

SEQ ID NO: 1749251 - RNA, 22 nt, Salmonella enterica enterica serovar Typhi Ty2
guuccacgggaucguuuuaucu

SEQ ID NO: 1749252 - RNA, 21 nt, Salmonella enterica enterica serovar Typhi Ty2
guuccacgggaucguuuuauc

SEQ ID NO: 1749253 - RNA, 15 nt, Salmonella enterica enterica serovar Typhi Ty2
guucaugcacucgcg

SEQ ID NO: 1749254 - RNA, 15 nt, Salmonella enterica enterica serovar Typhi Ty2
guucaucucuucccg

SEQ ID NO: 1749255 - RNA, 22 nt, Salmonella enterica enterica serovar Typhi Ty2
guucaugccgacgauuugcgcu

SEQ ID NO: 1749256 - RNA, 22 nt, Salmonella enterica enterica serovar Typhi Ty2
guucaugcaauuccgcuuucuu

SEQ ID NO: 1749257 - RNA, 21 nt, Salmonella enterica enterica serovar Typhi Ty2
guucaucaggccugcaaaccu

SEQ ID NO: 1749258 - RNA, 17 nt, Salmonella enterica enterica serovar Typhi Ty2
guucaucauccugcagg

SEQ ID NO: 1749259 - RNA, 13 nt, Salmonella enterica enterica serovar Typhi Ty2
guucaucgguuuu

SEQ ID NO: 1749260 - RNA, 19 nt, Salmonella enterica enterica serovar Typhi Ty2
guucaugaaccacgccaac

SEQ ID NO: 1749261 - RNA, 22 nt, Salmonella enterica enterica serovar Typhi Ty2
guuccaggcgaaccauaauaaa

SEQ ID NO: 1749262 - RNA, 21 nt, Salmonella enterica enterica serovar Typhi Ty2
guuccagcagcucaucaauaa

SEQ ID NO: 1749263 - RNA, 20 nt, Salmonella enterica enterica serovar Typhi Ty2
guuccagauaauccagcguc

SEQ ID NO: 1749264 - RNA, 21 nt, Salmonella enterica enterica serovar Typhi Ty2
guuccagcagcgcaucauggu

SEQ ID NO: 1749265 - RNA, 17 nt, Salmonella enterica enterica serovar Typhi Ty2
guuccagaggcauuauu

SEQ ID NO: 1749266 - RNA, 16 nt, Salmonella enterica enterica serovar Typhi Ty2
guuccagccgccaggc

SEQ ID NO: 1749267 - RNA, 21 nt, Salmonella enterica enterica serovar Typhi Ty2
guuccagccguaacuaugcca

SEQ ID NO: 1749268 - RNA, 14 nt, Salmonella enterica enterica serovar Typhi Ty2
guuccagcgccacg

SEQ ID NO: 1749269 - RNA, 13 nt, Salmonella enterica enterica serovar Typhi Ty2
guuccgcuaccug

SEQ ID NO: 1749270 - RNA, 20 nt, Salmonella enterica enterica serovar Typhi Ty2
guuccgcuuuucuggcuuca

SEQ ID NO: 1749271 - RNA, 17 nt, Salmonella enterica enterica serovar Typhi Ty2
guuccgcgauuuccugu

SEQ ID NO: 1749272 - RNA, 13 nt, Salmonella enterica enterica serovar Typhi Ty2
guuaggaaagcag

SEQ ID NO: 1749273 - RNA, 20 nt, Salmonella enterica enterica serovar Typhi Ty2
guuaggcaagcugguaaaug

SEQ ID NO: 1749274 - RNA, 21 nt, Salmonella enterica enterica serovar Typhi Ty2
guuagggcgcggcugguaaga

SEQ ID NO: 1749275 - RNA, 16 nt, Salmonella enterica enterica serovar Typhi Ty2
guuaggguagaaaaag

SEQ ID NO: 1749276 - RNA, 19 nt, Salmonella enterica enterica serovar Typhi Ty2
guuaggguagaaaaaggua

SEQ ID NO: 1749277 - RNA, 22 nt, Salmonella enterica enterica serovar Typhi Ty2
guuagugacguuaucugucagc

SEQ ID NO: 1749278 - RNA, 14 nt, Salmonella enterica enterica serovar Typhi Ty2
guuacccgccaguc

SEQ ID NO: 1749279 - RNA, 23 nt, Salmonella enterica enterica serovar Typhi Ty2
guuaccccgaagcgcccaugaau

SEQ ID NO: 1749280 - RNA, 16 nt, Salmonella enterica enterica serovar Typhi Ty2
guuagcauuauuuuua

SEQ ID NO: 1749281 - RNA, 23 nt, Salmonella enterica enterica serovar Typhi Ty2
guuacccaugagcgaaacuccag

SEQ ID NO: 1749282 - RNA, 21 nt, Salmonella enterica enterica serovar Typhi Ty2
guuauagacgccggucaugcc

SEQ ID NO: 1749283 - RNA, 23 nt, Salmonella enterica enterica serovar Typhi Ty2
guuauaguuuuacgguuuauccc

SEQ ID NO: 1749284 - RNA, 21 nt, Salmonella enterica enterica serovar Typhi Ty2
guuauauauuuuucagcuucu

SEQ ID NO: 1749285 - RNA, 22 nt, Salmonella enterica enterica serovar Typhi Ty2
guuauaaauuuauuuuuugcug

SEQ ID NO: 1749286 - RNA, 22 nt, Salmonella enterica enterica serovar Typhi Ty2
guuauaaggccugccguccuga

SEQ ID NO: 1749287 - RNA, 14 nt, Salmonella enterica enterica serovar Typhi Ty2
guuauaugaauaaa

SEQ ID NO: 1749288 - RNA, 23 nt, Salmonella enterica enterica serovar Typhi Ty2
guuauaucuccccuucagaguga

SEQ ID NO: 1749289 - RNA, 15 nt, Salmonella enterica enterica serovar Typhi Ty2
guuauauuacuggcu

SEQ ID NO: 1749290 - RNA, 14 nt, Salmonella enterica enterica serovar Typhi Ty2
guuaucccugcuga

SEQ ID NO: 1749291 - RNA, 15 nt, Salmonella enterica enterica serovar Typhi Ty2
guuauuaaguuuuac

SEQ ID NO: 1749292 - RNA, 15 nt, Salmonella enterica enterica serovar Typhi Ty2
guuauguccuuccag

SEQ ID NO: 1749293 - RNA, 14 nt, Salmonella enterica enterica serovar Typhi Ty2
guuauucgcuggcc

SEQ ID NO: 1749294 - RNA, 15 nt, Salmonella enterica enterica serovar Typhi Ty2
guuauucauucaccc

SEQ ID NO: 1749295 - RNA, 14 nt, Salmonella enterica enterica serovar Typhi Ty2
guuaucucuauuga

SEQ ID NO: 1749296 - RNA, 14 nt, Salmonella enterica enterica serovar Typhi Ty2
guuaucucgccagg

SEQ ID NO: 1749297 - RNA, 20 nt, Salmonella enterica enterica serovar Typhi Ty2
guuaugccgacaguuuuacc

SEQ ID NO: 1749298 - RNA, 11 nt, Salmonella enterica enterica serovar Typhi Ty2
guuaugccauc

SEQ ID NO: 1749299 - RNA, 12 nt, Salmonella enterica enterica serovar Typhi Ty2
guuaugcaucug

SEQ ID NO: 1749300 - RNA, 15 nt, Salmonella enterica enterica serovar Typhi Ty2
guuauggcaggcgaa

SEQ ID NO: 1749301 - RNA, 20 nt, Salmonella enterica enterica serovar Typhi Ty2
guucaaaacgcuaacgcguu

SEQ ID NO: 1749302 - RNA, 17 nt, Salmonella enterica enterica serovar Typhi Ty2
guuauuuucaaaaacaa

SEQ ID NO: 1749303 - RNA, 18 nt, Salmonella enterica enterica serovar Typhi Ty2
guuauuugccucuggcca

SEQ ID NO: 1749304 - RNA, 20 nt, Salmonella enterica enterica serovar Typhi Ty2
guucaauucauagagcgcgu

SEQ ID NO: 1749305 - RNA, 23 nt, Salmonella enterica enterica serovar Typhi Ty2
guucaauacccuuuucuuuaaac

SEQ ID NO: 1749306 - RNA, 18 nt, Salmonella enterica enterica serovar Typhi Ty2
guucaauagagcgcagca

SEQ ID NO: 1749307 - RNA, 11 nt, Salmonella enterica enterica serovar Typhi Ty2
gugcagaacau

SEQ ID NO: 1749308 - RNA, 14 nt, Salmonella enterica enterica serovar Typhi Ty2
gugcagcgugccgg

SEQ ID NO: 1749309 - RNA, 20 nt, Salmonella enterica enterica serovar Typhi Ty2
gugauuuuugacccgcagca

SEQ ID NO: 1749310 - RNA, 21 nt, Salmonella enterica enterica serovar Typhi Ty2
gugcaaacgauaaaagcucug

SEQ ID NO: 1749311 - RNA, 18 nt, Salmonella enterica enterica serovar Typhi Ty2
gugcaaacgauaaaagcu

SEQ ID NO: 1749312 - RNA, 20 nt, Salmonella enterica enterica serovar Typhi Ty2
gugcaucaggaaauccugga

SEQ ID NO: 1749313 - RNA, 20 nt, Salmonella enterica enterica serovar Typhi Ty2
gugcauccggacgccagugc

SEQ ID NO: 1749314 - RNA, 20 nt, Salmonella enterica enterica serovar Typhi Ty2
gugcauccccugaaacaggu

SEQ ID NO: 1749315 - RNA, 14 nt, Salmonella enterica enterica serovar Typhi Ty2
gugcaucuggggga

SEQ ID NO: 1749316 - RNA, 13 nt, Salmonella enterica enterica serovar Typhi Ty2
gugcaggccggau

SEQ ID NO: 1749317 - RNA, 19 nt, Salmonella enterica enterica serovar Typhi Ty2
gugccggaaagacggcagc

SEQ ID NO: 1749318 - RNA, 19 nt, Salmonella enterica enterica serovar Typhi Ty2
gugccaguaacucaucgcc

SEQ ID NO: 1749319 - RNA, 12 nt, Salmonella enterica enterica serovar Typhi Ty2
gugccagguuuu

SEQ ID NO: 1749320 - RNA, 11 nt, Salmonella enterica enterica serovar Typhi Ty2
gugcauggugu

SEQ ID NO: 1749321 - RNA, 16 nt, Salmonella enterica enterica serovar Typhi Ty2
gugccaugaccauuca

SEQ ID NO: 1749322 - RNA, 21 nt, Salmonella enterica enterica serovar Typhi Ty2
gugccguuaaucgauaagcca

SEQ ID NO: 1749323 - RNA, 16 nt, Salmonella enterica enterica serovar Typhi Ty2
gugccguguaaggcaa

SEQ ID NO: 1749324 - RNA, 19 nt, Salmonella enterica enterica serovar Typhi Ty2
gugccgguaaagggcggga

SEQ ID NO: 1749325 - RNA, 19 nt, Salmonella enterica enterica serovar Typhi Ty2
gugccugacagcaaugagc

SEQ ID NO: 1749326 - RNA, 13 nt, Salmonella enterica enterica serovar Typhi Ty2
gugccugcuccgc

SEQ ID NO: 1749327 - RNA, 11 nt, Salmonella enterica enterica serovar Typhi Ty2
gugccugcugg

SEQ ID NO: 1749328 - RNA, 14 nt, Salmonella enterica enterica serovar Typhi Ty2
gugccugccgccuc

SEQ ID NO: 1749329 - RNA, 14 nt, Salmonella enterica enterica serovar Typhi Ty2
gugaccgauaaaaa

SEQ ID NO: 1749330 - RNA, 12 nt, Salmonella enterica enterica serovar Typhi Ty2
gugacccgccgc

SEQ ID NO: 1749331 - RNA, 16 nt, Salmonella enterica enterica serovar Typhi Ty2
gugacccgccgccagc

SEQ ID NO: 1749332 - RNA, 18 nt, Salmonella enterica enterica serovar Typhi Ty2
gugacccgccgccagcac

SEQ ID NO: 1749333 - RNA, 19 nt, Salmonella enterica enterica serovar Typhi Ty2
gugacccgccgccagcacc

SEQ ID NO: 1749334 - RNA, 14 nt, Salmonella enterica enterica serovar Typhi Ty2
gugaccugcugacu

SEQ ID NO: 1749335 - RNA, 12 nt, Salmonella enterica enterica serovar Typhi Ty2
gugaccugcuga

SEQ ID NO: 1749336 - RNA, 21 nt, Salmonella enterica enterica serovar Typhi Ty2
gugacggcaaaguuccagguu

SEQ ID NO: 1749337 - RNA, 19 nt, Salmonella enterica enterica serovar Typhi Ty2
gugacggaggucauuccug

SEQ ID NO: 1749338 - RNA, 23 nt, Salmonella enterica enterica serovar Typhi Ty2
gugacgucaagaucgcgcagcag

SEQ ID NO: 1749339 - RNA, 16 nt, Salmonella enterica enterica serovar Typhi Ty2
gugacgcaggccgggu

SEQ ID NO: 1749340 - RNA, 13 nt, Salmonella enterica enterica serovar Typhi Ty2
gugacuaaaagac

SEQ ID NO: 1749341 - RNA, 18 nt, Salmonella enterica enterica serovar Typhi Ty2
gugacuaauagccaaaag

SEQ ID NO: 1749342 - RNA, 15 nt, Salmonella enterica enterica serovar Typhi Ty2
gugacuuugcccuuu

SEQ ID NO: 1749343 - RNA, 19 nt, Salmonella enterica enterica serovar Typhi Ty2
gugauccaccaccagcauc

SEQ ID NO: 1749344 - RNA, 17 nt, Salmonella enterica enterica serovar Typhi Ty2
gugauccaccaccagca

SEQ ID NO: 1749345 - RNA, 18 nt, Salmonella enterica enterica serovar Typhi Ty2
gugauaaauacgcugcgg

SEQ ID NO: 1749346 - RNA, 15 nt, Salmonella enterica enterica serovar Typhi Ty2
gugagccuaaaacau

SEQ ID NO: 1749347 - RNA, 15 nt, Salmonella enterica enterica serovar Typhi Ty2
gugagcccuccucca

SEQ ID NO: 1749348 - RNA, 18 nt, Salmonella enterica enterica serovar Typhi Ty2
gugagccaaugaccauua

SEQ ID NO: 1749349 - RNA, 16 nt, Salmonella enterica enterica serovar Typhi Ty2
gugaggagcuuuagcu

SEQ ID NO: 1749350 - RNA, 15 nt, Salmonella enterica enterica serovar Typhi Ty2
gugagcucauccagc

SEQ ID NO: 1749351 - RNA, 21 nt, Salmonella enterica enterica serovar Typhi Ty2
gugaguccccaggagcauaga

SEQ ID NO: 1749352 - RNA, 21 nt, Salmonella enterica enterica serovar Typhi Ty2
gugaggcagauaugcgggcuc

SEQ ID NO: 1749353 - RNA, 22 nt, Salmonella enterica enterica serovar Typhi Ty2
gugagcuuugcacgcuguuucu

SEQ ID NO: 1749354 - RNA, 17 nt, Salmonella enterica enterica serovar Typhi Ty2
gugaaggcaaaacacca

SEQ ID NO: 1749355 - RNA, 18 nt, Salmonella enterica enterica serovar Typhi Ty2
gugaaggccaaguuuaga

SEQ ID NO: 1749356 - RNA, 14 nt, Salmonella enterica enterica serovar Typhi Ty2
gugaagccaucaaa

SEQ ID NO: 1749357 - RNA, 18 nt, Salmonella enterica enterica serovar Typhi Ty2
gugaauaugaucugcaca

SEQ ID NO: 1749358 - RNA, 17 nt, Salmonella enterica enterica serovar Typhi Ty2
gugaauagguauguagu

SEQ ID NO: 1749359 - RNA, 16 nt, Salmonella enterica enterica serovar Typhi Ty2
gugaauaccaaagccc

SEQ ID NO: 1749360 - RNA, 20 nt, Salmonella enterica enterica serovar Typhi Ty2
gugaauuaugaccaauguua

SEQ ID NO: 1749361 - RNA, 21 nt, Salmonella enterica enterica serovar Typhi Ty2
gugaaauaaacguaccgauga

SEQ ID NO: 1749362 - RNA, 16 nt, Salmonella enterica enterica serovar Typhi Ty2
gugaagaaucccccau

SEQ ID NO: 1749363 - RNA, 19 nt, Salmonella enterica enterica serovar Typhi Ty2
gugaagaaucuguauaaaa

SEQ ID NO: 1749364 - RNA, 17 nt, Salmonella enterica enterica serovar Typhi Ty2
gugaacgguugagcuuu

SEQ ID NO: 1749365 - RNA, 21 nt, Salmonella enterica enterica serovar Typhi Ty2
gugaacauggguuucuugccg

SEQ ID NO: 1749366 - RNA, 21 nt, Salmonella enterica enterica serovar Typhi Ty2
gugaaccagcaucccacgaau

SEQ ID NO: 1749367 - RNA, 14 nt, Salmonella enterica enterica serovar Typhi Ty2
gugaaccgguaaag

SEQ ID NO: 1749368 - RNA, 15 nt, Salmonella enterica enterica serovar Typhi Ty2
gucuuucuucgcugc

SEQ ID NO: 1749369 - RNA, 18 nt, Salmonella enterica enterica serovar Typhi Ty2
gucuuuauucaucaucuu

SEQ ID NO: 1749370 - RNA, 17 nt, Salmonella enterica enterica serovar Typhi Ty2
gugaaaccggcgcgccu

SEQ ID NO: 1749371 - RNA, 17 nt, Salmonella enterica enterica serovar Typhi Ty2
gugaaaagggaugcuga

SEQ ID NO: 1749372 - RNA, 22 nt, Salmonella enterica enterica serovar Typhi Ty2
gugaaaaaauaucgcugcccag

SEQ ID NO: 1749373 - RNA, 14 nt, Salmonella enterica enterica serovar Typhi Ty2
gucuuuuucaucuu

SEQ ID NO: 1749374 - RNA, 21 nt, Salmonella enterica enterica serovar Typhi Ty2
gugaaaaacgggagauuguua

SEQ ID NO: 1749375 - RNA, 13 nt, Salmonella enterica enterica serovar Typhi Ty2
gucuuuucugucg

SEQ ID NO: 1749376 - RNA, 15 nt, Salmonella enterica enterica serovar Typhi Ty2
gucuuccgacacuga

SEQ ID NO: 1749377 - RNA, 21 nt, Salmonella enterica enterica serovar Typhi Ty2
gucuucgcacugcccuucccg

SEQ ID NO: 1749378 - RNA, 18 nt, Salmonella enterica enterica serovar Typhi Ty2
gucuucuuaguaacauaa

SEQ ID NO: 1749379 - RNA, 14 nt, Salmonella enterica enterica serovar Typhi Ty2
gucuugucaggcuc

SEQ ID NO: 1749380 - RNA, 17 nt, Salmonella enterica enterica serovar Typhi Ty2
gucuuaaagaaaaagaa

SEQ ID NO: 1749381 - RNA, 18 nt, Salmonella enterica enterica serovar Typhi Ty2
gucuuaaccuuuuguauc

SEQ ID NO: 1749382 - RNA, 17 nt, Salmonella enterica enterica serovar Typhi Ty2
gucuuaaaugccgccgg

SEQ ID NO: 1749383 - RNA, 14 nt, Salmonella enterica enterica serovar Typhi Ty2
gucuguguugaaua

SEQ ID NO: 1749384 - RNA, 20 nt, Salmonella enterica enterica serovar Typhi Ty2
gucugucggacucaggguga

SEQ ID NO: 1749385 - RNA, 21 nt, Salmonella enterica enterica serovar Typhi Ty2
gucuuccagcauucuauuguu

SEQ ID NO: 1749386 - RNA, 12 nt, Salmonella enterica enterica serovar Typhi Ty2
gucuucaucuau

SEQ ID NO: 1749387 - RNA, 19 nt, Salmonella enterica enterica serovar Typhi Ty2
gucuucaucagccagcauc

SEQ ID NO: 1749388 - RNA, 20 nt, Salmonella enterica enterica serovar Typhi Ty2
gucuucaucagccagcaucg

SEQ ID NO: 1749389 - RNA, 18 nt, Salmonella enterica enterica serovar Typhi Ty2
gucuucaggucauucagg

SEQ ID NO: 1749390 - RNA, 16 nt, Salmonella enterica enterica serovar Typhi Ty2
gucuucaucagccagc

SEQ ID NO: 1749391 - RNA, 16 nt, Salmonella enterica enterica serovar Typhi Ty2
gucuucacucaccaca

SEQ ID NO: 1749392 - RNA, 21 nt, Salmonella enterica enterica serovar Typhi Ty2
gucuucaacguuccuucagga

SEQ ID NO: 1749393 - RNA, 19 nt, Salmonella enterica enterica serovar Typhi Ty2
gucuucaacguuccuucag

SEQ ID NO: 1749394 - RNA, 23 nt, Salmonella enterica enterica serovar Typhi Ty2
gucuucacucugggauuugcgaa

SEQ ID NO: 1749395 - RNA, 17 nt, Salmonella enterica enterica serovar Typhi Ty2
gucuuauuucuccugcg

SEQ ID NO: 1749396 - RNA, 14 nt, Salmonella enterica enterica serovar Typhi Ty2
gucuuauuauuauu

SEQ ID NO: 1749397 - RNA, 19 nt, Salmonella enterica enterica serovar Typhi Ty2
gucuuauccggccuccaaa

SEQ ID NO: 1749398 - RNA, 20 nt, Salmonella enterica enterica serovar Typhi Ty2
gucuggcgugccgggcuggc
